United States Patent 7,468,248 (METHODS AND SYSTEMS FOR INFERRING BOVINE TRAITS) - sequence listing, part 3

SEQ ID NO: 21880 - DNA, 598 bp, Bovine  MMBT15078
  misc_feature (1)..(161): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccagaggtctcttacctactgtaagagaaagttggatgatcacttttcctttcctgacaaaaattggaggctgttcgagtgattatctgccatctgttgtctacagcagttcaattgctgaagagtcctctagaagkggggagaaagagctcattcttgacggaaggttgaatgtacattcagaggtagattcagctgagcaagtgcccggctaatcccctttgcacacagggacaaggctgccaccaactctaattgattctgaaatgaatctgtatagaaaattagaaggttttggattcccatgtgagcttcaataaagagccaggatgtaagcctgacagctgaatggattcagaaatgaaaatctgataagcggcttaaaactgtacttaagtccagaaatgatttgaatgctgttgttaatggcacatt

SEQ ID NO: 21881 - DNA, 584 bp, Bovine  MMBT15962
agatgaaggaaaacaagctgggcccttaaacttatctcactggtacttgtgaatatatacgaataaatatgggtatgtatttctgggcatgaaggaacaatggccagaactaaaacagcgcaaacctgagtactaaaatcaggcttggagaaatgtctgctcaactatgcagagcatttcatcagggttcaccagagcttttccacctcagtaatctattactctgtattcctagaatgagaacagggctcaacaggtagattagtaatctaatgttacatgttattaaggatcacaackaatttttaagcaatacctttgataaaactggtttcacattcagaaaaatttccacatgttcagtttactttcaaaaaattgaaactgcctttcataattctttgaaatatgcattttatgtcactgcaagatcacattaaactgcagtgaaataaaaaacctttaggtgaataaaaagctctgggggaaaatcagttaaatttcataggctacaaatatgaaccataaaaacaacatgctcctttatttttactttttactgtcagtagaagaaatgcagcagt

SEQ ID NO: 21882 - DNA, 600 bp, Bovine  MMBT00793
tcaatctttctttgtatatatacaagcatgtatgcatgcacacacaaattttcttccctgttggcttggcaatagttgtcatgaagttgatgttggaaaaaaaaaaaagaacatccgcttaaaagacccactccatacttaagagctgcatttcaaatgctatacaagacttggcacaagttaaaacagcaaaaaacctttaattttagtcagcgacatgactgtaccttctataaggagtcttagttaccatagctgctgtcctctacttaataagatctctaccaagcctcctagaayatttcagaaacaaaaaacttgctaaaaccaaaaacttgatggtgtattccttccctgctcagtgagtcacggatttgacctcctccaagatcaygtatgcaacggaatwttgaatcacgaatccaaagattaatgaatcaaacactgcttaagggcaacgtatgcgtccgaactcctccctacctcttctctaacatgttagatccagctggcagtctagacagcacggaaaaggctgtgtgtacttagagaaatgaggtatcactgatccacgaccacatctatcagtgccaccatggc

SEQ ID NO: 21883 - DNA, 600 bp, Bovine  MMBT14076
gtgtggggctgttggaaagaattctaagaggtcagacacagagggctcactgctcttcctgggatgtttgagagaggccttaaattaagtaaataaagaagctaatggtaaaactgtttgatttaatacataacagtgagtccttttaaaatgctgattggagaaagcacataatatagcagttttaggagagtttatcgtttgaggttctggtatagagatttgactcacaagcataaatcccagtatgtaatgagccatgtaataatagggttctgctgttaattatggtgagtactstcaacgaaatcgaattttcttagtaccacccccgaaaaaatatcctaactcagactttatataacagtcccagatacactgtaaactttgtagatatgggatattgaccgaaaaaagagagaaaacaaatcttcagtatttccagaaaatcttactcatcctcagtgcaccgtgttgtctgtgggagcctatagggatgggcagttaccttttcaggtctctgggcgccgccaaattctaaagattaatatgtgatatttcttatggacatttgaaccttaggtatagttcctggtttgc

SEQ ID NO: 21884 - DNA, 477 bp, Bovine  MMBT18483
tccgggcccatcccctgccactatttttagtggtgatctggaggaaggaggactttcctggacttgccttcagagtctggaaaacaaacaccaccccctccccaccctcrccctcccagttcccctggcaggaagcgggagcccggattcccgggcctgccactcaccctccrtgcttctgcttgagctctgagctcttcagagctgagggacgggcggcagcaacagtgtgcccctgccctcaggtaggacctcagacagcctgcracaggtcccctctgccccctacagtatctcttyttattacactgtctgcgggtgtctgatcccctcctgagggttggccttgccctccgtctcaagtgtttcccagggccccaggacttccctgatggtccagtggttaagactccgctttccaatgcatggggtgagggttcaatctctcattagggaataacgtcccacatgctgtgg

SEQ ID NO: 21885 - DNA, 600 bp, Bovine  MMBT11195
ctttaatttttgtttgtctaaggagttttttccctccaacttgatccacgagatactactctgtgcaaaatgtaattaggctaatttttatatctatttagtattttttctgggataacttgtttgtcacttaatggaatagaaatttaatcatttatttttatctgtagaaaaccaggctaagttagtgatgaagatgtctatgttagaaagcaagagctcaagtaggatcttagtctgtaagaatatttgataatgctacaaatagccagtgctaactttgtattctgggggaaaagrttttaatttggaaggacaaatatgaaagttgtgagctcggataaagtcatcttgataattaataggtatgtgtatatccacaggggctcttatatttaaaactgaatagagtgtgtttgtgagacagtgtatgtatacgtgtgaatgtgtgcacattgcaagaaatccaaagagagattacatgaatctgggaaaaatctttgaaaaagagattttggatgcagatcctgtggtatgtatatgttttaggagaacaaatgcagatgatctatgatgttgtgacaacttgagtgggtgttc

SEQ ID NO: 21886 - DNA, 600 bp, Bovine  MMBT12357
aaaaactcatcttcaccaaaagatacagatgttttccagaaaatctttttatacctagtcatyaaccataaaggttactcatttatctcaattctcctttccaaacttgcataactcacaaaaggagttactttactctcctgcctacagctgttatatctaaagcctaaaatagaccagcatgtaacartctgtaagtagatactggtagaagaaagggagaggggaagtgagggagggaggaatgggagacaaaaatgtcaaaagaaagacttcagaaaaacaagttggaagctacayaaactacaaataaatccctagtttgactgaatataattttggaarccaactgacagcaaagtgaaacacactgaatccttgaattttcatcatttatgaattccagaaatataattctcaaaagcaatggaagaaagcctcatggaagarcagaagaagaacaactacaagaggaaaagaaaacaggaagaaggaaagttagcgggaagacactgaatgagacgcgacaaccaaccaaccggaggtgggayaggrtcaagagctgcagtcacagaaagggtcacctgctcacagcaaaga

SEQ ID NO: 21887 - DNA, 600 bp, Bovine  MMBT04906
gaaaactttcaccattatttcttcaaatattctttcttcctctttccctcttttccttctgggactcccatggtgggtgttgctctacttgacttccaaaataattgcatcagacagatttttccagtgggattgttatttaggtggggagatgaattcctgatacttcttactccaccatcttcccagaatctcctccagctgccattttgaacacatatgttgtaaccggctacatgcattttcagaaatctaattcaaatttgcataaaatttgtcaatcctaatgacccattgctwcctgaggagagcaaatgaggtgacctaaaagtatgcgtttttaaaatatttgtaaaataactaaggtatcttctttatttctcacattctttcaagaagcctgtgaatttagaaaatgcagaagtagctatggtataagattccttttgatttcttgtggtcatctctaccttttcagcttgtattgttgggatggggagagactaagagatttcttcaaaggataaggacatttcctacaaaagagaccggtaaggagaacttctgtgatgtaagtttttagtacatcaagaatagaaa

SEQ ID NO: 21888 - DNA, 600 bp, Bovine  MMBT06863
aaagattgaaggcaagagaagaaaggggtaacagaggatgagatggttggatagcatcaccgactcaatggacatgagtttgagcamactgggaaatggtgaaggacagggaggcctggtgtgctgcaggtcagagtcagccaggcctgggcgactgacacgggctcccmgcacacgggarctgttcctgtgytagtgtcattactagggatagactgtggtgtgcgccaggccaggaaccgctatagaaatactgctcttgcctccgacactcggtgatgtttgttcttagcactggcrtctcatcgacagtgttatagatgggtgaaacaacggggccattgtccatagtgaggtcacatgagatcaactgtaaaaacaggagtttcagaatttttatcaagtctcgggaagaaggggaaacagctgcaggaagggaggaaagcctgagaaaaggagaagacagggtcttttgcaaaatactttgtcgcaagaggccacaagctatgtctctgactgagatttacccagctccaaacctagagggcatacagaagcagctgctttgatcagataacacaagaaaagcacatgagtata

SEQ ID NO: 21889 - DNA, 601 bp, Bovine  MMBT04580
  misc_feature (1)..(1): n is any nucleotide
ntgtgcctctcaccatcagtttgggggctttcaagatgcacaggtgagccatcactgcaaggaagttatgtctggtccctcccacctccggaaaggctccgaaatgtaagaaatctatagtctgattactttgggaccaggatttttttttcattttcattttgatgwattgcttaatattagacctgggagacttcgagaggtgatttcgttgcccgggacctttggggcttctatctggggagtgaaaagcgtgtgtgtggctgcttactgcccaggggcctttagatgccaactgaakttgtcgcacttggaaggggataaagccctggaacatctctccctaggatattccgctgtccccactggcagaaatgatgatcctatggcctaaaacaaagtcttatttagaaagaaatccagctacagcgtatggtcatgtgaccagcagtgtccccccgggggaaagatgctcatcagggactgtcttagttggttcaggctgctgtaccaaaagtaccttagaccaggtggctcagaaacagcagacacttctttatcatagttctgcaggcttgtccaagatcaaggagccgtcatg

SEQ ID NO: 21890 - DNA, 600 bp, Bovine  MMBT07006
ggtaagaatgattttagaattgtattcattggctttttttttttttaatttatggtgtctgtggcttgcccatttttttagtctttattttccccctctttgcatgacttcagtgacattgtgtgatttataattctttctgcattttcgtctagttgctgccattgtgttgatttggaattggagacatgcaataccatgggtgatcatgttattccattcaaacgatccaaaccatctcagtcgtgtaacacactcagtgaaatggtgtcagcaatgtaaacacaagcccacacccaytggrtcaccgttagttcctccacatgcttacaacatagaaaaatacrtcrgaccracacttccttttaatatgcccctaatttgggggtggggggagatatgtatcttctggtgatattctgatttatgcaaaggaatgagcaatctaaaggaatccctagattcgaaatggagacctgtttctgatgcagaggactgtaggcccctgtccttttctcccacarcccatgctaactcatctgagagaggccagggtcattgttccagccagtggggctgtatatattggagttcacaccg

SEQ ID NO: 21891 - DNA, 600 bp, Bovine  MMBT16364
actaaggttatctgattaacttctacaccttggtacaatccatataatatggtgaaattgaagtgaattattgaatagttaagtgaataatgcatttacctctgaaatcaaaccttcaaagacttctgttcaaattttgcaattctaatttcttccagaaataccatttccttacgacatatttatgacaaaacatgaaaattttaagctgaggaataacaaatttgttttcctaagataattaatattaaaaaagaaaaaaataacaaatttcaatttaccttgtgcctgctaaagaarttagaagatatgaagtggtcatcattcaaacacaaaggtgaagaattaaatacaatacaagaaataaagttacttaaattttcttccttaaatcagattattttcttctaaaaagtttctgagatcataccaatcaatttgtcatgttttctctaaagactaatcattcagactttatcttttactcacacacttagaaatgccattcacctcaaaatgatacattaacatatttttcaaagacatattcmcagatatgcataatgtgacttattagcataatccacctgcttataacat

SEQ ID NO: 21892 - DNA, 600 bp, Bovine  MMBT13334
ataacagtacatcccattttaaggaatccccaaaggtgtccagagagagatcagtgagtctgccttgacaatttctttgttcaaagcacaccttaaactatactgggcacacactgagattgctttcagcttttcagtagcgctacagctgatttccagtcgttacagacttgggagtttttcgtgatccctgtaaaaatagttcatcgttgccaatcatttccttgtcataaacaggtcttgccgattggtttaaaatgtaatatagggcttccctggtggctcagtagtaaaaaaaamatccacttgccagtgcagggaacgctcactggcccttgatcratcctgatccgggaagatcccacgtgccgyagagcaactaagcccccgtgccacagctgttgagcctgtgctctggagcccaggaaccacaactactgagcccacaagtcgaaagcactggagcccacgcaccctgyaggccatgctacgcaacaggagaagcctccgcaatgagaagcccctgcaccgcaactagagcgtagcccgctcggccgcacctagagagacgcccgtgcagcagtgaggacagcggacagc

SEQ ID NO: 21893 - DNA, 600 bp, Bovine  MMBT06860
gcacgtggcacaatgagatgaaggactggtaacttctaaagcacgtggacgataccaaaaggagacagtgcttgcagtctgagcacagccaccacagtgatgagggcacagttacctctgacagtcacaggaaaacaggaagtgtcccaaaaattggggccaagggaagaaggataggatgagtgatgggcaccaggagaaaaacatgaaatgcttaaaaacaaactgtctagtgcctactttggcagagggctggccctgatgtgaagggtggctcaaaaggaaatgactgcccgacayaggagtaaagaataccaattattttcctcttaagtagggccagaccaactcagcagaaaaccagaggatgggcactgctttcctggaaggaagctgatggtgctgatgccatcggctgggttgactaaggagacatgatccaggagccacccagctgaaggctggtataccacagacagacatgcttctaagacctgcggcaattaggaattcaaggttagccccaacttttcagatgaagccttctaattttccttttccctcccccgagcttcttccaggaaacctgccttgtcctct

SEQ ID NO: 21894 - DNA, 600 bp, Bovine  MMBT05415
ttgcatacaggataatctggagaggagacaggcaattttacagctctgtaaaagtgcctttgaaagtcaaaacatttttaagtctttgtagagctaaactgaagaactcccaacaaaacattttctttctttcctctcaaaggaatgctgacatggcaagaaaaatagtttcaccatgtgtttgtactttcttttataaggagtataaaagaattgctatactcttttaatctgagcagctcagtctacagaaactttaacttctatctagaaattttactgtgggaagctttcctctcracatgcatactagatattttttcttgatgccttaataattcatctccagtttggtgatttttatcttaacatggagaaattgatgagggctccctgcctaygaattcaaataactaaaagttgaaagctaaaatctttaagattagaggaactatggttatttagtgaagactagagaataacttaaaastttcccctcagtggacatagttgtatcttattacatagcttttaatctcttactaaggataagcaagaataaacacatttgttttgaaatatggtttcaaggggagccca

SEQ ID NO: 21895 - DNA, 600 bp, Bovine  MMBT12921
aagaactcccaacaaaacattttctttctttcctctcaaaggaatgctgacatggcaagaaaaatagtttcaccatgtgtttgtactttcttttataaggagtataaaagaattgctatactcttttaatctgagcagctcagtctacagaaactttaacttctatctagaaattttactgtgggaagctttcctctcracatgcatactagatattttttcttgatgccttaataattcatctccagtttggtgatttttatcttaacatggagaaattgatgagggctccctgcctaygaattcaaataactaaaagttgaaagctaaaatctttaagattagaggaactatggttatttagtgaagactagagaataacttaaaastttcccctcagtggacatagttgtatcttattacatagcttttaatctcttactaaggataagcaagaataaacacatttgttttgaaatatggtttcaaggggagcccagaaagaattttttatacagtggagcagrtattaaggaacgtgatagactttcctagaagagttttgctaaggttatggaggtccactttgagtttaggcaa

SEQ ID NO: 21896 - DNA, 598 bp, Bovine  MMBT20689
  misc_feature (1)..(78): n is any nucleotide
nnnnnnnnnnnnnnnnnnnnnnnnnnnnnnnnnnnnnnnnnnnnnnnnnnnnnnnnnnnnnnnnnnnnnnnnnnnnnntctgtggtcactgtttatatttccagtgcaactcatttttatcttattaccctttggcaggtggtccattttcacctcatttttgaaactaattgaattgtgttcactgaattagtaagaggacaccatattacaatcaaaacatacaaaatcattttatccagttaaactatcaatagattattataattatacaaacactcctgctgatctaaatttttrtttcatagctggaagtatttaacccaatatcagtgcatcactttaactgggcaaattcttatactcagtaatctgttttgaccattctcattcctattcttctttcatcccttctaccatgtttcatttgactagggctaaattaacatgatttattgctattcaagtagaaattttacatcacctctgtagacagagcagctgaggtcctgcatataaaacagacaactggcttacatgtaaggttaaagtaatgaaatatggatcacaagtagtaatagctatatatgtgtgagaa

SEQ ID NO: 21897 - DNA, 600 bp, Bovine  MMBT09376
attttcaccttcataaagatgtagggatcaaatgggttggcatttatgaatgcccctagcaaagggccagttagtggcacccaatggcaaagggctcaccttgacttactttgaaaagtttggattttggcaaactaggaagacaagataccaaaaaagggggraaaaagcacaatccagcttccaattcagaccttctcagccgtttaaastaaacagctctcatgagtaattaccagagggaatgtgaacgggccatggagaccctagtcaggagggaatgaacaaaaaatctccaaratacaaaaagctgagaagccrtggtgatcaaagacaattttaaagacataggactcaaggtaaaactagtttaaaaggactgctttgtcagctccagcatatcttcaactggatgttgacaattacacagcttttttcattctagcataaaatttcaggcaattaaataaatgaattactgtgttggccacatccatctctgaagcccgtattcccttggggcagctcagacagtcctagaatttttgacataygcagtgaattgctcaaaaaaaattttttttwaaatgaagtattaat

SEQ ID NO: 21898 - DNA, 600 bp, Bovine  MMBT16830
aatttggaagctttattattagcttaggccattttcaactctcacgtgaataagagatggagaaaagttattagaatctatttttttttwaaactactgctcttaggagtgacgtcaaactaaacacaaaggtaggtactgagacaaaggtgtcggggctctttctttctgagtggtaaaatgacgtgggtctccctcatctttaccaaggcaggcaggcttcaatatgactcaaaataaatgttgatataggtataaaacttgaagtatttgacactcaggtaacaggaatcctttggkgttaaggagtaaaaaactattctgacaagtgaaaatggagcattggttggaattctaaggggatagttcacagaatccaaggataggaggtagaaccagaaacagatgttacggaaaccacacaactgctaacatctctgatttctaaatgtgcactgggctccttttgctttctccatagggcagctgttttctggaatatatctacacacagcagccatgtcgccgccgtgttaccgagtttactaggtccttcagttcaagggagcagaaagaccacctactgtttctttgtctttt

SEQ ID NO: 21899 - DNA, 600 bp, Bovine  MMBT09945
aacactgtcctctcaaaggatcctcaaaaagcaagcaatctagaacacaatcgccaagatttacgagtcgcaggaagtatgctagggacttcaaaataaaataaattctactgcttattttggctgtgtatttatattcttttcagactccagacagatggttccccagtaagaaaaatttcctcctggattcatctctggacagtcactctagccggctcccctgggccacctggggctggaatgtactgagactatggaaactaatatctaaattaggtgcaaacaaatttaacctasagggaactcaactttatagtaatgatatttagcattttcagtattaagggtttttctggtgagtgagacagtgaagaatctgcctgcaatgcaggagacctgggttcaatatctgggttgggaagatcccctggaggaaggcatggcaacccactccagtattcctgcctggagaattccatggacagaggagcctggcaggctacagtacatggagtcacaaagagttggatatgactgagtgactaacgctttcacactttcattttccaagctccccaaaaataatgctcagagaat

SEQ ID NO: 21900 - DNA, 600 bp, Bovine  MMBT12882
ggcctgggtttggggcttcctaagatcttatttagctacatgtgcactgtgacattaggacttctttctaagaacaacttactttcttgtcctttcctctgaagtatgaacctgattaatcacagaagcttacatggtgttttattgaaaactcctttcaagatggatacaacttggaaagtttatcatgaaactggagaattatattcacaatctggagaatgtcaacccctctcagtaaaaaagtgaaagtcgctcagccctcctctgtccatgggattctctagacaagaatgtggragggratagccattcctccctccaggggatcttccagacccaggaatcaaacstgggtctcctgcattgcaggcagaatcttaaccatctgaaccaccagcaaaagcctgccctaaaagctccccaggtctgactcaactcccaggaaggacagcacaaagaaaggaaatcaaacctcccgttgatgaacagggggtggaagggyggtcctccagtttcagtggccactgctatcaccctgctcagaggagagcactgcgcaatgggtacgtcttgtttataaatgataatcggtggctt

SEQ ID NO: 21901 - DNA, 600 bp, Bovine  MMBT11101
gaacaaacttaatgagatrggcaatctggtcctctctttgtaaaaagtagtgggaaagtcagaggaattgtttatgaaaatgctatatgaaaatattcctttagctaaccctgcaggggaaatcatagtgcaatacataaaagtatcaaatcaatgcagttgtgcacctcacatttacacaacaatatgtgttgattacattccagtaaaaaaactgaaaaagaaaagaaaagaaaaccttccaaacactggttgagaggccatctcagactggggcaagggtctaagtaaaagcagtaytgaacaggtggcccattagaaaatcctttacttatgatcaaagctactaggtaactaagataaatattagatgtttggcgtggctagataagacactgamgatgcatgtataactgaaaaattgaggagcaataattgatgcttgttgtatctgaaaagcagatcagtttgggtccaactgtaccgctggcttcagtatttggaggtaaaacccctttactagaatagaagaatatattcacagcagtgctcaaaaacaaagattatacacaccaaatagatggaaatgactcaaaaatt

SEQ ID NO: 21902 - DNA, 598 bp, Bovine  MMBT22618
  misc_feature (1)..(129): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagaagtgaaaaggaaaggagaaaggaaaaatatacccaaatgaatgtagagttcaagagaatagmaaggagggataaaaatacttttttttttwaaattaacaaagcaaaaaatagaggaaaacaatagaatgcaaaaaactagagatctcatcaagaaaattggagmtatcaagggaatatttcatgacaggatggggcaataaaggacagaatctaacagaagcagaaaagtttaaaaagaggtgtcaaggatacacagatgaagcatacaaaaagtcttattgacctagacaaccacgatgttgtggtcactcacctagagacagacrtattagagtgtgatatcatgtggaccttaagcatctttactacaaagctagtggaggtgatggaattctagctgagccaytgaaaatcccaaaagatgatgccgtgaaagtgctgcacacaatatgtccatatat

SEQ ID NO: 21903 - DNA, 598 bp, Bovine  MMBT00644
  misc_feature (1)..(13): n is any nucleotide
nnnnnnnnnnnnnatctgctttccctaaattactatgctttcaccaaccaagccatatatcttctaacattttattttaaaatatcttgtattattccctcatggccagttcagcttaagtgaacagtaaacttctataggtaagggactcagaaaaacttgggtactaactctagctctggatgtactggccatgtaccttttgtttcttcatcagtaaaatggaataatgccacctattatggcagatctggaagttaaattagagaataatacatataaaacagctagcacagtgaytggcactgagcaaacatttagtaggcttttttctgtcacccctcctctttcacttcctattgaagccagaatttcagaaaagagaggaattatccaaaaggaattccttatgtctctgtttctctttccttgactatttagactgaaggaatacctcatttatctagttctaaaggtaaggcaatttctggcagatattcatctccttttggcttattgaagaagcacacttcaggaagcctggggaggctcccacagggacttgctaaaattttctgaacatgttcaggcattagat

SEQ ID NO: 21904 - DNA, 600 bp, Bovine  MMBT02749
tcctttttcttataattctttggaggagggaaaagcccccatttctgataactcagtaactggcagtgagtagaaatcttttaaagtcataattggtaatgaattagtttcataaaactttccctttgaagaaataaaaatccagtttctacaaaatgttgtatctgtgtatacagagagtacctcactagatagaagtgagggggtgtttttcttatttttaaatttctgccactcctcttgttcttccctttctcagtttcttctttgacttgagacaggcacccagagggaacttgsggccagctaaaagcattgcagcactctggtctgattgccccaagggtggygaggcacccagcaggtaccctccagcatttccaaagtgcctccatccccattcctttggaccctgacacacgtgtcatttgcacatcttattctggtctccactgacctcctgattttttattcttgtctttctgcctcctttggtttctctctggctatttggtcttttagagatattgaaagtcaattaggattttccaagtctacactgtgaatgaaagaattaccgggtattgagtatgaccttga

SEQ ID NO: 21905 - DNA, 600 bp, Bovine  MMBT04096
aacccatagttctccagggtttgcaatcacaccatatcaaactagaaaatgagtgcaagaatgttgttttcttagtggagaaatttcactataaattctcatggcatctgagatctccaaagatggagtccaatattaattgatatagtgactacagtcagccctccatatgcttgggttccatatccacaaaaatcgatcctcggttggttgaattcatgaatgcagaaaccatggataaaaaggactgactttacaacttcattttatgtaagacacttgagctttcacagactttgktatctgtggtaattcctagcacaaatccctcatggattccaawgtgttagtctcttgatcttgtccagctgtttgtgatcccatggactatagcccaccaggctcctctgtccatggaattctccagcaagaatactggagtggatagccatttcctcctccaggggatcttcccgaaccagggattgaatccgcgtctcctgcattgcaggcagactctttaccatctgagccaccctccaaggatgactgtatttctcctgcagagtcacttaagaggttaagaatttaccatagtcc

SEQ ID NO: 21906 - DNA, 600 bp, Bovine  MMBT09262
aatattcaggactgatttcctttaggattgactggtttgatctccttgctgtccaggggactcgctccaaagtaaccatgaggaaatctcccttttgcccttcacatgcttccacctacctgttagagcagaacgcaggtgctgctgctgaggtgtcacctgtgtgacgagtgatggacatgccaaggcctactctcacaccaggcaggtcatctgtaagtatgccagggtgcagaagtaggtggaaatcagtactccacagcctgacctcttctgatgctcttgagaagctgtgaggcrtggtgcaaaggcccttgcctggacaccggtgtcctgcataactgggcaagtcagtcaccctctctggacttcgtttttctgattgtaatattgagtcgttggaccaacgttcatctctgcgctgcgatattaaggcttcctttccatccagttagtccttgggactgcctgcctttctgagccttttcccagtctattcttgcccctactcgtcccttacccaatccctccccaaagaccacttaattcacagtaatttcttcctcgccctcctaaggcggggagtacttgtggtctgtg

SEQ ID NO: 21907 - DNA, 554 bp, Bovine  MMBT08123
gggaagcccgtgaaaaagcataagcacttttaattggtgcatgatttgtgtagttggattttagaattcacttagtgaaaagaagtaacagatgaggttggggtgatagggtggggccaaataacagagggacctgaatgctttattagggcacttggactgtgttcttgaaagcactgaggaaccagtaggtcttaatagaccaagtgatctgaattagatttataatttgtcccagtgagatgtccatatgaaccaaccttcraataattactcaggtctggcaatctatatatctcwaaataattgtcagttgcatttttcttttcttgcatttagtggtttggcattgcatgtgccaaccatgcagatgaccaactgaaaggtttagtttatatccagatgtcttcagtgttgtatagacaatcacaaacattgaaagaaaaaatattccgtgagggtgaaagtccctgtaccatgcttcccaaataaatctttgtggagggtatcactaatagcagttccactctgtctaaacacagttattaagatca

SEQ ID NO: 21908 - DNA, 600 bp, Bovine  MMBT08094
aatggaaacaaatgttgcagaagccagagaacatcacagtcaccagctttaaccaaaatctaaaggtctttgggatgaaaggggctgaacagtgaagactcctcaacatcaatttaccgtgtgacttggacaattttcaagtacgttctgtggtagactatagctgaggacaagtcttcggaattcagacaattgaaacagagactgaaataaagaaggaaatggattaatagcctttctttcaaaataactgcagcaaaaaaatattttttatcttaaaaatatgtgtataacccattracttggtaattctattctaaggaaataatggctatgtataaaaatttacaaggaagaatattaatcctttttagagaaaaactagaagcaacctaatggctaataggaaaagattacataaactacagtgcacctgcacagcagattattatacagtcattaatactgtagaaacaacgttttcataaaacrgacacgtacacagtaaaaacgaaggctccaaagtgacatgtatcaacatggatgcgtctcagaaacatcccgtgtagaaaagtaagagtatatgctgtgtacatgaag

SEQ ID NO: 21909 - DNA, 600 bp, Bovine  MMBT12063
gacaattatatctacacaataagatattcttccaagtgcatttcatacaagcagggccactgggaatggttgggcaggttgtacacttaacaaagtattaatattactacttagcagtatgcagcaaccatgcccaaggggaactccatctcagactgtgtgctttctagagtgggagagtacagctgacctgtgcctttgacccttttttgtttcaacaatcaaacagtaattattcttcattttcactcattattccttatttcacatggcccaactcacctaaatcctccaaacaaytcccttgaaatgcatggcacacaaaagaaggccagagccaggaacagaacgggtgtgaaacctcagccttycggctggttggatttgaaacttttctatctacttcctgagtctgtactgaccatctgaggactccatctgtctcctcctaggccctgcaaccctgggttatgattcttgctaacaattgattgccatgattccatttcaacaacaatgatctggagttttactttgagtgtttaagaatccttcattatctcctaatggcataatagcaaacacactttaaccactaaa

SEQ ID NO: 21910 - DNA, 600 bp, Bovine  MMBT12381
tttacagagcctacttgatggtctcttcatgtataaccattgctgctcatatttggaaatatagggctccctataagtcacctgaatgtttgtggtggtaagatgtatcagaatccccctggaccctaattgttttataattgtcaaaaaagttargcaatttggatttgttgttatgaatgtttatgaaatgtttctctccctttcttttagtttggtagaacacttatttctaaatttgatataatgtgatttataataaacaggaaaagaatcattctcaatattattgtcaagatyaaatagccatagtgctagcaactatgaagacaattatatgaaacaaataattttctgaaaataatttttggcagtaacatggggaaataagaaaatagtttagcaaagggaaaaacttttgtatccataatctacttctacttacatttattaaatttgctacattgtgaaatggaatgtatctctattattaacatcaaggagacatttgttatacaatgacatcctaaaagaatgagttctaaattatttaaaggagacaaaatgctatttctgaacaccacatgaatacataaatgg

SEQ ID NO: 21911 - DNA, 600 bp, Bovine  MMBT07964
tttcttttttctaaataattaaaaatacaggtaaatttatgaatataaaagytatgactgaataacaacatgcacaatatttcatatgtgagtggtttaaagcactttaatactcatgtaacttatagatctcttgagtgatttaattatcagcatctgtcattttaatggaatgaatacagatgtaagcaaaatgcagattagaaataaatctaaagtctgggaacagttctttctaaaagacactataaaatatctcaggcctctttcctgataccacaatgcaatatgacacaagtyaataacaaaaaaaaggggtttccttggtgtttcagtggttaagaacctgccttgtaaggcaaggaacactggttcaatctctggtcccttcatgcctcagagcagctaagtttatgcgccacaactactgagccatgctctggagcccacaagccacagatactgaagcccatgtgccttagagcccgtgctccgcaacaagagagggcaccacgatgagaggcctgcacagcgcagcgagtgagtagccctggctcgctgcagctagagaaagcctgcacacaggaaggaagacacacc

SEQ ID NO: 21912 - DNA, 600 bp, Bovine  MMBT03928
cttttttgcactggaaaaccaaaaaaaatgtgtgagcctcactttaatgacatcttgtctttattgcggtgatctggaatcaaacctgctttatctccaaggtctgcctgtataatttaaatattagaagagtctcacttcagaactgggtcctttaaaccaagagctttgggttaaggccgtgttcatactacaggacgtgaagaataaaaagggcacatttataaataggctggttgtcaagctcctccctctctggaactttactactgttcttctctgacattttgtcaaattctkatgttaggctctcatgaaagctgttggaacattggaggaagggggacctgtgtagkgtgacatgtgcctggcaactgaagcttataaatcaagctgaaacctggtgaatctacaagatttatggctcatgggaaaatatgctaactcaactgcaaattgataccacaccaaactggcctccgtcttcttacataacaccgctcaaattgtcaggccgtctttgggggaatttattgcagcacgttcgatggaaacagagtctctggccacttgactgagccctttcagaccagctcgaaa

SEQ ID NO: 21913 - DNA, 600 bp, Bovine  MMBT12331
tttttttaagttgttttttaaagaaagataaatcaaatcctataaaaattcaagatccatgataaagctaagctcatgtttggatctgaattagaagaaactcttggaacctcagtggcagattttgtggctcttcatgtaaggatttctcccttttcttgattaatttatcacatatccacctgggccagaaagccaggggtataatttgttacaaaaagttgcctgccaatactgtatcagttgatagaaagtaatttataaaataaatcttcaaaggtgccagaggttattccctaygtctgggaatttggaggtagcattagagaaaaactgtatttaaattaagaaggacagtataaggggtgtggtctttctttagaaagatatggaaaggtaacagacaaagagcaattatcaaagattaaagtggtggatttatgatagtgaaaacagactcccatattctgaaacaaaattccaatacaaagatcatggtagtgccacattcacagttgttggttagctctgtgtgtgtatgtgtgtgtatgggcaaaccccactaatttccaacatactcatggtccctgttctcttgtc

SEQ ID NO: 21914 - DNA, 600 bp, Bovine  MMBT08783
gaaactgagctatcattggaagttcatttatctaaacgcccactagattgtgaggtccttgagatctcaaataatgtcatgctccatgggtgcccaataagtgtttattaagtaagtaaatgaaattgtacctagtaactatgtgagctgagaaacagtaatagaaatagtggtctacaagaaatgtacccaatttacccaagagttggaaaaatgtaggtagtgtgcccaaaaacaccaagaccatgtggaactcagcgtccaccctacaaaaattttaagaaggaaaatgatcttggkgtttatgcccrcctaaattaagcataattaatgagataaactacaacaaaagttttctcttaaggcactccaaagcaaagtcagaccaaataatgtttaattgcctgggtgttttattcaaacaacgtcattaacaccacttgaattgcaacttctgggatcataaactttatgtatacctgtcatcaaagtccttgaggggctcctagttkaaatgcgtttcactacacaatgattatatgatattaaagaaaggaatgagttacttttcagttgctgaaggataaaaaaggttgttgg

SEQ ID NO: 21915 - DNA, 600 bp, Bovine  MMBT13417
tacagttctaaatcgttaggatcccaaaatgccaaaattgtaaccaaaaaataatttgaygtttatagctaaattgaattgagtgctaagtgaaacaggataagccccatttagcactgtggaaaacatgatttcagaaaaagagggagtataatttgctgctgcttgtttttcaggctgtcagaatcatgtcttcctggcaaggcagtgttggccagtggtcaggatgagggtggctttggagccaagcagagtcaggttcagtctgtacaggcgtggctgtgtggctttggacaagtyrtttacgctctgtgagtgttttcctyttccttgttaggcagttgatagtggtccctataccaccaggtctctgccaagaaaagtaagacagtacacttgacaagcaggtggcatgccgcccgatacactgtgagccaacagacagyagggttaggagggagatgtgcagctgatgaaggtaacaggacatggatagtgttggtggcggtaccttgcttcagccccaaatcaagacgccagagcatatgttatttaatggcttatggtaactcttcccataaggaaaacaagaatcataaa

SEQ ID NO: 21916 - DNA, 600 bp, Bovine  MMBT13081
gcattagggtcttttccaatgaggtgactctttgcatcaggtggccaaagtattggagcttcagcttcaggatcagtccttgcaatcaatattcaggactgatttcctttaggatggactggttggatctccttgcagtccaagggactctcaagaatcttctccagcatgacaatttgaaagcatttattcttyagcactcaggcttatttatggtccattttagacaagttatttaatcttatgtatcttaactttcatcatccataaatgggtctaatgttaggagttactttgtakagctatcatgcctgacacataacaaattctcagtaaamtagtaactcattggcttgaattcaagctcgtcatcttccagatggggaagctgatccagaggatgaactgagttggcagagcaaggactgtgtgtgtgtgtgtgtgtgtgtgtatgttatttgctcagtcatgtccaactctttgtgaccccatagactgtagcctaccaggctcctctgtccatggaattatccaggcaagaatactggagtgaattgccrytcctttctccaggggatcttcccaacccaggaaatgcac

SEQ ID NO: 21917 - DNA, 600 bp, Bovine  MMBT11235
ctcattcatatttatttatttattgacttttatgaagtctccctgccatccaatccctcttgcctatgttgtcctgaccatccccaccccacccccagccatccagctgtctgtgcagctgtctgtctatctgtcacaaggaaaataaaaacagcaagcagcaggacctatgtgtgtggtctatggggagggatgactggggggtacagcgcgtacacaatgccagggtactgggacggggcattccagccttttctggaccagtgagaaccgaggtataccacctagcaccttaggacyttcctcccctgccctctgaccctcctggcccctcacctgtcccttatttcttgagaaaggaaagatgtgggtgtgtttctccctctaaagtttctgaaatcctggcaggaccactgaatccccacccccagcctctaactatatgggtggccccgacttcttctcacatgttccatcatcgcaatgggaggatgctgggctctggaagggaccagcccacacccccatcctggctcagccttcttcactctgttcaggggacagggcagctctgtcctgacccctggagcagagggggtt

SEQ ID NO: 21918 - DNA, 600 bp, Bovine  MMBT06250
tacctctatgaactcttgactacttttaaggataactgtgcccttcttggcgtaaatcacaacacaagaatgaaatcctcatgtggatatatcatgagaaaaaaartttgtatcttcatcatgggagcagtttagttcaaacttggcaaccttcttcgtaaatgtttatgaaatccttttggtcaagaccaaaatagaaatcaaaacttattatcctttcccccgaaaccaaaagagtgacattatttaaagtttaagttttaaaccaacacaaagataaataaaaacttttaaagtcamgatggtaactgacgaccggtgcttcacattataaatagtagaaaggttcgtaggaactcatgcactttttttttaatggctcaagtctcaatctgacagataatgtaaaatagacaagatcttcccttctcccttccaaaaagtaggaaagccaaaacttgaaaggattaacagcccttgcttttatacagtgttgtccataagaagccacactcaccttggagatttacctgcacaaaagcatcattgcctttctcagaagggcactgccatatcttctgtggtttcataaagccctat

SEQ ID NO: 21919 - DNA, 600 bp, Bovine  MMBT12449
agccacaggtatacatacggcccctgtctcttgaagctgcctcccatctctctccatcccacccctctgcttatctgtctttgggtccttggaggtgattcaaacagacttcattgccagtgaaccacattgttggtttacatttcccagaagtcatgtgtggtacatattatcttcaacccatatttaaaaatttacagtaaactagggacaattctaaaagaatccagcaaaataatggcactagatataggtcagtttcaagttacctaattatggtgtacaggactatattggacygtgtgcctctgcctcctagaatgatgaatttgctattaagrggaatgtcttagactgtatatattccctgaaatataatcctgtgattgggacactggggattgtatcatggggagtttcctggtatgcagaattcttacaagaaacactatatttgtagggttggccaacatgatgccttcttatttattatttagtattaccatgataaatagtaacatttatataatactttttatttaaaattattgcactaacattattttctactttgatttcccaaataatcctgtgaggtaa

SEQ ID NO: 21920 - DNA, 600 bp, Bovine  MMBT09649; identical to SEQ ID NO: 4699

SEQ ID NO: 21921 - DNA, 600 bp, Bovine  MMBT01660
agttaagctgaaatttaattcaagactatattttatgtaatcccacatatcaaaaatactatgcttttaaaatgattamtgaaatatcatacattcttttycraattaactctcaaagtccagtgtgtcctttactcttatcacttatctcaattataatttttcatcctttaaatctacattttgatatttatttaggttacaattgaaaaaggagacttmcattcctaccttgttccaaatattcttattcctataactgagtcagttttcagttcttaaaattttatttcaattaamtragtaaagtataattaaatgtttggtttacatgtgactagaggtgtgtactggatactgtggatatcgaagaatgaggagcagactcaccctggggagttggagtgaaattaggaggtgatctactgcactgaagaagcctaactggaaaactttctttatctcctccaccattagacaggtgagagatattccctaaatcaaaactttagtagcaagatggaatatgggttattcatttacctactaaattattgttattttattttagctcttcccacaacttmtaagttctaggac

SEQ ID NO: 21922 - DNA, 600 bp, Bovine  MMBT05406
cgggcagccgagttgctcccacagaagcctgcaaagcctgccagtgcatactgagtaaatcagggcaaaggcgtgaaccgagtataatggaaaaaacccaaagcctgtcgccagggcacctcggcgaaagggcaggacgcacctcgccaggctcccgtggctcccgccccgttcgacctccgctcgccgagagacagccaggtctgttgtgaacgcctccagtcgccagtgcgtgtttcccagctcacaatggagcgcttgtgccgccttcgttttcactttcaccagcgagggaagcgragcacaatggggcagtrcccacggcttgggaacaggacacgtttttccttagggttcccagggctggggacgtggaaaaggccagagccaagacaaacacgcgaagcyrgccagatcctccgttacgctttctcagtggcaatcaaacacatttccagttaccatctgatgggtagtctctgcctgtggggtaaaggcagatgctgttgaccacggtgagcaccttccctgaagaaagagcctgtattcctcaccgtacaggatgccgccgtggcgtgcctgcgggtgcctatcgcatcg

SEQ ID NO: 21923 - DNA, 600 bp, Bovine  MMBT10498
gaaaaaaaaccccacccatttcatttggactgtgtactaagaataattgccaccaatattgattggcccttggggacccagctgaatttaaaaattgcagactgtgaaatcccagctgatatagcctcgtggagcttgctgcttatttgtgacatgttcctatgtttaaacttacccacaaaaactgtgaaattaatatcctcacgttgagtacaatatggtgacacacccagctgacatgcgcagctatttttgttcctattgttttcatgctggcttctgtctgtaaacacagcagayctttctgatgatgaagcataagtccatttgtttcctggagtctccttttccraccattttcaggggttgggccaacacgtgaagtttttcagtttctttggctgcacrtttcgctgtaatgagtcaacgcagcagggtctcccrgtggcctctggcctggggtgaactgactgcgctggccccattcagcttctccttggctatgcctrcctctagcacaggcagcttgaagctagacattcctgttaaaagcaggggggaagatgtgttagtttgcctaaatccacgtaatgaaggatg

SEQ ID NO: 21924 - DNA, 600 bp, Bovine  MMBT09714
ataaaaaacaaagctctgtgtctcccccggccccttaggagtctgggcgctgaaagaagacccagcctgtggatctgatgcctggagccccgagggggacgggctgcgcatgctctctgcgcactggcagcttggcgcttagcctctgcgcatgctctctgagtcccgcccgccccttgcctctgcgcctctgcacctagtgctgccgtctccccaggccccctctgttctgtgattacttcccttccttggctttctctgcggggtggagcctcgttttatgacccctgtaaaacgctrggagctgttgacttcttcctctgggtttctgagatacctgcagcagctgggaagagagcagtgaggaaggaaagagcaggccaaccttcccaggttcccccagcccctcaccccagccctcagcagggagatgtggcctgatcccaagacttggcaaggcagccacacacatttgcagagtgacaaaaggagaggaggggcctaagaggaaaacagctttcacatgtgtaaatgcctggaaaagttttttggattcattattctactctgggtgattttcaagagcaacagagcttgggg

SEQ ID NO: 21925 - DNA, 600 bp, Bovine  MMBT11723
gtaaggaaacaacttgaagttgctccatctgcatggtgccttttacctttagaaaaccagagtaaagcaatcctgactyacccctgggagtgaacagtgctgacctgtcttctgctgtagttccactcttgagctcacattggttgtctcactttggtttaaaaatctcaattagaaaagcagtctagcttaccagttaagaatagggccactgtgtcaatctcatcttcagatttttgtttgccactgaggaaccctgtaataccggacatatcacctaactttagtgctttcgtttgsttatagaattgttaagagtagatgatgataacatgaaaagcacaagtcaggcacctcataagcattcaagttgtcatcgtctttttttctctcagttgttgaaaactcatagaggcattttttagaattttagtagtttgtgggaatttttctttttttttaatttcattttaggcacgtttaaggcctgtgttcctaattctgccrttctctttttgccatttgaaggaagagccctagactggatgtgttgatcaataatgcttggggtcttccagtgcccttatatgaagactgaag

SEQ ID NO: 21926 - DNA, 600 bp, Bovine  MMBT10510
ggaggtggggtaaggtgggaggagtcaggaaaggtactcaattgcttgagagaatgtcatggtttcctactggcgcacagcaaagcaaccccacactgagcagcccaagggcttctcaggtggcactagtggtaaagaagcggtctgccaatgcaggagataagagatgtgggtttgatccctaggtcgggaagatcccctggagaaaggcatggcaacccacttcagtaatcttgccatggacagaggggcctggtgggctacagttcacagggttgcaaagagtcggtcggacacaamtgaagtgactagcatacatgaacagcttaaaactacacacagcaaccgtctcctagtttctgggaatcaagagtctgggagtggctcagttggctacttttagctcaatagccccaggtgtcagctasggaatggtcatcgcaaggcttgactggggagggttcccttccaagctyactttcatgggcgccgggaggtctcagcttcccatgaaagcgaacaatctttttctgccatgtgggcctccccatcggactagtcactgcccattagcttgctcctcccttagtgacaactcca

SEQ ID NO: 21927 - DNA, 600 bp, Bovine  MMBT13074
tattgctacccattgattctcatgctttacttgtaataggacttgtcttattatgggcattttgatacatttaagcttattaaaaggtaaaggaaaacaatgtctgaaataacaggttcattaagcaagaaaatgagaaccataaacaaggcaaaggatattaaactattttgcttttcattgaacttgcgaattctgtagaaggcaatgctgggcttagtgagaagtaattcaaaaagtaaattattttagtaatggactggtcgactgacactattttctagctgtactgcactaaaygtcatttaactgttctaatgaatgtttatgccacaggtacaactgacaagcagttctctatgtgtatgtatgtgtgtgtgtgctcagtcatgtctcagtcgtgtccttctctttgtgacgccgtggactgtatgtagcctgccaggttgctctgcccataggattctccaggcaagaatactggagtagagtgccattcccttctctaggggatcttcctgacccagggatctaaccagtgtgtatgtactctgtctcctgaattagcaggagggttctttaccactagtgccacctggg

SEQ ID NO: 21928 - DNA, 600 bp, Bovine  MMBT09492
cctgttattctctcaatcccttaggcaacaactctttcactttggcatgtgttaaaaggagtgtaatttattgtttgatccctaagaaacactggaagtataaaatatggttacaaatttttaacagtacatagataaatatatacccatatcatacacacacacacacatgcatatatttacataaatgggttcatatactatataatctggtattccagttttttaaaattagtattgttcttttctacaaagtaaaaacagacctagaatgaactagatgttaatcagtgccagagratgagtgcttaatccaattaagaggtctccttaccatatttaaaactaacatggattcacctgatgaaggtagctcccaattttttgttatttcaaaaccaattcagtaacaaccttttgtcagtgtagtattacttctgcaggataatttcccagacttgatagagtcaaagagaatatatattttctttcaaacataatgccaggttggtcaccctccagaaataatggaccaattacatgtacattaacagtgcagaggacatttttgtcactctcttgggtcacaatgatatttca

SEQ ID NO: 21929 - DNA, 600 bp, Bovine  MMBT02739
gctggtcacctgaacctctcaccgcattgttaatcggccataccccagtgcaaaataaaagttcaaaaggaaaaaaaaaatagtgctaggtaagccttaaaaaaaaaataaggtgataggttcaatttggcttgtgatccatagtttgccaacccctactctagagcctaaaatcaaaacctgcagaaatgaagaaacttaagtttaaggatatggaagaaaaaaaaggaagacaaaaaaaaaaaaaaaaagaatatggaagaaccaggactgtgctctactttttcctgcttactcaasttcatgggttgtaccctaacgtaaagaaatgaaaataatgaaagctacaaggaggtaatttaattatatgtgggaaaggggcattttaaagccaagarccatggctgctatgaaacattcttaattaaagccaagtcagaatgcctggcattatwactccacatgccttatctataatacaatacactctttctattagtaatgttctcttccctctgccacaaaattgtatactattactaactgcaaactctgcaaatattaagctaaagggtcataggggaggaattgatgttgttc

SEQ ID NO: 21930 - DNA, 600 bp, Bovine  MMBT00665
gctcaaggatcaggtgtaatttcctttggcagccttccatagctagccctgcaggtccatgggggttcatcatttcatgtatttatctcaggtgtcttgcaaagattcagagaagccaataagtgtttattctcctttcaattgataaagaaagagattgatgtacatgtacaatacaggctgttggattggttggtcacaatggtgtaaacaccatcaatgaatcccaaaacagttttgggcacttatttccatgtaaattgtattacttaattctctgaaatgttttataggattggsagtataacacatagttttaaaatgctgttcctcttcctaaaagatctttcttccctttgctgtctgttaaatacacctgatctttcaggatccatctccagtgatatctcttctgtgattccttttcctccaatcccagccagattcataggcttcttcctttctgcttccataagaccttgcatatacatcgagcatggcactcaaacaattgaaatcctttctgcgtgttggaacatgagctcctcaaagcagcttccccatcatattcctcatcacatgaattgcacttaaatccac

SEQ ID NO: 21931 - DNA, 600 bp, Bovine  MMBT03931
gccagagaggaaggggccctcagcaaggtggcaaatccggtagcttttgttgtcaagaagggagagttacaggtcttcctgttggatgtcagagtgtggggctgagggaaagagacttgcagaaaggtgctttgggagagtggagttttatctgtgaccttggataatagcgagtgtttatttaattatagatgacaggtgcatattcattgtatttaatctttccatcatccctgtgggaatggtgtgggttctattattgtcctcagtttacagctgtccacaacatcctaagagacygctgaagaggctaaagccctgtaactagtgaaagatttgaaytccaggctcatgtgactccaaagccagactgtctcatcgtcaccctctccgggagctgagagttcgcttccacgagtggagtggcagccagactgcaggcttttccgagccacagtgagggggctgtggtgggaaggcaggtgcacagtcaagagtttagctctcaagggaatgtgacacctcaagtcacaagcaagcgagtttcttcccagaaaggataaactctttggaatttgtaaaagagatgctacaaggaaa

SEQ ID NO: 21932 - DNA, 600 bp, Bovine  MMBT08736
aatatcagactatacagaatgaaaataaacagatacctagatgttgcccaatatacagatgcacaatattaaatatattcaattgaaatgttctctttaacggagttttgttttgaaatgggaaggtgggggtaaacacaagtattattgctgtactgattatttaaatcaaaagacaatgtatataacactataattacataaaacatatactgttcctcactgtttagtcagtataagcatagacacacatgtagtaagtttaagaatgtatgtatatacatgcatatgtccttgtaytgaacagattttgccatggaaacattctttgtattatcaattacaattcattccctttccttagagactctaggtactgtactatgctggcctggtggataattcaagttctttggctgaacatctgcagtagtcacagggaaaaagcatatcccatttagagttcaagagcaggaaccaggatattattattttttaataaaaagakaaatttttgtgaactctagaaaaacacataagtcatgtcctacattaggaacatgttaggaaagcagcgtcctatgtaactgcgttagtaat

SEQ ID NO: 21933 - DNA, 600 bp, Bovine  MMBT22822
aaggcaaatccttaatgaatcgtatgataaaaaccctattccccaagaaaatatattggacatattctgctaactttgttatttttcaaagcaaagctgacatgcaccacatacagagaaatgtcatttcaaatcgagtgcatcaagcagaactgtattaattcacaaagaggcttttcagtgtttcatagaaagatgtacaattagctgcgatgactaataggtgacccagtatcacagactgtgtttcagatgccttctttgtaagcttttgtgaaggaaggcttgtccatcacttgkgtagttaccagctagaggacagaccctttgtctctcctacaatgagtaactttttaaatagaactattatgtagaaagcccacctccatcctctgtatgcaaacaggacttaaataaggggctatttgcctcccactctccttcctataaacccttgagtcacctagcctggctagagtgtggttggaaactgacttccagaattcacgttcggagaatgaatcagtctggcaaattttccattgcacggtttgtacaatgacagcaccagtgagataaaggtttcctgtgttgtgggta

SEQ ID NO: 21934 - DNA, 373 bp, Bovine  MMBT13083
aacttggaatgctgtgtaacccctgaattgttcttattaatattactagctaactcttagttttcctgtgtgctgaacagttagctcatttagttctcgaaacaatcttgtgagtaaggtacacttttttctgtgctttataaagatttggagaggttaataacttgctcaagttcacaggactggtaagttgtagaaatactgacaaatgcttaatagcacttaccatgctctgtaattacttatatgcttactatctgtctcttccagtagaacataagtcccaagaaagtgaaagtkttagttgctcagtcgtgtccaactctgcaaccccatgcactgtagcccaccaggttcccctgtccatggaatt

SEQ ID NO: 21935 - DNA, 600 bp, Bovine  MMBT02271
acttacataatgtgtacactattgaacatgtctttgctccaatatttttgaaggaaatacaaaaaccgatggtgacaactgtggttgtcttcagggaatacaaatgtatgtctagtgaaacagggtttggaaagagattctaaaatttttacttattcttaaatatttattacctgttttataaaagaatatgataaaaaactaaacaatctaaaaacaaatttattgagcacattagcttgtgtcaaatactttcctaagtactttgtctgtgtggtgttatttgagaccaggaggaayragataaacgaaagggaaaagtctgtagctagtgaacatgtgagcttgtatgtattgggggagggggtggaaatggcagagacttggaggttttcatgtgttatagattctgttttttctttgaataagagactgtcatctgttgagtgggaggaggcagggatcatgaagactaagatgaacatttggcatagttgctatagagaataggaacggaggtgatcaaaggcagataaaagaattttgtgtattgtttaaagttgcataggcatcaatctttattgcagtgctatttttctt

SEQ ID NO: 21936 - DNA, 600 bp, Bovine  MMBT05039
tagtagcaagatacagagaaaagaagtaattgtctaatattaacttactgttggagctacattactctgaagttactatytatggagttacagtctataactactcaaagaactgggagctaatataattcaccatcttttaaaaatattactaataagatattggtgaatcctgtgctaaagatactgaaggctcttccaaaaatgagatctatgttggttgagtataccgagtcatataaaactagaatagttgagttagtctcttattctaacttctttttaagactgatcttatcraaagaaaagtacacaatacctctcttaattctctcagatagagatattctttggaataaaaataagtatttttttgtgtgtgtgcacrtgtgcarttgctcagtggtatccaactcttttgtgaccactgtggactatagccagccaggctcctctgtccatgggattctccaggcaagaatactggagtgggttgccatttcctcctccaagggatcttcctcgcccagggatcaaacccrtgtttcctgcattggcaggtggattcttcatcactgtgccacctggggagcccaaaca

SEQ ID NO: 21937 - DNA, 600 bp, Bovine  MMBT19713
cagagattgtacagtgtcccataaaccccctcttttatgtattattgtcttttaagtctgttaacaagtgcgttgctacatgcatgctcagtgtgtccagctctttgtgaccctgtgactatagcccaccagacttctctgtccatgacattttccaggcaaaagtactggagtgggttaccatttcctcctccagaggatctgcccgacacaggttcaaacccgtgcctcctacgtctcctgcattggcggaaagtttcttcaccactggtgccacctgagaagcccctgggaacatayacttttttttttttttggtaacatatacttaacgtaaaacttamcattttggccattctaggtgtaccgttcagttgtgtggagcacattcacgttgccctgcagccatcaccaccatccctctgcagaagtcttttcatacttccaactgaaatgtcattagacaacaaggccccagccccctgcccagtccctgatgaccaccgtcctagtttctgtctctgtgcattttgactgtcctagggccttcaagaaagtggatgataccatatttgtcttttgtgaatcgtttatttcact

SEQ ID NO: 21938 - DNA, 600 bp, Bovine  MMBT03330
aatacaaatgaaatagttttagaaagttgtgacagaacatcttaagagggtagatcaaggacaaagactttttctgaagtagcaaattttaaatatttcccattatcaaagaagagctataataattctctatatatgtatgttacgtgtgtgtgtgtgtgtatcctttccttctgctatactaccttgagcttaagtcttagatcttaaaagaaaaactgtgaccgactagtagataattggataggcgtctacaaaaggaaactctagtgctttaggaaatgtagtgagtgactaagyggatctgccttctttccttggatgtcaaattgaatgaatgcatgccatgacaaagtctttatttaagacatgtatgaagaatgtcttcctataaatyctacactatacrttgtattttatttctattttcccaatgtaygaaatatgatgattagatcataaagttmaatagtaaaatatccataaaaagctttgtacaagaaagtccaaagctttatccatacaatccacaaactagaaacatacaagacattcctcgatggaagaatagataaacagaatacagtgtattcacacaat

SEQ ID NO: 21939 - DNA, 444 bp, Bovine  MMBT17460
caccagcatcagtgacattgatgaccacagcagcctgcagagtattgggagtgacgagggttactccagtgccagtgtcaaactttcgttcacttcctagaacccagcatgacatgacagtgcagggcaaagtattcactgggccaattcaatccaaacaatctcttaaattgggttcatgatgcagtctcctctttaaagctaagcaaaactatacttgaacaagagtcaagagacctctatttaagcaaatacttagcaaaaagtggggcagagcctcccctgcagaacaaatattcrtatttgaaaatcacagtttctaatggcagcagaaaatgtgtgtgaaattttctcaatttgatttagttgatttgaaagaggacactggagattacatcctctttttctagtttgctcctatcatattgattgagtagacacatt

SEQ ID NO: 21940 - DNA, 600 bp, Bovine  MMBT22058
gaaaataaaagacatcagtctttttacctgattattttaagactcaatatattccaatttcatctttaaaaaagtccaaaacagtgttgttaaagcatttcctcacgtaggtgatggtcaaaacacaacttcccacttttgagaaccagaatctggaaatctcagcaggtaacagcactagattaggtgtctaaggacctgttttgggttcaaatctaatggcctatttttaatatacatgtgaataccctcaaacacctttctttaaaaaaccaaaattctgcttctcattaataaagyctttagactatgaaattaggttaatggatcttaccatagggtttcccgaataacctgtgtttcagtaacaaaaactctgtcatctggaacatataacgggtcactgctgtacaaatgttggtccctattagataacaaacatcaaatgccaatgaaaagatgtctcattaagtaaagttagaagtctcaaagaatataagtaatttactagcaatttaacaagtattcaataagttaataaacataacacatgctttaattttcctcccatattcattttcacaagtcaacggaaatact

SEQ ID NO: 21941 - DNA, 600 bp, Bovine  MMBT09425
atttaggttttgctggataccgcatcttgtagtgtgctggtctctcagttgtgtctgactgtttgtgaccccgtggactgtagcctgccaggctcctttgtctggcaggaattctccaggcttgaatactggagtgtgttgccattcccttctccaggggattttcccaatccggggatggaacccgggtctcctgcattacagagagattcttcaccgtctgagccaccagggaagtcactcggcaacaaagtggttctctttccagttgtctttcggctcttctgattccatcaaggrgaagatgcgtctctgactgtaattttccttcttctctctctttttttaaagctmtatttctttttattagtcacaatatcacaggcagtgtgcactctttgtgtctggcttctttgactcagcacaaggttttgtgaatcatccatgatgtacatgtagtaggagttccttttgttccttttcattgctgagtagcgttccattttatggccatgtcacactctggctttgtgtgtgtggtcatgacgcatgcttgcagagtctagttccctgaccagggactgaacccgggtctgctgc

SEQ ID NO: 21942 - DNA, 600 bp, Bovine  MMBT08708
ttatgcctgaggtttaaagacaaatgttagatcgatatcataagttttatcaatgagcaaaagagtatataaagccaaaaaagtccaagtgaattgtgtgaataccagaaagtgcttgatataaagtcacctactggctctctgactcccagtacacaatgacacctactcaacttcaccgtctcgcttacatttgataaaacaactgtaacaaaagaggagtggtttcttgactcttggagaattcacagggaaataaaatatcagaccctaatctactgcagagagaaaaagaacatrataatgagaacgaagtcaatttcacaataaactcatatgtctgtatggaatgaaattggtgattttaaaaagtgcaccatcacaaaataaattttacatgacagaaataaaggagcagaggaaataagaaatgtattaaaaatgcatcattacaccttacctcaagaatacattatagtatctactggtttaacattatgtgaaatttaaaaataaaaaagtgccttgggtatttctccttgaagaacaatcacaggtacttagatgataatgagactttgcaaaaccaatggaagccat

SEQ ID NO: 21943 - DNA, 604 bp, Bovine  MMBT14835
  misc_feature (1)..(4): n is any nucleotide
nnnnatggacagagaagyctggcaggctacagtctgtggggtcacaaagagtcggacatgacttagtgactaaacaacaacaatctgtccaagaagtcaaggtagtcacagccccartgaccagggttacttcctcttccctgcacctgggggccataggttttcctttgggagggggtcaagaggtgccccaaggagagagagagagagattttgaggaattgtctcgtgtggttgtggatgcttggtgagtccagaatatgatgggggaggccggcaagctgggaagtcaggaaggagttaragtccaaagcctgagaaatccctcttgctcaggagatgtcaggtttttgttctatcagactttcaacggattggatgagacccatccacattctggaaggcaacccactttatttagtgtctactgattttaatacaaatctcatccaaacccatcacagaaatatccagattaatgtttaatcaaacgtctgggcactgtggcctgccaagttgagacatcacattaatcatcatagcatgtaaactttgaggaccttaagaagattgtcctgtgctgagactaagagggaaggacatg

SEQ ID NO: 21944 - DNA, 600 bp, Bovine  MMBT09532
gtgaagaggtgctgatgataaagagattatgtccacaagccccaaaacaaatttatctgtagagataaacaaaaagtctagctcacaaactggcaatatgaagcaagaaaaatgaaaagactaaatttttatttgtttgcacttttgcaaagagagagctattcaatcttgattctgggtgctccaaaaagagttattgagaaatagaaactggtcaaaggaayggagagactgctccaaagcagaacataaaggatgctgtgaccctatttgctgatgcagagctgaagtttaaataaytgtgtaaacaaatggacatatccttcagttcaaaatgtaaaatgatttattcttcaatagaccttttgttgattgtctaaaaccctgagttggggactttcctgtgggttcaggagctaagattctgcactccccaatgggaatttgctgtatgactcagggaactcaaccagagctctgtgaaactcaaaggggtcggatggggtaggaggtgggagggaggctctagagggagtgggcatatgtatgcctatggctgatgtatgttgatgtatgacagaaaccaacacactattgtaa

SEQ ID NO: 21945 - DNA, 600 bp, Bovine  MMBT00947
ccccatcacagacaccctgaactctatctacaagctaggacatcaggtggagactatatattttttttttgcctgcgccccatggcttgcagtatcttagttcccttatcagggtttgaacctgggccacaacagagaaagagctgagtcctaaccactgggaaaccaagaattcccaagaccctatcttaggtctgtgcttgtggagcctagttctgacccatgatggcattttctcatgagagtcagacccgggtaatttacccaacatgaaggattcacatgcagtctgagcatgtkacccagatcctcaggccctggtcctgttgtgcctgtgggagtgtgtggtatatcctgccaggaaatggacatttggagggaaggagcaatcagagagaatgaaagagaagaacataacctgaagatgggaaagggtgggaaagaagggtgtgatcaagttttttgaaattaggttagggttcaaatgaaggaatagaagggactggtacttttcccaggcagcacgggtcacgctggcctgtcgggcagcctcaaggcctcgcggatggtgatgacagtaaccagcagcaataacagcgg

SEQ ID NO: 21946 - DNA, 600 bp, Bovine  MMBT02058
gacttggttacctcccattttgccagggccatcagctggaggttcatttcttaggctgagacacactctacaaagtacctgccatgagattaccacacaaaacgaagtctgagagtctcagtctttgaatattttcaacagattcaggttgtttgacgacatatgtatttggatggtcaagagtttgcaagtcctacagggcagtgggccccaacaccagggaccagcttcgtggaagacaaattttccatggactgggaaggaggggatggtttcggatgattcggacaatacgtttaktgtgcactttatttctgttgattattacgtcagctccacygcaaatcatcaggcattagatcccagaggttggggatccctgcttgagggaacagattggtggttgccaagaggtgggggaggggggatgaaagactgggagtctgggatgagcagaggcaaactgttacatacaggatggagagacgagaaggttctaaggttgttagcaggaaaccatgttcaatattctctgatagacggtagtggaaaagaacatgaaaaggagtgcatttagtgtatagctgaatcactgctgca

SEQ ID NO: 21947 - DNA, 600 bp, Bovine  MMBT04731
ttgtgacatttttcagttgacaatttttatgagcaccatctttgtccctaaggagcttcatattgaagacagataattattatgtggacatgaacagttcaagtgcaaatattaaaggaacaagtaaatagatcatattaaaggaacaagtaaatagatcatatgcttaaaaaatcttaaacactggtacaaggataacatgtaaaatgggggaaagagtatagaaaggggaggatggctctgtatttaactttctggtgacctctctttggaaacattctttctttgacaatgagaacygaatcattaccttttcctagcaatatctcttctccaacagaaaatttccaacttgcagatacaaaacacgtaacatcattgtttttacttttaggagagtgagcaaggaagggagtctgtctgattatactactttatgtcrttactttaggaaagaaaatatttatagagaaaaaatattagactgtttcattaactaattaatatattagagckaatacttgtcccaggcatacttatcagtatgatatgatttcttcctatttaatagtgagatatgtattttaaattttactaaaa

SEQ ID NO: 21948 - DNA, 600 bp, Bovine  MMBT06364
acaaaaacaaacaaagatcctgagatctggatgttttacacactggcattaagaaagtatttatcttgcttggtctcttgggagcaggcagaaaagcaatcacaggtacttgtctaggtgtctttaataatattttgacctcaatgaggaaaatacctttctttttttcctttttagtagtgtgatctgtagcaattctttagttcagaaatctgagatgaaagtctggttcttatgtactgtaatagaaagaacttagaaaatctatcttatgctctcaaacagacagtccacagataycagagttcactgtcagaaatattgctttaacctacattttatatatatcttagtactagcaaaaatgatattctgtagcagtcaggttttcagtgattgtgatcatcaataggaaggaaaatattcaggtgtattgtcaaaaatcataaaatgaggctttgggacaaatgattttataaaatgaatgaagtaatgtaacaaatcaagtgtagctataaagaaagctctgcatgagatgattgagaaacactttaaagaaggggcaaagtctctcattttatttcattattagcagcacac

SEQ ID NO: 21949 - DNA, 600 bp, Bovine  MMBT07778
gacactgacaagacaactcttaacaaaaaagcctgagaaatggaagttaaatgtagttggcttaattctacgttaggacttagagtgatgaagaaaaagattctcataggagagtatatataaattccatagagtaggcccaaatatatattctaggagctccctaatttatcacccctttccagcttctacaatcagaatcttcaggaatgagagaaatatrgaaaatgtttattttctcacttacaagagtatgaggaataaaggatataaaatgttttatgcgtggtctaattatarctyggcatagagaagtacttaacaatgttgactgaatcaatattaaagagaagtaaggaaaaacttttgaatagcttccaaacattcttggaaaataattctatccttagaggtgctctggaggaggcagtggctgcttggctgactattatgtcagtgaatggacttaagaatgagtgkactttcaaatttatgccagtttgaaatgtatgctaattttctgtacataactatgagctgaagcagagttgttcaataattgtctgtcattcaggcaratcatggaagcaaaatgatcat

SEQ ID NO: 21950 - DNA, 598 bp, Bovine  MMBT22999
  misc_feature (1)..(64): n is any nucleotide
nnnnnnnnnnnnnnnnnnnnnnnnnnnnnnnnnnnnnnnnnnnnnnnnnnnnnnnnnnnnnnnncagtttcccctccgtaaagtggggagtgggtggatgatccactgttggtttaggactgaggggagtcgatggcctggaggttccackgaagtcacggccacagccttccagcaggagttctgcaaaacacagatggcttctgacagccacgctctttccagaagcatcgtaggttcagagttcagtgataaagctgacactgagcagaactgggactcaaacccaggtcttctgtytcctgatgcttctcccttgccgagataaccagactgagttttgctgatgtcgttgaaactgctacccaggactcccccaggcttctgtgactgcccttggctttgaattttaaatgacccaggagcytccaaccagagccctcggacacacagcagctggcagcagctcagtcctctgagtggatgagagagtcccataacctgggctagatgttaacmtgtcttttctgtaagaacgcgacagaagagtgagactcawgcagggaaggaggaamccccttattgtgtaaaccctttt

SEQ ID NO: 21951 - DNA, 600 bp, Bovine  MMBT14274
ttccagaagcatcgtaggttcagagttcagtgataaagctgacactgagcagaactgggactcaaacccaggtcttctgtytcctgatgcttctcccttgccgagataaccagactgagttttgctgatgtcgttgaaactgctacccaggactcccccaggcttctgtgactgcccttggctttgaattttaaatgacccaggagcytccaaccagagccctcggacacacagcagctggcagcagctcagtcctctgagtggatgagagagtcccataacctgggctagatgttaacmtgtcttttctgtaagaacgcgacagaagagtgagactcawgcagggaaggaggaamccccttattgtgtaaacccttttgcaattcctgggcaaggttagaacatgtgatgatgcttgaaatctaactttaggggagagaccatttttggtcatagctggtgtgttgacacctttgcaactggaaatggcatagcctctgtccatgtgctatgagtaactgacycstcctgcttgccaaattcgtgttcagatggcaaaacagcctgagactgccacattggaccccygccagttgttcc

SEQ ID NO: 21952 - DNA, 600 bp, Bovine  MMBT22978
ggacacacagcagctggcagcagctcagtcctctgagtggatgagagagtcccataacctgggctagatgttaacmtgtcttttctgtaagaacgcgacagaagagtgagactcawgcagggaaggaggaamccccttattgtgtaaacccttttgcaattcctgggcaaggttagaacatgtgatgatgcttgaaatctaactttaggggagagaccatttttggtcatagctggtgtgttgacacctttgcaactggaaatggcatagcctctgtccatgtgctatgagtaactgacycstcctgcttgccaaattcgtgttcagatggcaaaacagcctgagactgccacattggaccccygccagttgttcctgtgctgtgtacatatgaccagggcttagcacgcacctgtgtgtttacatggcagggagccagctaggctgattcaaggtggacccacggcctgggcaggctggaaggacagagacagtartggggggaaaagggtaaatagaaaatggacaaaaatattgtgtatcagccatgattcatctccatgtaaagcccttcagaaacaattttatcatttgctggta

SEQ ID NO: 21953 - DNA, 600 bp, Bovine  MMBT04023
actgggcatatgtgtgtaacatacctggtgttcaattaaatgccctcaataatatagagcaactacagaggcaaacagcactataaatggaagaattatataaataayttttgctaaataaaatgcatatgttgaaacattcatatgaatatgcatatatgcaaaacacatatgctggtatgcattgccccaaaatagttttcaacatttgccatgagtataattagcaccccaattttaccaccatactacccagtttggtttattctgtgtgagggttttttgacctgagcactattsatattctggaccagaaaattctttgttgtggggactcacttgtgagttgtaagatgttcaggaccacccctgacctttgcctgcaaatgagartaatattcttccctcagttgtgacaaccaaacacttcatcagacattgycaaatgtccccaggtagggggtactttggggattcccaggtggctccgtgataaagaatccgcctgccaatgcaggagacacagattccacccctgggtcaggaagatcccctggagaaggaaatggaacaatctccagtattcttgcctgggaaatc

SEQ ID NO: 21954 - DNA, 600 bp, Bovine  MMBT07177
cactgcttgttctcaactctggcctcactttagaatcacaccaagaccttttaaaacctgcagaaaaccagaccccagacaaatgaagaaccctggacgtggggaggactgggcatcagggtctaaggtacagccagggttgagaaccaccaaagtccttgtgacctgagctcctgcattctaatttcctgaataaccctcttctcctctagccctgccacaaggcccatgccaaactgatgaacaaatggtagggaggaggaggaaatccccagcaccattcagctaaggacaatttgragcagtaatgctgggcactgtcctttgccctgttgtcattttctcctttcagtgagaaaaacagcagcagtggacaacagtggagcaagctaggcgggtattctcttacacggttgcagggaatataaattactacaccttccaaaaaaaagagaacacaatgaaagaccttgaaaaaattgggcaagcaccagacccaacagttttaggagtttgtgctaagaaataattacggaaaagatcaaatacagagatacaagaatagggtcatcactgggcttccctgggggctcagtggta

SEQ ID NO: 21955 - DNA, 600 bp, Bovine  MMBT10061
gcctttgaccaatatggtgtcattgtgctttcctaaactggtctttaatcactctgggtgaggaaaggacacttcttgggcaaatgggaacgcctttcccattctgtccaaggggccactgcctcttcaaccccgctagtggtcatggaggcagaagtgcagtcaatattgaaagtgattatgtcctaaggatatgctaatgacatcctaaagagtccaaggcaagacatgattagaagatgtgtctttcaacttccccactataaagtttaaatcaaatcaacatgtctggaaaattarttgttcatgtataagatacgctataagagtcattagaagccagtattgaaaagtagcacaatggatgatgcactcatgagtaaacagtactcagaaattgcaaaggcaaagaaatctatgtgtttcaataaaaacaggttctaagaagccataacactatgggtaaaaccatcattactaactgtcccagaggaaaagatgaaattagtcaagaatggtgcatttgataatgatgaaaaagaaggaatggttcttgagcctgaaaaaatggtacctggacaccaggaaatactgacaggt

SEQ ID NO: 21956 - DNA, 555 bp, Bovine  MMBT19117
gcagcagcaggtgccacatgcagaagagtgaccagcagcttggtcacagagaaatccttcctgaggaagtatttttttttctcataaaagtgccttttaattgaccactgtaacagccaccctccaagacactccccagcacacagaccgcaagtcacttaagacgtctttcctggtgcttgagtttcatgaataaaaggaaaaggtcaaatatcactcatgtcttatgtcactgagatatttatwtttaaaaagagttaraagcagaaaaggatcttcctctatggctttatctagcayttatatagttttctgattatgaaagtaatatatataccttgtatatgcataaagccaacatctgacaggaaatgcacccacatattaacaggttatttgggaaagtggagtgcataggagtttgctttctgtttttcacaattttatattgttctctttttaaaatgtgtgtatatgtatatatgtgtactacttttgcagcagggaaacgatttatataataataaagaagaaatataaatcaggaaaaggact

SEQ ID NO: 21957 - DNA, 600 bp, Bovine  MMBT09603
gtaattgacattcatttattaaaaaaaaaaatgtttgctgagtaagcatgatgttccagaaattgtgccaacttctgagggtacagcagtggcccaaacagtgaggagctaatttatagtccagtgagtataaaaataagaaaacagctcaataagctcagtattgctacacccattctagagacaagcaatgaaggcaaagaggagtaaactaacctcttcaaagtctctgaattataggtggcctggacaagctcatctgtctcacaaaaatcagtgccatttccatcactttcccaytttccttagggacagttcaatgatgcagatctaaaattctttcacacacataaccctcttatattcttctaaattccctgaggagtgcatacatgctttcctcggatgggacaggggccatttctaaagctgttttgaagcatagcacttctcaacttccttctcctttggaccacagtcatgtaccttgttataggcaacccctaatattttgattattttgatgcaaatccatcacccataataaattcacctgctttccaaatgcaatagattttagaagcacgaaagcaaaaacta

SEQ ID NO: 21958 - DNA, 600 bp, Bovine  MMBT11133
caaaaatctctccagaaagacagtagaaaaagaaacattttttaaattattattattccataagcattaaatcgctctcagaggctacaagaacagagaggaatcttaactttttacataccctagccgatacaagtcatcctttacatgttcaaaaaaaatagtaattagtcctcaagtaagaggacttgccagcaccgtttgtcacatgtagttcattctaacttaacctggtaattatgtgggcagctacataacaacatacatacatacatacatagcattggcttgttggctttmccaagaagaaaagctaaattcttattttttttatgataggaggtagtttggcaactcagaaccaagcacccacctaaataagtctaccactgtcccccagaaactgggagagaggggtgctaccttccttgatgttcatattcaaagaggccactcccagtctcttgagagaaacattctcaggttacaaagctgaccaaatgccaatccagtcttcaaaagaattcgaagcacttcccaattatagcttttctaaagtaaatgtcaaagaaggaaagagaaggaaatctctcattttct

SEQ ID NO: 21959 - DNA, 598 bp, Bovine  MMBT03448
  misc_feature (1)..(103): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaagcacagggccactttctaaatcaattcaatttctaccaaaatttctcatcataaaatttctgcctgaaagagtccagcaaaaaatgcattccctgccaggttcctctgacacagctcaggtttacagctctccttcagaatttcagcaaccttggctaaatcaccagatgggtctgaaagaatgtcattacmatgcccttatgggagttggcaaatagatgtcaacaaaagctttgtgctttatccagaacagtccatgctgagaagtccaaaatctaaatctcactgctgaaaaatctgcaactagaaaataattcccccctgaactctgcagccatgctccctctttgctcactctctgtctcctcatttttctttttaaggaagaagcccatgttatttaaacttcaggctttataagaacaaaatattttaaatgagttacagtttcaaaagttataaaacaggctaaatcaaagacactgaacaa

SEQ ID NO: 21960 - DNA, 598 bp, Bovine  MMBT16852
  misc_feature (1)..(34): n is any nucleotide
nnnnnnnnnnnnnnnnnnnnnnnnnnnnnnnnnngaattgtgtcctatctgtggatccgggacggccgagtccagcagctggagtgagtacttgaagagaattgcccctggaccagtaatcattacgtctatgttagtttgctagggctgcatagcaaaataccacaggaggggcagcttcaacaacaaatatttatattctcccagttttggagactggaaggtccaagatcaaggtggtagatgactggttccaactgccttcttgttgtgtcttcacatgggagcagggctggagarggagaggaaggaggggagagagaggrgagagacagggctctcgggtgtctcttcttacaaggacactaatcctatggatcaggaccccacctttatgacctcagttcagtgcagtcactcagttgtgtccgactcttcacaaccccatggactgcagcacaccaagcttccctgtccatcaccaactcctggagcttgctcaaactcatgtccatcgagtcagtgatgctatccaaccatctcatcccytgtcttccccatttcctccttatgacctcatttaaccttaattacctca

SEQ ID NO: 21961 - DNA, 600 bp, Bovine  MMBT01167
aggagccaaggctgtagtcatggaaagagtctggcagcaaatggaagaaagtcaggaaccccgtcactgggggcccctgggtccacaagcaaggtcctgaggatgcctgggagacaggcatgccccctgtctgtggcccctttatctttaggttggagaaaacgtgcttgctatggagcagcttcccctctgaagttcactgaaatattcaccagagatggtgggaggcagtgaggcagttggagggccccagagatcagccagctcaggactgtccccaaccacagggttagagggggwagccagggccagacagggagagactctctgggtcaaggaggccccaccagagtctgcatggactctgagccactggactcccaggcctgyacctgtyctgctaaactgggcagcccggacctctgcagggccttcccatcctgtctcacctcatcaagctgggyggaaacatacagtctgcgtcctaggtcatcaccttgacattycaygtatgaaaaacaggtggaaaaggaaaagtggctcatgccagaccacagctggtacctgacctrgcaggtttggggtccctttgcctagggc

SEQ ID NO: 21962 - DNA, 600 bp, Bovine  MMBT18735
attcaccagagatggtgggaggcagtgaggcagttggagggccccagagatcagccagctcaggactgtccccaaccacagggttagagggggwagccagggccagacagggagagactctctgggtcaaggaggccccaccagagtctgcatggactctgagccactggactcccaggcctgyacctgtyctgctaaactgggcagcccggacctctgcagggccttcccatcctgtctcacctcatcaagctgggyggaaacatacagtctgcgtcctaggtcatcaccttgacattycaygtatgaaaaacaggtggaaaaggaaaagtggctcatgccagaccacagctggtacctgacctrgcaggtttggggtccctttgcctagggctcacttcaccacatgcctgggtctccctaaggaaatgccccgagtctcagcccaagccaccccctcgtttccctcctggaagatgtgcagagcatccaaaggctaacccagaagacccctgcattgccatccctagccctggaggctgaatgtctttaccttcaaatgcccgggcagcatccacgaggtgggtccaatctaaccct

SEQ ID NO: 21963 - DNA, 600 bp, Bovine  MMBT18736
caccagagatggtgggaggcagtgaggcagttggagggccccagagatcagccagctcaggactgtccccaaccacagggttagagggggwagccagggccagacagggagagactctctgggtcaaggaggccccaccagagtctgcatggactctgagccactggactcccaggcctgyacctgtyctgctaaactgggcagcccggacctctgcagggccttcccatcctgtctcacctcatcaagctgggyggaaacatacagtctgcgtcctaggtcatcaccttgacattycaygtatgaaaaacaggtggaaaaggaaaagtggctcatgccagaccacagctggtacctgacctrgcaggtttggggtccctttgcctagggctcacttcaccacatgcctgggtctccctaaggaaatgccccgagtctcagcccaagccaccccctcgtttccctcctggaagatgtgcagagcatccaaaggctaacccagaagacccctgcattgccatccctagccctggaggctgaatgtctttaccttcaaatgcccgggcagcatccacgaggtgggtccaatctaaccctgtg

SEQ ID NO: 21964 - DNA, 600 bp, Bovine  MMBT16558
caggacacttcctgtatactagatataaacctgtgaacatataaatgcaatatggggtgaaaaaatacagaatgaaaagatctcttctagataaagggatcaagataatcatttttattttttaagtatatttaactggctctggaatcctaagtaggattagagtaggaaaaaaattaggggttgagacacaaagatattccaagaggtggaaacagtagtttcagagaaataggatgggttggggtaaaacttcacttcagtttggccttaaccttcagttcttgaggaggaagcatrggacagtggrcctggagagatagattaatatcatattagtattatcagttaaatgtaagtaataacttgtcttgttttggaaaggattgcaggttctttatgaaggtacagaagccttttttttggcagacttgaaacagggctatttctcacattcctatcggtaattgcctratggtgtgtagagatgaaattgaaaacctggaggcttgccttctcagggaakagtgtgccttgacacttcttactgaactgttggtttcagaagaaacaaattatttaagctaatatttctttctc

SEQ ID NO: 21965 - DNA, 600 bp, Bovine  MMBT12583
tgaaattgtcaacacagcagcagctgtgtaagggttaacccgtttcccatgctttttctccatgaagatgaactaacaaggttttgttctcttctaaaaaagattatttcagagcgtaggatgctttattatgattatacactattagtgttctcaattctataaatatatgctttgaaatatagcagtgaggtagactttcagcaccttatcaaccaagaaaggaagtatgtacctaaattaccatcaccacactgacaatttgcaactttaaattattcacaaagttyaaaagaagtygatcccaactttatggaaaatttaatatgaaaagtaatgtttttatcttatygcaaggaaatgtttccagttctaatactgaacacatactgaagaatgaaaatagcaaaatcccagagtgaaaaaaaaaaaaaaaatacaagtctcttttaacatttctgctctcagaagtgagcaggattaaaatgtatttccccaacaaccgttatttctcattaaaggaggggcacacacatgtgtatattaaagaaactatgagatcccccccacatacacacaccctttttcaacccctctgac

SEQ ID NO: 21966 - DNA, 600 bp, Bovine  MMBT09546
ttaaaaaaaactcaatacatacatttctaaaatagtcatttagctacaattatttcatttttctatatacaataaaccatttttttctatgcacaatagatttgagggctatgatacaccttgccacttactatgttcatttttttcaaacctctgttctatctttctcaaggtgagtttctaccttaaaaagtcatgrtaaggtctgtatgagattacatatgctatattcttagaagcatagtaaaacacacatggtaaaaatatcagtaatgtggattttgtgctgttcattttttwaattaactaaagttttaatttacagaaaatagagtagtgtttcatttctttgaaacratgaacctgttagcgtctgtttagtaaaatgactctgatttgtatttcaaagtttttcagttatccatatcaaacttgatcaatttaaacgaatcttttatgactatccttttcaaattatgcagaataaagttatctattagattaaaaatattcacatgagcttgtcatgattctttaggctgatsttatttgctatcagttattttaatcaatgaattctgcatgaaaaaatctgttgaa

SEQ ID NO: 21967 - DNA, 600 bp, Bovine  MMBT05496
gtgatggttcaaggcatagcaggaaagaagctagaagaataaaattcgaagccatggggatagaaaaggtagagaagaaaggagcgagaaattgacagaagtagtgaccagattgtacagctgtcagttaattaagaatttgaagcctgtcgtcatatcatcatctactttgggaaattctggttatcttttgtcttattttaggtcaaagaagaaagagagaaacctaaaaaagcatattcaattttcattcacccataaaaatattgtttttgatatggtttaaatctgtttgcaaartctcccatttcagtatttttaaaaagttcattaaaaggtgttgaggtaagcaaatctgatgtaaaactattacaaacccagcaccgtacactattttctagatttttgctaaaacaatgtctataaacaagaacctacagaatgaaggcctgccaaatatctataatctatatatatctatatatctataattgttacctccagaaacaatttgatatagcaaagtgccggaaaagaaaatggaactatttcctttaaacctcaacttaatttttaaaaaataaagtgctgaaactcttg

SEQ ID NO: 21968 - DNA, 600 bp, Bovine  MMBT02239
tttttgcaggttgtactgcctttactttttctgctcttagaataaaacccaaacatatgatcatagcctctaaggtcactattccagtctgttcaggctgctgcaataaaagaccacagcctgggtracttataaacaacaaaatattatttctcactgttttggagatggaagcctaagattagggtgccaacccggtccagtgaaggtcctcttctgggtcacagacttttctttgtatccttacatggaagaatagacaagggagctctctcttgaggctcttttataagcgtcctragtcctaatcccagagccctcatgatatgatcrcctcacgaaagcctcattttttaataccattgcccttgggggttagttttcaccacgtgaattttgaaggsacacactcaggccttaatagcctggtgttatctggctgaagcctctctattccatttcctctcatcacaactccttactatatgcattcaaaccagtctcctttcagctttataattttgccaagttttccctacctcagagcctttgtaattgctgttccgtctacctaaaatatttttcaacttttcaccacat

SEQ ID NO: 21969 - DNA, 558 bp, Bovine  MMBT20477
tcttttccaggagcgtkttcagatttgaggttacttctgccttagttctttgagtaaaagaaataagaatgcaaagctgacagtgctgtgaagaatgatgtgaatatgaatgcatttgtgtaagtgtaatcatttccactgtatgtcttttatcaccatgatgaaaataataatatcatattacatgtttgtgttgattatggagtttaggaattaagtcactgggtgacatgctaccatcttttgctgaagaccaaactcaaatcctgctctcatttaagtggccttttccagttactytagtgttctatgaactctctaaactgtgactttattttctatccttctcacaaaatccattatgtattccactagattgtacaattcatggggccaggccaggcctgacctgttcaccctgtctcagcttccagcacaggcttggcaaggtggttggttctaaatgtctattcattaaaggaatgatgatgttgacttgcagagtcatcattgcatcgttgcatctaattacattgtgagtgtgctctcttcatagga

SEQ ID NO: 21970 - DNA, 600 bp, Bovine  MMBT06798
ccccccattagaaatgtcacccctaattaggatacagatgacctcaggccctctcgcgggccccggcatccctgccaatggacatcctgccctgagtgggaccttctgctgccagcccagagctgtggaccagcagcctctcctgaaaacagctgctccttttgggctcccctggaagggtrgcccgttagctgagaggaagccaggccctgttaacatacagtgcacatgtacagcttaaccagcgtccagataatcttaccagacatatttgacgtggctgtttggagcctggtcagmgtgcagatcacttggctgatagcgctgtttgggaagctgagaaagtccagctccgtgtaaaatacctgtagtaagagaagtaagggggttttactagttgttttctggaaaacagcttcatgctacagtgatgtcatctgctcagaggcatctgtaaaatgctacagatccaaaatgatgtcacatctctggaagtaagtgtatagataatcattaaacattgcaatgctcttaacccaggtgatcttctattagctgcaagctgaaatatgaatgagctacagtccaagtacaggcggg

SEQ ID NO: 21971 - DNA, 600 bp, Bovine  MMBT17031
caaaggcaatatttgaaaagacaatgagaatttttcaaaactaattaaagataatcatctacagattaaagaagtccaaagaaactaaattcacacctagatacataaaaagaacttagaaaacaaaaacaaaaaacaaaacagattagcttcaaagaataatcatgagtctaacagcagacttaataagaacgaaggaagccataagccaatggaagggtatcttgactaatatcttccatgtactaaaagaaaagaactattcatcccagaattcttaagtcagagaaaatatctccygkgaatgagggtgaaataaagacattctccatcaggcaaaagtgcttgtttcccaccagcagactctcattaaaggaagttctaaaggaaataattcaagcagaaagaaagagatcccaaatgcatgctctgagatgtaacaggaaatgaagagcaccaaatacaacaattaaaataaaatatggggtctaaaaacaaccaaaatttaaaatatacgacaacagcattcgagggaaccaatggtgttaaaatattctaaggtctttgtgctatacaggaaacaaagacatgaattttaga

SEQ ID NO: 21972 - DNA, 600 bp, Bovine  MMBT18599
aacaagaatgttatttttttaattccagaacattttttttcctggccagaaatggattagggaatcaatctagccagtgcacctcttcaatcagacaggtccctgccatgtgggtatgctttagcacaaatgttycatgagtctctgagttcattcataaggcagatctccctaatgtcatattcattcactcagtgaatgatcattaaacctgtacaggtgctgtactatttagattataaacaatcctcgctcagaaggggtcacaatatagtgggaaattacaggagacacaggttygatccctgggttgggaagatcccctggagaaggaaatggctacctgytgaagtattcctgtctgggcagaggagcccggtgagctacagtctatagggtcacaagaattgggcccaacttakcgaactaaaccaccaccacatagtataaataaaaatcataataaaacttgattatgctgtaagaatattgtgaattaactgctaaagtgatgcaggagagggagcctgtaattgcctctgactcaggcaagatagggtagcgtcagcctagctcctttctgtgttagtcctacagcag

SEQ ID NO: 21973 - DNA, 600 bp, Bovine  MMBT10014
cttcttgactcaagttyaattctgtccatttaacaaagatgttttgagcagctgctttgtatccaggcctggacaaagccttgggaaagtgaagcatacaggatggggggtgcggggwggttctttcccacctgataataagtatccaactggaaagaaggaaatcacaaagcatataccagcttgagtatggtcaagatgatttcartaataaaatgtaaatttggaagttagtctgaagaggaatattgatgctggtaaagaaggaagaaagaggcaggactgctgttttttggacgyatggtagaaaattcagcacttttcactgcactcaatttctagctcttttctatcaagacttagctcaggaataacacaaaaactcccatggagcaactctatttatacttgagggtgcttcaatttcttatagtgaaaggaggaggaagaaagtggtataaaaaattctaatagttgtttcctttattttaggaaaacagggtaacggaaatgtggtcctctttcacctagttcatgaagttctaaaatggagtctctcctatattgatataaaaaaatcgataggcagggattttagca

SEQ ID NO: 21974 - DNA, 600 bp, Bovine  MMBT04720
tggagtgggttgccatttccttctcaaatgcgtgaaagtgaaaggtgaaagtgaagtcgctcagtcgtgtccgactcttagtgaccccatggactgccccctaccaggctcctctgtccatgggattttccaggcaagagtactggagtggggtaccattgctttctctggaatcttgctttaagtccgaatatttttgccatcagtttgtgtatctgttcagtattctgctgttttatttctgtttctatccttggtggcttgttataacctcagagcagtgaagaaaaaatatgtgastgtataacagcggtagagatcaggcaatccccttaagtatatttggcattgctctatctttaagcaatttgcccaacctgtataattacaccgcctctgctgggcaagggtttttcctaatcagcatcagtggactgtgtgggtctgaatgttggcgcaagctcagcatatttcatcaacacagtgatttccttggaggtgtgccatcatcaagatatcaaaacatcaagaagcagaaacatgctttcactgttagagcaaaatggagaaaattcatttaaaggagtccttaatctagaa

SEQ ID NO: 21975 - DNA, 600 bp, Bovine  MMBT03101
acacctacctcttggggtattgtgacagtgagtgagataatgtacaaagtgtttagtatcgggcatgaaacatggtaagtgaacaataaatggtggctgttatcactcttgatctaaacaacctctgcttcttgctctcacctccctagttcttgactcccccatcaatcttagagttagttttgatcactatctccctaaacctgcagcactttaaggtcaagatcttaatgtctatctgtggcatcctatttagttccctacatctaataaaaactgcatgctcaataaatgctgggyggtggaatgggactaatactctgacttagataaggtgtagtggggctgattccmgggctcctgagtcattacctacgatacaactcctctttaackgggcttctgattgagttccattctggtttcccagttctccagagaggtctaaacattttctccaccaaagacactgcagtcctatccctgaatcccatttcagtctggggctaaagcccaggaacaatcccaggcatcagtactctgcctcaggttctatatggcccatccactaatggatgacttaaactccaattcttttca

SEQ ID NO: 21976 - DNA, 598 bp, Bovine  MMBT05685
  misc_feature (1)..(87): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnctttttaaaaagatctttgtctagcatgacaccatctgatgttgtttgaagagttaatcttaacatatccatacactctttcaacctgggatcagacgttcgcaatcctgtagatttgagtgcctgtttttaaaaaaataagagtctgtaaatacatagtgcaaataatgtatatgcttattccaactacaagtttttaattcctgtatttaraaacttctacccaagacctgaatatatatatatggcatcttagtgtcactattaccctctttctggaaaagtttctcattgtttctttcatttcctttcattgattaccttgaaatgagcatgatgaaaatttgaaaataagagaaatagtgtcagtcagatgactttaagactacattgcaatatcaccgtatattgcttcatattactggtttttaaaagttaggatagaaaaatataaaaacttactgtaataaatttatgaacaggtattttctcttgtccttctgcaattgta

SEQ ID NO: 21977 - DNA, 598 bp, Bovine  MMBT10125
  misc_feature (1)..(193): n is any nucleotide
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagaaaaacccactatattatacccagtaaaggcaattgctaatcaagagatttaagacactttcatctttcacctcaaaaactgacctgttaaaaactgagttstgatactaaaattgggcagcatgatatatcaatttttattgtaarttaaacagtttcatttaagaagttagraagcaattacgatttggcgagtttttgtcaaagaacattttctccacaaataagtgacatggcacattatcggtgttaggtcaaaatgccctccttaaagtgtttcaatattaaagttaaatatttttttaagcggatttctttccagaatcttatgcatcaaatttctgtagcagcagcccaacatgagggatttactgaaggtttatttcaacaccaatctcat

SEQ ID NO: 21978 - DNA, 600 bp, Bovine  MMBT11544
tctgggagttggtgatggacaggtaagccaggtatgctgcggtccatggggttgcagagtcggatatgacagtgaccgaaatgaactgaattgaactgaactaagttgttgaaattatgcatttattgtggtaatgtttttttaatctatctctttatgtatcaaatattcaaaatatttcttaaatctttatatttgtgtgttttagtaaatacattttcattggcctaatagattattgactctggacaaagtagggcagggatttctgctgttaatattttgccaggatccctttayggtgtgttcccttcctctagatcagtggaacttatatttcctatataaactcatagaaggaaaagtaataatgtgtcacttagagaaaatatacttctctaggctaaaaagaattttgacacagaaaccccataagggtcagcaaatatgggctctaacatatggtatctttggcagactgaaagtgtatcaccttgaattgtggctttgtcattatacttctcaatgacccatatcagatctactatatcacaaagtcaggggaagggtaggggcctgagaatccttatatttaataca

SEQ ID NO: 21979 - DNA, 600 bp, Bovine  MMBT05641
gacaacacagccagygtgggacagaccactatctcttcatctgagcatcagatacagtagctaagagccacactttcaaaaaccaagtaatcttcaaaygagagtcatgatcaggatgatgagatgctactattaggagggcacagccgattcaaactgaccattttaccttcactctgagttacatacccattgtttgaaataataagcaaaattaccagcacaatttaaatcattttatttcaggttttgaccaaccgaagttgcaacagttattcctcacactggaggactaccagygcgtcctagtcttgaagaaaggttgcaaggrtctcttaaatctgctataaggttcctaatactgctccttctagagtcaaagtgtgagtcaagttctgcctcgtactgatatttagaaatggtcagaagcatgttaacttttttttactcaagattattacaaatgtctgcagaaggcagataaaactgtggaaaagctttatatgttctgatttcttaatgttctttggagatcaaagcctgagtttcaggataggaattaacagggagtttattacaaatccagtcattgtgattaat

SEQ ID NO: 21980 - DNA, 600 bp, Bovine  MMBT04314
tgtgtggttaatagtccagtctcatatttgcgtgggaccagctgtcaaagatggcaccgtggggaatgcactataattttaagacccgttgcagagtcacatatgtccataaatctgcatcactagaatgcttatgggaagacagtcatcaccagatttgaaaataaatcctttattgctttcattttgaacttcactctttacttgactcaaattatctttatcagataaaggatgaggggccctcataatgagtgaacaagtttttagaagccatctcatttgcacaacttcttaacrttcttgccagascccattttgaacacagccagtgcaattatctccattcccttggagagatatcttcttgacctagtcaaatccacatcttgggtgagtttttcaatacacagaactttgagggaaaatattgggcatgttctacaaacctctctgagcctccaggacttcatctgtgggcagaaaatactttcatgtgggaaaattagacaagatacaggaagaaaggtggtcagtttattatcccttcagcgtgagttccttctccaagcgtggccgtggtatcgctgtttaaaatcg

SEQ ID NO: 21981 - DNA, 600 bp, Bovine  MMBT12560
agtccagtctcatatttgcgtgggaccagctgtcaaagatggcaccgtggggaatgcactataattttaagacccgttgcagagtcacatatgtccataaatctgcatcactagaatgcttatgggaagacagtcatcaccagatttgaaaataaatcctttattgctttcattttgaacttcactctttacttgactcaaattatctttatcagataaaggatgaggggccctcataatgagtgaacaagtttttagaagccatctcatttgcacaacttcttaacrttcttgccagascccattttgaacacagccagtgcaattatctccattcccttggagagatatcttcttgacctagtcaaatccacatcttgggtgagtttttcaatacacagaactttgagggaaaatattgggcatgttctacaaacctctctgagcctccaggacttcatctgtgggcagaaaatactttcatgtgggaaaattagacaagatacaggaagaaaggtggtcagtttattatcccttcagcgtgagttccttctccaagcgtggccgtggtatcgctgtttaaaatcggtcaccggcagc

SEQ ID NO: 21982 - DNA, 574 bp, Bovine  MMBT10670
ctcccaaactcttttatctagaagtgaacattttaaaatatggccctagagatcaaagtgcccattcttacttattttattagatccagatatgttgcctttatcctttaaaaagcactgactttccatttaattcagttttactcctctttaaatgtgtgattctctaccttaaataacctcgggatgttttcctagaaatgcagtcaaccatctgaaagtaatttttctgtctggtatgtggggagtttgatgggtgtatgtgacatgcttataacttaacattccttactatactcrttttcatcaaaatattggctaaaatattcagaacagatgtgtatttgtgtgtgcgtgtatttttctagagaaagcttcttttgtgagcaattaaaaggtacatcagacataaagagaaatttctctgcagccttttttcccccagttctttggcaactgtaatagagaagattacttctcagatgctgtatatcatcctgaaacgtaatgattttagcatgttggggccagagttttaaaaatgtaggggagggatacgactaaaaaggcagca

SEQ ID NO: 21983 - DNA, 25 bp, Artificial sequence
  Extension Primer
acaggctaatatgttaaatgcatca

SEQ ID NO: 21984 - DNA, 25 bp, Artificial sequence
  Extension Primer
ctacttcgctagacttgggactatt

SEQ ID NO: 21985 - DNA, 25 bp, Artificial sequence
  Extension Primer
tcactattgcaggtatccagaattt

SEQ ID NO: 21986 - DNA, 25 bp, Artificial sequence
  Extension Primer
ttcacaaaagacaatgaaggctaca

SEQ ID NO: 21987 - DNA, 25 bp, Artificial sequence
  Extension Primer
ttccttcatgaaacagatggtctcc

SEQ ID NO: 21988 - DNA, 25 bp, Artificial sequence
  Extension Primer
gtggtggcccttttccttactccaa

SEQ ID NO: 21989 - DNA, 22 bp, Artificial sequence
  Extension Primer
gggtcttcttctccttctcaga

SEQ ID NO: 21990 - DNA, 25 bp, Artificial sequence
  Extension Primer
accatctgaattccttagtgaaaga

SEQ ID NO: 21991 - DNA, 25 bp, Artificial sequence
  Extension Primer
catatatgtcagagtccaattatgc

SEQ ID NO: 21992 - DNA, 25 bp, Artificial sequence
  Extension Primer
tatgtatctgaggacgagatgtgtc

SEQ ID NO: 21993 - DNA, 25 bp, Artificial sequence
  Extension Primer
cagtattcaggcttctgaaggtgga

SEQ ID NO: 21994 - DNA, 22 bp, Artificial sequence
  Extension Primer
gtccagaaggcattgtttctcc

SEQ ID NO: 21995 - DNA, 25 bp, Artificial sequence
  Extension Primer
ttgagagggttttaagtgcagagtg

SEQ ID NO: 21996 - DNA, 25 bp, Artificial sequence
  Extension Primer
ttgaggtctttcaatatacaattaa

SEQ ID NO: 21997 - DNA, 25 bp, Artificial sequence
  Extension Primer
agagagaaagcaaaagagaggtggg

SEQ ID NO: 21998 - DNA, 25 bp, Artificial sequence
  Extension Primer
gtatctggagtaggccttcctttcc

SEQ ID NO: 21999 - DNA, 25 bp, Artificial sequence
  Extension Primer
gggaggcgagaacaagagatggaga

SEQ ID NO: 22000 - DNA, 25 bp, Artificial sequence
  Extension Primer
ttctcccaatttaaagagctttgta

SEQ ID NO: 22001 - DNA, 25 bp, Artificial sequence
  Extension Primer
cgccggctgactcgtcagcagactc

SEQ ID NO: 22002 - DNA, 25 bp, Artificial sequence
  Extension Primer
gcagatgtcttgcttaaacatgaag

SEQ ID NO: 22003 - DNA, 22 bp, Artificial sequence
  Extension Primer
gtagaaccttarcatctgtctg

SEQ ID NO: 22004 - DNA, 25 bp, Artificial sequence
  Extension Primer
agatatgatcctgaagaggtgaaac

SEQ ID NO: 22005 - DNA, 25 bp, Artificial sequence
  Extension Primer
tgtgcttagaacagtatataagtaa

SEQ ID NO: 22006 - DNA, 25 bp, Artificial sequence
  Extension Primer
agatattcccaacccagaggtcaaa

SEQ ID NO: 22007 - DNA, 25 bp, Artificial sequence
  Extension Primer
atctcgattttatgcgcagttcttc

SEQ ID NO: 22008 - DNA, 25 bp, Artificial sequence
  Extension Primer
cctctcattgtctttggtgttctct

SEQ ID NO: 22009 - DNA, 25 bp, Artificial sequence
  Extension Primer
atgagctcacatttgccaatgaaca

SEQ ID NO: 22010 - DNA, 25 bp, Artificial sequence
  Extension Primer
cttcgtatcatcctacacactcagg

SEQ ID NO: 22011 - DNA, 25 bp, Artificial sequence
  Extension Primer
agwgccagtggtacaataataacat

SEQ ID NO: 22012 - DNA, 25 bp, Artificial sequence
  Extension Primer
tgctcttctccttattagaaacaca

SEQ ID NO: 22013 - DNA, 25 bp, Artificial sequence
  Extension Primer
taaacactgataaacaggtgactga

SEQ ID NO: 22014 - DNA, 25 bp, Artificial sequence
  Extension Primer
agagatttgggagtgagcagaatgt

SEQ ID NO: 22015 - DNA, 25 bp, Artificial sequence
  Extension Primer
cgtggtcagtgccttaaattagcct

SEQ ID NO: 22016 - DNA, 25 bp, Artificial sequence
  Extension Primer
gcccaaggtcacagagttggtaggt

SEQ ID NO: 22017 - DNA, 25 bp, Artificial sequence
  Extension Primer
aagcaacaaatggtacccttaaaat

SEQ ID NO: 22018 - DNA, 25 bp, Artificial sequence
  Extension Primer
caagcaggtggttcacatctaattt

SEQ ID NO: 22019 - DNA, 25 bp, Artificial sequence
  Extension Primer
taatgaagagaatggtctataaagt

SEQ ID NO: 22020 - DNA, 25 bp, Artificial sequence
  Extension Primer
ctattcgatgctcagttagacacac

SEQ ID NO: 22021 - DNA, 25 bp, Artificial sequence
  Extension Primer
tggctgacagtgagggtgggcccct

SEQ ID NO: 22022 - DNA, 25 bp, Artificial sequence
  Extension Primer
cttccagctttaacattctatgact

SEQ ID NO: 22023 - DNA, 25 bp, Artificial sequence
  Extension Primer
gctgattaggaaacagtgtctaagg

SEQ ID NO: 22024 - DNA, 25 bp, Artificial sequence
  Extension Primer
ttaatgaaggracgaaggcgtccca

SEQ ID NO: 22025 - DNA, 25 bp, Artificial sequence
  Extension Primer
gctcaccatctttggaggtatatca

SEQ ID NO: 22026 - DNA, 25 bp, Artificial sequence
  Extension Primer
sttcagatatgttttcttccccagc

SEQ ID NO: 22027 - DNA, 25 bp, Artificial sequence
  Extension Primer
atttaaacaagaatatttctttact

SEQ ID NO: 22028 - DNA, 25 bp, Artificial sequence
  Extension Primer
aggccctgactattcccatgtcctc

SEQ ID NO: 22029 - DNA, 25 bp, Artificial sequence
  Extension Primer
ggtttgttgtcctcagtaatctcat

SEQ ID NO: 22030 - DNA, 25 bp, Artificial sequence
  Extension Primer
tgtcttgattctactcagttgctca

SEQ ID NO: 22031 - DNA, 25 bp, Artificial sequence
  Extension Primer
atgataatgtatgaatctcgttgca

SEQ ID NO: 22032 - DNA, 25 bp, Artificial sequence
  Extension Primer
gatatattaatgaactagatatagt

SEQ ID NO: 22033 - DNA, 25 bp, Artificial sequence
  Extension Primer
aaagccattaaggacaaaagattgt

SEQ ID NO: 22034 - DNA, 25 bp, Artificial sequence
  Extension Primer
ctgtataatctttacagaaaaatga

SEQ ID NO: 22035 - DNA, 25 bp, Artificial sequence
  Extension Primer
ccagtggtctcagaggccctgggag

SEQ ID NO: 22036 - DNA, 22 bp, Artificial sequence
  Extension Primer
gcctattcatatcaccatgctt

SEQ ID NO: 22037 - DNA, 25 bp, Artificial sequence
  Extension Primer
cttaaagagacatctaactaatgct

SEQ ID NO: 22038 - DNA, 25 bp, Artificial sequence
  Extension Primer
taaccactggaccaccagggaagtc

SEQ ID NO: 22039 - DNA, 25 bp, Artificial sequence
  Extension Primer
agccaggggggctatatatagtcca

SEQ ID NO: 22040 - DNA, 25 bp, Artificial sequence
  Extension Primer
atatcttagtagtagaaattataca

SEQ ID NO: 22041 - DNA, 25 bp, Artificial sequence
  Extension Primer
aaagtcaggcaagaggttgactttg

SEQ ID NO: 22042 - DNA, 25 bp, Artificial sequence
  Extension Primer
aggtttccttccctagaaccagatt

SEQ ID NO: 22043 - DNA, 25 bp, Artificial sequence
  Extension Primer
ggcccgcctggacctcacctccaac

SEQ ID NO: 22044 - DNA, 25 bp, Artificial sequence
  Extension Primer
agagaaaacaagaaatatgtaaaga

SEQ ID NO: 22045 - DNA, 25 bp, Artificial sequence
  Extension Primer
gctcaaagtctgctctgtcttaact

SEQ ID NO: 22046 - DNA, 25 bp, Artificial sequence
  Extension Primer
attagaacacaaatgttcaaccttt

SEQ ID NO: 22047 - DNA, 25 bp, Artificial sequence
  Extension Primer
gtggagacagctttgccagccccgc

SEQ ID NO: 22048 - DNA, 25 bp, Artificial sequence
  Extension Primer
tgtttagtgcttattttattacctc

SEQ ID NO: 22049 - DNA, 25 bp, Artificial sequence
  Extension Primer
gtgaggacagtaaatatgacaccat

SEQ ID NO: 22050 - DNA, 25 bp, Artificial sequence
  Extension Primer
agtggaatacttaataatcaggctt

SEQ ID NO: 22051 - DNA, 25 bp, Artificial sequence
  Extension Primer
aatgaatgagtgaacacatgcataa

SEQ ID NO: 22052 - DNA, 25 bp, Artificial sequence
  Extension Primer
gctgcttcctctagakcttgtggac

SEQ ID NO: 22053 - DNA, 25 bp, Artificial sequence
  Extension Primer
gtgtctgagtttcagctacaaacca

SEQ ID NO: 22054 - DNA, 25 bp, Artificial sequence
  Extension Primer
cacttagcctaaaaatgtggataaa

SEQ ID NO: 22055 - DNA, 25 bp, Artificial sequence
  Extension Primer
cacatatcctgagagtaaccttgaa

SEQ ID NO: 22056 - DNA, 25 bp, Artificial sequence
  Extension Primer
gacacctagcattagacacataacc

SEQ ID NO: 22057 - DNA, 25 bp, Artificial sequence
  Extension Primer
aaaatgtatttcgtacataggtaac

SEQ ID NO: 22058 - DNA, 25 bp, Artificial sequence
  Extension Primer
tagacgctggcctggtaggaagtgg

SEQ ID NO: 22059 - DNA, 25 bp, Artificial sequence
  Extension Primer
taaagcagaagcaggtgaaaaaatt

SEQ ID NO: 22060 - DNA, 25 bp, Artificial sequence
  Extension Primer
attctgcagtattatgyttctcctg

SEQ ID NO: 22061 - DNA, 25 bp, Artificial sequence
  Extension Primer
ctccaatttgaaacttcacagactt

SEQ ID NO: 22062 - DNA, 25 bp, Artificial sequence
  Extension Primer
gaacaatcagtcccagacaacatgc

SEQ ID NO: 22063 - DNA, 25 bp, Artificial sequence
  Extension Primer
caggtagaaattcacaatggaaatt

SEQ ID NO: 22064 - DNA, 25 bp, Artificial sequence
  Extension Primer
attttaaggagctcacaacacagta

SEQ ID NO: 22065 - DNA, 25 bp, Artificial sequence
  Extension Primer
gtgcaggaaaaaaaaaaaaaaaaga

SEQ ID NO: 22066 - DNA, 25 bp, Artificial sequence
  Extension Primer
atgatagcacatacctcataaggtg

SEQ ID NO: 22067 - DNA, 25 bp, Artificial sequence
  Extension Primer
ccctccccttcactcccactcagac

SEQ ID NO: 22068 - DNA, 25 bp, Artificial sequence
  Extension Primer
taacttcaatcataatttctataca

SEQ ID NO: 22069 - DNA, 25 bp, Artificial sequence
  Extension Primer
catcactcagccactgcttctctaa

SEQ ID NO: 22070 - DNA, 25 bp, Artificial sequence
  Extension Primer
ctcctgtgagaggagagcagaagac

SEQ ID NO: 22071 - DNA, 25 bp, Artificial sequence
  Extension Primer
tcctacagctgaaccctggggtagc

SEQ ID NO: 22072 - DNA, 25 bp, Artificial sequence
  Extension Primer
aaaaggtgctccttgaacacacaca

SEQ ID NO: 22073 - DNA, 25 bp, Artificial sequence
  Extension Primer
gagtgaacacagactttggagtccc

SEQ ID NO: 22074 - DNA, 25 bp, Artificial sequence
  Extension Primer
cccttctttacttcatttccattac

SEQ ID NO: 22075 - DNA, 25 bp, Artificial sequence
  Extension Primer
tcattaagaatcatgtgctgagtat

SEQ ID NO: 22076 - DNA, 25 bp, Artificial sequence
  Extension Primer
tgygggagcgataacacggttgcct

SEQ ID NO: 22077 - DNA, 25 bp, Artificial sequence
  Extension Primer
gcaagctagaccaggaacagtgtta

SEQ ID NO: 22078 - DNA, 25 bp, Artificial sequence
  Extension Primer
tgggaaaaggttgaattaggaaata

SEQ ID NO: 22079 - DNA, 25 bp, Artificial sequence
  Extension Primer
tacatcatattttaatacagacctc

SEQ ID NO: 22080 - DNA, 25 bp, Artificial sequence
  Extension Primer
ccagagtcagtcctaacgccagcct

SEQ ID NO: 22081 - DNA, 25 bp, Artificial sequence
  Extension Primer
cgggcttctctgatacctttttatt

SEQ ID NO: 22082 - DNA, 25 bp, Artificial sequence
  Extension Primer
tgggctgaagggagcgttgagtgta

SEQ ID NO: 22083 - DNA, 25 bp, Artificial sequence
  Extension Primer
caagcattcaagctctggttgttct

SEQ ID NO: 22084 - DNA, 25 bp, Artificial sequence
  Extension Primer
ttycagcatttggaagaactcaaaa

SEQ ID NO: 22085 - DNA, 25 bp, Artificial sequence
  Extension Primer
gtctcccaacccagtacatcaaatc

SEQ ID NO: 22086 - DNA, 25 bp, Artificial sequence
  Extension Primer
acactacatttcacaaatacacaca

SEQ ID NO: 22087 - DNA, 25 bp, Artificial sequence
  Extension Primer
ttgagcaaatatttatagcacatct

SEQ ID NO: 22088 - DNA, 25 bp, Artificial sequence
  Extension Primer
acaaggcaatagatatgtttggcag

SEQ ID NO: 22089 - DNA, 25 bp, Artificial sequence
  Extension Primer
catgtaaagactatggtgtccctta

SEQ ID NO: 22090 - DNA, 25 bp, Artificial sequence
  Extension Primer
atgttatgaactaactttcaatggg

SEQ ID NO: 22091 - DNA, 22 bp, Artificial sequence
  Extension Primer
ggaacaggtggaagagtagaaa

SEQ ID NO: 22092 - DNA, 25 bp, Artificial sequence
  Extension Primer
ttcagcagccaaaactgcgacccca

SEQ ID NO: 22093 - DNA, 25 bp, Artificial sequence
  Extension Primer
tcaatcctaaatttaagctgtattt

SEQ ID NO: 22094 - DNA, 25 bp, Artificial sequence
  Extension Primer
gatcccctcacattcagtaaaagca

SEQ ID NO: 22095 - DNA, 25 bp, Artificial sequence
  Extension Primer
ggcccaccagtcrtctgccagccca

SEQ ID NO: 22096 - DNA, 25 bp, Artificial sequence
  Extension Primer
ctagatattttcattgtggttctgt

SEQ ID NO: 22097 - DNA, 25 bp, Artificial sequence
  Extension Primer
gtaaaacttataacatagagcagaa

SEQ ID NO: 22098 - DNA, 25 bp, Artificial sequence
  Extension Primer
aaagaccataagttctcaaagatga

SEQ ID NO: 22099 - DNA, 25 bp, Artificial sequence
  Extension Primer
tggacatatttttccaggctttcag

SEQ ID NO: 22100 - DNA, 25 bp, Artificial sequence
  Extension Primer
aagcaggtgaatcagtcagcacatc

SEQ ID NO: 22101 - DNA, 25 bp, Artificial sequence
  Extension Primer
ggggatgtggaggatgcagatcttt

SEQ ID NO: 22102 - DNA, 25 bp, Artificial sequence
  Extension Primer
tcctcatccataaaagtggaaaacc

SEQ ID NO: 22103 - DNA, 25 bp, Artificial sequence
  Extension Primer
trtattgtgtgtattttgtctggtc

SEQ ID NO: 22104 - DNA, 25 bp, Artificial sequence
  Extension Primer
actccactgtttgtacactttaggy

SEQ ID NO: 22105 - DNA, 25 bp, Artificial sequence
  Extension Primer
actctgtaaacacacacagcaaact

SEQ ID NO: 22106 - DNA, 25 bp, Artificial sequence
  Extension Primer
agaactaatcacaccgaacggcgta

SEQ ID NO: 22107 - DNA, 25 bp, Artificial sequence
  Extension Primer
agagggatatcatttttcgtaacag

SEQ ID NO: 22108 - DNA, 25 bp, Artificial sequence
  Extension Primer
aaaagattaattttcaacttctgat

SEQ ID NO: 22109 - DNA, 25 bp, Artificial sequence
  Extension Primer
gtgctcacaaactgcaactcttttc

SEQ ID NO: 22110 - DNA, 25 bp, Artificial sequence
  Extension Primer
ttgagtgtagcctgtgggttataga

SEQ ID NO: 22111 - DNA, 25 bp, Artificial sequence
  Extension Primer
cttcacctcttgtattgagatgata

SEQ ID NO: 22112 - DNA, 25 bp, Artificial sequence
  Extension Primer
ttttgtggatatatatggattgttt

SEQ ID NO: 22113 - DNA, 25 bp, Artificial sequence
  Extension Primer
tggtatattttactttagttttatg

SEQ ID NO: 22114 - DNA, 25 bp, Artificial sequence
  Extension Primer
atcaataaagatttggcgagctttt

SEQ ID NO: 22115 - DNA, 25 bp, Artificial sequence
  Extension Primer
agagtgaggtcaagtgttgctatca

SEQ ID NO: 22116 - DNA, 25 bp, Artificial sequence
  Extension Primer
tctgcattcccttccattttaagtc

SEQ ID NO: 22117 - DNA, 25 bp, Artificial sequence
  Extension Primer
gagtctcctgacaggttagtggggc

SEQ ID NO: 22118 - DNA, 25 bp, Artificial sequence
  Extension Primer
gtgccaggtattggtgatatacaat

SEQ ID NO: 22119 - DNA, 25 bp, Artificial sequence
  Extension Primer
ccagtctcccctgccacacacagac

SEQ ID NO: 22120 - DNA, 25 bp, Artificial sequence
  Extension Primer
atgactcttgatatttttattttat

SEQ ID NO: 22121 - DNA, 25 bp, Artificial sequence
  Extension Primer
tgttccctgcaagtaaaagcccatc

SEQ ID NO: 22122 - DNA, 25 bp, Artificial sequence
  Extension Primer
tgctcaaaagatgaccttgatgtat

SEQ ID NO: 22123 - DNA, 25 bp, Artificial sequence
  Extension Primer
gaccttgatgtatrttacarttttc

SEQ ID NO: 22124 - DNA, 25 bp, Artificial sequence
  Extension Primer
agttaagataatgaacatatccatc

SEQ ID NO: 22125 - DNA, 25 bp, Artificial sequence
  Extension Primer
ttaaaaataaagggatattaagaaa

SEQ ID NO: 22126 - DNA, 25 bp, Artificial sequence
  Extension Primer
aatgcaaagaatactgtagcctgaa

SEQ ID NO: 22127 - DNA, 22 bp, Artificial sequence
  Extension Primer
aggcaggtacaatccccggctc

SEQ ID NO: 22128 - DNA, 25 bp, Artificial sequence
  Extension Primer
taaaagaatataaactatatacacc

SEQ ID NO: 22129 - DNA, 25 bp, Artificial sequence
  Extension Primer
cacatagacacacacacagatgaaa

SEQ ID NO: 22130 - DNA, 25 bp, Artificial sequence
  Extension Primer
ccgagagaaccttctcctctgtggg

SEQ ID NO: 22131 - DNA, 25 bp, Artificial sequence
  Extension Primer
ggaatttgtcctggaaacacatctt

SEQ ID NO: 22132 - DNA, 25 bp, Artificial sequence
  Extension Primer
tcttaaaatatttttatacagtaga

SEQ ID NO: 22133 - DNA, 25 bp, Artificial sequence
  Extension Primer
tcccccgttcaaagcccggttgctg

SEQ ID NO: 22134 - DNA, 25 bp, Artificial sequence
  Extension Primer
aagagctggagaaactatacaagag

SEQ ID NO: 22135 - DNA, 25 bp, Artificial sequence
  Extension Primer
aatactcaggggcttattatatcta

SEQ ID NO: 22136 - DNA, 25 bp, Artificial sequence
  Extension Primer
aggagaaaagttatagatctcccaa

SEQ ID NO: 22137 - DNA, 25 bp, Artificial sequence
  Extension Primer
gggtaggggaggtgctgtgtctatg

SEQ ID NO: 22138 - DNA, 25 bp, Artificial sequence
  Extension Primer
tcttaaaattaaaaaaaaaaaaagt

SEQ ID NO: 22139 - DNA, 25 bp, Artificial sequence
  Extension Primer
agaatagattaatgtgagaatgaat

SEQ ID NO: 22140 - DNA, 25 bp, Artificial sequence
  Extension Primer
actcagcaagttttacagggtagaa

SEQ ID NO: 22141 - DNA, 25 bp, Artificial sequence
  Extension Primer
tgctttctgcagtcatttttcaaaa

SEQ ID NO: 22142 - DNA, 25 bp, Artificial sequence
  Extension Primer
tacactgctactccatatgaagatt

SEQ ID NO: 22143 - DNA, 25 bp, Artificial sequence
  Extension Primer
cccacatctccccagcttcaaacac

SEQ ID NO: 22144 - DNA, 25 bp, Artificial sequence
  Extension Primer
cagtaagtctccactttgcttttta

SEQ ID NO: 22145 - DNA, 25 bp, Artificial sequence
  Extension Primer
tggttatccctggtgctgtttccct

SEQ ID NO: 22146 - DNA, 25 bp, Artificial sequence
  Extension Primer
gcctcggcgtgtgaatcatttaaca

SEQ ID NO: 22147 - DNA, 25 bp, Artificial sequence
  Extension Primer
gcaggacatttgacaagttactcaa

SEQ ID NO: 22148 - DNA, 25 bp, Artificial sequence
  Extension Primer
atattataaattcgaataacctctt

SEQ ID NO: 22149 - DNA, 25 bp, Artificial sequence
  Extension Primer
agcatccttgtgatccaggggccta

SEQ ID NO: 22150 - DNA, 25 bp, Artificial sequence
  Extension Primer
tgctgctcaggatgctacratgcct

SEQ ID NO: 22151 - DNA, 25 bp, Artificial sequence
  Extension Primer
ctaggaaagggcaggacaggaaaaa

SEQ ID NO: 22152 - DNA, 25 bp, Artificial sequence
  Extension Primer
gcaattagtgacagggaagcactta

SEQ ID NO: 22153 - DNA, 25 bp, Artificial sequence
  Extension Primer
ggcctgcttggtttattgcctcttg

SEQ ID NO: 22154 - DNA, 25 bp, Artificial sequence
  Extension Primer
taaaaatgcataaagtaaaagtgac

SEQ ID NO: 22155 - DNA, 25 bp, Artificial sequence
  Extension Primer
ctcctggccactagaggggggtagc

SEQ ID NO: 22156 - DNA, 25 bp, Artificial sequence
  Extension Primer
gggggtggatttcaagcatccttac

SEQ ID NO: 22157 - DNA, 25 bp, Artificial sequence
  Extension Primer
agtaaaccaaatcaaaagagggcaa

SEQ ID NO: 22158 - DNA, 25 bp, Artificial sequence
  Extension Primer
tatttaattgaaaagaattttgaag

SEQ ID NO: 22159 - DNA, 25 bp, Artificial sequence
  Extension Primer
aatagagtcttgtgttccacgctcc

SEQ ID NO: 22160 - DNA, 25 bp, Artificial sequence
  Extension Primer
cactcaacagtgctttcaaagggga

SEQ ID NO: 22161 - DNA, 25 bp, Artificial sequence
  Extension Primer
ttgagatccatacggtgattcaaag

SEQ ID NO: 22162 - DNA, 25 bp, Artificial sequence
  Extension Primer
gatacaatactacaaacgcggtttc

SEQ ID NO: 22163 - DNA, 25 bp, Artificial sequence
  Extension Primer
tgacatcatgactttgtgccttgta

SEQ ID NO: 22164 - DNA, 25 bp, Artificial sequence
  Extension Primer
acagactggcagcttgaattttttt

SEQ ID NO: 22165 - DNA, 25 bp, Artificial sequence
  Extension Primer
gcccatagttctcagttaccgaccc

SEQ ID NO: 22166 - DNA, 22 bp, Artificial sequence
  Extension Primer
gtttgcttggttggttcctcat

SEQ ID NO: 22167 - DNA, 25 bp, Artificial sequence
  Extension Primer
gtaaattctgcatgtaaatgtcttc

SEQ ID NO: 22168 - DNA, 25 bp, Artificial sequence
  Extension Primer
taataatattaagtctaaaatatgt

SEQ ID NO: 22169 - DNA, 25 bp, Artificial sequence
  Extension Primer
ttaaatcttagattaaggcaatatt

SEQ ID NO: 22170 - DNA, 25 bp, Artificial sequence
  Extension Primer
atcccctctaacagtgctcctgtct

SEQ ID NO: 22171 - DNA, 25 bp, Artificial sequence
  Extension Primer
gtttgcagacttcacttccaatgtc

SEQ ID NO: 22172 - DNA, 25 bp, Artificial sequence
  Extension Primer
aactccttatacccaagcacttatg

SEQ ID NO: 22173 - DNA, 25 bp, Artificial sequence
  Extension Primer
accgcatcaacaaggtgcagaaggt

SEQ ID NO: 22174 - DNA, 25 bp, Artificial sequence
  Extension Primer
aagctgtgtaaactggtcgtgagca

SEQ ID NO: 22175 - DNA, 25 bp, Artificial sequence
  Extension Primer
attatacctaccatatgagccagca

SEQ ID NO: 22176 - DNA, 22 bp, Artificial sequence
  Extension Primer
tcgtctgsgaaataacgtgaca

SEQ ID NO: 22177 - DNA, 25 bp, Artificial sequence
  Extension Primer
ccctcctccctcctccctccccata

SEQ ID NO: 22178 - DNA, 25 bp, Artificial sequence
  Extension Primer
gtttctagagctgatgaagaaaact

SEQ ID NO: 22179 - DNA, 25 bp, Artificial sequence
  Extension Primer
ctggcactcmaagcccccactctat

SEQ ID NO: 22180 - DNA, 25 bp, Artificial sequence
  Extension Primer
tcttcgaatatatgccagtattcat

SEQ ID NO: 22181 - DNA, 25 bp, Artificial sequence
  Extension Primer
aatagaaaagaatacctctctggca

SEQ ID NO: 22182 - DNA, 25 bp, Artificial sequence
  Extension Primer
caagaatgcctgatttttttccttt

SEQ ID NO: 22183 - DNA, 25 bp, Artificial sequence
  Extension Primer
ctgataaaaggaaaggaaaattaac

SEQ ID NO: 22184 - DNA, 25 bp, Artificial sequence
  Extension Primer
acaaaaagcagcttaagatcttcta

SEQ ID NO: 22185 - DNA, 25 bp, Artificial sequence
  Extension Primer
cactcttactccacacactttgatt

SEQ ID NO: 22186 - DNA, 25 bp, Artificial sequence
  Extension Primer
tgttcatcgattggaagatagttga

SEQ ID NO: 22187 - DNA, 25 bp, Artificial sequence
  Extension Primer
gatgactctccgtaaagaattactt

SEQ ID NO: 22188 - DNA, 25 bp, Artificial sequence
  Extension Primer
tactgtgtgatttaagaaatggaaa

SEQ ID NO: 22189 - DNA, 25 bp, Artificial sequence
  Extension Primer
cttttaagaactacagagctgagat

SEQ ID NO: 22190 - DNA, 25 bp, Artificial sequence
  Extension Primer
atctttacaaattacacggtattcc

SEQ ID NO: 22191 - DNA, 25 bp, Artificial sequence
  Extension Primer
tatggtccccatcccctcttcttga

SEQ ID NO: 22192 - DNA, 25 bp, Artificial sequence
  Extension Primer
tgtctatcagctacccaaagctaga

SEQ ID NO: 22193 - DNA, 25 bp, Artificial sequence
  Extension Primer
gacttcctrctttgagcaagtctct

SEQ ID NO: 22194 - DNA, 25 bp, Artificial sequence
  Extension Primer
aaaaaatggaaagcggaacattaac

SEQ ID NO: 22195 - DNA, 25 bp, Artificial sequence
  Extension Primer
ctgtgcagtccatcctgctggtgac

SEQ ID NO: 22196 - DNA, 25 bp, Artificial sequence
  Extension Primer
attttgtacagaaaaatggacgaca

SEQ ID NO: 22197 - DNA, 25 bp, Artificial sequence
  Extension Primer
tttctcagttctcccatgctttcca

SEQ ID NO: 22198 - DNA, 25 bp, Artificial sequence
  Extension Primer
attctggccaaggtgctgagagatc

SEQ ID NO: 22199 - DNA, 25 bp, Artificial sequence
  Extension Primer
tcagcgggatcgtgtatgtgattga

SEQ ID NO: 22200 - DNA, 25 bp, Artificial sequence
  Extension Primer
tacttaagacccctcctcaccttct

SEQ ID NO: 22201 - DNA, 25 bp, Artificial sequence
  Extension Primer
taatgaaaacatcctgttactcata

SEQ ID NO: 22202 - DNA, 25 bp, Artificial sequence
  Extension Primer
agtcagtgcagtgatggtgtgagtc

SEQ ID NO: 22203 - DNA, 25 bp, Artificial sequence
  Extension Primer
ttgggaaaagattctgctgtcatgg

SEQ ID NO: 22204 - DNA, 25 bp, Artificial sequence
  Extension Primer
acactaaatctaccttgatattcaa

SEQ ID NO: 22205 - DNA, 25 bp, Artificial sequence
  Extension Primer
aatagaatttaatctaatttttaag

SEQ ID NO: 22206 - DNA, 25 bp, Artificial sequence
  Extension Primer
taaaatgaacaatacacaatggaga

SEQ ID NO: 22207 - DNA, 25 bp, Artificial sequence
  Extension Primer
aatgctctagtcaatggcttctcaa

SEQ ID NO: 22208 - DNA, 25 bp, Artificial sequence
  Extension Primer
aggtttaatggcttaaaactgttct

SEQ ID NO: 22209 - DNA, 25 bp, Artificial sequence
  Extension Primer
tccaacagaggctgtcatagaataa

SEQ ID NO: 22210 - DNA, 25 bp, Artificial sequence
  Extension Primer
aagaaggaaaacagaccccagaatc

SEQ ID NO: 22211 - DNA, 25 bp, Artificial sequence
  Extension Primer
ccaaaacccagatcccaagttctcc

SEQ ID NO: 22212 - DNA, 25 bp, Artificial sequence
  Extension Primer
gggaagaaattttttttttctcata

SEQ ID NO: 22213 - DNA, 25 bp, Artificial sequence
  Extension Primer
tagtgagttaacttgacattccttg

SEQ ID NO: 22214 - DNA, 25 bp, Artificial sequence
  Extension Primer
gacattttctccatcttcttacaca

SEQ ID NO: 22215 - DNA, 25 bp, Artificial sequence
  Extension Primer
ctaggtgctcaggtttcagcagttc

SEQ ID NO: 22216 - DNA, 25 bp, Artificial sequence
  Extension Primer
agcaagttaaactttctttcaggat

SEQ ID NO: 22217 - DNA, 25 bp, Artificial sequence
  Extension Primer
ctgtttgaatttggtgtcaaacttt

SEQ ID NO: 22218 - DNA, 25 bp, Artificial sequence
  Extension Primer
gatcttgggggcccaggaaaaggtt

SEQ ID NO: 22219 - DNA, 25 bp, Artificial sequence
  Extension Primer
accactggagagcatttttcacttc

SEQ ID NO: 22220 - DNA, 25 bp, Artificial sequence
  Extension Primer
atgtcaagtgctggagagccgtcac

SEQ ID NO: 22221 - DNA, 25 bp, Artificial sequence
  Extension Primer
ttcaaacaagcttctgtcggagtcc

SEQ ID NO: 22222 - DNA, 25 bp, Artificial sequence
  Extension Primer
ctacaatggatctccttaatggctc

SEQ ID NO: 22223 - DNA, 25 bp, Artificial sequence
  Extension Primer
gaggatatgagccttgaatgaagaa

SEQ ID NO: 22224 - DNA, 25 bp, Artificial sequence
  Extension Primer
gagggacgggcctgacggggggtgc

SEQ ID NO: 22225 - DNA, 25 bp, Artificial sequence
  Extension Primer
atccttatttctctaggaagagtgc

SEQ ID NO: 22226 - DNA, 25 bp, Artificial sequence
  Extension Primer
aaaagccaagttcggttcacggcac

SEQ ID NO: 22227 - DNA, 25 bp, Artificial sequence
  Extension Primer
tggacctattctctagataccaagc

SEQ ID NO: 22228 - DNA, 25 bp, Artificial sequence
  Extension Primer
tgtgagtttttgtgtattttaggac

SEQ ID NO: 22229 - DNA, 25 bp, Artificial sequence
  Extension Primer
tayacctgatggaaatgtaagtcgt

SEQ ID NO: 22230 - DNA, 25 bp, Artificial sequence
  Extension Primer
cagagccagcagagtgttcagtcca

SEQ ID NO: 22231 - DNA, 25 bp, Artificial sequence
  Extension Primer
cttggaggtgaaatccataccagaa

SEQ ID NO: 22232 - DNA, 25 bp, Artificial sequence
  Extension Primer
caattaccatgtgcctttcattttt

SEQ ID NO: 22233 - DNA, 25 bp, Artificial sequence
  Extension Primer
aaaaggatttgttttcccaaggacc

SEQ ID NO: 22234 - DNA, 25 bp, Artificial sequence
  Extension Primer
gctgctgctttgaaaaaaaaattcc

SEQ ID NO: 22235 - DNA, 25 bp, Artificial sequence
  Extension Primer
aaagttaacgatctgtcttatcttc

SEQ ID NO: 22236 - DNA, 25 bp, Artificial sequence
  Extension Primer
ctgaagcacctacttcttgtccttc

SEQ ID NO: 22237 - DNA, 25 bp, Artificial sequence
  Extension Primer
actgaattggcacccatggcatagc

SEQ ID NO: 22238 - DNA, 25 bp, Artificial sequence
  Extension Primer
gttctgtgtgtaagagggaagattc

SEQ ID NO: 22239 - DNA, 25 bp, Artificial sequence
  Extension Primer
gtattttacaaagtaaaccagacct

SEQ ID NO: 22240 - DNA, 25 bp, Artificial sequence
  Extension Primer
ggttgcttctatatatggaacaaca

SEQ ID NO: 22241 - DNA, 25 bp, Artificial sequence
  Extension Primer
ccatccttctcatggagaagacccc

SEQ ID NO: 22242 - DNA, 25 bp, Artificial sequence
  Extension Primer
gagtagtccgtgcaggctcccccca

SEQ ID NO: 22243 - DNA, 25 bp, Artificial sequence
  Extension Primer
tttaatattcagactgacatcccac

SEQ ID NO: 22244 - DNA, 25 bp, Artificial sequence
  Extension Primer
taaggaggctatgtggcattgtggg

SEQ ID NO: 22245 - DNA, 25 bp, Artificial sequence
  Extension Primer
tattattcaactatgatcatcaaag

SEQ ID NO: 22246 - DNA, 25 bp, Artificial sequence
  Extension Primer
taataaaggactttgtctcgcctcc

SEQ ID NO: 22247 - DNA, 25 bp, Artificial sequence
  Extension Primer
tcttggatacaaactgtaccaaaaa

SEQ ID NO: 22248 - DNA, 25 bp, Artificial sequence
  Extension Primer
ccatttttcacatgtggctgaaact

SEQ ID NO: 22249 - DNA, 25 bp, Artificial sequence
  Extension Primer
ccaaaacatatttctatcrtcaatg

SEQ ID NO: 22250 - DNA, 25 bp, Artificial sequence
  Extension Primer
aggttggtttctctccttgcaataa

SEQ ID NO: 22251 - DNA, 25 bp, Artificial sequence
  Extension Primer
catttactaaggagtaagatagttc

SEQ ID NO: 22252 - DNA, 25 bp, Artificial sequence
  Extension Primer
caattcataaggcaaacaaaatgca

SEQ ID NO: 22253 - DNA, 25 bp, Artificial sequence
  Extension Primer
tcatactactatgttaaagcaaact

SEQ ID NO: 22254 - DNA, 25 bp, Artificial sequence
  Extension Primer
aatttgttgttgttgtttagtcgct

SEQ ID NO: 22255 - DNA, 25 bp, Artificial sequence
  Extension Primer
aagtaggtcaatgggttcaagcagt

SEQ ID NO: 22256 - DNA, 25 bp, Artificial sequence
  Extension Primer
gaagggtgtggggatatggaggagc

SEQ ID NO: 22257 - DNA, 25 bp, Artificial sequence
  Extension Primer
caaactcaccaatgcccaatagaaa

SEQ ID NO: 22258 - DNA, 25 bp, Artificial sequence
  Extension Primer
aaggagtgttacttctctacagttt

SEQ ID NO: 22259 - DNA, 25 bp, Artificial sequence
  Extension Primer
tgttgrgacwgggagkggggagatg

SEQ ID NO: 22260 - DNA, 25 bp, Artificial sequence
  Extension Primer
gtgaagacaagatttgagtgcagga

SEQ ID NO: 22261 - DNA, 25 bp, Artificial sequence
  Extension Primer
aactctgccctccttccagccagca

SEQ ID NO: 22262 - DNA, 25 bp, Artificial sequence
  Extension Primer
agagaccaaaactgattcactaaaa

SEQ ID NO: 22263 - DNA, 25 bp, Artificial sequence
  Extension Primer
aactatgagatgtttccagcttctt

SEQ ID NO: 22264 - DNA, 25 bp, Artificial sequence
  Extension Primer
ttagatgtttgagtttcattctaaa

SEQ ID NO: 22265 - DNA, 25 bp, Artificial sequence
  Extension Primer
cgtttcttactaagttttgaaattg

SEQ ID NO: 22266 - DNA, 25 bp, Artificial sequence
  Extension Primer
tcctgttgtcacttgagtaattctt

SEQ ID NO: 22267 - DNA, 25 bp, Artificial sequence
  Extension Primer
cctgcctcatgggattgccgtgagt

SEQ ID NO: 22268 - DNA, 25 bp, Artificial sequence
  Extension Primer
cttccatcattaaaaagtattcccc

SEQ ID NO: 22269 - DNA, 25 bp, Artificial sequence
  Extension Primer
tctttattttcacctgattttctca

SEQ ID NO: 22270 - DNA, 25 bp, Artificial sequence
  Extension Primer
ttggygcttgaatgaagtagactat

SEQ ID NO: 22271 - DNA, 25 bp, Artificial sequence
  Extension Primer
agatggttagacagcatcactgact

SEQ ID NO: 22272 - DNA, 25 bp, Artificial sequence
  Extension Primer
gagagcttgccttcctgtaagtgat

SEQ ID NO: 22273 - DNA, 25 bp, Artificial sequence
  Extension Primer
gagccagttccaatcactccagtct

SEQ ID NO: 22274 - DNA, 25 bp, Artificial sequence
  Extension Primer
cagttcaagcctaaatgaagattgg

SEQ ID NO: 22275 - DNA, 25 bp, Artificial sequence
  Extension Primer
aatcctattagagattcgttatttc

SEQ ID NO: 22276 - DNA, 25 bp, Artificial sequence
  Extension Primer
ggtgtatagcaaaatgatccaggtt

SEQ ID NO: 22277 - DNA, 25 bp, Artificial sequence
  Extension Primer
ccaaatatgaatccacacatttcca

SEQ ID NO: 22278 - DNA, 25 bp, Artificial sequence
  Extension Primer
tctggccagcagagggactcaagag

SEQ ID NO: 22279 - DNA, 25 bp, Artificial sequence
  Extension Primer
attccaaaggtactcgccacccttc

SEQ ID NO: 22280 - DNA, 25 bp, Artificial sequence
  Extension Primer
tgttggttaaaagattcataaagac

SEQ ID NO: 22281 - DNA, 25 bp, Artificial sequence
  Extension Primer
gtgatgcccttgttacayaaagtcc

SEQ ID NO: 22282 - DNA, 25 bp, Artificial sequence
  Extension Primer
gacagagactcagagaaaaggatac

SEQ ID NO: 22283 - DNA, 25 bp, Artificial sequence
  Extension Primer
cgatcccatttccctttgacatttt

SEQ ID NO: 22284 - DNA, 25 bp, Artificial sequence
  Extension Primer
agttaaattacttgtgtaaggtgtt

SEQ ID NO: 22285 - DNA, 25 bp, Artificial sequence
  Extension Primer
tccactccatcccattcatttcctg

SEQ ID NO: 22286 - DNA, 25 bp, Artificial sequence
  Extension Primer
aggagtagtgtattgcactaggaat

SEQ ID NO: 22287 - DNA, 25 bp, Artificial sequence
  Extension Primer
cttttgaaaattgcttattactatc

SEQ ID NO: 22288 - DNA, 25 bp, Artificial sequence
  Extension Primer
ggagtcaacccaccacacaggatgg

SEQ ID NO: 22289 - DNA, 25 bp, Artificial sequence
  Extension Primer
tggacttaaacacacacacacgata

SEQ ID NO: 22290 - DNA, 25 bp, Artificial sequence
  Extension Primer
ttccgtgtctcatgttgcctctcac

SEQ ID NO: 22291 - DNA, 25 bp, Artificial sequence
  Extension Primer
tgtgtgaggtggatccacgtagata

SEQ ID NO: 22292 - DNA, 25 bp, Artificial sequence
  Extension Primer
aagagaaaagactaggtcacccaag

SEQ ID NO: 22293 - DNA, 25 bp, Artificial sequence
  Extension Primer
tgtggttaactactcaaagagtaca

SEQ ID NO: 22294 - DNA, 25 bp, Artificial sequence
  Extension Primer
tggtcatagtatcttgctctgggtc

SEQ ID NO: 22295 - DNA, 25 bp, Artificial sequence
  Extension Primer
agctgtggcaagtgcctgtgagtta

SEQ ID NO: 22296 - DNA, 25 bp, Artificial sequence
  Extension Primer
aggtcttgttttttgtttccaggca

SEQ ID NO: 22297 - DNA, 25 bp, Artificial sequence
  Extension Primer
tatccgctgaaactttcctagagca

SEQ ID NO: 22298 - DNA, 25 bp, Artificial sequence
  Extension Primer
tggggtctctggtgagaattagcac

SEQ ID NO: 22299 - DNA, 25 bp, Artificial sequence
  Extension Primer
aaaaaacattgtaatacaactatga

SEQ ID NO: 22300 - DNA, 25 bp, Artificial sequence
  Extension Primer
gcgaggtacatctgtaaacttgagc

SEQ ID NO: 22301 - DNA, 25 bp, Artificial sequence
  Extension Primer
ttcaaacacatgtccttattcaggg

SEQ ID NO: 22302 - DNA, 25 bp, Artificial sequence
  Extension Primer
tcctcattttgtgatctggggacat

SEQ ID NO: 22303 - DNA, 25 bp, Artificial sequence
  Extension Primer
atgaaaacagaatgctgattttttt

SEQ ID NO: 22304 - DNA, 25 bp, Artificial sequence
  Extension Primer
atgtttattgaattgaaaagatggt

SEQ ID NO: 22305 - DNA, 25 bp, Artificial sequence
  Extension Primer
ttacttctctctgtatacactgttc

SEQ ID NO: 22306 - DNA, 25 bp, Artificial sequence
  Extension Primer
tcagggataaagcaaatctccattt

SEQ ID NO: 22307 - DNA, 25 bp, Artificial sequence
  Extension Primer
agatgagggaactaaagtgaagata

SEQ ID NO: 22308 - DNA, 25 bp, Artificial sequence
  Extension Primer
gatggagaggttgtccatccacact

SEQ ID NO: 22309 - DNA, 25 bp, Artificial sequence
  Extension Primer
ctttctctgtgttttaaatgatata

SEQ ID NO: 22310 - DNA, 25 bp, Artificial sequence
  Extension Primer
attaattccttgttttcgagccttt

SEQ ID NO: 22311 - DNA, 25 bp, Artificial sequence
  Extension Primer
agtgcactgagcctaacaaaacttc

SEQ ID NO: 22312 - DNA, 25 bp, Artificial sequence
  Extension Primer
cttcagcaactatagaattttctta

SEQ ID NO: 22313 - DNA, 25 bp, Artificial sequence
  Extension Primer
tgttccttgtgactagcataaacct

SEQ ID NO: 22314 - DNA, 25 bp, Artificial sequence
  Extension Primer
cactgtaatggtggatgcaagtcat

SEQ ID NO: 22315 - DNA, 25 bp, Artificial sequence
  Extension Primer
tgcttaggtacagaagagtccccat

SEQ ID NO: 22316 - DNA, 25 bp, Artificial sequence
  Extension Primer
acacaaaccctcatcagtaaaagca

SEQ ID NO: 22317 - DNA, 25 bp, Artificial sequence
  Extension Primer
tgacaaacttcacacatcactacct

SEQ ID NO: 22318 - DNA, 25 bp, Artificial sequence
  Extension Primer
aggagcaccagcaggatgatgccca

SEQ ID NO: 22319 - DNA, 25 bp, Artificial sequence
  Extension Primer
aagaagcccagtaaattcccccata

SEQ ID NO: 22320 - DNA, 25 bp, Artificial sequence
  Extension Primer
taggtgccccgagaaggagctgtga

SEQ ID NO: 22321 - DNA, 25 bp, Artificial sequence
  Extension Primer
gtatatggcagagctgagatttgaa

SEQ ID NO: 22322 - DNA, 25 bp, Artificial sequence
  Extension Primer
gtaaggatatggatgaggactctgc

SEQ ID NO: 22323 - DNA, 25 bp, Artificial sequence
  Extension Primer
taccagatagtgaaatcattacttg

SEQ ID NO: 22324 - DNA, 25 bp, Artificial sequence
  Extension Primer
ataattcaatggggacttggagttg

SEQ ID NO: 22325 - DNA, 25 bp, Artificial sequence
  Extension Primer
aatattgtaagttgattatacttca

SEQ ID NO: 22326 - DNA, 25 bp, Artificial sequence
  Extension Primer
aaaacctggctcacaattcccagtc

SEQ ID NO: 22327 - DNA, 25 bp, Artificial sequence
  Extension Primer
cctagatatcacttatgtagtaata

SEQ ID NO: 22328 - DNA, 25 bp, Artificial sequence
  Extension Primer
agcccacrcagattttagcttcccc

SEQ ID NO: 22329 - DNA, 25 bp, Artificial sequence
  Extension Primer
caatacaaagataaatcagacaaga

SEQ ID NO: 22330 - DNA, 25 bp, Artificial sequence
  Extension Primer
aaagataaatcagacaagaycccta

SEQ ID NO: 22331 - DNA, 25 bp, Artificial sequence
  Extension Primer
gagacgccgaaacagaccccgaagt

SEQ ID NO: 22332 - DNA, 25 bp, Artificial sequence
  Extension Primer
tatgcatcgctctttgtgttctggg

SEQ ID NO: 22333 - DNA, 25 bp, Artificial sequence
  Extension Primer
atcacctgcagttgatttaacaagg

SEQ ID NO: 22334 - DNA, 25 bp, Artificial sequence
  Extension Primer
ttgacattcaccatttccttggctc

SEQ ID NO: 22335 - DNA, 25 bp, Artificial sequence
  Extension Primer
tttttctagatttcatattcatgcc

SEQ ID NO: 22336 - DNA, 25 bp, Artificial sequence
  Extension Primer
ttaaggaaatgcttaaacatttcat

SEQ ID NO: 22337 - DNA, 25 bp, Artificial sequence
  Extension Primer
gcaaagtggatggggtggggaaata

SEQ ID NO: 22338 - DNA, 25 bp, Artificial sequence
  Extension Primer
ggtgatgacatcactggtcatggtg

SEQ ID NO: 22339 - DNA, 25 bp, Artificial sequence
  Extension Primer
atgatggtgacaccattggctctag

SEQ ID NO: 22340 - DNA, 25 bp, Artificial sequence
  Extension Primer
ggcagtctttttatcctgctcacct

SEQ ID NO: 22341 - DNA, 25 bp, Artificial sequence
  Extension Primer
ttattacagcccttcatctccctgc

SEQ ID NO: 22342 - DNA, 25 bp, Artificial sequence
  Extension Primer
ctgcgtcttcaaatacaaaatgtgt

SEQ ID NO: 22343 - DNA, 25 bp, Artificial sequence
  Extension Primer
tctgaaaacaaaattaactgggttt

SEQ ID NO: 22344 - DNA, 25 bp, Artificial sequence
  Extension Primer
catgtactctttttgagagcagcaa

SEQ ID NO: 22345 - DNA, 25 bp, Artificial sequence
  Extension Primer
ctaatatgcctaagtgactaccata

SEQ ID NO: 22346 - DNA, 25 bp, Artificial sequence
  Extension Primer
acctctctccctgtgtccctattca

SEQ ID NO: 22347 - DNA, 25 bp, Artificial sequence
  Extension Primer
tagagcatgcccattctgagaacac

SEQ ID NO: 22348 - DNA, 25 bp, Artificial sequence
  Extension Primer
aggtgtttctttttgatgattattc

SEQ ID NO: 22349 - DNA, 25 bp, Artificial sequence
  Extension Primer
aggagccactcagctgctagaaatc

SEQ ID NO: 22350 - DNA, 25 bp, Artificial sequence
  Extension Primer
aactcataatcatatgtagaactgg

SEQ ID NO: 22351 - DNA, 25 bp, Artificial sequence
  Extension Primer
agagtgacaaacaagacatagatgg

SEQ ID NO: 22352 - DNA, 25 bp, Artificial sequence
  Extension Primer
tcagaagactgaaagcaccaccaag

SEQ ID NO: 22353 - DNA, 25 bp, Artificial sequence
  Extension Primer
ctgactaggagaccttggattgtat

SEQ ID NO: 22354 - DNA, 25 bp, Artificial sequence
  Extension Primer
cactagattttcaaatgaacctatc

SEQ ID NO: 22355 - DNA, 25 bp, Artificial sequence
  Extension Primer
ttccctagtaaggcagargggcagg

SEQ ID NO: 22356 - DNA, 25 bp, Artificial sequence
  Extension Primer
atacaataaaccaaaccagtaaaag

SEQ ID NO: 22357 - DNA, 25 bp, Artificial sequence
  Extension Primer
tttctagcatggaatggcgactcct

SEQ ID NO: 22358 - DNA, 25 bp, Artificial sequence
  Extension Primer
tcaaaccagaaaaaaatcccctata

SEQ ID NO: 22359 - DNA, 25 bp, Artificial sequence
  Extension Primer
tgttctcagtccatgagattccagg

SEQ ID NO: 22360 - DNA, 25 bp, Artificial sequence
  Extension Primer
ggaggtagaggccagtggaagcctt

SEQ ID NO: 22361 - DNA, 25 bp, Artificial sequence
  Extension Primer
atgccctttctgcttggacagcacc

SEQ ID NO: 22362 - DNA, 25 bp, Artificial sequence
  Extension Primer
tatcacagtttattctaattgtcta

SEQ ID NO: 22363 - DNA, 25 bp, Artificial sequence
  Extension Primer
tttcaaacactatcgtttatgtgct

SEQ ID NO: 22364 - DNA, 25 bp, Artificial sequence
  Extension Primer
ggggcttctctctagctgtggtgct

SEQ ID NO: 22365 - DNA, 25 bp, Artificial sequence
  Extension Primer
cggaatacaattcaccaagactctt

SEQ ID NO: 22366 - DNA, 25 bp, Artificial sequence
  Extension Primer
tccaggggatcttcccgacccagaa

SEQ ID NO: 22367 - DNA, 25 bp, Artificial sequence
  Extension Primer
atgtgaaaatcaatggaattttccc

SEQ ID NO: 22368 - DNA, 25 bp, Artificial sequence
  Extension Primer
catttcctcctgtctccaygaccta

SEQ ID NO: 22369 - DNA, 22 bp, Artificial sequence
  Extension Primer
tgaattatcaatctttcaagaa

SEQ ID NO: 22370 - DNA, 25 bp, Artificial sequence
  Extension Primer
agtaacagctgagaacagtcttata

SEQ ID NO: 22371 - DNA, 25 bp, Artificial sequence
  Extension Primer
gtccaactctgtgcgaccccataga

SEQ ID NO: 22372 - DNA, 25 bp, Artificial sequence
  Extension Primer
actcagagtccttcctggtggagca

SEQ ID NO: 22373 - DNA, 25 bp, Artificial sequence
  Extension Primer
ggtccccaaggacaatatacacata

SEQ ID NO: 22374 - DNA, 25 bp, Artificial sequence
  Extension Primer
ttctggttttgcttaactttagaac

SEQ ID NO: 22375 - DNA, 25 bp, Artificial sequence
  Extension Primer
agaggatatggtttcaaaatgaaga

SEQ ID NO: 22376 - DNA, 25 bp, Artificial sequence
  Extension Primer
ctctaatctccagtgaggtgccctg

SEQ ID NO: 22377 - DNA, 25 bp, Artificial sequence
  Extension Primer
aatgatacaaaatccaagtataaga

SEQ ID NO: 22378 - DNA, 25 bp, Artificial sequence
  Extension Primer
tctgtctctttctcctaaagcataa

SEQ ID NO: 22379 - DNA, 25 bp, Artificial sequence
  Extension Primer
agatcagttttgtggaaatccacct

SEQ ID NO: 22380 - DNA, 25 bp, Artificial sequence
  Extension Primer
gtcagctctatagtcagagaaaaga

SEQ ID NO: 22381 - DNA, 25 bp, Artificial sequence
  Extension Primer
aacccaatgtctggcttgaaagtcc

SEQ ID NO: 22382 - DNA, 25 bp, Artificial sequence
  Extension Primer
cacaactgagccactaaagtgaata

SEQ ID NO: 22383 - DNA, 25 bp, Artificial sequence
  Extension Primer
gccctcaagatgggatctgagagtc

SEQ ID NO: 22384 - DNA, 25 bp, Artificial sequence
  Extension Primer
aggaaggagattttgagagcaaata

SEQ ID NO: 22385 - DNA, 25 bp, Artificial sequence
  Extension Primer
cctggttatttgtctctacctctgc

SEQ ID NO: 22386 - DNA, 25 bp, Artificial sequence
  Extension Primer
cccttcaaataccctgtccaccaga

SEQ ID NO: 22387 - DNA, 25 bp, Artificial sequence
  Extension Primer
tctggcagggtaatcatttgacaac

SEQ ID NO: 22388 - DNA, 25 bp, Artificial sequence
  Extension Primer
agctgtttcctgtgccaagcacttt

SEQ ID NO: 22389 - DNA, 25 bp, Artificial sequence
  Extension Primer
cacatacacagtatttattcaagca

SEQ ID NO: 22390 - DNA, 25 bp, Artificial sequence
  Extension Primer
tggagaaggagaattgactatgcct

SEQ ID NO: 22391 - DNA, 25 bp, Artificial sequence
  Extension Primer
ccaactcttgttttactttcacggc

SEQ ID NO: 22392 - DNA, 25 bp, Artificial sequence
  Extension Primer
cttctgctcaacttgtttataattc

SEQ ID NO: 22393 - DNA, 25 bp, Artificial sequence
  Extension Primer
ttagggataattaatcattctcgcc

SEQ ID NO: 22394 - DNA, 25 bp, Artificial sequence
  Extension Primer
attataaattatgtacacttttaaa

SEQ ID NO: 22395 - DNA, 25 bp, Artificial sequence
  Extension Primer
acacatgcctagtcctgtccaccta

SEQ ID NO: 22396 - DNA, 25 bp, Artificial sequence
  Extension Primer
acaggagggcaacaggaggactcac

SEQ ID NO: 22397 - DNA, 25 bp, Artificial sequence
  Extension Primer
tgttttacttaatgcccttctctac

SEQ ID NO: 22398 - DNA, 25 bp, Artificial sequence
  Extension Primer
ttcaagctcagaatgaatcactttt

SEQ ID NO: 22399 - DNA, 25 bp, Artificial sequence
  Extension Primer
ttaagctgaatgcattatatggaag

SEQ ID NO: 22400 - DNA, 25 bp, Artificial sequence
  Extension Primer
aagttgtgaaacacctccagtagcc

SEQ ID NO: 22401 - DNA, 25 bp, Artificial sequence
  Extension Primer
ctcacgctgcccgtggtctacttgc

SEQ ID NO: 22402 - DNA, 25 bp, Artificial sequence
  Extension Primer
attaattttattggacagtttcata

SEQ ID NO: 22403 - DNA, 25 bp, Artificial sequence
  Extension Primer
cggcagacctggtttcaaagtctca

SEQ ID NO: 22404 - DNA, 25 bp, Artificial sequence
  Extension Primer
attcctaaaatacacatctaaaacc

SEQ ID NO: 22405 - DNA, 25 bp, Artificial sequence
  Extension Primer
aggagcactcaggttccactggtta

SEQ ID NO: 22406 - DNA, 25 bp, Artificial sequence
  Extension Primer
acctggaagctgcataacacaacat

SEQ ID NO: 22407 - DNA, 25 bp, Artificial sequence
  Extension Primer
tgtaccctgggagcagacgaagtca

SEQ ID NO: 22408 - DNA, 25 bp, Artificial sequence
  Extension Primer
atgagtctggaaagaaagcaaaagc

SEQ ID NO: 22409 - DNA, 25 bp, Artificial sequence
  Extension Primer
gtctgcagagtataaatcaattcaa

SEQ ID NO: 22410 - DNA, 25 bp, Artificial sequence
  Extension Primer
tggaaccgtggatgagaagacccta

SEQ ID NO: 22411 - DNA, 25 bp, Artificial sequence
  Extension Primer
ggatttttatctttactgtgaactt

SEQ ID NO: 22412 - DNA, 25 bp, Artificial sequence
  Extension Primer
agctatcattactaaattttgtatg

SEQ ID NO: 22413 - DNA, 25 bp, Artificial sequence
  Extension Primer
tatgatggcttgagatccctggacc

SEQ ID NO: 22414 - DNA, 25 bp, Artificial sequence
  Extension Primer
gaaataggtgagcttaatcactttg

SEQ ID NO: 22415 - DNA, 25 bp, Artificial sequence
  Extension Primer
agctcggtgccatagtcccatgaag

SEQ ID NO: 22416 - DNA, 25 bp, Artificial sequence
  Extension Primer
gggagtgtgcgtggagtcttagccg

SEQ ID NO: 22417 - DNA, 25 bp, Artificial sequence
  Extension Primer
aaaaatttcattaacatcacaccaa

SEQ ID NO: 22418 - DNA, 25 bp, Artificial sequence
  Extension Primer
tccaaggtcctcctaccagcatccc

SEQ ID NO: 22419 - DNA, 25 bp, Artificial sequence
  Extension Primer
aggtcttgtaagactcaggaattta

SEQ ID NO: 22420 - DNA, 25 bp, Artificial sequence
  Extension Primer
ctcatcatttactgaacagttasaa

SEQ ID NO: 22421 - DNA, 25 bp, Artificial sequence
  Extension Primer
catcactttgctttcagatttctgg

SEQ ID NO: 22422 - DNA, 25 bp, Artificial sequence
  Extension Primer
cttgtatttttttaatgagaaagta

SEQ ID NO: 22423 - DNA, 25 bp, Artificial sequence
  Extension Primer
ctcagagttgtctgtggcacctgac

SEQ ID NO: 22424 - DNA, 25 bp, Artificial sequence
  Extension Primer
ttttttttttttttctttctttttc

SEQ ID NO: 22425 - DNA, 25 bp, Artificial sequence
  Extension Primer
attagtagaatgagacacagtagga

SEQ ID NO: 22426 - DNA, 25 bp, Artificial sequence
  Extension Primer
aaagaaggctgcttttggaataggg

SEQ ID NO: 22427 - DNA, 25 bp, Artificial sequence
  Extension Primer
atccaggtgacatctgggctccttc

SEQ ID NO: 22428 - DNA, 25 bp, Artificial sequence
  Extension Primer
acagcttctccagagttttatgtgc

SEQ ID NO: 22429 - DNA, 25 bp, Artificial sequence
  Extension Primer
ggaggaaggggccagagcctattac

SEQ ID NO: 22430 - DNA, 25 bp, Artificial sequence
  Extension Primer
aagattaaaatagtttcacataaca

SEQ ID NO: 22431 - DNA, 25 bp, Artificial sequence
  Extension Primer
gtagaaaaatgcctgcaaaaatatg

SEQ ID NO: 22432 - DNA, 25 bp, Artificial sequence
  Extension Primer
gagagctcagtacttcccacagatg

SEQ ID NO: 22433 - DNA, 25 bp, Artificial sequence
  Extension Primer
ggggaaagcacagaaatgcagaggc

SEQ ID NO: 22434 - DNA, 25 bp, Artificial sequence
  Extension Primer
tagattgactgcttgaatcctgtct

SEQ ID NO: 22435 - DNA, 25 bp, Artificial sequence
  Extension Primer
aaagatatgagtggattcagattac

SEQ ID NO: 22436 - DNA, 25 bp, Artificial sequence
  Extension Primer
tcatatctattgaataaatgtccta

SEQ ID NO: 22437 - DNA, 25 bp, Artificial sequence
  Extension Primer
ttaaagtttgtagggtaagttccat

SEQ ID NO: 22438 - DNA, 25 bp, Artificial sequence
  Extension Primer
ctatggaaatgctgcgctggcactc

SEQ ID NO: 22439 - DNA, 25 bp, Artificial sequence
  Extension Primer
gcccccagagcatttgccttgatga

SEQ ID NO: 22440 - DNA, 25 bp, Artificial sequence
  Extension Primer
atttcaattcttttggacaaaaacc

SEQ ID NO: 22441 - DNA, 25 bp, Artificial sequence
  Extension Primer
cactaagacttaagagagtccacac

SEQ ID NO: 22442 - DNA, 25 bp, Artificial sequence
  Extension Primer
cttcaaagggaatcagagtcttgtt

SEQ ID NO: 22443 - DNA, 25 bp, Artificial sequence
  Extension Primer
ctacaaaaggaaagagtgaacaaat

SEQ ID NO: 22444 - DNA, 25 bp, Artificial sequence
  Extension Primer
cctgctgctggccacctcctttctc

SEQ ID NO: 22445 - DNA, 25 bp, Artificial sequence
  Extension Primer
acaggtgagcaatactaagcaggtt

SEQ ID NO: 22446 - DNA, 25 bp, Artificial sequence
  Extension Primer
attagtatattttgaagatcaatcc

SEQ ID NO: 22447 - DNA, 25 bp, Artificial sequence
  Extension Primer
aataatttttaattaaggttaagac

SEQ ID NO: 22448 - DNA, 25 bp, Artificial sequence
  Extension Primer
ttaattcattatagagctactgttt

SEQ ID NO: 22449 - DNA, 25 bp, Artificial sequence
  Extension Primer
tggacctatgtttctgcaaagaatc

SEQ ID NO: 22450 - DNA, 25 bp, Artificial sequence
  Extension Primer
gctccttccactcctgctcattgag

SEQ ID NO: 22451 - DNA, 25 bp, Artificial sequence
  Extension Primer
tcgccatcgcttgctgcagctacag

SEQ ID NO: 22452 - DNA, 25 bp, Artificial sequence
  Extension Primer
atgtttaaactcatacacaatgtca

SEQ ID NO: 22453 - DNA, 25 bp, Artificial sequence
  Extension Primer
agttcgcttttctccttcgtgttgc

SEQ ID NO: 22454 - DNA, 25 bp, Artificial sequence
  Extension Primer
gtgtacttgatgtgcagtgcttcct

SEQ ID NO: 22455 - DNA, 25 bp, Artificial sequence
  Extension Primer
tataaatgtggagaaagagagagaa

SEQ ID NO: 22456 - DNA, 25 bp, Artificial sequence
  Extension Primer
ctttgaaacatcatgtgaacataag

SEQ ID NO: 22457 - DNA, 25 bp, Artificial sequence
  Extension Primer
acctcttccataagcacaccgaaat

SEQ ID NO: 22458 - DNA, 25 bp, Artificial sequence
  Extension Primer
cttgttgattaagactgcttgtttc

SEQ ID NO: 22459 - DNA, 25 bp, Artificial sequence
  Extension Primer
tgtgttccacaaaagaaggaaaaag

SEQ ID NO: 22460 - DNA, 25 bp, Artificial sequence
  Extension Primer
caaaccccagcccacaaaaaactca

SEQ ID NO: 22461 - DNA, 25 bp, Artificial sequence
  Extension Primer
cttttccactgggcgttagctctca

SEQ ID NO: 22462 - DNA, 25 bp, Artificial sequence
  Extension Primer
atagaaacttttaaggacaggaaaa

SEQ ID NO: 22463 - DNA, 25 bp, Artificial sequence
  Extension Primer
tcaggtgagcttgaaggcactcagy

SEQ ID NO: 22464 - DNA, 25 bp, Artificial sequence
  Extension Primer
tgataaaacaaaggtttgcataaga

SEQ ID NO: 22465 - DNA, 25 bp, Artificial sequence
  Extension Primer
gcagcagccatcacaagtgtgtcac

SEQ ID NO: 22466 - DNA, 25 bp, Artificial sequence
  Extension Primer
attgagcgtgatggtaagattctca

SEQ ID NO: 22467 - DNA, 25 bp, Artificial sequence
  Extension Primer
gctaggatgggaagagagaattgga

SEQ ID NO: 22468 - DNA, 25 bp, Artificial sequence
  Extension Primer
atttaaacttcaggatttkttcttt

SEQ ID NO: 22469 - DNA, 25 bp, Artificial sequence
  Extension Primer
ctgcaaagcactccacaaatgaaag

SEQ ID NO: 22470 - DNA, 25 bp, Artificial sequence
  Extension Primer
ataaatagggcagggtggagacaca

SEQ ID NO: 22471 - DNA, 25 bp, Artificial sequence
  Extension Primer
acttgttcaggaaaggtgtgtatgg

SEQ ID NO: 22472 - DNA, 25 bp, Artificial sequence
  Extension Primer
catctcgggcgtctgtcccgttttc

SEQ ID NO: 22473 - DNA, 25 bp, Artificial sequence
  Extension Primer
aaaatgtatgcagtttttttcctat

SEQ ID NO: 22474 - DNA, 25 bp, Artificial sequence
  Extension Primer
tgatttgcatgcatatcaaagtctg

SEQ ID NO: 22475 - DNA, 25 bp, Artificial sequence
  Extension Primer
tgaaacamcacctttgatgaaactg

SEQ ID NO: 22476 - DNA, 25 bp, Artificial sequence
  Extension Primer
gtctgccccagggggctaacccagt

SEQ ID NO: 22477 - DNA, 25 bp, Artificial sequence
  Extension Primer
tcccatgttatcacttagaatcaaa

SEQ ID NO: 22478 - DNA, 25 bp, Artificial sequence
  Extension Primer
gttgtaattacagcttttttttttt

SEQ ID NO: 22479 - DNA, 25 bp, Artificial sequence
  Extension Primer
tgaaatcctctctgatttggtaaca

SEQ ID NO: 22480 - DNA, 25 bp, Artificial sequence
  Extension Primer
atgcatgcaggaggacacgctcata

SEQ ID NO: 22481 - DNA, 25 bp, Artificial sequence
  Extension Primer
gaataaaggacacaaagacctggtg

SEQ ID NO: 22482 - DNA, 25 bp, Artificial sequence
  Extension Primer
ttttgaatgtgcctataaagaaaag

SEQ ID NO: 22483 - DNA, 25 bp, Artificial sequence
  Extension Primer
ttattgaggactactgtacaagtct

SEQ ID NO: 22484 - DNA, 25 bp, Artificial sequence
  Extension Primer
taaactgcagagaaaaatcaatcac

SEQ ID NO: 22485 - DNA, 25 bp, Artificial sequence
  Extension Primer
attatttcatgttttaaattcaatc

SEQ ID NO: 22486 - DNA, 25 bp, Artificial sequence
  Extension Primer
gaagtgaaagtgcaagtattagtca

SEQ ID NO: 22487 - DNA, 25 bp, Artificial sequence
  Extension Primer
cctcccacatgggacagaactatta

SEQ ID NO: 22488 - DNA, 25 bp, Artificial sequence
  Extension Primer
tcatattccagaggtcttctgtagg

SEQ ID NO: 22489 - DNA, 25 bp, Artificial sequence
  Extension Primer
caagacatggccatcacaaaccaac

SEQ ID NO: 22490 - DNA, 25 bp, Artificial sequence
  Extension Primer
taacaatgatggttgagcttaaaat

SEQ ID NO: 22491 - DNA, 25 bp, Artificial sequence
  Extension Primer
actcttgattcctgctgaatatcca

SEQ ID NO: 22492 - DNA, 25 bp, Artificial sequence
  Extension Primer
atcatgttttcctctttgacttggt

SEQ ID NO: 22493 - DNA, 25 bp, Artificial sequence
  Extension Primer
gattgaacctgcatctcctgcattg

SEQ ID NO: 22494 - DNA, 25 bp, Artificial sequence
  Extension Primer
tgtgatgctggctgcaggcgaggaa

SEQ ID NO: 22495 - DNA, 25 bp, Artificial sequence
  Extension Primer
cggcttgtcttgaaaacagagtttg

SEQ ID NO: 22496 - DNA, 25 bp, Artificial sequence
  Extension Primer
aatagcctcccatgtttatatagat

SEQ ID NO: 22497 - DNA, 25 bp, Artificial sequence
  Extension Primer
gagctagtcatggtctatctttacc

SEQ ID NO: 22498 - DNA, 25 bp, Artificial sequence
  Extension Primer
ataaatatacctcaagtgagggttt

SEQ ID NO: 22499 - DNA, 25 bp, Artificial sequence
  Extension Primer
gttcatttctataataaaatagttc

SEQ ID NO: 22500 - DNA, 25 bp, Artificial sequence
  Extension Primer
catcaatcaattaccaggtctgggc

SEQ ID NO: 22501 - DNA, 25 bp, Artificial sequence
  Extension Primer
taccttttattcagttatcacctct

SEQ ID NO: 22502 - DNA, 25 bp, Artificial sequence
  Extension Primer
cttcaaggtacagaatcaataagca

SEQ ID NO: 22503 - DNA, 25 bp, Artificial sequence
  Extension Primer
ctataactatgatatctatggacaa

SEQ ID NO: 22504 - DNA, 25 bp, Artificial sequence
  Extension Primer
actgatgctgctgctgctgctaagt

SEQ ID NO: 22505 - DNA, 25 bp, Artificial sequence
  Extension Primer
acaaatgattctataatgagtccac

SEQ ID NO: 22506 - DNA, 25 bp, Artificial sequence
  Extension Primer
gggcctctcaactatggccaattag

SEQ ID NO: 22507 - DNA, 25 bp, Artificial sequence
  Extension Primer
tctaaatcttcaccctgcttggagc

SEQ ID NO: 22508 - DNA, 25 bp, Artificial sequence
  Extension Primer
ctctcactaacatgctttgccccca

SEQ ID NO: 22509 - DNA, 25 bp, Artificial sequence
  Extension Primer
ttaccatagtgattattattgtaaa

SEQ ID NO: 22510 - DNA, 25 bp, Artificial sequence
  Extension Primer
ggagaaattctaaaatggctttccc

SEQ ID NO: 22511 - DNA, 25 bp, Artificial sequence
  Extension Primer
aattcaaggaatatttgacagtatc

SEQ ID NO: 22512 - DNA, 25 bp, Artificial sequence
  Extension Primer
gaatctgcctcccaatgaaggagac

SEQ ID NO: 22513 - DNA, 25 bp, Artificial sequence
  Extension Primer
tctcaatctctgcatctatctcttt

SEQ ID NO: 22514 - DNA, 25 bp, Artificial sequence
  Extension Primer
aaaataatgtactttctccttttta

SEQ ID NO: 22515 - DNA, 25 bp, Artificial sequence
  Extension Primer
tcaattcaaagccatctgcttccca

SEQ ID NO: 22516 - DNA, 25 bp, Artificial sequence
  Extension Primer
aatcacggatgtgggkatttgagga

SEQ ID NO: 22517 - DNA, 25 bp, Artificial sequence
  Extension Primer
ctctgctgactctcagaacaaatgc

SEQ ID NO: 22518 - DNA, 25 bp, Artificial sequence
  Extension Primer
catacagaggcttcccacctatggc

SEQ ID NO: 22519 - DNA, 25 bp, Artificial sequence
  Extension Primer
gcagctagaacttagcttctgagtc

SEQ ID NO: 22520 - DNA, 25 bp, Artificial sequence
  Extension Primer
tttgcctttttcagtgaaacatctc

SEQ ID NO: 22521 - DNA, 25 bp, Artificial sequence
  Extension Primer
tagtacaataaatattttaaaattc

SEQ ID NO: 22522 - DNA, 25 bp, Artificial sequence
  Extension Primer
gcaattgtttgcaagaaatgagccc

SEQ ID NO: 22523 - DNA, 25 bp, Artificial sequence
  Extension Primer
gtgtgtgtgtgtgtgtgtgtgtgyg

SEQ ID NO: 22524 - DNA, 25 bp, Artificial sequence
  Extension Primer
tttcctcactccagtatctctgttt

SEQ ID NO: 22525 - DNA, 25 bp, Artificial sequence
  Extension Primer
gaaatacctcctgaaacacaacgtg

SEQ ID NO: 22526 - DNA, 25 bp, Artificial sequence
  Extension Primer
ctgatagccagggccaggttgttta

SEQ ID NO: 22527 - DNA, 25 bp, Artificial sequence
  Extension Primer
tctctcccaggggccttcgccgtgg

SEQ ID NO: 22528 - DNA, 25 bp, Artificial sequence
  Extension Primer
atgggagtcagatgatcaaattttt

SEQ ID NO: 22529 - DNA, 25 bp, Artificial sequence
  Extension Primer
ttgatgcacttcatgcctggataaa

SEQ ID NO: 22530 - DNA, 25 bp, Artificial sequence
  Extension Primer
ccgaaaaatattcatatcccaagta

SEQ ID NO: 22531 - DNA, 25 bp, Artificial sequence
  Extension Primer
gctgttctaatccctctcaccagcc

SEQ ID NO: 22532 - DNA, 25 bp, Artificial sequence
  Extension Primer
gcccagggtctgcacagcctgccca

SEQ ID NO: 22533 - DNA, 25 bp, Artificial sequence
  Extension Primer
ggaactaagaatcagaagggaagga

SEQ ID NO: 22534 - DNA, 25 bp, Artificial sequence
  Extension Primer
tacacctcaagagcatcttacattc

SEQ ID NO: 22535 - DNA, 25 bp, Artificial sequence
  Extension Primer
tttggcacaacatcactttaaactc

SEQ ID NO: 22536 - DNA, 25 bp, Artificial sequence
  Extension Primer
acaataactattttgtcttagctgg

SEQ ID NO: 22537 - DNA, 25 bp, Artificial sequence
  Extension Primer
ggcaaagtgtatgggaaattgtgta

SEQ ID NO: 22538 - DNA, 25 bp, Artificial sequence
  Extension Primer
tagtaacaaaatgtaaattggataa

SEQ ID NO: 22539 - DNA, 25 bp, Artificial sequence
  Extension Primer
gtaagaaataatatacacattgaga

SEQ ID NO: 22540 - DNA, 25 bp, Artificial sequence
  Extension Primer
agcatattttagtgttcttaataat

SEQ ID NO: 22541 - DNA, 25 bp, Artificial sequence
  Extension Primer
gtgctttcttcatttgttgtcatgg

SEQ ID NO: 22542 - DNA, 25 bp, Artificial sequence
  Extension Primer
gtaccacagcactggcattatctgg

SEQ ID NO: 22543 - DNA, 22 bp, Artificial sequence
  Extension Primer
ggtttcatgtcactcaattcct

SEQ ID NO: 22544 - DNA, 25 bp, Artificial sequence
  Extension Primer
accagctatcagggacaccccctca

SEQ ID NO: 22545 - DNA, 25 bp, Artificial sequence
  Extension Primer
gaggaccggggcccccgagcctgtg

SEQ ID NO: 22546 - DNA, 25 bp, Artificial sequence
  Extension Primer
catataaacagcatacacttaaata

SEQ ID NO: 22547 - DNA, 25 bp, Artificial sequence
  Extension Primer
gacaagctatgatggttagcctcca

SEQ ID NO: 22548 - DNA, 25 bp, Artificial sequence
  Extension Primer
atccttatataaagatacatgtttt

SEQ ID NO: 22549 - DNA, 25 bp, Artificial sequence
  Extension Primer
tatctaccccagcccagtgaaacac

SEQ ID NO: 22550 - DNA, 25 bp, Artificial sequence
  Extension Primer
aacaagtggctgacatcatgaaaaa

SEQ ID NO: 22551 - DNA, 25 bp, Artificial sequence
  Extension Primer
aatggaaggggaggaaagaggaaga

SEQ ID NO: 22552 - DNA, 25 bp, Artificial sequence
  Extension Primer
gatttttttaagcagtagagcaata

SEQ ID NO: 22553 - DNA, 25 bp, Artificial sequence
  Extension Primer
cgttgtgagcttgtgtagcccgata

SEQ ID NO: 22554 - DNA, 25 bp, Artificial sequence
  Extension Primer
acttaagttgcttgcccaaggtcac

SEQ ID NO: 22555 - DNA, 25 bp, Artificial sequence
  Extension Primer
attagtttcctcacctgcaaagtgg

SEQ ID NO: 22556 - DNA, 25 bp, Artificial sequence
  Extension Primer
tccttaggttttggtccattcattt

SEQ ID NO: 22557 - DNA, 25 bp, Artificial sequence
  Extension Primer
gtcgacctaaatcctgagatatttt

SEQ ID NO: 22558 - DNA, 25 bp, Artificial sequence
  Extension Primer
atatatgatcatgaaaataccsaat

SEQ ID NO: 22559 - DNA, 25 bp, Artificial sequence
  Extension Primer
aggcagaagctaaaatttaatcatg

SEQ ID NO: 22560 - DNA, 25 bp, Artificial sequence
  Extension Primer
ctgaaacatctcagaccactaactg

SEQ ID NO: 22561 - DNA, 25 bp, Artificial sequence
  Extension Primer
ctcaccacaaaccctagcagtacat

SEQ ID NO: 22562 - DNA, 25 bp, Artificial sequence
  Extension Primer
ggccaatacaataagagaagatgtg

SEQ ID NO: 22563 - DNA, 25 bp, Artificial sequence
  Extension Primer
atggaaagctaaatccttatcagaa

SEQ ID NO: 22564 - DNA, 25 bp, Artificial sequence
  Extension Primer
gtgccttcagctcctaattaaatca

SEQ ID NO: 22565 - DNA, 25 bp, Artificial sequence
  Extension Primer
ttgcatagatttgatgttgttcagt

SEQ ID NO: 22566 - DNA, 25 bp, Artificial sequence
  Extension Primer
gtaccarctaagtggaacacagcca

SEQ ID NO: 22567 - DNA, 25 bp, Artificial sequence
  Extension Primer
tgcagctcacaaatgagatcttccc

SEQ ID NO: 22568 - DNA, 25 bp, Artificial sequence
  Extension Primer
gatccgcagataaggttccatttac

SEQ ID NO: 22569 - DNA, 25 bp, Artificial sequence
  Extension Primer
taaatgactgtttacaggctcttac

SEQ ID NO: 22570 - DNA, 25 bp, Artificial sequence
  Extension Primer
atggattcaatgggcattcatcttc

SEQ ID NO: 22571 - DNA, 25 bp, Artificial sequence
  Extension Primer
agggctgtgacgagacgttcaccaa

SEQ ID NO: 22572 - DNA, 25 bp, Artificial sequence
  Extension Primer
cagaagctctccagattaattgaat

SEQ ID NO: 22573 - DNA, 25 bp, Artificial sequence
  Extension Primer
actctgtgagcaacatttaccaaga

SEQ ID NO: 22574 - DNA, 25 bp, Artificial sequence
  Extension Primer
atgttcaagccctgagctgtctgcc

SEQ ID NO: 22575 - DNA, 25 bp, Artificial sequence
  Extension Primer
cttatttccctactctgatcatact

SEQ ID NO: 22576 - DNA, 25 bp, Artificial sequence
  Extension Primer
ccaaaattctgtttggttctctatc

SEQ ID NO: 22577 - DNA, 25 bp, Artificial sequence
  Extension Primer
gcctagccagctgcttctttcctct

SEQ ID NO: 22578 - DNA, 25 bp, Artificial sequence
  Extension Primer
tttacctcaccacaytggtctcctg

SEQ ID NO: 22579 - DNA, 25 bp, Artificial sequence
  Extension Primer
attctttctgaatatcaaccatcat

SEQ ID NO: 22580 - DNA, 25 bp, Artificial sequence
  Extension Primer
tctggagtcttctccttcactatca

SEQ ID NO: 22581 - DNA, 25 bp, Artificial sequence
  Extension Primer
attctcactggtgatttaaggagtt

SEQ ID NO: 22582 - DNA, 25 bp, Artificial sequence
  Extension Primer
cattatcgggcagtagtagtggcaa

SEQ ID NO: 22583 - DNA, 25 bp, Artificial sequence
  Extension Primer
cacgactgaaagactaacaygcaca

SEQ ID NO: 22584 - DNA, 25 bp, Artificial sequence
  Extension Primer
attgaaatacagttgattggcaatg

SEQ ID NO: 22585 - DNA, 25 bp, Artificial sequence
  Extension Primer
tagctttggctagcaactgacggat

SEQ ID NO: 22586 - DNA, 25 bp, Artificial sequence
  Extension Primer
ctttttttctgtggaccctacagtt

SEQ ID NO: 22587 - DNA, 25 bp, Artificial sequence
  Extension Primer
ctcgatgggcactgcattcctgtcc

SEQ ID NO: 22588 - DNA, 25 bp, Artificial sequence
  Extension Primer
aatgaaaactgaatagatttgaaaa

SEQ ID NO: 22589 - DNA, 25 bp, Artificial sequence
  Extension Primer
taggtgcttaatgaaatattctatg

SEQ ID NO: 22590 - DNA, 25 bp, Artificial sequence
  Extension Primer
ttttggcagcttctcttcctcagta

SEQ ID NO: 22591 - DNA, 25 bp, Artificial sequence
  Extension Primer
ttgtcgacacaacagggaaggcaac

SEQ ID NO: 22592 - DNA, 25 bp, Artificial sequence
  Extension Primer
cttatgtctccaaaactgcgttagg

SEQ ID NO: 22593 - DNA, 25 bp, Artificial sequence
  Extension Primer
tggtttgtcaaggagtttagatgac

SEQ ID NO: 22594 - DNA, 25 bp, Artificial sequence
  Extension Primer
aaaagccactcttgaagaatttgtt

SEQ ID NO: 22595 - DNA, 25 bp, Artificial sequence
  Extension Primer
ggttcaactttataaagtctgatag

SEQ ID NO: 22596 - DNA, 25 bp, Artificial sequence
  Extension Primer
cctaaamtagcctggctttcacagt

SEQ ID NO: 22597 - DNA, 25 bp, Artificial sequence
  Extension Primer
catttcctgaagctgtcagaagaga

SEQ ID NO: 22598 - DNA, 25 bp, Artificial sequence
  Extension Primer
cataatgttatatatttatactttt

SEQ ID NO: 22599 - DNA, 25 bp, Artificial sequence
  Extension Primer
tttttccctctactttgtcaattca

SEQ ID NO: 22600 - DNA, 25 bp, Artificial sequence
  Extension Primer
gatgataaacagaaaaaattattct

SEQ ID NO: 22601 - DNA, 25 bp, Artificial sequence
  Extension Primer
atttaatggcttatgagactttgaa

SEQ ID NO: 22602 - DNA, 25 bp, Artificial sequence
  Extension Primer
gatattggaaaagtctcaagggtcc

SEQ ID NO: 22603 - DNA, 25 bp, Artificial sequence
  Extension Primer
gaagcagcaagattgaggcgttttc

SEQ ID NO: 22604 - DNA, 25 bp, Artificial sequence
  Extension Primer
cctcatctggttagggattgctgaa

SEQ ID NO: 22605 - DNA, 25 bp, Artificial sequence
  Extension Primer
ttgtgatttttagcccattgagaag

SEQ ID NO: 22606 - DNA, 25 bp, Artificial sequence
  Extension Primer
ttacctcccttagcccaaaccatac

SEQ ID NO: 22607 - DNA, 25 bp, Artificial sequence
  Extension Primer
caacggctacggcctcatccagagc

SEQ ID NO: 22608 - DNA, 25 bp, Artificial sequence
  Extension Primer
cactttcataaagttggagggtaaa

SEQ ID NO: 22609 - DNA, 25 bp, Artificial sequence
  Extension Primer
ggaagaatgatgtaagctgagagag

SEQ ID NO: 22610 - DNA, 25 bp, Artificial sequence
  Extension Primer
tgagtttgctacaggaatggcaggc

SEQ ID NO: 22611 - DNA, 22 bp, Artificial sequence
  Extension Primer
cacttggagctggaaaggagcc

SEQ ID NO: 22612 - DNA, 25 bp, Artificial sequence
  Extension Primer
gctcacatctctctgcacatctcca

SEQ ID NO: 22613 - DNA, 25 bp, Artificial sequence
  Extension Primer
taagaattaaggtgtcatagtttta

SEQ ID NO: 22614 - DNA, 25 bp, Artificial sequence
  Extension Primer
aggtttagtttctcttcaagagtat

SEQ ID NO: 22615 - DNA, 25 bp, Artificial sequence
  Extension Primer
atcatatgataagtggataataatc

SEQ ID NO: 22616 - DNA, 25 bp, Artificial sequence
  Extension Primer
gtgtctccacagttggctgccttgt

SEQ ID NO: 22617 - DNA, 25 bp, Artificial sequence
  Extension Primer
aatttatgtttccaaacatctcatt

SEQ ID NO: 22618 - DNA, 22 bp, Artificial sequence
  Extension Primer
gccaaattgcttttgaatatgc

SEQ ID NO: 22619 - DNA, 25 bp, Artificial sequence
  Extension Primer
ctcaagaagaaaagaaaaaacacct

SEQ ID NO: 22620 - DNA, 25 bp, Artificial sequence
  Extension Primer
tcaaggtaccacttcaacaggttaa

SEQ ID NO: 22621 - DNA, 25 bp, Artificial sequence
  Extension Primer
ctggaggagaggccatggctccaag

SEQ ID NO: 22622 - DNA, 25 bp, Artificial sequence
  Extension Primer
ccatgagcacatgtgcacagactca

SEQ ID NO: 22623 - DNA, 25 bp, Artificial sequence
  Extension Primer
ccaccacaaaactccaaaaccaaag

SEQ ID NO: 22624 - DNA, 25 bp, Artificial sequence
  Extension Primer
ttgaggtaagaaacacggaaaggaa

SEQ ID NO: 22625 - DNA, 25 bp, Artificial sequence
  Extension Primer
agaaaacctattatctttcatattt

SEQ ID NO: 22626 - DNA, 25 bp, Artificial sequence
  Extension Primer
taggtgccacagtttggcttttatc

SEQ ID NO: 22627 - DNA, 25 bp, Artificial sequence
  Extension Primer
aaaaactgtagggcagttaatcctg

SEQ ID NO: 22628 - DNA, 25 bp, Artificial sequence
  Extension Primer
tcagaaaactcctaaacagaacaca

SEQ ID NO: 22629 - DNA, 25 bp, Artificial sequence
  Extension Primer
aatgagggatccggacaagagcgtg

SEQ ID NO: 22630 - DNA, 25 bp, Artificial sequence
  Extension Primer
agaggtcaggattctgtttgatatt

SEQ ID NO: 22631 - DNA, 25 bp, Artificial sequence
  Extension Primer
cacttgtgtgtcctgcagtgaagac

SEQ ID NO: 22632 - DNA, 25 bp, Artificial sequence
  Extension Primer
cagtaataaaaaacgctgactggta

SEQ ID NO: 22633 - DNA, 25 bp, Artificial sequence
  Extension Primer
attctctgtatactagagatggtgt

SEQ ID NO: 22634 - DNA, 25 bp, Artificial sequence
  Extension Primer
caaaaatgccttgtgtgtgctacca

SEQ ID NO: 22635 - DNA, 25 bp, Artificial sequence
  Extension Primer
accactggccctgtgtcaacatgat

SEQ ID NO: 22636 - DNA, 25 bp, Artificial sequence
  Extension Primer
tctgagaaaaaaaaataatatgaaa

SEQ ID NO: 22637 - DNA, 25 bp, Artificial sequence
  Extension Primer
gatagtagccaatccctttttatat

SEQ ID NO: 22638 - DNA, 25 bp, Artificial sequence
  Extension Primer
acaaagagcagaagtaattatgatt

SEQ ID NO: 22639 - DNA, 25 bp, Artificial sequence
  Extension Primer
ttaacttaaaacagagcaaaggcat

SEQ ID NO: 22640 - DNA, 25 bp, Artificial sequence
  Extension Primer
tcaatccctgggtttgggccactca

SEQ ID NO: 22641 - DNA, 25 bp, Artificial sequence
  Extension Primer
ctttgttgatctcctaaaaagcgaa

SEQ ID NO: 22642 - DNA, 25 bp, Artificial sequence
  Extension Primer
actatttgctttcactgtcacattt

SEQ ID NO: 22643 - DNA, 25 bp, Artificial sequence
  Extension Primer
attatccactgcctcttttccactt

SEQ ID NO: 22644 - DNA, 25 bp, Artificial sequence
  Extension Primer
agtattcctccagaaagagatacac

SEQ ID NO: 22645 - DNA, 25 bp, Artificial sequence
  Extension Primer
agttcaaatgcctgttcagtacaaa

SEQ ID NO: 22646 - DNA, 25 bp, Artificial sequence
  Extension Primer
gattgcacctgatcaaacagatgct

SEQ ID NO: 22647 - DNA, 25 bp, Artificial sequence
  Extension Primer
ttacccacgtgactcttttggagtg

SEQ ID NO: 22648 - DNA, 25 bp, Artificial sequence
  Extension Primer
aaaggttctcttctttcaaagaccc

SEQ ID NO: 22649 - DNA, 25 bp, Artificial sequence
  Extension Primer
atgattagacgcagtggggagtgag

SEQ ID NO: 22650 - DNA, 25 bp, Artificial sequence
  Extension Primer
aataggaactttaaaatgtcaaaga

SEQ ID NO: 22651 - DNA, 25 bp, Artificial sequence
  Extension Primer
aagactgagaaaccagcttttgtgg

SEQ ID NO: 22652 - DNA, 25 bp, Artificial sequence
  Extension Primer
actggtaccaggggcctggctgcta

SEQ ID NO: 22653 - DNA, 25 bp, Artificial sequence
  Extension Primer
tgarcatttttacaacaagaaaaga

SEQ ID NO: 22654 - DNA, 25 bp, Artificial sequence
  Extension Primer
tgaggctctgtggtcctcaggattt

SEQ ID NO: 22655 - DNA, 25 bp, Artificial sequence
  Extension Primer
atctataatcgagagtaggcagaga

SEQ ID NO: 22656 - DNA, 25 bp, Artificial sequence
  Extension Primer
cagcttcttacactacagcatccac

SEQ ID NO: 22657 - DNA, 22 bp, Artificial sequence
  Extension Primer
atgttcagacattacttaatac

SEQ ID NO: 22658 - DNA, 25 bp, Artificial sequence
  Extension Primer
tgagtggcctccaaaacttcttgtt

SEQ ID NO: 22659 - DNA, 25 bp, Artificial sequence
  Extension Primer
aggaaaccatctaccttttctacaa

SEQ ID NO: 22660 - DNA, 25 bp, Artificial sequence
  Extension Primer
atatatcagtgtcccatggatgcag

SEQ ID NO: 22661 - DNA, 25 bp, Artificial sequence
  Extension Primer
tgttttaaggcactgtgtttatggg

SEQ ID NO: 22662 - DNA, 25 bp, Artificial sequence
  Extension Primer
gagggaatactcagagtaggatgga

SEQ ID NO: 22663 - DNA, 25 bp, Artificial sequence
  Extension Primer
agcccacccctccccctgaaattct

SEQ ID NO: 22664 - DNA, 25 bp, Artificial sequence
  Extension Primer
gtctgtgtgtgcccatgttcatcct

SEQ ID NO: 22665 - DNA, 22 bp, Artificial sequence
  Extension Primer
cccaacccagaaaggagagagg

SEQ ID NO: 22666 - DNA, 25 bp, Artificial sequence
  Extension Primer
gccttaatcagtgtcccaggtctag

SEQ ID NO: 22667 - DNA, 25 bp, Artificial sequence
  Extension Primer
tttgatcacaggacgttttcagaaa

SEQ ID NO: 22668 - DNA, 25 bp, Artificial sequence
  Extension Primer
caaataaacacatgtttacctttgc

SEQ ID NO: 22669 - DNA, 25 bp, Artificial sequence
  Extension Primer
ctcaaccttacttctatgagaaaga

SEQ ID NO: 22670 - DNA, 25 bp, Artificial sequence
  Extension Primer
tayttcagcataatctgaaaggccc

SEQ ID NO: 22671 - DNA, 25 bp, Artificial sequence
  Extension Primer
tggcctcaggaacagtttcatacaa

SEQ ID NO: 22672 - DNA, 25 bp, Artificial sequence
  Extension Primer
aagcaaagaatgtctctagagtgac

SEQ ID NO: 22673 - DNA, 25 bp, Artificial sequence
  Extension Primer
taaggaccaaagcacccagtacaaa

SEQ ID NO: 22674 - DNA, 25 bp, Artificial sequence
  Extension Primer
ctgtcctccgtagtggctgtatcaa

SEQ ID NO: 22675 - DNA, 25 bp, Artificial sequence
  Extension Primer
cattttgtgtcacctttaagatttg

SEQ ID NO: 22676 - DNA, 25 bp, Artificial sequence
  Extension Primer
tggaacatataaacttttctgcctt

SEQ ID NO: 22677 - DNA, 25 bp, Artificial sequence
  Extension Primer
tgctctaaacttttccaaatactta

SEQ ID NO: 22678 - DNA, 25 bp, Artificial sequence
  Extension Primer
ggaaaacagtttggcattttgtcct

SEQ ID NO: 22679 - DNA, 25 bp, Artificial sequence
  Extension Primer
tcatttttttctttgtttttgaagt

SEQ ID NO: 22680 - DNA, 25 bp, Artificial sequence
  Extension Primer
gaatgggatgttgagtatgaatagg

SEQ ID NO: 22681 - DNA, 25 bp, Artificial sequence
  Extension Primer
tgctcaaggtcatttgaattccaay

SEQ ID NO: 22682 - DNA, 25 bp, Artificial sequence
  Extension Primer
ttctccagtgtgcaatcattaaata

SEQ ID NO: 22683 - DNA, 25 bp, Artificial sequence
  Extension Primer
gaacgcgggccctcagcagtgaaag

SEQ ID NO: 22684 - DNA, 25 bp, Artificial sequence
  Extension Primer
acctgaacgtttaacgaggctgggc

SEQ ID NO: 22685 - DNA, 25 bp, Artificial sequence
  Extension Primer
gtgtgtgtgtggaggaggggtgtgg

SEQ ID NO: 22686 - DNA, 25 bp, Artificial sequence
  Extension Primer
gttaatctcactacctaaaggcctc

SEQ ID NO: 22687 - DNA, 25 bp, Artificial sequence
  Extension Primer
atgtagattgaaaaataataggttt

SEQ ID NO: 22688 - DNA, 25 bp, Artificial sequence
  Extension Primer
ggaggattgcatctctgattaatga

SEQ ID NO: 22689 - DNA, 25 bp, Artificial sequence
  Extension Primer
atgaatagatgtgtgtggatcttta

SEQ ID NO: 22690 - DNA, 25 bp, Artificial sequence
  Extension Primer
tcctgggcttcatggaggtggcaga

SEQ ID NO: 22691 - DNA, 25 bp, Artificial sequence
  Extension Primer
tgttttccttacctgtcaatcgggg

SEQ ID NO: 22692 - DNA, 25 bp, Artificial sequence
  Extension Primer
tacccacttagccaaataaatgctg

SEQ ID NO: 22693 - DNA, 25 bp, Artificial sequence
  Extension Primer
gcttctttggcacctcttgatctcc

SEQ ID NO: 22694 - DNA, 25 bp, Artificial sequence
  Extension Primer
ttctgggattctccgacctcagggc

SEQ ID NO: 22695 - DNA, 25 bp, Artificial sequence
  Extension Primer
accctacrcattgtagcccacctgg

SEQ ID NO: 22696 - DNA, 25 bp, Artificial sequence
  Extension Primer
ctattaaagacaataatgaggactg

SEQ ID NO: 22697 - DNA, 22 bp, Artificial sequence
  Extension Primer
tttacctaatttgacaggaaac

SEQ ID NO: 22698 - DNA, 25 bp, Artificial sequence
  Extension Primer
aagcaaaatgcccatgtgcctcctc

SEQ ID NO: 22699 - DNA, 25 bp, Artificial sequence
  Extension Primer
aaatattaatagcatgagatttagg

SEQ ID NO: 22700 - DNA, 25 bp, Artificial sequence
  Extension Primer
gggcaccaggtattaggaccatgac

SEQ ID NO: 22701 - DNA, 25 bp, Artificial sequence
  Extension Primer
cactccctgcagaccccaggtccca

SEQ ID NO: 22702 - DNA, 25 bp, Artificial sequence
  Extension Primer
tgggatgagcctctastatytgatc

SEQ ID NO: 22703 - DNA, 22 bp, Artificial sequence
  Extension Primer
agacaggttccagataggctta

SEQ ID NO: 22704 - DNA, 25 bp, Artificial sequence
  Extension Primer
gaaccaggacagcacctgccagtgg

SEQ ID NO: 22705 - DNA, 25 bp, Artificial sequence
  Extension Primer
ttatattctccatgttttggagatg

SEQ ID NO: 22706 - DNA, 25 bp, Artificial sequence
  Extension Primer
accaaattggtcgttcaatttcaag

SEQ ID NO: 22707 - DNA, 25 bp, Artificial sequence
  Extension Primer
tgtaaatttattcaaaacatggaag

SEQ ID NO: 22708 - DNA, 25 bp, Artificial sequence
  Extension Primer
gaattcaaccgtacagagggaaggg

SEQ ID NO: 22709 - DNA, 25 bp, Artificial sequence
  Extension Primer
aaaccaattttcagcatggtaaaac

SEQ ID NO: 22710 - DNA, 25 bp, Artificial sequence
  Extension Primer
cttagtatgatggttccacagacaa

SEQ ID NO: 22711 - DNA, 25 bp, Artificial sequence
  Extension Primer
ttttttgttgttgttagtgttggaa

SEQ ID NO: 22712 - DNA, 25 bp, Artificial sequence
  Extension Primer
tttcacaaacaaattctgtgaaata

SEQ ID NO: 22713 - DNA, 25 bp, Artificial sequence
  Extension Primer
tattataatatttatacaatgttac

SEQ ID NO: 22714 - DNA, 25 bp, Artificial sequence
  Extension Primer
tatccctcaaaatccaattcaaatt

SEQ ID NO: 22715 - DNA, 25 bp, Artificial sequence
  Extension Primer
gtttggaaaagatgaagcctttgct

SEQ ID NO: 22716 - DNA, 25 bp, Artificial sequence
  Extension Primer
atgaaaacttgacccaaagtggagt

SEQ ID NO: 22717 - DNA, 25 bp, Artificial sequence
  Extension Primer
taattatcttgctcaccttttgttc

SEQ ID NO: 22718 - DNA, 25 bp, Artificial sequence
  Extension Primer
tgacagccatcaaaactacaagggc

SEQ ID NO: 22719 - DNA, 25 bp, Artificial sequence
  Extension Primer
aaaatgagaagtcagagttaataaa

SEQ ID NO: 22720 - DNA, 25 bp, Artificial sequence
  Extension Primer
cttttagctagggtggggcgaggat

SEQ ID NO: 22721 - DNA, 25 bp, Artificial sequence
  Extension Primer
caccgtggcggaggtttagcctctc

SEQ ID NO: 22722 - DNA, 25 bp, Artificial sequence
  Extension Primer
acggagccattgaggtcgaacggag

SEQ ID NO: 22723 - DNA, 25 bp, Artificial sequence
  Extension Primer
ttttctagtttaagtaaagaaaata

SEQ ID NO: 22724 - DNA, 22 bp, Artificial sequence
  Extension Primer
cagrctgatgctgggagagtgg

SEQ ID NO: 22725 - DNA, 25 bp, Artificial sequence
  Extension Primer
ctttgttctattcattgaatttatt

SEQ ID NO: 22726 - DNA, 25 bp, Artificial sequence
  Extension Primer
ggctagctgggcggcaactggggtg

SEQ ID NO: 22727 - DNA, 25 bp, Artificial sequence
  Extension Primer
acaacaagccattctagagatcaaa

SEQ ID NO: 22728 - DNA, 25 bp, Artificial sequence
  Extension Primer
gaaaaatagtcatatagctacagtc

SEQ ID NO: 22729 - DNA, 25 bp, Artificial sequence
  Extension Primer
atcacacgtgagggtgttagactgg

SEQ ID NO: 22730 - DNA, 25 bp, Artificial sequence
  Extension Primer
gtatctcacaattgtcatctgtgag

SEQ ID NO: 22731 - DNA, 25 bp, Artificial sequence
  Extension Primer
gagaaatctactagagatcctgggt

SEQ ID NO: 22732 - DNA, 25 bp, Artificial sequence
  Extension Primer
agatacatttctttgtgctctagtc

SEQ ID NO: 22733 - DNA, 25 bp, Artificial sequence
  Extension Primer
taagtgacagtgagatcctaacagt

SEQ ID NO: 22734 - DNA, 25 bp, Artificial sequence
  Extension Primer
ccacgttccccataattggaatgac

SEQ ID NO: 22735 - DNA, 25 bp, Artificial sequence
  Extension Primer
atgactgctaactgacacaactttg

SEQ ID NO: 22736 - DNA, 25 bp, Artificial sequence
  Extension Primer
tacaggcaaaatattcatttgttcc

SEQ ID NO: 22737 - DNA, 25 bp, Artificial sequence
  Extension Primer
tcaaccctgcccctgctgactgcct

SEQ ID NO: 22738 - DNA, 25 bp, Artificial sequence
  Extension Primer
aggtgcttgatcaatgatgaaggaa

SEQ ID NO: 22739 - DNA, 25 bp, Artificial sequence
  Extension Primer
tggcggaatgagattttcttaaaaa

SEQ ID NO: 22740 - DNA, 25 bp, Artificial sequence
  Extension Primer
gtcctaccatttttaaaacacagag

SEQ ID NO: 22741 - DNA, 25 bp, Artificial sequence
  Extension Primer
gctggctttgctgtgaaacgagtgg

SEQ ID NO: 22742 - DNA, 25 bp, Artificial sequence
  Extension Primer
tcactcggtttcttgcctcctggat

SEQ ID NO: 22743 - DNA, 25 bp, Artificial sequence
  Extension Primer
agtgcagaatgagccttacaataaa

SEQ ID NO: 22744 - DNA, 25 bp, Artificial sequence
  Extension Primer
attttaaaggtgatccaagtggggt

SEQ ID NO: 22745 - DNA, 25 bp, Artificial sequence
  Extension Primer
gtaatcatttatatgcsttcctctt

SEQ ID NO: 22746 - DNA, 25 bp, Artificial sequence
  Extension Primer
aataataatgtgctagaatgaaagc

SEQ ID NO: 22747 - DNA, 25 bp, Artificial sequence
  Extension Primer
aatacagaaaaaatatcctgaatcc

SEQ ID NO: 22748 - DNA, 25 bp, Artificial sequence
  Extension Primer
gcaggatttttcagagtccttaata

SEQ ID NO: 22749 - DNA, 25 bp, Artificial sequence
  Extension Primer
gccacgtggctctcaattcggccct

SEQ ID NO: 22750 - DNA, 25 bp, Artificial sequence
  Extension Primer
ctggtttcaaggagtttgctatatt

SEQ ID NO: 22751 - DNA, 25 bp, Artificial sequence
  Extension Primer
ggactgtcctttattcattttccta

SEQ ID NO: 22752 - DNA, 25 bp, Artificial sequence
  Extension Primer
ggaagttgtttcactctgtctttgt

SEQ ID NO: 22753 - DNA, 25 bp, Artificial sequence
  Extension Primer
tgtctagtcagcctgtcttaatcgc

SEQ ID NO: 22754 - DNA, 25 bp, Artificial sequence
  Extension Primer
ctgggaaagaaaaggttatggatat

SEQ ID NO: 22755 - DNA, 25 bp, Artificial sequence
  Extension Primer
cctgtgctttgtgcaacagagggtc

SEQ ID NO: 22756 - DNA, 25 bp, Artificial sequence
  Extension Primer
gtctaagccaagccctgtgaaagta

SEQ ID NO: 22757 - DNA, 25 bp, Artificial sequence
  Extension Primer
gttttgagcttttgaaaattactac

SEQ ID NO: 22758 - DNA, 25 bp, Artificial sequence
  Extension Primer
taagacaggatgtttttctttcatt

SEQ ID NO: 22759 - DNA, 25 bp, Artificial sequence
  Extension Primer
gaataaatgtaggttgatgaaaggt

SEQ ID NO: 22760 - DNA, 25 bp, Artificial sequence
  Extension Primer
tcttgcatataaggtggagactcac

SEQ ID NO: 22761 - DNA, 25 bp, Artificial sequence
  Extension Primer
tgtcgaagtcaagacaggaacatag

SEQ ID NO: 22762 - DNA, 25 bp, Artificial sequence
  Extension Primer
atgtgtaatttgttttcctttgggc

SEQ ID NO: 22763 - DNA, 25 bp, Artificial sequence
  Extension Primer
aggaaggaaactttttctagacatg

SEQ ID NO: 22764 - DNA, 25 bp, Artificial sequence
  Extension Primer
ttgagctttatgacactttttattg

SEQ ID NO: 22765 - DNA, 25 bp, Artificial sequence
  Extension Primer
ccactcacatccccatatggctaag

SEQ ID NO: 22766 - DNA, 25 bp, Artificial sequence
  Extension Primer
atctttgcatcatattttatgttcc

SEQ ID NO: 22767 - DNA, 25 bp, Artificial sequence
  Extension Primer
tctataatttttgctggggaaggta

SEQ ID NO: 22768 - DNA, 25 bp, Artificial sequence
  Extension Primer
tattcactttgaaaatggtttaatt

SEQ ID NO: 22769 - DNA, 25 bp, Artificial sequence
  Extension Primer
gttcactcatcagagtgctttgccc

SEQ ID NO: 22770 - DNA, 25 bp, Artificial sequence
  Extension Primer
cggcctctgtgcaccatggatgggg

SEQ ID NO: 22771 - DNA, 25 bp, Artificial sequence
  Extension Primer
ggttagcttttgaaaaataaggata

SEQ ID NO: 22772 - DNA, 25 bp, Artificial sequence
  Extension Primer
ccagaggcctctgagagcagaagaa

SEQ ID NO: 22773 - DNA, 25 bp, Artificial sequence
  Extension Primer
aaagagcctgatgctggtgagcgtc

SEQ ID NO: 22774 - DNA, 25 bp, Artificial sequence
  Extension Primer
tctcaacaactgctcctgagaaata

SEQ ID NO: 22775 - DNA, 25 bp, Artificial sequence
  Extension Primer
gaggcaaattaccagacacatamtg

SEQ ID NO: 22776 - DNA, 25 bp, Artificial sequence
  Extension Primer
atactgaacttcgactatagaggga

SEQ ID NO: 22777 - DNA, 25 bp, Artificial sequence
  Extension Primer
gccttctgaggccctgcaaggaatc

SEQ ID NO: 22778 - DNA, 25 bp, Artificial sequence
  Extension Primer
caggtagggtaatggtaatagtgcc

SEQ ID NO: 22779 - DNA, 25 bp, Artificial sequence
  Extension Primer
cctgagtgctctgctcatgctcaaa

SEQ ID NO: 22780 - DNA, 25 bp, Artificial sequence
  Extension Primer
tcaaatttaataacaacttgtttta

SEQ ID NO: 22781 - DNA, 25 bp, Artificial sequence
  Extension Primer
aggtaaaagaagtactttcctttta

SEQ ID NO: 22782 - DNA, 25 bp, Artificial sequence
  Extension Primer
gtcctctccaagcttgctgctgctc

SEQ ID NO: 22783 - DNA, 25 bp, Artificial sequence
  Extension Primer
gggggatgatggcagggtggctggg

SEQ ID NO: 22784 - DNA, 25 bp, Artificial sequence
  Extension Primer
ataaggcaaaagtcaagaaaatggc

SEQ ID NO: 22785 - DNA, 25 bp, Artificial sequence
  Extension Primer
ctcattcagccaacattttacaaca

SEQ ID NO: 22786 - DNA, 25 bp, Artificial sequence
  Extension Primer
ttttcttttctcttccagcatctaa

SEQ ID NO: 22787 - DNA, 25 bp, Artificial sequence
  Extension Primer
ggacctgctttgcagcggaggatac

SEQ ID NO: 22788 - DNA, 25 bp, Artificial sequence
  Extension Primer
gcaaacacaaaagatcaacaggtaa

SEQ ID NO: 22789 - DNA, 25 bp, Artificial sequence
  Extension Primer
gcaagttttgacacaaattataact

SEQ ID NO: 22790 - DNA, 25 bp, Artificial sequence
  Extension Primer
agagttcagccagcctcaactacag

SEQ ID NO: 22791 - DNA, 25 bp, Artificial sequence
  Extension Primer
ctttggttagctggcaagtgaacat

SEQ ID NO: 22792 - DNA, 25 bp, Artificial sequence
  Extension Primer
agaatagcatrtagtaatcacccaa

SEQ ID NO: 22793 - DNA, 25 bp, Artificial sequence
  Extension Primer
tcaaacgtttrttgggtgattacta

SEQ ID NO: 22794 - DNA, 25 bp, Artificial sequence
  Extension Primer
tacgttagcatcatcacatctctca

SEQ ID NO: 22795 - DNA, 25 bp, Artificial sequence
  Extension Primer
ataatagattttgctataaaagtgg

SEQ ID NO: 22796 - DNA, 25 bp, Artificial sequence
  Extension Primer
accaaaaggcagaagagatcataag

SEQ ID NO: 22797 - DNA, 25 bp, Artificial sequence
  Extension Primer
ccgtattttatatgtccttttatct

SEQ ID NO: 22798 - DNA, 25 bp, Artificial sequence
  Extension Primer
gaaccagaaacgaagccaagagtgc

SEQ ID NO: 22799 - DNA, 25 bp, Artificial sequence
  Extension Primer
gtatgaggccacttggggttgtttg

SEQ ID NO: 22800 - DNA, 25 bp, Artificial sequence
  Extension Primer
ggaattatggcactaggaaatttgc

SEQ ID NO: 22801 - DNA, 25 bp, Artificial sequence
  Extension Primer
tgacggtgctgggtcttagttgcag

SEQ ID NO: 22802 - DNA, 25 bp, Artificial sequence
  Extension Primer
tgtcttgatggagctttgggagttt

SEQ ID NO: 22803 - DNA, 25 bp, Artificial sequence
  Extension Primer
tctacttacctgagtgcccctgtgt

SEQ ID NO: 22804 - DNA, 25 bp, Artificial sequence
  Extension Primer
tttctgctattgaataagaaaacat

SEQ ID NO: 22805 - DNA, 25 bp, Artificial sequence
  Extension Primer
gagtcagtccacagataggaaggtt

SEQ ID NO: 22806 - DNA, 25 bp, Artificial sequence
  Extension Primer
ctactcagttcagttcagttcagtc

SEQ ID NO: 22807 - DNA, 25 bp, Artificial sequence
  Extension Primer
tagtcccaggtgctggcgcagtgga

SEQ ID NO: 22808 - DNA, 25 bp, Artificial sequence
  Extension Primer
actgtgtcttcccatgcaggggatg

SEQ ID NO: 22809 - DNA, 25 bp, Artificial sequence
  Extension Primer
cctatgaggactagaagagtgatgt

SEQ ID NO: 22810 - DNA, 25 bp, Artificial sequence
  Extension Primer
acacactttattttgatgagaacat

SEQ ID NO: 22811 - DNA, 25 bp, Artificial sequence
  Extension Primer
agtctatgtatgacctgcatagaac

SEQ ID NO: 22812 - DNA, 25 bp, Artificial sequence
  Extension Primer
agtaacccaagttattatgaaacag

SEQ ID NO: 22813 - DNA, 25 bp, Artificial sequence
  Extension Primer
ggagtggggcgaaaaggggttcaga

SEQ ID NO: 22814 - DNA, 25 bp, Artificial sequence
  Extension Primer
agatgaagagtcaaggacaaaccar

SEQ ID NO: 22815 - DNA, 25 bp, Artificial sequence
  Extension Primer
aaactgacactaaggtggatgtcag

SEQ ID NO: 22816 - DNA, 25 bp, Artificial sequence
  Extension Primer
ctgttctccagttktcctctctgct

SEQ ID NO: 22817 - DNA, 25 bp, Artificial sequence
  Extension Primer
agggagatttgaaggatgagactca

SEQ ID NO: 22818 - DNA, 25 bp, Artificial sequence
  Extension Primer
ttagcgacagggatccaggtgctgc

SEQ ID NO: 22819 - DNA, 25 bp, Artificial sequence
  Extension Primer
cctttccaacataaagtgaattata

SEQ ID NO: 22820 - DNA, 25 bp, Artificial sequence
  Extension Primer
tcagaatgtaggaaggctatgatgg

SEQ ID NO: 22821 - DNA, 25 bp, Artificial sequence
  Extension Primer
actctatggactcacacaagtacaa

SEQ ID NO: 22822 - DNA, 25 bp, Artificial sequence
  Extension Primer
cttcagccaagaaattgatgggaac

SEQ ID NO: 22823 - DNA, 25 bp, Artificial sequence
  Extension Primer
agggattgtatctttaacacttgga

SEQ ID NO: 22824 - DNA, 25 bp, Artificial sequence
  Extension Primer
ctctactacacatcagaccccagac

SEQ ID NO: 22825 - DNA, 25 bp, Artificial sequence
  Extension Primer
tcttcccagaccttgtggttaaatc

SEQ ID NO: 22826 - DNA, 25 bp, Artificial sequence
  Extension Primer
cggctgctgaactgtccattcattc

SEQ ID NO: 22827 - DNA, 25 bp, Artificial sequence
  Extension Primer
gccccaggccaagttcagccaagaa

SEQ ID NO: 22828 - DNA, 22 bp, Artificial sequence
  Extension Primer
ctggctgtaaagcagtgggtca

SEQ ID NO: 22829 - DNA, 25 bp, Artificial sequence
  Extension Primer
tttagatcccttagttctgtcatca

SEQ ID NO: 22830 - DNA, 25 bp, Artificial sequence
  Extension Primer
gggaagtggaggttgaataaaagas

SEQ ID NO: 22831 - DNA, 25 bp, Artificial sequence
  Extension Primer
taaagcatccataattgaagcctcc

SEQ ID NO: 22832 - DNA, 25 bp, Artificial sequence
  Extension Primer
aatgatatcccattaggaaaacctg

SEQ ID NO: 22833 - DNA, 25 bp, Artificial sequence
  Extension Primer
aaattttaactggagaattgaaata

SEQ ID NO: 22834 - DNA, 25 bp, Artificial sequence
  Extension Primer
aatcaaacaaccaagaattatatca

SEQ ID NO: 22835 - DNA, 25 bp, Artificial sequence
  Extension Primer
aaggtgaacttgaagacactttgag

SEQ ID NO: 22836 - DNA, 25 bp, Artificial sequence
  Extension Primer
ttagttttaaattctgcacaaaaat

SEQ ID NO: 22837 - DNA, 25 bp, Artificial sequence
  Extension Primer
atctgaagtgaccgagatgctaatt

SEQ ID NO: 22838 - DNA, 25 bp, Artificial sequence
  Extension Primer
aacaacctgggaataaaccctttgg

SEQ ID NO: 22839 - DNA, 25 bp, Artificial sequence
  Extension Primer
ggaggraccaagaaacagacaaagg

SEQ ID NO: 22840 - DNA, 25 bp, Artificial sequence
  Extension Primer
ctgaggcccttccctctccaagaag

SEQ ID NO: 22841 - DNA, 25 bp, Artificial sequence
  Extension Primer
caactatctcaagtgttaggtatta

SEQ ID NO: 22842 - DNA, 25 bp, Artificial sequence
  Extension Primer
ttgaggggatagaatagaggaaata

SEQ ID NO: 22843 - DNA, 25 bp, Artificial sequence
  Extension Primer
ccctctcctggtgctgtgacaaagc

SEQ ID NO: 22844 - DNA, 22 bp, Artificial sequence
  Extension Primer
gaaccrgcataccccatcacaa

SEQ ID NO: 22845 - DNA, 25 bp, Artificial sequence
  Extension Primer
attaaatgaatgtggtcattgcctc

SEQ ID NO: 22846 - DNA, 25 bp, Artificial sequence
  Extension Primer
gccacagacgggaacagagagggga

SEQ ID NO: 22847 - DNA, 25 bp, Artificial sequence
  Extension Primer
aaaaaaaaaaaagaggtgcatctgt

SEQ ID NO: 22848 - DNA, 25 bp, Artificial sequence
  Extension Primer
aagaagyctgaaacacagcacacag

SEQ ID NO: 22849 - DNA, 25 bp, Artificial sequence
  Extension Primer
tctgcttatattttcccacctaact

SEQ ID NO: 22850 - DNA, 25 bp, Artificial sequence
  Extension Primer
taagattctattaaaacaaaaaccc

SEQ ID NO: 22851 - DNA, 25 bp, Artificial sequence
  Extension Primer
tgctgtacaaaaattttttagatgt

SEQ ID NO: 22852 - DNA, 25 bp, Artificial sequence
  Extension Primer
gcattgctctgaatgggccatactt

SEQ ID NO: 22853 - DNA, 25 bp, Artificial sequence
  Extension Primer
ttcatcctactctgtcccctgtcta

SEQ ID NO: 22854 - DNA, 25 bp, Artificial sequence
  Extension Primer
ttctgaacgcctcctcccatcaccg

SEQ ID NO: 22855 - DNA, 25 bp, Artificial sequence
  Extension Primer
gcagagaaaggcgcaaacaagtaca

SEQ ID NO: 22856 - DNA, 25 bp, Artificial sequence
  Extension Primer
gacttgaagattcaggaacctagta

SEQ ID NO: 22857 - DNA, 25 bp, Artificial sequence
  Extension Primer
aactttttaaaaatcagtggagaaa

SEQ ID NO: 22858 - DNA, 25 bp, Artificial sequence
  Extension Primer
gattgtcccctgaaatgttactctt

SEQ ID NO: 22859 - DNA, 25 bp, Artificial sequence
  Extension Primer
aaaaaatactcatttgtaaatatgt

SEQ ID NO: 22860 - DNA, 25 bp, Artificial sequence
  Extension Primer
ctcttcagggtttcattggatgcct

SEQ ID NO: 22861 - DNA, 25 bp, Artificial sequence
  Extension Primer
ggtctaccagtatgccagtcccaag

SEQ ID NO: 22862 - DNA, 25 bp, Artificial sequence
  Extension Primer
ttcagagttctctcccgccctcttt

SEQ ID NO: 22863 - DNA, 25 bp, Artificial sequence
  Extension Primer
gtgccaccgtacctctcccaccccc

SEQ ID NO: 22864 - DNA, 25 bp, Artificial sequence
  Extension Primer
gtttcctgctactggaatggaccag

SEQ ID NO: 22865 - DNA, 25 bp, Artificial sequence
  Extension Primer
catgtctctgagtttcagatagatc

SEQ ID NO: 22866 - DNA, 22 bp, Artificial sequence
  Extension Primer
gctgctgtgaacattggggcac

SEQ ID NO: 22867 - DNA, 25 bp, Artificial sequence
  Extension Primer
ccatggagaaacagcactcaacccg

SEQ ID NO: 22868 - DNA, 25 bp, Artificial sequence
  Extension Primer
gtggctgtgacctcggaaatttctt

SEQ ID NO: 22869 - DNA, 25 bp, Artificial sequence
  Extension Primer
atgctcttccatgtgcttatatttt

SEQ ID NO: 22870 - DNA, 25 bp, Artificial sequence
  Extension Primer
tgagaactcttaggatttactctct

SEQ ID NO: 22871 - DNA, 25 bp, Artificial sequence
  Extension Primer
gcacataattatataccattcacta

SEQ ID NO: 22872 - DNA, 25 bp, Artificial sequence
  Extension Primer
ccttctactctcttccttcctgtaa

SEQ ID NO: 22873 - DNA, 25 bp, Artificial sequence
  Extension Primer
caaccaatagtaaaagaaccatgat

SEQ ID NO: 22874 - DNA, 25 bp, Artificial sequence
  Extension Primer
aggtgggtgcgtccatccctcaggc

SEQ ID NO: 22875 - DNA, 25 bp, Artificial sequence
  Extension Primer
agcaagaactgagttcagcgaggac

SEQ ID NO: 22876 - DNA, 25 bp, Artificial sequence
  Extension Primer
catgagaaaggagaggaaattagat

SEQ ID NO: 22877 - DNA, 25 bp, Artificial sequence
  Extension Primer
ttactaaatcgtatctcatgtagag

SEQ ID NO: 22878 - DNA, 25 bp, Artificial sequence
  Extension Primer
cctgactgttctagatcattttcat

SEQ ID NO: 22879 - DNA, 25 bp, Artificial sequence
  Extension Primer
ccacacccaccgaaccgctcagtgc

SEQ ID NO: 22880 - DNA, 25 bp, Artificial sequence
  Extension Primer
cggagacagcatcagcaaaaagaaa

SEQ ID NO: 22881 - DNA, 25 bp, Artificial sequence
  Extension Primer
gaaacgtaagacaatctctgctgtc

SEQ ID NO: 22882 - DNA, 25 bp, Artificial sequence
  Extension Primer
acttcgacctagcaaacagacataa

SEQ ID NO: 22883 - DNA, 25 bp, Artificial sequence
  Extension Primer
aggacatggctctcatgatgtatct

SEQ ID NO: 22884 - DNA, 25 bp, Artificial sequence
  Extension Primer
cacttctgtggtcatcaattgctta

SEQ ID NO: 22885 - DNA, 25 bp, Artificial sequence
  Extension Primer
aagaaaaggtacaattccttagatt

SEQ ID NO: 22886 - DNA, 25 bp, Artificial sequence
  Extension Primer
tgtgtgacttcttcggtgctgttca

SEQ ID NO: 22887 - DNA, 25 bp, Artificial sequence
  Extension Primer
ggaagccagcagcggtgcgtggacc

SEQ ID NO: 22888 - DNA, 25 bp, Artificial sequence
  Extension Primer
gtccaaggaatcgaaaactacagga

SEQ ID NO: 22889 - DNA, 25 bp, Artificial sequence
  Extension Primer
tcttctctctccctccgctttcagg

SEQ ID NO: 22890 - DNA, 25 bp, Artificial sequence
  Extension Primer
cctggtaggctacagtccatggggt

SEQ ID NO: 22891 - DNA, 25 bp, Artificial sequence
  Extension Primer
caagaaaatgtttatgatataatgc

SEQ ID NO: 22892 - DNA, 25 bp, Artificial sequence
  Extension Primer
tktgtgcaagaagatgcctgcctca

SEQ ID NO: 22893 - DNA, 25 bp, Artificial sequence
  Extension Primer
tttacagaaagaggaaccctaattg

SEQ ID NO: 22894 - DNA, 25 bp, Artificial sequence
  Extension Primer
gcttcttccctaagctacagtctga

SEQ ID NO: 22895 - DNA, 25 bp, Artificial sequence
  Extension Primer
ttgatctctttggatctgaggagga

SEQ ID NO: 22896 - DNA, 25 bp, Artificial sequence
  Extension Primer
gccttagtttcatttatggatcctg

SEQ ID NO: 22897 - DNA, 25 bp, Artificial sequence
  Extension Primer
ctgggaataaaaacccaaactgaaa

SEQ ID NO: 22898 - DNA, 25 bp, Artificial sequence
  Extension Primer
aattagaactatttatagcactgaa

SEQ ID NO: 22899 - DNA, 25 bp, Artificial sequence
  Extension Primer
caaatagagttgttgacagataaat

SEQ ID NO: 22900 - DNA, 25 bp, Artificial sequence
  Extension Primer
gctgttataatattccaactgaaat

SEQ ID NO: 22901 - DNA, 25 bp, Artificial sequence
  Extension Primer
ggtcaaattatagctttggacctct

SEQ ID NO: 22902 - DNA, 25 bp, Artificial sequence
  Extension Primer
ttgtccaggtaaatggacatcagac

SEQ ID NO: 22903 - DNA, 25 bp, Artificial sequence
  Extension Primer
gtctaccaaaacatccagtaacagc

SEQ ID NO: 22904 - DNA, 25 bp, Artificial sequence
  Extension Primer
ccagtgcagcctgatctgaattgcc

SEQ ID NO: 22905 - DNA, 25 bp, Artificial sequence
  Extension Primer
ctctccctttctcaccttcctctta

SEQ ID NO: 22906 - DNA, 25 bp, Artificial sequence
  Extension Primer
tcatcatcattattataacagtgct

SEQ ID NO: 22907 - DNA, 25 bp, Artificial sequence
  Extension Primer
gacatwtcaaactttctttrggagt

SEQ ID NO: 22908 - DNA, 25 bp, Artificial sequence
  Extension Primer
ttttctgacagatattcttttgaat

SEQ ID NO: 22909 - DNA, 25 bp, Artificial sequence
  Extension Primer
ttcagctcccatagtgaaagcagtt

SEQ ID NO: 22910 - DNA, 25 bp, Artificial sequence
  Extension Primer
ataattgtgtaacctgaggtgtccc

SEQ ID NO: 22911 - DNA, 25 bp, Artificial sequence
  Extension Primer
agacagacctggctctccagttctt

SEQ ID NO: 22912 - DNA, 25 bp, Artificial sequence
  Extension Primer
aaccttctgctctcttcytgcacca

SEQ ID NO: 22913 - DNA, 25 bp, Artificial sequence
  Extension Primer
gtggtcagaaccttctgctctcttc

SEQ ID NO: 22914 - DNA, 25 bp, Artificial sequence
  Extension Primer
acagttctcacgtaatggcatggga

SEQ ID NO: 22915 - DNA, 25 bp, Artificial sequence
  Extension Primer
attttactttaaaaggtaaaaagga

SEQ ID NO: 22916 - DNA, 25 bp, Artificial sequence
  Extension Primer
tcctgattaaacttccctaaaactc

SEQ ID NO: 22917 - DNA, 25 bp, Artificial sequence
  Extension Primer
ctaatttagaatgattgttgactac

SEQ ID NO: 22918 - DNA, 25 bp, Artificial sequence
  Extension Primer
gaaatacagatgaaaagtagaaggt

SEQ ID NO: 22919 - DNA, 25 bp, Artificial sequence
  Extension Primer
actaccgacagggagacaattttac

SEQ ID NO: 22920 - DNA, 25 bp, Artificial sequence
  Extension Primer
tcttttaaccaagcaggatggtcta

SEQ ID NO: 22921 - DNA, 25 bp, Artificial sequence
  Extension Primer
tttaagcagcattttcatttacttg

SEQ ID NO: 22922 - DNA, 25 bp, Artificial sequence
  Extension Primer
aaaatgactggaagtacaccaaatc

SEQ ID NO: 22923 - DNA, 25 bp, Artificial sequence
  Extension Primer
tgggaccaggggtggccccagctta

SEQ ID NO: 22924 - DNA, 25 bp, Artificial sequence
  Extension Primer
gaggccaagggctggcaggccaggg

SEQ ID NO: 22925 - DNA, 25 bp, Artificial sequence
  Extension Primer
atrcttgcctctgtctggacttgct

SEQ ID NO: 22926 - DNA, 25 bp, Artificial sequence
  Extension Primer
gccagacagtaacttaggctttgtg

SEQ ID NO: 22927 - DNA, 25 bp, Artificial sequence
  Extension Primer
tgtgccctatgtatcttcttcttcc

SEQ ID NO: 22928 - DNA, 25 bp, Artificial sequence
  Extension Primer
aatgtattttcttattacttcaatt

SEQ ID NO: 22929 - DNA, 25 bp, Artificial sequence
  Extension Primer
ctgccgaaacccactttagtgtctg

SEQ ID NO: 22930 - DNA, 25 bp, Artificial sequence
  Extension Primer
ctattttaaaaagagaggtacctgc

SEQ ID NO: 22931 - DNA, 25 bp, Artificial sequence
  Extension Primer
tagatatatctctttattcttctgg

SEQ ID NO: 22932 - DNA, 25 bp, Artificial sequence
  Extension Primer
gtctgtctaaactgtggactccaaa

SEQ ID NO: 22933 - DNA, 25 bp, Artificial sequence
  Extension Primer
attctgtgcatctcaaggccacttc

SEQ ID NO: 22934 - DNA, 25 bp, Artificial sequence
  Extension Primer
tttaatcatccttggaactctcatt

SEQ ID NO: 22935 - DNA, 25 bp, Artificial sequence
  Extension Primer
ttaatggaaagctagagaaatcaga

SEQ ID NO: 22936 - DNA, 25 bp, Artificial sequence
  Extension Primer
gttttagggatttccctggtggtgc

SEQ ID NO: 22937 - DNA, 25 bp, Artificial sequence
  Extension Primer
cagttatttctctaaaatacctttc

SEQ ID NO: 22938 - DNA, 25 bp, Artificial sequence
  Extension Primer
atacctttcrcttgaaattattagc

SEQ ID NO: 22939 - DNA, 25 bp, Artificial sequence
  Extension Primer
gcaccagctagagaatttatctgag

SEQ ID NO: 22940 - DNA, 25 bp, Artificial sequence
  Extension Primer
ccaaaacctttaytttatcaaacaa

SEQ ID NO: 22941 - DNA, 25 bp, Artificial sequence
  Extension Primer
tgataattctccyttgtttgataaa

SEQ ID NO: 22942 - DNA, 25 bp, Artificial sequence
  Extension Primer
ggcagaccttaaaacggcaggaagg

SEQ ID NO: 22943 - DNA, 25 bp, Artificial sequence
  Extension Primer
agaaataagataatagctcctttgc

SEQ ID NO: 22944 - DNA, 25 bp, Artificial sequence
  Extension Primer
gactttcattggttcatttaatgct

SEQ ID NO: 22945 - DNA, 25 bp, Artificial sequence
  Extension Primer
cccactcctccacgggcacgcactc

SEQ ID NO: 22946 - DNA, 25 bp, Artificial sequence
  Extension Primer
gcatccgttatccggtgatggtaca

SEQ ID NO: 22947 - DNA, 25 bp, Artificial sequence
  Extension Primer
ctggatagtattccctgagtgaaca

SEQ ID NO: 22948 - DNA, 25 bp, Artificial sequence
  Extension Primer
tggcgctgtgcccaggccactgagg

SEQ ID NO: 22949 - DNA, 25 bp, Artificial sequence
  Extension Primer
ttttctgttcttggcagggaggtta

SEQ ID NO: 22950 - DNA, 25 bp, Artificial sequence
  Extension Primer
ctaattgatacagctggaacactga

SEQ ID NO: 22951 - DNA, 25 bp, Artificial sequence
  Extension Primer
tcctatgtctccgtccagcttatag

SEQ ID NO: 22952 - DNA, 25 bp, Artificial sequence
  Extension Primer
ctgcaggggactactaagtctgaaa

SEQ ID NO: 22953 - DNA, 25 bp, Artificial sequence
  Extension Primer
atgtcaggctagaattaaaagacag

SEQ ID NO: 22954 - DNA, 25 bp, Artificial sequence
  Extension Primer
agagatgatgtaaagcctcttcctc

SEQ ID NO: 22955 - DNA, 25 bp, Artificial sequence
  Extension Primer
tcatgacaggacaggaatattgatc

SEQ ID NO: 22956 - DNA, 25 bp, Artificial sequence
  Extension Primer
accttgattgactttgcttttccta

SEQ ID NO: 22957 - DNA, 25 bp, Artificial sequence
  Extension Primer
ctcatacacaacacacatactcctt

SEQ ID NO: 22958 - DNA, 25 bp, Artificial sequence
  Extension Primer
taataaaagggagagaaaagactca

SEQ ID NO: 22959 - DNA, 25 bp, Artificial sequence
  Extension Primer
agattttgttttaagagatggaaag

SEQ ID NO: 22960 - DNA, 25 bp, Artificial sequence
  Extension Primer
ttttgttttaagagatggaaagrtg

SEQ ID NO: 22961 - DNA, 25 bp, Artificial sequence
  Extension Primer
tgctaattgtacagttagtctaagg

SEQ ID NO: 22962 - DNA, 25 bp, Artificial sequence
  Extension Primer
tttccttttctttcacatctttctt

SEQ ID NO: 22963 - DNA, 25 bp, Artificial sequence
  Extension Primer
atgtaatgatggccttggaagagag

SEQ ID NO: 22964 - DNA, 25 bp, Artificial sequence
  Extension Primer
gcctatcacagggcaaagagaagat

SEQ ID NO: 22965 - DNA, 25 bp, Artificial sequence
  Extension Primer
aattaacacttcactatttagttca

SEQ ID NO: 22966 - DNA, 25 bp, Artificial sequence
  Extension Primer
gggaatttctggtcttagtttcttt

SEQ ID NO: 22967 - DNA, 25 bp, Artificial sequence
  Extension Primer
tccccaagaaaacctggtaaatcct

SEQ ID NO: 22968 - DNA, 25 bp, Artificial sequence
  Extension Primer
actaattggaaacacacaagcaaat

SEQ ID NO: 22969 - DNA, 25 bp, Artificial sequence
  Extension Primer
aatgcacccccctccccgccatgtt

SEQ ID NO: 22970 - DNA, 25 bp, Artificial sequence
  Extension Primer
gcgatagtcctgtgaaagacctaca

SEQ ID NO: 22971 - DNA, 25 bp, Artificial sequence
  Extension Primer
aagtattgcctcattcagttcccat

SEQ ID NO: 22972 - DNA, 25 bp, Artificial sequence
  Extension Primer
aaaggaccatggagatctagacaga

SEQ ID NO: 22973 - DNA, 25 bp, Artificial sequence
  Extension Primer
agaaaaaaaaagccgtacaaataca

SEQ ID NO: 22974 - DNA, 25 bp, Artificial sequence
  Extension Primer
tactcttcaagttgatatcaaagtc

SEQ ID NO: 22975 - DNA, 25 bp, Artificial sequence
  Extension Primer
tggcaggggctgggggctagctatt

SEQ ID NO: 22976 - DNA, 25 bp, Artificial sequence
  Extension Primer
ctgttctgaaactattgctaaggag

SEQ ID NO: 22977 - DNA, 25 bp, Artificial sequence
  Extension Primer
acaccctgggtgggttaataagata

SEQ ID NO: 22978 - DNA, 25 bp, Artificial sequence
  Extension Primer
ccatcttaggaagtctctgctagag

SEQ ID NO: 22979 - DNA, 25 bp, Artificial sequence
  Extension Primer
tggaaagaggagattttcacagatt

SEQ ID NO: 22980 - DNA, 25 bp, Artificial sequence
  Extension Primer
ttacctatgtcaaaagatatgtccc

SEQ ID NO: 22981 - DNA, 25 bp, Artificial sequence
  Extension Primer
ttggaggccactggtaggtagaact

SEQ ID NO: 22982 - DNA, 25 bp, Artificial sequence
  Extension Primer
cracagctgttaccaagttgtctaa

SEQ ID NO: 22983 - DNA, 25 bp, Artificial sequence
  Extension Primer
ataattgttccaaataagcccacca

SEQ ID NO: 22984 - DNA, 22 bp, Artificial sequence
  Extension Primer
agtggagagtgtttaaaacttt

SEQ ID NO: 22985 - DNA, 25 bp, Artificial sequence
  Extension Primer
tgtcttctgttcatyggactcctca

SEQ ID NO: 22986 - DNA, 25 bp, Artificial sequence
  Extension Primer
tgactgggtgactgaacaaccacaa

SEQ ID NO: 22987 - DNA, 25 bp, Artificial sequence
  Extension Primer
tttttaagtgtcctttgcatgtaag

SEQ ID NO: 22988 - DNA, 25 bp, Artificial sequence
  Extension Primer
tcttgtttgagaggttttgctgctt

SEQ ID NO: 22989 - DNA, 25 bp, Artificial sequence
  Extension Primer
tagatgtagacccaggttcctgtcc

SEQ ID NO: 22990 - DNA, 25 bp, Artificial sequence
  Extension Primer
ctggttctccccctcaaatctcttt

SEQ ID NO: 22991 - DNA, 25 bp, Artificial sequence
  Extension Primer
gaatgatttctacaagtgttatgaa

SEQ ID NO: 22992 - DNA, 25 bp, Artificial sequence
  Extension Primer
gtccccaggatctctttaatggttc

SEQ ID NO: 22993 - DNA, 25 bp, Artificial sequence
  Extension Primer
cttccttgcagaccacaagcatcac

SEQ ID NO: 22994 - DNA, 25 bp, Artificial sequence
  Extension Primer
tgtgtgttatttgaaaattaatcct

SEQ ID NO: 22995 - DNA, 25 bp, Artificial sequence
  Extension Primer
ctggaagggtggaagaaaatgtgac

SEQ ID NO: 22996 - DNA, 25 bp, Artificial sequence
  Extension Primer
attctcctcccacaatctgtgcttc

SEQ ID NO: 22997 - DNA, 25 bp, Artificial sequence
  Extension Primer
agcatactctgatattatagtcaaa

SEQ ID NO: 22998 - DNA, 25 bp, Artificial sequence
  Extension Primer
ctaagtgggagtgaggaacaatggg

SEQ ID NO: 22999 - DNA, 25 bp, Artificial sequence
  Extension Primer
aaacactgcagatattcttccctct

SEQ ID NO: 23000 - DNA, 25 bp, Artificial sequence
  Extension Primer
gctgcaaatgagcttctcaaccatc

SEQ ID NO: 23001 - DNA, 25 bp, Artificial sequence
  Extension Primer
agactttaattcataaaagaacccc

SEQ ID NO: 23002 - DNA, 25 bp, Artificial sequence
  Extension Primer
agttgctcggttgtttctgactctt

SEQ ID NO: 23003 - DNA, 25 bp, Artificial sequence
  Extension Primer
aggagaagggagcaagccttgtaga

SEQ ID NO: 23004 - DNA, 25 bp, Artificial sequence
  Extension Primer
cttctaatatygccctgctctattg

SEQ ID NO: 23005 - DNA, 25 bp, Artificial sequence
  Extension Primer
ctccctgcttctcacttgcttctcc

SEQ ID NO: 23006 - DNA, 25 bp, Artificial sequence
  Extension Primer
tagaaatgatttgaatctaaacagt

SEQ ID NO: 23007 - DNA, 25 bp, Artificial sequence
  Extension Primer
ctatagaaactaaagaaggaaataa

SEQ ID NO: 23008 - DNA, 25 bp, Artificial sequence
  Extension Primer
gacttgtagagattgttttggatca

SEQ ID NO: 23009 - DNA, 25 bp, Artificial sequence
  Extension Primer
ttcagctctctcactccccttcgga

SEQ ID NO: 23010 - DNA, 25 bp, Artificial sequence
  Extension Primer
ggctgcctaaggtgaggtccacaag

SEQ ID NO: 23011 - DNA, 25 bp, Artificial sequence
  Extension Primer
ctcctttcaaaaggcttacaacata

SEQ ID NO: 23012 - DNA, 25 bp, Artificial sequence
  Extension Primer
ttgatcttcttctctcctcctgact

SEQ ID NO: 23013 - DNA, 25 bp, Artificial sequence
  Extension Primer
agaatctcttaatttctgggagtat

SEQ ID NO: 23014 - DNA, 25 bp, Artificial sequence
  Extension Primer
gggatgaaaggatatgayggacgca

SEQ ID NO: 23015 - DNA, 25 bp, Artificial sequence
  Extension Primer
tgtaactgctggctgctatcagggg

SEQ ID NO: 23016 - DNA, 25 bp, Artificial sequence
  Extension Primer
catcttatcaatcccttcttgcctc

SEQ ID NO: 23017 - DNA, 25 bp, Artificial sequence
  Extension Primer
atgccacttagtaaattagaaaaaa

SEQ ID NO: 23018 - DNA, 25 bp, Artificial sequence
  Extension Primer
gtccatataattgcttacaatgctc

SEQ ID NO: 23019 - DNA, 25 bp, Artificial sequence
  Extension Primer
ttggtatctagattttaactatttt

SEQ ID NO: 23020 - DNA, 25 bp, Artificial sequence
  Extension Primer
ggacgtttttccaaggaagcagtga

SEQ ID NO: 23021 - DNA, 25 bp, Artificial sequence
  Extension Primer
ttctttacaaactaaccttgttcat

SEQ ID NO: 23022 - DNA, 25 bp, Artificial sequence
  Extension Primer
ggatgattgcttctgagtcatttgc

SEQ ID NO: 23023 - DNA, 25 bp, Artificial sequence
  Extension Primer
attctttattttgatgtatctctta

SEQ ID NO: 23024 - DNA, 25 bp, Artificial sequence
  Extension Primer
caaatgtatacatcgtggcatctca

SEQ ID NO: 23025 - DNA, 25 bp, Artificial sequence
  Extension Primer
aataaaaccacaggcaaatgctccc

SEQ ID NO: 23026 - DNA, 25 bp, Artificial sequence
  Extension Primer
aaccaacgtatgctcctcttcatag

SEQ ID NO: 23027 - DNA, 25 bp, Artificial sequence
  Extension Primer
ttagtaaatctctcccttagctctg

SEQ ID NO: 23028 - DNA, 25 bp, Artificial sequence
  Extension Primer
accctggtcccccagatctctagca

SEQ ID NO: 23029 - DNA, 25 bp, Artificial sequence
  Extension Primer
ccctaaaatcaaacaacccaatcta

SEQ ID NO: 23030 - DNA, 25 bp, Artificial sequence
  Extension Primer
catattttgctttttttgacatttt

SEQ ID NO: 23031 - DNA, 25 bp, Artificial sequence
  Extension Primer
aacgtatagagtttaatgatgaagc

SEQ ID NO: 23032 - DNA, 25 bp, Artificial sequence
  Extension Primer
gacaccatccccactccacctctaa

SEQ ID NO: 23033 - DNA, 25 bp, Artificial sequence
  Extension Primer
caaacaaaaaatagagccccattaa

SEQ ID NO: 23034 - DNA, 25 bp, Artificial sequence
  Extension Primer
gtgcactcccaccctttgaccctgc

SEQ ID NO: 23035 - DNA, 25 bp, Artificial sequence
  Extension Primer
aaaaacaagagggaaagagtaactc

SEQ ID NO: 23036 - DNA, 25 bp, Artificial sequence
  Extension Primer
acttaaattacaacaaattttagac

SEQ ID NO: 23037 - DNA, 25 bp, Artificial sequence
  Extension Primer
ccctgtcacaytgtacagttaaatc

SEQ ID NO: 23038 - DNA, 25 bp, Artificial sequence
  Extension Primer
cagaactcggagagaagggagaggc

SEQ ID NO: 23039 - DNA, 25 bp, Artificial sequence
  Extension Primer
gaatccatacgcagtttctctttca

SEQ ID NO: 23040 - DNA, 25 bp, Artificial sequence
  Extension Primer
ttgtgaggatgcagcaaatgacttg

SEQ ID NO: 23041 - DNA, 25 bp, Artificial sequence
  Extension Primer
aaggagcatacacctttcagttgac

SEQ ID NO: 23042 - DNA, 25 bp, Artificial sequence
  Extension Primer
gatatgaagaagatgagcctggaag

SEQ ID NO: 23043 - DNA, 25 bp, Artificial sequence
  Extension Primer
caggaggccagactcttggatctcg

SEQ ID NO: 23044 - DNA, 25 bp, Artificial sequence
  Extension Primer
tggaatttttgaggaggcgaagcaa

SEQ ID NO: 23045 - DNA, 25 bp, Artificial sequence
  Extension Primer
gtattcacaagtatcagattctcat

SEQ ID NO: 23046 - DNA, 25 bp, Artificial sequence
  Extension Primer
tcaggatactccagtgtccagcata

SEQ ID NO: 23047 - DNA, 25 bp, Artificial sequence
  Extension Primer
caacatacaataacctggcctgaat

SEQ ID NO: 23048 - DNA, 25 bp, Artificial sequence
  Extension Primer
gaagctttacagaaacgaaaaagtt

SEQ ID NO: 23049 - DNA, 25 bp, Artificial sequence
  Extension Primer
gcaaatgtgttagtggagatcctga

SEQ ID NO: 23050 - DNA, 25 bp, Artificial sequence
  Extension Primer
ccacaactaaaggatcctgcatgct

SEQ ID NO: 23051 - DNA, 25 bp, Artificial sequence
  Extension Primer
tggcaatgcagggcgggcatggaaa

SEQ ID NO: 23052 - DNA, 25 bp, Artificial sequence
  Extension Primer
caaagggaagagatgattacttgat

SEQ ID NO: 23053 - DNA, 25 bp, Artificial sequence
  Extension Primer
ctcctctccrtaaaattatttccct

SEQ ID NO: 23054 - DNA, 25 bp, Artificial sequence
  Extension Primer
taagccagtyagggaaataatttta

SEQ ID NO: 23055 - DNA, 25 bp, Artificial sequence
  Extension Primer
ggggaccagagacagaacagtgatc

SEQ ID NO: 23056 - DNA, 25 bp, Artificial sequence
  Extension Primer
gaagatctactgaaaacttccagaa

SEQ ID NO: 23057 - DNA, 25 bp, Artificial sequence
  Extension Primer
gactgttgctgtaattgaaagctga

SEQ ID NO: 23058 - DNA, 25 bp, Artificial sequence
  Extension Primer
acagtccaggatcagggctgcatct

SEQ ID NO: 23059 - DNA, 25 bp, Artificial sequence
  Extension Primer
aaggactaaacaaattcccaatgac

SEQ ID NO: 23060 - DNA, 25 bp, Artificial sequence
  Extension Primer
tacttaactgaaatatcttacaatc

SEQ ID NO: 23061 - DNA, 25 bp, Artificial sequence
  Extension Primer
agacaartattcctgctcctcttcc

SEQ ID NO: 23062 - DNA, 25 bp, Artificial sequence
  Extension Primer
gtttgaacttctgactttttcmaag

SEQ ID NO: 23063 - DNA, 25 bp, Artificial sequence
  Extension Primer
tacctcctctcttaaatggagggga

SEQ ID NO: 23064 - DNA, 25 bp, Artificial sequence
  Extension Primer
ctttcaccagcttccttctctcctt

SEQ ID NO: 23065 - DNA, 25 bp, Artificial sequence
  Extension Primer
taggaataatggacaaggcaaagtg

SEQ ID NO: 23066 - DNA, 25 bp, Artificial sequence
  Extension Primer
taggttgmgttcctcrtctgtaaat

SEQ ID NO: 23067 - DNA, 25 bp, Artificial sequence
  Extension Primer
tcctggaaggtagttactgatttca

SEQ ID NO: 23068 - DNA, 25 bp, Artificial sequence
  Extension Primer
tctggaaaggctgaaaccatgggca

SEQ ID NO: 23069 - DNA, 25 bp, Artificial sequence
  Extension Primer
tatttaatctccctgggcctccctc

SEQ ID NO: 23070 - DNA, 25 bp, Artificial sequence
  Extension Primer
tttgccttgtcaaggaagtcagttt

SEQ ID NO: 23071 - DNA, 25 bp, Artificial sequence
  Extension Primer
aggaaaggaacagatgtgagagaag

SEQ ID NO: 23072 - DNA, 25 bp, Artificial sequence
  Extension Primer
attatggccaatatccattaacctc

SEQ ID NO: 23073 - DNA, 25 bp, Artificial sequence
  Extension Primer
tatataaacactaatttgcattcag

SEQ ID NO: 23074 - DNA, 25 bp, Artificial sequence
  Extension Primer
aaacgcagcttttggagttgaagaa

SEQ ID NO: 23075 - DNA, 25 bp, Artificial sequence
  Extension Primer
cacactaatattctacagccttctg

SEQ ID NO: 23076 - DNA, 25 bp, Artificial sequence
  Extension Primer
aatttgtataattctagacatgttt

SEQ ID NO: 23077 - DNA, 25 bp, Artificial sequence
  Extension Primer
gacaaagcactccatccccatgata

SEQ ID NO: 23078 - DNA, 25 bp, Artificial sequence
  Extension Primer
aaataacacacagtatttaacactc

SEQ ID NO: 23079 - DNA, 25 bp, Artificial sequence
  Extension Primer
atgctgtcactacaaagtgcacata

SEQ ID NO: 23080 - DNA, 25 bp, Artificial sequence
  Extension Primer
ttccactggaaagaatacaatgata

SEQ ID NO: 23081 - DNA, 25 bp, Artificial sequence
  Extension Primer
tgtgtccctaaatactgggaaaaaa

SEQ ID NO: 23082 - DNA, 25 bp, Artificial sequence
  Extension Primer
tgacttcagtgcccgaagagactag

SEQ ID NO: 23083 - DNA, 25 bp, Artificial sequence
  Extension Primer
gtggatggtgagagaagcgcaagcc

SEQ ID NO: 23084 - DNA, 25 bp, Artificial sequence
  Extension Primer
tgtgtgatttaacttttagcaatga

SEQ ID NO: 23085 - DNA, 25 bp, Artificial sequence
  Extension Primer
gaggcctgaagatatatctttgtta

SEQ ID NO: 23086 - DNA, 25 bp, Artificial sequence
  Extension Primer
tttagccaatatcaaatgttaagca

SEQ ID NO: 23087 - DNA, 25 bp, Artificial sequence
  Extension Primer
attcagagggtgtctcttgggaggt

SEQ ID NO: 23088 - DNA, 25 bp, Artificial sequence
  Extension Primer
aatgggcagttatcttttggattat

SEQ ID NO: 23089 - DNA, 25 bp, Artificial sequence
  Extension Primer
tcatatacatttcaaacacaatccc

SEQ ID NO: 23090 - DNA, 25 bp, Artificial sequence
  Extension Primer
tggtttgactccaccacctttcctg

SEQ ID NO: 23091 - DNA, 25 bp, Artificial sequence
  Extension Primer
gttgctcctgttcaggggcatggag

SEQ ID NO: 23092 - DNA, 25 bp, Artificial sequence
  Extension Primer
cattttaaaaagaatcaaagttaca

SEQ ID NO: 23093 - DNA, 25 bp, Artificial sequence
  Extension Primer
ggatttttgttaataatggctttaa

SEQ ID NO: 23094 - DNA, 22 bp, Artificial sequence
  Extension Primer
gcagttgtaaatgcctgagcct

SEQ ID NO: 23095 - DNA, 25 bp, Artificial sequence
  Extension Primer
ctcttcagagatggttttcccatgt

SEQ ID NO: 23096 - DNA, 25 bp, Artificial sequence
  Extension Primer
tatcaaataaactagccaatgtatc

SEQ ID NO: 23097 - DNA, 25 bp, Artificial sequence
  Extension Primer
tgatcttagacaagttcatcacctg

SEQ ID NO: 23098 - DNA, 25 bp, Artificial sequence
  Extension Primer
ttagctgggtgaccttgggctagat

SEQ ID NO: 23099 - DNA, 25 bp, Artificial sequence
  Extension Primer
ttatcaaatccaccctgtgtaaata

SEQ ID NO: 23100 - DNA, 25 bp, Artificial sequence
  Extension Primer
tgagtatccaaagcgagtggtacag

SEQ ID NO: 23101 - DNA, 25 bp, Artificial sequence
  Extension Primer
acccaccgtcatgcgattcctccag

SEQ ID NO: 23102 - DNA, 25 bp, Artificial sequence
  Extension Primer
cagagttattagaagcatatctttc

SEQ ID NO: 23103 - DNA, 25 bp, Artificial sequence
  Extension Primer
tagacaaacaaaaagacagtaagta

SEQ ID NO: 23104 - DNA, 25 bp, Artificial sequence
  Extension Primer
agtacatcagatatgtacgtctaca

SEQ ID NO: 23105 - DNA, 25 bp, Artificial sequence
  Extension Primer
ggataccaatcaaactgtaacacag

SEQ ID NO: 23106 - DNA, 25 bp, Artificial sequence
  Extension Primer
gtggcttctttgcagtcttccattt

SEQ ID NO: 23107 - DNA, 25 bp, Artificial sequence
  Extension Primer
cagaaggtcatgatgcatcttaaat

SEQ ID NO: 23108 - DNA, 25 bp, Artificial sequence
  Extension Primer
cttaagctttataaatacttacatg

SEQ ID NO: 23109 - DNA, 25 bp, Artificial sequence
  Extension Primer
ggagaatccggggcacgtggtgggc

SEQ ID NO: 23110 - DNA, 25 bp, Artificial sequence
  Extension Primer
tctagtttccttcttcttcactgac

SEQ ID NO: 23111 - DNA, 25 bp, Artificial sequence
  Extension Primer
gtcaagaccgaaatgacagcagaga

SEQ ID NO: 23112 - DNA, 25 bp, Artificial sequence
  Extension Primer
aaggtgatccttgaaaacttgtttc

SEQ ID NO: 23113 - DNA, 25 bp, Artificial sequence
  Extension Primer
cccaccttcctgcctatgcagccac

SEQ ID NO: 23114 - DNA, 25 bp, Artificial sequence
  Extension Primer
cacaggactagagtggttaaaaggc

SEQ ID NO: 23115 - DNA, 25 bp, Artificial sequence
  Extension Primer
aacattactacaagttcacagaggg

SEQ ID NO: 23116 - DNA, 25 bp, Artificial sequence
  Extension Primer
tagggtgtgaccttcttcctgacat

SEQ ID NO: 23117 - DNA, 25 bp, Artificial sequence
  Extension Primer
agacctagagcagagatccctccaa

SEQ ID NO: 23118 - DNA, 25 bp, Artificial sequence
  Extension Primer
aagttttctcaaagatgagtcttca

SEQ ID NO: 23119 - DNA, 25 bp, Artificial sequence
  Extension Primer
ttcatgggtggctcaaccgtcttcc

SEQ ID NO: 23120 - DNA, 25 bp, Artificial sequence
  Extension Primer
aagtatgaatccttcctctttgaac

SEQ ID NO: 23121 - DNA, 25 bp, Artificial sequence
  Extension Primer
gaatctataaaaattaatacaacag

SEQ ID NO: 23122 - DNA, 25 bp, Artificial sequence
  Extension Primer
atgaatttcttagatgaagaccgag

SEQ ID NO: 23123 - DNA, 25 bp, Artificial sequence
  Extension Primer
atgtttttgaatcatggtagcaggg

SEQ ID NO: 23124 - DNA, 25 bp, Artificial sequence
  Extension Primer
ctgagcacacccacccaccttcctc

SEQ ID NO: 23125 - DNA, 25 bp, Artificial sequence
  Extension Primer
gcaataattcttgccctgtctatct

SEQ ID NO: 23126 - DNA, 25 bp, Artificial sequence
  Extension Primer
gtggaagcattaacaagtacaaaaa

SEQ ID NO: 23127 - DNA, 25 bp, Artificial sequence
  Extension Primer
tgacaagatgtgaggatggtctcca

SEQ ID NO: 23128 - DNA, 25 bp, Artificial sequence
  Extension Primer
aggaagtcaaatgctgctgctgctg

SEQ ID NO: 23129 - DNA, 25 bp, Artificial sequence
  Extension Primer
atttttgtggccaaatmctgytcca

SEQ ID NO: 23130 - DNA, 25 bp, Artificial sequence
  Extension Primer
ttccctctgtctccttcacaagaat

SEQ ID NO: 23131 - DNA, 25 bp, Artificial sequence
  Extension Primer
agagacagagaagaggaatgcagat

SEQ ID NO: 23132 - DNA, 25 bp, Artificial sequence
  Extension Primer
tttcaacatacagaaacagagccca

SEQ ID NO: 23133 - DNA, 25 bp, Artificial sequence
  Extension Primer
gaacatccacatcacaatcaacaac

SEQ ID NO: 23134 - DNA, 25 bp, Artificial sequence
  Extension Primer
ctggagtgaatttaatattggcaat

SEQ ID NO: 23135 - DNA, 25 bp, Artificial sequence
  Extension Primer
taggagtacagtactatgaatgtag

SEQ ID NO: 23136 - DNA, 25 bp, Artificial sequence
  Extension Primer
cacccttattctactgaacaaccct

SEQ ID NO: 23137 - DNA, 25 bp, Artificial sequence
  Extension Primer
caggcttctctgtccttggaattct

SEQ ID NO: 23138 - DNA, 25 bp, Artificial sequence
  Extension Primer
ttaacttaattatcctagtaaagac

SEQ ID NO: 23139 - DNA, 25 bp, Artificial sequence
  Extension Primer
gataaagaaaatgttaggatgaatt

SEQ ID NO: 23140 - DNA, 25 bp, Artificial sequence
  Extension Primer
ttgaatatagcttggaaaaaaatag

SEQ ID NO: 23141 - DNA, 25 bp, Artificial sequence
  Extension Primer
aagtcaaaatcaactctctgggtgc

SEQ ID NO: 23142 - DNA, 25 bp, Artificial sequence
  Extension Primer
attttaattatgtctacaggagtac

SEQ ID NO: 23143 - DNA, 25 bp, Artificial sequence
  Extension Primer
gaaagataggaagatctatggaaag

SEQ ID NO: 23144 - DNA, 25 bp, Artificial sequence
  Extension Primer
aagagcctgggtatcattgaaccta

SEQ ID NO: 23145 - DNA, 25 bp, Artificial sequence
  Extension Primer
gtctctgtctcttcttgcccacccc

SEQ ID NO: 23146 - DNA, 22 bp, Artificial sequence
  Extension Primer
cactaaaacaaaaaagcaagca

SEQ ID NO: 23147 - DNA, 25 bp, Artificial sequence
  Extension Primer
acactaattattagcatacgaaaaa

SEQ ID NO: 23148 - DNA, 25 bp, Artificial sequence
  Extension Primer
caaggccacaagggtgtcagttgat

SEQ ID NO: 23149 - DNA, 25 bp, Artificial sequence
  Extension Primer
ctcccggtgcagaggcacgacttca

SEQ ID NO: 23150 - DNA, 25 bp, Artificial sequence
  Extension Primer
cctaacctttatgtaacgttcatca

SEQ ID NO: 23151 - DNA, 25 bp, Artificial sequence
  Extension Primer
agctagacatctttatgttcagaaa

SEQ ID NO: 23152 - DNA, 25 bp, Artificial sequence
  Extension Primer
agtttgaagaagacgactggagtga

SEQ ID NO: 23153 - DNA, 25 bp, Artificial sequence
  Extension Primer
tctgtttcactgaccaattcccctc

SEQ ID NO: 23154 - DNA, 25 bp, Artificial sequence
  Extension Primer
gaccatccygtttcagagttagtta

SEQ ID NO: 23155 - DNA, 25 bp, Artificial sequence
  Extension Primer
tgcatgtgtactgctttgagaagga

SEQ ID NO: 23156 - DNA, 25 bp, Artificial sequence
  Extension Primer
catgattacacctttgtggcacccc

SEQ ID NO: 23157 - DNA, 25 bp, Artificial sequence
  Extension Primer
tcctgcggctttagagcaattatca

SEQ ID NO: 23158 - DNA, 25 bp, Artificial sequence
  Extension Primer
ccccagctattgtgcatccggaagt

SEQ ID NO: 23159 - DNA, 25 bp, Artificial sequence
  Extension Primer
gtcagaaggttctcctgaaacattc

SEQ ID NO: 23160 - DNA, 25 bp, Artificial sequence
  Extension Primer
attgccttcttctacaatatcctac

SEQ ID NO: 23161 - DNA, 25 bp, Artificial sequence
  Extension Primer
gtgctttgttgcaggccccccactt

SEQ ID NO: 23162 - DNA, 25 bp, Artificial sequence
  Extension Primer
ttaataattacacctataaacagga

SEQ ID NO: 23163 - DNA, 25 bp, Artificial sequence
  Extension Primer
atctgtggtagtatgtatcctagtt

SEQ ID NO: 23164 - DNA, 25 bp, Artificial sequence
  Extension Primer
tcccttctttctggctttccaggca

SEQ ID NO: 23165 - DNA, 25 bp, Artificial sequence
  Extension Primer
atagatcaaagaagttcaagtgtgc

SEQ ID NO: 23166 - DNA, 25 bp, Artificial sequence
  Extension Primer
gggaatcctagcagagactggcagt

SEQ ID NO: 23167 - DNA, 25 bp, Artificial sequence
  Extension Primer
gatgtatcatctgcctagttctgct

SEQ ID NO: 23168 - DNA, 25 bp, Artificial sequence
  Extension Primer
gtcccccagccccaccctctccacg

SEQ ID NO: 23169 - DNA, 25 bp, Artificial sequence
  Extension Primer
atcgttaagataacatttatcccct

SEQ ID NO: 23170 - DNA, 25 bp, Artificial sequence
  Extension Primer
aatgcttgtaggaattatgagcttg

SEQ ID NO: 23171 - DNA, 25 bp, Artificial sequence
  Extension Primer
atatctccttatttgagatttctgt

SEQ ID NO: 23172 - DNA, 25 bp, Artificial sequence
  Extension Primer
cttaatttgatgcacttacttattt

SEQ ID NO: 23173 - DNA, 25 bp, Artificial sequence
  Extension Primer
gaacggagttgaattatagaacaga

SEQ ID NO: 23174 - DNA, 25 bp, Artificial sequence
  Extension Primer
aaaatgtattttaaactgtatatta

SEQ ID NO: 23175 - DNA, 25 bp, Artificial sequence
  Extension Primer
tagtgccacctgggaagccacattt

SEQ ID NO: 23176 - DNA, 25 bp, Artificial sequence
  Extension Primer
agaccctcagagatctcttgcctcc

SEQ ID NO: 23177 - DNA, 25 bp, Artificial sequence
  Extension Primer
ggcaaactaaagagacacaactaaa

SEQ ID NO: 23178 - DNA, 25 bp, Artificial sequence
  Extension Primer
ccaactccctcctgctgtattttct

SEQ ID NO: 23179 - DNA, 25 bp, Artificial sequence
  Extension Primer
ccgtggaataatttacatcaaagaa

SEQ ID NO: 23180 - DNA, 25 bp, Artificial sequence
  Extension Primer
gggaattttgtaaccttatcaactc

SEQ ID NO: 23181 - DNA, 25 bp, Artificial sequence
  Extension Primer
caaagtttatcatggataacgagag

SEQ ID NO: 23182 - DNA, 25 bp, Artificial sequence
  Extension Primer
ttttttttagtttttccaagcttct

SEQ ID NO: 23183 - DNA, 25 bp, Artificial sequence
  Extension Primer
atgttagcatatgcatactctacta

SEQ ID NO: 23184 - DNA, 25 bp, Artificial sequence
  Extension Primer
gaaatttgatctctccttacagttc

SEQ ID NO: 23185 - DNA, 25 bp, Artificial sequence
  Extension Primer
atgcttaggagattgtgcagtgtaa

SEQ ID NO: 23186 - DNA, 25 bp, Artificial sequence
  Extension Primer
ttaaccccaactaggaccacaattt

SEQ ID NO: 23187 - DNA, 25 bp, Artificial sequence
  Extension Primer
aatatgcataaaacaccattttaac

SEQ ID NO: 23188 - DNA, 25 bp, Artificial sequence
  Extension Primer
cgttcaaatttggcttactcttgtg

SEQ ID NO: 23189 - DNA, 25 bp, Artificial sequence
  Extension Primer
tcattctgtagctgccaattttcag

SEQ ID NO: 23190 - DNA, 25 bp, Artificial sequence
  Extension Primer
tgcgttactcatatttgttatctca

SEQ ID NO: 23191 - DNA, 25 bp, Artificial sequence
  Extension Primer
gtggagggggaagaggagtggtgac

SEQ ID NO: 23192 - DNA, 25 bp, Artificial sequence
  Extension Primer
cgctctaaaatgagaaaagaataga

SEQ ID NO: 23193 - DNA, 25 bp, Artificial sequence
  Extension Primer
aactgtagttcaatgttttgaataa

SEQ ID NO: 23194 - DNA, 25 bp, Artificial sequence
  Extension Primer
aaacaataacaaaaatgttcatgta

SEQ ID NO: 23195 - DNA, 25 bp, Artificial sequence
  Extension Primer
aaatgttttgatattcgagatacaa

SEQ ID NO: 23196 - DNA, 25 bp, Artificial sequence
  Extension Primer
tatgggagttgtatccayagagcaa

SEQ ID NO: 23197 - DNA, 25 bp, Artificial sequence
  Extension Primer
ttattttgcattttaatcaattaca

SEQ ID NO: 23198 - DNA, 25 bp, Artificial sequence
  Extension Primer
aatatgcatcaaaatgataaaggat

SEQ ID NO: 23199 - DNA, 25 bp, Artificial sequence
  Extension Primer
ttaaagggtcacataaagctacata

SEQ ID NO: 23200 - DNA, 25 bp, Artificial sequence
  Extension Primer
atattatacaaattaatagttctct

SEQ ID NO: 23201 - DNA, 25 bp, Artificial sequence
  Extension Primer
agatgaagagaatacatgtgagatt

SEQ ID NO: 23202 - DNA, 25 bp, Artificial sequence
  Extension Primer
ttcctctgtctacaactctaaatcc

SEQ ID NO: 23203 - DNA, 25 bp, Artificial sequence
  Extension Primer
ggacattgaaatgactggttaactc

SEQ ID NO: 23204 - DNA, 25 bp, Artificial sequence
  Extension Primer
tagtcctgttagaggcaccactgtc

SEQ ID NO: 23205 - DNA, 25 bp, Artificial sequence
  Extension Primer
tattttgtagcattggtttgcattt

SEQ ID NO: 23206 - DNA, 25 bp, Artificial sequence
  Extension Primer
tgatgtaaagccatcttcttttcgt

SEQ ID NO: 23207 - DNA, 25 bp, Artificial sequence
  Extension Primer
atcaccactgcacacttgagtggyt

SEQ ID NO: 23208 - DNA, 25 bp, Artificial sequence
  Extension Primer
acttcagtcagaagcttcagcccag

SEQ ID NO: 23209 - DNA, 25 bp, Artificial sequence
  Extension Primer
gatacgcctctgtctgcctcagttt

SEQ ID NO: 23210 - DNA, 25 bp, Artificial sequence
  Extension Primer
gtgggtgtttttgagatggtaagaa

SEQ ID NO: 23211 - DNA, 25 bp, Artificial sequence
  Extension Primer
aaattacatgtttcttaagtgttat

SEQ ID NO: 23212 - DNA, 25 bp, Artificial sequence
  Extension Primer
tattataggatttgtgttttggctg

SEQ ID NO: 23213 - DNA, 25 bp, Artificial sequence
  Extension Primer
ctactggcttagccaccaactttga

SEQ ID NO: 23214 - DNA, 25 bp, Artificial sequence
  Extension Primer
gactctggcaactgtttccttctct

SEQ ID NO: 23215 - DNA, 25 bp, Artificial sequence
  Extension Primer
tagtagtataaactcctgctacatt

SEQ ID NO: 23216 - DNA, 25 bp, Artificial sequence
  Extension Primer
cattgtggcagcccagggagggtgg

SEQ ID NO: 23217 - DNA, 25 bp, Artificial sequence
  Extension Primer
tcaattcccaagtgcaaagagtttt

SEQ ID NO: 23218 - DNA, 25 bp, Artificial sequence
  Extension Primer
tgagccatattacacttggaactga

SEQ ID NO: 23219 - DNA, 25 bp, Artificial sequence
  Extension Primer
aatgataagggttttgagatcttaa

SEQ ID NO: 23220 - DNA, 25 bp, Artificial sequence
  Extension Primer
tagtttaaaatggattcgaagtttt

SEQ ID NO: 23221 - DNA, 25 bp, Artificial sequence
  Extension Primer
ttacttgtagaatgaaaaagactct

SEQ ID NO: 23222 - DNA, 25 bp, Artificial sequence
  Extension Primer
gctcagatggcatataattaaaaga

SEQ ID NO: 23223 - DNA, 25 bp, Artificial sequence
  Extension Primer
aactaaaatgccttagcgtaccatt

SEQ ID NO: 23224 - DNA, 25 bp, Artificial sequence
  Extension Primer
aaagttgatcaagatcactccttcc

SEQ ID NO: 23225 - DNA, 25 bp, Artificial sequence
  Extension Primer
caccctgccctggaaggtcccacac

SEQ ID NO: 23226 - DNA, 25 bp, Artificial sequence
  Extension Primer
aacaaattaaaaataggcttacatc

SEQ ID NO: 23227 - DNA, 25 bp, Artificial sequence
  Extension Primer
tgagccaacactggtttgcccgtcc

SEQ ID NO: 23228 - DNA, 22 bp, Artificial sequence
  Extension Primer
atacactattccagggtcttct

SEQ ID NO: 23229 - DNA, 25 bp, Artificial sequence
  Extension Primer
gctctgtagtgaggtggttctgaag

SEQ ID NO: 23230 - DNA, 25 bp, Artificial sequence
  Extension Primer
cttagcactgaagaaactgggctgt

SEQ ID NO: 23231 - DNA, 25 bp, Artificial sequence
  Extension Primer
aatcgtcaactggaagaggaagacc

SEQ ID NO: 23232 - DNA, 25 bp, Artificial sequence
  Extension Primer
aggaaaggagatgttgtttctcttc

SEQ ID NO: 23233 - DNA, 25 bp, Artificial sequence
  Extension Primer
gtctgatatttgacttaatgttaac

SEQ ID NO: 23234 - DNA, 25 bp, Artificial sequence
  Extension Primer
tctctcaggtaagcatatttagacc

SEQ ID NO: 23235 - DNA, 25 bp, Artificial sequence
  Extension Primer
cctggggaagggcaggttggtgggc

SEQ ID NO: 23236 - DNA, 25 bp, Artificial sequence
  Extension Primer
ctacccactgttttccctactcaac

SEQ ID NO: 23237 - DNA, 25 bp, Artificial sequence
  Extension Primer
gaagatgtgaaacaacaggaagagg

SEQ ID NO: 23238 - DNA, 25 bp, Artificial sequence
  Extension Primer
aagtttgaagaccaagttggctttc

SEQ ID NO: 23239 - DNA, 25 bp, Artificial sequence
  Extension Primer
taagtctcacaaattatttcagttg

SEQ ID NO: 23240 - DNA, 25 bp, Artificial sequence
  Extension Primer
tcagacgtgtcygacttttgcaacc

SEQ ID NO: 23241 - DNA, 25 bp, Artificial sequence
  Extension Primer
cacagggctaattcaggcatcttcc

SEQ ID NO: 23242 - DNA, 25 bp, Artificial sequence
  Extension Primer
agagcagggaactgaaagaacgtcc

SEQ ID NO: 23243 - DNA, 25 bp, Artificial sequence
  Extension Primer
gaaaacaaatacttgggcagaattt

SEQ ID NO: 23244 - DNA, 25 bp, Artificial sequence
  Extension Primer
atggaaaccatcttaaatctacaga

SEQ ID NO: 23245 - DNA, 25 bp, Artificial sequence
  Extension Primer
gacagccctacaatatttccctcac

SEQ ID NO: 23246 - DNA, 25 bp, Artificial sequence
  Extension Primer
cacagataaattctgggcagcacac

SEQ ID NO: 23247 - DNA, 25 bp, Artificial sequence
  Extension Primer
gctggaagagctgagaaaagctgct

SEQ ID NO: 23248 - DNA, 25 bp, Artificial sequence
  Extension Primer
gtcaagtttgtaagcaggagctttc

SEQ ID NO: 23249 - DNA, 25 bp, Artificial sequence
  Extension Primer
atggttagatggctgcatrttgaat

SEQ ID NO: 23250 - DNA, 25 bp, Artificial sequence
  Extension Primer
ctgaggcctagcagacaggccatga

SEQ ID NO: 23251 - DNA, 25 bp, Artificial sequence
  Extension Primer
aatcgcctatagcattttcctaaca

SEQ ID NO: 23252 - DNA, 25 bp, Artificial sequence
  Extension Primer
ttcatgtgaaagataaactgagaga

SEQ ID NO: 23253 - DNA, 25 bp, Artificial sequence
  Extension Primer
cgaagacaacactgaagtcttcaca

SEQ ID NO: 23254 - DNA, 25 bp, Artificial sequence
  Extension Primer
cagacattcgcttcaatagcatcta

SEQ ID NO: 23255 - DNA, 25 bp, Artificial sequence
  Extension Primer
aaaaatatcttatccattaatcctt

SEQ ID NO: 23256 - DNA, 22 bp, Artificial sequence
  Extension Primer
gtaattatatgaaaatgacatt

SEQ ID NO: 23257 - DNA, 25 bp, Artificial sequence
  Extension Primer
taatctgataatgttgaaatgcaaa

SEQ ID NO: 23258 - DNA, 25 bp, Artificial sequence
  Extension Primer
caccagagatggagagggcccccag

SEQ ID NO: 23259 - DNA, 25 bp, Artificial sequence
  Extension Primer
agacatcagggcaatgatgtcatcc

SEQ ID NO: 23260 - DNA, 25 bp, Artificial sequence
  Extension Primer
tacaattaccccttactgagcataa

SEQ ID NO: 23261 - DNA, 25 bp, Artificial sequence
  Extension Primer
gtgtcagtggagcccagcagtgtgc

SEQ ID NO: 23262 - DNA, 25 bp, Artificial sequence
  Extension Primer
tcaccttctaaaggaagaatatttt

SEQ ID NO: 23263 - DNA, 25 bp, Artificial sequence
  Extension Primer
taataacaaagttatgatcagcctt

SEQ ID NO: 23264 - DNA, 25 bp, Artificial sequence
  Extension Primer
aacaggtttcccaacttttcaagcc

SEQ ID NO: 23265 - DNA, 25 bp, Artificial sequence
  Extension Primer
gggtggggaggcgtctctccaggaa

SEQ ID NO: 23266 - DNA, 25 bp, Artificial sequence
  Extension Primer
agggtgagtcaaagcttttgtttct

SEQ ID NO: 23267 - DNA, 25 bp, Artificial sequence
  Extension Primer
tcaggcacctagaatgtgaattgtt

SEQ ID NO: 23268 - DNA, 25 bp, Artificial sequence
  Extension Primer
atccttctgcctcatgacgtggaca

SEQ ID NO: 23269 - DNA, 25 bp, Artificial sequence
  Extension Primer
aagggaggaaaattgagggaacatg

SEQ ID NO: 23270 - DNA, 25 bp, Artificial sequence
  Extension Primer
taatttagatagtgtatgttaagga

SEQ ID NO: 23271 - DNA, 25 bp, Artificial sequence
  Extension Primer
tattttacagatgagaaaactaagg

SEQ ID NO: 23272 - DNA, 25 bp, Artificial sequence
  Extension Primer
ctcttagtgatgagtgatttatgtt

SEQ ID NO: 23273 - DNA, 25 bp, Artificial sequence
  Extension Primer
ttaattatctgaggggtttatatcc

SEQ ID NO: 23274 - DNA, 25 bp, Artificial sequence
  Extension Primer
atgttgaccttgaaatgcagaaaga

SEQ ID NO: 23275 - DNA, 25 bp, Artificial sequence
  Extension Primer
taagactatacacaggagtgaattt

SEQ ID NO: 23276 - DNA, 25 bp, Artificial sequence
  Extension Primer
cctgccaaagtgtcttccatctcaa

SEQ ID NO: 23277 - DNA, 25 bp, Artificial sequence
  Extension Primer
ttcagagatatagtaaaagaccaca

SEQ ID NO: 23278 - DNA, 25 bp, Artificial sequence
  Extension Primer
aaaaaaagcaactatgcatataatc

SEQ ID NO: 23279 - DNA, 25 bp, Artificial sequence
  Extension Primer
ctctgcctcagtgaccctcattgcc

SEQ ID NO: 23280 - DNA, 25 bp, Artificial sequence
  Extension Primer
aggggtttaatttcagaactacaca

SEQ ID NO: 23281 - DNA, 25 bp, Artificial sequence
  Extension Primer
gagctaagggacacgtattaacgcc

SEQ ID NO: 23282 - DNA, 25 bp, Artificial sequence
  Extension Primer
ctatgacgcagttccagtggaccat

SEQ ID NO: 23283 - DNA, 25 bp, Artificial sequence
  Extension Primer
gtatctcttataagaacactaagcc

SEQ ID NO: 23284 - DNA, 25 bp, Artificial sequence
  Extension Primer
tgtgagtccctgtaaggtgggagcc

SEQ ID NO: 23285 - DNA, 25 bp, Artificial sequence
  Extension Primer
acctggcgatctgtctgytcctctc

SEQ ID NO: 23286 - DNA, 25 bp, Artificial sequence
  Extension Primer
aaatgcagattgtgagcagtactac

SEQ ID NO: 23287 - DNA, 25 bp, Artificial sequence
  Extension Primer
agtctccatctctactccacccaat

SEQ ID NO: 23288 - DNA, 25 bp, Artificial sequence
  Extension Primer
ggagcagagattgaggacacaccag

SEQ ID NO: 23289 - DNA, 25 bp, Artificial sequence
  Extension Primer
cttgtggccccatggcatgtgagaa

SEQ ID NO: 23290 - DNA, 25 bp, Artificial sequence
  Extension Primer
ccgagacgcatgtgcagtcactgta

SEQ ID NO: 23291 - DNA, 25 bp, Artificial sequence
  Extension Primer
tcttgttgaattttggtgcctatta

SEQ ID NO: 23292 - DNA, 25 bp, Artificial sequence
  Extension Primer
ggagtgtatgcaagggtactacgct

SEQ ID NO: 23293 - DNA, 25 bp, Artificial sequence
  Extension Primer
ttggatgtgcaatctaagagagaag

SEQ ID NO: 23294 - DNA, 25 bp, Artificial sequence
  Extension Primer
acaccgtgtcagggcaggcaagtct

SEQ ID NO: 23295 - DNA, 25 bp, Artificial sequence
  Extension Primer
attgrggtgtctggattgattcaac

SEQ ID NO: 23296 - DNA, 25 bp, Artificial sequence
  Extension Primer
aaaccagcggcctcagcaccactta

SEQ ID NO: 23297 - DNA, 25 bp, Artificial sequence
  Extension Primer
ctccaatgctgaacttttctcaata

SEQ ID NO: 23298 - DNA, 25 bp, Artificial sequence
  Extension Primer
actgaaacctcagccggaaccaagc

SEQ ID NO: 23299 - DNA, 25 bp, Artificial sequence
  Extension Primer
gcaaataatctactgtggtagagaa

SEQ ID NO: 23300 - DNA, 25 bp, Artificial sequence
  Extension Primer
gggtgtagatgtagttaaacattaa

SEQ ID NO: 23301 - DNA, 25 bp, Artificial sequence
  Extension Primer
gaaggcaacaatcccatcattaagt

SEQ ID NO: 23302 - DNA, 25 bp, Artificial sequence
  Extension Primer
taaatgtaaaattcactggtgttcg

SEQ ID NO: 23303 - DNA, 25 bp, Artificial sequence
  Extension Primer
ctcccagctgttcgtggaggtccct

SEQ ID NO: 23304 - DNA, 25 bp, Artificial sequence
  Extension Primer
gggtacaggttgtctagaggagagc

SEQ ID NO: 23305 - DNA, 25 bp, Artificial sequence
  Extension Primer
atctaaattatctctstaatatgtt

SEQ ID NO: 23306 - DNA, 25 bp, Artificial sequence
  Extension Primer
cagaacccgtgatgatgtcacctga

SEQ ID NO: 23307 - DNA, 25 bp, Artificial sequence
  Extension Primer
atgggcacttgaaaaggcacaaatc

SEQ ID NO: 23308 - DNA, 25 bp, Artificial sequence
  Extension Primer
aagctataaaagattaagtggctac

SEQ ID NO: 23309 - DNA, 25 bp, Artificial sequence
  Extension Primer
gaaatctagtctaacttcctcactt

SEQ ID NO: 23310 - DNA, 25 bp, Artificial sequence
  Extension Primer
aatttttgcttaacccagaaaataa

SEQ ID NO: 23311 - DNA, 25 bp, Artificial sequence
  Extension Primer
cagtccttggacagaatctagttca

SEQ ID NO: 23312 - DNA, 25 bp, Artificial sequence
  Extension Primer
atgacagaaactagaggaaaagaga

SEQ ID NO: 23313 - DNA, 25 bp, Artificial sequence
  Extension Primer
agacttgaaccacggtacacagtaa

SEQ ID NO: 23314 - DNA, 25 bp, Artificial sequence
  Extension Primer
cacaaacaactagctctttaataaa

SEQ ID NO: 23315 - DNA, 25 bp, Artificial sequence
  Extension Primer
ttaaatgtcatcctaagaacagtta

SEQ ID NO: 23316 - DNA, 25 bp, Artificial sequence
  Extension Primer
ctaatccaactcaaaaaagttgtac

SEQ ID NO: 23317 - DNA, 25 bp, Artificial sequence
  Extension Primer
ttacaagtcaaaaaaaaaaattctg

SEQ ID NO: 23318 - DNA, 25 bp, Artificial sequence
  Extension Primer
ggcttsttctggaggctttagcaca

SEQ ID NO: 23319 - DNA, 25 bp, Artificial sequence
  Extension Primer
acagacattctcttgggcaccaaga

SEQ ID NO: 23320 - DNA, 25 bp, Artificial sequence
  Extension Primer
cgtacagcaaagtgattcagttata

SEQ ID NO: 23321 - DNA, 25 bp, Artificial sequence
  Extension Primer
tactctgagccccagggaggaggag

SEQ ID NO: 23322 - DNA, 25 bp, Artificial sequence
  Extension Primer
atactctaattttttttttcaaacc

SEQ ID NO: 23323 - DNA, 25 bp, Artificial sequence
  Extension Primer
ctctgacccactcccaaaatgccac

SEQ ID NO: 23324 - DNA, 25 bp, Artificial sequence
  Extension Primer
agctcctgcgtctgggaaacagttc

SEQ ID NO: 23325 - DNA, 25 bp, Artificial sequence
  Extension Primer
caagttttgtttaaaatgttcagca

SEQ ID NO: 23326 - DNA, 25 bp, Artificial sequence
  Extension Primer
aaacatccacattctgcccacacag

SEQ ID NO: 23327 - DNA, 25 bp, Artificial sequence
  Extension Primer
catagacttttggtgaatggggtgg

SEQ ID NO: 23328 - DNA, 25 bp, Artificial sequence
  Extension Primer
ctcttcactgtgatttacctttgat

SEQ ID NO: 23329 - DNA, 25 bp, Artificial sequence
  Extension Primer
agggtaccctaaccactctcccatt

SEQ ID NO: 23330 - DNA, 25 bp, Artificial sequence
  Extension Primer
ataaatgtgactacccatctatctc

SEQ ID NO: 23331 - DNA, 25 bp, Artificial sequence
  Extension Primer
gactcggaactcctaatgctggggg

SEQ ID NO: 23332 - DNA, 25 bp, Artificial sequence
  Extension Primer
tttataataagaaattggaggtaca

SEQ ID NO: 23333 - DNA, 25 bp, Artificial sequence
  Extension Primer
gcctgggggaatggtctaggaaggg

SEQ ID NO: 23334 - DNA, 25 bp, Artificial sequence
  Extension Primer
tggttttcaaagttctggttgcatc

SEQ ID NO: 23335 - DNA, 25 bp, Artificial sequence
  Extension Primer
cacatgatattctcacagtgtccag

SEQ ID NO: 23336 - DNA, 25 bp, Artificial sequence
  Extension Primer
tggcttgggatctaaaaacctgtaa

SEQ ID NO: 23337 - DNA, 25 bp, Artificial sequence
  Extension Primer
ataatgtactaataatgtgatgtat

SEQ ID NO: 23338 - DNA, 25 bp, Artificial sequence
  Extension Primer
caaaacttttcttaaattggcactc

SEQ ID NO: 23339 - DNA, 25 bp, Artificial sequence
  Extension Primer
ctcttagcatccatcttgcacatcc

SEQ ID NO: 23340 - DNA, 25 bp, Artificial sequence
  Extension Primer
aactataaatgacttaaacacttgc

SEQ ID NO: 23341 - DNA, 25 bp, Artificial sequence
  Extension Primer
tgggaattccctattagagaggctg

SEQ ID NO: 23342 - DNA, 25 bp, Artificial sequence
  Extension Primer
actgctgattgccattatctactaa

SEQ ID NO: 23343 - DNA, 25 bp, Artificial sequence
  Extension Primer
gatagaacattcctctcagaatggt

SEQ ID NO: 23344 - DNA, 25 bp, Artificial sequence
  Extension Primer
aaattaaaaacaacacamacctaag

SEQ ID NO: 23345 - DNA, 25 bp, Artificial sequence
  Extension Primer
acagatagaacacacagaaccagag

SEQ ID NO: 23346 - DNA, 25 bp, Artificial sequence
  Extension Primer
gctgggaggtgcagtttgtacaagg

SEQ ID NO: 23347 - DNA, 25 bp, Artificial sequence
  Extension Primer
gagcagagagaccagagtttagatt

SEQ ID NO: 23348 - DNA, 25 bp, Artificial sequence
  Extension Primer
ccttgtatattcccctttccaacct

SEQ ID NO: 23349 - DNA, 25 bp, Artificial sequence
  Extension Primer
atttctttgggaattctgcatactg

SEQ ID NO: 23350 - DNA, 25 bp, Artificial sequence
  Extension Primer
aatcaccaagggccaagtacatcat

SEQ ID NO: 23351 - DNA, 25 bp, Artificial sequence
  Extension Primer
ctctgtccccaaacagctcttgaca

SEQ ID NO: 23352 - DNA, 25 bp, Artificial sequence
  Extension Primer
atcccatgaactgtagcccaccagg

SEQ ID NO: 23353 - DNA, 25 bp, Artificial sequence
  Extension Primer
ttcagactatccatatcccttagta

SEQ ID NO: 23354 - DNA, 25 bp, Artificial sequence
  Extension Primer
tatttttaacctaakgacaaagtga

SEQ ID NO: 23355 - DNA, 25 bp, Artificial sequence
  Extension Primer
atctgagctgccaacagaaacacac

SEQ ID NO: 23356 - DNA, 25 bp, Artificial sequence
  Extension Primer
cagggcctgtctcttaataggagtg

SEQ ID NO: 23357 - DNA, 25 bp, Artificial sequence
  Extension Primer
cacatcagttcctaccctccctggc

SEQ ID NO: 23358 - DNA, 25 bp, Artificial sequence
  Extension Primer
atttgatcatcaccatctcccagga

SEQ ID NO: 23359 - DNA, 25 bp, Artificial sequence
  Extension Primer
aatacacatacttcattttgtttta

SEQ ID NO: 23360 - DNA, 25 bp, Artificial sequence
  Extension Primer
tataaatgttcacgctcatcttcat

SEQ ID NO: 23361 - DNA, 25 bp, Artificial sequence
  Extension Primer
agcttgtgccattgcaaaaatttaa

SEQ ID NO: 23362 - DNA, 22 bp, Artificial sequence
  Extension Primer
tctgtactgagcacagtggagg

SEQ ID NO: 23363 - DNA, 25 bp, Artificial sequence
  Extension Primer
ttgttccttccaagtgttttacata

SEQ ID NO: 23364 - DNA, 25 bp, Artificial sequence
  Extension Primer
ggcaaccacaaagtctagggaaatc

SEQ ID NO: 23365 - DNA, 25 bp, Artificial sequence
  Extension Primer
ttacctaacaagattgagcttggtt

SEQ ID NO: 23366 - DNA, 25 bp, Artificial sequence
  Extension Primer
catattgctgtacttctgaacatag

SEQ ID NO: 23367 - DNA, 25 bp, Artificial sequence
  Extension Primer
ggtaggttcgaagaacctctacagg

SEQ ID NO: 23368 - DNA, 25 bp, Artificial sequence
  Extension Primer
agaatgcctattgagaatacaatga

SEQ ID NO: 23369 - DNA, 25 bp, Artificial sequence
  Extension Primer
cttttgcttgtggtgtttttagtcc

SEQ ID NO: 23370 - DNA, 25 bp, Artificial sequence
  Extension Primer
acctacttaatattcagaggtgtca

SEQ ID NO: 23371 - DNA, 25 bp, Artificial sequence
  Extension Primer
agatgatgaagaggctggaaagatg

SEQ ID NO: 23372 - DNA, 25 bp, Artificial sequence
  Extension Primer
ctatccaggtgtaataatcttcctc

SEQ ID NO: 23373 - DNA, 25 bp, Artificial sequence
  Extension Primer
ggtgcattgcctgacgtggagagtg

SEQ ID NO: 23374 - DNA, 25 bp, Artificial sequence
  Extension Primer
atatttaataacctaacacattcct

SEQ ID NO: 23375 - DNA, 25 bp, Artificial sequence
  Extension Primer
gatttgtactaaaattttgagtaaa

SEQ ID NO: 23376 - DNA, 25 bp, Artificial sequence
  Extension Primer
ggttaagtttccataagtacttaca

SEQ ID NO: 23377 - DNA, 25 bp, Artificial sequence
  Extension Primer
tcctgaacagtcacagtcccacagt

SEQ ID NO: 23378 - DNA, 25 bp, Artificial sequence
  Extension Primer
ctctgtgcctgagacatctgaagca

SEQ ID NO: 23379 - DNA, 25 bp, Artificial sequence
  Extension Primer
taggaaagtatagaagtgaatttac

SEQ ID NO: 23380 - DNA, 25 bp, Artificial sequence
  Extension Primer
caggcaggttctttactgctcgcac

SEQ ID NO: 23381 - DNA, 25 bp, Artificial sequence
  Extension Primer
tctgcaaataattttcttaacttac

SEQ ID NO: 23382 - DNA, 25 bp, Artificial sequence
  Extension Primer
ggatttctgctttgtcattttagtt

SEQ ID NO: 23383 - DNA, 25 bp, Artificial sequence
  Extension Primer
gttttaattttgtgcaatctctttt

SEQ ID NO: 23384 - DNA, 25 bp, Artificial sequence
  Extension Primer
accccttgggtactttaaataattg

SEQ ID NO: 23385 - DNA, 25 bp, Artificial sequence
  Extension Primer
tacattcatggcctaatgtctattt

SEQ ID NO: 23386 - DNA, 25 bp, Artificial sequence
  Extension Primer
atcaaatactaagccaaacagattg

SEQ ID NO: 23387 - DNA, 25 bp, Artificial sequence
  Extension Primer
acttctgccggttccttgctccaag

SEQ ID NO: 23388 - DNA, 25 bp, Artificial sequence
  Extension Primer
agaatgaactgtgtgygacaaatta

SEQ ID NO: 23389 - DNA, 25 bp, Artificial sequence
  Extension Primer
attccaggagacttccttggtgata

SEQ ID NO: 23390 - DNA, 25 bp, Artificial sequence
  Extension Primer
gaactcatcattgagaacttagaaa

SEQ ID NO: 23391 - DNA, 25 bp, Artificial sequence
  Extension Primer
gagggactggcccaggctgtcaaca

SEQ ID NO: 23392 - DNA, 25 bp, Artificial sequence
  Extension Primer
tgccctcctggtcgcttcaattaaa

SEQ ID NO: 23393 - DNA, 25 bp, Artificial sequence
  Extension Primer
acactggaccatttctgaccaactg

SEQ ID NO: 23394 - DNA, 25 bp, Artificial sequence
  Extension Primer
actaaaatattataaatgcaacata

SEQ ID NO: 23395 - DNA, 25 bp, Artificial sequence
  Extension Primer
tttttatattctttgcataaactgt

SEQ ID NO: 23396 - DNA, 25 bp, Artificial sequence
  Extension Primer
ctgtgggaaaatcaataatacattt

SEQ ID NO: 23397 - DNA, 25 bp, Artificial sequence
  Extension Primer
ctacttcacctacctcgcctaccct

SEQ ID NO: 23398 - DNA, 25 bp, Artificial sequence
  Extension Primer
tctgattttattattccartgtctc

SEQ ID NO: 23399 - DNA, 25 bp, Artificial sequence
  Extension Primer
atataaagtgcttagaatgatgccc

SEQ ID NO: 23400 - DNA, 25 bp, Artificial sequence
  Extension Primer
tctggaccttgtcctgtgtacctct

SEQ ID NO: 23401 - DNA, 25 bp, Artificial sequence
  Extension Primer
ggtcgggtaactaagatcccacaca

SEQ ID NO: 23402 - DNA, 25 bp, Artificial sequence
  Extension Primer
gaggggctgctttgtggctgctaat

SEQ ID NO: 23403 - DNA, 25 bp, Artificial sequence
  Extension Primer
ctgttatcacaactttatgggctcc

SEQ ID NO: 23404 - DNA, 25 bp, Artificial sequence
  Extension Primer
acgaagtcggggagctctgcgtgtg

SEQ ID NO: 23405 - DNA, 25 bp, Artificial sequence
  Extension Primer
acgagcttcttgggtcttcagtgcc

SEQ ID NO: 23406 - DNA, 25 bp, Artificial sequence
  Extension Primer
ggactgaagaggttaatagtggtta

SEQ ID NO: 23407 - DNA, 25 bp, Artificial sequence
  Extension Primer
tttcatctcctttctagctttggtg

SEQ ID NO: 23408 - DNA, 25 bp, Artificial sequence
  Extension Primer
ctggtgggaaatcttcactttagga

SEQ ID NO: 23409 - DNA, 25 bp, Artificial sequence
  Extension Primer
taacaacggtgatcacataaccttt

SEQ ID NO: 23410 - DNA, 25 bp, Artificial sequence
  Extension Primer
aactatttaggtggttgtgtagtga

SEQ ID NO: 23411 - DNA, 25 bp, Artificial sequence
  Extension Primer
ccaaagtgccactcattctacctgc

SEQ ID NO: 23412 - DNA, 25 bp, Artificial sequence
  Extension Primer
caacaagacatgttttatggagact

SEQ ID NO: 23413 - DNA, 25 bp, Artificial sequence
  Extension Primer
aaaaaagactagaagatgcaggtag

SEQ ID NO: 23414 - DNA, 25 bp, Artificial sequence
  Extension Primer
gaagtcatcctggccccttaagttt

SEQ ID NO: 23415 - DNA, 25 bp, Artificial sequence
  Extension Primer
tagcccacacttccccagagcgagc

SEQ ID NO: 23416 - DNA, 25 bp, Artificial sequence
  Extension Primer
ttccaaaggtccaggccagaagtga

SEQ ID NO: 23417 - DNA, 25 bp, Artificial sequence
  Extension Primer
ccttgaggatctctcttttggtcct

SEQ ID NO: 23418 - DNA, 25 bp, Artificial sequence
  Extension Primer
gatgggattttcttttttttcacca

SEQ ID NO: 23419 - DNA, 25 bp, Artificial sequence
  Extension Primer
aagatttgaattctgagggagatgg

SEQ ID NO: 23420 - DNA, 25 bp, Artificial sequence
  Extension Primer
ggactaacagagatgtgataaatga

SEQ ID NO: 23421 - DNA, 25 bp, Artificial sequence
  Extension Primer
attctacctgcataatgtaaactgg

SEQ ID NO: 23422 - DNA, 25 bp, Artificial sequence
  Extension Primer
aagaaagaaggttaacagtccgttt

SEQ ID NO: 23423 - DNA, 25 bp, Artificial sequence
  Extension Primer
agggtcatttcataggtagaagttg

SEQ ID NO: 23424 - DNA, 25 bp, Artificial sequence
  Extension Primer
tcttaattatcttgactttccattt

SEQ ID NO: 23425 - DNA, 25 bp, Artificial sequence
  Extension Primer
ttgcaacccagatccctgattggtg

SEQ ID NO: 23426 - DNA, 25 bp, Artificial sequence
  Extension Primer
agatgttttgaatgaagaactgttt

SEQ ID NO: 23427 - DNA, 25 bp, Artificial sequence
  Extension Primer
ggataaaaatgataaaagactatgg

SEQ ID NO: 23428 - DNA, 25 bp, Artificial sequence
  Extension Primer
cgctgccagagctctaagtgccttc

SEQ ID NO: 23429 - DNA, 25 bp, Artificial sequence
  Extension Primer
aactgaggtcagttgggctgaggct

SEQ ID NO: 23430 - DNA, 25 bp, Artificial sequence
  Extension Primer
ggattttggagacctctgttctggc

SEQ ID NO: 23431 - DNA, 25 bp, Artificial sequence
  Extension Primer
atgaaaatgctttctgaagatcaac

SEQ ID NO: 23432 - DNA, 25 bp, Artificial sequence
  Extension Primer
tgtcagcctgtccttgccgatcaca

SEQ ID NO: 23433 - DNA, 25 bp, Artificial sequence
  Extension Primer
aagctgaaaatgctcttgtgtcaca

SEQ ID NO: 23434 - DNA, 25 bp, Artificial sequence
  Extension Primer
tttttcctaacattttttgaaaaca

SEQ ID NO: 23435 - DNA, 25 bp, Artificial sequence
  Extension Primer
attaatttctcaatatttttgtgta

SEQ ID NO: 23436 - DNA, 25 bp, Artificial sequence
  Extension Primer
tcataaaagggtgtctgccagattg

SEQ ID NO: 23437 - DNA, 25 bp, Artificial sequence
  Extension Primer
ttatcattatatatatttcagtgtt

SEQ ID NO: 23438 - DNA, 25 bp, Artificial sequence
  Extension Primer
ccttagcccaggcgtcgaaacctag

SEQ ID NO: 23439 - DNA, 25 bp, Artificial sequence
  Extension Primer
taagaatattcaaggaattaaaaaa

SEQ ID NO: 23440 - DNA, 25 bp, Artificial sequence
  Extension Primer
aaatgtacataaagtgactattatt

SEQ ID NO: 23441 - DNA, 25 bp, Artificial sequence
  Extension Primer
tttattctgtctgtaaccatcttta

SEQ ID NO: 23442 - DNA, 25 bp, Artificial sequence
  Extension Primer
tatactcaacataaaacacaaagcc

SEQ ID NO: 23443 - DNA, 25 bp, Artificial sequence
  Extension Primer
atctcaaatttatgatgaggttact

SEQ ID NO: 23444 - DNA, 25 bp, Artificial sequence
  Extension Primer
caagattccctctaagattttgctc

SEQ ID NO: 23445 - DNA, 25 bp, Artificial sequence
  Extension Primer
gtaaaaggagtttatactaccttca

SEQ ID NO: 23446 - DNA, 25 bp, Artificial sequence
  Extension Primer
gaaagagcacgagagacaaagcgga

SEQ ID NO: 23447 - DNA, 25 bp, Artificial sequence
  Extension Primer
ttttagtgggtaaatgggttaaatc

SEQ ID NO: 23448 - DNA, 25 bp, Artificial sequence
  Extension Primer
ccattttcaggatcaagacccaaga

SEQ ID NO: 23449 - DNA, 25 bp, Artificial sequence
  Extension Primer
gatccaaattcagtcttcaacaaca

SEQ ID NO: 23450 - DNA, 25 bp, Artificial sequence
  Extension Primer
gtgttgacttattcccagccatagc

SEQ ID NO: 23451 - DNA, 25 bp, Artificial sequence
  Extension Primer
atcttcagggaatttttttaagcca

SEQ ID NO: 23452 - DNA, 25 bp, Artificial sequence
  Extension Primer
acagaagcattacctcaagatcgtt

SEQ ID NO: 23453 - DNA, 25 bp, Artificial sequence
  Extension Primer
agcccacctcgcacctcaaaaatac

SEQ ID NO: 23454 - DNA, 25 bp, Artificial sequence
  Extension Primer
gtgagaccaacctgatgcagatatt

SEQ ID NO: 23455 - DNA, 25 bp, Artificial sequence
  Extension Primer
gagagtccagagaattctcataaac

SEQ ID NO: 23456 - DNA, 25 bp, Artificial sequence
  Extension Primer
tggtgattagaaatacaaaatacat

SEQ ID NO: 23457 - DNA, 25 bp, Artificial sequence
  Extension Primer
aggatcacagaattctccagtacaa

SEQ ID NO: 23458 - DNA, 25 bp, Artificial sequence
  Extension Primer
aaaacaggatatcacagaatgccaa

SEQ ID NO: 23459 - DNA, 25 bp, Artificial sequence
  Extension Primer
acaacatcgagatgaaataaaagac

SEQ ID NO: 23460 - DNA, 25 bp, Artificial sequence
  Extension Primer
tgagaggagagttgtaacaggccaa

SEQ ID NO: 23461 - DNA, 22 bp, Artificial sequence
  Extension Primer
aactgacttcttatttctttct

SEQ ID NO: 23462 - DNA, 25 bp, Artificial sequence
  Extension Primer
cccccttcccacacgcggctcgcag

SEQ ID NO: 23463 - DNA, 25 bp, Artificial sequence
  Extension Primer
atgatgatagctacaatgacccttc

SEQ ID NO: 23464 - DNA, 25 bp, Artificial sequence
  Extension Primer
cactgtatttcaccaccatataccc

SEQ ID NO: 23465 - DNA, 25 bp, Artificial sequence
  Extension Primer
ttatatagatttttgaaagcttacc

SEQ ID NO: 23466 - DNA, 25 bp, Artificial sequence
  Extension Primer
cagatagctccattactyaccgaga

SEQ ID NO: 23467 - DNA, 25 bp, Artificial sequence
  Extension Primer
tgttttcttctttgtgacaagggag

SEQ ID NO: 23468 - DNA, 25 bp, Artificial sequence
  Extension Primer
ttgtatgctcatatcctgagtggta

SEQ ID NO: 23469 - DNA, 25 bp, Artificial sequence
  Extension Primer
ccttctgctgacaagaaatggtaat

SEQ ID NO: 23470 - DNA, 25 bp, Artificial sequence
  Extension Primer
tcaaagacccgacagggaagcgagg

SEQ ID NO: 23471 - DNA, 25 bp, Artificial sequence
  Extension Primer
tgaactcacatttcttaatatgtaa

SEQ ID NO: 23472 - DNA, 25 bp, Artificial sequence
  Extension Primer
attcatctgcattctttttttagat

SEQ ID NO: 23473 - DNA, 25 bp, Artificial sequence
  Extension Primer
ctaaaaattcattagcactctcttt

SEQ ID NO: 23474 - DNA, 25 bp, Artificial sequence
  Extension Primer
ccactttatgtaagtggaaaatatg

SEQ ID NO: 23475 - DNA, 25 bp, Artificial sequence
  Extension Primer
atggagaaacatttttttcaaagat

SEQ ID NO: 23476 - DNA, 25 bp, Artificial sequence
  Extension Primer
tgccctccctcccacacctgcagcc

SEQ ID NO: 23477 - DNA, 25 bp, Artificial sequence
  Extension Primer
tattagctgctttccccaactagaa

SEQ ID NO: 23478 - DNA, 25 bp, Artificial sequence
  Extension Primer
tttgtttttttttwwattttttttg

SEQ ID NO: 23479 - DNA, 25 bp, Artificial sequence
  Extension Primer
gacatttagttccaccagaatgaga

SEQ ID NO: 23480 - DNA, 25 bp, Artificial sequence
  Extension Primer
gcacttacccgcaggcatcggcaca

SEQ ID NO: 23481 - DNA, 25 bp, Artificial sequence
  Extension Primer
aaatccaaatggtaaaatatatccc

SEQ ID NO: 23482 - DNA, 25 bp, Artificial sequence
  Extension Primer
taatgccaaagaagatgaagcttaa

SEQ ID NO: 23483 - DNA, 25 bp, Artificial sequence
  Extension Primer
aggttggtacacaggcatgcatgct

SEQ ID NO: 23484 - DNA, 25 bp, Artificial sequence
  Extension Primer
tgggccaagagaactggtaacattt

SEQ ID NO: 23485 - DNA, 25 bp, Artificial sequence
  Extension Primer
cacaacattttaaaatatgcagagc

SEQ ID NO: 23486 - DNA, 25 bp, Artificial sequence
  Extension Primer
tcagcaagcgctggcgggaaattga

SEQ ID NO: 23487 - DNA, 25 bp, Artificial sequence
  Extension Primer
tctaaaacataggggtggacaaaaa

SEQ ID NO: 23488 - DNA, 25 bp, Artificial sequence
  Extension Primer
ggatggagctgagaggaagcctgtc

SEQ ID NO: 23489 - DNA, 25 bp, Artificial sequence
  Extension Primer
aagtcgttaagagcatatattctgg

SEQ ID NO: 23490 - DNA, 25 bp, Artificial sequence
  Extension Primer
taagattgtttataaaccatgagaa

SEQ ID NO: 23491 - DNA, 25 bp, Artificial sequence
  Extension Primer
aggtggattctttaccactgagcca

SEQ ID NO: 23492 - DNA, 25 bp, Artificial sequence
  Extension Primer
tttgatttgtttgctggaagattag

SEQ ID NO: 23493 - DNA, 25 bp, Artificial sequence
  Extension Primer
tgggaggggagagaagtggaaggaa

SEQ ID NO: 23494 - DNA, 25 bp, Artificial sequence
  Extension Primer
ctataaaacggaggtgaccactgta

SEQ ID NO: 23495 - DNA, 25 bp, Artificial sequence
  Extension Primer
ttcaagccatcacgaggcactcaca

SEQ ID NO: 23496 - DNA, 25 bp, Artificial sequence
  Extension Primer
ctgcctacctttactcgatatcggg

SEQ ID NO: 23497 - DNA, 25 bp, Artificial sequence
  Extension Primer
tatgatagaaatgagtgagcaaaaa

SEQ ID NO: 23498 - DNA, 25 bp, Artificial sequence
  Extension Primer
caaagctacagaagccagggctcag

SEQ ID NO: 23499 - DNA, 25 bp, Artificial sequence
  Extension Primer
attaacacaggtcatgtgtacaaga

SEQ ID NO: 23500 - DNA, 25 bp, Artificial sequence
  Extension Primer
tgcatccctcttttgtgacatttac

SEQ ID NO: 23501 - DNA, 25 bp, Artificial sequence
  Extension Primer
cattatgacactaacctcttctagc

SEQ ID NO: 23502 - DNA, 25 bp, Artificial sequence
  Extension Primer
tggggtgtatacatcaattcagagg

SEQ ID NO: 23503 - DNA, 25 bp, Artificial sequence
  Extension Primer
gccaggatccccggcccattggaca

SEQ ID NO: 23504 - DNA, 25 bp, Artificial sequence
  Extension Primer
gattcaacagccacatgctggacta

SEQ ID NO: 23505 - DNA, 25 bp, Artificial sequence
  Extension Primer
cagatsataaaatagttttagatcc

SEQ ID NO: 23506 - DNA, 25 bp, Artificial sequence
  Extension Primer
acaaagtgatgccatttcacgcacc

SEQ ID NO: 23507 - DNA, 25 bp, Artificial sequence
  Extension Primer
cttataattagtggggcactgagta

SEQ ID NO: 23508 - DNA, 25 bp, Artificial sequence
  Extension Primer
cagagttgcctactggaccttgagg

SEQ ID NO: 23509 - DNA, 25 bp, Artificial sequence
  Extension Primer
tctcttttgatacaaattattgaaa

SEQ ID NO: 23510 - DNA, 25 bp, Artificial sequence
  Extension Primer
tgcgattcccacggtaaaccccagc

SEQ ID NO: 23511 - DNA, 25 bp, Artificial sequence
  Extension Primer
gggtgatctgataaactcacacact

SEQ ID NO: 23512 - DNA, 25 bp, Artificial sequence
  Extension Primer
tttgtggataactgacttcctaaga

SEQ ID NO: 23513 - DNA, 25 bp, Artificial sequence
  Extension Primer
acctcatctctcatcaggacactgg

SEQ ID NO: 23514 - DNA, 25 bp, Artificial sequence
  Extension Primer
gccaccacaggccagatcccaccag

SEQ ID NO: 23515 - DNA, 25 bp, Artificial sequence
  Extension Primer
tgtagtaaggtaggtaatgtgatag

SEQ ID NO: 23516 - DNA, 25 bp, Artificial sequence
  Extension Primer
agaaagaatggtaaaaagaacaatt

SEQ ID NO: 23517 - DNA, 25 bp, Artificial sequence
  Extension Primer
aaatccttacaatttctggacctac

SEQ ID NO: 23518 - DNA, 25 bp, Artificial sequence
  Extension Primer
mtcttcctgatggcaaattttgcca

SEQ ID NO: 23519 - DNA, 25 bp, Artificial sequence
  Extension Primer
ktggcaaaatttgccatcaggaaga

SEQ ID NO: 23520 - DNA, 25 bp, Artificial sequence
  Extension Primer
ccctttagctattgtagccactcta

SEQ ID NO: 23521 - DNA, 25 bp, Artificial sequence
  Extension Primer
tcactgtaaatgcttctaaataact

SEQ ID NO: 23522 - DNA, 25 bp, Artificial sequence
  Extension Primer
tctcccttctgtttaatccaacctg

SEQ ID NO: 23523 - DNA, 25 bp, Artificial sequence
  Extension Primer
actccaggagatagtgaagaacggg

SEQ ID NO: 23524 - DNA, 25 bp, Artificial sequence
  Extension Primer
caaaaagtgttgggagactctgaat

SEQ ID NO: 23525 - DNA, 25 bp, Artificial sequence
  Extension Primer
gaccatgaagctgactggaagctgc

SEQ ID NO: 23526 - DNA, 25 bp, Artificial sequence
  Extension Primer
aaaagcagttgagtgaattacttaa

SEQ ID NO: 23527 - DNA, 25 bp, Artificial sequence
  Extension Primer
aagaattacttatttggtacataaa

SEQ ID NO: 23528 - DNA, 25 bp, Artificial sequence
  Extension Primer
gcaactttagttctacttgccatta

SEQ ID NO: 23529 - DNA, 25 bp, Artificial sequence
  Extension Primer
catcaccgtcctatttatgcttggg

SEQ ID NO: 23530 - DNA, 25 bp, Artificial sequence
  Extension Primer
ggaaatcatgattgatttgacaact

SEQ ID NO: 23531 - DNA, 25 bp, Artificial sequence
  Extension Primer
tttccttgagatcactctgatgtca

SEQ ID NO: 23532 - DNA, 25 bp, Artificial sequence
  Extension Primer
aaatgaccaccaggccagacattac

SEQ ID NO: 23533 - DNA, 25 bp, Artificial sequence
  Extension Primer
accagctattcaatggcagcactat

SEQ ID NO: 23534 - DNA, 25 bp, Artificial sequence
  Extension Primer
aaacaacatgcttagaattattgct

SEQ ID NO: 23535 - DNA, 25 bp, Artificial sequence
  Extension Primer
tcactagagtaaaaggaaatgacaa

SEQ ID NO: 23536 - DNA, 25 bp, Artificial sequence
  Extension Primer
tctagagtctattaccttcgtagga

SEQ ID NO: 23537 - DNA, 25 bp, Artificial sequence
  Extension Primer
acatcattaatacctcacatttata

SEQ ID NO: 23538 - DNA, 25 bp, Artificial sequence
  Extension Primer
tgtgccccttgtctggccatgacca

SEQ ID NO: 23539 - DNA, 25 bp, Artificial sequence
  Extension Primer
gacttttcatagtttccctggtgct

SEQ ID NO: 23540 - DNA, 25 bp, Artificial sequence
  Extension Primer
cctgcgtggtgattatgagtggagc

SEQ ID NO: 23541 - DNA, 25 bp, Artificial sequence
  Extension Primer
tctttgaaagcattaaaaatcagtc

SEQ ID NO: 23542 - DNA, 25 bp, Artificial sequence
  Extension Primer
tctaatcatgattctaggtttccat

SEQ ID NO: 23543 - DNA, 25 bp, Artificial sequence
  Extension Primer
actttcaacaatgagcaaggaaaac

SEQ ID NO: 23544 - DNA, 25 bp, Artificial sequence
  Extension Primer
actctgctcacaaaatatttagccc

SEQ ID NO: 23545 - DNA, 25 bp, Artificial sequence
  Extension Primer
aatccatctaaagtgtacaaacaca

SEQ ID NO: 23546 - DNA, 25 bp, Artificial sequence
  Extension Primer
aaggcagagacaatattgtgctgac

SEQ ID NO: 23547 - DNA, 25 bp, Artificial sequence
  Extension Primer
tacactgtaaaaaatgaaacctgaa

SEQ ID NO: 23548 - DNA, 25 bp, Artificial sequence
  Extension Primer
agccgagagtgcttccgaaccttgc

SEQ ID NO: 23549 - DNA, 25 bp, Artificial sequence
  Extension Primer
aagcaatatttctaaagaatccacc

SEQ ID NO: 23550 - DNA, 25 bp, Artificial sequence
  Extension Primer
cactcagacacaaaaactgaccaag

SEQ ID NO: 23551 - DNA, 25 bp, Artificial sequence
  Extension Primer
ccagggtactttttatgttattgat

SEQ ID NO: 23552 - DNA, 25 bp, Artificial sequence
  Extension Primer
cagttgttcaaggaggaagaggaga

SEQ ID NO: 23553 - DNA, 22 bp, Artificial sequence
  Extension Primer
acctggctggatggtgaggtgt

SEQ ID NO: 23554 - DNA, 22 bp, Artificial sequence
  Extension Primer
tttcataagcatttatgtttca

SEQ ID NO: 23555 - DNA, 25 bp, Artificial sequence
  Extension Primer
acccagacatttctccttctcagtt

SEQ ID NO: 23556 - DNA, 25 bp, Artificial sequence
  Extension Primer
attcaacatgggggactaaagcaaa

SEQ ID NO: 23557 - DNA, 25 bp, Artificial sequence
  Extension Primer
tctagaattgctgacgacctactgg

SEQ ID NO: 23558 - DNA, 25 bp, Artificial sequence
  Extension Primer
taccttgccctttggcctcattact

SEQ ID NO: 23559 - DNA, 25 bp, Artificial sequence
  Extension Primer
actgttccccaaccatgcgtctggt

SEQ ID NO: 23560 - DNA, 25 bp, Artificial sequence
  Extension Primer
ttagcttcctttaaaataatgcaca

SEQ ID NO: 23561 - DNA, 25 bp, Artificial sequence
  Extension Primer
acaaaaagaggtacatgaacagtca

SEQ ID NO: 23562 - DNA, 25 bp, Artificial sequence
  Extension Primer
agacactgctgggatgcccatgttc

SEQ ID NO: 23563 - DNA, 25 bp, Artificial sequence
  Extension Primer
cctccggagtttctctacttatttt

SEQ ID NO: 23564 - DNA, 25 bp, Artificial sequence
  Extension Primer
tctcagcagctgaaccgtcctcaga

SEQ ID NO: 23565 - DNA, 25 bp, Artificial sequence
  Extension Primer
agtgcgcttactgactgccagacag

SEQ ID NO: 23566 - DNA, 25 bp, Artificial sequence
  Extension Primer
gacttgtacgttacaacataagaaa

SEQ ID NO: 23567 - DNA, 25 bp, Artificial sequence
  Extension Primer
gtaaattctcttctgtagtctccat

SEQ ID NO: 23568 - DNA, 25 bp, Artificial sequence
  Extension Primer
caaaggaaggaaagagtgggatgtg

SEQ ID NO: 23569 - DNA, 25 bp, Artificial sequence
  Extension Primer
cagctcccattacaattatctgaag

SEQ ID NO: 23570 - DNA, 25 bp, Artificial sequence
  Extension Primer
agccatttagaaggaattaaataca

SEQ ID NO: 23571 - DNA, 25 bp, Artificial sequence
  Extension Primer
gcattgtttctaatgccattttcta

SEQ ID NO: 23572 - DNA, 25 bp, Artificial sequence
  Extension Primer
cttaaaaataaatgtttacactgta

SEQ ID NO: 23573 - DNA, 25 bp, Artificial sequence
  Extension Primer
aactattcagcttcagtttttcatt

SEQ ID NO: 23574 - DNA, 25 bp, Artificial sequence
  Extension Primer
atcagatttttctggagttcaaaat

SEQ ID NO: 23575 - DNA, 25 bp, Artificial sequence
  Extension Primer
cttccgcagctactgtcattaagga

SEQ ID NO: 23576 - DNA, 25 bp, Artificial sequence
  Extension Primer
cctactgctctccctaaaactgatc

SEQ ID NO: 23577 - DNA, 25 bp, Artificial sequence
  Extension Primer
ccacgcgataccagaggggatgcct

SEQ ID NO: 23578 - DNA, 25 bp, Artificial sequence
  Extension Primer
attctgtgtcaccagaactcattaa

SEQ ID NO: 23579 - DNA, 25 bp, Artificial sequence
  Extension Primer
aaaagtcagtaattcttcttggatc

SEQ ID NO: 23580 - DNA, 25 bp, Artificial sequence
  Extension Primer
cacttgtttcggtgtggcttctagc

SEQ ID NO: 23581 - DNA, 25 bp, Artificial sequence
  Extension Primer
ctagatgaactttggttgggtacaa

SEQ ID NO: 23582 - DNA, 25 bp, Artificial sequence
  Extension Primer
gggaattagtgtaagactgatttct

SEQ ID NO: 23583 - DNA, 25 bp, Artificial sequence
  Extension Primer
ggactgtaatccgccaggttcctct

SEQ ID NO: 23584 - DNA, 25 bp, Artificial sequence
  Extension Primer
cgacacacctgttgctagaggtgcc

SEQ ID NO: 23585 - DNA, 25 bp, Artificial sequence
  Extension Primer
attattagttttrtaagtaaggata

SEQ ID NO: 23586 - DNA, 25 bp, Artificial sequence
  Extension Primer
tcgtatttactcttagtacctatgt

SEQ ID NO: 23587 - DNA, 25 bp, Artificial sequence
  Extension Primer
cattcatagatctttactcattaag

SEQ ID NO: 23588 - DNA, 25 bp, Artificial sequence
  Extension Primer
tgagaggatgtaaatcaactgcact

SEQ ID NO: 23589 - DNA, 25 bp, Artificial sequence
  Extension Primer
tcagccactaatgcaataatcaaaa

SEQ ID NO: 23590 - DNA, 22 bp, Artificial sequence
  Extension Primer
gtgttgtagaggaggtaagaaa

SEQ ID NO: 23591 - DNA, 25 bp, Artificial sequence
  Extension Primer
tcttgaagagtcttgatccacataa

SEQ ID NO: 23592 - DNA, 25 bp, Artificial sequence
  Extension Primer
caaaaaatgaccatgagccgtcaak

SEQ ID NO: 23593 - DNA, 25 bp, Artificial sequence
  Extension Primer
aaagatctccattcatttttttctc

SEQ ID NO: 23594 - DNA, 25 bp, Artificial sequence
  Extension Primer
ttcaacttcatagtatttactggat

SEQ ID NO: 23595 - DNA, 25 bp, Artificial sequence
  Extension Primer
caggggtacagataagcaggtacac

SEQ ID NO: 23596 - DNA, 25 bp, Artificial sequence
  Extension Primer
aggtcaggcacttgagacacagatt

SEQ ID NO: 23597 - DNA, 25 bp, Artificial sequence
  Extension Primer
aagcaaaatttcacaggatattttc

SEQ ID NO: 23598 - DNA, 25 bp, Artificial sequence
  Extension Primer
gctctactcascatctkaagtctta

SEQ ID NO: 23599 - DNA, 25 bp, Artificial sequence
  Extension Primer
aattgatggcagatgaagccacaga

SEQ ID NO: 23600 - DNA, 25 bp, Artificial sequence
  Extension Primer
ggtacattaactcttcccaaccctg

SEQ ID NO: 23601 - DNA, 25 bp, Artificial sequence
  Extension Primer
cttactacctggggccctacaccac

SEQ ID NO: 23602 - DNA, 25 bp, Artificial sequence
  Extension Primer
tttcttgtccgtttctgccatctac

SEQ ID NO: 23603 - DNA, 25 bp, Artificial sequence
  Extension Primer
tttgttttttttcaaaaaaggttct

SEQ ID NO: 23604 - DNA, 25 bp, Artificial sequence
  Extension Primer
gcctgtactttgtttacataatgac

SEQ ID NO: 23605 - DNA, 25 bp, Artificial sequence
  Extension Primer
aattaaattcttaaaatcaccatca

SEQ ID NO: 23606 - DNA, 22 bp, Artificial sequence
  Extension Primer
tttggtctgtcctgtatgtgat

SEQ ID NO: 23607 - DNA, 22 bp, Artificial sequence
  Extension Primer
ccatcttggagaattgctttgc

SEQ ID NO: 23608 - DNA, 25 bp, Artificial sequence
  Extension Primer
gattcacatccatttccttcaatsc

SEQ ID NO: 23609 - DNA, 25 bp, Artificial sequence
  Extension Primer
gaataatggctgggaaatagggagc

SEQ ID NO: 23610 - DNA, 25 bp, Artificial sequence
  Extension Primer
aaagtgagaaacagatggcaatgaa

SEQ ID NO: 23611 - DNA, 25 bp, Artificial sequence
  Extension Primer
cctcaacatctgtaactcaggaata

SEQ ID NO: 23612 - DNA, 25 bp, Artificial sequence
  Extension Primer
cccctggtctaatttgaggcatcta

SEQ ID NO: 23613 - DNA, 25 bp, Artificial sequence
  Extension Primer
attgttagtctaattttccctgcct

SEQ ID NO: 23614 - DNA, 25 bp, Artificial sequence
  Extension Primer
gctgctgctcttgcaattctctgaa

SEQ ID NO: 23615 - DNA, 25 bp, Artificial sequence
  Extension Primer
aaaatgctagtcaggacccacaaaa

SEQ ID NO: 23616 - DNA, 25 bp, Artificial sequence
  Extension Primer
tcaacttctgtccccaagcagatta

SEQ ID NO: 23617 - DNA, 25 bp, Artificial sequence
  Extension Primer
tcttctaggacccttacagttggag

SEQ ID NO: 23618 - DNA, 25 bp, Artificial sequence
  Extension Primer
gcaagatgatagagattaagaccct

SEQ ID NO: 23619 - DNA, 25 bp, Artificial sequence
  Extension Primer
gatagagattaagaccctmttttca

SEQ ID NO: 23620 - DNA, 25 bp, Artificial sequence
  Extension Primer
agattcaatagttttgacgcatgga

SEQ ID NO: 23621 - DNA, 25 bp, Artificial sequence
  Extension Primer
tctctattgtgaagyaagacagccg

SEQ ID NO: 23622 - DNA, 25 bp, Artificial sequence
  Extension Primer
ggccatatctcttcaaataaggcta

SEQ ID NO: 23623 - DNA, 25 bp, Artificial sequence
  Extension Primer
ctcatcttaaattattatatcctaa

SEQ ID NO: 23624 - DNA, 25 bp, Artificial sequence
  Extension Primer
atcagaataagaggaagaggctaaa

SEQ ID NO: 23625 - DNA, 25 bp, Artificial sequence
  Extension Primer
gtttgaatggatttgtcaaggccca

SEQ ID NO: 23626 - DNA, 25 bp, Artificial sequence
  Extension Primer
agataagtgtattgagagggatatt

SEQ ID NO: 23627 - DNA, 25 bp, Artificial sequence
  Extension Primer
gagagacgattccaggattttgaga

SEQ ID NO: 23628 - DNA, 25 bp, Artificial sequence
  Extension Primer
tttaataattgtgggtgttacttgg

SEQ ID NO: 23629 - DNA, 25 bp, Artificial sequence
  Extension Primer
atcaagcaaatagggcagaaccagg

SEQ ID NO: 23630 - DNA, 25 bp, Artificial sequence
  Extension Primer
tatgttctgtcattaccttttcttt

SEQ ID NO: 23631 - DNA, 25 bp, Artificial sequence
  Extension Primer
gttattaaatttgctgtcagttctt

SEQ ID NO: 23632 - DNA, 25 bp, Artificial sequence
  Extension Primer
tgacttgaactttcacaagaaacct

SEQ ID NO: 23633 - DNA, 25 bp, Artificial sequence
  Extension Primer
acagtcaggataattaaagtgagca

SEQ ID NO: 23634 - DNA, 25 bp, Artificial sequence
  Extension Primer
tgaagagaaatacaaagaaaatatc

SEQ ID NO: 23635 - DNA, 25 bp, Artificial sequence
  Extension Primer
aggacgcagatgacgaaactgaggc

SEQ ID NO: 23636 - DNA, 25 bp, Artificial sequence
  Extension Primer
ttatcagttctgtatttaccagttt

SEQ ID NO: 23637 - DNA, 25 bp, Artificial sequence
  Extension Primer
tcagtttttattgactagtatgaca

SEQ ID NO: 23638 - DNA, 25 bp, Artificial sequence
  Extension Primer
acaacaattaaaaaaaaagctatta

SEQ ID NO: 23639 - DNA, 25 bp, Artificial sequence
  Extension Primer
acaatactttaagtgtcttggaaaa

SEQ ID NO: 23640 - DNA, 25 bp, Artificial sequence
  Extension Primer
tatttccactttttaaaacgttcct

SEQ ID NO: 23641 - DNA, 25 bp, Artificial sequence
  Extension Primer
ttacttacatgctcaaaaggcatac

SEQ ID NO: 23642 - DNA, 25 bp, Artificial sequence
  Extension Primer
gcttgattaattttacctggctgaa

SEQ ID NO: 23643 - DNA, 25 bp, Artificial sequence
  Extension Primer
ccctgggaggagaaaatgacaagcc

SEQ ID NO: 23644 - DNA, 25 bp, Artificial sequence
  Extension Primer
ttcacaaggcaggtttagatggtgg

SEQ ID NO: 23645 - DNA, 25 bp, Artificial sequence
  Extension Primer
ataagattttcaaaaccttatacct

SEQ ID NO: 23646 - DNA, 25 bp, Artificial sequence
  Extension Primer
catgggaccgaagaactgagttttc

SEQ ID NO: 23647 - DNA, 25 bp, Artificial sequence
  Extension Primer
agtcaaaatctggcagaaaggaaaa

SEQ ID NO: 23648 - DNA, 25 bp, Artificial sequence
  Extension Primer
atggaaaggtagaatgacaaagaga

SEQ ID NO: 23649 - DNA, 25 bp, Artificial sequence
  Extension Primer
tgtagtcacttctaaaaatacaaac

SEQ ID NO: 23650 - DNA, 25 bp, Artificial sequence
  Extension Primer
gccctccggtgcggctccatcctcc

SEQ ID NO: 23651 - DNA, 25 bp, Artificial sequence
  Extension Primer
ccaagaataatgtgctttggagcaa

SEQ ID NO: 23652 - DNA, 25 bp, Artificial sequence
  Extension Primer
ccttaccctggagatgatattgctg

SEQ ID NO: 23653 - DNA, 25 bp, Artificial sequence
  Extension Primer
tcaccatcagtttgataggtcctct

SEQ ID NO: 23654 - DNA, 25 bp, Artificial sequence
  Extension Primer
tgtcctgccattcattgtttctctg

SEQ ID NO: 23655 - DNA, 25 bp, Artificial sequence
  Extension Primer
aatccagtgtgattggggttgggaa

SEQ ID NO: 23656 - DNA, 25 bp, Artificial sequence
  Extension Primer
tccaggagctgcctgttgctgaggg

SEQ ID NO: 23657 - DNA, 22 bp, Artificial sequence
  Extension Primer
ttttctgaagagaccactactg

SEQ ID NO: 23658 - DNA, 25 bp, Artificial sequence
  Extension Primer
tctttgtttccagatttcccacttt

SEQ ID NO: 23659 - DNA, 25 bp, Artificial sequence
  Extension Primer
ctggccatactgaattaaggcccat

SEQ ID NO: 23660 - DNA, 25 bp, Artificial sequence
  Extension Primer
ttgttgactgggctgggtgatttag

SEQ ID NO: 23661 - DNA, 25 bp, Artificial sequence
  Extension Primer
tatttgatgaaataattttctataa

SEQ ID NO: 23662 - DNA, 25 bp, Artificial sequence
  Extension Primer
aaaataacaccagtaggataaagac

SEQ ID NO: 23663 - DNA, 25 bp, Artificial sequence
  Extension Primer
agcaaagactcaaaacagtgcctcc

SEQ ID NO: 23664 - DNA, 25 bp, Artificial sequence
  Extension Primer
tatgctctgctttcccttttttggc

SEQ ID NO: 23665 - DNA, 25 bp, Artificial sequence
  Extension Primer
aagcattttcacttctttgtgccag

SEQ ID NO: 23666 - DNA, 25 bp, Artificial sequence
  Extension Primer
taaaattcataccacatagggtctc

SEQ ID NO: 23667 - DNA, 25 bp, Artificial sequence
  Extension Primer
gattgactgaaatggctgtctttta

SEQ ID NO: 23668 - DNA, 25 bp, Artificial sequence
  Extension Primer
tcccatcattttcagattgtaaatg

SEQ ID NO: 23669 - DNA, 25 bp, Artificial sequence
  Extension Primer
attataataaaagttgagcaatcaa

SEQ ID NO: 23670 - DNA, 25 bp, Artificial sequence
  Extension Primer
acagattctatcctctttcacttgc

SEQ ID NO: 23671 - DNA, 25 bp, Artificial sequence
  Extension Primer
gtgagttgtaagaagcctgtcaccc

SEQ ID NO: 23672 - DNA, 25 bp, Artificial sequence
  Extension Primer
tgtcactttattttgttagtctagg

SEQ ID NO: 23673 - DNA, 25 bp, Artificial sequence
  Extension Primer
tctaaaggcactgtactttattttc

SEQ ID NO: 23674 - DNA, 25 bp, Artificial sequence
  Extension Primer
aaagtttatggggtctgcatttaat

SEQ ID NO: 23675 - DNA, 25 bp, Artificial sequence
  Extension Primer
gaaattacagtactttgttttgtcc

SEQ ID NO: 23676 - DNA, 25 bp, Artificial sequence
  Extension Primer
ctgagctccaagggaagccctgcta

SEQ ID NO: 23677 - DNA, 25 bp, Artificial sequence
  Extension Primer
actgaagctcaaaatttcccrtcta

SEQ ID NO: 23678 - DNA, 25 bp, Artificial sequence
  Extension Primer
tgccatttcaggtttttgtctgtta

SEQ ID NO: 23679 - DNA, 25 bp, Artificial sequence
  Extension Primer
gcatgccacttcctttattttttac

SEQ ID NO: 23680 - DNA, 25 bp, Artificial sequence
  Extension Primer
gtgcagacttacaatggtttgactc

SEQ ID NO: 23681 - DNA, 25 bp, Artificial sequence
  Extension Primer
agcctggataaataacaactctaaa

SEQ ID NO: 23682 - DNA, 25 bp, Artificial sequence
  Extension Primer
caatatcactttttgaaaccatcac

SEQ ID NO: 23683 - DNA, 25 bp, Artificial sequence
  Extension Primer
acacttcataccagacatggggaaa

SEQ ID NO: 23684 - DNA, 25 bp, Artificial sequence
  Extension Primer
aggctttgttcagaaaggcagtctc

SEQ ID NO: 23685 - DNA, 25 bp, Artificial sequence
  Extension Primer
cataacttcccctctccctgcttaa

SEQ ID NO: 23686 - DNA, 25 bp, Artificial sequence
  Extension Primer
attgaggtttcattgcataggcatg

SEQ ID NO: 23687 - DNA, 25 bp, Artificial sequence
  Extension Primer
gggcagggtggccatcagcctcctc

SEQ ID NO: 23688 - DNA, 25 bp, Artificial sequence
  Extension Primer
tcacttctcattttgtggagctatt

SEQ ID NO: 23689 - DNA, 25 bp, Artificial sequence
  Extension Primer
tggtktgtacaagagagtcatttat

SEQ ID NO: 23690 - DNA, 25 bp, Artificial sequence
  Extension Primer
tgcattacccagcatgcactatggc

SEQ ID NO: 23691 - DNA, 25 bp, Artificial sequence
  Extension Primer
taactatcttaaccctatcagtcta

SEQ ID NO: 23692 - DNA, 25 bp, Artificial sequence
  Extension Primer
atcattgcagttgttgtttatttca

SEQ ID NO: 23693 - DNA, 25 bp, Artificial sequence
  Extension Primer
ttttttaggcaaattcactgtctct

SEQ ID NO: 23694 - DNA, 25 bp, Artificial sequence
  Extension Primer
agtgatgcgcctggaaaatcagacc

SEQ ID NO: 23695 - DNA, 25 bp, Artificial sequence
  Extension Primer
cacaatagttaagtcctgcttgccc

SEQ ID NO: 23696 - DNA, 25 bp, Artificial sequence
  Extension Primer
tttggcacttactgactgtgagact

SEQ ID NO: 23697 - DNA, 25 bp, Artificial sequence
  Extension Primer
caccagatgtcaccacccacacccc

SEQ ID NO: 23698 - DNA, 25 bp, Artificial sequence
  Extension Primer
ttacacattaggatatggattgtga

SEQ ID NO: 23699 - DNA, 25 bp, Artificial sequence
  Extension Primer
tcatgttgcagaaacaaccaagagt

SEQ ID NO: 23700 - DNA, 25 bp, Artificial sequence
  Extension Primer
ggttaacaatcatggacttcggtaa

SEQ ID NO: 23701 - DNA, 25 bp, Artificial sequence
  Extension Primer
gagatccattaccttttaaccaact

SEQ ID NO: 23702 - DNA, 25 bp, Artificial sequence
  Extension Primer
aatgttcgtagtcctctgggtgtgg

SEQ ID NO: 23703 - DNA, 25 bp, Artificial sequence
  Extension Primer
cccgaacacagggaaacactatata

SEQ ID NO: 23704 - DNA, 25 bp, Artificial sequence
  Extension Primer
gtataatatacaaaattaattctgg

SEQ ID NO: 23705 - DNA, 25 bp, Artificial sequence
  Extension Primer
atcctataacatttaaaatgtctct

SEQ ID NO: 23706 - DNA, 25 bp, Artificial sequence
  Extension Primer
atgagtgggatcaaatatttgggta

SEQ ID NO: 23707 - DNA, 25 bp, Artificial sequence
  Extension Primer
gtcagtataaaggacactctgatta

SEQ ID NO: 23708 - DNA, 25 bp, Artificial sequence
  Extension Primer
arcagagaaaacagagayacaagat

SEQ ID NO: 23709 - DNA, 25 bp, Artificial sequence
  Extension Primer
tggactcacacatctttccagaaca

SEQ ID NO: 23710 - DNA, 25 bp, Artificial sequence
  Extension Primer
catcaccagaggccatggagctttc

SEQ ID NO: 23711 - DNA, 25 bp, Artificial sequence
  Extension Primer
cagaaatacaaaggattataagaga

SEQ ID NO: 23712 - DNA, 25 bp, Artificial sequence
  Extension Primer
tctgggaatttatttcttataaatt

SEQ ID NO: 23713 - DNA, 25 bp, Artificial sequence
  Extension Primer
tgggatttattccagrgatgtaaga

SEQ ID NO: 23714 - DNA, 25 bp, Artificial sequence
  Extension Primer
ggcaactggtccaaagttattcagg

SEQ ID NO: 23715 - DNA, 25 bp, Artificial sequence
  Extension Primer
tagtataaggtacgaatgtgaatat

SEQ ID NO: 23716 - DNA, 25 bp, Artificial sequence
  Extension Primer
agtacagtatctaatagccttagta

SEQ ID NO: 23717 - DNA, 25 bp, Artificial sequence
  Extension Primer
ggcactggagtagtgggattacagc

SEQ ID NO: 23718 - DNA, 25 bp, Artificial sequence
  Extension Primer
tgtttgtagtctgctcttttccaaa

SEQ ID NO: 23719 - DNA, 25 bp, Artificial sequence
  Extension Primer
ttacaatccagcaaacctgagaggc

SEQ ID NO: 23720 - DNA, 25 bp, Artificial sequence
  Extension Primer
tatcgagcctgggagatgcaactac

SEQ ID NO: 23721 - DNA, 25 bp, Artificial sequence
  Extension Primer
aatcaaaatcaggtcaagaaaacac

SEQ ID NO: 23722 - DNA, 25 bp, Artificial sequence
  Extension Primer
tccctgaggccttgggggtatagac

SEQ ID NO: 23723 - DNA, 25 bp, Artificial sequence
  Extension Primer
tcaagtacaaaagctaaacattttt

SEQ ID NO: 23724 - DNA, 25 bp, Artificial sequence
  Extension Primer
tctggcctggccagctccccaacac

SEQ ID NO: 23725 - DNA, 25 bp, Artificial sequence
  Extension Primer
cataaaattaaagacttatacttga

SEQ ID NO: 23726 - DNA, 25 bp, Artificial sequence
  Extension Primer
catctttttgtggatctctcaatat

SEQ ID NO: 23727 - DNA, 25 bp, Artificial sequence
  Extension Primer
tatcgggaactacatttccaggcaa

SEQ ID NO: 23728 - DNA, 25 bp, Artificial sequence
  Extension Primer
aaattactaccctttccattagacg

SEQ ID NO: 23729 - DNA, 25 bp, Artificial sequence
  Extension Primer
ctcaaaatatttagattatttagga

SEQ ID NO: 23730 - DNA, 25 bp, Artificial sequence
  Extension Primer
tgctaatggattctttatactgatt

SEQ ID NO: 23731 - DNA, 25 bp, Artificial sequence
  Extension Primer
tttatttttaattgraggataattg

SEQ ID NO: 23732 - DNA, 25 bp, Artificial sequence
  Extension Primer
tattgcagacccctgtttcatctga

SEQ ID NO: 23733 - DNA, 25 bp, Artificial sequence
  Extension Primer
ttgaaatatttgtagagatggagca

SEQ ID NO: 23734 - DNA, 25 bp, Artificial sequence
  Extension Primer
taggtgactcatcaggttccagtga

SEQ ID NO: 23735 - DNA, 25 bp, Artificial sequence
  Extension Primer
tggtcatctgtggcaaagatcaaat

SEQ ID NO: 23736 - DNA, 25 bp, Artificial sequence
  Extension Primer
tactgaaggtgaaaagggggttgga

SEQ ID NO: 23737 - DNA, 25 bp, Artificial sequence
  Extension Primer
ataaatgttcactgcttcagtagtt

SEQ ID NO: 23738 - DNA, 25 bp, Artificial sequence
  Extension Primer
gaacagagagaagataagaggcccc

SEQ ID NO: 23739 - DNA, 25 bp, Artificial sequence
  Extension Primer
aagggctgcctctgtcctctccaaa

SEQ ID NO: 23740 - DNA, 25 bp, Artificial sequence
  Extension Primer
ttaaaaagtagatgactgagtaagc

SEQ ID NO: 23741 - DNA, 25 bp, Artificial sequence
  Extension Primer
gtaccatgtttagaaatattgaact

SEQ ID NO: 23742 - DNA, 25 bp, Artificial sequence
  Extension Primer
ttgactctgcaaagagatgggcaca

SEQ ID NO: 23743 - DNA, 25 bp, Artificial sequence
  Extension Primer
ttttccttattagatactcacatca

SEQ ID NO: 23744 - DNA, 25 bp, Artificial sequence
  Extension Primer
ttgcaatattcaattacctgatttc

SEQ ID NO: 23745 - DNA, 25 bp, Artificial sequence
  Extension Primer
tctgctgatgtggagaaaaataggc

SEQ ID NO: 23746 - DNA, 22 bp, Artificial sequence
  Extension Primer
aaatttcttaactctttaatgg

SEQ ID NO: 23747 - DNA, 25 bp, Artificial sequence
  Extension Primer
atagacattgatcactcatcaccgt

SEQ ID NO: 23748 - DNA, 25 bp, Artificial sequence
  Extension Primer
cactcggtatccacgcgaacttggc

SEQ ID NO: 23749 - DNA, 25 bp, Artificial sequence
  Extension Primer
aacctacactggcatatttggacac

SEQ ID NO: 23750 - DNA, 25 bp, Artificial sequence
  Extension Primer
tggtgctcagaagacatcatttgat

SEQ ID NO: 23751 - DNA, 25 bp, Artificial sequence
  Extension Primer
ctcatggcgcctacagaccccaagg

SEQ ID NO: 23752 - DNA, 25 bp, Artificial sequence
  Extension Primer
ttccctctgaaacttttattccctc

SEQ ID NO: 23753 - DNA, 25 bp, Artificial sequence
  Extension Primer
ttgatgtattaaaagtaaaaacaac

SEQ ID NO: 23754 - DNA, 25 bp, Artificial sequence
  Extension Primer
taaaaccacactccttctcctgtca

SEQ ID NO: 23755 - DNA, 25 bp, Artificial sequence
  Extension Primer
tcagaagttctgctcattaggtggg

SEQ ID NO: 23756 - DNA, 25 bp, Artificial sequence
  Extension Primer
attttaccaattttaattgtagccy

SEQ ID NO: 23757 - DNA, 25 bp, Artificial sequence
  Extension Primer
aaaataatgccttttttattatgaa

SEQ ID NO: 23758 - DNA, 25 bp, Artificial sequence
  Extension Primer
gcacatatactctcccgggggcttg

SEQ ID NO: 23759 - DNA, 25 bp, Artificial sequence
  Extension Primer
gtaagattctctgctgggagcttta

SEQ ID NO: 23760 - DNA, 25 bp, Artificial sequence
  Extension Primer
catcccctgtgattttattttttta

SEQ ID NO: 23761 - DNA, 25 bp, Artificial sequence
  Extension Primer
tagcagagacagttctctcatgatg

SEQ ID NO: 23762 - DNA, 25 bp, Artificial sequence
  Extension Primer
tcttgtcatttggggctccctccca

SEQ ID NO: 23763 - DNA, 25 bp, Artificial sequence
  Extension Primer
aaccaaacctcaggcctcaaaacaa

SEQ ID NO: 23764 - DNA, 25 bp, Artificial sequence
  Extension Primer
taacaagagaggaggcatgcataag

SEQ ID NO: 23765 - DNA, 25 bp, Artificial sequence
  Extension Primer
agacctcaactcagaccacaatgtg

SEQ ID NO: 23766 - DNA, 25 bp, Artificial sequence
  Extension Primer
caggacgtctgccctaagcctcagc

SEQ ID NO: 23767 - DNA, 25 bp, Artificial sequence
  Extension Primer
agaaaccatctgcagtgatgtgaag

SEQ ID NO: 23768 - DNA, 25 bp, Artificial sequence
  Extension Primer
gatagaagtaatcggttttcctaac

SEQ ID NO: 23769 - DNA, 25 bp, Artificial sequence
  Extension Primer
atgtaaatggttgattccaaatagc

SEQ ID NO: 23770 - DNA, 25 bp, Artificial sequence
  Extension Primer
gggagagtggtggaagaggaagagt

SEQ ID NO: 23771 - DNA, 25 bp, Artificial sequence
  Extension Primer
aagtacatgatgaaatatttcagaa

SEQ ID NO: 23772 - DNA, 25 bp, Artificial sequence
  Extension Primer
gaacaattacccagtgactctttat

SEQ ID NO: 23773 - DNA, 25 bp, Artificial sequence
  Extension Primer
tgagccctctgccacactctgggat

SEQ ID NO: 23774 - DNA, 22 bp, Artificial sequence
  Extension Primer
agtgacttgctgttaactttgg

SEQ ID NO: 23775 - DNA, 25 bp, Artificial sequence
  Extension Primer
tcatacatgttagccagtggtctct

SEQ ID NO: 23776 - DNA, 25 bp, Artificial sequence
  Extension Primer
aaggaatgaacttctaaccaagact

SEQ ID NO: 23777 - DNA, 25 bp, Artificial sequence
  Extension Primer
acctagttttcaaccttttctttta

SEQ ID NO: 23778 - DNA, 25 bp, Artificial sequence
  Extension Primer
cacacacaaaaggtaaatattttgt

SEQ ID NO: 23779 - DNA, 25 bp, Artificial sequence
  Extension Primer
catcatgaacattgtaagtgcctcc

SEQ ID NO: 23780 - DNA, 25 bp, Artificial sequence
  Extension Primer
aggcgaggtggctaggacacacagc

SEQ ID NO: 23781 - DNA, 25 bp, Artificial sequence
  Extension Primer
ctttctgcctcccgtgcctatcctt

SEQ ID NO: 23782 - DNA, 25 bp, Artificial sequence
  Extension Primer
cctgttatcaaagaaccttcttcca

SEQ ID NO: 23783 - DNA, 25 bp, Artificial sequence
  Extension Primer
ggaaacaacaaggagcatgatcccc

SEQ ID NO: 23784 - DNA, 25 bp, Artificial sequence
  Extension Primer
awttttttgacgaagcttatcttaa

SEQ ID NO: 23785 - DNA, 25 bp, Artificial sequence
  Extension Primer
ctttctctctggaagctttaagttg

SEQ ID NO: 23786 - DNA, 25 bp, Artificial sequence
  Extension Primer
aactgtttttcactgatgggaacct

SEQ ID NO: 23787 - DNA, 25 bp, Artificial sequence
  Extension Primer
ayatgcagggacycatgactttact

SEQ ID NO: 23788 - DNA, 25 bp, Artificial sequence
  Extension Primer
tcccatgtagatccctttagaaacc

SEQ ID NO: 23789 - DNA, 25 bp, Artificial sequence
  Extension Primer
gttaccatactacatacaagaagat

SEQ ID NO: 23790 - DNA, 25 bp, Artificial sequence
  Extension Primer
aagcctgccgcacacaatcagcacg

SEQ ID NO: 23791 - DNA, 25 bp, Artificial sequence
  Extension Primer
ttccaaatgatcataaagttcaggc

SEQ ID NO: 23792 - DNA, 25 bp, Artificial sequence
  Extension Primer
gacctccctgtccacattcttcacc

SEQ ID NO: 23793 - DNA, 25 bp, Artificial sequence
  Extension Primer
gttaaacatgtttgtacaggaacca

SEQ ID NO: 23794 - DNA, 25 bp, Artificial sequence
  Extension Primer
tgagctgtgtgtcttggctgaagag

SEQ ID NO: 23795 - DNA, 25 bp, Artificial sequence
  Extension Primer
aaggagacacaaactctgtgtttca

SEQ ID NO: 23796 - DNA, 25 bp, Artificial sequence
  Extension Primer
aggagacacaaactctgtgtttcay

SEQ ID NO: 23797 - DNA, 25 bp, Artificial sequence
  Extension Primer
tcagtaacttgaatgcactcaggga

SEQ ID NO: 23798 - DNA, 25 bp, Artificial sequence
  Extension Primer
cttggggaatggtaagaattcagca

SEQ ID NO: 23799 - DNA, 25 bp, Artificial sequence
  Extension Primer
aggtagagggactagctggagccat

SEQ ID NO: 23800 - DNA, 25 bp, Artificial sequence
  Extension Primer
actcggagctgagcgctggtctgtc

SEQ ID NO: 23801 - DNA, 25 bp, Artificial sequence
  Extension Primer
taactcagtacatatttgtcaaaca

SEQ ID NO: 23802 - DNA, 25 bp, Artificial sequence
  Extension Primer
attaatctctgcactggaattttag

SEQ ID NO: 23803 - DNA, 25 bp, Artificial sequence
  Extension Primer
cttctccctgaagggatgaaatgtc

SEQ ID NO: 23804 - DNA, 25 bp, Artificial sequence
  Extension Primer
ctgttgccatggagatgatcacata

SEQ ID NO: 23805 - DNA, 25 bp, Artificial sequence
  Extension Primer
agcgcgcccttccgtgtctcacccc

SEQ ID NO: 23806 - DNA, 25 bp, Artificial sequence
  Extension Primer
tggttgtgcttttgtatactgtact

SEQ ID NO: 23807 - DNA, 25 bp, Artificial sequence
  Extension Primer
tgaaatctgcctgtgaccacacctt

SEQ ID NO: 23808 - DNA, 25 bp, Artificial sequence
  Extension Primer
attagratgccctttttttattctc

SEQ ID NO: 23809 - DNA, 25 bp, Artificial sequence
  Extension Primer
gctaaggaaactggagagcagaagg

SEQ ID NO: 23810 - DNA, 25 bp, Artificial sequence
  Extension Primer
ttatcctattagttgatgttgattt

SEQ ID NO: 23811 - DNA, 25 bp, Artificial sequence
  Extension Primer
tcagttatttattttaaaaaagaat

SEQ ID NO: 23812 - DNA, 25 bp, Artificial sequence
  Extension Primer
ccgtgaaaaatgtatcacccggcat

SEQ ID NO: 23813 - DNA, 25 bp, Artificial sequence
  Extension Primer
tgtaagtactggctgggatatactc

SEQ ID NO: 23814 - DNA, 25 bp, Artificial sequence
  Extension Primer
gaatggttgggcagtgagacactct

SEQ ID NO: 23815 - DNA, 25 bp, Artificial sequence
  Extension Primer
gaaggttcaggcctcaggagattag

SEQ ID NO: 23816 - DNA, 25 bp, Artificial sequence
  Extension Primer
aatctactcaaccrcccataagcag

SEQ ID NO: 23817 - DNA, 25 bp, Artificial sequence
  Extension Primer
tttgtgagcatcacacatgatctcc

SEQ ID NO: 23818 - DNA, 25 bp, Artificial sequence
  Extension Primer
tctgtttctttattttctccaaatt

SEQ ID NO: 23819 - DNA, 25 bp, Artificial sequence
  Extension Primer
ttcatcagtacagtaattttaagca

SEQ ID NO: 23820 - DNA, 25 bp, Artificial sequence
  Extension Primer
tttacttattccttttgcacaataa

SEQ ID NO: 23821 - DNA, 25 bp, Artificial sequence
  Extension Primer
cactcaggaactttaagttccaagc

SEQ ID NO: 23822 - DNA, 25 bp, Artificial sequence
  Extension Primer
cctcagcaccattaaagagaaatat

SEQ ID NO: 23823 - DNA, 25 bp, Artificial sequence
  Extension Primer
aaccttttaataaaattggttatac

SEQ ID NO: 23824 - DNA, 25 bp, Artificial sequence
  Extension Primer
tagtattaaagcagatcttgtactt

SEQ ID NO: 23825 - DNA, 25 bp, Artificial sequence
  Extension Primer
caaactaaagtgagacctgctctac

SEQ ID NO: 23826 - DNA, 25 bp, Artificial sequence
  Extension Primer
agcactttccggggctcctttgaca

SEQ ID NO: 23827 - DNA, 25 bp, Artificial sequence
  Extension Primer
tgggttctagtctcggctctgctgt

SEQ ID NO: 23828 - DNA, 25 bp, Artificial sequence
  Extension Primer
tataatttgctgaaaaatattaacc

SEQ ID NO: 23829 - DNA, 25 bp, Artificial sequence
  Extension Primer
aaaatctcgcctctgtgaaggtaag

SEQ ID NO: 23830 - DNA, 25 bp, Artificial sequence
  Extension Primer
cgtccagtcacggaagtgagttcac

SEQ ID NO: 23831 - DNA, 25 bp, Artificial sequence
  Extension Primer
acaagcccttttaaaaaataccttc

SEQ ID NO: 23832 - DNA, 25 bp, Artificial sequence
  Extension Primer
ggttactattttatttaaaggtgaa

SEQ ID NO: 23833 - DNA, 25 bp, Artificial sequence
  Extension Primer
agacagacgttgaacgagcaaggag

SEQ ID NO: 23834 - DNA, 25 bp, Artificial sequence
  Extension Primer
agggggacttactgcgacgggaact

SEQ ID NO: 23835 - DNA, 25 bp, Artificial sequence
  Extension Primer
cgggccactgcccacccatgagact

SEQ ID NO: 23836 - DNA, 25 bp, Artificial sequence
  Extension Primer
tagaaataactacaaagattactcg

SEQ ID NO: 23837 - DNA, 25 bp, Artificial sequence
  Extension Primer
aactttcatttttttctgatcaatt

SEQ ID NO: 23838 - DNA, 25 bp, Artificial sequence
  Extension Primer
tttttatgactatttcattacatta

SEQ ID NO: 23839 - DNA, 25 bp, Artificial sequence
  Extension Primer
ctcagcttttagagccatcaacatc

SEQ ID NO: 23840 - DNA, 25 bp, Artificial sequence
  Extension Primer
cccggcacagacaagcgccctgtta

SEQ ID NO: 23841 - DNA, 25 bp, Artificial sequence
  Extension Primer
ccattggatattcaatgtgaaacaa

SEQ ID NO: 23842 - DNA, 25 bp, Artificial sequence
  Extension Primer
attctggctcatggagcaggcttcc

SEQ ID NO: 23843 - DNA, 25 bp, Artificial sequence
  Extension Primer
agacctgctaaatcagaatcttcca

SEQ ID NO: 23844 - DNA, 25 bp, Artificial sequence
  Extension Primer
gttgtctcttactctgaacctcacc

SEQ ID NO: 23845 - DNA, 25 bp, Artificial sequence
  Extension Primer
ccagggaaggtaaagtttcatctaa

SEQ ID NO: 23846 - DNA, 25 bp, Artificial sequence
  Extension Primer
caacttttatttctagtcggatttc

SEQ ID NO: 23847 - DNA, 25 bp, Artificial sequence
  Extension Primer
tctccctggttgacctgttgttcag

SEQ ID NO: 23848 - DNA, 25 bp, Artificial sequence
  Extension Primer
gatacctctgtgggtgagaaagata

SEQ ID NO: 23849 - DNA, 25 bp, Artificial sequence
  Extension Primer
aaattatagatgagggagctctttg

SEQ ID NO: 23850 - DNA, 25 bp, Artificial sequence
  Extension Primer
ttaaagtttataagagatttcattt

SEQ ID NO: 23851 - DNA, 25 bp, Artificial sequence
  Extension Primer
tacttttcacattgtgtcccaaacc

SEQ ID NO: 23852 - DNA, 25 bp, Artificial sequence
  Extension Primer
acagatacttgggaagagtctatta

SEQ ID NO: 23853 - DNA, 25 bp, Artificial sequence
  Extension Primer
ttgacattccttccctgacctgccc

SEQ ID NO: 23854 - DNA, 25 bp, Artificial sequence
  Extension Primer
agtaacctgaacgctaccccaagtc

SEQ ID NO: 23855 - DNA, 25 bp, Artificial sequence
  Extension Primer
acaggcatgaaaactaaaggaaaaa

SEQ ID NO: 23856 - DNA, 25 bp, Artificial sequence
  Extension Primer
caataatggaaaggaaaaagtttta

SEQ ID NO: 23857 - DNA, 25 bp, Artificial sequence
  Extension Primer
agtcactcagttacatggattatat

SEQ ID NO: 23858 - DNA, 25 bp, Artificial sequence
  Extension Primer
acaagtggcaacaccaacaatgggc

SEQ ID NO: 23859 - DNA, 25 bp, Artificial sequence
  Extension Primer
ctctgctctggagggagatatgtct

SEQ ID NO: 23860 - DNA, 25 bp, Artificial sequence
  Extension Primer
gaggtatctgaatggccgttaattc

SEQ ID NO: 23861 - DNA, 25 bp, Artificial sequence
  Extension Primer
ttaccagggcccctgcactggactc

SEQ ID NO: 23862 - DNA, 25 bp, Artificial sequence
  Extension Primer
tgaatcagaaagccgtggaaagcaa

SEQ ID NO: 23863 - DNA, 25 bp, Artificial sequence
  Extension Primer
ctgctctaataatggataagcttcg

SEQ ID NO: 23864 - DNA, 25 bp, Artificial sequence
  Extension Primer
taaaatgtatattttctcagagtca

SEQ ID NO: 23865 - DNA, 25 bp, Artificial sequence
  Extension Primer
tgaggggaatgcatatttccggaag

SEQ ID NO: 23866 - DNA, 25 bp, Artificial sequence
  Extension Primer
ttaacttgtatagaatcacactaag

SEQ ID NO: 23867 - DNA, 25 bp, Artificial sequence
  Extension Primer
aggagtcagttaagaagaatcatgt

SEQ ID NO: 23868 - DNA, 25 bp, Artificial sequence
  Extension Primer
gtgtccctttgagcagcaagtatta

SEQ ID NO: 23869 - DNA, 22 bp, Artificial sequence
  Extension Primer
aacacggttccccccacattcc

SEQ ID NO: 23870 - DNA, 25 bp, Artificial sequence
  Extension Primer
tattggctcagttagtaaagaatct

SEQ ID NO: 23871 - DNA, 25 bp, Artificial sequence
  Extension Primer
cattaaactttggtcatttttctta

SEQ ID NO: 23872 - DNA, 25 bp, Artificial sequence
  Extension Primer
gaatagtctgatatgtccttaagag

SEQ ID NO: 23873 - DNA, 25 bp, Artificial sequence
  Extension Primer
ctgaatgaactgtagtatgtgtctc

SEQ ID NO: 23874 - DNA, 25 bp, Artificial sequence
  Extension Primer
atggagatcttacatttatagtgga

SEQ ID NO: 23875 - DNA, 25 bp, Artificial sequence
  Extension Primer
cccatccctggagcattgctggccc

SEQ ID NO: 23876 - DNA, 25 bp, Artificial sequence
  Extension Primer
ttttgacttttagagccaatgaagc

SEQ ID NO: 23877 - DNA, 25 bp, Artificial sequence
  Extension Primer
taattcttcataaccattctcctca

SEQ ID NO: 23878 - DNA, 25 bp, Artificial sequence
  Extension Primer
catatcacactcccaggctgatttt

SEQ ID NO: 23879 - DNA, 25 bp, Artificial sequence
  Extension Primer
tttcatctcatttctmaacttttca

SEQ ID NO: 23880 - DNA, 25 bp, Artificial sequence
  Extension Primer
tttatatagagaaatttgccatttg

SEQ ID NO: 23881 - DNA, 25 bp, Artificial sequence
  Extension Primer
atctggaggactgtagttgaaaact

SEQ ID NO: 23882 - DNA, 25 bp, Artificial sequence
  Extension Primer
aggacacaygccaaaggccaggacc

SEQ ID NO: 23883 - DNA, 25 bp, Artificial sequence
  Extension Primer
aataacttaaaaatagtctaaaccc

SEQ ID NO: 23884 - DNA, 25 bp, Artificial sequence
  Extension Primer
ctgttcagataaggaaggctaaaga

SEQ ID NO: 23885 - DNA, 25 bp, Artificial sequence
  Extension Primer
agtattaagtttttgggrggaacac

SEQ ID NO: 23886 - DNA, 25 bp, Artificial sequence
  Extension Primer
aagaatataacaagagtatggaaac

SEQ ID NO: 23887 - DNA, 25 bp, Artificial sequence
  Extension Primer
cagttgttacctcagaggttcctac

SEQ ID NO: 23888 - DNA, 25 bp, Artificial sequence
  Extension Primer
tacgtagtgacttgttttttcaagg

SEQ ID NO: 23889 - DNA, 22 bp, Artificial sequence
  Extension Primer
caacatattcagatttgctcca

SEQ ID NO: 23890 - DNA, 25 bp, Artificial sequence
  Extension Primer
agagtgtctcttcatctggaaggaa

SEQ ID NO: 23891 - DNA, 25 bp, Artificial sequence
  Extension Primer
tgaggagcctctgatgtgatctaag

SEQ ID NO: 23892 - DNA, 25 bp, Artificial sequence
  Extension Primer
ggaaaattccagtacaactggcaca

SEQ ID NO: 23893 - DNA, 25 bp, Artificial sequence
  Extension Primer
ccactatactttattctcagtgcca

SEQ ID NO: 23894 - DNA, 25 bp, Artificial sequence
  Extension Primer
aaggtttggcttgactctaccatac

SEQ ID NO: 23895 - DNA, 25 bp, Artificial sequence
  Extension Primer
cacactgcctgggcagtagtcagta

SEQ ID NO: 23896 - DNA, 25 bp, Artificial sequence
  Extension Primer
aaatgattgattgatgaagcagggg

SEQ ID NO: 23897 - DNA, 25 bp, Artificial sequence
  Extension Primer
cttgcaatttaagtgtttccaaggt

SEQ ID NO: 23898 - DNA, 25 bp, Artificial sequence
  Extension Primer
aaagagttactaggagatgagtgcc

SEQ ID NO: 23899 - DNA, 25 bp, Artificial sequence
  Extension Primer
agggacagggaggcctagtgtgctg

SEQ ID NO: 23900 - DNA, 25 bp, Artificial sequence
  Extension Primer
ctggatgtatgggtttaagagagac

SEQ ID NO: 23901 - DNA, 25 bp, Artificial sequence
  Extension Primer
aaagtaattatccctcaaggaaaca

SEQ ID NO: 23902 - DNA, 25 bp, Artificial sequence
  Extension Primer
tccaagcaaggtaaaggccactgcc

SEQ ID NO: 23903 - DNA, 25 bp, Artificial sequence
  Extension Primer
tgtaatacacatttcattttttatt

SEQ ID NO: 23904 - DNA, 25 bp, Artificial sequence
  Extension Primer
taaaatgtcttattttcttttgtcg

SEQ ID NO: 23905 - DNA, 25 bp, Artificial sequence
  Extension Primer
tgcctttatttagcataagataaca

SEQ ID NO: 23906 - DNA, 25 bp, Artificial sequence
  Extension Primer
ccctgggtcccatgctgcccacatg

SEQ ID NO: 23907 - DNA, 25 bp, Artificial sequence
  Extension Primer
aatcataaattaacttagtgcagtg

SEQ ID NO: 23908 - DNA, 25 bp, Artificial sequence
  Extension Primer
gatacccatcccagctgataaccag

SEQ ID NO: 23909 - DNA, 25 bp, Artificial sequence
  Extension Primer
aacccaatgacatgggttctactct

SEQ ID NO: 23910 - DNA, 25 bp, Artificial sequence
  Extension Primer
acaagtctgattccagtaaacagta

SEQ ID NO: 23911 - DNA, 25 bp, Artificial sequence
  Extension Primer
tgcactgtggtttgacgttcctaag

SEQ ID NO: 23912 - DNA, 25 bp, Artificial sequence
  Extension Primer
tacaaacctgattctgtataaacca

SEQ ID NO: 23913 - DNA, 25 bp, Artificial sequence
  Extension Primer
gtaggtctagctcacagagttgact

SEQ ID NO: 23914 - DNA, 25 bp, Artificial sequence
  Extension Primer
tgaatacgtaatagagttgagacta

SEQ ID NO: 23915 - DNA, 25 bp, Artificial sequence
  Extension Primer
agtctataattctcctacatgaggg

SEQ ID NO: 23916 - DNA, 25 bp, Artificial sequence
  Extension Primer
tgtgtggcagtctgttgccatggaa

SEQ ID NO: 23917 - DNA, 25 bp, Artificial sequence
  Extension Primer
tggatgtgtgaggggattagaaaca

SEQ ID NO: 23918 - DNA, 25 bp, Artificial sequence
  Extension Primer
agagaaaataaatatcagtgattga

SEQ ID NO: 23919 - DNA, 25 bp, Artificial sequence
  Extension Primer
ttaatttatcctaccttaattattt

SEQ ID NO: 23920 - DNA, 25 bp, Artificial sequence
  Extension Primer
aacttctgctgcagattgtgggaca

SEQ ID NO: 23921 - DNA, 25 bp, Artificial sequence
  Extension Primer
tctggtgaaagaatcaaatgaatgc

SEQ ID NO: 23922 - DNA, 25 bp, Artificial sequence
  Extension Primer
aaagattgtgttttttaaaaactat

SEQ ID NO: 23923 - DNA, 25 bp, Artificial sequence
  Extension Primer
acttttcatttgttaggtatttctg

SEQ ID NO: 23924 - DNA, 25 bp, Artificial sequence
  Extension Primer
ctgctatagctaattttgttgctgt

SEQ ID NO: 23925 - DNA, 25 bp, Artificial sequence
  Extension Primer
cctgtggctaagagacacttgacca

SEQ ID NO: 23926 - DNA, 25 bp, Artificial sequence
  Extension Primer
agcgttgtgcaaccaccacctctat

SEQ ID NO: 23927 - DNA, 25 bp, Artificial sequence
  Extension Primer
gtagctagtgggggaggagagaatc

SEQ ID NO: 23928 - DNA, 25 bp, Artificial sequence
  Extension Primer
acacccaatcgggtataagtgtagg

SEQ ID NO: 23929 - DNA, 25 bp, Artificial sequence
  Extension Primer
gcctgggtcttatctccttccctcc

SEQ ID NO: 23930 - DNA, 25 bp, Artificial sequence
  Extension Primer
agggccctttgaaagtagcagcaat

SEQ ID NO: 23931 - DNA, 25 bp, Artificial sequence
  Extension Primer
aacaatatgaaaaattaatagatgg

SEQ ID NO: 23932 - DNA, 25 bp, Artificial sequence
  Extension Primer
ttttaagctcgtacagtttttgcac

SEQ ID NO: 23933 - DNA, 25 bp, Artificial sequence
  Extension Primer
ttgtttcaaaattggaatagaggga

SEQ ID NO: 23934 - DNA, 22 bp, Artificial sequence
  Extension Primer
ttgaagatagtcacctccaaaa

SEQ ID NO: 23935 - DNA, 25 bp, Artificial sequence
  Extension Primer
atgtctacaggtaataaatctgtgt

SEQ ID NO: 23936 - DNA, 25 bp, Artificial sequence
  Extension Primer
tgttagactttgtgtttcttgccca

SEQ ID NO: 23937 - DNA, 25 bp, Artificial sequence
  Extension Primer
ctaaggttgcaaatacttggccact

SEQ ID NO: 23938 - DNA, 25 bp, Artificial sequence
  Extension Primer
cattagtgaaagagggactggaggc

SEQ ID NO: 23939 - DNA, 25 bp, Artificial sequence
  Extension Primer
ttagcctgcaaaattgattccaaca

SEQ ID NO: 23940 - DNA, 25 bp, Artificial sequence
  Extension Primer
gctggaaatcagctatctgctctaa

SEQ ID NO: 23941 - DNA, 25 bp, Artificial sequence
  Extension Primer
ggatctttgtgtgtgtgcatcccta

SEQ ID NO: 23942 - DNA, 25 bp, Artificial sequence
  Extension Primer
acagaagccgaaagcctgattatgg

SEQ ID NO: 23943 - DNA, 25 bp, Artificial sequence
  Extension Primer
aattaaacaacatacttttcaacaa

SEQ ID NO: 23944 - DNA, 25 bp, Artificial sequence
  Extension Primer
aaaggtggaggattatgctgtttta

SEQ ID NO: 23945 - DNA, 25 bp, Artificial sequence
  Extension Primer
aaacattatccctgttttaggcatc

SEQ ID NO: 23946 - DNA, 25 bp, Artificial sequence
  Extension Primer
aatacagacttagtatgataaggtc

SEQ ID NO: 23947 - DNA, 25 bp, Artificial sequence
  Extension Primer
agatcttatgggaaccatgaaaaat

SEQ ID NO: 23948 - DNA, 25 bp, Artificial sequence
  Extension Primer
atagtgttaaatagatttaaaaaaa

SEQ ID NO: 23949 - DNA, 25 bp, Artificial sequence
  Extension Primer
cgcctcgtccccaaatcacccctgc

SEQ ID NO: 23950 - DNA, 25 bp, Artificial sequence
  Extension Primer
gtgagtggggtttggggaagggggt

SEQ ID NO: 23951 - DNA, 25 bp, Artificial sequence
  Extension Primer
gaatccagatagtctcagacatgaa

SEQ ID NO: 23952 - DNA, 25 bp, Artificial sequence
  Extension Primer
acttcaacaaggtcatgagtgaatg

SEQ ID NO: 23953 - DNA, 22 bp, Artificial sequence
  Extension Primer
acagagccatgttggatttatt

SEQ ID NO: 23954 - DNA, 25 bp, Artificial sequence
  Extension Primer
tcatactggtaccccctagggtata

SEQ ID NO: 23955 - DNA, 25 bp, Artificial sequence
  Extension Primer
aaaagtgtaattaatgctagtagga

SEQ ID NO: 23956 - DNA, 25 bp, Artificial sequence
  Extension Primer
gttatacctccaaaacacaccctga

SEQ ID NO: 23957 - DNA, 25 bp, Artificial sequence
  Extension Primer
aaagaaactgtggtacatatgtatg

SEQ ID NO: 23958 - DNA, 25 bp, Artificial sequence
  Extension Primer
agactttcttttcagagtcaggcag

SEQ ID NO: 23959 - DNA, 25 bp, Artificial sequence
  Extension Primer
aaggacaaatgtatcaaatttcata

SEQ ID NO: 23960 - DNA, 25 bp, Artificial sequence
  Extension Primer
tataaacaccaaatatttgctctta

SEQ ID NO: 23961 - DNA, 25 bp, Artificial sequence
  Extension Primer
accttactgtcaatcatcccagagc

SEQ ID NO: 23962 - DNA, 25 bp, Artificial sequence
  Extension Primer
taaaatctcagacagttgggaagaa

SEQ ID NO: 23963 - DNA, 25 bp, Artificial sequence
  Extension Primer
atattcaacttttaattcctgctct

SEQ ID NO: 23964 - DNA, 25 bp, Artificial sequence
  Extension Primer
cccttgcgttctgtctcttcaaatt

SEQ ID NO: 23965 - DNA, 25 bp, Artificial sequence
  Extension Primer
tggtgacaaggtaatgacccgattt

SEQ ID NO: 23966 - DNA, 25 bp, Artificial sequence
  Extension Primer
tatatgagtaataagagcacttaaa

SEQ ID NO: 23967 - DNA, 25 bp, Artificial sequence
  Extension Primer
ccagttgttattacaaatgatgcta

SEQ ID NO: 23968 - DNA, 25 bp, Artificial sequence
  Extension Primer
gcttgctagatggtggatccaaatc

SEQ ID NO: 23969 - DNA, 25 bp, Artificial sequence
  Extension Primer
tcatgataaattttctggttaatct

SEQ ID NO: 23970 - DNA, 25 bp, Artificial sequence
  Extension Primer
cagtcttagcctcagtgatggacag

SEQ ID NO: 23971 - DNA, 25 bp, Artificial sequence
  Extension Primer
tcactcagcacctatggtgactacc

SEQ ID NO: 23972 - DNA, 25 bp, Artificial sequence
  Extension Primer
aacccaagctagctatttcctatcc

SEQ ID NO: 23973 - DNA, 25 bp, Artificial sequence
  Extension Primer
cccgtctaccctgggaagcccaggt

SEQ ID NO: 23974 - DNA, 25 bp, Artificial sequence
  Extension Primer
agagttttattcttaatttcctagc

SEQ ID NO: 23975 - DNA, 25 bp, Artificial sequence
  Extension Primer
tagcatattattggaaattttccct

SEQ ID NO: 23976 - DNA, 25 bp, Artificial sequence
  Extension Primer
agagatgactgagcatgtacccaaa

SEQ ID NO: 23977 - DNA, 25 bp, Artificial sequence
  Extension Primer
gcaggcataataatatttctggtaa

SEQ ID NO: 23978 - DNA, 25 bp, Artificial sequence
  Extension Primer
tacttctttggaaagcccatgtttt

SEQ ID NO: 23979 - DNA, 25 bp, Artificial sequence
  Extension Primer
agaggacacggctttaaggaaaaca

SEQ ID NO: 23980 - DNA, 25 bp, Artificial sequence
  Extension Primer
atatataacccgggcgactcctctg

SEQ ID NO: 23981 - DNA, 25 bp, Artificial sequence
  Extension Primer
tttccttctttttttaaggttgaat

SEQ ID NO: 23982 - DNA, 25 bp, Artificial sequence
  Extension Primer
ataaagagagaacacccatacaatc

SEQ ID NO: 23983 - DNA, 25 bp, Artificial sequence
  Extension Primer
aagaaaccatggtgattgtcctaaa

SEQ ID NO: 23984 - DNA, 25 bp, Artificial sequence
  Extension Primer
gtgaaagaaaggtttgtaccttctc

SEQ ID NO: 23985 - DNA, 25 bp, Artificial sequence
  Extension Primer
tacagagaactgtttgactctgggc

SEQ ID NO: 23986 - DNA, 25 bp, Artificial sequence
  Extension Primer
tgaaggaaaagaaaaagcatcacca

SEQ ID NO: 23987 - DNA, 25 bp, Artificial sequence
  Extension Primer
tttaagcactattaatagagcacta

SEQ ID NO: 23988 - DNA, 25 bp, Artificial sequence
  Extension Primer
tatagtctgttatgtctgagaaata

SEQ ID NO: 23989 - DNA, 25 bp, Artificial sequence
  Extension Primer
cttggccttgttgacaaagtgcccc

SEQ ID NO: 23990 - DNA, 25 bp, Artificial sequence
  Extension Primer
gcctgcccagattgggggagaggaa

SEQ ID NO: 23991 - DNA, 25 bp, Artificial sequence
  Extension Primer
gaagctaatcaagagttttcctaag

SEQ ID NO: 23992 - DNA, 25 bp, Artificial sequence
  Extension Primer
tagtcctcaagcctctgtttacagg

SEQ ID NO: 23993 - DNA, 25 bp, Artificial sequence
  Extension Primer
atgctatttggtactttttgattca

SEQ ID NO: 23994 - DNA, 22 bp, Artificial sequence
  Extension Primer
tgctcttttaccaggcctccca

SEQ ID NO: 23995 - DNA, 25 bp, Artificial sequence
  Extension Primer
aagaaggtggtggagaagctgtgag

SEQ ID NO: 23996 - DNA, 25 bp, Artificial sequence
  Extension Primer
tgatgtgcaaaaggcaaataaatgc

SEQ ID NO: 23997 - DNA, 25 bp, Artificial sequence
  Extension Primer
gaatctgaggtacctgagagacact

SEQ ID NO: 23998 - DNA, 25 bp, Artificial sequence
  Extension Primer
ccatccccctcaacaccctacctac

SEQ ID NO: 23999 - DNA, 25 bp, Artificial sequence
  Extension Primer
aggatgctgcaggcagagggaacag

SEQ ID NO: 24000 - DNA, 25 bp, Artificial sequence
  Extension Primer
acctgcaacctgcgctgcggtgatg

SEQ ID NO: 24001 - DNA, 25 bp, Artificial sequence
  Extension Primer
catgattctagaaacaaataatatc

SEQ ID NO: 24002 - DNA, 25 bp, Artificial sequence
  Extension Primer
caaatattataactattgggaaaat

SEQ ID NO: 24003 - DNA, 25 bp, Artificial sequence
  Extension Primer
tatagaaatttgttttgagtggcta

SEQ ID NO: 24004 - DNA, 25 bp, Artificial sequence
  Extension Primer
agaaactgaggcttccctgggactt

SEQ ID NO: 24005 - DNA, 25 bp, Artificial sequence
  Extension Primer
ccagctgagaactattccgatatta

SEQ ID NO: 24006 - DNA, 25 bp, Artificial sequence
  Extension Primer
aatattctgtctgtcagacaccatg

SEQ ID NO: 24007 - DNA, 25 bp, Artificial sequence
  Extension Primer
acaatgaaccacagctgtaacttca

SEQ ID NO: 24008 - DNA, 25 bp, Artificial sequence
  Extension Primer
agtacagtattacctatgtaagttg

SEQ ID NO: 24009 - DNA, 25 bp, Artificial sequence
  Extension Primer
atgcttagaatcaggaggaatttag

SEQ ID NO: 24010 - DNA, 25 bp, Artificial sequence
  Extension Primer
attttatcaatccccactgtgctta

SEQ ID NO: 24011 - DNA, 25 bp, Artificial sequence
  Extension Primer
caaaataggtgattttgtcatagtt

SEQ ID NO: 24012 - DNA, 25 bp, Artificial sequence
  Extension Primer
tgccctgaacaggatcccgggatag

SEQ ID NO: 24013 - DNA, 25 bp, Artificial sequence
  Extension Primer
cggctgcctttctccagccctgctc

SEQ ID NO: 24014 - DNA, 25 bp, Artificial sequence
  Extension Primer
gatttttaatacaaaaaaatatccc

SEQ ID NO: 24015 - DNA, 25 bp, Artificial sequence
  Extension Primer
cttttttctgcatatgaatcctcca

SEQ ID NO: 24016 - DNA, 25 bp, Artificial sequence
  Extension Primer
gaccaacaattaaggagaaaagtag

SEQ ID NO: 24017 - DNA, 25 bp, Artificial sequence
  Extension Primer
tttgtaactgctaagtcacttcagt

SEQ ID NO: 24018 - DNA, 25 bp, Artificial sequence
  Extension Primer
atattaaaaattaaaaatggtaaaa

SEQ ID NO: 24019 - DNA, 25 bp, Artificial sequence
  Extension Primer
cttggagatataaaatatggagaaa

SEQ ID NO: 24020 - DNA, 25 bp, Artificial sequence
  Extension Primer
atggccatttatatatggttacact

SEQ ID NO: 24021 - DNA, 25 bp, Artificial sequence
  Extension Primer
aatcaagttgggaattgtatggaaa

SEQ ID NO: 24022 - DNA, 25 bp, Artificial sequence
  Extension Primer
gcctgagacaatggagaaatacctg

SEQ ID NO: 24023 - DNA, 25 bp, Artificial sequence
  Extension Primer
atttgctttatatcctagtcattct

SEQ ID NO: 24024 - DNA, 25 bp, Artificial sequence
  Extension Primer
aaatccatattttcccctgctcctc

SEQ ID NO: 24025 - DNA, 25 bp, Artificial sequence
  Extension Primer
taaatactctggtcattaaaatgct

SEQ ID NO: 24026 - DNA, 25 bp, Artificial sequence
  Extension Primer
cagtgagattctgtggtatttaagt

SEQ ID NO: 24027 - DNA, 25 bp, Artificial sequence
  Extension Primer
aatctatagcaacctctttcattgt

SEQ ID NO: 24028 - DNA, 25 bp, Artificial sequence
  Extension Primer
gtggagatggttcccatatcaggat

SEQ ID NO: 24029 - DNA, 25 bp, Artificial sequence
  Extension Primer
aagggccattaatccatttactgct

SEQ ID NO: 24030 - DNA, 25 bp, Artificial sequence
  Extension Primer
gacaattagatgaaatttggaaaaa

SEQ ID NO: 24031 - DNA, 25 bp, Artificial sequence
  Extension Primer
gtgcaacttggatgtaagatgtgga

SEQ ID NO: 24032 - DNA, 25 bp, Artificial sequence
  Extension Primer
atcagatggaattcaggtgcaggat

SEQ ID NO: 24033 - DNA, 25 bp, Artificial sequence
  Extension Primer
agtgtaaggctgggcagaggttttt

SEQ ID NO: 24034 - DNA, 25 bp, Artificial sequence
  Extension Primer
cacatagacacacacaactttacat

SEQ ID NO: 24035 - DNA, 25 bp, Artificial sequence
  Extension Primer
atgcartgtgtccattcctattggt

SEQ ID NO: 24036 - DNA, 25 bp, Artificial sequence
  Extension Primer
ggtcactttcaatgtttgcttcctt

SEQ ID NO: 24037 - DNA, 25 bp, Artificial sequence
  Extension Primer
taacaaccacagtcatactgctcac

SEQ ID NO: 24038 - DNA, 25 bp, Artificial sequence
  Extension Primer
tctccctcattctttgcccatactc

SEQ ID NO: 24039 - DNA, 25 bp, Artificial sequence
  Extension Primer
aaagtggtgagagtattagaacaat

SEQ ID NO: 24040 - DNA, 25 bp, Artificial sequence
  Extension Primer
ttcaaatcctttccttacctaagat

SEQ ID NO: 24041 - DNA, 25 bp, Artificial sequence
  Extension Primer
tattttacccatctaacaaaatctc

SEQ ID NO: 24042 - DNA, 25 bp, Artificial sequence
  Extension Primer
ttttatataatgaatgaaagaaacc

SEQ ID NO: 24043 - DNA, 25 bp, Artificial sequence
  Extension Primer
tctaagcagactgtttctgggtgcc

SEQ ID NO: 24044 - DNA, 25 bp, Artificial sequence
  Extension Primer
attagtgttactcatgtgaagactt

SEQ ID NO: 24045 - DNA, 25 bp, Artificial sequence
  Extension Primer
crtctcaaaagctccagttgaaaac

SEQ ID NO: 24046 - DNA, 25 bp, Artificial sequence
  Extension Primer
catgttattccatttattgggtcta

SEQ ID NO: 24047 - DNA, 25 bp, Artificial sequence
  Extension Primer
cagatctgccagcccctcttttacc

SEQ ID NO: 24048 - DNA, 25 bp, Artificial sequence
  Extension Primer
ttaggtaatttcatattaagtgaat

SEQ ID NO: 24049 - DNA, 25 bp, Artificial sequence
  Extension Primer
acccaaacctaactttccacaatca

SEQ ID NO: 24050 - DNA, 25 bp, Artificial sequence
  Extension Primer
attgtctaaggacagtcatttgctc

SEQ ID NO: 24051 - DNA, 25 bp, Artificial sequence
  Extension Primer
gtggtgggctgccgtctatggggtc

SEQ ID NO: 24052 - DNA, 25 bp, Artificial sequence
  Extension Primer
ggcctccccaagacttgcatggtga

SEQ ID NO: 24053 - DNA, 25 bp, Artificial sequence
  Extension Primer
cccatttctgccccacctgccttgc

SEQ ID NO: 24054 - DNA, 25 bp, Artificial sequence
  Extension Primer
acgtcttgagacactgttaaaagca

SEQ ID NO: 24055 - DNA, 25 bp, Artificial sequence
  Extension Primer
aaagacaccatacaagtttatagaa

SEQ ID NO: 24056 - DNA, 25 bp, Artificial sequence
  Extension Primer
attcgtgctgaagttatgaggggtg

SEQ ID NO: 24057 - DNA, 25 bp, Artificial sequence
  Extension Primer
gttttcagatggattaaaaataaca

SEQ ID NO: 24058 - DNA, 25 bp, Artificial sequence
  Extension Primer
ggagggttacaggtgaggatgtatt

SEQ ID NO: 24059 - DNA, 25 bp, Artificial sequence
  Extension Primer
gttgccttctacctaaatggataca

SEQ ID NO: 24060 - DNA, 25 bp, Artificial sequence
  Extension Primer
aagacttactaaaaaatatatacaa

SEQ ID NO: 24061 - DNA, 25 bp, Artificial sequence
  Extension Primer
ttacttaataaaagcctagggaagt

SEQ ID NO: 24062 - DNA, 25 bp, Artificial sequence
  Extension Primer
ctcacgaccctgtgggagctgaaac

SEQ ID NO: 24063 - DNA, 25 bp, Artificial sequence
  Extension Primer
aagctattggtgcaatgaacactac

SEQ ID NO: 24064 - DNA, 25 bp, Artificial sequence
  Extension Primer
atcaagttcatagcatgttgaaatg

SEQ ID NO: 24065 - DNA, 25 bp, Artificial sequence
  Extension Primer
gtgcatactaggatttaagagtgtc

SEQ ID NO: 24066 - DNA, 25 bp, Artificial sequence
  Extension Primer
taggaagagggctgcattgattaca

SEQ ID NO: 24067 - DNA, 25 bp, Artificial sequence
  Extension Primer
gtgaaaggtcacatcgtctgcctaa

SEQ ID NO: 24068 - DNA, 25 bp, Artificial sequence
  Extension Primer
ttcataaacatataaattaggcaaa

SEQ ID NO: 24069 - DNA, 25 bp, Artificial sequence
  Extension Primer
tctaaaaaataaattcatgacacag

SEQ ID NO: 24070 - DNA, 25 bp, Artificial sequence
  Extension Primer
gttttctttatatagtatgttatga

SEQ ID NO: 24071 - DNA, 25 bp, Artificial sequence
  Extension Primer
ctggtaggtcagagtactgactaca

SEQ ID NO: 24072 - DNA, 25 bp, Artificial sequence
  Extension Primer
tatagtatattgtaaacatttcacc

SEQ ID NO: 24073 - DNA, 25 bp, Artificial sequence
  Extension Primer
gttaatccccatcaataataaaaaa

SEQ ID NO: 24074 - DNA, 25 bp, Artificial sequence
  Extension Primer
agctggccgtgaccacaatgaggtt

SEQ ID NO: 24075 - DNA, 25 bp, Artificial sequence
  Extension Primer
agaagtttaagagtgcataaaacat

SEQ ID NO: 24076 - DNA, 25 bp, Artificial sequence
  Extension Primer
ggggcaaagttctcagcccacggaa

SEQ ID NO: 24077 - DNA, 25 bp, Artificial sequence
  Extension Primer
aaagagcaattttgataagaagtga

SEQ ID NO: 24078 - DNA, 25 bp, Artificial sequence
  Extension Primer
gttaatttaaaaagttggtatgtca

SEQ ID NO: 24079 - DNA, 25 bp, Artificial sequence
  Extension Primer
aaaaattagaatttgcggcttgaaa

SEQ ID NO: 24080 - DNA, 25 bp, Artificial sequence
  Extension Primer
atgtcatatttcaacaggatagctc

SEQ ID NO: 24081 - DNA, 25 bp, Artificial sequence
  Extension Primer
ttctagcactggctattgtatttgt

SEQ ID NO: 24082 - DNA, 25 bp, Artificial sequence
  Extension Primer
cctggggaaggaaggaaggatgtga

SEQ ID NO: 24083 - DNA, 25 bp, Artificial sequence
  Extension Primer
atctacatctcaacttcttgaatca

SEQ ID NO: 24084 - DNA, 25 bp, Artificial sequence
  Extension Primer
taggttatttagagacgatttcctt

SEQ ID NO: 24085 - DNA, 25 bp, Artificial sequence
  Extension Primer
tcaaattctatgtagtcaatataat

SEQ ID NO: 24086 - DNA, 25 bp, Artificial sequence
  Extension Primer
agtttaagtttgaatgttaagtaaa

SEQ ID NO: 24087 - DNA, 25 bp, Artificial sequence
  Extension Primer
aaatactgagactgttaggttccca

SEQ ID NO: 24088 - DNA, 25 bp, Artificial sequence
  Extension Primer
tctgaattctacttgctttccaggg

SEQ ID NO: 24089 - DNA, 25 bp, Artificial sequence
  Extension Primer
attcaagtaaacagcagcaacacac

SEQ ID NO: 24090 - DNA, 25 bp, Artificial sequence
  Extension Primer
gtgtttcacttttcagtgaatgtca

SEQ ID NO: 24091 - DNA, 25 bp, Artificial sequence
  Extension Primer
ataaaagtacgcattttggcccata

SEQ ID NO: 24092 - DNA, 25 bp, Artificial sequence
  Extension Primer
gcatttaatcctcagaacaacctac

SEQ ID NO: 24093 - DNA, 25 bp, Artificial sequence
  Extension Primer
cagttgcctctctgctgtgtgtgca

SEQ ID NO: 24094 - DNA, 25 bp, Artificial sequence
  Extension Primer
ggactgaggtctaaaagatgaggtc

SEQ ID NO: 24095 - DNA, 25 bp, Artificial sequence
  Extension Primer
atgttgggggcttttgtgcaattat

SEQ ID NO: 24096 - DNA, 25 bp, Artificial sequence
  Extension Primer
acaggcacagcaacacatcagacac

SEQ ID NO: 24097 - DNA, 25 bp, Artificial sequence
  Extension Primer
gctggaggaaaatcataaagcagag

SEQ ID NO: 24098 - DNA, 25 bp, Artificial sequence
  Extension Primer
gtcaggacttgagcaggcttgtctg

SEQ ID NO: 24099 - DNA, 25 bp, Artificial sequence
  Extension Primer
cgtcattaaccctgactcagccatc

SEQ ID NO: 24100 - DNA, 25 bp, Artificial sequence
  Extension Primer
ctttctacaactatcctatttatac

SEQ ID NO: 24101 - DNA, 25 bp, Artificial sequence
  Extension Primer
aatttatttctaacaacaaagggtg

SEQ ID NO: 24102 - DNA, 25 bp, Artificial sequence
  Extension Primer
cttctaacaagaagcagaatctgaa

SEQ ID NO: 24103 - DNA, 25 bp, Artificial sequence
  Extension Primer
ggacctggttgtttgagcaagtaca

SEQ ID NO: 24104 - DNA, 25 bp, Artificial sequence
  Extension Primer
cctttcatgagagatagttttcctc

SEQ ID NO: 24105 - DNA, 25 bp, Artificial sequence
  Extension Primer
gtggtcatttaagaatagacaaagg

SEQ ID NO: 24106 - DNA, 25 bp, Artificial sequence
  Extension Primer
gggaacatcaccaaatgtgttgtca

SEQ ID NO: 24107 - DNA, 25 bp, Artificial sequence
  Extension Primer
tttttgtagccaacagttccgagat

SEQ ID NO: 24108 - DNA, 25 bp, Artificial sequence
  Extension Primer
attcagaaaggaggaacctgaagca

SEQ ID NO: 24109 - DNA, 25 bp, Artificial sequence
  Extension Primer
ctatggcttcatttgctttcaggat

SEQ ID NO: 24110 - DNA, 25 bp, Artificial sequence
  Extension Primer
catgagtttaattgaatgggctatt

SEQ ID NO: 24111 - DNA, 25 bp, Artificial sequence
  Extension Primer
agatagtraggaaaaatttctacac

SEQ ID NO: 24112 - DNA, 25 bp, Artificial sequence
  Extension Primer
cccaggactacacacaggtaactcc

SEQ ID NO: 24113 - DNA, 25 bp, Artificial sequence
  Extension Primer
tgaaacaattaccaagtaaaactta

SEQ ID NO: 24114 - DNA, 25 bp, Artificial sequence
  Extension Primer
tgagcacaaagcatgattttgggga

SEQ ID NO: 24115 - DNA, 25 bp, Artificial sequence
  Extension Primer
aatagagtgaacagatgcagctctg

SEQ ID NO: 24116 - DNA, 25 bp, Artificial sequence
  Extension Primer
ccaaggcaatgtaacatattttagg

SEQ ID NO: 24117 - DNA, 25 bp, Artificial sequence
  Extension Primer
acttctagttagcatattcagtgtc

SEQ ID NO: 24118 - DNA, 25 bp, Artificial sequence
  Extension Primer
atatggtgagaaacactggggattt

SEQ ID NO: 24119 - DNA, 25 bp, Artificial sequence
  Extension Primer
aatcttgaggctttatttcagagtt

SEQ ID NO: 24120 - DNA, 25 bp, Artificial sequence
  Extension Primer
aacattgtttccttcactcctcact

SEQ ID NO: 24121 - DNA, 25 bp, Artificial sequence
  Extension Primer
tccatgtgtttatcaaagatcatcc

SEQ ID NO: 24122 - DNA, 25 bp, Artificial sequence
  Extension Primer
tcaggacctgtttgctgggcaggaa

SEQ ID NO: 24123 - DNA, 22 bp, Artificial sequence
  Extension Primer
aattcagcagggcattttttca

SEQ ID NO: 24124 - DNA, 25 bp, Artificial sequence
  Extension Primer
ccccaacgagctcctcggtgccccc

SEQ ID NO: 24125 - DNA, 25 bp, Artificial sequence
  Extension Primer
atgaatatagggttcccaaatgaag

SEQ ID NO: 24126 - DNA, 25 bp, Artificial sequence
  Extension Primer
attgtaccccagtgtgggaaggata

SEQ ID NO: 24127 - DNA, 22 bp, Artificial sequence
  Extension Primer
agacactattaagatatcattt

SEQ ID NO: 24128 - DNA, 25 bp, Artificial sequence
  Extension Primer
aagctccaggtttcagtcccaatcc

SEQ ID NO: 24129 - DNA, 25 bp, Artificial sequence
  Extension Primer
ctgtgttttcctatagtaagcaagc

SEQ ID NO: 24130 - DNA, 25 bp, Artificial sequence
  Extension Primer
tcccatctctcttctccattttcta

SEQ ID NO: 24131 - DNA, 25 bp, Artificial sequence
  Extension Primer
tgtttctcactggtaagtaaaagaa

SEQ ID NO: 24132 - DNA, 25 bp, Artificial sequence
  Extension Primer
cctggaccatctccagcacacttta

SEQ ID NO: 24133 - DNA, 25 bp, Artificial sequence
  Extension Primer
ttttgaattctacctttcccatctg

SEQ ID NO: 24134 - DNA, 25 bp, Artificial sequence
  Extension Primer
ttgttacagtaagagtgaagccaac

SEQ ID NO: 24135 - DNA, 25 bp, Artificial sequence
  Extension Primer
cctgcaccttatcccaattaaccac

SEQ ID NO: 24136 - DNA, 25 bp, Artificial sequence
  Extension Primer
tttatagaaagagcccagggctcct

SEQ ID NO: 24137 - DNA, 25 bp, Artificial sequence
  Extension Primer
gcatgaagctcttcttgaaaaggta

SEQ ID NO: 24138 - DNA, 25 bp, Artificial sequence
  Extension Primer
ctgctctgaataactgagaagttgc

SEQ ID NO: 24139 - DNA, 25 bp, Artificial sequence
  Extension Primer
tcttttccaagaagcacaacagagc

SEQ ID NO: 24140 - DNA, 25 bp, Artificial sequence
  Extension Primer
tggaggacgatcctgaagatctgac

SEQ ID NO: 24141 - DNA, 25 bp, Artificial sequence
  Extension Primer
gagattcagctctagctactaatcc

SEQ ID NO: 24142 - DNA, 25 bp, Artificial sequence
  Extension Primer
aatactggggagaagatgaaggttt

SEQ ID NO: 24143 - DNA, 25 bp, Artificial sequence
  Extension Primer
aaattgtgggggatatcaggaatgc

SEQ ID NO: 24144 - DNA, 25 bp, Artificial sequence
  Extension Primer
gaagacttaggcttaaaggctattc

SEQ ID NO: 24145 - DNA, 25 bp, Artificial sequence
  Extension Primer
caacacagtaggaacgtcatctctt

SEQ ID NO: 24146 - DNA, 25 bp, Artificial sequence
  Extension Primer
tagattcatataatatacgtttctt

SEQ ID NO: 24147 - DNA, 25 bp, Artificial sequence
  Extension Primer
ccctgaagacagcaaggactatatt

SEQ ID NO: 24148 - DNA, 25 bp, Artificial sequence
  Extension Primer
tctcccgacttgtccctgccatcat

SEQ ID NO: 24149 - DNA, 25 bp, Artificial sequence
  Extension Primer
cagaatttacaagtttaggaaaaat

SEQ ID NO: 24150 - DNA, 25 bp, Artificial sequence
  Extension Primer
catgtgaatcagaagtttcaaaatg

SEQ ID NO: 24151 - DNA, 25 bp, Artificial sequence
  Extension Primer
ggtttttttgatgcgtttacacagt

SEQ ID NO: 24152 - DNA, 25 bp, Artificial sequence
  Extension Primer
ttacggaacatccgttcagtcacta

SEQ ID NO: 24153 - DNA, 25 bp, Artificial sequence
  Extension Primer
gaacacagaactattttcttacata

SEQ ID NO: 24154 - DNA, 25 bp, Artificial sequence
  Extension Primer
cagtgggggaatctctgctgggatg

SEQ ID NO: 24155 - DNA, 25 bp, Artificial sequence
  Extension Primer
gtcccctggagaggagtgctgactt

SEQ ID NO: 24156 - DNA, 25 bp, Artificial sequence
  Extension Primer
ttatgtttttagtcctgttataaag

SEQ ID NO: 24157 - DNA, 25 bp, Artificial sequence
  Extension Primer
ttaacactgcagaaattcacatccc

SEQ ID NO: 24158 - DNA, 25 bp, Artificial sequence
  Extension Primer
atgtgctttaaatttagtttgatta

SEQ ID NO: 24159 - DNA, 25 bp, Artificial sequence
  Extension Primer
atgactcacactggatcaataatcc

SEQ ID NO: 24160 - DNA, 25 bp, Artificial sequence
  Extension Primer
gccattgtgtgcatatcccgagact

SEQ ID NO: 24161 - DNA, 25 bp, Artificial sequence
  Extension Primer
accctgccgcatgtcctgcccctcc

SEQ ID NO: 24162 - DNA, 25 bp, Artificial sequence
  Extension Primer
tataacacattaaaattattattta

SEQ ID NO: 24163 - DNA, 25 bp, Artificial sequence
  Extension Primer
gaaagttctagtttctctacaacct

SEQ ID NO: 24164 - DNA, 22 bp, Artificial sequence
  Extension Primer
aagaaggctggaattcatttgg

SEQ ID NO: 24165 - DNA, 25 bp, Artificial sequence
  Extension Primer
catttgaataaaccccttgttatct

SEQ ID NO: 24166 - DNA, 25 bp, Artificial sequence
  Extension Primer
gctgtggctacccactaacttctgc

SEQ ID NO: 24167 - DNA, 25 bp, Artificial sequence
  Extension Primer
cataaataaactccagtagaatcta

SEQ ID NO: 24168 - DNA, 25 bp, Artificial sequence
  Extension Primer
ctcatcctcatgttcaacattaaag

SEQ ID NO: 24169 - DNA, 25 bp, Artificial sequence
  Extension Primer
ccccggccaatgctggttctggtag

SEQ ID NO: 24170 - DNA, 25 bp, Artificial sequence
  Extension Primer
atttagataatgtttagattttctc

SEQ ID NO: 24171 - DNA, 25 bp, Artificial sequence
  Extension Primer
gctgctcaagggccctcagtcatgt

SEQ ID NO: 24172 - DNA, 25 bp, Artificial sequence
  Extension Primer
aggtaaaaccaatgtataggaacaa

SEQ ID NO: 24173 - DNA, 25 bp, Artificial sequence
  Extension Primer
ttaggtaagccctaaaagctaactt

SEQ ID NO: 24174 - DNA, 25 bp, Artificial sequence
  Extension Primer
ggatcatcagtccttccatgtttta

SEQ ID NO: 24175 - DNA, 25 bp, Artificial sequence
  Extension Primer
gaggggaggtaagcagaggccgatc

SEQ ID NO: 24176 - DNA, 25 bp, Artificial sequence
  Extension Primer
tgttgaggtcaataagctcttgcca

SEQ ID NO: 24177 - DNA, 25 bp, Artificial sequence
  Extension Primer
gtctaacagtacttagattatacaa

SEQ ID NO: 24178 - DNA, 25 bp, Artificial sequence
  Extension Primer
attacctaatgtaattaaaggcata

SEQ ID NO: 24179 - DNA, 25 bp, Artificial sequence
  Extension Primer
tttttaaggtaagtatgtggtgtta

SEQ ID NO: 24180 - DNA, 25 bp, Artificial sequence
  Extension Primer
tagttagatcttcagtggtctccaa

SEQ ID NO: 24181 - DNA, 25 bp, Artificial sequence
  Extension Primer
cctccctttcaaaatagtgtgtgaa

SEQ ID NO: 24182 - DNA, 25 bp, Artificial sequence
  Extension Primer
cgtcgaagcgcttgcgggtgtggtc

SEQ ID NO: 24183 - DNA, 25 bp, Artificial sequence
  Extension Primer
tttgatgctgtggcttgaacccagg

SEQ ID NO: 24184 - DNA, 22 bp, Artificial sequence
  Extension Primer
ccctatacatatgtcaggtggc

SEQ ID NO: 24185 - DNA, 25 bp, Artificial sequence
  Extension Primer
gccctaaataaactaaggttttcca

SEQ ID NO: 24186 - DNA, 25 bp, Artificial sequence
  Extension Primer
cccgctctgagtgatgcgaagcccc

SEQ ID NO: 24187 - DNA, 25 bp, Artificial sequence
  Extension Primer
gaaatgacacccatcagtatgaacc

SEQ ID NO: 24188 - DNA, 25 bp, Artificial sequence
  Extension Primer
gccccagctccagcctacccagtcc

SEQ ID NO: 24189 - DNA, 25 bp, Artificial sequence
  Extension Primer
gaaacgaatgagaaatgactgagaa

SEQ ID NO: 24190 - DNA, 25 bp, Artificial sequence
  Extension Primer
agctggtagtccttctagggagcgt

SEQ ID NO: 24191 - DNA, 25 bp, Artificial sequence
  Extension Primer
aggggagaacccgggcgttggtctc

SEQ ID NO: 24192 - DNA, 25 bp, Artificial sequence
  Extension Primer
cttgcccaactccaggagtgaggga

SEQ ID NO: 24193 - DNA, 25 bp, Artificial sequence
  Extension Primer
cttgagaagagtgatatcttgagac

SEQ ID NO: 24194 - DNA, 25 bp, Artificial sequence
  Extension Primer
ctttcatttgattatatttacatag

SEQ ID NO: 24195 - DNA, 25 bp, Artificial sequence
  Extension Primer
ggctccagccaatctgaatccacac

SEQ ID NO: 24196 - DNA, 25 bp, Artificial sequence
  Extension Primer
tctgtatcactgcactacaatgaag

SEQ ID NO: 24197 - DNA, 25 bp, Artificial sequence
  Extension Primer
ataacacagtcacataaaataagta

SEQ ID NO: 24198 - DNA, 25 bp, Artificial sequence
  Extension Primer
ttaaaatatcccaagggggtactaa

SEQ ID NO: 24199 - DNA, 25 bp, Artificial sequence
  Extension Primer
gttttaaaagtcagaaatcacatat

SEQ ID NO: 24200 - DNA, 25 bp, Artificial sequence
  Extension Primer
cctttgttcatcatagtcctcaatt

SEQ ID NO: 24201 - DNA, 25 bp, Artificial sequence
  Extension Primer
gctgtcaaatattcaaatgatgccc

SEQ ID NO: 24202 - DNA, 25 bp, Artificial sequence
  Extension Primer
ttagatttccttcccacttaggtca

SEQ ID NO: 24203 - DNA, 25 bp, Artificial sequence
  Extension Primer
ttcctgatctcggaggacatgtagt

SEQ ID NO: 24204 - DNA, 25 bp, Artificial sequence
  Extension Primer
aatacctagaccagtacaggcaacc

SEQ ID NO: 24205 - DNA, 25 bp, Artificial sequence
  Extension Primer
gtcctgtgcagggatttctgtgccc

SEQ ID NO: 24206 - DNA, 25 bp, Artificial sequence
  Extension Primer
aatcaactttggagtcctgagtaaa

SEQ ID NO: 24207 - DNA, 25 bp, Artificial sequence
  Extension Primer
tctagtctgtaggacaggatgctga

SEQ ID NO: 24208 - DNA, 25 bp, Artificial sequence
  Extension Primer
aaataattggttttggtttagggaa

SEQ ID NO: 24209 - DNA, 25 bp, Artificial sequence
  Extension Primer
cagaggcaggggatctggtttcaag

SEQ ID NO: 24210 - DNA, 25 bp, Artificial sequence
  Extension Primer
gtttttcctctaaaacattgttgta

SEQ ID NO: 24211 - DNA, 25 bp, Artificial sequence
  Extension Primer
tcctactttcattcattcagggttg

SEQ ID NO: 24212 - DNA, 25 bp, Artificial sequence
  Extension Primer
atggacacatcctttaaaaagggga

SEQ ID NO: 24213 - DNA, 25 bp, Artificial sequence
  Extension Primer
gatgaagccatcctagagatgacct

SEQ ID NO: 24214 - DNA, 25 bp, Artificial sequence
  Extension Primer
tttaaagaaagtggtaagtataata

SEQ ID NO: 24215 - DNA, 25 bp, Artificial sequence
  Extension Primer
ttttgttcacctattatagcaactt

SEQ ID NO: 24216 - DNA, 25 bp, Artificial sequence
  Extension Primer
cccagtctgtttatgtttgtggtat

SEQ ID NO: 24217 - DNA, 25 bp, Artificial sequence
  Extension Primer
aaggccagttcagtggtgttcaaca

SEQ ID NO: 24218 - DNA, 25 bp, Artificial sequence
  Extension Primer
caagagttggcgttaattaacagtt

SEQ ID NO: 24219 - DNA, 25 bp, Artificial sequence
  Extension Primer
gcatgacctgaaagttgtcaaattc

SEQ ID NO: 24220 - DNA, 25 bp, Artificial sequence
  Extension Primer
acagtcctcattggaatatactttc

SEQ ID NO: 24221 - DNA, 25 bp, Artificial sequence
  Extension Primer
tgtgtagccatgagtaagctcttcc

SEQ ID NO: 24222 - DNA, 25 bp, Artificial sequence
  Extension Primer
tgaatatacctacagtctttgttct

SEQ ID NO: 24223 - DNA, 25 bp, Artificial sequence
  Extension Primer
aacaccataacaaaaatatggatgc

SEQ ID NO: 24224 - DNA, 25 bp, Artificial sequence
  Extension Primer
cttcctcagcagccatacagcccaa

SEQ ID NO: 24225 - DNA, 25 bp, Artificial sequence
  Extension Primer
ataagacacgatctctgtcgttacg

SEQ ID NO: 24226 - DNA, 25 bp, Artificial sequence
  Extension Primer
catgatcactagcgcagaatatgag

SEQ ID NO: 24227 - DNA, 25 bp, Artificial sequence
  Extension Primer
agtgatgcttaatcttaatttttaa

SEQ ID NO: 24228 - DNA, 25 bp, Artificial sequence
  Extension Primer
actccgaggctctgtatgtgtgtac

SEQ ID NO: 24229 - DNA, 25 bp, Artificial sequence
  Extension Primer
ctctggctatggagacgtgtgctga

SEQ ID NO: 24230 - DNA, 25 bp, Artificial sequence
  Extension Primer
ttcaatatagtgcatacttaataac

SEQ ID NO: 24231 - DNA, 25 bp, Artificial sequence
  Extension Primer
gtttgtgcttgctttatttgtagtg

SEQ ID NO: 24232 - DNA, 25 bp, Artificial sequence
  Extension Primer
ctagcaatgtatccttgtgccaaca

SEQ ID NO: 24233 - DNA, 25 bp, Artificial sequence
  Extension Primer
cctttcttaactggagctcctcata

SEQ ID NO: 24234 - DNA, 25 bp, Artificial sequence
  Extension Primer
acgaaggtacagaggagctacagga

SEQ ID NO: 24235 - DNA, 25 bp, Artificial sequence
  Extension Primer
aaaactaaaactccaacatttgtaa

SEQ ID NO: 24236 - DNA, 25 bp, Artificial sequence
  Extension Primer
agttttaatgagaattaaaaaaaaa

SEQ ID NO: 24237 - DNA, 25 bp, Artificial sequence
  Extension Primer
tccagatctaacagctgcactttgt

SEQ ID NO: 24238 - DNA, 25 bp, Artificial sequence
  Extension Primer
tgrtttgtttaatgtctgccccctt

SEQ ID NO: 24239 - DNA, 25 bp, Artificial sequence
  Extension Primer
tctgacttctttgaaaagagctccc

SEQ ID NO: 24240 - DNA, 25 bp, Artificial sequence
  Extension Primer
gtgtgcagttttggctgcatgtcct

SEQ ID NO: 24241 - DNA, 25 bp, Artificial sequence
  Extension Primer
tttgctgtgatacccccaaactcac

SEQ ID NO: 24242 - DNA, 25 bp, Artificial sequence
  Extension Primer
tccaggaagtcaagagtaaagatac

SEQ ID NO: 24243 - DNA, 25 bp, Artificial sequence
  Extension Primer
atctaactatcattctgtcactttt

SEQ ID NO: 24244 - DNA, 25 bp, Artificial sequence
  Extension Primer
tggaaacattgatcttggtttgtcg

SEQ ID NO: 24245 - DNA, 25 bp, Artificial sequence
  Extension Primer
tctacgaattttggattaactgcca

SEQ ID NO: 24246 - DNA, 25 bp, Artificial sequence
  Extension Primer
aatattcatttgttctgaaaattat

SEQ ID NO: 24247 - DNA, 25 bp, Artificial sequence
  Extension Primer
cctgacacgtggaatgtgctcagaa

SEQ ID NO: 24248 - DNA, 25 bp, Artificial sequence
  Extension Primer
cttgaacccttgagtggagcagtaa

SEQ ID NO: 24249 - DNA, 25 bp, Artificial sequence
  Extension Primer
atcagagtaaaggaagaaatataga

SEQ ID NO: 24250 - DNA, 25 bp, Artificial sequence
  Extension Primer
gctaatggcaagatccacagcagca

SEQ ID NO: 24251 - DNA, 25 bp, Artificial sequence
  Extension Primer
ggaatctgtagattactttggctgg

SEQ ID NO: 24252 - DNA, 25 bp, Artificial sequence
  Extension Primer
tttcttgcttttcacaactttgcat

SEQ ID NO: 24253 - DNA, 25 bp, Artificial sequence
  Extension Primer
tgctacttttaaaaattcaacgaaa

SEQ ID NO: 24254 - DNA, 25 bp, Artificial sequence
  Extension Primer
gccggtggcctgagccgagtatgtc

SEQ ID NO: 24255 - DNA, 25 bp, Artificial sequence
  Extension Primer
ccctgagctctgttttcttacttgt

SEQ ID NO: 24256 - DNA, 25 bp, Artificial sequence
  Extension Primer
tacccagaagtgaaattgctggatc

SEQ ID NO: 24257 - DNA, 25 bp, Artificial sequence
  Extension Primer
tttactgtgaggmaacaacctataa

SEQ ID NO: 24258 - DNA, 25 bp, Artificial sequence
  Extension Primer
aagagttccagtgagaagcttagca

SEQ ID NO: 24259 - DNA, 25 bp, Artificial sequence
  Extension Primer
ggataagccatggaggctggcactg

SEQ ID NO: 24260 - DNA, 25 bp, Artificial sequence
  Extension Primer
ggtgagygcggagttcctggtctgg

SEQ ID NO: 24261 - DNA, 25 bp, Artificial sequence
  Extension Primer
ttcatctcgcacgcatgctgggggg

SEQ ID NO: 24262 - DNA, 25 bp, Artificial sequence
  Extension Primer
gagttcgtgcgtcctctgctgggtc

SEQ ID NO: 24263 - DNA, 25 bp, Artificial sequence
  Extension Primer
cattaactgaaacattgaagaagcc

SEQ ID NO: 24264 - DNA, 25 bp, Artificial sequence
  Extension Primer
agtctctttcacatggttccttcct

SEQ ID NO: 24265 - DNA, 25 bp, Artificial sequence
  Extension Primer
tacaagtcctttctggaagtgatta

SEQ ID NO: 24266 - DNA, 25 bp, Artificial sequence
  Extension Primer
attggggctacaaaaatgaatttac

SEQ ID NO: 24267 - DNA, 25 bp, Artificial sequence
  Extension Primer
tgacagccttaatgagtcatttaga

SEQ ID NO: 24268 - DNA, 25 bp, Artificial sequence
  Extension Primer
tgtttagaatgcctctaagttaaaa

SEQ ID NO: 24269 - DNA, 25 bp, Artificial sequence
  Extension Primer
atgtgtggatacatgtgcatttctt

SEQ ID NO: 24270 - DNA, 25 bp, Artificial sequence
  Extension Primer
acattagtgaggaatagaataaaat

SEQ ID NO: 24271 - DNA, 25 bp, Artificial sequence
  Extension Primer
ctaaactgcaagatttgaaatctgg

SEQ ID NO: 24272 - DNA, 25 bp, Artificial sequence
  Extension Primer
tgtccttaaatcacagtttcttcat

SEQ ID NO: 24273 - DNA, 25 bp, Artificial sequence
  Extension Primer
agaggctaagagtatttaagaaaga

SEQ ID NO: 24274 - DNA, 25 bp, Artificial sequence
  Extension Primer
gtgatttaatgaacaaagaatatgc

SEQ ID NO: 24275 - DNA, 25 bp, Artificial sequence
  Extension Primer
ttttacctggatctatttttccgta

SEQ ID NO: 24276 - DNA, 25 bp, Artificial sequence
  Extension Primer
ggctgtatcaggaagcagaaagtga

SEQ ID NO: 24277 - DNA, 25 bp, Artificial sequence
  Extension Primer
tttgctaagtaaataagtgtcaaga

SEQ ID NO: 24278 - DNA, 25 bp, Artificial sequence
  Extension Primer
catcttacctaatcactgattctgg

SEQ ID NO: 24279 - DNA, 25 bp, Artificial sequence
  Extension Primer
catttgttcaatgcatcaagctttc

SEQ ID NO: 24280 - DNA, 25 bp, Artificial sequence
  Extension Primer
aatggcctgccagctgttcacagaa

SEQ ID NO: 24281 - DNA, 25 bp, Artificial sequence
  Extension Primer
gatcacatccctttgaagtgggatc

SEQ ID NO: 24282 - DNA, 25 bp, Artificial sequence
  Extension Primer
acagggggtggtctcaccgtagtag

SEQ ID NO: 24283 - DNA, 25 bp, Artificial sequence
  Extension Primer
aatgacttggacagttaattaaaac

SEQ ID NO: 24284 - DNA, 25 bp, Artificial sequence
  Extension Primer
ccttcacacggagtatgtcctttcg

SEQ ID NO: 24285 - DNA, 25 bp, Artificial sequence
  Extension Primer
ggcactgtcacagttgcttggtttt

SEQ ID NO: 24286 - DNA, 25 bp, Artificial sequence
  Extension Primer
atttgtatagtttttttctcacttt

SEQ ID NO: 24287 - DNA, 25 bp, Artificial sequence
  Extension Primer
gggaaccactaaagtccatttttgg

SEQ ID NO: 24288 - DNA, 25 bp, Artificial sequence
  Extension Primer
actgtcaattgtatcccctccagta

SEQ ID NO: 24289 - DNA, 25 bp, Artificial sequence
  Extension Primer
atcctcttgtgaaatggaggcaggt

SEQ ID NO: 24290 - DNA, 25 bp, Artificial sequence
  Extension Primer
aatctgagggtggaaacaggcacaa

SEQ ID NO: 24291 - DNA, 25 bp, Artificial sequence
  Extension Primer
attgtctagaaactcctagatgctc

SEQ ID NO: 24292 - DNA, 25 bp, Artificial sequence
  Extension Primer
gtgtgtggtgaggtgtgtgttattc

SEQ ID NO: 24293 - DNA, 25 bp, Artificial sequence
  Extension Primer
aaaacatgacatgagtgatgtatat

SEQ ID NO: 24294 - DNA, 25 bp, Artificial sequence
  Extension Primer
ttccccggtggtccagtggctaaga

SEQ ID NO: 24295 - DNA, 25 bp, Artificial sequence
  Extension Primer
tgtggtgacatcattatctagtgtt

SEQ ID NO: 24296 - DNA, 25 bp, Artificial sequence
  Extension Primer
attgtgttttctgcatggaatggac

SEQ ID NO: 24297 - DNA, 25 bp, Artificial sequence
  Extension Primer
tgcctagtaaacccccatgtaccaa

SEQ ID NO: 24298 - DNA, 25 bp, Artificial sequence
  Extension Primer
aaaagctgcctcagttcccagtatg

SEQ ID NO: 24299 - DNA, 25 bp, Artificial sequence
  Extension Primer
acaaaaggctttgaaggagattcta

SEQ ID NO: 24300 - DNA, 25 bp, Artificial sequence
  Extension Primer
ttcccatgtcttggctatttgaata

SEQ ID NO: 24301 - DNA, 25 bp, Artificial sequence
  Extension Primer
aatctttttgcaatttatactaaga

SEQ ID NO: 24302 - DNA, 25 bp, Artificial sequence
  Extension Primer
tgctaagctctggttttaaagactg

SEQ ID NO: 24303 - DNA, 25 bp, Artificial sequence
  Extension Primer
gaaagtttaaaatcaaggtctggca

SEQ ID NO: 24304 - DNA, 25 bp, Artificial sequence
  Extension Primer
amgtttctccacttctctgcgtttt

SEQ ID NO: 24305 - DNA, 25 bp, Artificial sequence
  Extension Primer
atgatcatctatataataataaata

SEQ ID NO: 24306 - DNA, 25 bp, Artificial sequence
  Extension Primer
aataatctctgatgtggggcaggag

SEQ ID NO: 24307 - DNA, 25 bp, Artificial sequence
  Extension Primer
ctctgatgtggggcaggagrggcca

SEQ ID NO: 24308 - DNA, 25 bp, Artificial sequence
  Extension Primer
aaggaatacctgcctcctcccactc

SEQ ID NO: 24309 - DNA, 25 bp, Artificial sequence
  Extension Primer
ttcccagtgagttggttccctcttt

SEQ ID NO: 24310 - DNA, 25 bp, Artificial sequence
  Extension Primer
attgtagagatactttcatttttgc

SEQ ID NO: 24311 - DNA, 25 bp, Artificial sequence
  Extension Primer
ggaaacaacaatgaatctgcttcag

SEQ ID NO: 24312 - DNA, 25 bp, Artificial sequence
  Extension Primer
ttacattgttggatcataaattata

SEQ ID NO: 24313 - DNA, 25 bp, Artificial sequence
  Extension Primer
atattattgcagtcttagccctttt

SEQ ID NO: 24314 - DNA, 25 bp, Artificial sequence
  Extension Primer
ctttttttaaaaaagtactacagta

SEQ ID NO: 24315 - DNA, 25 bp, Artificial sequence
  Extension Primer
gattcagggctcagggatctctgtt

SEQ ID NO: 24316 - DNA, 25 bp, Artificial sequence
  Extension Primer
ctgtccattgtctgatcctcggctt

SEQ ID NO: 24317 - DNA, 25 bp, Artificial sequence
  Extension Primer
gatcatttgtaatgatgtagaataa

SEQ ID NO: 24318 - DNA, 25 bp, Artificial sequence
  Extension Primer
tgaatttgcttatgactatgatgtt

SEQ ID NO: 24319 - DNA, 25 bp, Artificial sequence
  Extension Primer
tctctggaatttgcaaaataaccaa

SEQ ID NO: 24320 - DNA, 25 bp, Artificial sequence
  Extension Primer
tatgtttatagcagtgacatcctac

SEQ ID NO: 24321 - DNA, 25 bp, Artificial sequence
  Extension Primer
aaaaatctggcacccagtagtccaa

SEQ ID NO: 24322 - DNA, 25 bp, Artificial sequence
  Extension Primer
tctagcccaaggacagtacataagt

SEQ ID NO: 24323 - DNA, 25 bp, Artificial sequence
  Extension Primer
agaggggagtgcacaagcagacaaa

SEQ ID NO: 24324 - DNA, 25 bp, Artificial sequence
  Extension Primer
ccagacctcttctttaacacacctt

SEQ ID NO: 24325 - DNA, 25 bp, Artificial sequence
  Extension Primer
gttctgaagtggagagatgaccttt

SEQ ID NO: 24326 - DNA, 25 bp, Artificial sequence
  Extension Primer
ttgatcagttcaatgaatacagtta

SEQ ID NO: 24327 - DNA, 25 bp, Artificial sequence
  Extension Primer
ggagctgagtgtgccaggagaaaga

SEQ ID NO: 24328 - DNA, 25 bp, Artificial sequence
  Extension Primer
gaacaatgttcatcttcctattgat

SEQ ID NO: 24329 - DNA, 25 bp, Artificial sequence
  Extension Primer
tttataacaaagcaagtgtggggaa

SEQ ID NO: 24330 - DNA, 25 bp, Artificial sequence
  Extension Primer
aaaacaaaattcacaagatagagac

SEQ ID NO: 24331 - DNA, 25 bp, Artificial sequence
  Extension Primer
acttaaaaattaaggttaaagaaaa

SEQ ID NO: 24332 - DNA, 25 bp, Artificial sequence
  Extension Primer
aaagtctcttcattgctgtgctttg

SEQ ID NO: 24333 - DNA, 25 bp, Artificial sequence
  Extension Primer
acttcttgatctttgtccttccact

SEQ ID NO: 24334 - DNA, 25 bp, Artificial sequence
  Extension Primer
ctacaaatgtcccagaagaagcaga

SEQ ID NO: 24335 - DNA, 25 bp, Artificial sequence
  Extension Primer
atatgaaacatgacaactgaatttt

SEQ ID NO: 24336 - DNA, 25 bp, Artificial sequence
  Extension Primer
cttagctacggatcccccaaaactt

SEQ ID NO: 24337 - DNA, 25 bp, Artificial sequence
  Extension Primer
aatgacatatttggagttagttact

SEQ ID NO: 24338 - DNA, 25 bp, Artificial sequence
  Extension Primer
tccagcttctcctttctataatatc

SEQ ID NO: 24339 - DNA, 25 bp, Artificial sequence
  Extension Primer
cacttgctacattaagttcattagg

SEQ ID NO: 24340 - DNA, 25 bp, Artificial sequence
  Extension Primer
tcaggggacctgctgataagcctct

SEQ ID NO: 24341 - DNA, 25 bp, Artificial sequence
  Extension Primer
aactgaaaacgcccaccttctccat

SEQ ID NO: 24342 - DNA, 25 bp, Artificial sequence
  Extension Primer
aatagctttcaaatgaaatccaaac

SEQ ID NO: 24343 - DNA, 25 bp, Artificial sequence
  Extension Primer
tatcaggccggtccctgtcctccta

SEQ ID NO: 24344 - DNA, 25 bp, Artificial sequence
  Extension Primer
tccttgctgagtaaggcaaaggagt

SEQ ID NO: 24345 - DNA, 25 bp, Artificial sequence
  Extension Primer
agctgatgaacttctctgtgattaa

SEQ ID NO: 24346 - DNA, 25 bp, Artificial sequence
  Extension Primer
gaaatgtggctcttgggaagctatt

SEQ ID NO: 24347 - DNA, 25 bp, Artificial sequence
  Extension Primer
tcatatggtttgcaaatattttctt

SEQ ID NO: 24348 - DNA, 25 bp, Artificial sequence
  Extension Primer
tttatccatccattttcccgagttc

SEQ ID NO: 24349 - DNA, 25 bp, Artificial sequence
  Extension Primer
cttagctgtgaatggtaaatgagtt

SEQ ID NO: 24350 - DNA, 25 bp, Artificial sequence
  Extension Primer
gactcaggttcactttctttctcaa

SEQ ID NO: 24351 - DNA, 25 bp, Artificial sequence
  Extension Primer
cctgtagttagttgagaagctgatg

SEQ ID NO: 24352 - DNA, 25 bp, Artificial sequence
  Extension Primer
tgatacacatctgggttgttcctac

SEQ ID NO: 24353 - DNA, 25 bp, Artificial sequence
  Extension Primer
aaacaatttaaactctttacaatat

SEQ ID NO: 24354 - DNA, 25 bp, Artificial sequence
  Extension Primer
ttctattagcatgtccaccatgaat

SEQ ID NO: 24355 - DNA, 25 bp, Artificial sequence
  Extension Primer
ggcccgtctaggtttaataacaagt

SEQ ID NO: 24356 - DNA, 25 bp, Artificial sequence
  Extension Primer
tgagagcactgggagaaaagaatgc

SEQ ID NO: 24357 - DNA, 22 bp, Artificial sequence
  Extension Primer
cagccctaatgtccttagttcc

SEQ ID NO: 24358 - DNA, 25 bp, Artificial sequence
  Extension Primer
acatctcggtccaatgtctacagta

SEQ ID NO: 24359 - DNA, 25 bp, Artificial sequence
  Extension Primer
gtgaaagtcttctacagtgttgtat

SEQ ID NO: 24360 - DNA, 25 bp, Artificial sequence
  Extension Primer
acctccttactagattgccrgaaag

SEQ ID NO: 24361 - DNA, 25 bp, Artificial sequence
  Extension Primer
aaccttagaagtctgagagaaagac

SEQ ID NO: 24362 - DNA, 25 bp, Artificial sequence
  Extension Primer
gcaagaactaacctgcttcccagtg

SEQ ID NO: 24363 - DNA, 25 bp, Artificial sequence
  Extension Primer
atcagaacatcttgcttgaagttcc

SEQ ID NO: 24364 - DNA, 25 bp, Artificial sequence
  Extension Primer
tgtctccacaggcaatgtgaaatgg

SEQ ID NO: 24365 - DNA, 25 bp, Artificial sequence
  Extension Primer
cagatgaatatggaatgccttcaac

SEQ ID NO: 24366 - DNA, 25 bp, Artificial sequence
  Extension Primer
aaatgcctttataataatagaaata

SEQ ID NO: 24367 - DNA, 25 bp, Artificial sequence
  Extension Primer
ccccaggctcctgaactccatccac

SEQ ID NO: 24368 - DNA, 25 bp, Artificial sequence
  Extension Primer
ggttaaaaagcaataaaagtgttag

SEQ ID NO: 24369 - DNA, 25 bp, Artificial sequence
  Extension Primer
gttaatttcagctgaacgctgttag

SEQ ID NO: 24370 - DNA, 25 bp, Artificial sequence
  Extension Primer
tcttgcatatttcttctgtccactc

SEQ ID NO: 24371 - DNA, 25 bp, Artificial sequence
  Extension Primer
atgttccctttgtcatgcctgtctc

SEQ ID NO: 24372 - DNA, 25 bp, Artificial sequence
  Extension Primer
agaaaacaagttagagacggaaaac

SEQ ID NO: 24373 - DNA, 25 bp, Artificial sequence
  Extension Primer
actaacttctcygagatctttccca

SEQ ID NO: 24374 - DNA, 25 bp, Artificial sequence
  Extension Primer
taccaactcttcttctaaactatac

SEQ ID NO: 24375 - DNA, 25 bp, Artificial sequence
  Extension Primer
agggaggagagaacgctgcatcaga

SEQ ID NO: 24376 - DNA, 25 bp, Artificial sequence
  Extension Primer
attgacaattactgtggttcaacct

SEQ ID NO: 24377 - DNA, 25 bp, Artificial sequence
  Extension Primer
tttccaaggtgtgagttcttgatac

SEQ ID NO: 24378 - DNA, 25 bp, Artificial sequence
  Extension Primer
caggaggagagatgattgggtattt

SEQ ID NO: 24379 - DNA, 25 bp, Artificial sequence
  Extension Primer
cttcatctcctgcatcttgtgcatt

SEQ ID NO: 24380 - DNA, 25 bp, Artificial sequence
  Extension Primer
gtccgtcatgggtaatgacttttag

SEQ ID NO: 24381 - DNA, 25 bp, Artificial sequence
  Extension Primer
aaagtgatagtgatggaggttcaaa

SEQ ID NO: 24382 - DNA, 25 bp, Artificial sequence
  Extension Primer
tgtcagtatggtacaatttatatct

SEQ ID NO: 24383 - DNA, 25 bp, Artificial sequence
  Extension Primer
gtaggagatggctgcattttaacct

SEQ ID NO: 24384 - DNA, 25 bp, Artificial sequence
  Extension Primer
gtattgtaacttagagaccaaggca

SEQ ID NO: 24385 - DNA, 25 bp, Artificial sequence
  Extension Primer
ccccatcaatattaaattgaaatgt

SEQ ID NO: 24386 - DNA, 25 bp, Artificial sequence
  Extension Primer
aacatgagggttttgcagtgtgctt

SEQ ID NO: 24387 - DNA, 25 bp, Artificial sequence
  Extension Primer
tttcactggaaaagttggttaggag

SEQ ID NO: 24388 - DNA, 25 bp, Artificial sequence
  Extension Primer
aggcgtgatcaccacatcgtcatct

SEQ ID NO: 24389 - DNA, 25 bp, Artificial sequence
  Extension Primer
ccaccgtaaatcaagttctacccag

SEQ ID NO: 24390 - DNA, 25 bp, Artificial sequence
  Extension Primer
caattgctgaagagtcctctagaag

SEQ ID NO: 24391 - DNA, 25 bp, Artificial sequence
  Extension Primer
gttacatgttattaaggatcacaac

SEQ ID NO: 24392 - DNA, 25 bp, Artificial sequence
  Extension Primer
aagatctctaccaagcctcctagaa

SEQ ID NO: 24393 - DNA, 25 bp, Artificial sequence
  Extension Primer
tactaagaaaattcgatttcgttga

SEQ ID NO: 24394 - DNA, 25 bp, Artificial sequence
  Extension Primer
ccctctgccccctacagtatctctt

SEQ ID NO: 24395 - DNA, 25 bp, Artificial sequence
  Extension Primer
ctaactttgtattctgggggaaaag

SEQ ID NO: 24396 - DNA, 25 bp, Artificial sequence
  Extension Primer
tcagaaaaacaagttggaagctaca

SEQ ID NO: 24397 - DNA, 25 bp, Artificial sequence
  Extension Primer
ttgtcaatcctaatgacccattgct

SEQ ID NO: 24398 - DNA, 25 bp, Artificial sequence
  Extension Primer
ggtgatgtttgttcttagcactggc

SEQ ID NO: 24399 - DNA, 25 bp, Artificial sequence
  Extension Primer
caggggcctttagatgccaactgaa

SEQ ID NO: 24400 - DNA, 25 bp, Artificial sequence
  Extension Primer
caatgtaaacacaagcccacaccca

SEQ ID NO: 24401 - DNA, 25 bp, Artificial sequence
  Extension Primer
aatttaccttgtgcctgctaaagaa

SEQ ID NO: 24402 - DNA, 25 bp, Artificial sequence
  Extension Primer
cctggtggctcagtagtaaaaaaaa

SEQ ID NO: 24403 - DNA, 25 bp, Artificial sequence
  Extension Primer
ctcaaaaggaaatgactgcccgaca

SEQ ID NO: 24404 - DNA, 25 bp, Artificial sequence
  Extension Primer
ttttactgtgggaagctttcctctc

SEQ ID NO: 24405 - DNA, 25 bp, Artificial sequence
  Extension Primer
gaaattgatgagggctccctgccta

SEQ ID NO: 24406 - DNA, 25 bp, Artificial sequence
  Extension Primer
aacactcctgctgatctaaattttt

SEQ ID NO: 24407 - DNA, 25 bp, Artificial sequence
  Extension Primer
gagggaatgaacaaaaaatctccaa

SEQ ID NO: 24408 - DNA, 25 bp, Artificial sequence
  Extension Primer
cactcaggtaacaggaatcctttgg

SEQ ID NO: 24409 - DNA, 25 bp, Artificial sequence
  Extension Primer
tcattactataaagttgagttccct

SEQ ID NO: 24410 - DNA, 25 bp, Artificial sequence
  Extension Primer
tgggattctctagacaagaatgtgg

SEQ ID NO: 24411 - DNA, 25 bp, Artificial sequence
  Extension Primer
ggcaagggtctaagtaaaagcagta

SEQ ID NO: 24412 - DNA, 25 bp, Artificial sequence
  Extension Primer
agagatctcatcaagaaaattggag

SEQ ID NO: 24413 - DNA, 25 bp, Artificial sequence
  Extension Primer
acatataaaacagctagcacagtga

SEQ ID NO: 24414 - DNA, 25 bp, Artificial sequence
  Extension Primer
gagacaggcacccagagggaacttg

SEQ ID NO: 24415 - DNA, 25 bp, Artificial sequence
  Extension Primer
gacacttgagctttcacagactttg

SEQ ID NO: 24416 - DNA, 25 bp, Artificial sequence
  Extension Primer
tgatgctcttgagaagctgtgaggc

SEQ ID NO: 24417 - DNA, 25 bp, Artificial sequence
  Extension Primer
tcaggtctggcaatctatatatctc

SEQ ID NO: 24418 - DNA, 25 bp, Artificial sequence
  Extension Primer
cttaaaaatatgtgtataacccatt

SEQ ID NO: 24419 - DNA, 25 bp, Artificial sequence
  Extension Primer
caactcacctaaatcctccaaacaa

SEQ ID NO: 24420 - DNA, 25 bp, Artificial sequence
  Extension Primer
tcattctcaatattattgtcaagat

SEQ ID NO: 24421 - DNA, 25 bp, Artificial sequence
  Extension Primer
taccacaatgcaatatgacacaagt

SEQ ID NO: 24422 - DNA, 25 bp, Artificial sequence
  Extension Primer
cttctctgacattttgtcaaattct

SEQ ID NO: 24423 - DNA, 25 bp, Artificial sequence
  Extension Primer
caaaggtgccagaggttattcccta

SEQ ID NO: 24424 - DNA, 25 bp, Artificial sequence
  Extension Primer
attttaagaaggaaaatgatcttgg

SEQ ID NO: 24425 - DNA, 25 bp, Artificial sequence
  Extension Primer
cgtggctgtgtggctttggacaagt

SEQ ID NO: 24426 - DNA, 25 bp, Artificial sequence
  Extension Primer
gtctaatgttaggagttactttgta

SEQ ID NO: 24427 - DNA, 25 bp, Artificial sequence
  Extension Primer
ggtataccacctagcaccttaggac

SEQ ID NO: 24428 - DNA, 25 bp, Artificial sequence
  Extension Primer
agataaataaaaacttttaaagtca

SEQ ID NO: 24429 - DNA, 25 bp, Artificial sequence
  Extension Primer
tatggtgtacaggactatattggac

SEQ ID NO: 24430 - DNA, 25 bp, Artificial sequence
  Extension Primer
ctcttctttctggtcacattgactg

SEQ ID NO: 24431 - DNA, 25 bp, Artificial sequence
  Extension Primer
gttcttaaaattttatttcaattaa

SEQ ID NO: 24432 - DNA, 25 bp, Artificial sequence
  Extension Primer
ttcactttcaccagcgagggaagcg

SEQ ID NO: 24433 - DNA, 25 bp, Artificial sequence
  Extension Primer
ggcttctgtctgtaaacacagcaga

SEQ ID NO: 24434 - DNA, 25 bp, Artificial sequence
  Extension Primer
cgttttatgacccctgtaaaacgct

SEQ ID NO: 24435 - DNA, 25 bp, Artificial sequence
  Extension Primer
cacctaactttagtgctttcgtttg

SEQ ID NO: 24436 - DNA, 25 bp, Artificial sequence
  Extension Primer
gttgcaaagagtcggtcggacacaa

SEQ ID NO: 24437 - DNA, 25 bp, Artificial sequence
  Extension Primer
tattttctagctgtactgcactaaa

SEQ ID NO: 24438 - DNA, 25 bp, Artificial sequence
  Extension Primer
aactagatgttaatcagtgccagag

SEQ ID NO: 24439 - DNA, 25 bp, Artificial sequence
  Extension Primer
gctctactttttcctgcttactcaa

SEQ ID NO: 24440 - DNA, 25 bp, Artificial sequence
  Extension Primer
tctctgaaatgttttataggattgg

SEQ ID NO: 24441 - DNA, 25 bp, Artificial sequence
  Extension Primer
agctgtccacaacatcctaagagac

SEQ ID NO: 24442 - DNA, 25 bp, Artificial sequence
  Extension Primer
gtatatacatgcatatgtccttgta

SEQ ID NO: 24443 - DNA, 25 bp, Artificial sequence
  Extension Primer
tgaaggaaggcttgtccatcacttg

SEQ ID NO: 24444 - DNA, 25 bp, Artificial sequence
  Extension Primer
acataagtcccaagaaagtgaaagt

SEQ ID NO: 24445 - DNA, 25 bp, Artificial sequence
  Extension Primer
tggtgttatttgagaccaggaggaa

SEQ ID NO: 24446 - DNA, 25 bp, Artificial sequence
  Extension Primer
acttctttttaagactgatcttatc

SEQ ID NO: 24447 - DNA, 25 bp, Artificial sequence
  Extension Primer
cacctgagaagcccctgggaacata

SEQ ID NO: 24448 - DNA, 25 bp, Artificial sequence
  Extension Primer
ttaggaaatgtagtgagtgactaag

SEQ ID NO: 24449 - DNA, 25 bp, Artificial sequence
  Extension Primer
cattagaaactgtgattttcaaata

SEQ ID NO: 24450 - DNA, 25 bp, Artificial sequence
  Extension Primer
aaaattctgcttctcattaataaag

SEQ ID NO: 24451 - DNA, 25 bp, Artificial sequence
  Extension Primer
ttcggctcttctgattccatcaagg

SEQ ID NO: 24452 - DNA, 25 bp, Artificial sequence
  Extension Primer
tctactgcagagagaaaaagaacat

SEQ ID NO: 24453 - DNA, 25 bp, Artificial sequence
  Extension Primer
aagctgggaagtcaggaaggagtta

SEQ ID NO: 24454 - DNA, 25 bp, Artificial sequence
  Extension Primer
tgatgcagagctgaagtttaaataa

SEQ ID NO: 24455 - DNA, 25 bp, Artificial sequence
  Extension Primer
aggaccagggcctgaggatctgggt

SEQ ID NO: 24456 - DNA, 25 bp, Artificial sequence
  Extension Primer
tcggatgattcggacaatacgttta

SEQ ID NO: 24457 - DNA, 25 bp, Artificial sequence
  Extension Primer
acattctttctttgacaatgagaac

SEQ ID NO: 24458 - DNA, 25 bp, Artificial sequence
  Extension Primer
ctctcaaacagacagtccacagata

SEQ ID NO: 24459 - DNA, 25 bp, Artificial sequence
  Extension Primer
atgttttatgcgtggtctaattata

SEQ ID NO: 24460 - DNA, 25 bp, Artificial sequence
  Extension Primer
tgggactcaaacccaggtcttctgt

SEQ ID NO: 24461 - DNA, 22 bp, Artificial sequence
  Extension Primer
tcgcgttcttacagaaaagaca

SEQ ID NO: 24462 - DNA, 25 bp, Artificial sequence
  Extension Primer
tgtccatgtgctatgagtaactgac

SEQ ID NO: 24463 - DNA, 25 bp, Artificial sequence
  Extension Primer
agggttttttgacctgagcactatt

SEQ ID NO: 24464 - DNA, 25 bp, Artificial sequence
  Extension Primer
gcaccattcagctaaggacaatttg

SEQ ID NO: 24465 - DNA, 25 bp, Artificial sequence
  Extension Primer
tcaaatcaacatgtctggaaaatta

SEQ ID NO: 24466 - DNA, 25 bp, Artificial sequence
  Extension Primer
tcttcctctatggctttatctagca

SEQ ID NO: 24467 - DNA, 25 bp, Artificial sequence
  Extension Primer
cagtgccatttccatcactttccca

SEQ ID NO: 24468 - DNA, 25 bp, Artificial sequence
  Extension Primer
tacatagcattggcttgttggcttt

SEQ ID NO: 24469 - DNA, 25 bp, Artificial sequence
  Extension Primer
gatgggtctgaaagaatgtcattac

SEQ ID NO: 24470 - DNA, 25 bp, Artificial sequence
  Extension Primer
cttcacatgggagcagggctggaga

SEQ ID NO: 24471 - DNA, 22 bp, Artificial sequence
  Extension Primer
ccaaccacagggttagaggggg

SEQ ID NO: 24472 - DNA, 25 bp, Artificial sequence
  Extension Primer
cgtcctaggtcatcaccttgacatt

SEQ ID NO: 24473 - DNA, 25 bp, Artificial sequence
  Extension Primer
cctaggtcatcaccttgacattyca

SEQ ID NO: 24474 - DNA, 25 bp, Artificial sequence
  Extension Primer
ccttcagttcttgaggaggaagcat

SEQ ID NO: 24475 - DNA, 25 bp, Artificial sequence
  Extension Primer
attattcacaaagttyaaaagaagt

SEQ ID NO: 24476 - DNA, 25 bp, Artificial sequence
  Extension Primer
gtggattttgtgctgttcatttttt

SEQ ID NO: 24477 - DNA, 25 bp, Artificial sequence
  Extension Primer
tttttaaaaatactgaaatgggaga

SEQ ID NO: 24478 - DNA, 25 bp, Artificial sequence
  Extension Primer
cttgaggctcttttataagcgtcct

SEQ ID NO: 24479 - DNA, 25 bp, Artificial sequence
  Extension Primer
atttaagtggccttttccagttact

SEQ ID NO: 24480 - DNA, 25 bp, Artificial sequence
  Extension Primer
acgtggctgtttggagcctggtcag

SEQ ID NO: 24481 - DNA, 25 bp, Artificial sequence
  Extension Primer
ttcttaagtcagagaaaatatctcc

SEQ ID NO: 24482 - DNA, 25 bp, Artificial sequence
  Extension Primer
tgggaaattacaggagacacaggtt

SEQ ID NO: 24483 - DNA, 25 bp, Artificial sequence
  Extension Primer
aggcaggactgctgttttttggacg

SEQ ID NO: 24484 - DNA, 25 bp, Artificial sequence
  Extension Primer
agagcagtgaagaaaaaatatgtga

SEQ ID NO: 24485 - DNA, 25 bp, Artificial sequence
  Extension Primer
aactgcatgctcaataaatgctggg

SEQ ID NO: 24486 - DNA, 25 bp, Artificial sequence
  Extension Primer
tacaagtttttaattcctgtattta

SEQ ID NO: 24487 - DNA, 22 bp, Artificial sequence
  Extension Primer
ctgacctgttaaaaactgagtt

SEQ ID NO: 24488 - DNA, 25 bp, Artificial sequence
  Extension Primer
ttaatattttgccaggatcccttta

SEQ ID NO: 24489 - DNA, 25 bp, Artificial sequence
  Extension Primer
caacctttcttcaagactaggacgc

SEQ ID NO: 24490 - DNA, 25 bp, Artificial sequence
  Extension Primer
catctcatttgcacaacttcttaac

SEQ ID NO: 24491 - DNA, 25 bp, Artificial sequence
  Extension Primer
acaacttcttaacrttcttgccaga

SEQ ID NO: 24492 - DNA, 25 bp, Artificial sequence
  Extension Primer
taacttaacattccttactatactc

SEQ ID NO: 24493 - DNA, 1404 bp, Bovine  19866880174425
gattcaaatgagatgaaatgagatgtattcaaagaacaacttctcaatgctagatagatccctagaactacaatactcaatggggctgacactgaatgtatgctttctgatcttagttatgtctgctgctgctgctgctgctaagtcgcttcagtcgtgtccgactctgtgtgaccccgtagatggcagcccaccaggctcccccgtccctgggattctccaggcaagaacactggagtgggttgccatttccttctccaatgcatgaaagtgaaaagtgaaagggaagtcgctcagtcgtgtccgactcttagcgaccccatggactgcagcctaccaggctcctccatccatggaattttccaggcaagagtactggagtggggtgccattgccttctccgtagttatgtctaggattccataatattatagaaggagggaagaaaggtgaaaggaagagagagagagagataaagggagggaggtgagtagggggagaaacaggagaaggggagagggggcgaaacaggagagggagagaggaggagagagggagagagtaagggggcagggagagaaagaaagagagagacgttgattgagaatctgctgatctgtgaaaatgcaagggaaaggttccagatcttaggaatggtaagaagtccagtgtgtttgctgccaaattttgcattagtctcaactacccggctttagccataaagtaactgctgtggtctcaggagttggctacaaaagaactctgtctttttggctaatatgataagaaaatcatttacctttcaaatttccaacagttctgatcctcttacaagggggcaaaaaagagcaaaatgtgggagagggagtatgaggggaagagagattatggactgttaatttgtaaagccacatgaggatggagggggataaaacaccaactctctgacttaaaatgcaatccttttcccattcatcctccattgtaccagagaagaactgtatctatcccatcattttccttgatgattggatgacatatatatactaataatatataagaatgctctgttttggattatactctgcaattcatggatgaacctgctataaaaaataatcagaaacttcaattaaatagtttctgaaaataaggctccctggtggcttagatggtaaagcatctgcctgcagcaggagacctgggtttgatccctgggttgggaagatcccctggagaagggaatggctctaccccctccagtattcttgcctggagaatcccatggacagaggagcctggtgggctacagtctatggggtcacgaagagttggacacgactgagcgacaaaaactttcactttactttttaattaaacagaggtgggagaccagaagcggta

SEQ ID NO: 24494 - DNA, 2168 bp, Bovine  19866880359188
tgaagaagaactaaaaaagcctcttgatgaaagtgaaagtgaagagtgataaagttggcttaaagctcaacattcagaaaacgaagatcatggcatctggtcccatcacttcatgggaaatagatggggaaccagtggaaacagtgtcagactttatttctgggggctccaaaatgactgcagatagtgattgcagccatgaaattaaaagacacttactccttggaaggagagttatgaccaatctagatagcatactcaaaagcagagacattactttgccaacaaaggtccgtctagtcaaggctatggtttttccagtggtcatgtatggatgtgagagttggactgtgaagaaagctggatgccgaagaattgatgcttttgaactgtggtattggagaagactcttgcgagtcccttggactacaaggagatccaaccagtccgttctaaaggagatcagtcctgggtgttcattggcataactgatgctaaagctgaaactccaatactctggccacctcatgcgaagagttgactcattggaaaagactctgatgctgggaggaattgggggcaggaggagaaggggccgacagaggatgagatggctggatggcatcactgacttgatggtttgagtgaactccgggagttggtgatggacagggaggcctggcatgctgtgattcatggggtcgcaaagagtcgggcacaactgagcaactgaactgaactgaactgaatcatttatttaagcacagttcttgttgaggctcatttaaattgttttcaatcttttatgcttataaatgaagctgatataaccatctggtaactaaatatttgtactcagtcactctttcattctgagggtaaattcttgctgctgctaagtcacttcagtcgtgtccaactctgtaggaccccaaagatggcagcccaccaggctcccccatccctgggattctccaggtaagaacactggagtgggttgccatccttctccaatgagtggaagtgaaaagtgaacgtgaagtcgctcagtcgtgtccaactcttagtgaccccatggattgtagcctaccaggctcctccatccatgggattttccaggcaagagtactggagtggggtgccattgccttctccggggtaaattcctagaaccagtatttttcagttaatgggtaggcagtcttagctggttgcatgttcctaaaatatatgcactatttcactatcaaaatgaaagggtttcttttcttcctttccttacctctttttgggagagatctttggaaagacagagggagtagttagaagtttttaaaatataatgatgcggacttccttagtggtccagtggctaagactccacactcccgatgtacatggttttctgaaggatattatactcatataataacaaaaaaggaggatacaagtcaggtttgagagcctttttgtaagataataataataataaatgtccatatattaaatatagaaatgttccctctggtcagggaactaaaatcccacatgccacacagcaaacaaacaaaaataagctaccaaaaaagtaaaatatattaatacattggtgtaatactgggagatttcattgatcattaaattggcatcacatcccatatattttagtaccttgaattcagctggcttttattaaatgtaaaacatcatcaagtttaaaatgcatcattattttacgtaaaattaagaaataaatttttaaaatctcttccaattaagtcactgtgcaatgccttcatcgtccttttaaataccttgattgatcacaccatcctttgaaagtcccttcatctgttcccagggatttggcaacttctttttacctcttgttgcttggcttgatgtgacaagaaaacctttagcatgtatctaagtgacagaatgcaatacagcttcatctatcatggtttcttcctttttaggggttccgtcaagatctggttgttactttgcaagaaaatatgaaactggagttgttccctcagacaagaatttgcttcatgatgatcagatctccacccctctgctgtgcttgggcatctttctatgcacacagaaacttcccattcaatgctgactcttatcatggcatcatctttctgaaaata

SEQ ID NO: 24495 - DNA, 1739 bp, Bovine  19866880364794
ttccctgggagcagagaggcaaagcacttcacttggacaagtggtgggcaaggcctcttagagggaatggtactggaatctgggagggtgactggaatttagccagatgaaaaacaagggaaatggaataccaggcagagggagcatcatgtttgaagatctggaagtaaaggagaggacagcaatgcttagaaatgccagtcgcttgatataggtaaaaggttaaggaggtgagcttagaaggaagatgaaggagagacgagatcacgttaaggaatttggactttattctgcatcagaagccactaactttaaacaagaaagtaatagaggctgcactggagtgaaattacaataaaagaggccagctgggaaagattgaaggcaggaggagaaggggacaacagtggatgagatggttggatggcatcactgactcgatgaacatgagtttgagcaagctccaggagtcaggtgatagacacggaagcctggtgtgttgcagtccatggggtcgcaaagagtcaaacacaactgagcagctgaactaaactgagagtgggcatggccatgcctgctcctgggtttctttggaaacttaaatgagacaatgcatgagaaaagcttagcttggcatctggcacagagtaggtgcttcataaatgcctgctgtaattatgatcaaaggatgtagaaaagggacttccctggtggtccagtggttgaaagtctatcttacagtgcagggtgtgtgagccaggggaactaagatcccacgtgccaagtggcaaccaagtgtgtgtgccacaattatagaagcctgtgtgccacacaaagagcccacatgccacaactaaggcccgatgcagccaaataaataaaggacatgaaaagagcgctggactaggactcaaaaggccacagagttctaacatctgtctccatgtgctccttgtttcttgggacctcagtttcctcattctgcacagagataagtggaggccgggattctcacttccctccaacattgtttgtgtctgattccccaaatagtgtataactcaaactagcactcgaggctcctaaccaggctgagtgagcactttggtggagtcacgagctttgatgggggaggcagctcaggagacttttgcagaaagttcagccctcttatcggaggctgagaatctgctggttgccatgactacggatagcctcatctaagctctaggtcgctgattagcaggaaccgagcagggaggccttgaggaattcagcactcagggctccctccctccttctgtgaagcggagtgcgccagcccttgacttcactgttttagctgtcccctgaagatctcaccttcttttaagtattttttttaatgcaacatcaaagggcaatgtagtaaaaacaaggcagctgccggtactcctcagcaacgatggaacacaggatttttcttaaagccctacaaggatgtaaagctggaagcaaggaaggaagatgggtggggccaagggggtgggcgtgccaaggctgaggtctgagtcctctgaagtgctttgtggcctcagacgggtccttctccctggacctctgcttatttatatatgaggagaagttgcatctgatctatggttctcacatgagatcggacatcagaatttatttgtaaattccttccttccttcattcaacaaacgtttcttgagcaggaaggcacgctatgccatgca

SEQ ID NO: 24496 - DNA, 1460 bp, Bovine  19866880399503
ctccctgtccatcacaaactcctggagttcactcagactcacgtccatcgagtcagtgatgccatccagccatttcatcctctgtcgtccccttctcctcctgcccccaatccctcccagcatcagagtcttttccagtgagtcaactcttcgcatgaggtggccaaagtactggagttttagctttagcatcattccttccaaagaaatcccagggctgatctccttcagaatggactggttggatctccttgcagtccaagggactctcaagagtcttctccaacaccacagttgaaaagcatcaattcttcggcactcagccttcttcacagtccaactctcacatccatacatgaccacaggaaaaaccatagccttgactaatagaggctagtaatttggatgcatacagtatcgtccagcagaagtcaggagcatcttgtagccaaacagacgtgggtccaaaccccttactagcttagtgaccttgaacaaatcacatcatctctctctgcctctgtgtccccatctacagattgggattgataacagagtctaaccctaggaagtgctgaggattaaatgggattatatacacaaaacatttagttcaaaatccggcacatagtaaaatacataataatcatataataataaacatttcctgtgtgctggctgtacacaaaatgctaagtaatttaccctaatttacttgtttaattgacaattctaattgggtaagtacttttaccattttacagatcagaaaagtggcccagagaagtgaaatcacctacccaaggtcacacagctaccaaatggccaggataggaagaactcaataaagggaagttgttgataataattattattaatcatccaaaagggagggggatttcatcctcaggtaagggcttgagttcccccacctgacctccagaaataaaaaggcctggtgaccaactgaataaaacgctagacagaagggtcaaacccggcggagctcagcaggcccctcagcggctgtctcctctcctccaggtcctcctcgcgctctcccagctattcctccaagtctggcaagagaagcccgcctagcagaagctctaggtcgcgccgcagcccaagctactcccgctacagtcccagcaggtataggccccgccgccaggcactgaccccgcccctcgagctaggctccacctccggccacgttcctttgttcaggtccagaatctgcctgcaatggaagagaccccggttcaattcctgggccgggaagatccgctggagaagggataggctacccactccagtattcttgggtttccctggtggctcagctggtaaagaatccacctgcagtgcaggagacgtgggtttgatccctgggttgggacgatcccctggagaagggaacggttacccaccccagaattgtggcctggagaatttca

SEQ ID NO: 24497 - DNA, 1682 bp, Bovine  19866880407603
cttagcgcctcgtgctggagtagctgtctgctgagctgtagctcccactccgactccgactccggctccggctccggctgcggctccgggagcccaggctggggctgcgggagctgcagctgctgctagagagggtccttgctccggctgcggctgcggctccgggagtagcttcggctggctgagcggctgctgctgctgctgtaccaggaggaggtgctgctgaggccgctggacgaagaggggctgggccggtagtaggggatggggcgtttccgggcactgcagagatcagagggggaaagcgtcagggcaggactcctcccagctgcaatcccgggagcacaaacattgtcccaggagacatgtcccgtctccttagcagggaaaaagaattcctgttactcttcccttgcagtcctgagaacatcaaggaggtggtctcagtctaatgctgatatgctttgaaaagtgataatctcgcttttttaacatagcaaggctgggctcagagagagcatccagctggccacagaatctacatctcagctttaatcacagttttgttttgctatttttatttttactagaaccttctatttatggcaaaagaggttgatttttctatttattatagtgtatcaagtttcgttttgaaataaatgtatggacccccaaaaaaggcgtatctatttaaagaaatttaagtaagcagtacacttaatcagataaggcaaaagtggtgggtgatggaagcttgggaaacattgaatggattcactcaggtggattatttggggttgagtacagaacccagagagcctttttcttaagacttcctccaagtccactccaaggatacctctgaaagtcaaggcagtgagtgtaggactcccacaatatgtcctaggccaaggcaggctgttcagtgagacatctgagaagatgacaccattaccctgccttactgtctggggcacaagctcttttttctccttcaggtcatctctagggagaaggcatgggcagccaggattctcctttccttgtgggtctctggactgagtagctgacccttggaggaccagaaggaagacccacaaattttcaagagccatttttagggcagcattcagccattttctccatttcaaggcctgaggattctcagacttcaggattctcttctagggcttttctcatctaagactacctgttacagaaatctttacctaccaagtctgaccattcagtccatcacaatggcacacaatgtgttctagtgctctgcatttaagtgtataaattgcattcatatctctttgcctcttttcattttatccttttgacacttttaggagttatttcctccagcagttcatgggtgaaaaaacttaagattctgggaggtgaagagacttttccagctcactcggaaagtggcacagacaagattcctctccaaaatactggtcttccccttacccaatagcgcaccccactcccccacccccttctggtacctaacaatcctgttggccctctctacagttggttcagggtataattacctacggttgtattcaagccttgcatctgggcgcgtgagtctaaaggtagaggtgtgttgctactgcctggctccacccccacgcaatgtcctgggttcagttccttgcttg

SEQ ID NO: 24498 - DNA, 753 bp, Bovine  19866880408587
ttccagctttctttaaaagcacctgcagtgcagttttctttctggtcctccaacaagagggcagagccatggcccacgctctagagaccaacatgaagcctgatcagagacgcacgttggtgtgcccagcagacaccccaagagctccgcttagtcacctggcacgacccctcacctcccctgtgatcatgaacaagccctttcaccgcctgacttaggaagaaaggggcctgagagcctgcctcctttcctttgaaatccagtcccatgaaacgtgggagaatctccgtgatttctagatcctactaagcgcacacatctgcttttgttcacccacagtgtgatccagctttgctccctgagcccaaccacgtcatgttgaaccacctctatgcgctctccatcaaggtaaggacccgtttgttactctctgagccgtgtttcttgccctgaggcaaccccccccaccccagtgctggaacggcctgaagtccttacctggagggcagcttccgggcccaggcacttgtgtttatgccaccctctggattctcgtgttccctaaaatctgagcatatttccaccctcttcctcaggatggagtgatggtgctcagcgcgacccaccggtacaagaaaaaatacgtcaccaccttgttatacaaacccatatgaagaggtgggagccgccggggccccggggcagcgtgcacctccaggctccacgcatgcatgctcttcgctagacggaacg

SEQ ID NO: 24499 - DNA, 749 bp, Bovine  19866880472171
tgaaggaggcgggggtaaagaatgaattaaaattttttaaaagctgttttttggtaaagcactgggaagtgttctgggctcctaaatttaaaggagtatttttagcacctgtaatcaaaccgacttgcataaacacatctgctggaatattggcatcaaaatgtctttgccgtcttcattttttacatttcttgcagccctcctgggacccagggagagtttcactgattttcttcctttcattatgtttttccaaatcaactgagtgagaaagtcaaatggaatattttctttttcattgaatgctgctgagtccctacctgaagagtggccacaaagtcttcaaactttagtgagtgtaagaatcacctacaaactttgtatcaaatgctgattcctggaccttaccctcagattctagagggccatgtgggcctgggattctgcattttacacacgtttcaactgattctgatgtaagcagtccggggaccacaatgattagtactgggctagggactaaagcagatttagaataagattctggttccatcatgcacaatctgttgactctgggcaagttccttgaccttttgaaatatcaatcacctcatctgtaaaatggactattaaggatacctattccataaacttgtcatgaggattaaaactgatgtattaacttggcaccctgtcgggcatgcaataaatgaccccataaaaatgctaactcttatcattattattaa

SEQ ID NO: 24500 - DNA, 2859 bp, Bovine  19866880522560
actgggactcaggtggcttggccctccctcctggtgtgggtggcgaactccaccctgtgctgtctgcccaatctcctagatgtcccctatgtcctgaagatggagtctcaccccccaaaccacctgctggcctgggaggaccctctacttgctggctcccagctttcccgacaagcagcgctgggtcaccgccttagagtcagttgtggcaggtgggagagtgtctagggaaaaggcggaagccgacgctgtgagtatgcacgcgggccagagcttgtgtttgtagagggggctgactgggtgggggtcccttcagcctccccctctgaagggtgatgggattgtgtgcccctagagatccaggcttccaggcagggtctggcctcacaggtccccccgcccgaaccctctagaatgagggattcgccaccattagccagctcttcagggcatactaggtctcagttctggcagcacagctgcaaattacttagaaggaaatgctctctctcctttacccagatgtgtttacgtggttcaaaggcttgtgttacaagcagcacaaagggctgccgaaagccatgtctctttcaggaagctttttcataacctgctcaattgcttttacgtgatctgctcttccaaaggcaggtctgaaatcctacttctcctgaagatgttagagacgtgggtaggccttgattggcatcactcctcctggaacattccaggatacaaacagtgctcatcacgcactggcatttccaccaccaaagccccaacagctcttttcaaacacttagctcctaataaacactttaagtgttagcagtcggaagtccttagccaccagcctccctctcacgagaaagcgctgtgttgatgacccatctcccacgtgtgagcctttaactgaacgccccatccatgtgtgtacgatagggccgtgactgtacttcctacgagcctctgcccgcgtgggctcaggtaaagagactcaggagctggttgatttgccactgacactgggctttgcacttgtgctgccgcctggaggggcaggagcgtccacgtggcttattaaccctttgcagtgacacccttcagctttggcttgttttgtgtgacagaatctatgtctcctgtgctcatttagttatgcatctaaacccagttatgtccccgacgctaattaaccaccacccagagacaccagtaacattcaggtcctgccttttgaactcagatcaaagtagggggcaaatcaggagcaggtgtgtgcttctgagtgtctgcaggagtaacttgcccttctccctggcattaaactttcctctgttcttgcttttgtctctctggacagttcagtcacgaacagttcagcctcactgtggcctccttttttctctctcttctctttcacatgtgaaaagaaattgctcggaaactccctgttgaaactggaaggtgatgaccgtctggacatgaactgcacgctgcccttcagcgaccaggtgacgatgctttttttgggcaacgtctgctgggatctggccatagccgcacgcgttacaggaccatgtcaaggggtggtaatggggacatggccccgctcatgctcttcctggggacttgtgccctggcaggtggtgctggtgggcaccgaggaagggctgtatgcgctgaatgtcttgaagaactccctcacccacgtcccaggaatcggagcagtcttccagatttacatcatcaaggacctggagaagctcctcatgatcgcaggtgggaggccaaggacacagcgctttgccttcacttgtaggggaaacgatttgaaactcacatgtcatgtttgtcaaacttgggggcgggctggagcaggaggggctcttccctctgggtccctgaaggggcccgagcccctgtgctactgagagcctgcctgccctgccgtgtgcatcgcccgtgctccccagtctcagacccttcctttgcatgtagcactcagtaacagttcaacacatatttatttgtctcttcctacacacacacacacacacacacacacacacacacacacacacacacacacacacacacacacacacacattctcacttattctgaaccacgtgagaatcagttgcagctctgactccagattcttcagccagtcagctaagaacaggggcattctcttacatacccagggcagaaaggctttattctcctctctttattggtaattttttttttttaaaggaaaacaacaatgcattggcttcacgttcaaaacattcacagtcaaatcttaactcaggcttggctggctggatccatatggtcaggaactagctttgcttgatctctcggtgcttttcctctgtcagcttgttttctcgcttgctttctttttcttcacttccatcttgatattttccctgggcgcagttttaggttcacagcagaaggtagagagaattcctgtgtacctctgccatcacacacacctggcacctgagtgggacatgccacgccaaggccatagtttacattggggttcactcctatgcattctgtgggtttggacgaatgtgtgacaaacatctgccactgtgacatcatacagaatagtttcacgtggtacgttttcttcttttctttggtcacatggcatgtgggatcttagttccctgaccagggattgaacctttgtctctgcagtcatagtgcggagtcctaaccactggactgccacagaactcccatgtccactgttttatattataaaagtccctcactgactcccaacacaaacgttcttgactttggtggggaacacattgaacgttcagttca

SEQ ID NO: 24501 - DNA, 1635 bp, Bovine  19866880525139
cacatgcatacagtcttctgacttgggttcgcagagaacatactttgaaacccttagaatttcctgacacacccacgaaacaatgcctgctcaaagtgcttgttaaaaaatagggtttcctctagggattttggttcagcgtgtctgggatgaagaccataaatctgtggttttcacaagtgccccagctgattctgatctttgggatgtttgggaaagactgttagaggatttttagaaaaggtcatcttcctaaacaatgttatgatctgaatgtttatggtactactattgcccctctacccgcccgccaaattcatatgttgaatcctaacctttcagaggatgctgttaggaggtggtggcctttgggaggtgattagatcatgatgggggagccctaatgattgaaactgatgctcttgtaaaacagaccctggagaactagcttgttctttctaccacgtgaggaggcagccgtctatgaagaagagagtccttgctggacactgaatctactggcatctggatccaggaccttccagcctccagaactgtgcaaaataaatgttgttcacaagctcctcagtttacggtattttttgttatatcagtctgaacacacgaagacatgggaccaaagggcagtctggcccttgaggctcggggctggaaaggcaggctttcaggggtttctaataagcccagaactctatgtctgtcttgatgggagcagatttggtgtctaaagtgaaacaggaatccacatttttaaagtgaatcaggcaaaagaaaacctgcagctttccctaactgtctctgtgcagctctgcagagaagcctccaatatttgctctttgtgacagattaaggagacttttctcctagaggaatggaagcagatgggaaatttcaacaggttcttgcactgtaaccatggttattttatcattaaagtgaatgcaggggccaggtgaagagttttgtgagaaccaggttctcgtgtggtttagtctttgagtgcctgaagcgagtcatccttctccatctatgagatgggacaaaggaattgggcactggttaatctatctgtctcagcaaagtgctgcaaaggttccccaggacactgcacatgaaatcaaagcagccaccacctccactgtcaccaatctttacatgcttacaatatgccaggcacaggctaatatgttaaatgcatcatctcactaaatgcttaatgtgacttggtggcgtagacattatttccataataatgaaaacactttaccaggaaattatcatttaattctcattgcagccctttgggataggttattaaggagcctcatttaacagaattggaatcaggctcagagaggtgaagcaacttgctcaacagcacacagccattaactcatggaaatagagctcaaccctcctctgcttggtcccactgccaatgcctggatgatacacaagctcattctacagatgagaaaactaaggtttagagaaaggctgagggacttgttcaaaggcactacgtcttgagcccacgtcagtctgattccaaagccagtgttcatgacgtgagtgctcacacaggggaaggagcttcttgagctgatgcttcat

SEQ ID NO: 24502 - DNA, 2045 bp, Bovine  19866880529851
atgtgagcccagcgtctgatagcctgcccccacctagtgaagagctgttccaagataatgaagtatagacagcagcatgtgtgagagacacagagaatcctttagatgttccagtctcaagttctggccgtccctgtggccaactctggccaggacgttcctgtggtttcattatgtgagccagtttattcaagctaattcacgttggatctttgtctcttgtaaccattggaattttttatatacagttttttttaatatttatatttctttatttggctgtgccgggtcttagttgcagcacatgggatcttcgatcttcactgtggcacgtaggatctttagttgtgacattcgaactcttagttgcaatatgcaaactcttgttgcagcatgtggactccagtttcctgactagagtccacatggaaccccggaccctgccttgggagcaccgagtgcttagccactggaccaccaagtttggaagttcccaacttgggatttttatttattgtttttaactaaactttttattttgtattggaatatagctgattaacagtgttgtgatagtttcaggtggacagcaaaggaattcagccatgcatatacctctatccactcccaaccattgaattttgactaagacaccttagcaaagacataaagagaattcacataatgaacaggaacactggtaaatttttcactcataaatgttctgtgcaaaccacatgggtacaaatccacctatattgtaaattctagtgtggctctggaaaactaagcagatatggctgcctcttgccacatacagataaaacccacaatggctcccattggttcaaaggatttatacctcctgaagctttcacatccattacctcatttgccttctaccaaaactcaaccagacaagaaggagactttagcatccccatttccaggtgagaaagtggagacaccatatggctaaatgacttttttatgtaatgcaggggtttggatcgagatcagcagttctcaaattcaatcagtcacgaactgtgtcatgactgatttgatgctggtggttaaagtaccggagcaggagaatgattcatctttttaaaaataacacattatccttgtaacaacctaattctccccagcagtcggtatgctttcctggctaggagaaaaggagtggggttacagctggcataatcggaattcccatgggagtgttatgcatgtgaatagtcaaccatgtgcattccaacagtttgggggaataaaaaaacagttgagagttaatggataagccaggcctggaggttgcttccagctctaaaactggatgattcacccaaaataaactatgagttgatggcatacaagatcaaaacaaaccacttttccctgtccatggatcttattaaggatcacttactttaaagcgttgtaggttgatcataagatgtatcatccaaaacaagatggttttgttttttaaatatttatttatttggctctccctggtcttagttgcagcacacggcatcttcagtcttcactgcagcatgggggatctttagttgattagctgcagcatgtgggatctagttccctgacaaggatggaacccaggccccctgcataggaagcatggagccttagtgaccggaccaccagagaagtccctaaaccaggataattttaggagaaaagggggcatcaatggaatggaacatcaggacaacatattaaacgggaatgactcgatggacatgagtttgggtgaactccgggagtttggtgatggacagggaggcctggcatgctgcaattcatggggttgcaaagagtctgacacgactgagcgactgaactgaactgtgtcgaacgaatcaggactagaatcaccctacgtatatgtaatgcaagatatgtgtgcttcagtcatgtccaactctttgtgaccctgtggattatagcctgctaggccccatctgtccatgggattctccaggcaagaatactggagtgggttgccatgcttg

SEQ ID NO: 24503 - DNA, 1243 bp, Bovine  19866880569696
ccattcctctgaatcagcaaagcaccagctgtactctttgacttccttggggtggttgaataccagaccttgacaacttcccaaaataaatttttcatccagagggttcagtctgcacctcctttccccaaccactcttatgattttgtactttatatctttgaatcatagaatgattagccctgagaggttcaaagactcaatccacagagaaggaaactaagacacagaaagaaggggggtaattcactagaagtggcaaaagcatgaaataacagggctggtccagagccccaggcatcctgcctgtggcatcttcccattacaatagactgcttctcctggaattctgatctccaccacgtactagcttgtgatctttaaccaagttactaaacctttctgagcctcagttttctcatctgtaaaatgggaacagtagtgacactcacctcaaagggcttttgtgaggattaaatgatttaattcatgcaaagtaggaagcacagtggcaggtacatagtaaacactccataatggcagctatcaccctccttctcattatcatcacgcagtccccagcacacgttgatcagtgagtggttgtatgtgtgtgttaatcactcggtcatgtccgactctttgtgaccccgtgaactgtaacccaccaggctcctctgtccatggaattccccaggcaagagtactggagtgggttgctatttcctccttcatgggatcttctcaatccagggattgaacccatgtctcctgtttgcctctcctgcattggcaggcagattctttaccagttgatccaactagggagccaataatataatggcatgtctgctactgtttccgccaactttattgtatttttgagcaagatatctctgcctttcaacacctttgtatctaaaatgaaagtattgcacttcagttgtctattcaataaggcatacattagccacacatagctatttaaattaaaattaaactaaaacttcagcttttcatttgcactagcaactttttctgatgctcagtaaccaaatgtgaataactctcttattggatggtgaatgttttagaatattcccactatcatagaaatttctggagctgctactgatttattgtcctcctctctggctatgttgtacaataattcatatctggcttatcatttggcatacataaatgtcatgtaaattaaaatgttacatgcaagatggaagaa

SEQ ID NO: 24504 - DNA, 943 bp, Bovine  19866880599886
tagtctctgtgaaatggtgttcccattttaagtaggctgccttttcccagcactaattatgctcagataacgagggccccggtaccttttctgctcgagggtgagaaggaactgactttgaaggctgtgtgtcagttctgtgtttctggatcttgcttctgcagaggggtggtaagggccaagcctggtgagatcttcatttgaaacatgaaaatttctctgcaaggcaggccagggctgggtggagggttagatcgttcacaagaaaaggtcccactactttcaattgctcatgttttttgagcctagtccgctgtttgcattggccctgctctgtctcctaattggatcaggtttgagttctacacctctagcacaaaggctcttggaaagccacctcgagaggtgaccgacagaggcccaaaagtggggcagatttggcaactgacagtaacgagtacaggcttaacccctaaaggaagacttcctgtgaactttaggctctggaaattactaggtcagcggggtggagtatgcgaattacgatgtcaaactgacctgtactggagtcctggcctctctgcatctccgtcctcttgtctgtacaatgagggtcacctgttcctggcatgccgagctgttagcatgatctgacgagcttacacagcacttgacatggcaggtgctcagcagaaagcctgccccgagactaggaaacttgacttctctttgctgttagctctgccttctttctgtccttactctcgaggtaaacacaaagcctgaaggactccaggtggggatctgtttctaataacctgtggtgagatgggcatggggatggctcagctccccacctccctctcctgttgtcatagccccaacaagcgaggcccgccgacgtacaacgagcacatcaccaagcgcgtggcctcaagcccgg

SEQ ID NO: 24505 - DNA, 1612 bp, Bovine  19866880637555
tggtcttttccagacacattcttgggagtgtctagcatagtcaaccattggagaaggaaatggcaacccactccagtattcttgcctggagaatcccagggacagaggagcctggtgggctgctgtctatggggtcgcacagagttggacacaactgaagcgacttagcagcagcagcagcagcatagccaacaggtattatttcaagtgatggttaaaaatgagtcttttatggtagggagttcttactgttgtttattttttaagcctccttcccaaccaccatggaacagttctacttattttagtaagcgtacatatgatttttgccattaatgtattcagtatcaattatctacttgcacacagctctgagtgggtgtgtttcagcattgagaattttcttaagaaaatgaactctgaattttaaggtttcttttatcactttctcattttagctggctacctggggtgaagaaaagcgcaaaagacgtctgatgctgcttttaacttttggcttgagtcgtgcagattagatttaactttaatgaaaaaagaggaaataaactcgaagtgtatgtgttcatccaaatttataggtctgagatgagaagcttgagttatttttaataatttatcaaaaatgcacttgtcctttttgctgtttgatatctcaggtattgcttagactgaaataaccaggccaataaattgatgtactgatcgttcctgggcaaaaaagtcttttaaacctcatcaacctcccctgagcccctttgcttcgacagtatctacctctccctggtcagcccctgctttcccctcctcatcacaatgacatcctcaccagcttcagcatggtaatgagctggctccatgcctgcctcttaaccttattttctttcatcagagaggctgtttctcaaaatcctgcttgtgatgaactaaccttggaggtgctctgatttataaaatttgcctccctaggaagacttcactttcacttttcactttcatgcattggagaaggaaatggcaacccactccagtgttcttgcctggagaatcccagggacaggggagcctggtgagctgccgtctatggggtcacactactgaagtgacttagcagcagcagcagcagcaggaagacagtaggtggttcaccctcgcctctgtcttagtctagaaggagttaaggccatgagagattaaaaatatctttgataaaaacatcctagatctggctgtgtatcccaaagaatttaaagtaggatcttgaagagctatctgtatatccaggtccatagctgcatgattcacaatagccaaaaagtggaagcaatctaagtatctattgatggatgaatggctaaactaaatgtggtatatagacataatggagtattattcagccttaccaaggaagaaagttttgttttttgcttcaacatggatgaatcttgagggcattatgctaagtgaaataggccagtctcaaaaggctcttatgtaaggtacttagaagggtcacatttctagagacagaaagccgaatggcagttgagttttcagggttctggggaggaggaggaagaagaaggagttactt

SEQ ID NO: 24506 - DNA, 848 bp, Bovine  19866880647430
ataaagcttccttatttcatatcaggtagacattcaactaatttgcagttaggaatttctgctaggcatctggcttacatttctactgctgcttcacagaatctccctgtgaaggaagtcccatggagatcacctctttgcttaaatagccacctagaacccttgccccatggggtgataacctttgctagctgtggtaagagccccagaatctggaccagtgctcagcacagaatgagccttggaaaaaggttttttaaatgaacaactaatcataaggtctttaccagagagttgagctttcactataagagaaagaaaaacaagcattctactcttttaactgagtcacaaacatgtcctttctactaacttcagctcacatatgaggtccctagtagggctggacaaagcaaggattctcagccctttatgaaaaagagtctggcatcagtggccacgggggggcagtgatgcgcacactccctcacctgtctgatccttgggaggttctagtctgctcaggctgatccaaggtgtccctggagttcttattctctgaagccaaatgccgatgaatgtacacccctcccctacccacaaatcagctgatcactcctgattgtcattctgcctcaattctgtaacttctctattgtctgccttgaattatatataggtagtcatttgcctagagatttcatctcctctatgaacactagttctttttttaagtaaaagataacagacttacagaagagctcccagtcatcaaggtagagctagatcaatgcatttctatcagattaaagaaacagaatattctcaatactttagaagcccccacg

SEQ ID NO: 24507 - DNA, 1349 bp, Bovine  19866880697732
ctgttagaatactgggaaacttctggtactgactgttaggtagcagcagccacttcccaatttcccagccatcctgctctctccaccgagtttctccagacatctcccatgatgcagggtatcactaggctcaagatggtatccttgtgcaaaggcacagaatctttctgtgccctttggagagatgtctggtccattgtaggaactcaagaaatctgtattggctgaatgggtgatgaatacatcagttttcctacagaatatgagttcactgatggcatcctggagccccaggcaaaggagaggtgctcagagagtccttgctgctgagctgaaggtcagatgctatccctctctcttattataagccctctttatcataactcccactgccgagacttcccccaaaagctgtgctgtagcccaaagaagactggaaatctgcatttgtaagttagggatagaatgattcgatccatgccatgaattgcaggtttccgtgggaacctctattcttgactctgaaagcacagcacttcagtaataatcacccttcttcgtggactatgaagaggaatgaggcatatgcagacaattacaagccagagaaactcccagtaaaccacagagctttctgcttccggaaccttccattaattcttggatctgggccatcttagcaacaggctgggagacttgcctccccagggagtcttgctatcaggcctcttgtgtgaatgggagagtgagagcttgaaatgatgccaggggctgccggcagggagaactccagaaccctgcatcctgaattcttaacctgaattcttaaccctgtgtgtccatcagaaacacttggatagtattaaaaataaatgccacaggcttggccctattctggagagacttcaatttaactggtgtaggagccagacaccagttttttaaagtagacattgtggtaaaatgtgcctgacataaaatttaccactgttgagtgtacaattcaatggcactaagtacattcatgttgtgcaaatatcactgtcattaatcatctcaaactgaaactctgttttcattaaacactcactcctcattcttcccaccactcctccccattcccagcccctagcaatcaccattctatgtcctgttcttatggatttgactactctaggaattttatgagttgactcatacaatggttgtcttctatgattggcttatctcgataagcataatgtcctcaaggttcatctatgttgtagcatgtgtcagagcttctttcctttttgaggctgaataatatttcattttatggatatgccacattttgtttaccactcatt

SEQ ID NO: 24508 - DNA, 4710 bp, Bovine  19866880756771
ttgctgctgctgctgctaagtcgcttcagttgtgtccgactctgtgcgaccccatagactgcagcccaccaggctcccccgtccctgggattctccaggcaagaacactggagtgggttgccatttccttctccaaatgtaaatgacattaagaattttcatctttgaaagctgtgaggagattttaaacgatttcaaagatggtaaggatgattcgagatgatttattccacatgtccctcttattgtagtgtctctcaaatctttagctctggcccaagccttttccttgagttttcccagctgtatattcaaatacctgttagacaattctcatagttgttcccccaggcactcagagccagcatgtcccaaagtgaattcataaccatcgaccctaaatctgattctcctcctccatcccttcgccttcttttgtctctttataaatggaacgtatggcagaaacttctagttgcctctgaatagtcattcacctttcttagtagtagaatcttgggcaatcttcataggaaatcactatattactacatttcccagcctcaccacagctagctgtggctacatgactgagttcccgctgaagagatataaagtggaagttttgttaccaggaaatctctttaagagggctccattttgtaattccacttgttctccttcttatactctgaaatgcaagtgtgatggatggaatgcctgcagccattttgaactctgaggttagaacatgtatgacaggatggtagaacagacagaaagaaccaggttttctaagtattgaagagcttccaaatagccctggactgcctatctccagacatctctcacctgagaaatagtcttctttcttgtataagtcactgtagttttggattttctgttattcacagctatgccttattttaagtgatagccagaatcctggaattccttccctacatctaatcttataccaagccctgtcttccagcaatcctggctccaatccatccccttttgttattctcttttgaatcatgtcatctcttaccagtatgactacaatagcttcttcattgactccccacttttaacctctccccactgatacccatgctcaaagaatttccatgtttaaattaagtaatctttctaaaactcaaaatggtcctgatacttctgagaaatcatggaatcacagacacttataatacagagtttaagaggccctcggaggtcatttaatctggatttttaaggtttattttgcttggtgaaaaaggaaaagcaaatgaagtagttttccatggtttttccaatatccatgtatggatgtgagagttgggctgtaaagaaagctgagcgccaaagaattgatgcttttgaactgtggtgttggagaagactcttgagagtcccttggactgcaaggagatccaaccagtaaatcctaaaggaaatcagtcctgaatattcactgaaaggactgatgctgaagcctgaaactccaatactttggccacctgacgcaaagaactgactcattgaaaaagaccctgatgctgggaaagattgagggcaggaggagaaggggatgacagaggatgagatggttggatggcatcaccgacttgatggacatgagtttgagcaagctccaggagttggtagaggagaaggaagactggtgtgctgcaatccatggagtcacaaagagtcagacacgattgagtgactgaactgaactgacgggccttttgctacaaacagtaaacaattccatatataaagtatagaaatgcacttgtctggagaagacccacagttgtcagcagcttctcacagatgttcaccaaaaatgaagcatctctggtaagtctaaccacctcactttatatatggggaagctgagaccagagaagttaagcgacatgtccatgatcacagagaggttcaatggcagaactggaacataaccttctattttctccaaacaagggttaccaactggaagccagtaaagatgctgagccctcctacacatcttcttaaggactgtctatttccactcagattactcaaattggactcacactggtgagggctggggtgtaatctgtacctgtgaatacaaggaatcttagcatgcttattaattatatacatgtctgtttacaggagaataatactatgaacccattaagcaccattatcaatgcatgatctaatactttcagtgtaataatgtatttcagaggaatggaaagaagtattctaaagttgatgaaaactgaattattctgagctagggcgtccttgaaacagtgataatagtttttctggggaatttcttcgtggttaggagtccatgcattccacagccaagggcccaggttcaatccctggtcagggaactaagatcccacaagacatgaagcacagccaaaaagaaaaattgttctgacttccaccacatctatttggaatggtgctttacactttacatataattttcacttacttttttaatttttattattttttttaacccttgtttcattctagaaatctgagaaggagggcagagaaagtagagtgtactagttgggaatattcggagaaggcgatggcaccccactccagtattcttgcctagaaaataccatggatggaggagcctggtaggctgcagtccatggggtcgcgaagagtcagacatgactgagcgacttcattttcacttttcactttcatgcattggagaaggaaatggcaatccactccagtgttcttgcctggagaatcccagggacgggggagcctggtgggctgccgtctatggggtcgcacagagtcggacacgactgaagcgacttagcagcaggagcagcagcagcagcagcagcagcagcagcagttgggaatattttggttgcaagcgacagaacacccaacctacattagcttgaggaaaaaagaaaattgcagggggcaggagatggtaagattattgtctcacataactgaattgccctggaattgaggcatgattggatcgaggggtccatgctgttgttaaggctctggctttgtttccatatgactcttgctgctgctttgttggcttcatcctcaggttgactcatagtggctttctattctcacatcttcaaatcacaaagcccagaatgggagcagatgagttcctgtggcaggcctcatggaggacagaacatctgtctgtcccagaaatatcagaaaaacctctcctagtgtcttcctggtgtgaactgggtcaggtgcccgcctctcaaccagtcacaatggatgatggatataggcacttactggtttgagccaaccagagcccattctagaacagagggtgggatccgttccaccaaaaacaacagagcaaaggatggtgggggtggagttacccacagggaaatgtgagtaagtgctcctggtgggaaagagtgagtggtctccagaaacaacttacagtgttcatcgtaccatggacgggagaggttacgagtcacactcatatgacacacagattctgacacacaggacccgacataaattcacggcttttttgttgttgttatttcaaactttataccatcaacagcttgtctagaaacctgaagaattttcctaccattcatacatatctaccagctctgttcttggcaaaaaaagaaaaagaaaaagaaagaaaactcatgacaattaagctgagccaggaacttcctgtccatgcccaatcaaaacacagagcccaaactccaggtaataaaggcactgagacggaacttagcattgtcctgataaataggaattcccttcagcgttatcataggaagtagctggacagaagcaagttctgggtattttttttctgaacccacacccttgtaagtcaagttaacttcagtttaaagtcagcaagtcagttttatgtcacaaatcaaatcactctatcacctccccaatcacacgggtttttctaggatttcaattcatttatatatgaattgaagtaagtccccaggttactacaacagagcctgaaactaacctacaatgcgcctagctccctgtattattagtatcagaggaggtatattagtatttctaatttacaaagaaaggcgctgtgactccaagagctaacagcagtttctccaaagtcactgtattagaaccactcagcctttccctcctggatgcatccttcattactcacacagtacacttcacttccgacacttctagtcaccaaaagcgcgtgggtttttcctagcaagcaattctccaggacatccactggatgtcctacaatttgtctcaattctaacgccattcacctggagtagagtcgatcccatgggttaagggctcagtcccacccactgctcctaccccaggtagtaagtcctcaggttacccacaacctctgtcagatgtagctgctaatcaaaggttcccatgaccctaatttgttagaggcatctcctagaactcagggaaacacatttaccagcttattaaaggatatgatagggacttccttggtggtccagtggttaagactgccctcccaatgcaggaggcctgggtgcaattcctggtgaaggaactagatcccacacaccgcaactaagagttaacatgccaaaattaagacccagcatgcca

SEQ ID NO: 24509 - DNA, 1233 bp, Bovine  19866880761316
tctgctcctaaaagctcctcagcaaacttctcttatgtcttattggcttcgattgggttacatataaaacatcttcaaacaattgcaggagaatgggattagtttagacctatcacctggggtggtgtggctgaattgggaaatcaatggctgggacaccaaggcagggacacagggaattcctctgatggctgccaacttgggctggagagctcccaagagccccagactttccccagatggcaagacaggttaggatgcttccactcgacctttctttctcccctttttcctctgttcaaggtccgatgctctcccagcctctcctgcccacttccaccccatttgtctcttgggcagtttccctagtaaagtccttattgtgttggcatctgtttctaggaggacctagattcacagagtgagcacttccatgatctgggccagcctcacctctcaccacttgcccgtaccccaggccccactgcatgagatatgacagccaccctgaaacatagacagctcccccttacctcctagttttgcacatattgctcctgtgctctgacaccaaccccacctctacactccctgtttgactagggtctcatttcttctggaaatctttatgttctgtccccctacacacacatacacatcaaggttacatgcctttgatctggacacctagactcttcccaaacctccatcactcctcagtctgtgttgtaactcttgacccaagtgtatctccatagaaaatcaagccctgcagggggcaggaccatgtcttctcatttctcctatttgtttagtacccagaacaggccccaccacacagtgtttatagctaatggtccccttgtcttcctatggccccagtacatggctgggaagagtccctgatacggctctgaaagacatggatattatgcgttcagcattagcctggtttggatatagaaggatcagaaaaggtcctatggccccaagatccagctcgagacctggcagcttggctgttcctccacttctgcaggaacaagtctcagccccagggaggctcagtttaaatgcctgtcaatcatgctctggcgaatccgggattaaaagatccaagctgacaggctgcctgttcaaagcagaaaccaaccaggacattaaggagaagttgggtgtagaatatgcaacagcctggggcttatgaggggcagggcttctgtatgtgtgcaa

SEQ ID NO: 24510 - DNA, 3996 bp, Bovine  19866880767338
ttcgagaagaaattaatactcagagtcggtgtcagccctgccgacagcagatcaaggctgaaagacaaattgctcattacagttcagggaaccggagctgggaggagacagccgagccatcccctgccagctccaggcggctcccgctggtgactgactccagccggggactccccctggcttctgcctgccttctgaagtttgtgcagggggtgcaggggactgactctgggcaagcagcctgttaggacttccttgggggcccctcatcagctctgtttgtatcatgtcaccagcgtgacacaagccagcgctgtagaaaagctgcctgtcctgggccatcgcggtggccctggctggcagcaaagccaacaggaaggcagagggacctgggaacaaagagacatcaaacatagacacagtccccaccgtctgccctcacttcgcatgctctttcactcttctctgattttattaatttatgaagccatatctgcttgacattcaggggtatcatgttttcttcactgggtcccacacaaccccggacccaaaaggaaagctgatgcccagacagcgctgcacatacttaccacatcccctggcaaggggctgcatctgttcagagagagggtgtctctaattcgcacaaagatgctgctgcttgaacatatgaaggtcctggagacattatatttgagacctattgacttgtctccccaggtagaatataataagctccatgagaggagggactgtgtgggaaagactccgcttgcctctccaggttcactggccaccccacctcctccctacctactatgtgccccagggtgggtgatgcaccgttggccctggttggattcaaccaacaggaggcaccattaggagctcaaagggcaggggaagggactggccagagaactattcttggtctccttcctgtcctgctgacgtggtggctcatgaatcattgtacagcctccctcttgggttctggtcactgttcccttgctctgccccttctcacatctcggagaggctccctgctgctcctgccctggtaggtgtctttgcctcctgcccgcacctttgtaaacagtccctttattcaccattcttcaaattccaatatgagtaccccatctttttcctcctgggagccccgctaggatttgcttgtttgttgccaggtggccttgtgcggagcaactattaatactgaatgaatggatgctttttttttggtagtatatgtgagttttatttcttttttatgggaacttgttttaactttttattttgttttggagtatagctgattaacagtgttgtgatagtttgaggtgaacatgaatgtatgaattctggagccccaaagtggggaccggctcttggtttttcctggtgctttgtcaaaggctcactggtatcttctttattcagttatagcacagttgttggaaactggccaccaggactgtccctcctcatcctttcctgctgagcagaaccccaacatcacccccactgccaaccctttatttcagagacaacagttaaaactctgtctgaaaagttttgctgttctctctcgctgggaatggggtggggtaggaaataagtgaaacacttagcgaagcatcctttttgatttccagaaaatcaaatgtttcctccaccattctttccttttacacctgtcggccagacctcatctcctaagttagcactaggggtgctacttagcctggaaagcgtgaggcagtcacaggaacaacagggcgggtcagtctagggagacttggtgcagtggcagcagaggcacgcatcctccggaacagccattcgagggctgttgggcgtgatgaccgggtggcggcattccagccctggagaccatgcaggattctccctgcagcattgtgtgggaatgacactgtcagaggagacaataccttcatagcaggacgacagcaaccttgaggcaaatggtatccaacccagaaaacggggcccaacccacataggccacaacgaaaggcagtcatgacacagcccaggcccacaacactgtcatgaccatctgagcatcccaggaatcctctcccctgtggaaagtcagattcacatggtgctaagtggctgcaggagaagggctgctgcagggtgacacaggctggatctttgtgtaaagaattctccagaatcgtgtggacagcagcccacccactgccctttctctccctctcctcctcctctgtctctttctgtgtctcttacacacacacacacacacacacacacaccccaacacaaatgacgcagccctgggggcgtccctggttgtccagtggttaagactccatgcttccactccagggaccccgcgttccatccctggtcagggaactaagatttcacataccacacagcaagaccaaaaaaaaaaaaaaagcctacgtacaaatgatgcagtccttccacctcccaaacccagtcccacagagctttgtttatactggcattactcactggacaagcagcttttgattaaaaacactgaactctgcccaagtaattgtgctgcatacaaggaaaacatttgagggcccaaggagaagctcctctttgttcccaggaagcctgaaatcatggtttaagaagaaaaaaaaaaaaaagacttctggcttgcatggtctgaacaaaacatattctgccacatttttctataatgagcatgtgggatgttttctgcacgttatttttaatggcagagatcataaataaaattcactagtattgccagaaaagcattaaaaaagtaaaagtctcctttaagtatcaccttctgtctgtctccagctggagatcaatatttttatgtatgtggtgtggctacctccatccactttctctatagatatgactgtaaatatttatgaatctttacacagattttgttttgaggattattttgcgtgtcataaatggggttctcccatatgtatagtttcagaactttttaaaacttaagaatgtatcttggagatctttgcatggtggatccagagcataaagactaaccttattgtttttattggctgcctggaatttggtagtgttaccgacccataatttatttccctaggtccctgccgatacacactctggttactcctaatatgtcatcatggtacgtggtgctaacaataaaatgctggtgcattgactatctggacatatgagccactatttctatatggaagaggcagttatatcaattaagatactttgggcttcaaggaaaagaagactcaaatggccaaacaacaagggctttattttctcatgttaatgagaagtcagatgagagtcagttccaaagatggtaaattcaggggtatgaagccatcatcgtggacccaagtactttctctgccacccttagtgagttgggaatgcctccctcatagtcacaggatggctggagatggcctcagtgacacatgcagccatatcttcagctccctctggtcccacatacaccagttactggtgagtgaaatggagccaccatgactggcctggaccattatgacttttcctcaggggcttggaagaagaagggagagaaaatggattttattaatcaattgcttgatagctcagttggtaaagaatccacctgcaatgcaggagatcccggttcaattccttggtcaggaagatccattggtgaagggataggctacccacttacttcccttgtggcttagctggtaaagaatccacctgcaatgtgggagacctgggttcaattcctgggttgggaatatcccctggagaagggaaaggctactcactccagtattctggcctggagaattccatggactacagtccatggggtcgcaaagagttggacacaactgagcagctttcactttcactttcactctccagaaaacatgttccagctaacagcctgccagt

SEQ ID NO: 24511 - DNA, 1071 bp, Bovine  19866880793468
gatggggatcgcatttgctcatatcccattataaaccagtccagatgctgatgacatgtttgaccacacctcactgccctgcagcccccggagagggggaggaaaagcatgatttctgttctccttcccctgttttctgcatctacaggattcagatcatagctgccatggaaactgtgcgttggaatttctggagcccttaattttaacttagcatagaaaaaacacttttgtgctgattttataattattcacgacaaggagaaagtgactaaatgtctcctgacagtgagggaagatacagcaacgctttcttctttcttcctttcttcttgctttcataaagatacgagtatttgaagtacgttatggattcaggagtcactcttccgtcttttgcagattccgatatcatagctgagttgcaagagctccagccttcagtgaaggactttgaagtgagaagtgtcgtaggctgcggtcactttgctgaagtacaggtggtcagagagaaagcgactggggatgtctatgccatgaaagtcatgaagaagaaggccttgttggcccaggagcaggtaggagcatttaacatccagcctcccctgtctgaaccagcaggttcattgcagagatgaaaatctgctgaattgacacctgggatggagccagttttcctctgcatccctagttttaattactgtggcgtagccaggaaggtctgagcatgctttcttgaactgatattgactaattttgaagattgacaagctcccttgggttgcttgatcatgtttttatagttgcatattattcagaaccaacttggccttttcactaatgaatttgagatgatcttttgtgaccatccactgggaattcagagatgtgcatatcatgcggtgagttagatagcctttgcttttgtacacatcttatatatttgtgttgggggcctctgtacttgattttttttttttttttggtatttggttttaaaacaggcctctgaagaaattaaattgttctgtggctagggagttgccagtctgagaggaggtgagaagttat

SEQ ID NO: 24512 - DNA, 803 bp, Bovine  19866880801043
tgccacgttgcctttgcacttgctgtccttcttcctggaattgtattcctcctgatatttgcatggattgttcccatctctccttgagatgctcctatctaactacagctgtgatttaaatgtagaggaaaatgcctggagggtgcaccccaaatgttaacagtgctgctaacccttgaggaggagagtaagattcagaaagcctcagggcccatgattgtgcctacatctgtatcatttgggtttttgcatgtgcaacatgtaaaacatatgttcccaagtaagatatatttttcaaaaagaagccagtgcttagactcaaaagtgtgcaaagctgctagtccatgtcagcactgggtgaattagagtactagccattgaagagggaagcccttgctgaagaggctctacgctctcttctctctctctttctcttttcttctcccctgccatcccccccgcaccccccgtcccaccatctgtttgtctgtctctctcactctcactcactctgtctcttgtacacgcagagcctgaacagccagcagtcagccacgagcatggaggatggacctcatccacacacaccccagaggagtttttgaggaatggatccttgacttcagactgtgagatcttttcctccaggactctccagaggcaggtccctggcaaatgagctaaaaccagaaagaacagcaggcaacaacaacaaaaaagtccaaaatttaggaaacccaggcagcaaagccagatcagctgaagccattgatttttttttttttaaagaaaatcaagcctca

SEQ ID NO: 24513 - DNA, 1368 bp, Bovine  19866880816959
ccagtccatatggttcagataggattggcctcatattccagatacaagattgggcatgtgaccctgatctaggccaatgggtatattttgtcctccagggggcacagtgattggttcaggtgatccagtgaaactctattctaggagctgattggttggaagcttggagtaacagggaccatctttcctatgagagagttgccaacaaagagaaggacaggcgggagatatagagattgagcctaatgacatgcttgctcagtcgcttcagtcatgtctgactcttcacaaccctacggactgtagcccaccaggctccccttccatgactggagagggttgccatgccctcctccaggggatattcccgactcagggactgaacccgtgtctcctgcatctcctgcgctgcaggcggattctttacccactgagccaccagggatgcccgatgacatgcttaaagcccctgaattgagctgagctcgaaaatttcttcaatagtggatgcttccattacaggagcctacagattcccttttgggcttaatgacattttgatgtgaggttaaatgatttgtaaccaaacacatactaaccaatgtaattttgccccctccctgcccctgttaatatacctcagtcactcctggtggcctacagtaggaacatttcaccaggaaaagagaatttctatcaggcttcctgcattgtctcataagagcctggtttacagccccaacagagatgctcataattggccagtgaaagcaaggagccagggtggtgaatgtgtgccaacaaataattcaagccggcagaactcttggggttttataattatgtggaaagacctgagatttctgtaaggcaggggtcagcaaattaaaattctcccaggggctcagggcttctgaatgctggtttctgataatcttgtttatgtcctggggtaaataaatccgtcttttgttctgtgttattcaactctcagcactgtttgtaattaaaggggtggagggtggagaaatgaatgagttctttaattggctctgttctgggtgacatagagtaagacaaaaaggccctcatgggcgggagggggagttgggggtggcctgctctgccctgggaaacggtgataaaacccggggcagctggtgatcaagtggcaaaggggcggaaatctatcgtcattagtgtgatcaatgagcacaggctgcgcctctgctggcctgcgccagggccctcctgagacacagagagaacctgagcaaatgtggctggtttcagaagtcaccccacccccactcctctagtcaaggataccctggcggcggtattgcttatcccacactccatctccta

SEQ ID NO: 24514 - DNA, 1886 bp, Bovine  19866880817319
agaggagaaaaggaaagaggctttgcccaggattcctgcctgtgctcaggaaattggttgcagacactgacaaataccttgagaaaaatgccttgaagggacttcccgtgggtggtccagctgctaagatttcaagcttccactacaggggatacaggttcgatccccggggaactaagatcctgcatattgcatagtgcagccaaaaagtaaatatatataaatatatatattttttaattaaaaaaaagccttggaaatcttaacacttatagagaagggttatagaagggatacaaaacgctctgggttaggtatcaggttctagccctgattctgccactgactgtgcaacctctggcaataccctcagcctctctgggccttagtttcttgaactacagaacttggaggctgggaaagataggattagaatctcttaggagttagcagggatcagtgctgaccaatgaaccatgaggggaaatctgttggagactttgggccaggtttcccctactcttagaaaaaaggccagttcctctgaatgtgatcatttctaaatagaacaccaggaactgcggtgtttgtggaatgcttatgacgggtcaggccctgtgctagactaaatgcattaagtcatgtgatcataatggtaaacttctgaagtattaccctgatgcccattttacaaataaggaaactgatgttcagagtggcaaatgttctttcccaaggtcatgtggggagcaaagggcagagatgggattggaagccaggtctgtctgactgcaaaattagtgatcttaaagtcctcctctatactgtctccgtgttaaaaaaaaaaaaagctaatccagataagcccccttcctctcactgatccatattcatgctgctcagaaccaagtaattggggctgccaaagggtgctgagaagccatgctaatgagcttgctcagctcctcttctgaaactacatcccctgctgggctgtggggcctcttccgtcaatattgacgcctgtctgagacactcggaagctgccatgaactggggaagcagctgctgctgagattttaagagagaaaggcagaaaagaaaattacaacccccctaataacgccaccgcttggcattgcagacctagcaaacccctgcacatctggagaaactggggaaggaaagtctagatgaaatgccagttgacctgcgagatgtgcgcttgggttcctgcacccggagtctattcccctacctgtggagggctggggaaatctgtctggcaaggggaagatgcgtctttgccaggcgtgctcctgggggagctgagattttaagttctgcagcccctggaggggcaaagtcgtgtttctgagtgggggcagagggggagtcagaaagcaggggtttgaaacagggctttttaagaaggatggtgtaactgtggagtcagaccattctaggcttgaaccccttagtaagtgagttatcctttctggcaaatgggatttattcactcaacaaatatccatgcatctggagaacagggcagtccagtcatgggcatataggtaaaatgcacggagcctgattgcttccctggtggctcagatggtaaagagtctgcctgcaatgcaggagacccaggttcgatccctggatcaggaatatcctttggagaaggggatggcaacccactccagtattcttgcctggagaatcccatggacagaggagtctagcaggctacagtccatggagttgcagagagtcagacacgactgagcagctaacataataacataaaaataatatggaacctggtacctaatgtgtccttaggaatgcagaaactccacaggatcaggcaggcgtcatcaccc

SEQ ID NO: 24515 - DNA, 933 bp, Bovine  19866880832018
caggaactccagacccgatgtactggggagggaggatgctgaactgccgattaattatttaaaaactgatttatttaccacggtgagccatttgcaaattcaataataaatctattaaggagcagttaacctctatagctctgttttaaataatcaattggtgtttgggtaacgtagagcatctgtctcattaggtcagcattggctccttatttgaggcattaaacctgaagtgcaaccaaatcagccatgaggtggtgattaggtattcactgtgggtccttcaccctcccaggaactggatcatctctcagctacaacagcaccagttggcggctcggggaaccctgggtcctctaatgccttgttctatgttctcctcagtgcctcccacagcaaagacttgacgccactaccttcctccagggggaagaaaaaaaagaagaaagctacgcggaagaagagaaggaggtgagggctgcaaggggccacgaaaccctgaagatggaggaagggacaaaagggttcttgagttaggcagtgactcctctgggattcagatcccctctttgcctcttaacttgctgtgtgaccttgggcaagtcacttcacctctctgagcctgtttccatttctataaaatggtagaaatacctacttcttggggttttgtgagtattagacaagaaagttgacgtggaagcagctgtcacagcgtctggcacatagtaaatgatagttaatatgaagcatgaccctgaccattagtatttacttctttatgtatttttggagaactcacttcatgtaagtgccatgccaggcactttgatctcacatagttctagttgtttttcttgtgatgagaaatcttaagatctaatcttttagcaactttcaaatgcacagtattgactctagtcatcatgactt

SEQ ID NO: 24516 - DNA, 1433 bp, Bovine  19866880856594
gctatagagtgtttagaagtataatggatggttttctttaaacattcagaccagtctcagctcaggtgacacagtgggctcggttctggtccccatcaatataccatgcttagctgtgggcaagagggacctctgcctgggtctcctccagtgacaaccattcccatgggtggagaaatctgaggggttacctggaaacctttccttgagatttagtctctggagacctgaagtccggctgctgagtccccttccagggtctcttcaggctctccatgatctattctcacagggatagaccacgtttcaagtgtgcacatttgtaggtccaaacatggctatctgaatggaatttggatgttcggactgaggtgtccatgtgcatgtgtgagaggtctgtcatggtgatgaagcaagatgtagggggagaatgggagggaccagggcgctggggcagattctctccacactgtcatgttgtggtccggcactccgaggggtccaaggctctaaatccaaatctgactctcccgatcatttcaaagacatgtttgccaagataggagaacatacttcacctaagtgtgctgtcttgatttaaaaacatttagtgtgtggcttctcctgtactcttgtcccaggccctgcaagtattagcataggtctcgccatcaaaagcctacttcccccgccccgtttctcccatgaactttgagtctaaagaaggggggctctagggatttcttgaggaaatatttctgtattctcagcaactggtcatgagcatgagatacagagacactgaaacagtgagagtaatagcaatggctccaccagctcaggatatcagctcctggagttggggaggcagaacttcctttgcagattctcccaggagactttgcacaccgacaaggtgatggtccaactttaccaacttttcacccaatgcggctgccacttcccatttgacatctggctacttttgctctcggacaagggatcttaaaataaggttgcccaagtggggctttctagtgtgagatttcttttaaaattaatgtaaagaccccttttccattcagctcctttttgtcttctagtttgcaggttggatgccaaatctttaccacctctgtgagttcagtggtcacacgtgtatttccaccacctctgtcaggaatgagaaagcatcacacaaggcagttggaccctgggacctggactctcaggctggggtttggtttgagctcatggaatctttgcctcagagatgataagtgtttggtagccagtgtatcacaagtgattcaggtaagcccttcctgaaggaagccaggctggactatgaatataatggatttcgttatcttgggcttgctacctggaggcatccaggccgggcttttctccacccaggtactcgtttccac

SEQ ID NO: 24517 - DNA, 995 bp, Bovine  19866880867944
ctccaactttatcattggtaaccatagtttctactgttttccttgaagtgacagtcttgctacattcatttttgagaaaatatctgccaaatacccaaatcagaataccacagtctgtcattcatttaaggaaaagtgatgttcccccaaaaacatgattagttcaatccctaagtcaaacagtggtacaaaggttttatctcaaaacaacaatgtacttagctatacaacagaagtgctttatgggtacttcagtttcatcacatggagtattaaaaagatatttactcaaggaatgggatttaataaaagttatgtttcatcacgcacattctcaaatgaaactagcttctttcttcttgtgaacaaatagtagtgaagaagaacatgtctatgagtacactttggtaccactgccatgaatcatgctaaggtatcagtaatgttatccacactatccttttcacaccaccaagaccaacatagtgaaaaataaaaatagtattatacagttagtattatgtttactaacatgaaattatgaaataaaatacaagattatgaaattagctttactgttgttgataccgttagaattactatcaatgcaattattatgaaaatagtgctgactttgctgaccctctgaaaaggtctttagaacctcaggagctgatgaaccatgctgagaattgctgatttagaaccattcaggacgagtcaaccttaaactaagaagaatgaaaaaaataccttcccacatggcacttagttgttgtcgctgttcaatcactaagctgtgtccaactctttgagacctcatagactgcagcatgccaggcttccttgtccttcactgtctcctggagtttgctcaaatccttgtccattgagtcagtgatgctatctaaccatcttatcctcttttggccccttctcttcctgccctcaacctttcccagcatcaggggtcttttccaatgagtttgcctttt

SEQ ID NO: 24518 - DNA, 2187 bp, Bovine  19866880878730
tttaaaaatctcacatatccaggagctaattaaagccacccacccgttagttacctgagccacgcaggactatcacagacaggatgctctgttcctctcattgcatcccaacaggggagtctcagttgcggcttgtcacattcctgaggatgtcacgttggtatctgccacctttcactgcaagttactcctttcctctttgtaattgcataggtattttggaaggagatactttcaaactggggaagtacctgtttctgataaaactttcaacccatccatttatttatatctgtatgcacttgcgtttgcctgtcaatgagttacaatccattcctgtcagtatatgtttttatactcaaattgttcccaagttggccgatgagaatctcttcaggttggcttttgtatatccttttgacatattccccatctttgaattctgtgttactttttgatacaaggtgtttgggctcttaaactcactttacctgccccagccccacagtcagtcatttctctgggagccctgcattttgttatttatttatttttttaagtggaaaacagtatttagaggccaaggtctgggcacgaggtgttctctttgctatcaggatgtcattgctgccagactccattcagtggacaaggccaggaaatacatgtacgtgtatgcagcatacctacctcatacacacgaacattaacatctgtatttatttctgtatctacttgtgtatgttgaaaaccatgtattcacatcagcatctccaagtcctctccagcttcataaggtttgttatcattttcaccctttccatgtttgtaactctgatatcaccctcaatgttttttacttatttaatgcacctgtgtccatctgtcaactctaccttgacaggctcagatgctctaggtcatctagacctagattgacttcctcaccatacgtgagcctttgataccccacattggtctgctccacatgtggttgcttccctcctcaccgtgctcggacctgtcaccctgttctggactaccatggctttccttgtcacttgtcatggatgtttatctggttattgtccatctcatggttttaggactgaattgctcagtaagggaagatgaagagaaagatttaaatttcaaagatgttggtcgacttcgaagaaagacattaagtaaataactggacactattgtatggatctggcaaaaattgagcaaagtaggcataagaatgagatttgtggaatgttggactatgtgatggctttttaaaaaagaaacaaaactaggtatcagtttaagcttaaagggagaacaaagagcatttcccccatcacacttagttctttataattgtcttaatagtttctattcctcctaggtctcatattttgaggaagaacagaacatattatctcagagtacaagtccttggatcccccagttgcagtatgcctttcaggacaaaaaataacctttatctggtgagtctttccatccatctctgtagaattagcctagtgttgcaataatcagatagcacggctgtgtaattgaatgtggttcttggccacatggcccatgacacttttcattcattctcatgctctcctgcctttcaggtgtcttcttgttctagtcctaaagatgaagacctgatccatttagaaacagcccccatttattgctggatattgcagctatggctcaaagggcaataaagagaagtcatttattggcaatagtctgatagtacctttaacaaaatcttactttaaattttaaaaattgagatagagcatggttattataagaaaatgcaaacactgaggaaatgtatgaaataaaagagaacatgcttgacctttctctctaatcgctgtcccctgggaaacacatgttaatggttatgtatgttcgttctggctcttaaccatgagttgtggaaagaatatttctgtgtctgtgcctatcacacatgtatatagtttgtttcacaaaaatggtgtgttactgtctactctgctcttcaacttgctttttgcctttcagtaatttctccctgacatcttttcatgtcagtgcatgcaaatctgcattgttcttttgagcagcaccatggttttcactgacgtgcatgtagcataacttacagaatgtaaaattcatttt

SEQ ID NO: 24519 - DNA, 922 bp, Bovine  19866880909324
cgcatctcgaacatgaaagcgttgctgggagctttcatattccgtgttgtctccgtgtaatttgttcccttttacatagaaatatatggtattaactgggggatgtgattagaatacaggcggatgctcactttgatgggaaacacacaggcaggcgcctaacagccgctggagatgagagacggtctctctccagtaaactcacaaattgcagggcccacagtctgcctaatgagtgaagagcgctggggccgagactgcaatgttccagagacccaagcctcccactggggtcctggcctcacagtaacagtaataggctgagaagcaccacaagcccacctgttcctgtgtgctgcctgcactcaggtgctgtccacagactcatccgtttcatcctcaagcaaacgtaggagggagatgatccaattgtccccactttagagacaagaaaactgagggtaaagaggctcaaagcctgggtcaacggtgtggagccaggagctcctccttccttttactgaagcccttggttttatcctttgctgtatcctgcatccacacctcgcaggggacagggagcagcagtggggtgtgggatgagagcctgcccctgctggaaggcctgagagaccccactcccacacagaccaggagactgtgctctggagagtggggtgatgatcccagaggaaatccaagtagtcagaatcttaacgttcctagaatacatgcacccattctcctaatttgatggccaggaaaacgggtcctgagcagggccagtggggtctgtgaatgtttcttccatcaaacatgcccttcagggtatacctgtggggtcaaggtgagcagccgcagaagacctcaccaaggtagtaagagaattaatagcaaacacttgtactcgctgtatgccagg

SEQ ID NO: 24520 - DNA, 1000 bp, Bovine  19866881007822
acagctgccacccctcaacccaaccagccagtgttccttctcaatggtcctttccaaggccacggggctgcagcgacagaggtctacttacggcagaaccaaatcccccatactggatatctgacagccttttggctggttggaatttatttctttcttcctcttttagtttctccagttgttgctgcctctttttcaaggcactctcctccttcaggatggtgaagtatccacggccaatcttcacccactgaattaaggtgctgaagaaaagaaagagggaggaagatgggctggctatcaaggcaatgtcttactatcttgggactgacagttaactgaaggacactctcaggcccagtagcaggagacttcctgtctttagaattccaaagtcacagagttacttaccctaagcttgaattctaccaaagaccacctcctaccaaagaccttgaacaaattatctaacctctccaggttttggttccaccactcaacaaatacttattgagtgcctgctatgtgctaggcactctgctaggtactatgaaatgagaataacaattcacccccttgaggaccgatttaattggcagtatttttatttgttttgtttgtcatggtttgtcttagattcctcgacatgtggtatttgagttccatacacgtatgtcactggaaggtcactggcaatcttttcctaagtgtagaccctgcttctcaactcgtacacttttctgaatttctacgctacatgccacattcttaatctctaaaatggggttaatcatagcatctatctcataggaacaatttgaaattttcacaaaaatttggcaggcgaggatcaggtgtcatctgtccagccacgttcttgtcacagcaaaataatctctcaggttcctcatgcataaaactgcgcaaaaccaaatgactgtgaagccagattatacataactggcccgaattgtccatttgggcttttaagtttagggag

SEQ ID NO: 24521 - DNA, 1677 bp, Bovine  19866881007913
atagagagtgtctggctttgtgtctgttaacagtggccactccaaaaaggctagagcctctctaacccttaataacaattcactgaaagaatgaagatttcccctcctcagcatgcagagtgttaacttagaacctcaggctgttagcgcttctctgatcttggcactaattacgtacagaaatcattttgtctctgccatgtctaatgaaagcgactgtacagaaatgggatttatcatgatatgtgttaggagagttttttcttctttaaaagactacctcaatttcccccacttttcatttccccctctccttgccagataatcaaatacaaaagttatattaacctccccaaccacttcaattaaaacgctcatccaaaatttgaaaacaattaaaaaacccattatctcagatttaacgttctctgattccatgtctattttctgccatggcgtaaacggcaggtaacgttatcacagtaggtgccttctggaaagctttgcctcgttctccgccagtcagtcccgaggctgctcgcccggcacgggccttattaaaaacccacatgccctggtgtactttcgtcatgtccaaatgcattgaaataattgattgttttaatgagttctccatctgtctcattttcttctgtctttctctactcaggaatggatttcagagagagggaaggacagatccactcttgggaggtcatgggctgaaagatgtgagggtccttgacttggatctattgccctggggttctgcataccgtgatgaaattagaaatggttcttccaaagaagagcatgccatgaggtgtgttaggaagctgtggtggctgcaaagaacacaagacccctaaagatgggtcaagagaaataatgctgtagtcactccttgtgacttctggttgtgtcaaacaatatgtactgtgtgcctgttgtatagtaagataccatgccaaatagcagagatatggtctccaaggcctaggagattcaataaaaaataaacgaacaataacaaccagcaaacaaaaaaccaaaacgcaaaacacaaaacacccccctccacaaatccccaaattccttggatcagacacattcatacactactcatggaaatgtaaatttttgaaacctgcctggagtataatttaacaataactatcaaaacatttaagagatatacatgcctattcacctagcaatcagccttctaatcatttatgataaggggataatcacttatgtgtataaagatttaactacagctgtgttctgtgcaacacttataaaagcataggggaaaaaaacattggaaaatctaattgtccaatgacaaggaattatataaactaatgacatatctttagaatgtaatattatgaagtcattttaagagtatactagagaagaaaataaattgaaggagtaaaaatgaagactgtgttgttagttccctcaccagggattgaacctgcaccccctgcattggcagctctgagtcttaaccactggactgccagggaggtccctgggtttttaaatgttttgaggatttacggaggttaagctcttaacatggttcctggaatatggcaagtactcagtaaacctttagctgttagtattaacaggaacctgcccatctctccataaagcttctaa

SEQ ID NO: 24522 - DNA, 1349 bp, Bovine  19866881014196
ctcatttgtgtccaactgtttgcgaccccatggaactatacagtccatggaattctccaggccagaatactggaatgggtagcctttccattctccaggggatcttcccaacccaaggatcgaacccaagtccccccattgcaggcagattctttaccagctgagccacaagggaagcccaagaatactggagtgggtagcctatcccttctccagtggatcttctcaacccagggatcaaaccagagtctcctgcattgcaggtggattctttaccaactgagctatcaggtgccagtgctccaaagccaaggtgatatcaggctgggagctgggccctgacctgcacagtcctgtctcacaggcaccctgcagacagtgacttcttgtgttcccatcagatctgcagaagctcctagagatggttcgggaagatgcccggagaacaatcaccatggaaaatgagatgcaaagacaggcacccaggtatattctcttgctccctggtcaaataaaggatgtcagcatcagagtgatatcgttcaggccagcagtgccccgtggttgaacattttctctgtgacaagtgctgaaccgtatactttgttcacatatatcacctccctgagtccttccaacaaccccacaaggtaggtactgttgtctgtattttacaaataaggaaatgaggttcagagagggtaaggaacttgtttcaagtcacccagataacaaatggtaaggcaacaactcaaatcttcaactttcttattccaaaaacttttcctttaactactacgctgcccttcttcccaggaacccaaaggttattcattcattcttttagtgagtatttatgaatatggatggaccaactgtacttattattgcaggaagtgttatgaaagaaatctcagacctgtaagaggaagtaataggagcatctgatctcgtctgggatggggatcagagaagctccctccaaggaggaaactttgagctgagattttggatgaagcatgaagaagagctagctagcccaagttactagaggagcagggagagcgggcaaggggagtgaatattgcaggcatgcatgtgcagacatgctcagaacggaccgaaatgctgccagaatggggtgaggagaggtatacgtctgctgagaccttggaagccacctctaggattctgatttctaaccatggagcaaaaagaatcccttttgaagtttcgagctgacagacagccaatgtaattggctcagagcgtcaggacttgaaccccgaggtgtcctccttccggtggaaagccccaggccctggatgtctgaccctctaaaagccttg

SEQ ID NO: 24523 - DNA, 921 bp, Bovine  19866881062273
taaatgctgcagccaggcacagaatggattatcaacctctctgtccttgggtctgtctgtacttttatcactatctatgtgaccatgggcaagttctagtgtttgaagtcatttggtgtatgtggatctaggctaaatgacttacctaaggccacacagcaagagggtacatttcagagcttggcagggatttattcatcattttcctccttctgactcttgagagtatgttggattcaatgtgaagtctttctccctaggagtctgaatcagaagcagtatgcctcagtcatctctttggtgccacatacccaaggagaattacatcacctgacttgtttagaatatatcacagtggctgttcttgttgtgtgaatgtagatggatcctgtgtagcagtgggtgggtgctggcttatccagtatagaggggcagggctgtgattttcaactgataaggaccatatgtgtctgtcaggtgggtgtatttgggtaggtgtatatgtcagcgtgtagtatagtgcttctaagacttacctggggaaagacttgtgaagtgaaggttttttgataatttaggatgtgcaagggttgagagagagagaatgcagtgaagtacaaaaagggagggtccttagaggatagataaattggagtttggggtgctgtgttttccaaaattttggacccatattattatttgtctgagatattttaggtggccccatggacacagcatgaaataacacataataacatagtgagaaaacgatgcccttccaattcactttctatccttccgattgtcaaagcgttgtctaaatttgggactgctgtttttaacacctctcaatacttgctaatcttcttttcttaacaaaaaaggaagcaggtgtcaggctcagaagcccaaagcaggtag

SEQ ID NO: 24524 - DNA, 1728 bp, Bovine  19866881081284
aaattttactaactggcagcaggagtgctgcaaacacgattctttgttcatcgcaggaagatcccatatttgggtagatgggtggatggtcgggaaagtggagagatgacagattttaagatgtccttctgagttgtgtctgagtctcccctttatttagaaaggaaaaaaaaaaaaaagatcttcccgatttcatcatgtggcaatagaaacacattatcattttctagtatccttattaattctacttctagcaagagtttatttcaattgacaagatgatcaggtccaaacagagcagaaacaaagccttcaataatgaatgcgctaattaccctcctctgagagatggaagcttctgtttagggaaagtaagacttgttttatacatgaaggcccacagatttttattcaaacctttggggccagctgcatttcaaaattgtggtttttgtttttttgttttcttttttggcattttagaatggaaatatgagacaatataccatatagagcattttactcccagagggaactaggacagcaccctattgtcaaacatatttctgcagaaaaaaaatgaatgtttacactaaatggatactcgaggtaaacaaaggtcatcaatagtcttccatcagttcagatcatgttttgctgccaagtaaattatgagtttttgttttgtttgttttcaagaccctttggattttggaactgaataaagggttgtgaactcatattggttttattcttattagaggctcactttcgaggactgactagaaacgagtggacctttacagagaagcagacaagacccggtgtaagcaagcacttcaagccttagtgacacctcttcttagtcccactcagtgggaaagaacagggcagaccccaggtcaaagaggggagcgagaagttaccgatttacctttcaggcagagggaaggagctgctccaatcgccctgagcctccagagtcaggtaatcggtgctctgccctggagctacgtgggcagcgcagtcaagtatgtcttattgcctcagctgtcccggagacaccactggacccactctttttttttttctttttccttttttgactgcattgtgcagctatagcggtgaaaacctagaatcctgaccagtataccaccaaggaattcctggatccactctttttttttttttttttaagatttatttactcatttcatttttggctttagtggctcttcgttgctgcatgcaggctttctccagttgtggtgagcagaggctactcttcattgcagtgcatgggcctctcactgcagtggcttctcttgtaaaatataggctctaggtacacaggctacagtagttgccgctcaagggctctagagcatgggctcagtagttgtggctcatcggcttagctgctccatggcatgtgggatcttcccagaccagggatcgaacccatgttccttgccttgcaaggcggattcttcaccactggaccaccagggaagccctggacccactcttaattggaaactccaaataattttgactttcattaagagagtccagacactcaagggctgggcttctaggcccaaagaacccactgcctcctttagaaaaagatagatgcctttctacatataagacatttcaaatatgacacaggtacctaaatctagccactgtgttataaggaaactacctgtcatgtgagtg

SEQ ID NO: 24525 - DNA, 1240 bp, Bovine  19866881090864
gtggttgttacacacacaccagcaccctctgtggacatgcctctagataaccaaggtagagctttcctctaagcctgtagagcagaggggtgaaggaagggtgataaagacagtggcttttctgccgtccttggtttggcaggctgagtctgtcctttctgccagacacatctaccatggctagaatttaacaacctcatcagacaggctttaacatccttagccaagtgctgtatgtgaaggacagtgtgaaaagagccagacagaaaagccacaaagcaagaaaacaagaaacgacagtaaaaccttccacctggccatgctcctggatcccactgacatttaaggagccagagatcccccttcagaagcaaacaccttattttccaggggaaatcacccctctaagagatgcataccccttggcctcatcacacagtattaaatgaggtgaattattagcagagaagatattgtctttctacttactgtttttaatatctgtttcacctcctgttagaatccaacccaccttgtgccaaacaccttcactgtctcctcgatttttatttaatacttcagccgtcttataattcaaatgcaccatccctggtttcatggccaatttaacatgatactaaaaagaataaaaatctaactgctttcctcctcgcctgttccaccagatgttcggtggcactaagcagccaccgtacgctcacttgctgaattttagcggaagctgacacccagggcttctgtgtgtgcccagttctaggttgactcttgaaggcaatggcatgtcttcctccaaagctgctgatgctttttattgcacatgttttaagggaaacagacatctctgcaactaaaacaacagacgtgtcaaaactgaagctatgatttacccacacaaagtttagttaggtaccagcaattgcaaataagcagagatgagttagccctctccccgagcagatcccagcagagtacaaactatgcaggtgtttccaaggtctgaggctttgctttccagctgcattttgggagacagccgaagcagggtagtgagaaatgagaggtgggatttgggcacaggaagaagctttttcttttgtatgaagttaaacatttctcttggtccctccttagttttcattcattttcttcagcaaatatgtattgagtgacaggaatcaccaggtatacaccaggcgtcattgtatatacggagacaggg

SEQ ID NO: 24526 - DNA, 1626 bp, Bovine  19866881108194
atatcaaaaattgaatttctgttatttgcattgctgtgctgtacactcatctactctctcaggtgttcagtaaagcttaatattactcagatttctttccaacaggtgatggaaatacgactcaaattggattaagaaaaaataagctaggagtgtttattcacttacgaaattgaatacaccagacatgactggattcagggtcttgaataatgtcactgacatttggtatcttttttatatctttccttttttcttggttcattctaaggtattgattcccaatgtgcgctgtgctgtgctaagtcacttgagttatgtccgactctttgagaccccatggattgtagcccaccaggctcctctgttcatggaattcttcaggcaagaatactggagtggattgtcattcccttctccagggtatcttcccaacacagggatcaaactggggtcacctgcattgcaggcagattcttgctgagctaccagggaagccttaatgcccaatagttttctcaaaaaagacctcaggctaattcttatttgatggactgggatcatatggccatctttgaaccaatcattgtggccagggggatggaaagctctgattggccagggctggatcatgtgcttatgcttgaatccagagatagtgtcacattcacatcctcttggcttgaggtggctgaggagtggtttgcagaaaactgggttcacaatgggagaaccaatggtgggaggcaaacacaacatccatgcctgttgacaaaacctcgtgggaggcgtgaacttagtagagagtgagtggggctctgaatggctttgtttgccccagtgtagaaatggactccctgagaggcacatccaaatgatccctaaatagaactaagaacaaaaggaaagtatttctgggatttcacagaaatcttggagacagggtgacattttcctataattttacgaaggatatccatatcaaccttgtctagctcttgaaggaaagaagatccctgaggacatctgagttgcataaatggggaaaccaaggcccaaagaagtttccagatctgtccagatctatttgctagaacctagattgagcacagtctcttgccatggcttagcaatgttccctccacatgactcaagtagacgtctctctattgtgctgcttacattaaagctagacatatctcaaagacttatttccctggactctcctactcttataagccccttgcttgtccttggggctgcctggggcctctgcatagacctataaggaggagcttgtgtaggaacagacagtcaggctccaactctttaggagactgggaacccaggcgtctgaaagggaggcataagatgcagggtccaacaagaaaaacaaatcaacagggcagggtcagtggaataaacaggagtgaccaagaaaggacaaatagctaaagaaagtggatcgatatttataatgtacctcctattaccaagtattttgcatatattattttactcactcttcacaaaaattttaatttcagggaatgaaagggaagaggaggaaaagaagtgtccatcatcaggagccatgttttaaagggcttgaattggctacatgaa

SEQ ID NO: 24527 - DNA, 2373 bp, Bovine  19866881132774
tcagtgtctgtttcacagaattgtaacacaagatgttaacccagctttggcatgctatgccatgctttctctttattcctgtgcccccatgaagcccagaactgctgtgggtcctgggggtctccaggcaacactcaacaaaggtggtgggaccgccaacagctcccagatgctagccctggctctttgtcagttcagcctggccttcccaacactttctgagtactcaggccacaaagcatttgagtgttctccacctgaaaaacgacgtcctatatatcaccacttaagcttaattgtgagtggcttggaggaagccacacatggggtgattttacaaaaggctattatgttggcatatgggtttcacgatctgtggccatcacagcaatggctatttttagcttcccagaaaaggtttggcaggagctatttttctttttttctttcccccttcaatgctggaattggccactgtctggtataacctggccaggctgagctggggatttccagaatgaatacagaactgttaaacaaaactggtcatttaatgacctgcgcactggtcccagacccacccagaatgttctggctgtgagctgagcatcagttggtactgacattaatgtaccaactaattagtggctcaccaccacatacttggaaagaggattccatcagtgggcctggatctccacacacatccagcagggccactgtctgctgtcttgagaagcctgtgtcaagcttgacttgtgcacagggctctgcctgtgttgttttctaggcttgtgccttgagaagtttggcaaaagaaatcaatttcagcaatgtacttgccacttgctggagggaggtcaaatttcagccatgtcctgggaaggtgaagtgagagtcattcagttgtgtccaactctttgcgaccccatggactttacagtccatggaattctccaggccagaatgctggagtgggtagcctttcctttctccaggggatcttcccaacccagggatcaaactcaggtctcctgtattgcaggcagattctttaccagcttagccataaaggaagcccaagaatactggagtgggtagcctatcccttctccagcaggtcttcccaacccaggaatcgaagtggggtctcctgcactgcaggtggattcttaactatcagggaagccctcctgggaggaaggtgtcatatttgtcaagagcacagacagacctaggttcaaatcccatctctgacgctcattaggtctatggccacttaatcttttggagcttcagtctgtgtctgtccaatgggaccaacagcactgccccctttcagggctgttgcaaaggttaattgaggtacttagcacagagcctggtatgcagtaagtacttctttatgttccttggcaaagcagttaagagcctgggttcacagagcagtgacatgtggtggaggagaaaatgtacagaggtaaaacggaaagacttcgaaaccaaacttccctgggtttgattccaagtctccccattgctaggtgtgcataaaagagttgggggttgggggcagggctgtggcaggagtcacactaaatagctgacaacggttacttctacagtaggaactgttttgggatgatgatcaaagacgacatcaaccttacttacagtaccataactgtttacaaggtcaatgtgcttatgttattactcatgtatataaacactgagaataaagggaaacagaactggttattggagttgcccagatttttgtgggccatagagatgaggctttatgacaattggaaactgtcaaattggaaattgggaaatccttcttagtctacttctccacctcctatgacttgggttggaatatcgagggttgccagcccagggcatggcaaagtctctctctagccctaagtccttgcagctacagaccaccccccgaccccttactccgaaatggggaagtaaaccccactcctagctactggtgctccattgcctataacgcggcccgctgttgggaatacagggtaaactgcttaaaggaatggaggtgaggactgaggctggaccgaaaaaagccagcatcctgaggtgacttcagccttgcacttggggcaagcccctgagagatttaagagcaaagcactggagctgtggacactcactgctgggacagccccgggctggccgtttctgcccaactcctcccacaggcaggctgcactgaagctctgcgttgggctggccaagatgctcagagctgcgtggaagcctcacgtgttccctccttaatccatcttcttcccctttctccccagtgtcagacctcatcacagtctgaggctcgcc

SEQ ID NO: 24528 - DNA, 1382 bp, Bovine  19866881155271
atctgggtggggggtgatggggagagggggggataattccttttaatcccttttacttttataatacacaggatcaaatactgtgttaaaaaagcagttctaaatgaacacttgtatttttgataattctgtgattggaagtatatttatagaacatagctcttagatgtgagatactttctagcctgcctggaaattgagatttttagccatagatctgagggttgtaggtaattgaggcccagagagatcaaattcatttcactgtgtaataacagctagcaattactaggcatggctcatatgccaggctctatgttaagcttattttatttaatcctcacaacaaatttgagagcttggtgaggttaataagggtatagagagaggaggctcagagtggcacagtgacttgcccaaagttaaacagctgttatgtgcaaagttgggacttgaacctcagtcctgtgctcttacccactacttcatgctggtatggatcatctcccagtgctattttataacacctgcctccccacctgcatctgatggctatgtgcaataatagcctccagttttactttaataaccagtactgcacagcttatagaatccactgggtaagacacaaccagaccaatgtctatgagaagcatgatctcatgcatatttaaacttattaaactttaaataaaccacgtcatgcacactgaaacatggattggagagggaaggattgtgttctgcaaccatggattaatgaccatgtgcaaacgttataactgaactattgaaatggtcatagaagggtccttaacagaggccaccttccccagcgcctgtccgcgtgcctgttaatctgagaaaaaacctctcccaaaaaagagccacgagttcatgccttctctttattctagagaaaggctgccagctggctagtgtcactggaaataccaggctcaaagagtgtcactgggctcttaggtgacactatgggcaagatttgctccgagctcttgggacctttacagaaagggtgagactccctcagttcattgagtggctttgtctatcctgtgtcccttcaaggtcctatgaggacacttcattagggtccactgagtggctggatggtggtggctcaggccatggatttcttgcttttcttttttcactctgaaaatcacatttctgatttttggcaaaagataaacaccatcacagcttcctcctccagccctggcctttctaagcaggcaggctggctgcaggatttctggtggactgaaacagcagggtataaccacacttcttttgtgtaagccaacaaactcccactgagtactgaaggtcctgctcaaaagccacattttgggggaatt

SEQ ID NO: 24529 - DNA, 1252 bp, Bovine  19866881168727
tagacaggctttaagtacatggataatgaactcagaattccaaatgaacttcaacctattcctctgtcgttctctgtttgaggtgagaaagttttctttgaaggagatgcagagaatttcatcctttttttcctgctcccagcagaactccagggctggcccaaacctgcatggtgcgaagctgacttgccggaggaagaaggcagatgcttcagagggaggttaaggtgtcggttggacacgcaagctctggaattccaaaagccacacgttctagtcttgcctctgccactaaaccatggtgagagttaaaatcttaggggcctcctcgagtggataataatgctggccactggattattatcaagcctggataaattaaaatagtaaatataatgtattgtgccagtcctccatggcagctgtaaagaaactaccctaggaggtttggtgctatgcttatacccattttattgatgagaaacctgagacacacagaggttaaccaacttgcccaactgcagaggtagtaagtggtagaactaggaaaggaaacactgaacaataaacatgcggatcattacaattgcaaaggaaagggtgtgagaagaaatgccacgaagggatctggggtttgggggcaatacctcttaggaatgggtccattccgacaaaagtttttgtcccggtgacatgctgataaatgtctaacagctctgcggggaaaacaaaaccaaaccaaccatccaagtttgtagtgttcaccagtttctgtggtgtaaacactgctcccactgtggccagtttcaagctaccagtttcaagcgacttcgccgagcacagagcgaggaaggaaatctacgcggtcagcccccacaccatcgctgtctcctctcttttgtccccacctgacttctgatcgtctcccttgaaaccacccttcagctgcctcttccgggccacgtccctccacctgtgctactgaaccctcacagaatgtgctggtgcaaatgatgtgtatccgtggggccccgccttacctccccagaggcaagcttttgattgtgatcagaccagtcaaagtgatggggtgtggggtcagggagcaatgtccttccttgagctcagtggtccctgcacacagcaaagacagttttcagctaaatggacagcagtggagccgtggagagaagtggctcggatgtcattaaaatttcatgtactcccgctgcacgcaaaatgcagtggggtg

SEQ ID NO: 24530 - DNA, 830 bp, Bovine  19866881170619
aagtttactctccccagaggaaagcattgatcaccatgataaaaccaccaaaggcttaaatatcagtctgcaagctgagttctctgggctcacgtgtacactcttcccatggaccctgcccactctctgcttgctttgttgtttataccttgtccgtaatgagtctgcagtttgctaaacatcttgcctgttcctcagtgttctcttttccaaccgtctccctttcccccgcccccctcacacttgacagagcatccccagctgttcccctgacgtctgtatcaacccaagtacatttagcaggaattcatttccatcttaatctgattcaaggaagtggatcatattttaagaactaacgaagatgggtttagaacattctttcataaaagacaagagaacaacagacatttcaaagattgcctctctggccttgaccttcaaccaatcattctgatcttctgccatataaaaattcttacaacaaaatctaacaaagctcaatgggccagctttggaggcagcatccataaattaatagctgtcattgctatcccttgtctagcccctgccatgcaaaattgggagcagggtaaagtagtggttaagaacacatgcttttcaacaacaaacagcaacaacaaaacccgattaaaaactagacagaggatctgaacagacattttttaaggaagatgtatcccgatggtcaacagatacatgaaaagacattcggcatctctataatcatcagttcagttcagtttggtcgctcagtcgtgtctgactctttgcaaccccatgaatcgcagtacgccaggcctccctgt

SEQ ID NO: 24531 - DNA, 1930 bp, Bovine  19866881173911
taggcttcttggaggaggtgacatgactaagttttgaagtactgatacaaagtcatctcttccactagaaagtaaactccccgagagtagagactttgagtgtttttttcatggctacacccctaaaagtcagaacaatgcccagcattgcaggtgctcaataaatattggttaaatgaaagcatataaggggctccccaggtggcacagtggtgaagaatccacctgccaaggcaggagatggaggttctatccttgggtcgggaagatcccctggaggaggggatggccactccagtattcttgcctggagaatcccagggacagaggagcctggtgggctacactccataagactgcacagagttggacatgactgaagtgaattagcatgcaggcatagaaaagtaaagatacaggaaaggaatccaggcagaagaaactgtgtgtgcaaaggcatgggatgcaaaagggcccaggacatctggaaatggcaggaagatcattgcagggttagcacaggatgtgggggaacagaaggaccctgaaccacaggctgagttgggactgagtagggactcgtccctgaaggcaatgggaagttagggatagattttaagtggagaggtggcagaatcatctctgtgctttagaaagaccatcctgtctgtcgtgaggagaagaaaacggggatgagggagagatggcggtgctggaagcccagagcaccgtctgttcaactagtttgcccaaagccccccagcaagaatgccaggcttgactgacagggcatgcgacggggtggctgtggacgctggagggaagttcggtccctgcttcaccttcctcggcctcctgctggaaggcacatgatcatgcggaaaggctattaccatcccaccagaagaagcctctgcttgttaaaattctgggccatagtgtcttgtattaaagctgatattaagccataaaatgtaatatgttatgacaccataaaatgcagtgtaattgctatagaaccataaaatgtaatgtaacgggcgccgtgaccattacgctgcttcacagcctaaaacacttagcttccactctgcttttagacaaacaaacaattcctattcattgctacctctggaggaaggtataggaaaatcaacccagatgagcatgaattgtaaggcaaatgccaaaggaggatgcagtggggtgtggaggcaaccccaggctttgtaggaagacagaacctaggtttcagtttttttcaattatgtcttgatcaagatcccaaaaaagcagagccagagatgggggttcagactagatttctcctaaaattacattttgtctaactcctacaggaggaccacaaagctgcacccaaacaggctgggagttagaggaggaaatgggggagctctggcccacaagcccccagcaaggggaaccaccagactcgtgacagcaggtgtgaattgcccccaggactgaactgacatcactgaccttctgagcataaacatggctacttgctgcttcacgcccaacttctgaaacttgccccaaatcctctcctggccaattcaaacacagaaccgtatagggaaggcagtttggggcaaagattttcatttaactaaggtgacactatgtaagatgattctgagaagggaaggcagaggaaacagggagtagaatcacagttggggagccagctatggacggggaagaagggaggcctgtgggtgttcccccagcaggggccaaggctgtctgggggctcaggcagaaacaagggattgctgagctgagggcaaaggagaaggaggagttagctaggtgagatggatgtggaggaagacactggtgtatagaggaggtaggggggagggggggagaaagggtgagggaggtgaggaggagaaaaaggagg

SEQ ID NO: 24532 - DNA, 2583 bp, Bovine  19866881210017
tgatgattaaataagttactgaaaagacaatgatatggaaataataatagcagtttaagtacttatattccagtcttccttctatgtttttatagataactcatttaattttcatcacagtgctttgaggacaacattattattcctattttaaataggaggaaactgaggcacagagtggttaaataagtcacccaaggtcacacagcagagccacatttcaaaggtctaaaatcagctcttgctccctgctccctctctagcactgaatagaaccacttgggtccttaacatcctcttgcaccagtcaacagaagctgggacttagaaccagccaacaccctacattctctaggtgtggccccacacctttaagcaccagtattcttctgagcatctgagtggagaaggtgtgccaggtagctgaatttgggttgattaaatcaaggagaaaatcaattaaatttaaataaagaaaaaagattggaaatcaggcacaatgccttcttaattacagcacctaatcactggctgaaaaaaaaaataaccacagaacatttcatttcatataaggccttgtgtatctaaagtgagaggctcctaatgaaatgtacatttccccacttgactagtaattgactaggcgatcctggcagtttcatgagtggaaatgatcaggcgtaatagccagagcttttaaaggatgtgacaacacaggatgctttgggggcttattgaggggtagttgaccccaagttctcctttccttgcagtacaactcacaattctcccgacagtgaatgcagccactgggcagggccaagtgtgcaatgcagcaggcgagcatgattaaatggcttttttttctgcacagtccagtgtcatcgcaaacacacagagctgggggaagatcgccggcaatcagcgactaaatgcctcaaagaaattactctgacaagcatccctgccatttagatcctggattatagccttctaattggtctccctgtcccccatctccctcattccaatctttcttgtccactgcagctaggggcatctttatataggcacatctcattgagtcacttctttgattaaaacccttcactggaggctcgttgagattagagcagtccagactccctaccctggctcagggaagggatcaccgacgtggatcggattccagcccatcatttctctggcctttgttccctgttcctgcatcctttattccaaacatactgacccagtagaattctttcaaatctttcctgcactcatgatttcatgtctttgcatgtgcagttccttctgcctgaaacacccttcccttcacctgactaacccctgtatcacatcctcccaaaccagtctcccacgtggctagacttgcttttcagactagctttctcctatcacggcaaacattacatggaataatgattgttcacgagctcagtgagggcagattcttaggtctgttgaattgatttctgcccagaacccagcacagtatccagccctgcttaaagactttgttgaatgagtgggagtagacttgccgcgaatggttgccatcatctgcatgatgtggagcttacttcttacaaggtaacacatctagaacatcatctctcacttggtatgctatctttttttttttttggactactaatgagtgtaataaggctcaatgtttgcttgctattttggtccttttagaaggtgggcagtgaccagagctcctggggacatcatcgactcagttaattggacaactagcccccgtttactgtacccctgtgattgcccagcattgagctggacagctgagctttagaacgctgacaaaggtgaagtatctgtggtacaatagctcacagctcagtgcaaagcagatgtgcaaatggatacttacaacaccaggccataaggaaggatcgatttccacaacagttccttctgtagggcaggggactgaagtgcagaaatgggccatagctttcctgaagtcacaagtaggaaaactgtatatcccacctgcctcccctcaagacgcccatgccatctttagatggaggagaatctcccaagccaccagtgtagaagccagatccagtgaagccatttttgagatgggtaagcctgagtgcatttggaagcaggtgaggtttagagaagcatcaaaattagagtttagtgaaagatatagtgattccaagaagttaaggtctggagaccaagaatcataaacaccgggtctctgctccaggtccactgaatgatgttggagagaagttctcttaaaattccttattgtctgcagtttggagaaggcaagtgttgaactactcattgcattcattcattcattcaacaaataccagatatttaaatgagccaggcaatatgctaagtcctctgcagacattttctcattaaattaaagctgattttaaggtattcttctaatttctccccctttgcatatggggaacctggagtcagaaacaaaaataacttgctaaggttgccaaaattaataataatataagagttagcattttagggtcattt

SEQ ID NO: 24533 - DNA, 1310 bp, Bovine  19866881353037
actggagcaggttgccatttcctatgccaggggatattcccaaaccagggattaaacccaccatctcctgctttggcaagcagactctttaccaatgagccaccagggaagctccctccatgattacccgatattaaataacagtcacccctctcacttttctaggccctttacactgattcattctctctataatttattactgatgaataagccatattattacttgcttgtgcatttattacctgcttttccatgtataatccaaactctgtgatctctgggaacacctgtgtcttgttcactacatccccacacttaaaactggcccggagacactgcaggcacccagggaatcagagctgatgaattttaggttagcctcagctaggacaagaatggcaagaggcaaaccttgctggaggctgggcaggaattgcaagctttgagtttgaaaagagccaggacagcattccacacagatagaccagagggaacaaagacatagaaatggaaccctcatcatgggggaaaagtggagttctggaagcatggaattgacggtgagaagggctgggtagaccccactagaatccccatctttcctgggcttgaagcatctcctagctccgcttctaaagatgcactgagaagcggctgacagagatggatgtgttttgctgccctcccttcaatactgccaggcttggcctgcgctcctggcagccccaaggagcaggggggcttatcagatgcatttatcctgagtcataaaaccaatcttgatgcaatggctgcagaagctcgatgcaggagagatgctaatacctttgatcaatgcttgacctgggatctgcaggcagggcgggcaggcagggagggcagcaagcatgcttgctggatgttgctagatccacctgtggctctcagactgctgactcttcctggttaggagccaggagatttgagtgacagccccttcagagactgagtaggcaatttcttttccttctctgggactcagagaaggaggtgggacacaggtcatcttcctatgcagtttggacctcatctcagaggcagaggggagagcttcaagccttcactggaactgctatcccagatgggtgagctcccacctgctaaggacagcagataggaggcttggttcacagagaagtaaaggaaaatggaaatgacacattttaggcctttcctgtttgtttatattatcttattttatcttcacaacaactcaatgatatatggactgatattatcctctattttatagctgagatataaactca

SEQ ID NO: 24534 - DNA, 1277 bp, Bovine  19866881379096
acactagaaaaattcatgtgatggctcatatggctaactggaaaaataaaggaagtgtgacttaaatttgtaacctgtttaagttataaaagagatggtccttatgaaatatctgctcatattctaaatgctttctttgtactaattttatcttaaaaacaatgtctggaaagtatctagctctttgtctctcaaggcacagaacaaactatggcgctctaagcttcttcattgtatgctctccagcatctgactttccttacagtcagagaggaaagagaaaatgctgggtccccacacagatgataagaaaatatctgctgaagagtggacagaatcccagtggcatggtcaagcagtcagcgtgatgtataaacaccagccatcaggagtactgactgactgtgttagttatatgtttaacacatgcaatccaagtgccacatacatgcatcttaacacatttaactatcacaactaggttttattattattctcattttacagatgagggcaatgagattcggaaagattaggtagcttatccatattcaaacagtttgttagtggtggagccaggattcaagctgggtccaaaagccatgatatattctgcacttccctggtggctcagacagtaaagagtgcgcctgaaatgcaggcaacccaggttcgatccgtgggtggggaagatcccctggagaaggaaatggcaacccactccagtattctactgcctgtcaatacattacatcaaaggtggggtatgtggctgggaaactggtttcaaaaaattcttttctgaaatgcacttttggaacagagccctgaggaaattaatacctgttgaaatatatttacaagcactaattttggaataacagggtttgaactgcctattttattataattattgcttcatactcctgtgggtcatggtttggacaaatgagtgtcacttttctcacagtgggctgcaagatgctcagagacaaggtcggtgaacttgtgaggtttctgactttttaatataattttattttactttcaagtgaaatcatgactacaaaatgtcaattgatattacagagaagatccagacaaagatgtggtcaaaagctataggtagtgtgttcaggacaaatcgaagttttcctttgcactgaaaaaggtgaatggattacagtcttgggcaacgggctcatgtgagtgaaaaccatcagaatgaccacttatgaaggggcttatgaagggagtgctagtagggcaagaatttt

SEQ ID NO: 24535 - DNA, 704 bp, Bovine  19866881639424
tataaatggaatatggaatcatatagtaggcagccttttgtacccgttttttttttccgttcaacactaagtttgtaaaatccatcactattgttgtctatggtagttcactcatacccattgtacagatgaggaaactaaggctgagaaagagcaatcttaagaaaggtcctcagacaaccaagggaacccaaagctcctctctgttgcctctgaattaccaccttcttgctgccacaacagcgcccctctgtggggaggatcagctcctccttttcctgtccacccaacaggactctttgaaaaagaccagcttaatcacctccccactgcctttttttttccccaaaagcctttactcattcttggctccaagataaaatcctctttttttcccccagctcattccttcctgtgctatcgatagaaaacttctccagctctgctggcaattaccacagagagaaatctcatctatttcgggcgattcatttgcgctttcataccgggcctgtctttaacacacctgaatggccctcttcaggacagcctgccccctcaagctgcggtttttcaatgccacctgccccgactcacaccccctccatcctgactcttatcctttccatgatttcattccttgcactgttggaaatggatcattcaacccagactgtgctaataagacgaatagctcttccctg

SEQ ID NO: 24536 - DNA, 798 bp, Bovine  19866882136893
actatataattagtccagagagtcactcaacaaatagcagcaacacaccctgggaggggaagggggagctgattttcagagtcatcacatggtattaattgaaatgtttgcttttcaacaaagtatagcctgtactcaaggcctcatttctcctgggaaatccttcttagcccccaggtccaagctgggaaccctcctctgagcttccgcagcgctttaaaccacccaagtatgaaccccactctccttggctagctggcatcacatgggtgcttgtcttgcccatgggcctcctcagggagggaaaagagtccaactattcacactcagtctccctcagcaagcccagtgagcgcagcacacttatcagctaaagcaatgaatgcgttatgaacacagccacaggaaacagcaccagagaaaaggctagacatttccttccaccttttccaaggggacactaaaaaattctcctgttgcttataaaggactgtcatttaaatgccgttggtttcaaagaaataagtggcttgagcttgaagatgggaaaactgtcaaccagttaagcaagatttcctcctcctctgcccctctgtgatgaggaagaggagaaggcgtgttacctgcgggaggtggatgggccacggtggtggtcggtgccggtctccttcaccaggtttcctttgcagcagatgacccttaacttatcctgatatgaggacgccaggtagatggctcctgaggagattgcagggcccaggtagcgtgggttggggatttccaaatatgctcgggcgg

SEQ ID NO: 24537 - DNA, 1463 bp, Bovine  19866880525178
cgcctggggagaagggctttgcgggaggtgggactgagcgcggccgcagaggccacgagtgtggtgggaggcctctggggaggggaggagagcggctctggagacggccttccagccccgctgtgaccgattcactctcccggtgatttactgaccctctttctgtgccagttccttcaaacgtcagattatgtctaacatcgcttcttgccattctgtcattttagcacccacctggctgtagaattctcttcctgtctacttccagttttttgcttaaacattaaagtaaaaaaaaaaaaaaaccctcacatacactaacttccttttgttcccttttgtttgattctgcccaggttctttggctccataaatatttcccacttaaagagtaattacattaaggaaaagccatacatttaaacaaatatggctttcatggttgcatgataactgcgtctaaatcggctaattcttattaataaagggacaaggaaatatgcaaagacataactgggtcagagccttggacactgacttaaccttcctttgcccttctctgctgaagctttggacggaatatggacaaagagcaatttaaatctctttccattcctgtccttagagcagcttcacatctgaacctctaataaagatgcggataataaaatggcagggaaagtacaatggaaattatattgactctcatagaagtgttggaggagaaatagattctcttccctcaactctgtaataatataatcatggtatgatttctacttcgctagacttgggactatttggaaatctttaatgaatataatcaggtagtaagcatttaaaagttactcttttctgaaagccaggaaattatatgctcagtcagtggaaaattcaaagaaaaaggaaaaagaaaaaaaagcaagctacctttttttttttaaacaacataatacacgtgtcgtgatggaatcaaggtgggaaatgagacctgagttacggcatttgctttggaccctgcagtataaacttggggggagtcatataatatctttggggatgcggcttttgtgctgttgcaaaataataattgcaagcatttatatctgccacgcaccaggcgctgttctaaacttctcatgtttgatcacttaaccctttgactaactctgtcgagtaggcactgtcatcagattgccatttcgttcttgctttatctcacccaacatttcaattaagttacttgaacccacgtctcttggattatgaatctatgcttgtgaaacaccgtgctgggctgccttgttatttacatcatttttatctgaggccaaatatttcagttacacaaaaagtgaacatatttctcaacatatacaatagtacccaagctgaatataaaaactcctttgtctttaaaggaactctgagaaaggtcatttattattttacttaattagcaa

SEQ ID NO: 24538 - DNA, 977 bp, Bovine  19866880526856
tgctccttaccttggacgaggggtatctcctcaccgccgcccttcctgaccttcaacgtgggataggtcaatgtaataacataagtacgtgcatgtatacatatatacccagggagagagaagaatctaatatcaagctgtaaacgacactaacatgtaggaaaggagtttgacaggcaactcactttatcacatctcatcagccccaagtatcttaaagacttgctgctctgtgcaatcagggtggctccttggtctgtaatctccttacaccatccaacgtccacggtctctattgtcatgctgtatcgcccaatggctatcagagctgcaaggggagacagaggaagacaggaagcacaaatgtcagcagcataagggatctctatcttattatgactatttctctcatttcctcactacatttgttcctgaaatgttgtgtataaacgaatgtttcgtaaacgaaatccaatttaaaatgctttaggaaagcgtgccctatgacagagcctttcacaaagtgaataatcattccataatttcccctttattggaacacaaccttttatcagtttaattcattacaaggttacctgtacttccaaacattcatatctgtagagggcatacactcaaatgaattacgcatataacattacaggaaacccccaaggagtaattaaattttacccaagataaatttaataatttttaaaaagaaaaaccttcagaaacaccattttgaggtgtgtgattctgcatatgaatttctttaccaattggcacattttttcccccatctgttcatgatctgtaaaatgtaagagaatataatatttttcacattagtccttcttgagacagctgggaattaagaggacattacacatacagttgaatttagctggtgctagcatttgttacgggagaaggcaatgataccccactccagtactcttgcctggaaaatccca

SEQ ID NO: 24539 - DNA, 1721 bp, Bovine  19866880565829
ccagtcaatgtctaacagccacctctcaagtcaaaggaagcaaaataactagtctcttcgagttacgtaaagaagtctctcctttattgttaccatgatgaagcaggtagacaagatagtcgtggcaatattttttccacttcaagataaattaggaacatttggtacttttaagaaaaaattttttcagttactaatgaacatttttgagttgtctataactgacttctctctgataagttaatggagaactggaaacctacttatttttgttggactactgacttgaattttgtttgaaaacaaagcacaataaagtgactgatgaaacattgaaagaaaatacagcaacaacaagtaagtacctaaaaatgataattgtaaattacatagatgaataagccatgtaaaaaatatgttaaactttgttatctatagaactggccttcagtggttattaaaaatgatggtctctaagtccattgacttttaataaaaagacaccaaatagataaacaaatgctaagtcaatttctcttcaaatatttaaaatgttaaaggttaatctatgttgctgaattagccatgacagagtgaaatgttgtaaataataaacggcctctaataataactgtaacattatataatgataactgtaacattatataacagcaatatttaaataacagttcagagtcacattgcatgctgtcagcaactagccatatgaggaaaaaatgcaacaataactcctactacacagttatgttacccaagatttcagggaagagcaaggatgtatgtatggctctttacaaagcactgaagtctttgattcttgagcatcccatctgcccaacagctaagaacaaccacttccttttatacaaaagattatgagccaaatgtgaaaactgaaatgtacagagaagaacttcttcagttaataagctctcataagattttaactataaacacacaatgattctctagtaaataaaactggatacaaaagagcatattatctaccacaaggttatggttttctctaacacagtaattttcttctgaagaaaagattctataatttcaaagaagtatgcttcaaggggagaaaaagcccctcagtcttttaaaaaattatggtaatacactgacacccaacataacgaactctctttcttgacacacgctgattggtattctgcacgtattccaagaagttaagacacaggaataaaagagattgcacttgaccttttttcatatcatgttagcaattactcttttcaattcacctattcttataactgacctcatttggcagggagatattaaatatccaaatattttaaggatggtagataatattacaaaatgattaatttcttaccatccacctacagagcctttaaaaatattaaagctaccctgggtaaagaagctcttggagagttcctctcaaccataataaaggaaattctaaacagtaattaatatgagaaaatatgattgctctttgagcactggtgaaggaaacgtgagtgtacgttaaaatttggtaaagagaagcagcacgcagaaacacataaagagaaaacagggctcctatggggcccgctcaggctccaaggaaagcttttcacgaagattaaagaggcagtgggaaaaaaagagtttgactagcttttcaggaaaatacatatacagtagcaatccat

SEQ ID NO: 24540 - DNA, 1401 bp, Bovine  19866880587178
tgctgttatgtaccttgctacatacaatcgtttttgcgactgtctaaaacagttggtattatagagcacaatggactcccttctcaccacagcccagttcagctcagacggcatttcctccagcaaactcgagaccctaccctgctctgtatcagattcatccaccatgtctcgtacgttcccgagccacctgctcatacctttggcacaggccccatcacctcacactgcaactctgtttacttatgattctcattcactggcctgtgggctcctgagagccatctttgcgcctgtatctggattctaagcatgtcatgcagtgtctagcacagtggagatgcccatcaaatgcttgtgaaggcaagaagaaagcagcgttcggttatctgtatcattcacagccctgagcagtgcttcacacagagcaggccctcaacgtgacactgttaaatgaaaggaaagggaacaaaaaagaactgcacttattcagggccaggaaaaacggtgagcaaagtcatctcgtgaaatcgtcaaacaaagccttcctagtaataaggtaaacttatctttatagaagaacagggaaggaagatgactacgatattttatgttcacgacagaactgttgaattcctcaaaacagttgtctggctcagttctaccatcaagcaggtcaactctgaagccttccaaccacgtgggtgttcattccattttgaacatcttcagattatattctactgcttggtaaccttagacaatgcttattgatattttataatcaaaaaaccccttctaatgtaaaagcaatccccctcttgctactttaaactagtttcttttgttcattcttctgtagggatagagtgctggtttgcatccttatgataaacctcttacatactataagacagttattaagtcatctctgagctttctattttcctggctaagcaaccaaactcctttaatctttccccacatggcttattttacattccattaagcatttctgttgttttgccatagaccttttccaatttttacacttccttttaaaaggtaggaatccaaagtcaaccaaagagtttaataagagctcatacaacactaaacatagcaaaggattactttccaaccccctgaatcccactatcacaggagctgtgtagcttgctttgctcaaagccaacaagtccttaccgcctctccatggctgctgacgctcctgtacgccctgaaacctggggcgtgcggggggcctggcaccccactctctccctgtggatggtggttcggaggtgccctgggcacatgctacaccctctttctgccctagcttgctggactagactttggggcgtggagcggttccaggtggatctcatcttaattttc

SEQ ID NO: 24541 - DNA, 847 bp, Bovine  19866880605699
ctgaaattttctttgtcttttaatagaaagaataacttagtagataggagcaaatatgctttcattttcacaagttttacaatatatgtccagaccatttattggaaaggcatttaggagattattttatacttattaaaaaaaacagaatatgatatattgtatgactttaaacagcaactaaatagtttcaccaggatagtaggcaaaccaagaagtcagcattattacattccttttctgctgctactgctactgctgctaagtcgcgtcagtcgtgtccgactctgtgcgaccccatagatggcagcccaccaggctcctccgtccctgggattctccaggcaagaacactggagtgggttgccatttcctcctccaatgcatgaaagtgaaaagtgaaagtgaagtcgctcagtcgtgtccgactcttagcgaccccatggactgcagcccaccaggctcctccatccatggaattttccgggcaagagtactggagtggggtgccatttccttctggacctcctctaattaccaaaaaaatgtcctctttagattgagtttaaaattaggatgctacattaggtaagtctcttccttaccttttctgtagggttggctgcctgttgaaagcagaaaagaatgcattttgtgcatatgtaattatacagataattgcctctatcatttaaaaatatcatttgccaaaatggtgtctatgattaatgatgtacatttatcacagagtcgactggggtatattataaaaccctttccctaagctcacgcatctttcctctcttcttatttttttcaatgtaactcgtttagtaatcaaatgttt

SEQ ID NO: 24542 - DNA, 1835 bp, Bovine  19866880631233
acagcatattcaaaagcagagacattactttgccaacaaaggttcatctagtcaaggctatggtttttcctgtggtcatgtatggatgtgagagttggactgtgaagaaggctgagcacagatgaatagatgcttttgaactgtggtgttggagaagactcttgagagtcccttggactgcaaggagatccaaccagtccattctaaaggagatcagccctgggatttctttggaaggaatgatgctaaaactgaaactccagtactttggccacctcatgtgaagtgttgactcactggaaaagactctgatgctgggagggattgggggcaggaggagaaggggacgacagaggatgagatggctggatggcatcacggactcgatggacgtgagtctgagtgaactccaggagttggtgatggacagggaggcctagcgtgctgcgattcatggggtcgcaaagagtcggacatgactgagcgactgatctgatctgatctgatctgatatgttcattatctttctgtttgatggtcttttccccagagagactaccaggaaaaatcaagcctctttttttaagtggcatactcagaagcacaataacatacttcagaaatgacaatggatgtgtgattactgctaaaatttaatacacgtgcttgatggaaaagtaaatttcgtaacatcctatactaatgtaatccatacactgaataaagactctatcctcaactttctatttagataaataagccggaatctcaagacaataaagtctcactagagggtatccaatagcagaactttaaattgctttcagcgtctccatgacgattcagtgcattaatgacaagtgattggttaaaagcatttaaatcaaacttatgttcttgaaattttccatgaacaaagacaatatccatttagaaagatctcacaaaaatgagtttggtgtagaaaaatataataatataataaattattttaaagcatttggctagtggataacataattgagtaggtggaatataacctaagcccttgaatcacaaaagagtcataggtgatgggtaatcaaaaacatctgtgctcacttacatttaccactgaaacatgaactatgaaatagcggatgcccataagctgatctgcagataataaaacatcaaagcaactaacaacatttgaatgctgtcctcactgccctaaataacctgagagcagaaagaagaagaattctcttcatgtatagtagtagagaagtagtaacaaaagtctacttcatacatagtagtagtctgttagttttgccctatttttatatataactgtaactatttactagctatgatccaaaaagagaaaagaaaaccccaaacagcaataaggacgatatgtattggatgttttttatgtttttaatgaaagcgtgacaagtgaaaaccaagtctctaaaacggaagtaatttctaattaaatgacttcatcattacaaattttaattatcattataataacaaaagtagaatttaagtaatctgattttaaatatttgagtaaattaaatgtatttctttctacctctttcgatgaaagcacagaaaagaggtttcttgggattagctctcttaaaggttggctttcctgtgtcccagaataaaatcaaaaacaaactataaacaagcaaaaaccttccttttctgagtgaaaatgtgacctttggttaacttcctagaggtgttctccaaaaatggtacgtgcaccaccgcttagagtatcagcgattcccttctggtagatagcatctgtctggcctaagagaactgca

SEQ ID NO: 24543 - DNA, 1087 bp, Bovine  19866880671555
tatgattgtgaagaagactaaagctcccagatcagttagctgacctgctgaaaatacagacataagatgctgctctgatgtctgcgtgggaccttttctcaaggacagaggagaatcgctgtaatccttactatctctaagaaaaaagtgaaaaagaaccaacggactgagtgtcttgagggcatctcactgtttccaacacagattaattttttggatgggctatcatgcagcattgtcaatcaaaccctcctaggattgtagcgtgccatccgccctcagtacagccggagtcatgaatgctgaaagttagctacgaaagaaatggaggtcatgtccccgactttcaaaatgtttgcaggctctaactttctgttaaggactgagcataacaattacttcgagttggtgccaacggaggatatttgccatgtgtttaaggttatttcatgatggcaaaactgagggtaaggatggggggggaatgttattttggttactgtcatttcaaagtatcattcttaatagcacccgcaactctagatgaaattcacccagtaatcattcagctcatcggtggcagccatgcagtatttaagcctttgtcctgctttgcctattaatggaaggtacacgcatgtttgcaagtaaaatcctcttttctgcttttcttgtagtttctccaactatatcttattgggtacacttaagagatcagtaaataggtaagcctctactgatggatcaacaattatctatttcaagtactgatactcagatattctgtatttcataatgcatgtttttcagagaatggcaacgtcctttggatgacactcttgatggaatatactcctaaaatttcattctctatgtaaattatctactgaaatatcacagaatgaatcatgcacattaaacatgaaatcagatagaaaattaatctgcatttgaaaatctcatcacttcccccatacagcacttggtaagtatcgaatgtcatccagcacgctcccctgcatcactggataaactgcttccagagctgtgcggagtttggccttctcactgacttgatactcacgtg

SEQ ID NO: 24544 - DNA, 2061 bp, Bovine  19866880719195
ttaatttcatggctgccgtcacccatctgcagtaattttggagcacccccaaaaataaagtcagccactgtttccacggtttccccatctatttgccatgaggtgatgggactagatgccatgatcttagttttctgaatgttgagctttaagccaactttttcactctcctcttttactttcatcaagagcctctttagttattatattgcagtatgctgctgctaagtcactccagtcgtgtctgactctgtgcgaccccatagatggcagcccaccaggcttccccatccctgggattctccaggcaagaacactggagtgggttgccatttccctctccaatgcatgaaagtgagaagtaaaagtgaagtcgctcagtcatgtccacctcttagcgaccccatggactgcggcctaccaggctcctccgtccatgggggtgcatgcaatttatgattaaaacacataaattggaggggatagatcaaagttattttagaagtatgtgtgcaatgaaaaatctttgagatactggcatagaactacaaatggaaaaataactatcttgatttgtctacatatttctgaataaaatgaaaagagataatctgattttaaaaggaactagtctgatgtgttgtcttaaagtctaatcccaaaccattggtatttcctactatgataactgctgtgacttttgaggaatcttcccttataaaagtgcttgtttctgagatttcaaaatatagcaatttattgatgtctatgagttgtgggaccagggatagtgaatattgatctgtgaataatcaatgagttgaaactggatagattctcttaagtctttaattgctaaatgccactttctggctgtgaagatggggatgaaaaggagagaactgagtgactgccatgagacaattgttgcagattacatattacacatttaatgtaatctgattatacaccaaagggttaacaagcagacctgggttgttcaaaccctccatcctccaaagaaaggattggctcttctctggcttctgggaagtaatgtctaaatcctcagaatatcccgcttgataagagtgactttccatagctggggccttgggtgaccccagataacttacgtcaatgatgtcactgatggtggaagccttgagccaccctccatcagtctgtccttagtgggagttggagcctgagtgactatggtcaggcatgggggctttccatgcctacgttaccaaccccagcagcagccctggacaccaagactgaggtaagcatcccaggttggcaatgcttggtacatagagatccacatcattgctgggagggctaagcattgtctgtagactccgactgagggagggtattggaagcttatatctgcactatactctttcctgattttaatgtttatctgttcatcataataaacaataaccataagtgaaacagcttttctaagtcccaagtccttttagtgaagaatcatagggtggtcttggggagctcgaggacaaggatgagcatatccatgaagttgatcaaactctgtcatccgatctcattgcacagaggaggaacatgaagcttgaagaggtggaagtgacttgctcaagatcacacagctggaaaataacagagccaggtatccaaatccaggactcagttctgttcagttcagttgctcagtcatgtccgactctgggaccccatggacagcagcacgtgaggcctccctgtccatcaccaactcctggaggttactcaaactcatgtccatcgggtcagtgatgccatccaaccatctcatcctctgtcatccccttctcccaccttcaatctttcccagcatcagcatccaggactgtttaaaactaaaacttgtatttaaagtgaaagtcacacagttgtgtccgactctttgtgaacctatgaactgtatagtccgtgggattctccaggccagaatactggactggggagcctttcccttctccaggggatcttcccaacccaggaatcaaacccaggtctccctcattg

SEQ ID NO: 24545 - DNA, 906 bp, Bovine  19866880770487
actgagggaggcaaatggaaagcatgcaggaaaacagagctagagcctgagaatgcgaactgctggtccaaacttcatggctaactgggactgtccagaccttcagggtcttcagggccatgaaccagtcaagcccacccctcctttttttgttcaaaccagttgagctggggttttttattaattgcaacccaaagattcctgaccgtattccatgtgtttgataaatggttttaaaaataaatgtggatagaaccctgaactacattttggtcattgatggagaggctaataaacttatcttttgtgtagagaaaaactagtttcttactataattgaaagtttaaaatatattatttgcttagacccaagcgtcccttcattatttttagaacttcctaaaatttatgccatatggaatctggagggggatgtttgaattctaaatgaagagtctcaaccattacaagctgcatgaaacataagtaaaacatttttgccaatttttaaaattttatttgtataccctattttagatctgggaatctgacactaaaaatggtctcagatttaatgttgatttgtattcaatgccaacaataaaaaaaagaaccctagttaatatgtctttggtgtttttattttagtgaactgctatttcataagagcggtttcccagattgagtaggggctggaggggacggcgggcaggatggtttattctttatctgtgaagaaaaatttccaccaatagtctggaaaaaatatgcaaccgtcttttctgcaagaacttaagaaagtaatgagattttttttcccctccttagcttctaagaaatttacagtgaaccccattgttcttgggtaatctagtcttgggacatatattttagaacccgaatgta

SEQ ID NO: 24546 - DNA, 3289 bp, Bovine  19866880826917
aattacaatccttatttccttttttttcctcccctccagacagactattttgcagacgcaggcaatgcactcagggcagggcagacagtgattatcatcaccccctgctttcatccattagagctgggcgttagcaggtaagggtgaggggctgacaaagaggttttcaaaactggtcagcataaatgcttccaggaggccaattcaggataatctattgaaatatggatcagaaatatggccagccaaggctgaatacctctatctgttgcatttaagccaaagcaatagaaagctttcatgggagaaaaataacaaaagccataattacatgtggagaattgtctgttcacatcatctgggggttaattttgtgaaatggttgccattctgtctgggtccagcatctgtctcagtcattttatttgttttgagatgctgcaggggtgagatccctggagactcgagtccaggaggccttctggtttccaggagccaatttgtgacaagatcaaaggggtccatggtcccaagagaccaagttacactttggaatttacaggtgtacctcattttacgcagcccttctacgctggaaacacactggaaagtaacttttagtgaattgaattttattaacccactaatccttttaattggtagtggcccctgatcatttaattgatcaaaattgaagtggagccataaaataaatcttgttaaaagttaagaatgctttgctgatgtaactatcagtgttttatggcaggttttttttcccccatgtaatttttattcgataatttgggaagtggagaagtaaaacaaacaaaaaaatcattttgaaagcttgaagtaaaatttccaaacacttagaaaacagtaattacaatgccttaaaattcaaatacatagataatgcttaaattatgagagataaaaattgccccactctgctttatttggggatagttcaagcaaacagacaagtataaagagtaagacagtaagcattcaccaccagcactcagaattttaagatactaacaggttttctttattgttcaaaaataaccgtaggtacatacactcaaagaaggtttaaaccactttccggtgttacttccctctgttgctctctgagatagcttctaccccaaagcaggcatataccctgcccatccattgtctgtgtttttactaaatgtatattttaccaatttttacttacttatttttgtaagttcttaaaatgttcgtaattgatatcacgtgtcagtcttgcttctttcactcactattttgttttgggttctttctgtatcagcccatgtagatcaaggtttaaataaatgtaatcggtatgggacatgccatagctacttacttactcatttttctattgatgtgcatttatgtggcttccaatatttcacttgtataggctatgcagactgtctccttttgtataaatgttcacgtttctttcaagtctatcacagcaattggagtttctgagtctggaaaacgtgcatctttatgaacaccaccagattgctcgccaagtctgtattctcaccagtaatttatattctcattgtaataatgcggtcagattcatcaacctttttctttacaaatttgacttgctgagcttggtttaagaatttcttccctctctgcatcataaaaaggtatagttagttgtgtgttcacatttgtgtctttaattcatttggattttttttttttttgaagtatgatgtaaggtcgggttctaattatatagttttccatgggcagtgaagccacttacaatgcctcctggtttctaaggtcacctctgcttacactgaggtcttatgtaggagtaggtatttccattaagtgataggtctggcttcttttccgttcgctgctatgttgaccttccccctaacaccacattattttactcgatacagtgtacactgtagtaattcatgatatctaatgaggcaagtctttccttcatatttccttcttcaaatttgtcttggttatccttggaactttatgctcttatatgaattttatagtcagtttttggaaatctttaatatgataaagtggtaattaaaatgtgtgatataatccattctacttacatcaaatcactaaatctaatttattgctcattagtcaatattaaagatctcctgccatgtcttgacacttaacttctttgaaaaattagcttatcatgttccctttcttctacaaataattactttccctcactttcagtaattttcatgttattcccattgtcccaactcatgggctcttaatatccattcctgcaccaggttaactgatgtaattcccttcccgttgtcctgctgtgacagtattttgtaaacataactctttctctgacttgatcctcctctattttcctctccagtaaattctagaaatagcttgtagagcaactgttttcctgctttaatcatgcctcttgtatgccaaaggacttagactcttatttgccaccgtcttgagtgaccctctgaacccatggatccatttcacaggtgaacaacttaagtctcaaagaggccttgtcctgcccagagtcactcagttagctagcagaggaattgggactctaaaggtaaaaacctaatttagagcccaggttcactgactcctgaacccactgtctttctgtcatctgctctcctcccgcaaaccttcagatattattccctaactgatattacactgcattaattttacttcatgtaaatctcccaagggaacttccctatcttagtcaaaatgtgcctcgttctttcccactactttggaaacaccagctttcaccttgaaacccagtctccctacttttcactgaggtacctcaccttcttggaaacaagtctctttttcagactgtataactacagctactactaagtgaaagtgttagtcagtcagtcgtgcctgactctgcgaccccatggactgtagcccaccaggctgctctgcccgtgggattctccaggcaagaacaccggagtgggttgccattcccttctccaggagatcttcctgacccaggggtcaaacccgggtctcatgcattgcaagcggattctttaccactgagtcagcagggaagccctactactatgctgttgctattaccactcttaacggcagtgatgaaaccatcacttactgcactcttaccatgaatctagctcttgaacgacgtgacctctcctttcttcactccacagat

SEQ ID NO: 24547 - DNA, 1023 bp, Bovine  19866880827548
tgcagagttgaaccggtccccagcctcctcagcctaggccctttctactgcctcctgctgcttgaaagagcttgtcaaagatcaggggcttctcaaattgattccctggcaatttttctttcagaaaaggaaatggtttcttcatcttcaagctataatcactttgtcacattaatagggaatatcttctcatttccagactcttgacaaataggtcccagtgaataaatgaaccctgctctttctgctacctgctaatttattagctgttttcatattaatatccagggccaaccttaggaggaggcaaaccaggtgtgcaatgcctgaaattctaccactgtaacatctatgtctttgccaacctttgtccccagtggaagcgcaaagggttttcaaaggatcatgaggcacgaattgaaattttactttgtgctagtctccgcggctagagaggcaaataataacaacatgaattgaacccttataaccacgaggcagtatgctcagcacatttcactatctcacttaactatgacagtgaaaatattagtcgttcagtcatgtccgactctctgtgaccccacggactgtagcccaccaggctcctctgtccatgggattctccaggcaagaatactggggtgggttgccatttccttctccacgggatcttcctgacccaggaattgaacccaggtcttccgcattgagggcggattctatgaaacaacccaatacacaggtcccattattatcctcattttacagattagaatattgagagttaggttagaaaatttgcccaaggcttgcagctaagtaaagacagagggagaggattttgaacccagtcagtttggctcccaatcctttgcttttgaaggttattctctatgaaacacgtttcctatgtgtgagaagccgtgctgcattcagagagagtggggtaatgggagcagagcgctgtgggaagtggaggggtgggtgctgggctttgcctggcacagagagcgctttgca

SEQ ID NO: 24548 - DNA, 1098 bp, Bovine  19866880835913
cccgctggaacatgaggtgtgtaacccgctgtgctcagaggcacgcgtggagccagggtgtggaagatgcgtagctgtgttctccagtcctgtataaaggtggccgtatatttacgtaagacaaggttctatagcagtccgttatcaagagaaggcaggagcatgaaggaattcttttccttgcaaggtttatagagggggaaatttaggaaatcagaagtgtaagcaaagagagaacaacccaagtcatttaggttgacttagcaagggggacactcaagcaaacagatgctttcgtgccgaagatgattgcttccacagaaacccctctcctcttcggggatcaatatcactaaccaagggagaaagtaaacaaaaagtgttaaaacatgacgtcttctggacttaacaaaacaaacaatggtgataaaataacaaagaggcgaattacctccatttcaagtcccatttgggagatacacttctttgcagaggaaacctcatcaagttgagcttcatccacagtttttaaatatttactatggaaaagagtactcattctctttactgatatgtgtgtgtgtgtgtgtgtctgtgtttataattagttttcgttctttggcgcctccttaactcaattggatattagcagagcccttgattatatcttttccctcctccttgttttaggtattccagtcactttgctttttgcaatctgaataaaaggagatctgggaattaaactcaaaggactgattctggccctttaagcagtttgggacttagtctatgagacagttaaatctgttgcttatatttagcttatggctctctgtagacttaattcattcgtcctgctcctccttgtcaggcataattcagttggcttcacgtacctaaatccatgaccatctgcataatttctctttgagtttattctctttgccccatatttgcagcctcttgaagtggccagtctggtggccgtccgcagactaagtttcactctcatgatgccacacatcgggttgggggctcagggaagactgtcaacagtgttggaatgcctgaagtcttttttcagcaagctgggga

SEQ ID NO: 24549 - DNA, 2426 bp, Bovine  19866880838318
tttttgctgactgtatagagcttctcctctttggctgcaaagaatataatcaatttgatttcagtgtcgaccatctggtgatgtccacgtgtagagtcttctcttgtgttgttggaagagggtgtttgctatgaccagtacattctcttggcagaactctattagcttttgccctgcttcattctgtactccaaggccaaatttgcctgtcactccaggggtttcttgacttcctactttaaccaggcaagaactttatgtcagcgggcttccctgatagctcagttggtaaagaatccacctgcgatgcaggagactccagttcaattcttgggtcaggaagacccactggagaagggatagggtacccactccagtactgttggaattcccttgtggctcagctggtaaagaatccacctgcaatgcaggagatctgggcttgatccctgggttgggaagatgccctgaagaaagaaaaggctacccactccagtattctggcctgaaggattccatggactgtatagtccattgggtcacaaagggtcactttggggtctcaaagtgcttccatatgtcgacacttatcagagtatgtcccatggagtacaaatcccttgaattgttctattgaaaataggttatgtggtcaaatgagttggagaaattttgcatgctagatctctactcttccacatacacataggaaggtttgccctgcacagtaacatgttagaaactctggtaagctctacattaaagaaccctgtttaaccttttgtaaggtggcagttttctcagaatacgtgacatagaccccttgtgtagccccttttaatgaaatactactatcctagcttttgaactgtggtgttggagaagactcttgagagtcccttggactgcaagggagatccaaccagtccatcctaaaggaaatcagtcctgaatattcataggaaggactgatgctgaagctgaaactccaatactttggccacctgatgtgaagagctgactcttggaaaagaccctgatgctgggaaagattgagggcaggaggagaaggggatgacagaggatgagatagttggatggcatcactgactcaatggacatgagtttgagtaaactctgggagttggagatggacagggaggcctggcatgctgaagttcatggggtcacaaagagtcggacacgactgagtgactgaactgaactgaagaagttaaacaagcatccatacgcatagccatgtaaccgctgccactgtcgtgaatattctttctcaaagaaaaaaaaaatgtgacttggtttccagtcaaaacatgaggcacttccccccccccccaccacctttttaaaaaaagaaaacaaagccacaaagcctacttgttagttttgggattcatttattttattctgctccttgctgcctggaattcagggcccttctatgaaggacttcaagggactcatcattccgtaaatttgttgagagtaggggacatttttgcatctctagcgcatagcacagtgcttggcacagagaaaattgagtacgtgtaggctaaactcagctgttgaactgaatgaactgatgagacagatgcataggacagggcggtaaagccgggagctgacgggcgttgaacagaaactcgcccatcggaaggagggaggccagcggtggaggtgtggctgtgacgtgtgtgtgaaggcagagtgcggttctgcttcctctgggaggctgtgtgtgcttccttgtgtctgtgtatatggagagatgacggtaaatggaaagaatacaggtcagaattgccatggcttgctacgcgtgcaagtccatttaagcaacatttgagtaaaatttgttctttaaaaacaatcaagaacctcttccttcctctaatcgtaaaaggttatctaccttgtctttttttttccgactttccaatttggctttccaaccaacaagtaatattacttagtttatcgttttaccgtgacttctaaatatatatatataaaaggaacaagttatggatgaagaaaaaatcagtctatttataaatatattaatgtgttttattccactcaagatgcctccctggtctgaattaggctgtaatggagccaaacatggagcttagcgctggtttcatggggagaagccgagtagtcaattttaattacttgttgccatatccttaaacaatgcaccaagcatggaaatgttcaaaatatctttccttctgtctgatttcactttagtcaatccaaatttggcatcactgctttttgaaatatttttgattgtagagcagttggtgattttaataatttagtatagaggagagaatgaagagaaagaaactggaatttaaagcacaatggcaaaaaagttaatttaaagtgat

SEQ ID NO: 24550 - DNA, 1515 bp, Bovine  19866880894319
ggtctttacaaaagaaggtgatatgtattcacatggtttgccttaaaaacattttataccctaggagtactttagaaggaatgatacaataaaaagaatgtcttttttattgtataattctatcaaatagaattacatataccacttttccttccatacttttgaaagatgtaaacgtgtaagctggcataaagggccattttccatttacgaagccaaagaagaatgctaagtaacatatctgagctgaaatgccagcaccagtttgtccaataggttttcaagatctcattctgcaaatcagactgaacaggggaagaagctagggaggggaagctaagatcgtatcgctgcagcaacagtggggagcagggaagtggggggaaggcacaggacaccacatgccacctgctaatcaattaggaggcctgtttgcaagctcgagaaatcctggaggctctggggctgtagacaccactatagtcaagagtcaaggaacacagaaaatgtaactgggaattctcttttgaacttaaaacactcacttatacttttaacacccatatgttaacaatactgtagtccataccagccactctgctacgccatctgctccaaaaaagtgttatttatcaccactgtacatgtgattgctgtttaaaaagctgcattgatatttttccttttcgtctgcattaatcgcactgttggatgagtctgagaatgaacttgattttcaagtgcagtattttacaatctctcattaagacagcggtagcttcggtgtttatgtaactgttttacactcttgttcttaatacagaaaacatcaatgtataaatcctttccttgttttacgtaacaagattattcaacctattgctgaatggggtcagaggagcttgtaggtcatttaatttactatttatttcctctaaaatcattcctggaggctgggagtcctctgaggactgctgctttccttccgcctctggctaaccaccccacctcccctgtgccaccctctaccttggaagatctgacaagtattctttagtcctgctctcctgaattcggaactattgacgacttcacacgagaagtctgactgatgtgttacacaaaggccccgatgtaggtgacgtctcgagatgtgctaagaagcccattattttcacagcacagtcatctgcctgtagaattttctgcaaacatttccaagggacaagacacgagagcctccattcctgttttgtgttgacttctgacctaacagcggaccagtaaatcccatgtgtaaataggaggctgggtggcaaggccactttcctaaatatttcacagtggtaaactctccaggttataaattacaagagaaataagacgatcatctttccccaccatgaacttgtattcaacacttacttttctattatattaagcaggctagcaggaatttagcagcgcacagaaactcgaagaggaacaaaaactggcctaaacaattcatcactg

SEQ ID NO: 24551 - DNA, 872 bp, Bovine  19866880895691
ccaaaccacaaccctaggaagaataacattcttgaaatacttcccaacgacttccatccagagggagtagaatttatagctctgtgtcagatgtcagtgatctgggatctctagtcaccggcatgaatttatcttaaactaaatggcatgcatcatgcagaaggcaagattctcacgtgctccagagccataaggccggaccaagctcactgcaaccacaactgctttcagaaattgtgctgagaaataatgtgaccagaactcatttagacagtcactcagatagtttatgtgcccatatttatgagcattttttcacaccaataatcataaacgcttgtgaccagtttgggtcttcatgtaaaaatgttaacagttgtgtgggtgggtcaagaggggagtatacgtgtgaaatgaatctctcattgtacatattttattaccatctgctgtttcaatgagttttaattacttaacatgcaattctcagtgctgagaatatatttaaaagtaagctaccccactcaagtagtttccacatagttggggctgggtagggagcagggaacagagccacaaaacgtcagaggtcacaaaaattctcagcctgcacccaagctttacttggccagcacaggattttttttaaacaagacttaaagttcggtgttgaattgacctaaaaatcgagattattaggtttgtcatagaaatatgttaacatctggccacactatcatattaatattcatgtctagccacagagctgaacagcagttgccctgtgaagtagagcctgagctctcccggatgaccacagtctcacttctttccacaacacaccgtcttcctcacttaccttgtgtaaccct

SEQ ID NO: 24552 - DNA, 1388 bp, Bovine  19866880949194
taggccctctccagcgtcctcttgcagtcctgcaggacggtgctgaaggtgatgtgcgggtactgctgcaccagctgctccaccgttacctcgttgacctgcaagtgaacaagatctgccgtcacacacaggcaccaggaccgcccctcgtccttctcatcagcgccagcaagtgtttgctgggaagacctgccctaagtactacattctacgtggtgctaggtagtactaagttctacgtagtactaagcactactaagttctgtgtagtactaagtagtactaagtaagtaatactaagttctatgtagtactaagttccacgtagtactaagtactatcttccccctacgtttttttttttttttaaagatgtaaggtatcgggaggttagcgctttctaggagtataaatgagctgaagtgtgtccgttgaagggtgagtgcctgggaggggaggcagcatgagacactctcatgtacctctgactctgccaacccacctggcagcttttttaggagagaaccatagactgccggagaggatgcacgggactctgaataggagtgctgggcaaaatgtttatttttcttccccttaaatgttaaggtcctggcaaacctcaggtcccttcgtggaaaagggctgaaaatgtgaggaatcaatcactaaaacatacatggctggcaggtcaaagatggccccaatagaccttaaccatcaaagacaccaccttgattcttgattagacaaggcaatcagacaggcctaattaaaactaacaccttttcaattgctgtgctgtgaagggattaatttgtcaattatttttaagctgattgcagttcatatcacaaaagcagacagctcccttcatccttcagataaataaatgattaacctaagaactgcaacttttagcttgctttatttaaaatctttatcgaacacttcggcattttcaaatacaataatgtttcatttatattgaataagctggtctgcaagaaggttctgctgagacacgtttttgtgcttcctttccatgtctgtccactactgaaaggatcaggaccatcaggaaaaacctcaaacaatatcagacccttgcaatttgctttgaaagccagcttgggagtatgctgaccgtgacattaagtcctctgcacttttctaaaataacatggtgttttgttaaactatgttacatgtagtatttgttaaattcagagttgatatttccacattgcactgatgatgcttattttttgtcagaatttctattcaagactttcttgtactgaaatcaactgtcattccaaatttaaccaagctatgcagttcaatctgtgttacaatgtatgacttttgtttacaaaaacatgaag

SEQ ID NO: 24553 - DNA, 944 bp, Bovine  19866880972371
ttcctgtacttttggtcgctttggtttacataataactatgaattcacttaaaattaaaaaaaaaatacagcttccgcctccttcacattcaatacgttctgatcaagaagcgtgtgtttttaatggtatcgagaacagcctatgaatgcttgaattgactctgtgtcccaaaccccactccacactccccatctctccccttttcttacttcctttcatcatgggagttttttgtccgatagcttaacagccagtaaattattcctgattagtttcaaagacaaaagtcccccgataggatgtgggtggctcaggttcctcactactctctggagagacagcatgggaaggaagaaagagttttcgcaccttatccatagtggacatctgctttgcaggctaacccaggtctgtcagctgaaatatgtgcctggaaacatggggtgattcatcaccaggcagaacctttgtggctctgcagtggaagttcttagcccttcttctacttcagtgtatatgaatgacattgatacgcagataatcctgagtttgtgtatactatctacatctttgtttgtgttctgttccctggatgataagactcttgacgtcagggattgtggtttatgtacagaaacactacatacaagaactggcctgggatggttaaaaatctgaggcacatcctgggtataattctcagcttctcaacttagcaggtgctgtgggcctggacaagttgcttaacctttccctggtttacctacctcagctgtaaatgagaggaataaagctatttatctgttaagtcttattgtgattattaaatgacatgttacattagaacaatgcctggcacagagtatgtgattcgtaaatgctagctactaataaatacttttgcgtgactttctctattttcattattatgtaccaaaaaaaa

SEQ ID NO: 24554 - DNA, 1090 bp, Bovine  19866880978807
ttatggtattctggcatattttaagataaaggatggaagagaagattgtattctcctatatgttacaaacatttactgtgtggaagcaaaagcccgggccttaaaaagaaaacaggaatgtaaaaactatagtttttataggttaaactatggttagtccagttcagtggcctgtggttcattagaggccattccttttctgaaaagaaggcaggcaaaattctggcaagttccaactcctacctgcctcctgcaacaataaataagaacgtcagtggtaaagctagaaatattccagagagacttgctaggcttccaaacggctaatatgaaatttagacggaatataaaataaaacattcagtggataatctccctgcccgtctccacctccatcgcccttactgctttcactactgatgagaaagcctcaattccacaaacattaagcgcacctttaatttaaaatgaagaagacaaaattatttgcgtggactataagagtattctgaagatgcgattttaggcatcattcaggaaagagttaaatacttccttaccagaagatgccacaaggctttgtagtgactaattgcctctttaacctctgcactcggggagctggcctgcacttcaataccagttttgtgatagagccaaagactgatgttcaacacagacctcctatgacctgtgtagccctggagtcaactcggacaagatgctgacaaaaggtctccttctcacttgggaaggcacagaatccctttttggatcagccaaattcccagaagacagagacaaagcaggtaaagactgtttggaagataaagaatggttttactgctcctgacaatatttcccaaccttccaatgtaccactcaaaattctgtttgagaaaatggttttagtaatatgaaaaaaatacatatttactttaaaatgcaatgaagagggtacctaactggatatctttgaaagcttacatcattagatagctgtaggaagactcaaagaaggcaggttaagcttctcccttacaactgtttcccacgtgactttaagcattcatactcgggaagtctgtac

SEQ ID NO: 24555 - DNA, 1200 bp, Bovine  19866881007423
cagctgtaactcgggggctgttgtcctgagtgtgaactagtttagaaaccggcaataactcctgccgatgggcacttctgccccaagaagggcaaagtcaataaaatatgaaattcaaagtgtttcagcctgagagttcagagtgtagtgcaggactggattaaaatgtagagaacactacactttctctactcgtttttgttttcgagggagaaggcagagtcccagccctgggtcctctcacttgggaccttgcatcaggcacacaggagcgcacgctcacgtggacacacacacacacacacacacacagacgcagacaggcaaacacacatttattccccagtcctagtctacacgtggcccaccttgaagctaatgaagttaagcttcagggtccgtcattaacatggacctttaccagggccaggatcctagagatacatccacatggtaaagtacttttgtaaaatctgttaaagcaagatgctttgcattcatcttcttaaagagacaccccaaattgcataaaccccaggtcctggaaaatcctgactttcctcctgacccatcgcttcagggtggatgtcaggaagctgtgtcttttcctgcttctccttttttttttcatgtcaccaagtgattctgatgcacagctaggtttggaaatcactgacgaagggctacagactgatcagtttaatgagtctctgacttccaggtagtatttctttctggagctttgccaccattgattgggatgtaaaccatataacactacgcagtctggaaaaagctgacaactggcaacattcgcttccacactgcagtgatgaatcacataaccctctgtgccgagtaattaactatccatttgtatgtcctggctgtagtgacagagttcttttcaacgaggaaggaagggaatttggacataacattaacagttgttaataccaagcaaatagagtaaattggatttattaaaaagagtatgtgtgtggttttttttccctaggagttgatataatttatctagctttctaattatagctaggacagaaaatggctgaacccagagacctctcacggtatctaataaacttttacttacagggagaacgtttcttgggctggagaatgacaaataatttactaagcttttccgaaagatagctaaaggtgtttcacctatatcta

SEQ ID NO: 24556 - DNA, 1002 bp, Bovine  19866881051386
agacttagctctccgtaatgtcttattcagatttattggtcatctgaattttattgcatatatgcagaatactgctggttcgtgtccactatactgtgagaaatatgcgtgcttcaccttggaaaaggagtacctgaattagtccttataaaatcaccttgtcctggtgatgctgctgaagaactgatagtcttttcataaagtaaggaataaacctatcaccggttgctttaaaaggtcattgtctctcgaaaagtagattagctcactttgttccatgggcaggaatcatcactctggaaaactgtacataccaagtaaatttctgctctcacttttggcttgctcttgtaaaagaggtttcatgcctaccggttttcacttgctaatgtaaggcacagctcctcacaggtagagtggcgggacaccaaggatgctgtgtctagtgtgcttttaaagtttctccccttaacaaacgcagattcccaagcatggaacgcctgcacagaaacactgacgacagattcggtgattgagtattttggatgttgttggaggccagtggttaggaggtgagtcacagcagtagctgaagtgactcagttccgttttatggaagaaagtgactgaaatggcacctctcccttggttcgtacgtatcatgcagaatggacccgctcttctcccgacatacggcctgtggatctctgctatgtgtaaatcctcatgtaacagagatggtgatttagcctgtcacttagaaaagcctgtgaatttatgtgaagggaagggataaacattgccatgatatttgctggaagaatcataattaactctgtgtattctctcctttctaagctaaaaatgggataggatgagttgggggtgggggggtggttggttcagttccgctagaaggaataatgttccacgttgatacatctgaaactacaaccttcctctactaactaatccgtctagggtgttcagaaaggaggagtt

SEQ ID NO: 24557 - DNA, 1144 bp, Bovine  19866881090286
aactgatggagttaggggtggtaatatacctcactggggatccaaagcaattaaacagtattgcaaacccaaactcggagtggatttaagccctcatagggaagtacagtcccttcttcgggaagaaagtgaaactaggcattctgatggcaaacaagaaagctttccatttgattctctccttctttatagcgtctgctttatagcatcttcttgctgtctgtcacatttgagcttatcttccttattccgacaataaggaagcaatgttatagcttgttatgtcaaagctgcgagggaagcatggacctagctgaagaaagcacgtcgttatttttcttaattatttcagaaatgtcatctccgataccactcagccttttgtaactatgaggagaaaattgaataaccgcccgttctccctagaatcgctttaaaaagtttgcagtcaattttttcggacggccaggaaacaatccgatgatacaggtaagctttgcaggatgataggagggtcattacatgcaatcaggaaaaaaaaatattatggtatatacaggcagactgtatcacgtcgtccagttagtttaggttaagaaatgttttctctcaggaaatgcctttaaaccagggctacgttttatttaatgatgtggaaaaattccacaaaatatccttatgagaaatgtatttaattttctctttttaagccagtcagcaggtaaagtgagctgcgcattgctcacatgactagcaccgcctggcagagcacgctgaaatatgcctggtcacgcacattcggaggtaatgttagttgggagcagttggtacggttgcttagcactttccagaacctgattgacttcagctgctgaaaggttctgcaaggatgctgacagatgttggaacccagggcaaactccccttgcctatttctgtccttgtacgaaggaatcaacagaagtgcaacttggcatcccgaaaggagatcctcaccttctcccagctttaatgactaccctgaggaaagagcatttatgccctgctctgaaagagcagttagcaaccttggtgtcatcgggtgtgcagggcaagggagctgaagaagctcgggaaatatgcctgcgcccccgggtgcatcgtc

SEQ ID NO: 24558 - DNA, 1581 bp, Bovine  19866881093507
cggccccatggactgcagcccaccaggctcctccatccatgggattttccaggcaagagtactggagtggggtgccactgccttctccgcaacagagaaatagaaattgtattaaaaaatggaagttctagaactgaaaagtacaatacctgaaatagaaaatccgttgaatatgggtttaagagcaaatggagttggagaagtcagtggatgtgagtatatagcaatagaaatgatctcatctggaaatggagaggggaaaggctgggcggagaaaaacagaaacacgaccctgagccatgtagcccgggtggcctaatgcacaatgcaattggaaccccagacaaagaggaagaagagaatagaggtgaaaattattttttaaaaaatagtcacgtgcctctaacttggaaggacttaaactctaagctctttcttgtctgtgttggcagaactgaaatatctttaatcttttcagcgttccgattgttgctttcgcggaactctttaataggctcccccacgcatgcgcggaacacgagttggccagggctcggcgtcgggtttatatgccgattccgacgggtctctttcattcccaggacttcccattcaagttccaacctcttggacacttccctgacccttcaggtctagagatggcagctttctgctcgaacctggacggtctccagcctccctggtgccacgcagaccgaggcgtcctctcaggggaaaagctgtgtcgcgcaatgagtgcgcttcctttttaaagggctgagtcccctttaatagctgcctgctttgggttgttgtgcagtgacttcaagaggttttatgtttctgtttttttcctacagtttaattgttatctgtgggagggttaatccaacacgaactgctgtgccactctcaaccccacgactccttatgtattgatatttaaaaaagccaaatttagactggagaactgccgtcagtgccacgaatatactttgtacagttgcagagacagcttgttgcctctaatacccatattctctttcttcttcaggaatagtgaaagtcgctcagtcgtgtccaactctttgcgaccccatgggctgtagcccaccaggctcctccgtccatggggattctccaggccagaatactggagcgggctgccatgccctcctccaggggatctccccaacccagggatcaaacccgggtctcctgcatggcaggcagattctttaccatccgagtcaccagggaagacctcttcaggaaaacccagttggatggaaagccacatttcccaatttcctctgtggcaatatcgattctgctgcatataagcagactctatagggaggaattgtgcagacatcactttaagagagaaagagacagcagaacgccccttttctccttttctcccctcccgccacgtagtgtccacgacgccacaggtggggtttccgcatctgccttgggtcatgaattggtaatagaccgatggaggagagttcacgcatcccccaggagcgtggtccctagtccccgtgcaatccccacaccagatctgcctgccag

SEQ ID NO: 24559 - DNA, 966 bp, Bovine  19866881093841
taaagttaaaagttgttctgagcccagagaggactggggaataaaagcagtgaaccgcaaaactgtgtcaagaaaagtttacttttcatggtcattgaattaacgaaagaaagaacaagccagcctggtccacctctttctgcctccgcatcatgctgggcctccctgccacagacgctgctcaggccccaaacgcctcttccaccagaggagagctgccaaaaccgagtgctccttgactgggggagggagggggaaaattggaaattgctaattctcactttccactcacttgcttgaaatgtgacaatcgtgtttctggggcatccttcgagagacacaaggataagacgtggggggcaggggcagaaagcacagcgcctgccttttttccccctctgtggagatggagagagcagaatgacttgcaggtggccccatctgaagccaagaggaatgcaacgatttggaaaagagctctacctattttttttttaattgcaaaagaaaaaaagaaaatgagaagaaaatgctaatagttgcagctagaaaatatgcctgggagaatggcctttatcatctgttttttgaagtaggggttgagaaagagatgaagccagggagagaggacccagagggctgatcctgcgaacagagcgctgtgggcaccgggacacaattggtacctgagggagaaacttgcctgtaaagtcattacagactcgctcagcgattcggcgagaatcatttacatggtcttctaaatggtatagccctgtttcatctccagacaagagtgcgagaggtgtttataaagatcctagcctctgtttagggatgtctaaatacattctggtaattagcttaactttgatccaatgcagtgctttttctcagtaaaataaataaatcaacgaaaggttctggaatactctcccctttgagacccctgccattaatatcaag

SEQ ID NO: 24560 - DNA, 1536 bp, Bovine  19866881096019
ctgtcctctgccttcctattacccttttctcctgcatcctcccccgcctccttggctcgtctttatatctttataaccctggtcgagttggatgagttacactctcagaatgaaccaagatgtatgagttacgcagttacaatgaaccagatgctccacaaccttcgtcttcaaatacacataaaatctcaccaaatgttattcggagaccattgctttctcccatccttccccctctggtctgcaaggctaaagcagaaagctgggaggatgtctctcaaacactctccttgggtgaaaataatactgcatctattcaactttttaatctgccataagagagctccaacatggctgttaacgatattctttgaaaatatcttcctaatctattcacaggcctcaaaacctttataagtttaaacattgccctttcaaaataatttggccaagattacattctagaattcaccttcgaaagttcagcattttatgtggccttcatagtcactgaatccgcgctaaactcattatccttacaagcgcactttttctgcacaatgtggaatttttttttttttttccttttcttactttccaataactgcagacaaaggcattgacaagaagggggaaatccttcaacagtctaaactgaatttattttttcatgttcagtctgctttttaaaaatttcttcatactttcattatctgtgagtaatttaagatgaatcccaatcaggccaaactcagagtccttttctgcagtgaattcattctcgaaaaaaacttgtttttcggacgaattacatataaaccagccagccagctctactcgagggccagtctcagccgcgctaccaggctgcaaaaatctgatgcgcactttccacctcccctgtccctttccgcctgggagaaaagcaagaagggacacatttccggggaccagaggccacgggagccccagaactggccggcctccccgcgctgccgcggcgcattacttctgcttttctaacctttccactggtgagcaccatcaattatgcactagaataacaggggcctggcgaggcagtgtaacagaaaggccgattatgacaatgaataattcaaacacctacgcgctgtgttccttttaccactgataggaggccaggggacggggatccacgttgcagactgcgccacaaggactggttcggggcaaacccgccgcacgctggccagggaacccgcctgctgggagcgaagaccggaaagaaatgaactgctcgcaaaagtaaagcacacttgcagaaactgattaaagaatggcagaggccacacgaatgctaacacctgaggcttactgttgaccctagatacaggcaaggacgtgcagggaacaacatttgagaggccgttagcatcttataccttccagaaaaaggtcaacgactacgtatacaaaggtcttcagagaagacaccctgtttccaagtaaagttgctcaaacttcactgaaaagaaattcaaccttggagcctct

SEQ ID NO: 24561 - DNA, 669 bp, Bovine  19866881119042
cttttgacaggggccgtgcaaagtttggaccgaagccccccaccaccacaaagagccagcccccaacagagtcactgcaccaggcggtggagaccagacacagggcgtcttaagcagggccccatccacctgtggggtgactggcgagacacggcccgccatgcacaggtggatagcatatttgccgagtgggaaagaaaggcctcttcctctaggcagctgagggtcagcgtggccagcagatcccgggatggatttcatcccccagccttgtctttggctgggcttcccttagtaggaccaaacttgcagggtatacgtaccaagcagcccagttctttaccaacttaggggtgcgtctccagacgcgcctttccggaacctggtaacacgcagaccgtgttgcgaatcattttcctgcagcgtttctacctgccgtgtggatggaaatcaggagcccttgggacgtggagctatttaaaaataaatgtggcatatgtaatcatagcaagcgattatatcaattctaaatggactttgccctaagaaaacttttaaaaaaggccaagctttggggttttatttcatttaccagaacccaagtgaatcgagcatgattgaagtgcctgtgtttggctgggctcctctatgtgatgttggcttgtcggg

SEQ ID NO: 24562 - DNA, 913 bp, Bovine  19866881146421
tcattgaagagaattttgtggattttttaaagtaaatattaacttatcaaattcaaatgaaaacttaaaaagggaaattgtagtatgcaggttagtaagaagtttattgaggacagaaaaatttggaccatccttattctttaaggattagcaaagataaggggctcataaaggagtgcatttaggaacatatttggaggtattcattgtgtattaaaaacacggaatttgatcaatattcttttcctgaaaagtattcacagttttgtcaacataactggaaaagacccaaagcttaaaactcaaacgatattgcaggcagtgtttatcatcttctgcttcccctacggttgataaaagttgactgatgggatttgaaaggaagccaggagtcttttttttttgtatgtgtgtgatgtctgtaaagctgcagtgatttcaggcgctccctcttgtaaagatctacgtatgcgtgacaaggaatgcagcatttaggaattcgcttacgtgtttcaaaatatcattaacaaaagcattggagatgatagctgcgttttgtgtttttttaagctggactgttgtgtggtgcggtattccaagctgctttcagcaaactggaaaccgtctccacggactcaggctttccctttacgtttgaactttcctggcagaaatggcttgtcgatagagtccaagctagttcattccctttgtgtgtagagaattagacacatgaataccacaaattaatcaaatgtaagtccagaatagaaggctctcacccactaacatgactgtgaaagccgctttgaatgagagggaaaggacccatcaaatatacatgaaaaatagtgagtttatgaaggcccgggaattgttgggctgaccggacctgcatgccaccacttagcgg

SEQ ID NO: 24563 - DNA, 1219 bp, Bovine  19866881183877
catgtctggacggcctttcctttgaccgatactgtaaacgtccctgcatcttaaatgcctgtctttctgtgacatttgatgcgaacacaccagggctaaagaccacatgcaggcacataccaacacaattagaaaatgcattaattgtcaaggcagtgatcagaatgttctgcttcactcaggctaataaggagcaactaacaaatgatgtcacaacaaagcctggaatgctatgaacagagagaaagcacatctgttcagggtatcaggaactgcttcctggaagaggaatacagtagtgtaggctttggacgatggatatgatcttcatagagatggagacaagcaggagaagaccattccagggagtcacagcaagaggagtgaagacttgctggtggtagctttggaggtggatttgggggccatacagaaagtagttcattctgagtcaatgagatccggtgcaagattggaagcttgggctgcagtggattagccatgttgtggggtgtcaccaagaagcttctcatattgaggggagggtcattatgatggattattctttataatgggtgagctagctgagtgctcatatgcgttatcattgttctgcaccattgtgtatctcagctgctgtttaattgacttgcaaatataaccggtactggaaaattttgaaggtctcgaattaggtctggttcataagtggttaggtggtaggaaggtaaaaaccggggcagttttagtatttccagatggcaccgcatggtgctctatcacacataaattacttctctgatttctagattgagcagttgttttcaaacttaatttttagccccccccccaaaaaaaaaccccattatttgcaaagatcattagcagaaaactaatatgtaaaaaaaaaaaagcagatgccatcattcaaacatcaggctgcatttaggagagattggcagctagggcaccccctcttctgctccagagaggctgtgcagaggctccctgggctggctgtatgagtcccttttcaaaaccccaaatacagcctgggtgattacttagaggagtgcgggatgattcacccctgccttttcaggcacagaaggggccccgtgcccctctggagatggaggtatttctcccatggctcccgtttatcaagcccttactgtataccaagcatggtgctttacggactcctcagtcattatca

SEQ ID NO: 24564 - DNA, 1003 bp, Bovine  19866881249871
atgtatttctctcttgatgcttatttggacaaagcaacatagcgcttttcagattcctgtaacaaatttgtttccctgcattttaagagtcaggctagcaaagctctagcgtgcgtgtgtgtgctgctgttgcgtgaaggggagacaagaggaagggggctggcgtggagtatgaattacacatggtgaggacacttggcgcggactgtctagaagcagatgtgtttgatgtattcaaacacgtgcatattcaaaactcacgagaggtgttaggagagcggatcagttccctccacacttcctgcccagaatgtcagaacaaaggctcgcttgatgaaattgaagggcagagatttatgaggggaggggtcacaaaaggaaaggaaattccacttcacgttgccttcattccgccttctgaatcggcttccatggaaatccctcacatcatgctgcggttgggttttaatacggttaatctttctcactgatggtagcgccgcgtacagggtttcgctgagatgatgataaacgtaagaaaatctcccgctttgggttgtaaaccgtccttggaatgatgaacttgattctgcgcacagcgctggcagagttatccgaggaaaggcctgagtttgcttcccctgctcagaagcagggcttttggatcatcactgcacgggatgagcctttaccagccacttgtgacaacctgagatccactttgttgaagaggctgcttcgttttggtgttagctgtcattttccaaagtgttagggctaagccccatttttaaatgtatacttttttcattatacaagtaatacgtgctcatttaagaaaatgcagaaagttatggaaagaagagaaaaactggtatcacctcagacagtgctactcttaatttttcaatgatttccctcaatcctgtatttcctgtacaaagagttttttttttttttcttttgctctctagttgactggtttatgtaatatataatcaca

SEQ ID NO: 24565 - DNA, 1109 bp, Bovine  19866881275842
cctgtgtaattctaatttatgtaactagaaataaagaaattccaagaggctttggtcagaggacatcggggtggacctttcagaatctatttatgtctgctccttaagttgggtggcccccgtggccctccaggcgcccctatgggccgaggcgaggcggcttccctgcagaagggctgctacctgctctgggcagaagcgcacagtggggtgaacgggggctccctgcccccatcgacgactccgcagacacgtgagcgccaacaagcatttccagccaagtgctttgccaagagtggctccctcaataatgctctttaatgctaccccagacgctggcattttcaaatcaaatgaacagtgtataaaattagttctgcatgaagttacagaaaaagaaaaaaaatatagaaagtgaaagggagcttttaaaagctccagaatttcttcatccaactgcttttcacaagggtttggcatttgagaattgctacatttatgatgttattcgctgctcataatttaggccctctgtctccaaacttctgtattaacacacgttgcagaggtttccacctcgacattttatcacggaggtttcccaaaccagccggcctgcctctggccaggtctggtttctcagccaacgccacgccactgggctcccttgcttttcatcaaccttgttaccccaaacatttttcattaaccttgaacactgcatttccattggccctacagctttcccaggaactttttttttttttttggtccttcttagttttgttctccatccaaactgccatgtaagaagtgaggaaaataccatattattagaagaaacagatctgaatagaatctagaattcactgaagttgtgaaaacgacttctatgaccaaagccactgactgtctataattgcggaaagcagaaaaaaacatattgctcttattagagagtcccgttggttatacaagtagttttaactaaatcaccaaataaatgcgtgttaagttgataggtgatttcgggtcaactctaattcccaaggtcaagtaagcctttgaacagtctttaagaatataagttcaccccaattcatcaaagc

SEQ ID NO: 24566 - DNA, 1441 bp, Bovine  19866881316407
tagatttgttgaaatagctctgacactgagattaataagagctctcccagaggtaataggatccgtgtgcatatagggaaaatttaagggctgaaaatcggatgctagacactatcattaaaacacttcctctcgttaattgttatcatgcatgtgttcgccatgcagaagtgaggcagccaggtgccccattcactgaaacttgcctcaaacaaagtagctctccactcccaaaaaggcaggctggaaatcaaacagaagtaaacgcagttgggtttggaagcaggagaatctgtgtatgtgaaggggggagggcattgtgtgtgtgtgtgtgtgtgtatattctagctgaattccattttcattaagacaatcacaaagagatggtccgtccaatgtctctataaaaggaagcgtccaagtttttgaggtggacatccgtggaatcactcaggtcctgagactaataaagatttggggtggctgttagtgacaccctagcagggttcctcgggggagcaaaggcctaggagggaaaaccaagggttcctagaggccccagagccgttcaggttggaataaataatgcgtaatgttcttagcacacagcaccatagcactgggctctgtttttattttttaaattgagaaatagctcatggaggaactcgtgaagttgctcagtcgtgtccgactctttgtgaccccgtgaactgtagcccaccaggctcctctgtccatgggatttcccaggcaacagtactggaatggggtgccatttccttctccaggagatcttcccaacccaggaattgaacccggatctcccacattgtaggcagacgcttttaccgactgagccaccagggaagactcgttggttaattctaacagcactgtgccaatctcccaccctttcagaggccatctccacctctcctgctaagtgtgtaggcacagagacatgtgcggagttgttcattcaaccttgcaagctatcgctattttaaatatatgctcctgttgcaggaaggcggaccccttccagtgcccgaaactgggctcttgtctaacactcggaaatgaattgtccgaggagacacatgtgctgacaaagcaagagattttattgggaaagggcacctgggtgagagcagtaggggaagggaacccaggagaactgctctgccacgtggctcgcagtctcggggtttatggtgatgggattagtttccaggtggtctttggccaatcattctaattcggagtcttccctggtggctcacgcatcgctcagccaagatggatgctagcgagagggattctgggaagtggatggacacgcggtgtctcctttcgacctttcccgaactctttcggttggtggtggctaattagttccatattccttaccaggatctgtcataaaacaactcgtgca

SEQ ID NO: 24567 - DNA, 726 bp, Bovine  19866881399742
attagtgttagtcactgagaacaggtctactgagacggcccctgcaacgaaatgaaatgcgttttattactaagtgccgaataaacctcacggagcttttcttgcctttttgagaccatgttagttccaaagaccaaaaaagaaaaagtatcaaagaaacagggaacttggaggccatttcttgtcccaactttagcaaaccacttgaagctctggtctgtgtcaattgagaccacattggaagggacctgaaactggtgttttaggtaaaattcagcagacttagtccccatgttacaagaaccgttgtaacaaaactttgtacatccatcaggcatgtgaactgttttgtataataaaagccactcctactaaaatacaacatatgatggagtgattagcatgcttttcacattgtgatcattgaaacgtagcagccaaataagctagtgaatttgatgagtgagtcaaagcgggtatgacgttgatgagaaccaggtgaaaggcaggtgaggcatatcacaaaatgcacacagaagtaaaatccacctcaataacaaagagttgcctgtgcgcatgtgagtgtcctgtgattatttcgcagccctgcatattaaataacgattgtggctcaggatgcttgaattttctgtgtaacagtaaaaagtaagttgaaaatacatgaggttcttctcaaggattcctgagcatttttcttttatataa

SEQ ID NO: 24568 - DNA, 1260 bp, Bovine  19866881430849
gtccagaaatcgacctaatgaaaaagtctaccacggtgttaaaaggccagcgaatgctcagcgtggactgattgccaacactctagaacaggaagctcccctccctggggctggtaaagagccttccatagttgggcggtgataacatcacacatccctaacgcacgtgcttttgccttcctgagcgccgcgacgtcacgacctcacggagagagaaagcagacgtgtgcaaagctacggaggaaacagcgggtacggggttggctatggttttccttggcacacggggatcttccagaagttcttctggggatcactttaaacacagaattgcacaggagagggcaaaggggcgagaaatctcagaaatcacagaggaaaagtcagacctggctctgtgtgacatctagaatgttctcttgcctcccaattttcccacctacaaagacgaaatcagacgttacatgaacccgaagaacccacagggcaccacctctataaaggttgcctgactcaccttaagaactaaattttaaaagccacggattgggataaatcactaggtgacataaaaaagcttttaggtgaacttgacaatcgagtggcctcaagacacgtctgtctcatcactgaggcactcggaacctcctgccctccagtaggctcagcctttaagtaacacctcagcagatctgccgaatgaggccagcatcttgccccagggtccccactactgggggggggggtgtctccccatggggaccgataagcctgggaccacaggacttgagtggtggcagctctggctggtcagagagttaaatccaacaatttaagggagcgtgtagtcaggcaggttgagaaagcatgggacgcagcccctcgtgactgcagagacccatccctctcctgactgcttccgagtctgcccttccaggggactccctgctactgggacctgctgggccccgtggaccccagggtcccacctggatccagccatctgggccctgaaaggttccacggtccccagcctgaatggcgattgtctccagaagcgtcttgactgtgtttgaagcatcagggcttattaaaaccccgaagggaagtaatccctgaatgccactaaaaggtctccagctgctaccgtttatgaaggaggcttgacaagatgtggcgggaaagaaaggggaaggggtgagcaggaaggacggggagagagaagaatttagacaaggcaaagtatccaaacagagcccc

SEQ ID NO: 24569 - DNA, 927 bp, Bovine  19866881439212
cacctgtgggattctcttacttggaactgtggctctttacagggaattaattgtttacaaagttttggtcacatatctcagttttatatatatcatcttcttgaatgaaaccagggttcctttgaaatttgaatgtatcgacatatttggctttaaaaccatatatttttcgtctgtctttcacccaatccatactttcattttctagtacataagaagtatgcctggaacttactaggcacttaaaaatcatttgttgaataaatgaatgggtttttctgtatgcagaagacagtattttgaatattcatgaaactagcaaaaaaatctaatcatagctgctgctgctgctgctaagtcacttcagtcgtgttcggactctgtgcgaccccatagatggctgcccaccaggctcccccatccctgggattctccaggcaagaacactggagtgggttgccatatcatagcaaagtaaccaaaatacatgaggattagttcttagcctaatactaagtacaggagaataccaagtagagtcgtgttgggtatttgtttgctcggttggttttttgtttgttttgctttgatttgaaaagacattagtttgcagctattctgatttggcactgagctgaaacgacagggtttggtcctgagctcacacgtgcatactggtactgtggctattgcatatggaactgctcagtagcaatgcccaaaggatgtctgtaaagtaatgtggctgatctttaatcaacatactggaattttcctatttaaatcactgtgatctcctacaaattagtcatcttttgagactattccttattcatcacgctgtagtcacacttcgttgatctttacaaggtgtgcatgtgaggtgtaaatggatgatgtggccgaggagaggcagaggacatcagg

SEQ ID NO: 24570 - DNA, 1594 bp, Bovine  19866881521098
aatgcaactagaagctctaatactgtctctcttcctttacttgagcagatcatcttgtgaaacccttggggtacatgcctcccatgtggatatctttattctccatatcagaaccacaacttgattcctttacgtcacactgtcctggtcagccaggacctcttttcaggtcctcactttaatattatgtcaacaacattgaattgtaaagagttattctttgaaaagatagaaggagaaagaatctatatgtaggatatagtccaaagcagtggaatgctaagctgtgtgtcaagggggttagagatcaaggcaaaaagataatggactttttggactaggaagggtccacagaagagggagaatgtggctggcttctcagatggatggaattgggttgggaggtggaagcataaagtgatgaaggcctggagggaggattaaatgtaatcaaaatgggggaaaatgtaggaccagcccagctggaagacccaacccaggccagccctgaagctcttgacctttctcccattaggccactaaagtgattcgatcctgttcctttgctagctgtctggagcttcagaggctgaaagctgcctctcgggtctcatctgtcagggtaactgaggactgtccatagttctcacagcccagctccttgcgagcctctttcctgagctctggagcctctggctggctttcaggcccatccccaagtggccatccatcccaggccttctcgaggtaggactaggctgtcggtgacgggaagggaatttcagccaagatcaggacctcccagtctggtaagcaagtcatgttttcaagttaaaaatcccgacagtaagctgtgtggtgttttgcggtgtgtgcagtgttcatttaaaacatgtgtgtgttgggcggggcctacggctgaaataagatccctctggcacatcagcgccatctgtcagcttcacttgggaccatgtcttgaggacagtccatcccttgagagtgggtgtggagggaaggtcaccgcgaagaaagcaaggatggtgggcggggtggcaggacggacgttcacggagtcaaaaattaaccggtgtcaaaattaaccggtgcgcgtgtggtaacaggaagaagggaaggaacagatgttgagggtagaccagttgccaacactcagggacggccggtctgtctttctgccagtgttccatccaagctttgggggaaacaggctcactaccttgaggtcttaatggaacatcagtcagggttgcgggggagcaggcttgtgccaaggagacgtcatcccagaccagatttcagtgaggcagggcaagtgtgggctctgccccctacacacagcttcagacccaccccttccaggcttgctagtgcctggagcatctttaggaaagccaaacttaaggagcctgtggtttcctcttggcccccacgccctgtggcccctgacatgttatgagccgccgaacctccagatgcaatccagggtcaaaacaagcctcgggctgtgctggttaatcttcacaacacaaggacccgtgagggcactgaggcttctacagagatgggtttctga

SEQ ID NO: 24571 - DNA, 968 bp, Bovine  19866881653508
tcatgtgagtgcattaacaagtgacccacacgtgccattttgtcctttgcagttctatcgtctgctgtggatctatgtacctgtaataaaatcagaagcaatgccccagtgctggaaagaattaaggttaaaatttaacagtaggattaacatctttcatgtcatacttggataaaagccatttgcaaagaaatttcttggcacaggtacaaagagatgaatatgaaaagtgctcttctttgtgaaagccatagtagctcccaaaacaaagagaggcccttcttgttgtgtgatggtcccagtgaaggctccttctgccctgcaggactccagcaggggctccagccccggcggtccaggagactcacaggcgcctagaaagaggacagacacccgagtcccagccctggagattctgactcgggagcagctataaaagctcctgtgatcccaacatgcactcatggctgagaacctctggaacaaaataacctacaactcagacaaaggcagtcaactgaaaacagaggaacttatcttgaaggatataaacaacttatgtgttctgatatttgaaaccaactttgtctctccaacagtcccaactccttgtacataatccaaagctttaattcctttgtttgtaatgtatggagaagggaatggcaacccactcccagcactcttgcctggagaatcccatcgacggaggactgtggtgggctacagtccagggggtcgcaaagagtcggacatgactgagagacttcactttcacttcccttcttatgtgtagcctgtcttccacttttaaacattattctgttcctcccactccagtgttcttgcctggagaattccggggacgggggagcctggtgggctgccctctatggggtcgcacagagctggacacgactgaagcgacttagcagcagcagcatcagcccagtattatgaagcaaacc

SEQ ID NO: 24572 - DNA, 1795 bp, Bovine  19866881763234
ctgggattctccaggcaagaacactggagtgggttgccatttccttctccaatgcaggaaagtgaaaagtgaaagtgaagtcgctcagtcgtgtctgactcttttgcgaccgcatggactgcaggctcaccaggctcctccgtccatgggattttccaggcaagagtactggagtggggtgccattgccttctccgacctacagcatacccttatttaaataaaaagaacatatgtagccttttcagaaacacagttaacctgtgctttttttctcaaatatatacaaactaataattaggatacttttctccaccagctacatctaatgtcacccaaaaagtatgtaagttgtgtgcttttgtatttttttttcacttgtttagagactccccaaaggcaagaacatcttttttttaaaaatttaattgataccattatgtacatacacatttatacacacgtagcatgtttatgagcatgcatatggatagggagagacagaacttatttttcaatcaattttcccccaagatttcatcaacttctgtgagaattctatttaaaggcaagcagaggatataacccttagtcagtgggcatgatttcatgaaatagaaaatgtttctaagccccattttaacattggctttactttttctccctggatctaaactggctaagcaaaatagaattatggcaaagtaagaaactctttcctcaactatgtgcattttttcttttttctttttttttttttactttttttttaccttttatggctcagttaggggatattttggagtgtggatttttttttggtagtcatttaaataattgtctcaattttttttgatttttcttggccatggtagagacggtcttttaaagcatattatttatttttttaggaaaattgtcctcttactgcagatttataactctagtagagacttccaaaaatcttatgccaacattgtaaattttactgtgatgttgtaaagttacagttagggtataattttttaaaggcatttcattttgtagtttggagtaatagttataagctgctctctatagaaaccactgtaacttgtgattttagaacgtcagataataatgcagaatattggccaaaacttttaaaatgagaaatattttactgaactaactctttctaaactgaagtctgggagagaaatgtgttgttaaaatgactaccttttaaccaaagattatcacttccatttccattagtctaccttgggggggctgcatatgatgtatactaattaaataggatttattggttcagctagattctgaattactctccttccttatggattaagagagtgcctttcttaacccttttccttgaaatccatcaggatcttttatgtggactggctagtattctgcacacttctaatgcttaataaatattacattacaatattagcataataataaatcatcttaaagtactacatgggctattaagtgagatcctattcagttgagccaagacatcaaaaagttttattttctctatacgcatacaaagtaatttaaaaactccctttccatgaaatgtccttgcatccataagatgtctacatattacagagtgaagtggtgaagtgtgtgtctccagttatgtatttcatttgttcaattcattccggggcctgaatttgccattttagtaagaggaaatttaaaatcgggcagacaaaaatggaaatagcaccatttgtcaagtaaatgcccttttcccatggcaattctgaact

SEQ ID NO: 24573 - DNA, 835 bp, Bovine  19866881807370
atgcttacatttacagactgagagatttcacattaaaatctgcacttctggtttctttggaaaagctgggcatcctggcctcatcgggtttgcttcatctcacgacagcgtttggccggagtagaggagctgccgtgtctctggatctggcctgttctgtagggtcagggtcgccatggtgccttcttccttcctgtgaattatctgccttgctgttctaggcatatggtttaattgaatagaagtccattggaataatgatccaatcatctcccttatattcagttaccggatccagtgccgtagcatggagtttgtcaatgttttttttccccttccttatcatccatggtagatgactttcacatgtacagcacactctcaagggtgctgtcagggttattctagctgtaacaagactgtgagatggttgctatagcctggaaaactctcttctcagaaaaagaaagcaaatactttgcaggcttcagaaaaactattactggtaacaaatttcttgtgacatctcacaactgatcaggacacacctgtgtgaagtgagagggcagttgagaatagctttgaagctgaaaaaggaaaagcataaataagtttagagaattgtgtttataaagcgtgatggaaaagaaggcttacaagacctccaagtaaataattttaggtcagggtaaatactgggtttactcacttctattcagctccccacacgtgtgttatgatcagggccagcccaccgcatgggggaaattggcagccaccttcttctcatgattgggctggtaaggaatctctactattagactcatttctagga

SEQ ID NO: 24574 - DNA, 1320 bp, Bovine  19866880356199
gcctattgggcagcattgctctagccctgcaggaaggaaagatagaatgaaagatggctgaggagtgtgagccagacgtgtgaaccctgggtgtaaggaaaatgcagctaagcttggaggttagttggctcagtgccagttctggctctgccactcctaattcttgggaaaaattgcttccccttcctggttatctcattgccaagaaaatgaaactgttgggcaatgtaatcctaggagcccatccactgatttatagattctatggctatttagcaggaaaggaatatattaagccatttcttccagatgtggagaaaagagccttgactcagagagaacgcagctggttccggggctacccagctggaccatcgggcgaatcatttaacctctcttgacccctatttcctcatctgtaaaggagggggcagttattggggggatgaactgagagaatgtaaaggaaagcacttagagaaaagactagggataataggctgccacaaggtcacataaagtgggagagtgacagtaagttaaatgagtttatttgctgaaggattcctttaatgcgctgatgtgcactgtgaatctctaagcattttgcaaaatgatacgacccccagaattccattttgtgttttaattctcttaaggaatgttcacaggcattggttatgattacacggaacacacttgggaattgccatttgcagagacggggccacagcttgctctgatggccatcccccagagtggtccctaaacagcagatgacctcaggaagaacgggaaacatcagggttggatgacatcatagattgcctgggttgggggcaggcagccacaaaggaaaccagcaaagggaaagaagagggcagatctgggggaggtgcagagtggcacagagaagccgaggttactgaaagttagatgcagacgacaagccaggcactgaccttgacgtttccatgtgcatcatctcccatcctcagagcagttctgagaggtgggtggggtcatttcatacttactttttatttatttggcggtattggatcttagttgcagcatgcaaactctttgttggggcatgtgggatctagttccccaatcagagatcgaacctaggccccctgcattggaagcatagaatcttagccactggaccaccagggaagtccccccatttcatacatgaggaaacagggtctcagagaggggccgggtctggagtcaaatcactcataattttgtatcctgatgtctattctctgagtgtgaaatattcccttcctttgttaagtttccagagga

SEQ ID NO: 24575 - DNA, 3730 bp, Bovine  19866880427961
actctatgactcttctcctcgctatattggggaatagccaattaataaacaatgttgtgatagtttcaggtgaacagggaagggactcagccatacaaatacatgtatccatcctccccccaacccccgtccatccaggctgccacataacattgagcagagttccatgtgctatatagtaggtccttgttggttatcaattttaaatatagcagtgtgtacttaaatatctattctgctctgacacagagataaaccaaagaacaaaactgaccaggtctatgcccttataaagaatgtaaattcttatgagaaatctgtaagtcaacgactgtatttcctcaaagctaaggcatcattgatttccatcatggatttaatagcagattttcaaggggaaaaaaaagtgctaaatatgtacattgattggatgttagcatcaaaaatacctccctgccaacgtcaccaaggcaacgagttgctatgacaaaactcagtttatttcttactaaagtaaagaaggacactatctagatagactttgtagcatctcaaagaggagtaagggcaaattgggctatctattgagctttaaaagtctggttcagggtgggtctttcactgaggggcaagggaagtcatggttagcactggataaggatcacgataaaatagtctggattggtatatacagaaattgaggtaataggactttcctggtggtccagtggtaaagagtccacctgccgatgcaggggacaggggtttggtccctggtctaggaagattccacgtgccgtggagcagctgagcccttgtaccacaactactgaacccacgctctggtgcctgggaaccaaaattactgagtccaagtacctagagcccgtgctccacaagaaaagcaatagcaactgacacaccacaactagagagtagcctctgcccactgcaactagagaagacccatgtgaagcaacaaagacccagcacagccaaaaataaccaaataaataaagaaattgagacaatggcctccaagagtcttggagcataaattgtcatttgaggctttatttcaaagagcttatgatgggtctttcaaaaaggccctggactcaacaataaagtcatttgtaacttttatcttcttgatcaaaagtttcctagaatagtaaaattatgttgatgacagcagtagaatagtaaagtcatgttaatgtatagagtaaactatgtagatggccttttaaacgtgaaaaatatgcatcttcagagaaataaagtggttacacaaataattataaagtaattatataattataatgacaaaacatgctggacaaacatagggtgctaggggaacatgtaactgaggctcctcacttactctgcagaggtcagcaaaagcatctttgaggaacttgtgtttgaactgatgcaaaatgatgagtttggctacaggaagaaatgaagaggcaggggtgggcggctaagatagcatgtgcaaaggtccagtgacaggaaggaacatggtgtatttaaggagttgtcgagagatcagcagggctggagcacaaggttaagaggacattggcacatggtaagctaactcgcttgggggttgggtggggaggagattgctgctcactgctatacttcagagtgatttcttttttcttaaagaaaaaaacactttatgcctttagatccaaagacagcatccccagaacctcaatctaagattctcaaagctttaaaaggggtaatgaatgtgccttcatgctagcttactagaacatcaggttaaaattgttgcccaacaatagcaaaaccagttctagaacatcctcctacatgaactcaaacttgtgatcaaacaggttgtcttgatgctggtctggagatcaggccatgcccaggaaggcaaataaatttaaattaaggagtaattcccgagtgcttgatttgtaaatgagttaaatcaacatttctttttttaaaaatccaggattaagacctttacagtggtttttgctttatatccaattatccactaattcagtattaaaaatactttgataatgtctgctagataccagctgctctgctagatcttgaataaaacctgcttcctgtttttaaagattctaagcaattgaggatgagagcaatggcaacgctagaactacgtgctcaaatgacattctctattcaggggcctctttgttccagttctctctgtctgtgtaacaagctacctccaaacaatttattattatcttttgtggtcttgtgggctgactgagttcagatcagcacttcttgcttggtatctctgagtcagttgcagctgtaggtcaactgggaccacagtcatctgaggactcagctaggttagacaactcagatggctcatttacctggctggcggttaatgatgaactttggtcagcagcacagctgaggctgccatctggagtacctacttgggacttctcccatatggtctgggcttctcacaaaatgaaagctgagttatgagaggaagcagaccaggaacaacgttccaagagacaggaacagaactgttgggccaggaaaggagattgggtgaaacttccccagcattacttctgccatgttctactggtcagagaagtaacagggccttcctagattctaggagatggagaaacaggttccatttctttcttctgtttgttttttaaaaacttgttattttatattggagtatagctgatgaacaatgttgtgatcgtttcaggtggacagcaaagggactcagcatatgtatacatatatgcatataaccattctcctccaagctcctcttccatccagcctgccccataacattgaacagagttccctgtgctatactgtaggaccttgttggttacccattttaaatatagcagtgtggacatcagactgcatctctcgatgagggagggacaaggtcccactgcacaagagcaagagggtggggtgggagatctcactgcagcaatctttggaaagtcaatctaccatattggaatagtgatgatattctgacaggagcttgcgccaagccttgtaagaaggaggagagggtgcaaaagaataacatgtattgctcttgcctctgaggtggttgttggcaatgctaaacacttgagagaatgaattaagatacttccaaaaccacatacctgtcagtacagagaaacacacaggcagctcccagttcataacagaaaaactcttctgaaaagtataaactctttgtaaaaatctcaactgggagcctgatttagactatttaaagggggaaaaagtataatcagttatgtatcaatcccaaattcctgatcaatcttccaaagtgaaagtgagtgttagttgttcagtcgtgtccaactctttgcaaccccatggactgcagcccaccaggctcttctgtccctgggattctccaggcaacaatactggagtgggtagcctttcccttctccaggggatcaatctttaagtcaaaactaaaacactgctgggactccctgatggcccaaaggttaagaatccgagcttccactgcagggagcatgagttaaatccctggttggggaactaagagcctgcaggctgtacagtgcagccaaaaaaaccaaacaaacaaaaaaccactgtaatatatctatatataaatgacaaccaatcatat

SEQ ID NO: 24576 - DNA, 1164 bp, Bovine  19866880501873
tgtgtctgggtggagagagaagtactctggaatcctggggagttggcatgtcatcctggcaatcgtcatgcacatttgctgagtgaccatggccaagccctctttaggtctgttgtttgtctgccttttaaccttcgctaagattgagagagtcttcaacgtacacatatatcttctgaggatgcttctgccccgcatcctgggcttcatgctttataagctgcttcctccaagcgctctccaggctgctgacacagcagatggagccggtgcctgcccacgactgacagatgagcctaatttacagccctcaacatttaaccacttggctatctgacagtgtcatctagctccaagatgccgggagagccctccccatccccagcaacacagacaacttcccacccccatgctctgtctgcacctgggacctggggaacatggagcagagaagccagcttccagccacgggtcagcgaggccttagagagaagccccatttggacttagcaatagtgtctagaagcagaagatgctgacgtggtgtccagacaaataatagctagcttgatctattttcaggtccagtttctcagccaatgggattactttggctgacctatttagtaataatatcagtacttctagaaaggcctgatactgattataaggtggtctgagaattgaaacacaccttattcttgtttgttgacattgaagacttttgagtggtcagacatttccatgacgataacaacaactctctaatatctgttgagtgctaattatgtgtatgtgtgttagtcgctcagtcgtgtccaactctttgcaaccccatggactgtagcccaccaagctcccctgtccatggaattctctaggcaataatactggagtgggttgccatttccttctccaggggatcttcctgaaccagggattgaatctgggtctctcccactgcaggcagattctttaccatctgagccaccaggaaagctgaccatgtgctagacataaacatattcacaagctcttattttgcccttccaacacctctataagacagatatgatgattatcactactttatagcaaggaaacagagaatcagagatgctaagaaatttactcaatattgcacaggtcttaaaaggtagaaca

SEQ ID NO: 24577 - DNA, 3924 bp, Bovine  19866880525628
ttccttctctgcaaatgaagatgataatcctgcctaccccactgggttgttggtgaggattaaagaagctaattcatgtaatgcgcttaaagtgtccagatgtagttgaaactcattaaataattattctagattcgcaggaagtgtgggggtttgagcctgaaggcagggagaccagtttagaagaaggaatggaacatggtggaaacataagctagcacaatgatggggtgatggagaagagctgcagtagctcctacctgaactgagttgactcaagaaactgacattctccagggacccagcaacaagccatgcaaatcaccaaacagatgtcctattcccggggttcctaccatgtccaggtctggacagtcccatgctgaactttcccaccacattgcccctgatagtgtgagtctgagatctgagctagaaagagttaattcagtgaggatccacagttgaagggtacatcttcatttcattctgccttgtctgtatttgcctgttcttttctgcagcctgccttctgttctgaggaagaagggctgcaaatgacctgcttcaggaccaaataacaatttaatagagtggagattcattaagacagtgctgatggcgactatagtctccagaatggagaaacagcccagaggacttagattctctaccagttttctgacctcaatttacaaggcacaattaagttccggaaacctcagaacagaatgaaataatgaaactactggcttttaatcactagtagaatcatgaggagttagcagacctctaacattattcagttctctcttttaaaggaaagtttctgtatcagtgacacataacctgatgtggattgctatttttcctttcattctcagaatgtactcatccaaatatatttttttaaaacaaaactatgtgccatgatagtgccaggtattggaaagacagtgataaacaatgccaacctaacccttgttcttgtgggggttaccttcaggaagagccgaacaacaacaacaaaactgctaaaaaatcatggcaattactggagaaggaaatgaatcaactggtctttatgtggctaaaggacatgggtcccaattttaaacatgattttcaggtttttttgtttccttttagatcataattgttatgaagcagacagacaatttcatgcctacctctggcagcttggggaattgacttaaattgattgagtcatgggttaataactcagagttattatcactttcttacatatctaggaaatcagtgttgaagggcagaatagagaaacatgatttgttttagttttttcatagttaggtgaagtttggtttcttagagtattttggaaaaactttagtaatgatgttaaagtaggggttaggagtgtgggccctgaagtcaggtacttgggtcaaaatttgggtcctgctacttattggctgaacgactttggcaggctcattcaccttaccaagtctcagattgtaaaatgggataataaccaacttctcagagatgttgggagaattgaatgagatgatgcatataaaggcttagcaaagtgtctgacacatatggcatatttctaaaaataatataacagagaaaggaggtgtgctatattgccgggtgcagtggaaattactgaactggtctatgagcagcagcaaggaagagtatgttcacaggcagcttttgcctgctcctaacaatgattgctggagaaggcgatggcaccccactccagcactcttgcctggaaaatcttgtggatggaggagcctggtaggctgcagtccacgggatctcgaagagtcggacacgactgagcgacttcactttcacttttcactttcttgtattggagaaggaaatggcaacccactccagtgttcttgcctggagaatcccagggacaggggagcctggtgggctgccgtctatggggtcgcacagagtcggacatgactgaagtgacttagcagcagcaacagcagcaacaatgattccatttccctctctccaccccaacttcctcctttgcaaaataggaataataacgaccatcttttgaggctatagtgaggatatgaagcaatgtatttaaaacatctagattggaggccagtacgtatcactcctcagtacaacgtaagaatcaccatcagtaccatcacatcatcatcaccattagcaccatcgtcagcatcaccatcatcactatgatcatcaccaccttcataaccaccatcatccatcttcatcactatcaccatcgtcaccgccattattagggacagttagttgttttgctgcttagcatgcttttttgccttcccatctgccttaggttatattgcctagaagcataatttgcaataggatattttgtgtgtgtgtgcaaatggtttattgagaggctgctctcaggacaaacaagtatcaggagagagtgggagaggaaagatgcaaagaagtgatttggggtgatgtccagctttggtcagatcctgcagggagttctagtgcactgtatcacagagtttatcctatccagaggccagagaactgggctctataccgccatattagtcagtcgttggttgcttgcctgctcccagaaggacctaatttcccagacacgcctgatgagagggctcctatcaatagcaaggcgatcccccagagaaggatgcaagataaactgtcagcacccagcatcacagcagctgggagatgaatgcacagactttgtattgaggctgggataccagtagcatccactgtacctttctgatgcactttgatttcctctggaagccccctcccctactctcagtcttatcccacctccaaggggagacttgtgacctgagacttggccaaagagagtatgagatttgcctgcccatagtaattggttcagaggtgatcatgtgatctcctgaaagtcaataaaactcaaggaaacttttgctaggaatgctggcagagagttagatggtctttcccacagataatgctaacaattatggcatcacaagccagatcagtcaggagccaaacatggggtctgagaatgaagatagttcagtggatgatagtcaaatgacagagagaaacgaggtccctggatcaaaacatgcttgaagtttactcttcccttgcactttcacattacataagccgtttctcccactttcgcttatttctctgagctgaaaattctggatacctgcaatagtgagtcctgactgatattattgctgtaatggccccaggagtgctatgtaaatgagaagcagtcaatcaacttacaggattattgttgctatgtaaataaatttctcttttgactgcgtgagcagagacttccaagccagggcagttttccaaattagatttttcattgtctcagccagaagagaggcacattaggctactcagagggcaccaagcctgcccatacctctgagaatgagactttcctgccagctttccctaattgctgagggccaggtgctggcaaagtgactttcaaacaaagtggccatcgtaaggctgacagcttaaaacaagccagaggaaggcatagatttactttagaaggaaaggtagacaaaagtagagtgggacaggcaaatgggtgatgtcaatgagcatttttaagagataaattgagtcatattcaaaatggtaagaatttatttgagcaaaaatctatttgaatctgccagtgcccaataggaagtggttaggagtagcccaacacaggagcttggggaaagatgtttatagagaaaggctgaaagtaacgtgagggaatggtttgctcagctatagcttacttggttgccttatggggagaaacctagtggctatttgggtggtgtctttaggtatcaa

SEQ ID NO: 24578 - DNA, 708 bp, Bovine  19866880566062
atgaggttctgtaggttgcccaaaaaaacaggcacaagcaaaaatacagatctccctaattctcacatcctcaagcacatcgaagagtttggccctggatcagagatattcccagctgatgagctgagcagggtaaaggaaaggccaagagaagcaggctttccccagtcagcaaatgaggaggcttccccagccttgggtcctccaaggtcaaaggctggcaaacagtctataattggagtcatatgtcccctagcctttgggtaaccacatggctgaataactccaaatcaccatcatggcttagttattgtctcaacaacagatgaaattcagaaagaagagaagcgatgtgggtgatccgagagctgcagtcctagaaggccattatctgtcttaagcttcagcccaccctaccacctactcctccatgggaggttataatacagcaataagtctgcaattatattttactggtgaaaaaaaaatagtggtgagtcaaaagccagctcatagatgtaacatctctactagttacttaagtgggagggggccaagtcttgggctgaagtcagactcctcactgtgggcccatgttcttgagtctgactgctctggaccaagtctcccaggagcacttagccctagctggtgatgaccaccaggcacaagagaggtagggttaaggttcggaaggaggctgtagga

SEQ ID NO: 24579 - DNA, 1042 bp, Bovine  19866880646653
gtctgactcttgcgatgccatggactgtaccctgtcggctcctctgtccgtgggatttcccaggcaagaagactggagtgggttgccattttcttctccaggtgaccttccaacccaggggtcgaactcacatcatgcttcctcctataacttattcagttatttccaggacccatcagtacttaaactggcaaggaactatatccacttgggcattcgttatccttggaccaagagtattatgaaacacccccattaggtcaaaaaggtgagcacagaagagagatttcatttaatttctcctaacactctctaagattaagaagacgaaaatgagatgccattgaaagttacttttcgtcactttttttcaaaaatcctcccacttcctgttttctcttgggagattgaaaagtgtctccttgcatatttttcattatcaggacttaatgagaattttaattagggctactgcacactttggtggcagctttcaaaatgtggctctggcttcttatttgtcaggcagccagtccttgcgtcattgccaaagatgccctccatcataataatcctaatagctatcatttattgaaagtgtacttcgtgccaggcaatttgcatacattagcaccagtcttcacaaaagtcatatgaggtgggaactagtcaccctaattttagaggaggaaagtgaggctcaggctggtgaagtgattggcttggagccacacagctggagacgggcagaccgaggactcactttggctgaattctctggtcaggaattttttctgtccagccctcacagggggtcttggggacagacaacaagacaatgagacaactcatcaccacttccgatcagaattgtggttatgagttattatgtcttcagcctcggattctcagtctcactgagaacagtgctatggtttagggaatcccaggagactctgagacacccaattagaaggacagtaatagcagatcccagaatagactgattgcttattcattattctcttattcctgaactttt

SEQ ID NO: 24580 - DNA, 2445 bp, Bovine  19866880664210
acttcagtcctgtggatctgggctgaggcccctcattgccttaatggaccatgtgaccttgggaggtcatgtaggtatcattcataaagcactttgcctccagtcagattccccagaaacagaccctgtggtgaagatcaccgtgtgcttcagcaagggttcagaaagacagagctacagagagtattatgaaataaagaatttatcatagggtcaaaaagtggaacgactgagaaattataaccaggagccattttttctgggtctctgttgttttatctgtaaatttgagataataaaagcttccatgctaaatagcgcagagtgggtactcaaaaaagtaaatttccttcaacaggtaaagcaagttctaggcaaaaccattaactacatcagtggctcccagaatctcattttgcagactgacacagtaactttaaaaaacgcagcagaaactcacacaacattgtaaagcaattacactgaaataaaaatttcaaaaaacggggaaagttatgaatgagcgccaacttttaattttgccaagttatgacatcagataagtacttactagctatgatcaccatcatttcgttaaaaaacccgacagtttatttatttatctacgtctgtgctgggtctttgtttctgtgcacgagttgtctctagttgctaagagcaggagctagtctctagttgtggtgtacgggcctctcttgctgcagagcaaaggctctagggcatgtgggcttcagtagttgcggcacgtgggctcagctgtgactcctggactctagagcacaggtgcagcagttgtggcacatggccttagccactccacggcatgtgggatcttcctggacctgggattgaacttgaatctcctgcgttggcaggcagattctttaccactgagccaccagggaaacctaagaaacaacattttaaaaccaaaaaatgtaaggccattgattatcaccaacttaacaataatgatggaccatgttgtcaatttagctttatggtgacatgatccttatttttcctctaataccacataggttagtgaacagtgtcgtgggcaggctggtacccaggtgtgtattttgaggaagaattgaactaagtagcaactgaatatagtctcctctccttcacttgtctgcatctcttaatcctctctgcttcctcctcattcatttgcaggaaatctattgccttccctcaatgcaccaaaggtactccactgtggtagccctatatcttatcctccctctcttccagggcaactaaaagactacatttctcagtctcctttgattgacaagccatgtgcctaattctggccgatgggctgcaagtagaaatatctgtcaatcctagatgaaagcatttaagagccagtgtgtgattctccatcttctttttccttccatagtgaagtgtctgttgaagtggaagtgccacagagggaagcagctaccacacagagagtagcttccctcgaaatctgcctagacacagagggctttgcaagagcaagaaataaacttgggtaaaacctgtgagatattggtattgccaattactgcagtataatgtggtctgctctatccaacaccagcataggaccaagatctattggacctaagcaacttcacgtctggttttgttaacaattactgcgtagaaataaatattagtctgaaaagaaaataatttctgactttcaattttttactttttaaagttctaatgctttcttctatctgagccatcccgggaaactatgttgcattgtcctgttcaattcagttcagtcgctcagtcgtgtctgactctttgcgaccccatgaatcgcagcacaccaggcctccctgtccatcaccaactcccagagttcactcaaactcatgtccatcgagtcagtgatgccatccagccatgtcatcctctgtcgtccccttctcctcttgcccccagtccctctcagcatcagagtcttttctgatctaaattaaaatgtcatagcttagttggaggaaaaacattcagccagccctgagttccctttattatttaccagatgcgattgtaaagctgcttgtttgtgggcattctcagagaatctggacaaatgacttagctcttgccttttctccagggttttgttattcttttaaagttcctgttacataaggtacaaggtaaatgcagcatgatgtattactttagattgttttcaaacagtgtaatggacagtttgctcattgattaaaaaatgtagccaagaccattcattttgatattaaaaattcaattgttgattgctacttatttgttttttaggcatttgtatatacctactggagaagacaatggcaccccactccagtactcctgcctggaaaatcctatggatggaggagcctggtaggctgcaat

SEQ ID NO: 24581 - DNA, 963 bp, Bovine  19866880718166
gcttaacatttttgggtggtatttacattttaaaagaggcacttatttactcaaatctcaaaatataatacccaggagatatttctgagctgagtctttttggtgctctgtatctgtgacttccataagcagcactcacaaagaataacagcacaaaaatagattcataaactttccaacaaacttctgaagtcttcagagacaaagctgatagctttggacacaaacaggaaataaaatttcaaaacgccaaaccaggagaaacaaagcgtggtgcaatgggaagatctcgggccacggatatcaaatggacctgggttctaattatgatgccaggaactttcctagcaggccaggggttaagactgcgtttccagtgcaagggactcaggtgcaacccctaatgaggaaattaagatcccagatgctctacagcaaggacaaaaaaaaaaaaaattatgatgccagcactgataacttgatgacattggccgtgatacttgattttttgagtcccagtttctatacttgaaatagacatagttaaatatttattgtggtgcctacatgacacaatggggcttccctggtggctcagtggtgaagaatccgcctgccaatgcagtaggcttggcaattcctgggttgggaagatcccctggagaagaaatggctacccactccagtattcttgcctgggaaattccatggacagaggagcctgttgggctacagcccgtggggtcgcaaaagagttggacgtgttactaacacaacaagtgacacaatgcaaatgagaagccgagtatgatacctggcacataacagatttttttttttttaagatgactgttaatgttttgctgtctttatcttcatcattgtgatcaccatcaatggctcctgcactgccaagctgaattgtctggggaaaattacttaccatcccccagcttcagtgct

SEQ ID NO: 24582 - DNA, 1328 bp, Bovine  19866880748217
tgctttacatttctaggctaacaaggtgcggtaatttcattccaaatgtgtaaatattattgagtttgtcagggctgctgcccgaatccgggacagagaactgatgttcaggaccaagaggatatggaagaaagaagcagcgtgggggaggaacggagaagcttggctaccctggcttgcttcagctaacatttccgtgtccttgtgcattttgtattaacacgctgcagagagcatctctttggggctgtggctcatacagaccctgttctctggcctcagaggtgggaggtaattctgcccttggcactaaggcaaggatgagggattccaggagcagagagttggttgctcaggccatggtttgccttctctcatgtttccagtcccttgattgattctctcttcttctgattgattattatctgatacttgcttaactgactatctaattacccttgaggtacctcaacgtttcagcagttgaatgaatgagagtctcatcctgtctgtgcccaagtcaatccctcccccaaatccaagggattttggagtcttatctgagttgttgagaagagaaggagatatcagaggaactagtcttccccttgagccattctcctttttatctgtcactgcttcagagagatgagcttcttgggtgcccgggaagcccaaagtatttccagtttccctgagttgttctcactccctggttgttattttcttagggccctggaagcctggtttgtagtaaaagcttcatgaatatttgattgaatggatggagagagtgggtagatgggtggttgggtgaataatcaaacctctctactggtagctgaaatggtattacatgatttcagtaccagatgaggagacagaatgttgatctattgttatgaaaattgaagatcatgtttaacagtttctgtcctgaagaagcttagagtttgtttaaaaattaattaattaatttaaaagttgaagtctagttaatttacaatgttgtgttagtttcaagggtgcagcaaagtggttcaagttatgcatatatatatacactattttttcccaattcttttccattatagatattataagatataagaagtttagagccttataaggaatttaagataggcttatagttattaaatgattgaaaaaattaccatctattaatcatctgctatataccaggtttatattatattttcatagcatatatatattttaatatatatcaaacttcttttaagagcatatgtgtatataatgtctataaatttatatgtaaatatgtaacatatataatatgtagtaca

SEQ ID NO: 24583 - DNA, 1079 bp, Bovine  19866880782017
ttgctcccctgccagtttagaaacccagggaacctttaccaatgcctcctttcccaagtctggggaaaagccctctgtggtcaaaaacccctattctcattaatggatttaggattttgaagtgggaaggagaaaaaggagatgcatctgtcacaaacccttgccagaggcaaggaacacagaggactcattgcttaagtggagagagaaataccaggagacaaaatagaaaacagtgcatatggcagaagaatgatccaatgcacaattattgagtaggttttgcaaacaattcttaccatccctctaaaaacattcatatttccttctctttaaaaataaaaagcttggcaacagggtttctgcaagatcatacttctacaaagagttgtaagtttccatctaataaacacggccaattgagaaattcataatacatgaaagcaatcccaaaggccatgaagtcagatggacctggagtgataccataagcctagtggtgaagaaaaagagttgtcaagttgatctgtgaagtaaagaaaataatgaaagcaagtgaacacagtccaaaaaaattaaaagggattatcttacccaaaataggatgatttaatatgctaacacacagaattctttcctctgcccccaagggctgtgtgcatgacgatttgtactttgttttagaaaacttatgattgtttggaagtgttttaaatgattcaggggcagagatgtgaaggataacaaatgaagcaactaaagtttcatattttattgtgagttcggccctacttaaaagtcaggctgagcttctaatcaaaatatgaagggagagagcttgaaagtaatatgaatcattaatatgggagtacttaaggtaacgaactcaaggattttcgaaaatttgcagcactttttcagataacacgaagaggttgagtatttttatttccctctccttcaagattctttttaagacatatttaaaataggcctaaggtcaagatcatgaaaggaaagaacagttttgagttactcccttataaattgcacagaagacaacacataatatcttaata

SEQ ID NO: 24584 - DNA, 1555 bp, Bovine  19866880783291
acccattctctctccatttaccccatggctccaacagtaggctttatctatctgataaggatgctgagatcatttcaaggggaccaagcaaggcttatggaccatgatgatcaaagaataggagttattctcagtatatattaagttacctgggcttcccagataaagaatttgcctgccaatgcaggagacacaagagacacgagttcaatccctgggttgggaagatcccctagagtaggaaatggcaacctactccagtattcttgcttggaaaattccacggccagaagagcctggtgggctgtagtccacggggtcacaaagagttgaacacgactgagcacacacataagttgccctggaattgattccaagatgccagaataagaagcaagctttggcaatcatttagttccaaccttctttttgcagcagaagaagggagcctggagacctgcctgaaggacagagctctttagcagaaccagggcaaaaccccatggctttcaagaaccatccgttttgccaactgctcaatgcaaggggcttccctggtggctcagatggtaaagaatctccctggaatgaaggagacctgggtttgatccctaggtcaggaagatcccctgaagaagggaatggctacccaatccagtattcttgcctggagaattccatggacagagaagcctggtgactaacactttcaccttcaacacaaagagaatgcaaactgcactgaagggcttccactgaagtcttttaatatatagtttattttggaattataaaagctgtgcatgtttgccatagaaaattgggaaaatacagaaacaaagaaagttgtgacaaaaataaaatgatcctgtttcccaccacccagagagctgtagataacttggcatgtttccttctaggactcttcctatgcatagctttttgtttgttttctttttagtttttagatacttgtgaaggcactgtgtatgcaatttgttaccagccttcccacttaaattataaatattttcccatgttattacagtctctttgtaaacaattttctttttcaatattcaagtgcaatagtctcctgctctatgcctacaccctaccctgctcacacatgcatctattgcgatccccttgggaactggcttcaaccatctgtgtttaaaatttttctgttacctccatatagcttaaaatgtgacttctagatttttctacttcataattacctgttgatttcctgctgtgatagatgggaattgagtttatttctaccaccaactctagatatatcttttctccttattcttctcccaataattataataattatgccattatttttcttatttcctccttggccaccatgataattgtagataacttgcctaaccctcactttcaagatctttgtcttgttttcctccctacacttctgaacttctattgactctagtttttatttttaaaatttttattttattttatttttgactgcaccacacagcatgtgagatcttagtttccgcaccagagattt

SEQ ID NO: 24585 - DNA, 3092 bp, Bovine  19866880796153
ggctgcaaatggcattatttattctttttatggctgaataatactccattgcatatatgtaccacatcttctttatacattcttctgtctatgggcaactagttgcttccatgtcctgactactgtacacagtgctgccgtgaaataggggtgcatgtatctttttaaattatagttttgttttcaacaaagcagcagaaattatgtcagagcaggggcactagagaactccaccacctctgtgtgttttttgctacagttttttgatgctgaaaaaactggatggttaacttatgaccaggaagtttaggtaccagatatttacaccgtgattttcattctgtttccattttgggacatccttgctaatctctctcttccatctttcccaaatgctttagtgaataaatgggttattatctctcaaagttagacaactttttccttcaaatgcaggatgtgactcttggctctgagtgtgagattgttggaagatgtctaaaatctccattcaccctggacaccatgaaatatacatgacaccaaaataggcagacttgacaactccccccacgcatgtcaggagggtaatgtttgcgatctatatgcatcttggtcaagtggacatctgggggtcagcttgaaatttatcgataatttcatcagggtgataacatttcacacattacccaaaccagcttcctcttttccagatgatctgaagaaccaggtgaaactttgattgcagctgaaaaagctctagaatcaaagtggccctgcctgcccctggctatggttttacttcccttcccctgaaagagagaagtcagcctgtttgatgtttggatggatgttccaaccaatcatacatgtgcactgatggtccctaatctacaaggtccaagagctggaccagagaacatcctccttcctgcactgaagaatgttttcttttctgcactgaaaggtagctcttcctggcctctgacttctgaagacagacactgcagaggacctcttgccaagaaaagaagcaggatgaagagctggatatctttttttgaaagcttttttaaaaaaattgtttgtttatgtattaatttatgactgcactgagtcttcattgctggacatgggctttctctagttgcggtgagtgggggggtgcctactctctagttatgatacacaggcttctcattgcagtggcttctcttgccactaagcatgggctctaggcatgtgggcttcagtagttgcagcttgcaggttctagagtggggttcgctagtcgtggtacatgggcttagttgccctgtgcatgtgggatcttccaggaccagggatcgaacccatgccccctgcatgtccgactctgtgaccccatggactgtagcccaccaggctcctctgtccatggggtttcccaggcaagaatactggagtgggttattgtgccctcctccaggtgatctacccaaggatcaaaccccagtctcctgcattggcagtggggttctttaccgctagcaccacttgggaagccccaatataactgcagtgtgtgtgtgacagtcactcagtcgtgtctgactctttgtgaccccatggactgtagcctgccaggttcctctatccatggaattctccaggcaagaatactggagtgggttgccatttggatttctcattttttttctggtggcaccgctttgcttcaaatctacctccagtcatttctctagactccagccatccccctctttctttttctaaatatcactatctaatttatacccccaactagattagcaagaaggaaaaccagcccaagatcatggggagtgttttctgaaggatgttagggaatagagatagaacatgaagccagtcgaatgcacatcaagaactgtaccagctatttaatgcataccaggttatcatggcaacctggggtagtattatagttacaataatagcattactgtttccattctccagacaggaaaataaagatcaggaaggttcaatgacctgttggaagttatactgcaaacatatagtggaactggaatcagaacccaggactggtctggagaagagacaaggtcattttggaagggaagcttgagattacggctacaaaatatcccaaaatgttgaagccagggagaaaaaaacccccactgtgatggaagagagcagatgaagcagaaatgtgggaaaactgaaatatatgcatttcttgttttttttttttctttttatttaacactctttatggaacttaagtcattttgtaagctttgaaacataaaaatgtattatgtataatgtgctttgctcataaaattatcatgtttggtgtatttaaagacgtgagaacatgggaagaaggaaaggagtttaaggggaatagctttttttcttttttttttgaaaaaagttaaaaggttttgatggggaaaaaaatgttaaataaaaattttctatttttttcaccagatgttcatgattctatttacagccattaaattttccctttttctgttaactttcaggaaccctcaaactgaccctcaggggttcctccatctgcctcaggcccaaagctcatcatcactatccccacccctctggggatatcccctccttctctttagttgtggacacttcacaactctggcacccttgatttttctggctctttctcaagtaccagccttccatccagctttctgttagtagctgttacttggttctgcctcttcatgataaactactccttctgagtggttagtgtctatatagctcacagtggcttctagtcatctcactgagatgacttatgatccttgggattggctgggtactaggtaaagaggactgcttctctaagacttttacaggggtcaggccagggaactcccctttactacacctgtatacctgggggacacagtcctactctagggttcctggtctgatgaatggagtgtgggcttgaatgtcactcccagttggcctcttggtcaagtgctcatcccctctgtctcagatcaagccaaggttttcaaaagaattttgctaaa

SEQ ID NO: 24586 - DNA, 2678 bp, Bovine  19866880848846
gcattccctgcatccgacacctagaggtggccctcttgggaggagaatagctcatggaggtgtcagatcatctgcccattctccaagacccggattccagtctgtcccatgggtgaaactcactgggaccattcagtgcccattccctgctcctggagctcacatggtttcctctttttattcattcttggttttcttttcaccattttcaccgagggcctaactatgttctaggcacaggaaataaaatgggtgataagacaaacaagctgtctactcccagagaaattttattctagtggggaaaggagaaaattgacaagtaaagaaataaattaattttatattgtggtgggtgagggccagaaagactctgggacagtgacatcaggggaggtggagagacttgatgcctggatgttagtgagggcccttctaaggaagactgaagacccaaggaagagagttccaggtagaggaaaccgtggaccacaggccctgagatcagagtgagctgatgtactccaggcatagacagagggttcgcatggctggtgagcagtgagggaaggagagaggtttagcaaggcaattaaaccagtcaattctaaaggaaaccaaccctgaatattcattggaaggactgatgctgaagccccgaagttctattactttggctacctgatgcaaagagctcattggcaagaccttggtgctgggaaagattgaaggcaggaggagaaggggaggacagaagatgaggtggttggatggcatcactgattcaatggacatgagtttgagcaagctctgggaaatggtgaagaacagggaagcctggcatgctgcgatccacggggtcggaaagagtcagacacaactgaacaagaacaatggtattttttgtgttagcttattaagttgtattttcagcagtcacgtctgtgttttctacttcttgatatctgcctgtttgtttttttttttaatttacttatttttggctgtgctcagtcatctttggtgctcatggactttctctagttgtggtgagcaggggctgctctccagtggcgatgctcaggcttctcattgcagtggcttctcttgtggaggatgggctccagagacgggctcagcagttgggacacaggggcttagttgcctttcggcatgtgggatcttcctggaccagggattgaacccatgtcccctgcattggcaggtggatcctcaaccactagaccaccaggggcttcctatctgcctgttatttgttttgcttggagtgttcactgacacatgttgattgaaatttttcctcccctcattgtattttacacagcataagtggtcctggtcccttcaagttattatttccacaaaatactgcagcccaaagcagaaggctacaaggtcccatgtggttttcgtgcctgccaagttacttcagtcgtgtctgactctttgtgaccctatggactgtagcccgccaggctcctctgttcatgggattcttcaggcaagaatactggagttggttgccatgcccttctccaaaggatcttcccaacccagggatcgaatccgtgtctcttgccatctcctgcattgacaggcagattctttaccactattgccatcggggaggcccccgacgtgggggcatagctaatgaacgttgggtcacgtttcaccagtacagtcaaatcaggaggaccacacctgagcatcaaatatgagaatcaaaatctgatgaggaaattctagtatgtgctctttgggaactgtttttttatacctccttgggctcagttgaaagatacagctcctagcacttaacaagctccttgtcacatatgtccatagatctatcagaatacttctgctgggaactctccgacaggaaggggatgatgtctccctgaagtcctctaatttcactgcctctggctgagacaagttgggaagaaagcagtgctctccttttcggactggatggcttcaaggaaacaagtaaattctcagcctcaggatagataatggtgtcgaaatggccctggtttctctccctagtctcattttccatggcaagaggagttgaaaagttggcactcgagccaaagcttcataaataatttgttggaaaaggcaaaccctgatgagagccaaagacctatatttcaaaggagccatggaaattctgagttctctgtcctggcaggttctaggaggtagtgagcagaggaaatgataggctgtggggagcttcaggatccaggattccatggcttttgggagatgtctgtgatgccttcaaaattaggggagggtggacctctgctacttcagtgggtcactctttgtcacatcactgaggacatctttctcagctgcccaggcctttgtgtcatcagacccagctgcccacatgggtagccccacctcagagctggaccctaacgctctcactatgctgccttatttctaaacaactcttcacctacatggccacatttttttttttttttttttttctgatcagcttctgaaccggttaatctgtctctttcatcttgatcttgacttttggcacttttcccatcccaacctcgactgtccctctacagctaagatgccgtgtccacacaaactcaaaggcattttaacccagccat

SEQ ID NO: 24587 - DNA, 1526 bp, Bovine  19866880976717
gagtccgtgtacttgtgatggtgacacattgcttctaacaaaaacatcgtcctccctacccagaacatggagtgccaagtcaagtacaattatagataggggcttcactttgttttcctaactggttccatggcatcctactttttggatctcatgcttttcctcagctaaaagggagaaaagggtactgcaagcctttgcctttgatcattttaatgcaatcagcgggaatctaggaggcacagttattgctgaaagctagggttccagtgggttactttgagcaggttatttttctaagtcctcactttctcatttataaatgggataaagggacctccctggtggtctagtagtcaagattccacacttccagttcagggggcatgggtttggtccctggttggggaactaagatgtaacatgctgagaagctcgccaaaacaacaacaacaacaataggggcttcctggtggtccaggggctaagtctctgtgctcccagtgcagggggctcagcttcaaaccctggccagggaactagaattcatatgctgcaactaaagatcccttatgcagctaagacctggcacagccaaataaataaatagggtaagaagaacctttcaaaggatttgtcgtgaggatggagataagccaaaagtgcttagtacaggccctgaaagggactcaatgaacatttaattttatttttatcagcaaatggtgatcagaaagatgaaggaaattgatattaagttatatgaggagtgattacaagatgtttatttttatgggggagagttacaatggacataaagactatcttcaactgtctgatggaattctgtaaaaagaagagtttttccaaaagacaaaaccagagataagagaagtgttacaggaaggtgtatttgggttccagaagttttccaacaactgctcccacatggttaatgactagaaaaggagagagactctcctcatgaggaatgccttgggaaacctccttcgctggataggggaaaactcctacacatccatcaagatccatctcagttgtccctacttgagaaagtctgtgatcaccttcatggtccagcctaaattcagtgtcttgaacttgacctccccagattttacaggttacctgttaacctgcctctttctgcatctatatgataaacttcttttgttctcagttgtttagctctttagacacattgcccatcataatgcctgggactgagtagaaactcagatgtcaaggggagaaagaattgaatggacagaagtgatttctgatttaggagaggaaactgacaccggttgtgtataaattttcatccaactggaatatgcgatgtgttcttggttatattttctaatatccaactgatttttaccaagatcttatcaggctgtatatccagcaacaaaacaacagcttgaagcaagaaaagggtaaacaaacaaaccaaatgtatttggttcctctagcaatctcactcctgggcatatacatga

SEQ ID NO: 24588 - DNA, 745 bp, Bovine  19866880989320
cagctcaccctggctcctggctgatggagaacaggaggcaaaccagcatggaacccgagcactcctgatcccattcagcccagagagcatcagagcagccaattaagatgttttatcctaaaagttctcagtgaaagcaggtggaaagaggaggtcacagagcttggagcacaaaaaaagagaaaaagtccatatctatatgtgctttgaaagtcttattctaaaataaaaattagggggaaaaaaaactgggtcattgaattgaaattcgtcaggatcctcattaaaagtttgactttttctcatatgaatctcaaataatagaagaatatgagaatggcatttggttattttagggtcataggaaaagtttaggcttttgatccaaagagaccagggttccaattttgattttttggcttagctctgtggcctgcaacaagccaaatgtgctgtttaatcccagtttaccccctcatccgattaaatggaactaatttttggggttaattaaaggaattaaataaaattcttgtaaagtgtcttcatagtggccaaacatgatatgtgctcaatcaataaaaactgccacatctccaaactctgtaaagcttttttaaaaaagtttattaaagtatagttgatttaaaatgttgtataatttcttctatacagcagagtgacagtatgtatgtatgcatgcatatatatatatataaatacatatttttcatattcttttcta

SEQ ID NO: 24589 - DNA, 2685 bp, Bovine  19866881077605
aagactgacagacatcctggaacagcaggtttggatccctccagaggccacatccctctgcctgctggagcttgtgatggctggaactgatcctctgggacacgctttggctttttctaatggctctgtgggaagctgagcctgcagaccccctcctcttgtgggaagtcacccataggagttccaccatcaggttccagaacagtgggcacgggatacctccacagtccactgaacaccacgactgggacgaccaggagcaagaaagttccatcgtctatcaatggatgaagccaacacgcatcagccacttcctttcctacatgagaaggctgagcacccaaagaattgatgctttccaactatggcactggagaaggctcttgagagccccttggacagcaagaagatcaaaccagtcaaccctaaaggaaatcaaccctgaatgttcattggaaggactgatgctgaagctgaagctccaatactttgggcacctgatgtgaagaactgactcactagaagagaccctgatgctgggaaagattgaaggcaagaggagaaggggacgacagaggatgagatggttggatggcatcactgacatgaacctgagcaaattccgggagacagtggaggacacaggagtctggcatgtgacagtccatggagtcacaaggagtcggacatgacttagcaactgaataacaacaacaaggtttttatttataaaaagagggcataattaaattatagtctgtgaaaccatttttttttaattgaaatacagctgatttacaatgttgtgttagtttccagtgtacaccaaagtgattcagttattttcacattgtggtggcttttttgtggagcccagactctagggtgcatgggcttcagtagttgtagcatgccagcttacttgccccatggcaggtgggatcttagttcccatgtcccctgcactggcaggcagattcttaacactggaacacaagggaagtctcctgattaagttttgatcagttcattaaactgggtgccatattctttcctgtttaaggactacaccatgtgaggtaggccagtcagctatcctgtccctgggatttgaatcttgaatcgaatgatcccataatggaaaattgttgacgttcaatcacctccatcacagattgtgctgaaaggagcagaatagttgcagttctctgaaacttccctggtctctttccttcctaaagtgaggttctctaagcatttcttctgattctgtgagctaacccatatttcttccaaaagatcatttattggcttaagtcatccagatatagtttctgttgcttgcaacccataagccttgagatattcagacacagcgacacacacagagataagcagagaaacccacagaacatgaagataaagcaggcacatagacaaaccctcctgacttgtattgaggacaacagacttattttgaaagaaaaaaaaagtgagtctgaaataaatagctcggccagatgaatttatttctagggagtggtagacttgttatatgcatctctgggtattttcacagttccattgttggaactaaccccttttatttatttacactgaatgataaaaggagtatgataatatgcgtgaaataaggtttctactttgctttcttctctgatctttttctcacaaaatttaatctaaggagccatactaattcctactggcaaagcctgaagaactgactgccacatctgtccattcattcattcaaaaacaaattataacacctactctgtgctgggaaccttagagatgtggagatttaaaaagtcagacaccctggacccaagggagttacggaatcattcattgaaaagaattccctgagcatacccactaagtgtcagctaatccatcatcctgttctcatggagattagagtctagagataaacttatgaacgagacacgtgctgatgtagaacgatcagcagggaaatcttttttttttttttctgaatgagagaaagtgcatttggctaattaataagcatacaaaacatatttagttcaagatttgtaaaggtttaattatgcagtcatgtaaatttagaaatattcttttcataagagcaggagagatagatactgatggaggagaattgagggaacacatcttggtggatgagatatataaagaggatagagctacagagtatttatattcttgtgaccgtaagaggaggctgaattctctgctgttcagccaaatggaggcaggatacaatacgctgaaaaatcagagattgggtaccactctttgttgttccatatgtggatattcctcctcatgttgatgattatgtgaaaaaaaagtccatatgcaaagaaatatgcaataattagagacacagtaactcatagtttgctgtttccatctgggaaatatgggaacagagtttgggggaggtttgagatgaaggcaggaaaaagataatatggagaaaaattagaggattcaatgaaagaccaagactgtattcttgattgcatcatacatacatatgatatctacctggggtttcttccatggtcatggtagaaatcagacaagtgttcacagatgccctttatttcacctgtccagcttatcaccatcgtgcaagggggaagccctaga

SEQ ID NO: 24590 - DNA, 1551 bp, Bovine  19866881094702
actaacctaaatacttaaaggaataatttcattggtttttcagaaactctgcaaaataaagctttttcttatccccaacttctgatgaggaaactgaagctaatagttaagcagggttaagctacctgctgggattacgtagcttatttgtggcatggttgggtttgtaaaccagagccagtggcttctgaaattgaagtatttgccagtttcagattccagactccattcctagccctacccatctcacctctcctccactaggaaggaagaacaaagaaaatgttctctcagagcaaggttctcagcatcctgcatcaccatgacaacaggtcctagtcaatttcttcacaaggaggggaaaagcaaaagtcaaaccgagccgccatgggaacattctgtgggcaaacaccatggccagtgtgcttggagccccatgtcctcactcagtcccaggtgactcactcctgggattggagctgggagctgggccaggttcctaaataggcaagggtaatggtgctcttggacagcctgcaggtcactttgaaaagtaatcctttttccttaagaatctgagctcataaatgagcagattagaaatcaaaggggagaaaccaatgaggattcctggcaagaggttttagggcaacccagctttcttcctaggatgacatcatcttgtttcacctctcctgcccaccctcagccaaggtctagtctgttttgctttgttttgtttttttttttaattttttaatttttatttttttagtatagttgatttataatgttgtgtcagtttcaggcatacagtaaagtgaatctgtttatatctctctctctctctctctctctctctccaggtcctccctggtggcttagatggtaaagaatccacctgcaatgcaggagacctgagtttgattacagagtcaggaagatcccctggagaaggggatggcaacccactccagtattactgcctggagaatcccatggacagaggagcctgacgggctacagttcacagggccacaaagagtcagacgcaactgagtgactaacactttcactttcacagaatactgagtagagtcccttatgctttacagcaggttcttattagtgatctatttgaagactgtcaaatcccaagagaatgtagactccaaaaagtcaggggtcaagttaagctctcttttactgtatacacggcacttcacaggtcgctcagtgctaaagaatctgcctgccaatgcagcagacacaggagatggaggttcaatccctgggttgggaagaactcctggagtaggaaatggcaacgcactccactatgcctgcctagaaaattctatgaacaaaggagcctggtgggctgcagtctaccagtgagggtcacaaagtgtcagacatgacagagtgactggcatgaactgcatatacatgccaaacaatgcctgactcagagtggatacttactagctattgatcaattaggttattgattgcagataacacaagcaatgatttgactggggcagaatg

SEQ ID NO: 24591 - DNA, 862 bp, Bovine  19866881344887
tagaacatacagaaatggataagagtaagggaagggtagggagccagcaaccagaggctccaggtattaaggaagcagggcagcagaaccatcttctgtagactccagcatttgagcagctccaatctttatctccatcttgttttgctgcgtttgagggctgaattcccagttagagtcctgtcagtcttgcttggcttgtatatatgctccctggctaggacaaggtgaggcacagtgatttacagtttcattgagaccctagacactgagaggagatttcctaaaagaaggacaggaacaagaacatggtgtatttgcctgaatgggacctccttttctttggttgtcatttactggaattacaatcaatgctttgcagtggttggctgatggccaacttcagtcatggattgactctcactggaaacatgaaatagagacgctgtccgagaagggagtcactagattctggaggactaggatgagactacatgatcctagtcccatttgatttaattcagggagccttctctgtacccaagaaaggatagaaaatgtggtccccagagatggagtctcttagcaatctgggctttgcaataattcttctgtgcagagtacctcatctggatttagacccgaagcagtgggggtggggtcacttaccacagggaagaagaagagatgggaaagacaactttatagcaccctttatcatgaatgtaacagggtcagatgaggctgacaagctggtcctcacagctgctgtgaaaaaggaaggctgggctgaaattgcaatatgaattatttaggcagaacatgatgaagggctttctggctgcaaggaaaggcagaacat

SEQ ID NO: 24592 - DNA, 1662 bp, Bovine  19866881423567
cattttcttagtactttacatgtatctaatctttctcaccaacctatgatataggtatcttaactttccccattgtatagataaagaaactgaaacactgaggttaaacaatttgcccaaagtcacctcacatgtacatgatgtggccaggattcaagtctgggcagcccagctccagaggcaatgcttctgacccctcatctgtacattctctcttttcacaaatcataagccaccaacttggccaacttccttgaccatcactgcctgaccatctacgtttggtctcctgttcaacagacatttcgagcccccttactctgtgtatgttctgtgctagtttccggggcgatattggcaaatgaaatggtgcagtccatgtcctgaacttgtcaggccaataaacttgaccttcagatgcattgctatccacaccactcagaggtatgggatgcatactattttttatctttttatggtgtgttttgcatcctgtatcttccttagggaattagttgtgtctttgctgttggacatctctcttaacacttagatgatcacaattgcttgatgatcatttaatgatgatgatgctataataggcaatgttccatatagattgcttaagtcttacctacaaaagaatctggatatggtgccaggtaaatcatgtcttgctaataagtctcattcccactttgatgtccagagaactacttggcatatggttgaaacccactcactgaggacttttatgtccccactcaggaagtaggacttcagtatctacagatcatctgaagaacctcatctgaagccttgggttctttcaagaagaactgttggggttagagaagtgtgtggagtcaatcctggctcttgagctccacgtgtctcacagtaagggaggcaaagggtaaaagagtgcccgttcatcagagtggctgcatgtctgtcgatttcaccttctgtaaatctgcttctgttgaactaatgcctctggtgcccacatttaatattttatatgctcccctgaacctagagaaagtcaaagcatttggaaacatctttaggattcacagtttagcagaggattatcctatcatgtaacataccaagtgaaaaataccaggagttgggctttcactctcttttacataacagatgttgagaagagcatcagagggaagcaggtagaaacaaccacaattaagtggaaacaaatttgctgtatgactcagggagttcaaataggtgctctctgacaacctagaggggtgggatggggtgggaggtggggagagtagttcaagagggaggcgacatctgtatatctatggctggttcatgctgatgtatggcagaaaacaacacaatactgtaaagcaattgtccttcagttaaaaataaatcattttttacaaaaggaagtggaaacaatcaagttagtggttcagaggtctatgttccacatcaagatgctaccaatgggcaagaggaaaaaaaaactcactgggccaaatttgttaaaatcaggccttgcttgttaacacaccagacaagtaccttaggagctttttttagagcattttgttgtcattgttcattttgccttgatttctgctccaacacagggaattaaattcagtctatttacctgtt

SEQ ID NO: 24593 - DNA, 1713 bp, Bovine  19866881427186
tgttatgtttaggatacacgctgctctgcctccttatcatgaaatcccactcaggataaataagattcatttcggctatagccatttgttcttgttagggagctgccaggatggcatgaaatattaaatgacaagggttaattctgttctcagcaaagagctcccatctaatttcccataagattgtacaatgggtcattgtgtcaggcttgaaatcagcctgcaaaagccttccctgagaaggttctgtactctggctgtattgatgattctggcttttgtgatgggaaaacaaagctgattcttcctgccactgggaggaatgaggggcttggttgttcccagggtgtgcagcagtgactctgacaatctgcctctagtgactggtgcttcgttattttcttctggttcccttgtgacgaatgggggtttctgggggtggtgctagtggtaaagaaccttcctgtcaatgcaggagatgtaaaagacatgggttctatccctgagttaggaagatcccctggagaaggacacggcagcagcccactccagtgtttgtgcctcaagaacccctgggtgaaggagcctggttggctacagtccatagggtcacaaagagttggatacaactgaagcaactatacatacacatctttgggtattggtctttcatgcttacttctcctggtttcttatacagagatgatttgtgttaagtgagaaggttgttgctttaaattacattgatgctttattaatatgttaaatgatcatgcttgagctatattcacttacagcatatgcatgtgcattatgcagggcattagtaatgaatgagaatgctttacttaaagatctgtctataaatcagttgaacacgagggaaaaaagagtcattgtttatttatgaagcctggaaaaggaatcacagagtgtaaatgttatgtattctcttattctaaaaacattatgaaacattgattatatgtttgtcattaagtttattcccatgttgcctttatattcctgatacagtgttactcttaaggattaagcctctgaaatcttctgtagacttaagagtagaaagcttcaaggctaggtagtaaactttgctcggacagaaattggatatgtgctctcttgctgtgcaaatggtacacaggatgagccttcagagtgtgccgttctgtgggagtgttttactactgcccggggtccattaacactttgcttctcagtaaattcaaattaatagacattcattgggtttcttgccttcgaattaaggatagggccaaggtactgtttgttgttgtttagtcactaagtcatgtctgactcttgtgacctcatggactggaacccgccaggcttcttctgtccatgggattttccaggcaagaatactagaataggttgccatttccttctccaggggatcttcctgcccagggattgagcctgtatctcctgccttggcaggtggattctttactactgagccaccagggacaaccaaggtactgttagaacatctaaaataaagacattctgggaaattattccctacagcagaactgtcactcttcataatacttctggagtggaatattcacatgaaattatagccaacaggaaacaaggcaccattttattacttggctaagattctattgagagccattgtttcaaaatacattgctagagtgg

SEQ ID NO: 24594 - DNA, 1523 bp, Bovine  19866881740618
atggagcctggtaggctactgtccatggggtcgcaaagagtcggacacaactgagccacttcacttcacactttttgccaagatatcttcaaggtgaccccaggcaaggactttaggctccagggaggaagagggagtgttccagtgaggcgttcaaaaggagaggttgccatttactttcacaagtggttgaaacacccagagccaaacctaaaattagaaaattaaaactaagagaattcaagcaggaccattttcatcaaaagcaccaagcatatgggccatgctgtcaagtggagaccatcaaactgaaaaagtgtaaatgaatctgggagattagacagatcagctggaaaaggaggcaagtgccttttgaaggcccagattggagatccgattttgtccccggcaggaaggctgccctccacttctgtccggccctttgagacagccatttgccttagaacatttggtgtcacccctggaaaactttctacagagaaaaaaataataataaaagtcccccaggatattactcaatagaaagctctttttgaaagtgtctgtaacagcctgttgtgtgttttaatgagttgaaacgtgtgcctccattggctgggattttaaagaaagcctctgtctgcctgttccctctggctcctattagtccctgtttgattctgcatattcataaaacactcggcaggacacatcacagttcaaacaaggctttaagctttgctgacttgaataagcctctccctctcactcagcagctaatccactgagttcataagacacactgggcattttgagctgtgggttggcagaacaaggtacagatttcacaggctagtaacattctttcttggagaaccagtggggaaagggggtcccaagatgggctctgcccacttctgtttagcatggggactaggagtcttcccccatctcagtctgtaaaatagtttacattttcataaaagtctgaaagtgttcatcactcagtcgtgtccaactctttgtgaccccatggactgaagtccttcaggctcctctatggaattctctaggaaagaatactggagtgggtaaacattcccttctccaggggatcttcctgaccaagggatcaaacctgggtctcccacactgtaggcagattctttactgtctgagccaccaggtttactttgcctcttcttcttatcctttggaaatttctattaagcaagaagccagctgtactgtccaaaaaaagaaaggaataatgaagaaaaatgtctgccggtaatttattaatacaaagtttcctttccttgctcttaacatcacctatttccctccaagctcatgtcaccatctaagttcaaggccaccttgacattttatttggtttggaggatcagcctcctccctgatatctctgcttccctcatggcttctgtgtcctctcttccatgtggtcagagtgacttttctagagcacaatactgtctcttcacttattcagtattgacgca

SEQ ID NO: 24595 - DNA, 1218 bp, Bovine  19866881889344
atagtgcttaccaaaatccttctcttttggtttctattgaccaaatatgcccttaccccaaaagagcagttcttctctttgtgtacctcattttttgaggtgcatctcattgttctccatcagagaccaagaagagctcctaagacataaactgtggtacaggtagtcatttaagtttgttgatttggagcttatgctccttaatttctcaccagctctgtctgttaatacaatttacagccatataaaaaatgaaactattatctctagcaggtagattaatagacagcaaatcatttagtctggtgcgtatgcaaatgtttttgtcttcctctggacagagtgacaaggagagcgggcagtgagagagagcttgttttgatgataattcgactgactctgtagatcatcacagtcctcaaacctgactcacaaatttaaaaattgaaatcataaatcacccaaatccagggcaatcatcccctccttgctttcttcctttgctcattatacaaaggtgtttttgcagcatgacaatcaccatccagtatccagaaaccctgtgatgggttcctttggaaatcttccaggaaaagattatctccttgtggtaaaaagaaaaaaaaaaattcaacaattcttctctgactgactatgacttccaggatcatgttaccctggtttgcaataaagatatggatgtgctgactttgaggcaggagaaatgtggcttccaggttaagcatttaaaagtggcctcctgtttatatttcttgaggcaggggatagataagctctaggttattagacatttatagctagtctcttgtttatactttgagatggaaataacaaaagaaacagggtaaatatctggactttgtctcctgtggacacttggcgatgacactaatggcaagggcagaggggggataacgttgtttgtgtaaaagatcaagaggttacatatttcccatctttggggccaagaagatcttcactgcacatgcacagaaacgcttcttagaggtcaaaaagggaggggatgccaggccataataaagtgtcctaactcccccaaaggcgcttgaactgaaatccatctttgctgaaggatgcgaacacatgtagaaatggtcttgaagcaaatcagccatggggtcaaagcaaaacagttggccagaggaaaacaaagacctggaagactgctagcttatg

SEQ ID NO: 24596 - DNA, 1798 bp, Bovine  19866880466431
aactggcccttaaaggctaattcagaaaaaaaaagaaaaagaaaaagtaaacaaaacgaattcttctagaagaatgaagagcaattgtatagacaatgtcatgggactaaaaaaaaaaaaataaagtcaaacctttagcagaatttcttttccttcatgggccaaaaattcaagtaatactttataagagcaaagtgataggactatgcattttagacaggcaattcttggatttaaatagcacaatttaaaatattggaagccaaaataaataaataaataaataaaataaaatattggaagccattattttcaacttcttgaatacagatctccaaactcttcattaatcagcataatcctagactttctgaaactattaccaatttactgctaataatttcaacagtttgaaacaaatgttttgcaattcacacttgaagataagaaaaagtattaatcacatgaattttggacctcaaaaatttaaagtctatctttagagaaatatttagtttgttttaagaaatattatttgtctaacatatgaatatatacttaaataaactaaactaaataaacttaaactaaaaacaagagcccgtggaggtaatagaagagttctggaatttgttacatgggttgagacatacatcatggcttattaaagattaataacatattttagtagaatctacagcgcctactatataactgacagagtaacatacagtgttcttttatctgactctcacaaggctaaaatctataggaagtattaatatcaataaaaatattatgttctctaagcaaatgagtaaagtaaaagttgatcaagttcattaagcctgccattgtcaaaatgctttaaagaggaaactactagagatgtgatacatttggttagagtttctaatttttggcattaattattttgttctatcatttttcaatacaactggctatgagacacattatgcatggtaatgcatgacaagagttttaagtatctgaacatggatttgagtaagtgtgcttaatctagagagtttaatcagttttatcaatactacacatgtcagagttggtgagtagcatggtaatgtgacctcattaaattaatacttgtgacgagtatgaaaatgaccattgaatattagaataaataatgcatcgtcttatgttcctttgccactgctgctttaggcatctggggaaattaataagggttattgtgtcaatcaggcaaatcagaagtaaaaagaaatcttcaattaatcatggtattttacaacaatccctttggggaaaaaagagaaccctattaataaaaaagcattatgccttctgttgcagttgacaaacagtgataagcttctctggggacattctgtatgagaaattcataataaagttttccttgtaaatttttctaaaatcattccaactgctaaatcttagcacttctgaggcacgaaaccctccggggcttcttctaaagaggttttcctcctggccttcacagagtgagccgctgatttctgactaggtcctttgtagcctgctgccagccactgtcacagttaagatgctgaagcatgtcccctgcatcagcaaatctggttaatcaggaaacttcccagggaccatccagggattaaccacatattactagctttgagacactcacagtgagaaccagtttccacagactttgtatagagcttgttaggtacaacttcttggtcactacttccgggcttattcctagaaatttcagatggactggtcatcaaga

SEQ ID NO: 24597 - DNA, 3345 bp, Bovine  19866880480272
tcctggtggagaggcactcttgcctgctctcagctggtgttctgtaggatcttcagtgtctagaggtgtattgccgatgtatccatggagagagatgtgctccacatccatctactcctctgccatcttggatctctactagaactgtgtttgaacatacatccatgggatttccaaacttcccaagccatggaagacaaataaggagcaagatttcaactggcagagacagcagtggtggagaaaagatgctagcatattcacatgtgttcctaattatctggaggctttgctctcccttgacattcttgaaagcagaaccacagaaactaagaggttggaatcatatcagctgagttcaagtcttggtcatgctatagactaacatttaaattcaaggcacgtttcttaagtcttctgagcctcaagttccacgtgggttaaatgaaactagagttgtgatgaagattaaataaaatgttagtacaatgcttaggtagtaggcttggctccataagaggttattgttagtattattattatactctaggcataggcttaaaatttttaagtatagtgatcatacttgcatgaccatagttgaaccctgatttcctctaaactttttttttttttttttgtcagtgagctatatattcagagcataccaagtgattaaaacctggtgtcacttataattaacttgcaagaaactgttgcctcagtgagctttgcttctctcctgaatgtagaaaatagaaaatcacatgacagacacctagaaaacctgcttaattgcatttgtcgctgatcacaagttaacagaaaacagaggagatgaccatagaatatttttccaatttattgagaaataattggcaaatataattgtactaatgtatattttaaagtatacaacaggatgatgtattaatatacatttgtggaatgattacaaggtcaaaataacacagcacttcacatcattaattttgtgtgtatgtgtgtgttgagaacacttaagatctactttcagcaacttttaagctttattaattatagtcaccattaaatattcagaacttattcatcttataaatgatattttatagcctttgacctgtatctccccactttccttttttcccagtccctggaaaccaccattatattctctatttctataaattagcctttttcttctttttttaaaatataaatttatttattttaattagaggctaattactttacaatattgtattggttttgccatacatcaacattctttttttaatatatatatgtgatatcatacagtatttgtctggtttatttcacttagcataatgccctaataccctccaagttcatccatgtcgttacaaatgtcaggtcttcctttttgtactaaataacattccattgtatgtgggaaaataatctgaaaaaaatagatacttgtatatatatagctgaatcacttttgtgtatacctgaaactaatacaacattgttaatcaactatactccattacaaaataaacatttttaaagttgcaatgaacaaagagtatgtttttgaagtgtattaagcatatctacctataacacgggagacccaggttcaatccctgagttgggaagttctcctggagaaggaaatggcaacccactccagtattgttgcctggaaaatccgatggatggaggagcctagttggcaaaagtccacgggtttgcaaagaattggacacaactgagtgacttcactttcacttttactttcaagaacataggctcttgtgtcataaagcaagaaaataggcaaaaatctaacttgacagattacgtgtatatccctgtatttattatttatatgcagagatgcattaagactaaaaagatcaaaatgtagctaaaaagtttttcatagaggagacacttgaagcaaattagtatgcactatgtttggtttgctgtacattaagaccagcttaatttttagtgcagttaaattactaagttattttactgcataaattgcaatttttcctttctttttgcctgtaaagtttcataaagaagcatgcaactcaatgtcataacttaaaccctcataatatcctgagttaatgccagtagcctaaatgagcaaagtaccctcagattttagctgtgtagtgtatgtgtgtgagcgtgtgtgtatacattttcaagatactctcaaattgactcttttggacccaggaagcttctaataaatattgtgaaacaactttaactgaggctgcccttctaggcatttttgccttaattacccactccctatctaaatcacagccttctgcctgtcactttttcaaggcccaactgtgaatccaaaccaggtgactatgtgaatatgctggaaagcaaagtgacataacacacctgagcttctattttgctcagggcagtgattattaacatgggaaatccgtagtgagtgaaatggccagagtttccacagaacttattgcttacagcttttgggtcccctggcctttgccagctgttccacacctggacctggagaacagaaacagcccgcttcaatttatctttcctagacttgttgcttatgggactcagatgccaggtgacagggctcagaagcagcagtgagagtctccacctgcacagctctgaattccccaaagagcccttgttctgactctgatgcagacaccagcttttaacagtgtgtaagctttaagtctaggggggaaagggaacttacacaaaactcatgttttagtgtgagaatgttagactaatctgggacagattgattaagtgagcaggaaactggggtcttctgaaatgttcaaggactttgtcttccatgggacatgagtgctgcaaggagtttctttctgaaggcttttctgttggatttctggaactccagagaagtttcctatgccctgaaattctatgagctgcatgaaggtagtagccattttatcccccaaatcattataccagttggcacatattaggcactaagaaaaggttgtttatcaaatgaatgggaaaaaatgacaaaaaaatcacctttctgaattctaaaagcaccatatgcatgttggtggttaagagcacaagccttggaggggtagaatccagtttcagattcaataatagttctgcgaattttctatttggaaccagtctgttgttccatgtccagttctaactgttgcttcctgacctgcatacagatttctcaagaggcaggtcaggtgctctggtattcccatctctttcagaattttccacagtgattgtgacccacaaagg

SEQ ID NO: 24598 - DNA, 1543 bp, Bovine  19866880481570
cacatgcttttgtgacaagtataccatttcttcctaacttaatgcaatctgtacttgtggtgtccatgcagtcgtaacttagagatgtaatgggtctgaacctcagtctgtttttatacaaacacaaagaaaggaattgacatttgcaacagatttcaatttttttgaaaactcatcatttggcataatgattgacattaaaagaatgccatttaactcttggctgaatgaatgatctattattattatagatggctctataaaacattggaaatacacagaatatatgaacacagtgcaatatcagtataggtgagtgtgagtggttcagattctgatttattatcaacaattgttctgttgtttcccagcaacaactatagactgaactcttgggaaagcgcttgttatacccagtttgacttccaggaaacttactcagtgaaatgatttgagtaactagggcaaaggatataattattggtatatagtaatttgattgacctctggcaccagagtatttgtattaaatattttcaactggagcctgggtttaaatttcttccagtttgtctgcactcttgcccattttgagtgttattaaaaacattgaggataatcaagtggaaataaaattttccctaaagattgatgtcacatttgcttgtttatgttttctcttgtgtaaattgttagtttacaatcttcagtgttcacaagcaagatactatttcctctggggagaaagtatatcagacctgtgagtatgaagcatgtaagattcactgctctgtatggctttatgttacttattctctgttccatactcagatctcctccctctttgcaaggtgcaataaacatgaaggaaagtttgggtagagagagctgtttttcactctttcaccctcatgtattcattgacagaaaacctccagcaatatatctacctaggaagcagtgctacagaagattttgttgtgttattacctactggtaattttatattataacagtgacttaaagaagttgaaaaagaataggcattttgcatctaccaatcatgaacacagtgtcatacattactgagtccacagacatttcatcactgtaaaagaaaatcccctcaaatcatttcaaggatatttcagatttgtgtgtgttgtattttaccttataactaaatatttttttcccttttacactgtagtctttaatatctgccttctgccccaaataagcaatttctattcctgattcagaaatttacactgcaagaaacaacaacaacaacaacaacactctatctaatattttgtctagaagtagaaatgattaattaaaggaatgatttatcaattacagggcaaagtacaataataaggccaaggaagagtatacattgcatacacccaatgcttttgtttgggtaaaatatgagatgtaatgagatggtactcttatcttgattaattccaaactgcctatctcacttattctagtgccctcaccctctcttctaatcacattgacacaagaactt

SEQ ID NO: 24599 - DNA, 2030 bp, Bovine  19866880525932
tattgaagctgagattggctatgggagccgtgaatctagtcctaatgtcatgctccttatctcttagaaatggaggcatcagcctccataggcagcctctgtgaacagctgccatccctcatggaggaatttcagtctctatggagactgcctccatttcaatcctagtcaattagaggtgaaaagtattccatttgcagtcacctaagccatagagtccacctattttttttttcttcgttctttcagtcaaatgatatcttcttatctaagattgaaaaaaaaaatcagaatcatggtcatttaattcaagctcattcagttctagttactttttcttttgtttcaaatggcagccttctctgtaaatcagataaagaactgtatcattatgttatcatctttgaaagctccataattgtagcttttctacccaagtcactgaaataaaacatctaattctacactaaatataaatttatttccagttttatgtattgtattatttactaggtgatagtgcttccaacctttttcagaggtgagcctatagtataaagaactattttttaaattacacatattttcacaaaagacaatgaaggctacatagattaggagttactcttagtagttcgtcaatacttccatattttttcttaaggacataaaagacagatattactgattttgctttaaaattagtccaaaaggctggaaaaaaaaagtcatattgaattaattaatttagatctaattaatttgtgtattcactagagcaattaagatttgtgtaaaatgagcagggattaaaaaaagtacaataaacaatatgaaaatatttactagggataatttactgctgagagtctattactgtatttttctctttatccttgttcctcaagaacacagtggcacttattatgattgttaacttttgtgatttcaagtgacaaaagtttgattcacacagacattaactgaaaaaaaaaaccaaaatttatgtggagagtctattaactaacttcagacacggctacatcaaggagctttttcatcattaaatcttctttctccattttttaaaatgatttttccatgaatgtgacttcatactaaggcagatgattcctttgaggtaccattatgcctaagaacaccttcaagttttcattctaaaactttgagtatacacaaatattttatttccttccagttttattgagatataattgacatagagcactgtataagttcaaggtgtacagcataatgatttaacttacatgcagcatgaaatgattatcacagtaaacttagatgaatatccataatctcatacagatgggtttccctggtggctcagatggtaaagaatctgcctatcaatgcaggagaacggggtttgatacctgggttgggaagatcccctagaaaaggaaatggcaaaccactccagtattcttgcctggagaattctgcggacagagaaatctagcggactggggtcgcaaagagtcaagcatgactgagcaactaacactttcactttcatacagatacaaaattaaataaaattattatcctgttatgagaactcagaatttactctctttacaacttgcatatataaataaccactgaattgtatttatcatgttgcatattacatccctaatacctgtatagcttataactggaagattgtaccttttggaccaccttcactcaataacccctccctccaacctctcagctctggtaaccacaaatctgatctctttgtctataggtttgtatgtttgtttttcagtataaatgacctacaacattatgtgtgtttcatttacacaacatagtgatttggtatttctatacatttaaaaattatcaccatgataagtttagtcacagcatgtcaccatacagatactacaccatcattgactgtgttccctaactgcacatatcacatcagtgactcatttatttgcaactggagggttgtacctcttaatccccttcat

SEQ ID NO: 24600 - DNA, 2243 bp, Bovine  19866880539980
aactgggacttccgtagttcagtcggtaaagaatctgcctgcaatgcaggagacccaggttccattcctgggttgggaagatcccctagagaaggaaatgccaacccacttcaatcttcttgcctagagaatcccatggacagaaaagcctggtaggctagagtccatggagtcgcaagagtcggacacggctgaacgactaaaccaccaccacaaccaccaccacctgggaatcccttgttgttcagccactaaatcgtgtcctactctttaagaccccatggactgaagcattccaggcttccctgtcctttattacctgccagagttcgctcaaattcatcaacattgagtgggtgatgctatccaaccatcccatcctccgcggctcccttctactttgccttcagtctttcatagcatcaggatcttttccagtgcgtcagctctttttatcaggtggctgaagaattcaagcttcagcttcagtatcagtcctttcaacgaatattcaggattgatttcctttaggattgattgacaaactaactccttggtattaagattccaatgagtttacttcaaaggtgccttggggcatattatacaaatagattgttgttagaaatctgaatacccaggttgacattgttcaaatgtgtgaagttcagtttatctgttagaaatgatttattatttatatctgcaaatagatatgtttctgaaagttctgtttactgttctctcagagaaacatacttgtaaattagtgaattgctaatctaagtcttaggttttctcttaggtgttctggtcattgactggaggaaatctggccaatatctactggtttagccaaacatttcacaacctcacacaaagttagacttctagattcaacttcttgtcttgaaaattccagcacaagtggacaattagaggtttcccttgggatgagtggcctgttctattcagatacgcaagtaactcaagcagcattggtctactttatcccatgtgaaatctaaccttttatttagagcctgtctctattttgacttgattcagcagtcatttatattagtccctgatgttctacttcaaaagcttttaatgttgataaatggcctttaagttccacctgctaaattgctttcttcatacagaaattattttttagtattttgcctgatctatgacttttttttttttttttgagaaagaatgaggccattaactgatgggatgctagaatgattagtacaaactgcatcaataacctccttacctgtgaagcacaagaacaggtatataggttgatgaaaaacgttgagagccacaagaactcatctttgtgtatgtacatatatttcttctttacagaaagagttgagagactctaggatgtgccatttttctttatcttccattctctctctctctctttctctcatattctctgagagtagaacaatgataactttatttgtgaagaaaatagatcatgagaaaagctctttcattaacttgtcttactacttatttgcttcaaaaaagagcatactctggaagcatgctttttgtgaaagcactgcatttaaaataagtttcaaggctctacctttaagtgcagagttgcatcagagaaaattcaactaaaagtgttataaattaaataaatgttcaaattagcacaggcttaatttttaaatgagtttccttggtagcacagctggtaaagagtccacctgcaatgtgggagacctggatttgatccctgagttgggaagatcccctggaggagggcatggcaatccactctactgtattcttgccatggagaatccccatggacaaaggaacctggcaggctatgatccatggggttggaaagagtcagacatgactgagtgaataagcacaacttttaaggtaataagaaccctgaagatccagctgagaaaccgggacattgaagaggttgtcacaatcatgggattttgtcctgaagttttcattccaatcccaaagaaaggcaatgccaaagaatgctcaaactaccgcacaattacactcatctcacacgctagtaaagtaatgctcaaaattctccaagccaggcttcagcaatatgtgaaccgtgaacttcctgatgttcaagctggttttagaaaaggcagaggaaccagagatcaaattgccaacataccgcggatcaggaaaaagcaagagagttccagaaa

SEQ ID NO: 24601 - DNA, 1447 bp, Bovine  19866880548042
cagaaaatatgtgaagttaactataatcttcaattttattcaatgttttgacacagataggaaatatagcaaatggaaagacaacatgagatatttagaattcttcttaatatagaattgatgcaaccacatttggtaatatttagtatcatttactttaaactagtaactgcaattctactatgaattatttctgccattattttagaactagaatactgttgatagtatttaatattaacactctctatgtcgtagattctgtaagaaacaagtaaaatatgcagttctgtttccaggacagtttcatttgcatttcattacacttttaaccctcaatttttattcttttagaggctattacaggggctggtaatcataccttatatattataaacaacacttcagtcatcaaagagatcatgtggtccattcttctgattctgagcataacagccttagatcattcaaatctattcttacttttctaatttttcaggacaccaggtgtaaagatcaaatcaatcaaaaaaaaaagtatatttcctcagaggcaaatatgtgaaataaattgagttatatcttgtgaggaataaaatgattagcatttggtctcaagctcagaatcaaaggataaactaaaacacagtaccataggtagaataacattttaataaagcaataacaatgtcataaagtgatattcaatttattctcaaatgattgattcaggcaatacatgctggtagatttcagaggagggaagaaatacatcctaacatttgatagaaattatctcttgctgtaactaaacggcattttgactgagtcttttgtaatcactagaaatggcaagttacaagtctgcttatttttttgagcctttatcatccataacttcttggatgtctttgaaacttttcctctagggttgagtcgactatctgttaaataatctataattattggcatgcatgtgtgtgtgtgtgttagtcactcagtcgtgttcaactctttgtgaccccacggactgtagcccgccaagggcctctgtccatgggattctccaggcaagaatactggagtggcttgctattcccttctcctgaggatcttttcaacccagggattgaaccctggtctcctgccttgcaagcagattctttcctgtttgagctacaggggagtccttatatacaatgctttcttgaaataatacagtattgtagagttaaaaaataaaattaaatttaaaaaaaagaaataaaagaaataatatgtactctgatcccattactatatcttattttttaaagcaacttgattcaattcagttcaaatgtactaatattgccattgcaaataattcatttggtgaggacaaagaagttcttgtgtcaatgtgattagaagagagggtgaggcacagaataagtagataggcagt

SEQ ID NO: 24602 - DNA, 920 bp, Bovine  19866880559128
agataggtagcaccattgataaataaaaaaaaataatagcactgtgtcatatgatttgttattacattgaagattatatcttgtaacatgagaaggaagatttaaatgggtttccaaagtcataaccttaaggtgatgaaaatatatacataatacaaagttttcttactttgtttttgtaataacatattccttctttaacaataaaatattaaattatagctcatatatttttaaaagtctgtcatgattatcatatatgtatgctgagaagcatgcttgcatcaataatatatattaattactttcacaactggattttggtcaggcatcttgataaatgattaaacttttgaacatatgtatctttttttttcaagaagtctgaaaacaccactgatgaatgaaattttataaaaatgctattatttgcttatatacaaatttctgtctttctaaaataaacatacatagcacatataaaatcatgcacaaagtaccagagagtagctttgtaaaaagtacaaaaatactagttataataacaagtctaaatttaatttgttcatttgagattataaataatatatgcacatactttcaattcagttcagttcagtcactcagtcgtgtctgactctgcgactccatgaattgcagcatgccaggcctccctgcccatcaccaactcctggagttatgatagcaattctggaggtgactaaatgtgataattaaaaggaataattaatgattgttttcttagtatatcttgttcttttaaaacatagtcctactcttaaagctaaggctccattctgttcaaaactagagatttgaaagtattatcttccgcaacctgataaaaaatggagcaaaggaactatgtctatgtctaggtattgtttaaagtaaatgta

SEQ ID NO: 24603 - DNA, 1351 bp, Bovine  19866880596340
attctaagtgaattcataaatgaatggaatgactacaaaacctgtgactttgtctctatatgtgacaaggtcttttgagttatcaaaaattcacaacatagttttaaagtcttaaacctgttgagaatatacagaatgattaaaaaaaaaaaaaaaaaaaaaggaagcctagtctctagaatgactactcctgtcacgccaacaagagcaaacaaggcatttggcaactcataaatgctgtgaaagctccgtaactagcagtactgtttgttcatgataaattcactctgtctttcctacatggtcttggaaacattatcaaactcaaaaggagcatgggtggaaggatgactcctgagagctttcacctatttcctgttgctaaggaaacgtcttccctttgtacatgttcagaatagcaggttcctttgaatcctgcctttcaagctctattttttaaagaaaacatatagatatataacccatgtcttgaaatgtacacagatttactctttgtttctactacctggtgaagaagtgtcatccaattagaggtaacatatgctttaagattaaaacattggagatagacaacttctctttgttgtttcagactttgtcaaatctagtgtttctgaatccacaaaaaaagtcagtaaacctaagatatcactatgacctgtgaatatgtatctctcaaaaattggttgaaataaagtatagcttttgatatttgatagaattgggaacaattatacttaattactgcataataagtgacagagttattgtacattaattactcggagatttttattaagacaatatgtgtctgcttattttcgttgaaaaatattatggaatttttctcaattttcttctttaacatttgcggatggattggctcaaatgctagaattcaatgaattggctttcaaagataaaaatgtggagttttattataccacggtgattgcaatatttatttgcaagctattaacaatagcatgtgtggacattggctataaatactagctgatttcataacttggattgtaatgctataattatatgttgttattcatagtatacaactgagaatcatagcccaggccacagctttcttacagcattctcattaatgtcctgtttatttgagatctttcaaagaattcctaggagcacccatcatgatatttttaattatactctttatatcttttcaaaatgttttggacctgtcctacatgcgatagttgtgcatgattccctaagactacagcctgcaaatccagattacatcactgcaaagttaaaatgattttgattattggatctatagcataatttc

SEQ ID NO: 24604 - DNA, 1497 bp, Bovine  19866880741987
ttcataagtattttaaagatcaaaattctcaataatttcccaaaaggcttagactatttgaggttgcctagtacaaggtgcccaagcaagataaattttgtcgtgggtgatgtatcatatagggtgcaaagtgtgtacctctcctgggaaaagataatttttatgactaagatttagccagtagggtgcatatatatctataatgcaatcaaaaagtcttgctctcaatggaaaggagggaggtggagaaagagagagggttactataccatttccaatcaaacattgttaactttgtcaaccttgggattgtcaagactatgttacaatgaacagttaagacagaaaatcatctttatcatatttcaggtattagagtgttgcagtttcaaattcaccatttttaccactgttgttacacagtcaaatatccatttatgcttatgatggcattaacaatatactcagaaactgaagatagttaagcaaacatgtaaatagaaagtagaaaatattccaaccaagatcttagtctgggtattgtggaaatggctttatctgagcacgtgcaatcagtattcactgaactgtgagtttagtgcaaaactctgattaacagttcctaaaaacttaatctcatcagaaatcttgggatgagggaagcttaattgtctactgaaagtctggtacttttcacctgcacgtagggctgccatgatgaagttgttttaaaacagtaagaggaagagcaaaagaaaatcagccagaagtatttgtcggcaagattccttaatgtccgtttcaaaagtcacagattacagttaaaaatggaagccctctttcaaacaaagaaagaaaggttatgaaaaaatacagtttgccattattgatgtatgaagccggctctgattgcatctatcctgtagctcccccacatgtaccactcggatattacctaaatcttggaaatgaaagagaagcttcagccgtcgctcttcccactgctgctatgagagcccagtttgatgagcatcacatccgacctctgtttttctcatttaacttattttatagactgcttgtcaggtggtctctgtgtggtttgctcagctaatactagaaacatgtaaaagtcatacaaattataatttaagaaaaggaaataaagtcaattgaccatcgattgttcttttctcttataccagtacctggtaagagcatccaagtgtaatgattgtgaactcaaagaatttctgtttcactgcactttatttttactggtaatgaagttagtggcttcaactttagtgtttctctctctttctctccccgaccccctctctctccctctccaaaagcacatctatgacagacaaatagttattctactgttttagcactatggtttgcctttcttcctttctgaatgcttgataatgatagaagaattagacaaaagcagacttcttatagagcaaaatctttagttttatttga

SEQ ID NO: 24605 - DNA, 2593 bp, Bovine  19866880869483
tgactgatttgatctctttgcaatccaagggactctcaagagtcttctccaataccacagtttgaaagcgtcaattcttcagtgctcagctttctttatggcccaactcttaacatccatacatgacaactggaaaaaccatagctttgactagacggaccttcgtcagcaaagtaatatctttgttctttaatatgctgtctaggttggtcatatcttttcttccaaggggcaaacatcttttaatactttaatgtattaatttttcatctagaatatgaaagaaagaacttggaaacaaatacattttcctttgtatacatatcctacctaaaccgaaagaaagttttaatactcattttaaagtacctgagaagtcagcttttcacaggctcaaaaatatatgttgaaatactgctgtgctggtgggcatgcctgtaatataatttctttgacttctctttgagaaaaagaagccttttttttttttccaaaggcacttcatgtagcacgttaattcagcattaattatagaacatgtcaaactgtatttcagtcaaaggccccctgtaagtctccagagctttcttaatgacagtaattataggtcataaaaagagtcgtctaaaattaacatttctctcatgtcttaataggaaaatgtaaatggctgcaccgtacagatgttttgattagtaaaatttacacttccttttttgtttcaatgcttgtcaaacttcacagtgttaaacataaggtgctgcctttctcacattcctgaatagacgaaggtgcatcagagcagttgtaggagttcttcaaatgctatgccttattattttgtgctgcaattaaacaaaaataaatcaacagtttcttctgccataaatgaaaggatcctttaaaagacagaacaaactgacttttttttttttgcttttgaaaattttcacgaaaaaagattaaagaactgtattggacacaagcttataaaatgctttattccaacatggaaaaacatcttgcctacttatatatttaagtctcctggtaagccatattttatcatataccatcagaaagaatacatgaaacctgctctactctgaactgtcaaaatttacttactagaaaatgagaatggaaacatcctggtttaaacaatgttaatatcatcaaacatccagggaaatataacaaattaaaagagaatcacttcaaagtataaaaggcctacaccttaaataataataaatctaatacttgacattcatctccctggaaagtaaaattagataaacttttgcaagggcattcagaacagccaatccagtttattaataatttcctgttttcatattggaagctcatattatctggtcgcagccacagtagacctccacagatatttaataaagctgccttcagtaatcctctctgattacctataacctcccagctataacacacactgtgctgcagcttcacagaaggacagcacactgtcaccagctatgatgtttgacagcttattctgctgcatcaagctggcacaaaattactttttccaaatccatccctagttaataaccaaaagtaataatggtattcagcatgcgtaatactctgagaaggcaaaatgaggcaacagaaggggggaaaaaaagattaaagagtgactattatggaagggagatgaaaaacggaatcttgtaacatacaacgtttcaattataatgccatgtggagagttctacatatcaccctacaaaatccacactgcaggaccaagaaacatggaagagatttcctattgtacttacactatgtgtatgatttttctcgttcatacagagcaacatggagaattttctttctaaattattctgaggcattctcttgggagcaagaaatgacttacctttagtggaaaatgtctagttaatagaatgtattgctttgatctcatcttaaagtttgcaagagtaataagctattttgcttatagaatagagcagactaaccttaatccaaatttacaagcataccaaacccaattcaacctttctttcttttttgaagatgaaacaccaaattaaaagtctgaactgtcaaatgaaaaaatggatttgtttcatcatctaggcagaatccagtacattacatttgtcttcattacaggtgggtgaatgaccttggtagaaggtcaaatatgacagtgacaattaatagggaaaaaaaatccttgtctccttcctttcttcttttcttctttccttccatccctcccactttctatttctttctttattcttttttccattaattcctctttctttgttttcccttcttttcctttgcaaatctccccacttttccttcccttccttcttcttcctacaatatttttcagaaaagcttcatatacttttcattttctaggtggctaactatacgcagaatatagaaatatattttgaatgagcacagatgtaatgaagtcataaccaagttaaatatttcatcaaaaactaaaaatattcccatatgtgtttatatttatatgcagaggattaaaggtgtttctcactta

SEQ ID NO: 24606 - DNA, 1526 bp, Bovine  19866881030555
ttgcctggcttctctttctcgctctttgtagtttctcattcctttcacatgtctctcacccacaaggtggttgagcttcttttcatggcagctattgtccaagacaaaaaacaaaaatagtaagcatgcaagcctcttagatctcagcctggaactggcaaaatatcatttccaatgtattccattgatcaaaaccaatcataagaaagccaagatctaaggggaggggacataagaccaacaataaacacacagggatgggaacaacttttggtagccatctttcacaggttccttcacaattttttgagaaataggctcatattcttgttgcttgttagtttggggtaaattacttaacctttctatccttaagaatcttcaactgcagaaaaagcctaacattaatctttgttttgcaatgttgctgtaaaaactaaaagattatgcatatacaaattaaatacattaccattcacattgcatatttcaataaatggggattattataaaagcatgatatgcaattcctattatctcaaaaatgactttaatataatacagatttatagcatccactgatttcaaagaatagtctagacaagtaagatttaagtaaatctaaagtttttatttttagaactgaataagtctgtttacataatgaattctctttatattttatgtaatatcaagaatagttgggtttaaaattgcagcatggaattggcagagatattgcttcttaaaaatacttgcctacatagtgcttgaccagcataattgctaagtattaaattcaaccacaaaacttttttaaatggataactataaatagaagaatcaagacaactttttttttaagatctccagacacaattgtaaaatagcatattggagattatactagcacattcccttgaaccaatgacttcttaataaatgaatgcatacaaaggatatgaattttttcttcttactagatatatattacagtggaagactgaagtccaaaaaaatcaacatgcaaagaaaatctattagaacataaattaacgttttaatctcagacgtttctgctgtttttttccccccaaaataaaaaaacaagacctttgttctttgctgcaaggaaaaccagattaaaagcaaaaactgtttaaatacaatctctatttctgtcaaatgccaccttttttgagaattttaggctacatgctttcagtgggatgagagagaagaaaataatagagtaaggtgggagagaggaaagttttagccaaaactgctgttgctgctgctaagtcgcttcagtcgtgtccaactctgtgcaaccccataaatggcagcccatcaggctcccccgtccctgggattctccaggcaagaacactggagtggggtgtcattgccttctccgcctcacatctgagatgattgatatttctcccgccaaacttgattccagcttttgcttcatccagtccagcgtttctcatgatgtacactgcataaaagttaaataa

SEQ ID NO: 24607 - DNA, 1457 bp, Bovine  19866881080497
tgatcctcacaatcttcaccctcagttgactggtgaggagaccaaggcttagtacgatgacatcactcgtggccacttaactagaaagtgagacagccgggctctgtggcttgaagatgctcccgtcacagctcaaggtccccatcttacacgagcccgcatatttttcaggcagagagtcaaggtaaagacagatttcacaccttggaagcagacgggcctaaagaaaaggggagacagagagaacctgcattaaccagctgtgtgaccttttgaaaatcaatctcctacagcctcattttcaccttctgtaaaacaaggcgcttagattaaatgctctctgaagaatcatccagcactaacactcaatgatactgtgaagtatgtcacgtctgctgacaggcaagtgtgacgggaagggaaattttgctattaacaaaaagaaaagagaagaacaaccacagccccttgtgcattttagagaaacagaagaatccctcccaggctccttattgagcctttggttttagcatatttcttatacaagagtcttacaagtcctctggtgcccctcatttactgatctcagtgcttcagaatccttctcaacacagtgccccaggcagccaacagatgatcaaagtggacatccaagataaaatgcactttatatccctcccacacaagagttatctggggtttttagaagagtatgaatcttacagacgtgccaaggttatgctgtggtcaaacggtggatgaggggcagcctcttgaacaagtgcaagtctactaaacacatttgcagggacaagattaaaacgcatcctcagagagcccacgctgtggcggtccagcagacctgacagtcccttaacataaactctcattaatagagcttaattaacaccaccgaggataggaatccatccactcactttcagccacgagacagagcagcttctcagggagggtccacaccagaccttcagattctctctgggagaaagaatgctgctctcagaatgccaactcccacaggctcgtgcatgaaacacaccgattctcttatccatctatttcaagtctttttccctggggagtgaagatgagcctgtgggatcagggcagcaggctgtaaataatggtcgcagggaaagatggatgatgagagagtgctcggccaggctcccggctgctatcgcatcccagctctgcctgcttcagtgaccaccccacctctgctcagtgatgcccccaggaaggagtgcatgtcctccaggcttctatttttgactgcctttttcctatgcatccttgctgccctttctctgtgcaaagctgaatgataacagccatagccgaggaaaaacacaccctgaaaagccagctttcttctcaaaaaaccaggcactcccatgagaccctttgatgtgctgcatgtgttctttgatgaa

SEQ ID NO: 24608 - DNA, 1077 bp, Bovine  19866881081105
aaattttaaggtgctggatagatagtagattatccagatattagtagatgatagatgacataaatttgcatagatatgagattatttataaaacatatcgtgtatatatttgcatgtagatagaagggcaattttaatttgctgcttaggtgagaggtgaagcacccatggggatatttgagaaaccacagatattagctaaactacattctagtgagaatgaatcagtgaactaaagacctttagtttggtgtgtagaatctgcaggcagagtgaatacacatttctcaacctctctgcaagctatgttcagattctcctctagaggcctaaataatacgaattttaacagtgcgagattatcagcttccaatatactttcaaattttggaccaattctgatgttgttgtaacctttgttgatgttgttgtaaccttttccttacaaatgtatgataatgaagcattaaagttcaataatatgtcattggtattactttatttatatctaagttccagcttctctgaagcttgaaatctccacacttttttaaagataaagggagagtttttcaagtatccattcaagttcattcaatgcactgcttgcttagaaataggaatgtatatattcttgttaagtttatttatttttaaatagaggataattgctttacaatattatattggtttctgccatatatcaacatgagtcagccataggtatacatatgtccctttcttattgaacttccctaccacatcccaccccatcccaccattccaggttgtcaaagagcacaggatttgagctccctgcatcatactgcaaatttccactagctatctaattttgcatatggcaatctatgtgtttcaatgctactctctcaatttgtcccaatattcttttattctctaagagttaagtaaatttatgtatgtgcttgataacagggcagtgctaaaacaactctgtaatcctatagcattaaatccataaaaaagcaatccacttgacacaagacacagaaaagcaagtataattacattataatacacgagttgtcaaaattt

SEQ ID NO: 24609 - DNA, 994 bp, Bovine  19866881229151
ttcatagaagacattgttgttcagtcgctcagtcttatacaactctttgtgacccgcagcatgtcaggcttctccatccttcatcatcttccagagcttgctcaaactcatgtccattgagtcagtgatgctttccagccgtcttgtcctctgtcattctcttctcctctgccttcaatctttccccaggcatcagggtcttttccagtttgtccactcttccttcaggtgggcaaagtattggagattcagcttccaggcatcagtctcagaagacatagatttataattatcaaaatatgacaaatggctgtgttttggtaaacatatcctgctaaattagaagatatcaaaataatataataaagagaagataaaaattcagaaacttcaaaaatgaatttgagaaaaacaaattatataaacagtgttcttaactcagtagtaacatttaagttactatgtcttaatatttcaactctaaataaagaatactaactcttttacatattaagaagcactttttttcttaagtaacttcaaaatagattgagctagaactgaaatattctataactaatcttttaaaatgaaaatgaagaagtctgccttagaatcaggtaatgaatgaacatgagacaaaagcgttcattccagcaaactattttcattcagttgcttctggcagcactaggttttcttctctgtgtacaggcactttggtttgttttaaatttggaatcaatgattgcacaaacaaaacttgttctagaaataaactgaagaagaaggaaattatattatttttgtcattatatctacagtctgataagttaactttacctagtctctaggaaaccacttcacaccatagaagaggttacttgtacatgagacccattgtccataaagagttaatctagtctctgtggtgaagcactttactctctgaaagctctttctcttcactcctgttcaccataggaacaggcca

SEQ ID NO: 24610 - DNA, 763 bp, Bovine  19866881606189
actggttaatgacgtctacaacaattcaagttgatcacctgacccctttcctctactcttaagccaaatatgagcatatggctcttcttgggaaccttccatcatctcttgcccccactacaactctgtcaagtcagaaactgggcttcctgactcagccccttccagagctgttaatatttatttttctgtatttcttcagtttgactggcatcctttgacacagagagctttgaactacatccaggatggctcagcctccttggtctgctctatcagtgaacagaccctggcatctgctttgccccacagtggcagagggcctcgggaattattgccccactgccgggtgtctcaccatgtgtggccatcaactgctggctaatagtcatgcctgctcgtgtgattcaaaaccaaatatgaatagctatttcagttgctggtcacttgatcaaactcagtgttaccctaacagaagccttgacctgggttttaaattgaggtcagtggtcaacacaactctgcagttccagctctctgctcccctgcaggtttgtccatgatcatgaggctgtgggtgaagggcagggacaggagaaacagtgcaaagcactgcgggctttaactgtacgcaatgctgggctaaatcttggttctaccacttccccatgtgttaccctggacaggttaggcagccactctgaacctgtttccccaatggcaaaatcagggtaataaaatctaccttgggagtgttgagtgg

SEQ ID NO: 24611 - DNA, 2697 bp, Bovine  19866880434017
agccctacctggggtgggctggaaaactgtgggcactgactgagggtcccacgtggagagtgtaggctgctgacctgaggtgggctgacctggtgtgtctcttccccgccgttcaaaccttcacttgggtctgcatactgcccagcctgcaagatctattatgtgcagatatattgtgtatgctccctgcctcttgctcccaggtcaccccatttgcccactatgtgcaccccactcttattccccactgaggctgggcaccattaggttgccccgacacagaacactcagctgcccctgagcaaggcactagggcagcccccaggatcatggcagggctagcctgggggaaccctactcttccttcctgcctcccactccctgccttccgtagggagggctcagcctgaggactctctttggccacccctcatctcccatcctctgccatggggcctgggcctcctgattgttcagtgggcgcagcctggggccagagatcaccctgaatttgggggggagcaggcctccagcactgtttgacgttccttctccctcatccagcagtcgtctgggggagcccagaagttggtccgcattgtcagtatggacagaaccaaggccagccctctgtggtcaagctttgaagggagccagttggacccgagccgggtagaaggtgaggtgggtggagctggtggagggtcttcaggggccacagtggttgggcagcttggtcaggataccaccactcatctaggccagaatctgttttaagaatcataatggatgtctatgtgcccttctggaaagcagttgttatacactcttagtgacctttaactgatgctcctacttctgtaacctaccccaaaagatggtccgaagcccctggtacagtcatctggacagcagtccttttagaatagtaaagtctaaatactctccaaatgcccaacactccacaaaccagtgggccctcagacagctgctgtttttaaaagtcccagggaatatagcagttggggtgggggacagtggttgtgacaggggccagcacagcacagacccctgcgcaggtaaaactgtgtgatgagataagcagaagtgaatttagagaaaggtaaaccattttgagtttattttcttgaaaagtgctttgagtgcccgtgtccttagtcacttcagtcatgtctgactctttgcgactctatggcccccaggctcctcagtccacaggcaagaaaagtggagtgggttgccatgccctcttccaggggatcctcccaatccaacctgcatctaatattactgaaatgaccaggagaggagagagggaaggagggaagcactgggatcatgtgtccctgaggatgaggctaaggaagaagacacaggaagcttccagactgtttggaaggataaactcaggttttctatcctccctgtgagccagacagggaaaagagtttaagctgcagcctataaaggtgatcctagagaagcaggacatctaatcagcaagtacaaagaaaccagccagggcaggtgtggaggccatggtgcatcgtgcaggagcccggtgtacccgcgttactttcaggggctgggctgcagcagcgagcaaagcagacacaggccgtctcctgggggcgggggctgctgcagcccggcacccagcccacttgcggctccttcctcccacagacccctccaccgtgtgcttttggaccgagagctgcttcaccctggtgccctacaccctggtgcacccccacaggcccagccggccccggcctgtgctcttcgtgcccagggtggtcgggaagatcctgattgagaagctgtgcctcttccaagggtttaagaaatgcccagcaggtacgctctcacctgggagtcccacctgactgtcaggtggcgaggcgaggcctttgcagaatgctgtatctgctttcaagggggtggatgacagaggagtggccaaaacaaaggaccacaaaccagggggcttaaaacagcagagatgtattctcttagtgttctgacggttggaagtctgaagttaaaatgtctccacaggctgccctttctccaaaggctgcggtggagggcatccttcctgcctctgcctgctctggtggctgatggtggcttgtgactctaacactgatctctgcctcctcatctgtgtgtccctctgccttcacattactttcttatgaggagccagtcattgaatttcagaccaccctactccagtacaacctcctcttaactaacagcatctgcaaagatcttatttccaaataaggtgaaaatctgaggtttcagatggccatggatttgggatgggggaggggtggggcaaagcacagctctgctggcagctaggtttgtacttcatggagtcatacaaccaaagggctccatccacctacccaaagccactcaatatagagccattgagatgaactggccagtgggaatcctgggtcccagtggccctgctctgcaggaaaggtggctcagctggctggagggcaggagttagctccttggcactttcttccgtccagagagtcgggttacaatgtgagggtgaacagggccctgttcttttctcctggagttcacagaggggacagaggggagcaagtgtgggccacacagttcctccagtgagcaccagctgtg

SEQ ID NO: 24612 - DNA, 2697 bp, Bovine  19866880477419
ctcaggcctgcagagggtcgggggcgtggacgtgtccttttgtgaaagacgacagtggcagcgcctgcgcctccctggtggtgctcagctacccagagcttgaggtaacccttaaggggactctgggccaggggccgcaccgctggggtccccgggtgcattcgtgagagaggcgggacactggacagggaacagtgccagggtagaaccccgcttctcctcttgtgggagttcactaataaattggaaagcttttgaagaaaagaggaggggagcaaaaactgactagattctgtgacctaaatccaaattaactcatgatctccaagtttggcagtcatcttttgctccccatctcaggaactcacagcaacatacccccaagttgcccaagacgctagaaatctttgtcttcccataccccttagctggtcacacactaactacatttttcccaccacctaaaatcactggagtctgtccccttgtctctatcgctgctgccccttcttggctgtaccactgtcacctcttgcgtaggggacaggcggaatcttcccagggtcctttctccatgttgtcaacagagcagttttcctaaaaagcaaatgtgagcagtcaccacctagtccagttaaaacacttaagtgcccatcctgtgatcgcacagtaaataaaagcaacactcactaacaaggcataaaggctcttcatgatctgacccctgcttaatataactcacagtaggctcacctctggccacctgccgcgttcatcacccactccccattctggaggacttccgcttcctcaagcactccacgctgtatctgcctgcctaacctttgcagtgatgtttcctctcctggaatatttttcatctggctaactcctcatctcttaggtcctccagtaagtcccccacctcgtcctacaagaccaggggttgctcccagcatcctctcattcctctttatcacctgggatagaattggcctgtgtgtctcctgcaccagaatgtaaactccacaatagtagaaactgtactctcttgcacaccagttatagccttggcacttagcttgatgcctggcacatagaagatgctcaaatagatatgtgaatgaatgaacagtgcacccaccattcctttggagtcaacagctcaggaagccttggctgaagaagagcttgacaaagaaacttctgctctgcagcttcagcatttccccctccatgctcctctgcctgctcccagagctgccatcttcctgcctcagtgtctttgcactttactcgaagagcttttagtcagaatttagcagaaatatattgatacctgactcagagtttggtgaggaataattgagatcatgtatggaaagcaattaacgggcatgtggtaagccctcaaaaagtaaatgctaaggtactgttaattcttaggacagcttctcatttttcaattcagttgttcccgtcgctctgtaccgttctctacctgcagaattaatcaccttcttgtcctaggtctctttgttttgcatatgttcttacagtacttctcacactgtattaaagttactgatttaagagatcctctcagatcttacagcctattagcagagcactctccctattgcagtaggcaactccccttcattgcagaaatcattttgaatagtgtgtccttcttgtttagttgccaagttgtatctgcctctttgcaaccccatggattgtagcctgccaggttccattgtccatgggatttcccagacaagaatactggagtgggttgccatttccttctctaggggttgttcccgacccaactcaaagaaaagaagttattggcttatattgtttttcccaccgtctgtaggttctcgagagtagggttatactgtatttttttcagaaccccagcacttggatgtagtcagcacttgccatcctatgctatgggtgcttagtctagggaatgctcttataagagtctggtccagtgactcccaaatgccaatctatgattctgtgcaatcagagtcacctggaagtgtgtttagaaataagatttcataggcaaatctgtagagacagaaagtagtattgtggttgccaaggtctagcgattgagatggagggtaactgttaatgagtataagaattatctgggagagattaaaatgttctaacgttagattatggcaatggttgaatgactctgtaaataccagaaatggttgaattatactcttcaagtaattttacggtagcaaattatatctcaataaagttgttgattcccgggcccctctccgtttactgatatttgggtttttttgacaatccttcctgtgattccatagcaaacccaggctgtgagtctctggtctgccattcacacagccagaaactcttgtcgtgcctgacaaattgtggcctcacacagagcccattccgtaactggaagagcgtgttcttttccacatagagctgaaatgtacttgtttgttacttctgctttctggtgcatagtacaggacaaacttttcctgcccttctctgaaaaccctcctatttgaagaccattgtgtgttctcctgagtctcattggggtgattcccagctcctcctcttgctgctggccctctggcccgcctgcagtgagcagggctcatttttatatccagc

SEQ ID NO: 24613 - DNA, 1818 bp, Bovine  19866880495922
atgggtaagatacctgggcctcaacccactcccatgccaggagcagagcccctccccccaaagctgtgacagtcagaaatgtctccagacattgccaagtgtcccttgggggcgaaactgcccctggttgagaaccactgatttaagggcttgaagggattttggggtgtaagaagttgcatatgtaagtttggggcttgggaagtgatgggagaggggtttatctacatctgtctatccttccttctttccctccatccttccttccacccaaccttccatccatccactcacatcctggcattgactgggcacccgctgtgtctgagtttagggtgaatgtgcagggcacagactcctccaagcagacagagcagggtcaggtttataaagaggaaaccctagcaagagctttccctagagctcacaggggtctgcgggggtgggggggtgttcagcacgggctcttgagggagcagctgagtgtgtgacatccccatcaactgtcaccttcagagtacttgagccaggaggagtatgacacctccagccagagaggggacatcatccaggaaagagaggcatccggtggcctctactgtgtcacccgcagagcagttgagtccctcatgggaaaggtaaggggttgggtgggggttgggaggaactccatctccagaggagggcggggggagaaggcaggaagggccaacctccagagacccctggagcacccaggattggtggttagctcatctctggctccatcacagaaagatcaaaccctgtttctgccatgtgaggtccatgtgaccttgagcaagacttaacttccctgaatctgtttccttgacacagatgtttaataaacatttgttaaatgaatgaataaaatggagataacactccatgttttaaggttcagacaaatatatgaaaagctcacggagaatgataaaattttctgttgatacaaagcagttaggaacagctatgatccagaggcccagtggccccatctccttctaacccccaaagaggctgatggagccaccaactcctagggtttgagctccacacaaagcctccctcaatcccagtggcctctgatttttaattcagaagtgaaaagtcaaatggatggaaacttttaaaactgtacaggaaacatgctcatatacaaaggggcatgcccaaattctttccccatctcctttgcaaacttcagtcctgcctgtatgcttctctccatgtttcccctgagtgtgggctcccctcgtgtcctctgaggctaaggctgacttctctccccacgtcccccagaacacccacgccctcctggacatccagctggacagtgtctgtgtcctgcacaggatggagattttccccatcattatccatgtctccatcaatgagaaggtggcaaagaaattcaagtaggtgcacccctgggggccggtggtggggtttgaacaggctctggaactccccgtgaggcccacggtgaacatgtccggagcctgtgtcggggtttccaggatctcaccctgtgccaccccctgagtgtcacagatcagttctcccgcaacatccaggacaaaggtcctgcagccagcccccaggagtaacccagaggacagtaaggtgagaccctagaacctgacctcggctaagtccatacatttcctggggtacagttaacagtccaaccatgttaggtgaggacagagactgaaaaacactacttggttcataactgggacaaacccagatgtcctgctgcttcctttataatttgagaactgaacttgtaaa

SEQ ID NO: 24614 - DNA, 1244 bp, Bovine  19866880502096
tacccttcagagccttcccaggaactgggtagggctttttagacaaaaggattcactataaaaaaactaccaatagaaactagtacatgattgggcagtacaatgctctacctggggactctgggtggctcccagaagcatagccagatgagtgagtagccggatgagaaggaagaccactggggacatctgtcggtcagataccacgggcgcacctctgggtggtgggtttcccagcacgtggccagtttgagttctgtctgtggtgtcactggaaaggacgagagaagacagggtgaaggctgaagaagataatttcttctggctctgggggcgcatttcagagtctcaggactgagagaccaggttcacggtcttgaagaaaatgatgctgaaagttactgattgtaataagcctagaccactttcccgagtctttttctttatagacagccccttctggctgaccaaaagcccacaacagtataaagtggctgtttgtgagactagtgggggggaagaggggcaatataatagtagagggtttgaggtacaaactattatgtataaaataagctacaaggatatattgtacaacacaggcaatatagccaatattttataactataaatggaatatagcctttaaaattgtgaattacaatactgcacacctgtaacttatatagtattgtacatcaacttcagttaaaaaaaaaaaaatgtatacctgtgatggattcattttgatatttggcaaaactaatacaattatgtaaagtttaaaaataaaataaaattaaaaaaaaaaaaaaacaaataaataaacttttctgataagcagccctgagatgacctctaaaaatggttcagcattcacttgacccagaaaaccccacaaaatcatggaaatcaagattcactttaagaacattggtgaaaaaaaaaaaaaaaaaagaacattggtgaaaccgccccggccattgagggtgtgcatatccgaaaagccaccgagtatctggaggatgtcactttacaggagcagtgtgtgccattccactgttacagtggtggagctggtcggtgtgcaaaggacaagcactggggctgaaggcagggtcggcggccgaaaaacagtgctgaatttttactgcacacgctcaaaaatgcagaaggtgatgccgaactgaaggacttagatgtaggttatcttgcctatcgagcacagccagttgaacaaaacc

SEQ ID NO: 24615 - DNA, 1980 bp, Bovine  19866880526797
ttcctttattcgtttctttctattcaattatctgataaaccatatattttttaaaagacagagtggatcaaacttgagtataaattcacaggctgctgtgcacaatgacatccaagctgttatgcagaatgaagaaatcatgtaggttaaactggccaatcactgctttctgctccccaaaccaagagtctgactcactcctattccttccgacataaacaactgagcgtcatggagaataaacagaaagcaagactagggtttgccatatacgccacaacattcactattcccctgttcgtctgaggcgaagccacccaattcccagcagtactcattaagattcagagcatcaagcaaaaactttgagcagagccgaagctatacaaatacataatttataaagaaagtcagaaactagaacatacagcaaacagagtagatgcaccacaggaagagtggggggaatcaagctactgacgaaaaggaaaaactggcttgcctcctgattctcatcccaaagactgctagaaagaaatgaacaataaacctagcaagaagcacatcaaacagaatttttgcaaccaagacctgtaatacaaaacaagatactcatcaccagcagcaactgtatgaacttgggcaatcctgtttgtctgttcctttgttcatttcaatgggaattggcaatgagggagcggttctttaatgtatgagctcagtttgttaccttgagccaccggcctaatttgggtttaaacactcttttttgaggccaaattctgtttatagttccctgtctagattttccactaaatccaccttcactcctgtaaaatagcctaataaaaagggaagacataagaggtaactcttcaacatggagaatcagaaagtctcatccagagatgttgtctcagacgggtgcagagctctccccttctccccctcccactccatccgaatgctgaggacacgtggagcaagagtacttccaacatcggagacccttgggaaatttaggtttctaaaaaccaaattaaagaactgcatacaaaataggttgattacagagatcataactgctttaaacaagccaaagaaatcccttctcaaaggaatactacactgattctttttgtggttccttcatgaaacagatggtctccggttggcgctacctttgcaaacctgggcatctgtgatgggggttctacacgcccccctggtctgaggagccagtctacttgcactaatgagctgagtgagtgaggaaccaaaaatgacgtccttgccttttcttgtaaaccccttttgggacgaaacttaagtgtgtacacacacacacacacacacaattaactcttcagtctgctccctcataaagtgacaataaaaatacttgtcacagagggattaaagaagctgtctatactgaaaaattaactttaaataagtcgacaatatacaaacaattctgttgaggcctcagggtctgagttgagggcacaggttaaagaacactctgggtcatgtgctggagcatctacaggttgcacaactctgttggaagctggcaaactttgtaacatgggcactagatatagatctcaataaacttgttagaaaagacatcttttcaaagaatgttaaatagcatgagatatacccaaacataatctaagtggagagaggaggtaaacaaccagatccataattcttatttcaaatatgcaagtacacgtacgctgaagacacaagagttaaaaaacaagatgtcacaagtagttctgatctctggggagtggaaagtgatagatgattcctctttttctttctacctggccctgctgtgtgtgtattttcaaactttctaccatgaacatacgtcatttctataagcaaatgggaaaggttataaaaattattttatcacaatagtcaaggagtttttgatgtgtgcatagatgtatatatcat

SEQ ID NO: 24616 - DNA, 1721 bp, Bovine  19866880532520
actcaatctccttttatcgtggtttccaggggctgaaacggagatggtgccaacagtcactccctggactgatagggacagctggacatttggggtgcgccaaggcctgtgccaacatggtgacagcagggttccgagtcctgtattgagagacaggcttagggcccactgcttgatgcagctggcctcctccctctccgcccaatgaaacggagcccattgccaggctgtgagggagaggactgtggtgtagagctggacctgaacaagctcttggagacaggtcggcaagtagcccaagaaaggagggagacagggcaagcttcagtagggacagaagtaaggtgaggcactgactcagcctcacctcctcccatcgcgggcctgctgtgataagtgtctccggagcaccaacaagcctcaggagacaaagtcgccacaaggaaggccaatctccgagagactggaggcacacgccgcgcccccgctgactttcccctctcaacgcctgacacccgccttccattaagaaaagccacccacaccaccatctgtatccctgggtcttggggatgacgcattctttacagactcgcagacacattttcctcaggacaccaggagggcgcccagggcatcaggagatgaaatgaacgccacagagcggcgctttgcagcctttgtttggataacgagcagccaggattcagtcccacagagaaggaaatggatgctctgggcggtgagcaggcgccccacggaggtcccgggaacctctcatgctccctgggcagctcatctacaacttcctcccagacaagcctccttcatgctggctgatcagcacaggccacggggaccatatggggtgtggggatcagctccccttcccctgctgacctgagcaggattgtagcgacaggcagaaaagccgggtctagtccagccactcgccccagaggcagcgctccaaggccaggctgatcgatgtctgactgacgcctgctcgcggggctgggaggacctgtgactcttccttcacagtgtttccacatttccgccaattactcacattctcgccccttgtgccgtctcttggggatttgttttccccacttcatttccaaattagctgccagtgaatcattactcatcttctcagtgactggcaggcgttaatgaattactgattttcaccttcaaccagccaatacaatatatttatgttggaaagaaaggtactttttgaattaagacttgtatcttttgatagttttcctttcaaacataatacatgtgtacaattctggcttgacagtggagtaattctaatcacagctactgagcctggggtggcaggcatgggctgccaccaggctgagtccctctgctcacactagccccatgggatgccgcttcccttcctgctgcgatgctgggacagaccatccagcatggcctacacagacactgggctggctagttgcctgccgcgagagcctcagtctctttggaatgtggacagtaatagcacctccctttgaaaggctccaggaatgaacagactgaatacatgtaatgcccttaacacagtacctggtacacagcaggtgaccaataaatatcacctattcttgttcttaactctcaactaaagaatcgttgggttaccctatattcttaagccataatccatgtattttttaaactggagtataatt

SEQ ID NO: 24617 - DNA, 1968 bp, Bovine  19866880603188
tatgctgtgctgctggcctttctgaccggctgcatccagttaggcatggggttcctgcgcttaggtaagactttcaggctttgctgccatgagggtggggggctacagttctcctcctggggattcgatgcctttagcagttccttatttgcatttcaagggctatcccagtgtgtgtgcatgtgtgtgtgtgtgtgtgtgtgtgtgtgtgtgtgtgtgtgtgtgtctaaggaaggatgactctcagcccttccctattatgctcagccaggacacttggagaagtgcccaggggctcagtccatagtctctcctgttctccaaaccagcccgaacagggcatgccctccactagtctttagctccagtccaaccctcacctctcccagcccatgttgagccagtagggctggaaccagtgtggtgttccctcttggctgtccagggctcctgctggacttcatctcctgtcccgtcattaaaggtttcacctcggctgctgccatcatcatcggcttcgggcagatcaaggtaggcacactagttggccctggggcacctaccggctaacaggactgaggccgtgtcctgatatgtgtgggcctgtcaaacctgctctttgagggtccagagcctgtggtgctgacctgagtctccattaataaaaccatcctttgggggagatcttgagtgatggccaagttctaccacaggtaaaccagtactggggaaccagtaatgacagcccccacacttgtcagagttttcgtgcctaagtgcttggttcacctcacagagttctgcagcctcaaatatacactaagccatcaggtcttcacagatcacaagcatactgccaaaattttgacaagcagattgctcccccaagctaatttagctaggtgatttcatttttatgtctccccacccccaacttctcattcagtgtttgtcaagtatcatgcttctttatgtttccatttaaacgtctgtggcaagtattggaatcagtaatcattggtcatctgaggatatcatttgttctccttccactgggttctgagtgcctggagggcagggactgttttgcttccaccgtggttgtcccgagctgtgctgagcagaatgaaactgagctgaatcgtagagattcagggcaacagacacatgcacacaccaggctctccatggtgtgattcccacagtcgggctccgcttcagtctggctggtgacagtcttcaaggatggaggccaagcaagaaagtgaaaacacaaagccccagaggggtacatgtgagagagactagggtagctgacccttttgggtgtgggactgaatgcaccctgcatttagttctcacaagtcctctgggaggtaagcttatcattatctccatttacaggggaggaaacagcctagaacaatgtgggtaaattcaaagaatagattatgtacacacatatgtcagggtaagcttggcaaatgctgtttcgtgggacgctgtgtcctttattctggaaacattatccttcatttttagtgtcaagaatgctctttttttcataacacagtgagagggtatctgctttacgcattcctattcgacaaccctaggccctgtcttcaaaaccttcactacatcatgacagccctctgagagcctttaggctggattgggtggggttcctcttgacctgcccaaacaggagtcccctgcccaggacagagacccctctctgtgtccaccctcctcagtgtccttcctcttcaatggctgtgtgcacagcgggttttggggtccttggagcctgaccaccctgggagtctggtctcgactgccccttctgatcccagccagataaagaactaaaacacagagcggcgccccttctccatgactaggactgctatttgataggggccccgcggccccacccgcgcagctcagcctgccgcgcagatttta

SEQ ID NO: 24618 - DNA, 1555 bp, Bovine  19866880640968
cagtaacatgcttgggcccccatggctcaggactcacatctccctttggctccaaggtcagggagtgttagggctgcaacacagagcaggaataggtccctaggggccttcctcatggattttagaattctgggtgtcaccaaattggggcctcctgttatattgaaggcatcatagcctggagggtgatgcagcagcgatgggttgaccatagcagcttccccctgttggtgatttgatgtgtgaggcggcccaccagcttccagagtggtttggattcaccctttccaggggtctggacctagtgccctggagggcccaccctgctgagatgccatctcctttccagatctcacgcccaccatcttggattggttctccatcccctaccctagctatgccatctttggcacaaagaccgtccagcttactgggcggtccctcctcccagtgctggaggcagaacccctctggaccacagtcttcggcagccagagctaccatgaggtcaccatgtcctaccccatgcgctccgtgcaccaccagaacttccacctggtgcacaacctccacttcaagatgcccttccccatcgaccaggacttctacatctcgccgacctttcaggacctgctgaatcgcaccacagctggccagcccacgggctggtataaggacctgcatcagtactactaccgggagcgctgggagctctatgacaggaaccaggacccccacgagacccacaacctggctgccgacccccgctacacccaggttctggaactgcttcagacccagctggtcaagtggcagtgggagacccatgacccttgggtgtgtgctccagatggggtgctggaggagaaactggctccccagtgccggccgctccacaacgaactgtgaggcccttcctgcccctacagtagggggcctgctgtcctgagtctgagccgcgtccccggcacatgaattcctggggggtacccaagatgctgcagtatcccccaacctgtgacacgtgaggatggtctggggacctgcagggaaaaaaggggttgggacatggggcttaagaccctcttggttctttggaaaccacagacattcttgtgcccctcacctgagaggagatgggtttccatatgccacgagggtggtgggtgggtgcagaccacactcagtgtggggacagcatctgtcaatcctggtctggacagggagcctctaaaggacctttgggctttcttcttccttcactttgcccatagtcaggctcccaacccctgggctgggtttctgtgggattgctgattcttggcaggctccttgagtgatgggtttcatcctggggtctgtatgagcagagcttacccttctttttgagagggtcccaggatgaagatgccactgctgaggcatgaaactgccctattcactgggtaaatcctggatgaacatgagtctgtagcacagacagcactcgtggagtgcttcagaccttccctgcctccgcccacctggagcagaagctctgcctggaaagcccaga

SEQ ID NO: 24619 - DNA, 1051 bp, Bovine  19866880643953
tgtaagaaatacggatgttccatgaagatgagccttgaatctgccctgaaaacactaagcgccaaagcagatgcttctctagatgctcttcatcctcgaagaacctctggggttcctgccctctcccgcccacctcctcaggtttcttcactgagaggaacacggtcatcccttctgacttctctcacatcccagggccagagtctcctgactccagggcagcagccctcccgccagcccatggccgggcgcctcaccccgaggaagcacgttccacgcaatcgtgtccgtgatggctgtgaagatccagttcagctcgcccaggggggtcctcctgtcattcagccgcccgggaatcctagaaaacacaaaatagccacagtgacagaaacaggtgatggaggcaggaggtggtgggaaaagaaggagggaggggacagcacatcagaccaggggtgggggaggcttggccatactgggaggacctctgtgcctcgctgggatttttgagactcctggatgtccaacctctcatcttgaagttcagcttccactgcactttcttcccctccccatctgtacagaaggagcaggtgtggcctctccagcactcatgtgtgacgacaggcgtaaagcaactctgaccaggggagcccctggagccctgcagctcaccacaggcttactctcagcctctgggtggactggccctgtactctaatcaagacactcctcttgggctggacacaggtcacttcccagaagccaagggtaaaggccagacctcctctgtgggcccagctcttcaccacacattcacctgttcaacatcaaacaaacttactcaggcctagattctgcctcttaagttcacagagcaagcatcgctgggctgaaaatgccagcggtgaggacatgagaggcaggccggctgcggcccaggcctcccagtggggcatgtgaggggagctgggcttaattccccacccccacaggggaaatttgaacacagcaagacaaaacccaatgggacaaccaggcaacactcttg

SEQ ID NO: 24620 - DNA, 1191 bp, Bovine  19866880771682
gaaagttttctctctcgaatgctctttttcctaagaaatctgtgtccctattccacttcaaatctttattcaaaactttttaggtatgcaggacctaggggttgagggccagatcacagtggtagttgcactacctctcacagtttcagtttgtagctctctggactacaaatgcctcgttggttccagaagactcacttctgaccagtccatctccatctccactgctcgctgtgacccccaccaggtatatcctatgggccgggaacctcagcagcagacgggaagacgacgagggtcacagggtttctcccctactccctccaagtagctccccctacagctccctccaggtcatttcttcctcttgcctctccagtcagggaagggtcctgacctgtggccaggagcatctcctatttgttcctttaacccactggccctctgggagacgcagctccacctgagggaggtgcttgctgagggaaccacctctacctgccatccatcccttgggtacctgcatatctgctggcctcggcctctccctgccctacgtcctcctcttcgctgaactatgaattctttgagtgacagactgcctgcccttccctttcgtggtctcttcttacttcgaccatctgagaaagccccgcatggggtcacgctgaccagcgcactggactgactggagcagagcgtctcaagcttcaatcaatatgctggccaatcacctggggctcttgtcaacctgaccaattcagcaggtctgggcaggccagagtgtgtatatcttaccagctgccaggtcatgccaacggtactgctcatggggcccctgtttaagcagcagggccccagaggactggaataaatgccacctgggaggggaaatggggaggggactgggaggggggtctacaaggaagagcttactaatacaggcggtaaaaactcagccgaccgagtacctggtctctccgatgttgtggaaagtgtaatacacttgcaggaaaaactgcctggggatgtgctgcagtcccagcaggttctgttcaaacagagattgtggttagacaaccttctgcgacgtaaaccctgaggcctctcccttgcagcatcgtaataccgctctaaagctggagtcccctacccataaccgcccttcctgagggaaaacacttgctggct

SEQ ID NO: 24621 - DNA, 1897 bp, Bovine  19866880781087
ggcccaatgtgacccaaacagactctcccacaggtgcctgtggcaagctcttaagcccaagggcacaggaagagtaggtgctgtgcgctagcccacccacctggcagcccactcacctggcgcacaggctccgggatccgaaacttgcagcagctgtgggtcaggcgcacagctgcctccaggcttatcttgtggcccacagagacatagaggggcttggtgctgtggtcgtggctcctcagggcctgtgacagagagggcgaggtcagggcgctgggcaggctttgtgggtgagaggactgacacatctcaggtggcgggcaggggcttgggggactggcggcaccttcagggcaccttcctgctgcttgtcttggggacaggatagggccagtgaggacccagagggcccctcagcacagttttggaggggaggaagtaaagatgcagggtcagccagaatggcaaggtctggggtacacacattacacgggtgctaacccagggcccagctgaggggtccttctcagcagggcacaggcccctggccacttactctgcccaggacggtcccagagcctcccatcagaggaaatgagtctcctccagcctttaggagctgtatctggaaaacagaggaaaaaaacaaacttgaatacctttctcggtgaagggccgaaggcaagcctgctcattttcaaaccatgagcagttgctgagcaaggagatggaagggcccatcccgtgagtgggtcctgcttccaggcaccacctacggcactgtcccaccctgacaagacgctctcctcaaccctgcagcagagaagggacagtagcccacctagtgctgggggtggggaagcgccaggatggtatacacacagggccacaacctgctcgaggctgcttatttcctgctgctttctctccttctacaaatttgagcacttctgattcaacctgacgaactttttcaggtggtagggactggctcgctgagtgggtcaggggcccctgtcaactcaacaaacacgtgctccactcaggcatagggagctggaaggaaaagacagacacaactgatccccgctcccagtcggctgtccaggtgggtgaaccatgcatgtcattgtccccctctggaaggggtcccagaggacggggatgccccaggcaggtaggtgccccagttccacgctggaggaaaagcacggaacgttgcacaggccccgaatgcctagtacctacaggctctgcttcctgtgggcgccacagcagcacgcaggtcagggtagacagagcaggagaggcaaacgtgtgcccagaggctgggagaggagttccgggtctccagagatgacccaccacccacgagcaactctggtctcctcattctgcccagcgacccaggatgggaagagagtgtcccagcggagccagcccacagcagggcagtctgtgtcctgcgccacacaggccccctcaccttctccttgtgcagagcattgttctcaagtccatccacctgcaggagtttcttggccaccccgatgcaaggcaggtctgtgaggacaccaaggtggcaggccaccccaaaacctgcaggggcaaaggaagatgaggctggagcagtgagcccagcagtcaggagtcggggtgagggacacaccagagcctcaccgagcttcccatcaacggaggcctattggtgggcaaggactagggggttcaggcctcagagccccaccttgaccttgaatctggccctctgccccaacttcccagctggcaggctggatggatgcctccctccgtctgactagattaggagcctaattacaattaacatgctcacatgtttcacctgcttctcctttcattttctggcacattccat

SEQ ID NO: 24622 - DNA, 724 bp, Bovine  19866880809800
ggatgctggcagagcaggaatttgttgtgttctgctccgtgtcttgctccttgcagtgtgagctcacagccctgctgctagagttatgtttgcttccgtcagacatggacaagccagtgcttgccttatcaggtcactgcctggtcagacctgttctgtccttcctcagagggtcactcaccacccctctctcctctctcagggaatgggggccgggctggtcgtggtacccctgatgggtctcctggagagcatcgcagtggccaaatcctttggtaagatgctcaccacccacgccctccctggcacctcaacccggagctcagcctgccttgcttgcctgctctcctgcttgcttttatctgctctgatttttaaaactttgaatttttatccaagtagcacatgtttatgttttttgaaaaaaattagtggaaatggattgtcaatgaaaaatctcttccagtagctggaaatatttgacagtccactctctggacataaaaggtcctgcattgaggctttgtcagttgaactttctgtgtgtggtatacacccttccgctgccagctaatttcaagctgaatgtggagtctgaacattcaggtcttgtgatgagatatgaaatagccactatccattgtatgcatacagctaagtaatttcattggtcataatgaaagttagtaaagtacattaagaacggacacattttaagtattat

SEQ ID NO: 24623 - DNA, 1784 bp, Bovine  19866880881329
agagtgtattttattgacagtgaaagtcctcagtctgtccactctttgcgaccccacggactatacagtccatgaaattctccacgctggaatactggagtgggtagcctttcccttctccaggggatcttcccaacccagggatcgaaccctggtctgctgcattgcaggcagattcaactgagccacaagggttttctgctgttcatttgccttgacaatctatgtttagagcagtttggtgtttatttttctgtttatgttcaaagaaatgttatttttttttttttctctaagttaaacctccttcctttgctttttgcttttgatgcttagaaagtcctctcctgccagagcagagggaaacatggacttctgttttcctggggctttttctacagtttaatttttgacacttaattcacctggaatttaagtttgtatgagatgagaggaaaatagatttttgcaaatagctgactaattaccacactactgaaaaatcctttaaccctctgattcgaggagccattttacaggatagtaacttctcaggtatatcgagtcctatctgggggatagctattggatttctttggtggtcttattatcttaagccccaaacagattcaatcatagtagacttacaacttgttttgccatctgggaggcctggtctgtactcagtgttcaccatgggatgttctgttatcgagggctcccagccctgaaatggaatccagtgggtggggactggggggtgcagggggtacctcagtggggagggcccagattttgccacgcctccttccttttggtgcctggaacacccaacgcagaagggtggctgccctggggtcagtgggcctgaggccattgctcccaacccaggtactcactccaggaaaaggggccgggccactgtctcgcctctgacgtgggccctgtggaacagtgtgtagagatagggcagtagcacgtagcgcagggtgaaggccttcctcatggcttgctgcgccgtctcgctgaacctgtacggttcctgcggctgcggtggagggagtggcggaagcacctgggatctggggtggcagtgcccagtcccttcaccccaggagacctggcagttcggggccagccagggctggcacagaaagcagcgttccccagggcacagcctcccctgccgtccccgccctacctggctgttcagggcattgtggttccgcatgaaggggtagaaggcccccagctgggtccaacgcacacacagctcctctgaggtgttgcccaggaagccacagatgtcagcccctaccaggggcacccccagcagattgaaaagcaggatttctggagggcagagtcagacaggtctgcagatgccacagcctgaccagtccaggagcctgacagacatgtctgttgaactggcgagggaggaggatctctcccaaagaccctcccacccagcccccacccgatggctagtgcatcctgcacttatgatttcagcagaacaaccagctgtatctgctccttaacacctagagtgtgcagggcaaactggattggccagggatgaattgaatcccctcccctccccacaaaggttaagttcctagtcctaacccccagttgctggaaatgtgaccacatttggaaatagggtcactgcagacataatcaggtagaggacatcagggtgggcactgatccaccatgactcgtttccctatcagaagaaggaatcagatacaggaaacccagagggtcccaaacaa

SEQ ID NO: 24624 - DNA, 1564 bp, Bovine  19866880934123
agagacctcaagtctggaacctgctgccattgaggtcaggtgacctggctagccagcaataagccacacccagagtggccttcccaaccctcctgagacccctcggggactgcactttcggtcctcggagcccctcagcccggcacccaggccagcccctcactcctcccaccgggtacctggtctcgttccttctgcagctcgaccacttggctctgcagggcgttcatcttctccttgtagatttcacagtccaccttggttttctggaactggagcagggtctgctccttctcttcccagtactggacggagggggacaaacatggcccacggaggtcagtgactccgcgggtagggctgaggatgggggtgggggagcctcggggagaagtgagggaagtggttctcaagaggaaataaggtgaattgacgctcatttcttaagtgctagatttcaggtgcatctagagttactgtgttgattatattttaatttgatcatcaaaatatgcatgggtcatgcatgtcaaattgtgttttgtttattccatgtcccaaaaggcatacctattttccctctgcccacctcattctcttccactgtctcctttctctcatcctccccttgctttttacagcaactaaataaatccctggctctcaccctggggcccccacgcactggaaatcactctgttttaatcgcttgtttgcctgacctattttctcatcaccccacaaagtggacgtggcctttagcattggattctgaattggtgtccagtctagtttgacaaaggaataagcaaacaggccaatgcatttcttgggcaaagttggttttaagctcagtatagattaaagaatctgcttcctcatccaagcagcccggcccctaaacacggcccagcagtgtcacctgctttcgctgtctctcagcggccaccgcccgctccctcagagagtggatgcggtccaccagctcctgcctgctctccaaggcctcgtccagattctgttccagaatgtccttctccgcctggcacaaagagatgtcagcccagggaccctgacctccccaaaggccccagggaaacatccccatcatctcgtccccaggacaggaggcaggaagcttcgagtccgggtgtggggacggatttagctttattactgcacatcaggcaggaaaaaaggcaaggtcagcaatcaaaatggggaacatgcatttcgggtccacgtgagtgtggctagaagacaaagtacaggaagctgaaagcctctgagggtagtaaagcgcctccttctttttggcagtttcagcctgctcccaatagatgcaaaggcagaggcttccaggagggcgaatatcaagggctgaggcattccctcttcacgctcacttttctgaacgatggcacagttcgggccgggtgacccacaccccatgaacgtctgtcgaagggctagttcaaaaaataggtatttattgatacctattgcagaggagaggcagatgatttgcataattttcagggtgctggcgacacgaacttctctg

SEQ ID NO: 24625 - DNA, 1189 bp, Bovine  19866880966565
atctctaggaggccctcccctctgcctggcctgggagcaagtcagtgcagggatgtgtccttccccagcccaggtcatcctcacccccagaagaagcatctctccctgggggcggacctccagctggacagaggcatgtgggggcccagcagccccagggctggatgaatgggctcaggggcccggtccagatacctgcatagggatgatgtgcccggcccggaggtggacgttgatggtgtccagcggggcggacagcgtcacccactgccccttgctgtggatgacagacgtgaagggtgcaggaggtgggaggctgccaaaggcctccattggtacctggagggggatgtcatgtcacaaagggtcctgagcagtgccaagaccctgtgctgttgctgggaggcaagatcggagacagtccacagtggggacagagcaagagaggctggagccagggctccggtggggctgctcagaggatgggagaaggggcaggagtgtggaagcaggagaactggagtcctggctcagcttggtggcaagtcacctatccagcctcagtttccccatctaaaaaatgggtcctgcaaggattgtacaagatgatgctagtggagcagctccaggtgagggcctcatgtagcaaggacccctccataccaacagtgccagagggaggacccctccaccatctcccccatcctcccaggcttcagggccccaggactcaccgtctgcaggtcgtaccacgtgccctgggggaagtagccagtgacttcaaccttctcagcctcgagcaccggggtgatgagcagagcctccccccacaggagctggcggtccacagtccaggtgcttggggtcctcggggaaccttcaaacaggaaaaactggcagggcggtctggcagcctctgaggtcagtgggctcaggaggcccatgggggaggtttgggaagggagctgaagggccctgggttacacgtggcagggctggttctggctaactgaagtcaaggcaggagccaagaataacctctccttgcctggttatccgggcatgacctgtttacatttccgacttgcaaactgtgcttttgcccatgtgttttatttggttcttgatgttagtcttacacttggtctgaatttctgtacattagggagagtgtcattttattgacaag

SEQ ID NO: 24626 - DNA, 1491 bp, Bovine  19866880987701
actcacaggaatttttccaagtctgatctgtttagtcttcagcaactttgcactaaagccatggctagaccaagtcctccctggctaagaaaccctggctctagccagtccctatccccagcagagagcagggcatgggctgcggctgggtcctcctggtccacggcagatctgggccctgagcaggcttcctcccagttccttgctgcccctggcgtcctttagggatttccaggtcccctctccccagccctgagcacactcctgtggttttctcttataaatgacccaagctcaggcatcttgcatgctgccctactgtttcaagtcgccaaccccaagtcccagtctcgcccgggtgcacggatgagcttgagaggctcagccttgaagtcgcagaaatcaaacaaggttgtaaaaggggaggcggggggatgcgaggctgggagcagggccacgtgacccttctcagactgcaaagtgtgctggatggatttaaacagtgccatcttaaggcacgttatgtaactgaaaaacagatcggggaagggaggaggaagaaagaagggggagattggggaaatgaagagcaccccctggagagagaccagatctgctccaagggcagggggctgccagcctgagacagaaggggaacatggccaaccctgctctgttccctgacatctggcttagaggaagggggtggggtagctgacccagtaggatgccttctagaaataattcttggcctagagggccggtttagtgctgagctccctggcagcaccccgtgtacaccctggagctggtgggtgtgtgttcctggctctgggccgggtgcccatgcccactgctgggttggaatgttttgactggaatcagtcacaccatgcccagggtcatagccacagtgtgtgtgagttgggacagggcagacaagcatttcctggagatgttgccgacagacggggagctggtggctgagtataaagggaggcgatggggccctgagtatgatttttcaggaaacacaccggaagctcgccctgagaatgattggcattgtcctcaaagcagtcatctcaggggaacatggctctagggccaccttcgggctccctgctgacctgctctctctgcaggggcagacagaactgcttgaagagactcagaggggacagctctccttcctgtggggtggatgggattctggaaacagcctgagtcctcaggatgaattggctgggtcagatgagtgaccaggggctgcagtgtgtcctggccttgagggaagtgtgatgggccccaggggcctgttctgagcagcagccagcatcatggaatcgggttgggctcctggaggggctactctgaggggagctagcctctttcctggtgaagagacccccttcctctgcagccacacctttgagcaagcattggtttacagggtgtgccctacccactccctccccatgccactgccca

SEQ ID NO: 24627 - DNA, 664 bp, Bovine  19866881016125
acgctggtcctgggctggacccggaaagagcccgcacagctaaatgtgccctttcctgatgctttgggactcgcctctctaaatggggtttggctcttatgaggctacccaaacccctcagaggtctgggcccaaccccagggcgaggctgcactctgcatgaggtggtgccatcgagcacccagcagggaggtgggacctgaacctcaccaaggaggaagggcagggcccagcggccgggagatcatgatttgctctaggaggcaccgttctccaaaggacataacaaggtgggtacctgggatcttctcaggaaggggctctgaaggaaccgctggcagctctatctgttcctgcgggagacagagggtaaaggccgtgagacactcccgccccatccttgtcccgggaaggacagcatcccgtccacctggctgctctcagcggagtttagacggcacgtgacgccgcagcatgcacacccttggcttctggcgtttctgtcactcagatcggtggccacaaaaggtggctgctcccaatgacccggagcctgaggggttccccgcccagagttctgttctgagtctgggctgagggctttgcagcaggcgcccaggcaggtcaggggccacggtggtgccccagcttggtgtggtggtgc

SEQ ID NO: 24628 - DNA, 735 bp, Bovine  19866881035226
tgctatgcaaaatctaatatccggccggaaatgaacaaataactcacagcctcccccaggtctttgctcaccctgctgtgtgcctcagcggctaggccttttctgcctgtagggaggggtccccggggctcagcagcgggcctggcgccagagtcagtggggtgggtgcatgtgccatccaggggcctccctggacactctgagggtccaggggaccgtggccttgaatagcacatgtggacggcccctgactgcacgtggtgcatcctggggccccagtatgcccacccagcatcaccacgacccactcccgcagcgtcaacggggatgtgcgcttctttgaccctcggctgccggagtctgtgaacgtcatgcagatcgtgaaggggctgacagcgctcgacatccacccccaggcaaacctgattgcgtggtaggtgctgcctcttctctgccccttcccgcgctgcccagacagctcccgggccctgtgtaaacagcaggcaccatgacccacccccacacctgtggaggagagctgggtggagggactgagtgtggggcccctttgctgctcctcacctgcctggcctcacagcccttgaggctcaagccccctcatgggggtgaccagagaggagccccctctccccatggacacacccactccacgcgctgaccgccaggccttctcctatgcagtggctccatgaaccagttcaccgccatctacaa

SEQ ID NO: 24629 - DNA, 1394 bp, Bovine  19866881056945
ggccccacctgagaagatgaacatgcacagacacaaccgcaaggcctttccaaggcagatcctagaagcagttctgcagatcgcaccaaaagatccacagtccttctcaacggattgtctgtggacagcaaaaaactgtaaacagccaaatttccatcctgtcactctcagggaatacacagaacaggaagaacaaaagaacccaaaccagccaaacaaatctgaaaaacaggagtcgctgagcaaaggagacgcgagtgccacaaacagggcaagctgacctcagtccaattagggtcttgttcacacacacacacaaggcaatggcaccccactccagtactcttgcctggaaaatcccatggacagaggagcctggtaggctgcagtccatggggtcgctaagagtcagacatgactgagtgacttcattttcacttttcctttcatgcattggagaagggaaaatggcaacccactccagtgtttcttgcctggagaatcccagggacaggggagcctggtgggctgccgtctatggggtcgcacagagtcggacatgactgaagcgacttagcagcagcagcagcacacacacacagacacagacacacagacacacagacacacaaagacacacacacacacacacacacacagagacatgcatatcactcttcagaaaacaagtgaaggcacacagcttggccaggacaaggctgcctctgcaggatgagggggttgtcatcagggagggactcgaagaggttttaaagccacaagtcactttctctttcttaaacccaataatggataagcaattaatttgattaatttctaaaccatgcatgtattccataatacgcacaaatggcctaactcattccccaccgcaaaggaaagtatattatttgagaggaaaacaatgctcaatatctaacctaagaattcatacaaagacaaccaaacatctccaagctcatttatgttcatattttcatgtctccagagtatttggagaaaactgtaaataagatttctctgcagattgcctggctctgcaaagaaaaacagatgatttttgtcattttgtcaatttagaactgcttacaaaatataacggaaaacataacaagtacctcatgacctgcaaatccattcctaggtatttactcaagagaaatgaaaatatatgcccacgcaaaggctattacatgaaccctccagcagctttgttcattgcagccaaaactggaaaaaacctgcatgtgcatcgggaagagggtggggagacaggtttgagtccatccatgagctgagacgctgcgacaatgtgggtaaatctcagaatcaggttgagtaaaagaaggcagaccccaaagaatacccaccgt

SEQ ID NO: 24630 - DNA, 1230 bp, Bovine  19866881220293
tgcatccgcatcactgtgctcagcacacaactccacggtgcgtctgcatcactgtgcttgccacacaactccacggtgcatccgcatcactgtgctcagcacacaactccacggtgcatccgcatcactgtgctcagcacacaactccacggtgcatccgcatcactgtgctcagtgctgtcggccccaggttcatgtgccttaaactgttgttgttgttcagtcgctgagtcgtgtccaactctttgcaacccgtggactacagcacaccaggcttccctgtccttcaccatctcccggagctttctcagactcaggtccattgagttggtgatgccgtccattttccttaaacttaggcacataaattttactcagggctatttgcatatagtttagaagtaaggtactttataatgtgtaattgtgagaaggaacctagagatttacttcatctagaaattatgttattttggggttgagtttttaaatatttgaatggctgcaaaacaaattttgtcgtaattggaggttcaaaaattgagatatatatataaaacacttattccaaatctgcttccttttacaatctaggcatatataggcagtctacccagagtccttcagagtagtgcagtaaatattgcttcaagtctttggagttctgtgttcttggtgacggctgtgaagtaacatttgcagcacagatcataatgttgtttgcagtttgtcagaggtgctgtgcagccgggcagatggaggggctgagaagcaggatgctgaggatctgcgagggcatcaatcctctgtttctggcacagatttaattgtttggttcaagtgggaagccatacgttaacttctacttcaacccatcatgagctctcctacagatgctggttttatacaggtctatttgtcttggaaattgagcctgagagacaaaaattcatgcttgagttgtcatagatgttgctggattgagacttgtggagctggttggatgccctctgcctgccccagccctgccccctcgtgtaaactgttacactgtgtctccaggtgacatcttgggatgagttccctgcccagatggggatgtctgttttcatcgcactttctgtatgacccaaatgtacactgatgttccctttctgagaaagtgagaataaggagttaaagggagaacacggtcgaatagtttgggcatgcaggtctttgtttatagcc

SEQ ID NO: 24631 - DNA, 1797 bp, Bovine  19866881240077
actgtttttagtttcccagtccatgtgctgggtcatcttgaggggtttaattcatctgttatatttgcttttgtgttagataggaaaatgtattatattttagaaaactaccagaaattgaagtatgctatgtttattttcttgcactatagagggatggtggtgtagttcatgtagcttgcatcaagcaggaatgtgatccaagcagtagatgaaatggagttctaggtgatatgaacaacttgcagacttactactggttgggagtggtgactacagtactgattggtttatcctccttttttaccttaaaaagtaacgtcacagaacccccagcagtgcaggttattgtaatgtagccaaacaacacacaagtaattggagtaaagtgtgagcctccctcacccccattctccaggagtaaccacattctttttttaacctcaggtctctctgttttgcaacaatgttccttagagattgtttctgtataaataagattatgtgttggtatgaaaatccccttcagcctaatacttcattcagtagtttattctgagcttagtatgttggacattgggttacgagtaggtggggaattttaaaaagataccatcttccccacaaggagctccagttatggttttaagtatgctgtcctagtggctagagctcatttttttgttttaatttacaggttttgaaaaaccatcagcaatccagcagcgagctattaagcagataattaaaggaagagatgtcattgcgcagtaagtctgctcatgcaataggagtcaggctctagtcagcccaggaatctgtagtttagtgcttctccattcaaacgcctttaccagctcttgactggacttcagctgtgggctgtttttatttttgtgtcctccactctagaaagcattctttttttttctttaagccagatttacttacttattgtttggcatatacattaatactcttttaatagctttgtttctgatttgccttatttttaaagactcatttaccaaaaaaaaaaaaaaaagtctgaaattgtagaaaagagttatataaaaggtaatcctttgctactgcctggaacacccattctacagattctgcagttctgtaaccccccgatgcaaaggccacttttactgtccttaacacctgtgatttaaaggttgtgcctaagtcctgcccccttgtggttaagatgttggttagggcattggggtcatgtgaaggggggactctccttggaagaagctgcctaagtgcttctgcagcccaccgcctcagagcactgctgcagcaggggttacatgaatgggagcagaggcatgtagcccagcattctacatcccatttatctgtgttttctttactagatctcagtctggtacaggcaaaacagccaccttcagtatttctgtcctccagtgtctggatattcaggtaatcttaaactttaatccttggaaatacttcctttaccttctgtaactacaatcttcaagaagtacagttcttaaatatatctagttgtactgaataaacatattttaagagaatcttaattgtacactagtatctgagctaatatcctgtcagaaattcctttttatttaaaccgttttttaaaattttattgaaatgcagttgattttgcagtgctacattagtttcagatggacagcaaagtggttcagatgtgtgtgtggatatatatacacatatgtatatacttttaaagattcttttccattataagttatctattttatatatatagta

SEQ ID NO: 24632 - DNA, 1750 bp, Bovine  19866881543307
tctagaaaactcttgttattcatacctttattcaacatttcatcagcctcatccaaaaccaacatcttgatagcacgtgtcctcaaactcctgcgacgaatcatatctataaaattagatttccaaataagtagaggtcaggttataagtaaagagccagccatttcaaccagtattcatcgcatttcagggaccttccctccacttcttaaaagttactcaaatgcaaaaagttatcaggtagcatatcaaaatgaaaatagtcctctatcactgaagctctttttatagacaaaagcaattaatcaccaaagacacgcccaggtgtgccggcgacaacgtgctgtccgtagtccaatttcctgatgtcctcccccacattggtgcccccgatgcaggcatggcactggacgttcatgtagtcacccaaagcaagcaggccctgaatgaaaacacaggttcatgtccaaggtctgcaccaagaccactctaaagtcagaaacacctgcactctccccaaatgaagactgcttctaatttacaacgaccaccaggtattatttatgctattacttttatcataaaactacagacagcctaagtctcttccttccatttttttctgcaccagaatgaagttagttttactgtttttcttattataaaagcagtatgtattagaaactatagaaaaataagaaagcatgcaaaattcacaatcctaccacccagagacaacattaacatcttaacaaacacatttccatttccacaatgtttacactataaagaccaaatagttacaattatttttattaagatggacttttttttgaaaaaaattataattgtaagattacaaaaaactaaggggaatcatacaagtagaactaaagatgacttcatacaaaccagtgatttatggcaaaacatgaggaatcaggggggaaaaaacccaatagaagagacaaaacagattcaattaagtcaatcagttggcttgaccagtgtgaatggcagagagggatgacacctatatacggactccagacaccccaaaacccaagcttggtcagaaatctacacagacttcagtcagccctccctatccttggagccacctaagttcagatcaggcagttctgtagtatatattcatttttaaaaacctgcatataaatgggattcatgcagttcaaactcatgtggttcaaggatcaagtgtacttgcaaatgcgaccctgccatctttcaccatctcaccttctggatctgtacagctaactctcttgttggagccaagatcaaagcttgggtttcacgaacctaggaaaataatttttgtcagaaaatagagaacctcagtattttcgaggggggtgtgtgtgttagttgctcagttgtgtccgactctttgcatccccatggactgcagcccaccaggttcctctgtacatggaattctccaggcaaaaatactggagtggggtgccattcccttctccaggtagaccgcacatattcagactcagatctattctgaatatcacctcatgttaaccacacatctgatttcaggtaagcaagtctgaatattacttaaaccagacaagcagcaataatgaggtatactagtcaggattcttgtttgcagacaaggatttccactagttaacaaaagcctcccaatttacgacacagaaaacaatctatgggggttatatgggaaaagttggggagcgggataaat

SEQ ID NO: 24633 - DNA, 1498 bp, Bovine  19866881646866
caacccactctagtattcttgcctgggaaattccatgggcaagaggagcctggatgactacagtccgtggggtcacaaaagaattggacacaacttagccactaaacaacaagaataagggtgatctctactatggaaacatatgggggaaaaagatggacaggaaatgtgctaaaatgtcaccagtggttttctctgaatggaggtaattgttagttaatatgctatatatacattttggtatttttccatactttccacaattcgtacagattcatttttaatcagaaaagtaagcatttctgtgtacataaatcagctgcaccagggttcaagcaagcctatagttcataacttgcctaacagggtggctgaggccccaccaggggtgaaggagcagaagaggaatggcaggagctcacagagctcacgtgcttgtttcagccagcattatccccagttaggggcccggctgaagggccaccttctcacagagagctgagttcatgcctgtcgctccccatccacgtatccagggcactgggtgggaacacagaggaacagccattgcagcaacagcacgtgacccaggagggagagccaaagcccgtggcagtggtgggcagcagatgagggacgcctcctctgtgggtgatggcacactgggccagagaaggggaggaggcgtctgtccctggaaggcagaggtggagagagtggcaggaagaagatcatgcctaagcttcggcccattttctctccttctgtcctgacagcgtgactctgcccggaacctcgagtggctgaagacagtgaaggagagtcatgggtctgtggagctctcatccctgtccctggccacagcaatcaacagcagaggcatctatgtgatcaaggctcccacggatggccaaaaggtgagcctcacatcgcaggcacagctgcaggaggctcttacgggctgctgtcgtcggggggtttctgcctccccaaatcgacctctgactgtgccctgttccacagatttccccagacacagttctgcatttaatccttcccgagggccagggaggccacgaggagaagcgagactactctttagaagagctgaaagagcttttgaacaaattgatgctgatgtctggcaagaaagaacacagcaatgctgaagtcgtagaggtattttccgaggtaaggatttgtatctacgttggagcaagtgtcctaatccatctgtttgggctgagcactctcactgctgaggtgcctgggaagtcagaagagattgagtttgtctttaattcatgggaatcactctgctcttaaaactgtggagagtagagccagtgggtcttgcagagtgcatgtatttcaaattcatgacccaaagagatgtccatcttctccataaatcagcaagcatcccaaaatacttaaagatgtagttggacatcgttcatcgaaatccacagtaaccacaatcgtaaaggcatatcag

SEQ ID NO: 24634 - DNA, 1845 bp, Bovine  19866881873322
ccggtgactggcaattccatcatttcttggggtctcggtttcctcattgtaaaagatcttttaaaatggaaagaaaacttacctcgtgggaatgttgtaaaaaagcaaatgaaatagcaaatgtgaaataaacagtcatgcagaggggattcttagtaaggagcaaaacctgagaagcataaacattcttttcaagttgggaaccaagcacgtagccatcagcgattaaaaattgcactttcctgccccatctgcccacctggcgccatcatcacctgaaaccccagcacctggttttcatggagctcccccgcccccggcctttataacccaagagtccttgcataacaagtgatttggggctggagctaacgatcatctccaggagaggatccgacagctgggcctctttttggggaacttggcctggaacccctcagccttaagcctcagtcgacagaccctttccttcgtgtcatatttctggcttagtctctagttgtggacaatggctaagccactctccttcctgtccccctgcaggtcgctgctattaacccaaaccacccactggcccagatgcctttgcccccgtctatgaagaactgcattcagctggcagcctgtgaggccaacgagctcctgcccatgatccccgacctcccagctgacctgttcacatcatgcctcaccacccccatcaaaatcgccctgcgctggtaagtggcgcctgcctcaaatcccagcaacctcacttgcctggggcttgccatggggacccaaggaatctacctgactctggtggaccaagttccaggcatgaactcaggactccgagtggatgctggggatttcctctcagggctcaggatgcgctttcccccaggtcaggtgtgtgcatgatttctaggagctccctgtctgtatcttggctaactgaggtggtgtcctcagtaccaaggtgggtcatgctgaaaagtggactttctttaaaaaaaaaaaagcttctctagttatataattctttgctcgagttgaagtagaatatttcatattacttccctaccatcactcttttgagaagttcaaagctcttgtgactgtgactgaggaaatacgtgggctattccaggatggtagaagctgcatgtaaggccctctgtccctggcaggactcacagtggaatgtgtgtgcttcctgcctccaagtccaactttgtcccttagaccgtcttgctcccatttaatatctgcctttccattttatgttttgctggaaaccatatacatgaaggtaagtagcccttggtgagccacaggcaggacggtgcagccgtgtgggttcactggactctgtgggggcttcttcctcaacttcctgccagggtgtcctaaccccaccagacacacggggtcctgcttccttccccacagccctggagaaagtactgagacaggagaggactctaggggcagcaacatggtgctcaaccctttgggaggccccttgagtgactgtagcctgggtgggggtcgggacatgaagttgcctccaatggctggtttgatgagaacttggacttgcagctttgcctctgttgcagcatcgggttgacacacagcgcctggaagagggcatctgcctcccactccaccccatccctctcaagtcccagctgtgggtctctccaaggagaagccttttctagctcagctgatccctaaagagctagaggagaaggagcggggtgatgggcagtggccccagctgccgagcccactccacagctcagcccactcagacagggcctgacttcggccgctcctccactgcacctcaaaaag

SEQ ID NO: 24635 - DNA, 1715 bp, Bovine  19866880360692
gcatctgtgtgtgtgtgtgttggcgggggtgacatctgtcacatttaatttaaaagatacggcattcctcgatcttaatggcttataagtctttgctgctaaagtgaagtgtaatatgttaccaaaatttgctctcaaaaacacatgtaaattacccatcttggagctcaacatttcattcatcatcttggggtcttcatacctctcaatatgaagaaaagttgggattttcaattatttatggttttatttcaccaatactttatctttttttttttggctataccattccttttccaaaatcttagttccctgaccagggattgaacccgcccctcagtagtgaaagtgcagagtgctaaccactgggactgccaggaattcttcatcaatacttttatcagttttcatttctcccccttatcctttgtcttttcttagtgatttagagttctacaaagtatccctattttgttacaaaatttcttttctttcaaaaataagtcaatggaagctttattttggcgtctttcctatggtgatgatttcaatttagcaagtatttgttgaatataaaatatatgccaaatactgacacaaatatttcattttcacaagtatatgtgaggtgttagcctccaatgtacatactggagaactcaagtacaaagagacaaagtcacagggctagaatagaacaactactaaatagcaaggtggtacagctagtatttgacttcacaacttctgattccagctctaatattctgttaataaggcttcttaacagaattaaatatcagacagtaggggtatgtgtttcactttgttcttatttttctttctttccaatttattttccatgcaataatgtgattttttaaaataacatcaacaaagactagagatagatcagaaaccattttgattataatcaaagaacagctctaggtggcaaaaaagtctaggtaacttttcttcagagtcaaaactgatgtcttcagctgggattctgaaacaacagactaaaccaagtcttcaaacatgtgatattttacttacggagtcattaattttttcttcttccccctgggctagttcaagtctcatcatattcataatgattattccagaatcacgtctatggaaagaaagaaaaaaaatacacacacacacattctttgaagaattttgtattaaatttctgcatgtttttccctttatttttctgaattccgaatcctgagggttgatttatccattttttgatagacccataaagtttggagaagccatagaagaagcttttgaatccttactcctttttttcaaagcatagattttgctttgtattaccaaagttacttatcaagttttaaaatatttagattatagaaattttaacagtaacatcttccagtatttagatatgttctagaagaaagtgttttctttcttcaaaacctattttttttttcaagtcagtgtattgttcatcatttcatttcctatctttaaaagctaccccttggcatctctagtggttttcacatacttttgaatatattcaaaagatcagaagtgacatttcccttgtaatctgttctttgtgagctaattcaactcattcagatggattaaacatttgttgaaaattataaaacatttataatcctgtagtgatctttttatctggataatttaaatttatttga

SEQ ID NO: 24636 - DNA, 827 bp, Bovine  19866880489152
tttattaaaatcagtattgctttctggttaagagcccatgcatgttatacagtttgacttcgtaacctcatatttcaggttggccacttaccaagcttcatggtaactttctttacttttctgaaactcattgtgtgtgaaatgaaaataatagtaccttcttcacagggttttaagaggactaaatgtgatgatgcatattaattattcagcatatttcccagcacaaagaaaaactcaataaatcttaactattgaagtctgaagagttttaatactgtgaaaccaatgaactcttacatcagcgtagcaatttatttggctcacttttccacaagttaaaaaaaaagcctaagcgatcctttttcttttctcattagatgaataccttcccaataaatctccatacagcatagggtactgaaatgttttatggtgcaatttaagaaaaaatgttgagtcctcttagagcccatattgaagtgtacctcaaaccaaagatgtatctatcactgcatcaaactgttcttttggaagaagctaaaactagatagttaattagatatggttcaagtttcttccctattgaaaatcagttcttgtcatatgtcttcaaatgataatatgtcttcacttttaatggtattgagcacaggctgtttgttccagatggtctctgaagttgatttgttagaattcatagattagcagacatatttcaaagcatttctatccatagctcctgtgttaaacgagtgagaactgggtcaagcttctgggtgttttcctagtcaaccaccaagcctagccagattccaccagagaaa

SEQ ID NO: 24637 - DNA, 1507 bp, Bovine  19866880547712
tttcacacagcccatgtcgactcacccaaacctgctatattttggcctaagcttaaatgcaaatataattttctatatagactatgacatggaaattaaagactgttttcatattgtctggaaaacagcagctgatctgattccacagttgactaggtaacacaggtaaaacctcaggtgaaaaataaaaataaaacttcagacaacagaaacatgatgaagctttgctaaaatactattttacagagagttgaataaaaataagaatataaatcattggaaaaagtaacacaaaacaaaaatgaaaggaagaatttgggtttcttcagaacgaaatcaatgaccttcttttcagaaactaaattgatcttattcagccaagtagattgtctaacaaagttaactgtaatagagggcttcccatgtggctctagtggtaaagaaccctcctgccaaggtagaagacataagacacataggttcaatccctgggtcgggaagatactctgggggaatggcataacaactcattccagagttctggcctggagaatcccatggacagaggaagcctggtggggtatgcagtcccatagggtggtgaagagtcagacacaaaatgaagtgacttagcatgcatgcactgctgtaatagactttgagatttgaatagatcatcagagctcaagagatacactaaataagatttgcctaaacagccaatgaatagagtgactatacaatttatcgttcaaatgagagcacttcccaggagagaaaggttgcaccaatagtgcagaaaccagtactgtcccaaatgaaccgtgacatgtagtcatcctgacatgaagcacaataacatcaaactatgcttcctcgagcttactagcatcgtgtggaatgtgatggcaaggggcaaatcctatgttacactgatccagagagtgctaatcttgtagaaatcattggtaatagtgcctctgaagctgtaaagtgtggtggcccttttccttactccaagccaggcaattttgttaggatttaatccatattaatttacttactattcaaaaactctgaaatgcttatctccattttaagaggaagaaaccaagatagattgtctgaataacctgcccagagtcacagagctaaaactggttgagcgaagatatgaaaccacaaggtctagctttccaattcctattttaatcactgtttatacacctccttgttaattctttttctcttgcataaattttctttaataatcagaacaatactttaagaggataaaacttttaggatgaataaatttcccagaaggtattctattcaaataattttcattgcatcaataagggatttgcaagcaaaataataacttgtgggttgggaatatcttgcaaagaatagtttaaagtgatagactttgtaagtcagagctttaccgccagcaattttgttttgaatcgtaaaataaaatgaagaaaacggcttttcagaa

SEQ ID NO: 24638 - DNA, 2873 bp, Bovine  19866880570216
tgatgcttttgaactgtggtgttggagaagactcttgagagtcccttggactgcaaggagatccaaccagtccattctgaaggagatcagccctgggatttctttagaaggaataatgctaaaactgaaactccagtactttggccacctcatgagaagagttaactcattggaagagactctgatgctgggagggattgggggcaggaggagaaggggacgacagaggatgagatggctggatggcatcactgactcgatggacatgagtttgagtgaactccgggagttggtgatggacagggaggcctggcgtgctgcgattcatggggtcgcagagagtcaggacacgactgagcgactgaactgaactgaactgataaacctattcatctactcaggagtagagactgaaaagaactgagggatcggctgctaaatggggaaagtgaggaaaaaggaacaaaagaggagtctgacaatcattaaagactaaacagcaagaaagcagtgaaggagttgggagacagagagagaataatgggaatcaactttccactaagggaagtgtattgccacatacgacttcgcgtacaatatcctctccaatttcccaagaaagagttgcaagggaaaatatactcaattaaaagatatttagaaaatgtttagacatagtgagttggacaataaggtcatgatgtgaagaatattggtagtccatttttagtttgaatagttgttctcgagatgttcatactgatcatctttgaagaagttgctcctcaacacctaagttaaatatcagcaatgaaaaaccagcaagcttctgagttgcctggatactgagagggtccacatcttacatagcagcagtagtatgacctacctggctgcaatccggccaagctctagcaaacagagacacacttctctgggttgcttgtggaggactgaaaaagaagacgaaggcggacacttttacaatagaagggattggacagcagctcaatggggaacatgcttgacccccccgcctcacacctcagggtcccagtaagggagctagtcttcattctgatattcacagaaaccatcctgtcccacagtacacttagatctactgaagtcctaaagcagttttcaaaactctttgcctagcttccctaccaaaaatcatgagcctcaggaatctcactctgaaaatattttcttcaattagtcaatatttgtatgtgaatattgaaaacatatgtagttataattctgatataagtagttgatgaatacttaaaaacagcaaatagaagactatgaagcaaagattgtttaaaacttctaactctatcttcaccagtgatattagcagaaataatgcaatgaataaggattaaaaattacatatcacagccctttgttatcctccaaacaataatgtaaggtgagctctctgaatcttgatatcttctcctattttgattatattttaaaaggaaacactttcaactgactgaattttgtaaatatgtacaaatatataccgtcagtcagtttgggccataaaatgagcaaatcagaagatggttctttgcaatactatttattttctaatataatctgattacttaataaatttgttttaccagtttctttggacacattcagtaatgctgacaagtcatacttgcatttgttgaggctaccggaggagtatgtgttgctcatacttttttttttctttttaaactcagactagaaaaaaatttttaatgttattatatacaatacctaataaagacaaagatattagggggaaaagattgtattgagaatgctctttacatagacacaatatcctgataaaagaaaatacgagtttattgataaactttaagaaaaatagcaatattgcttcatctttttttgtggattagggggagccttccctggtggcttggatggcaaagagtctgcctgcagtgcaggagaaccaggttcaatctctgggttgggaagatcccctggagaagggaatggctacccactccaggattcttgcctagagaattcaacgggcagaagagcctgatgggctacagcccattgggtcccaatatactgataaaagaaaatagtagcttactgataaactttagtataaatagcaatattatttcaattcttttatttgtttatttattttaggcagtgctggatcttcattgttgggcaggcttttctctagttgtggcaagtggcggctactctccagttgcagtgcatgggcttctcattgcagtggcttctcttgttgcaaagcatgggctttaagcaagtgcacagatttcagcagttgtgcctttggacccagtagttgtggctcctgagacctagagcacaagctcaatagctttggcacacaggctcagttgcttcacagcacgtggggtcttcccagatcagggatcaaacccatgtctcctgcattggttggtggactcttcaccactgagccaccaaggaagccctgcttcaattcttaaatacacaattttataataatttaatttcccagcattatttctatcccccccccaacttaaatatctaatttcttctctccacaggctatgacaatggcaatatttgccactgacaccagaatggaatttgttggggctgtgtggtgaatagaaaaatacatttacttagattgtgaaagtatatgattttacttggctttaaacaagcaaaaattattatcttgctataaaatgtaatctttaaagcttttaaaatatgttctaatatcatcagcaatactcattgaaaagaactgattatgggaaatctgaattacagagtaattccat

SEQ ID NO: 24639 - DNA, 1436 bp, Bovine  19866880663085
ttaacataaggcaattctaacaccaagggttgtgatgtattaacctcaatggcagaagcagtactaatttagaagtctgttttgattctttggccatcaaatccagaggcatagatttgcattttctatgctttaaaaacttttttccttgtctttaaggcaatgctttaaattattggtctttcaatttgcagaaatgaaaaacaaaatttctgaataacacatgttccaactgccaatgcaggaaaatgtaggtttgatccctgggtcaggaagatcccctctggtaggaagtggtaacctactccagtattcttgcctggaaaattccatggtcagagaagcctggaagggggtcctaaagagacagaggcaactgagcacgcaggcacacaaggctggttaacttattagaatgtcaggttaacaaggccaaaattcagggtataaagtccaactaggccagttggttttccaaactatttctgacaacacatgttgttggttaaagaaatctcttcacttctgaggacttaaaaaaaaaaaaaccaacaaaaaacctacaaaagtaaggcattaataatgtaaaaacggtgtcttgttggtcactggaaaactactttttctgggacaagcacatatattttcaggattattagaaacgcacgttctaaaacacttgttaattctatggttttaggtaggatacttgcaatgttacctcctgtatccagaaaatccatggcactacaaggcagttactttacatatttgtaattaagttacaattgctttattatatattaggacctaaaataatattttggacacatgaaagtacaggagatgtggtgagaaaacaggaattttaattttgtaaaccatacattcgagtaattagtaacacaatgttgcccacagagaactggggtctgggctgaaaacttctcttccccagtgcaatatcatacacgactcccaagagctaacaacaggtctgtccagatgctaagaccagggacttcgaaatctccgtcttgagccttataggacttcagggcagttagaacttcatctttcagaggcggaggggcctgacagaggctttgaaacctgctgaacaactcctcccagggcacatcctggggctcagttccaatccaaaggcctttcggaaggtcatagtgcagttggcgaccccagtttgtgagcagacccaggtagacaggggacagctctggatggcgccccaccacggaagttaaaagctcggctgggaggttgcggcaaaaggcaaccacgatatctgatttccccagaagccaacgaagcagttcttgacgcccgtctcccggtgttttggggctgcctactcccaattcctcttcttggagccggggggatgcctgcggcagcagcagcgcggccgccaccac

SEQ ID NO: 24640 - DNA, 2014 bp, Bovine  19866880716562
actcacactaccaggaggtaatatacagctgactggctggggccttgtcactggccactagtccctggcaatctggtggttaggagtcaacgctctcattgctccagcctgacgtctatctctggccaggaactgaaatcctgcttcaagtcactacaggctgaggccactggagatcagttcgtaggatggagacgtggacagggagaaccaggtgctaagattgaggggtcctgaggtcccatttcccaggtgaaatctcagaagtgagaagatatgtagttaaaggggagctgtaagctgagaggcctcggtctccctccttactgtttaggaccctggcaaagacagcaccaagctgcatagccctagggcaacctggagacattcacagcagaggggcaacaaagttggacaaacaggaccgctgagatggctccttcaagctgcgcttggttcccaggggcgagctgacttcctgcatccagattcccagccccacccctggggcctctcccctcaattccctcccctgcactgtgctgctcaaaagtcgtgaggaaggggaaatttagctggcaaggggaagggagcccatcacatcccctccctgcagcctcttctagcttgcaggtggaggaagctctggtttcaatacttcctcaaacacccccaaaccaccccaagcagaatttcatagtccagagagcaatcgatcgatggagccccttagggcccccagccagtaatccagagtggtgggaaaacccagacaagtgatgtaaatgtgcgaagaaaacccaggcacaacacaccctcagctctttgttatgtggattaagctgatacatctctgaacctgcatccctgaaaaatgggaaccactgctgctgctgctgctgctaagtcgcttcagtcgtgtccgactctgtgcgaccccacagacggcagcccaccaggcttcccgtccctgggattctccaggcaagaacactggggtgggttgccatttccttctccaatgcatgaaagtgaaaaatgaaagtgaagtcattcagtcgtgtccgactcttcgagaccccatggactgcagcctaccaggctcctccgtgggatttgccaggcaagagtactggagtggggtgccattgcctttgtccctagagaccttttaaaaagctaacaataactcagtcagcaactgggaaccataaactaagaaaatgcatttgaacatcatataacttaatactatactggtgtgatctaaggttaataatagattttaatgctactacgtaaattattaatgctatataagtaaatggttaatgtgattgaacctctttgttgaagaataaaaatgactgggaatacttatgataatggctaaagcctatggctgctacttctactagagtctgaaaaaagcgttctcctaaaatggaaccgtgctagaaccctttcaaatgtagttgatctcttcattcattttacatttctagttaataaataattaatgtaattattctcatcacatatatgtaaaactcagaaagtctattcttcactaggctaaaataataaaccactccccacccccacccccaaaatttccaaaatataacctaccagggactttcctggaggcccagtgattaagactccatgctcccagtgcagggttcaagggtttgaccactgaggaatgatcagtgaggaattgaggtcccatatgctgcacatggcctgaaaaaacaaacaaaaataaagcctatctacaggaagtaaaattctaaatataagttacttaaataggaccgtgggggaatgtaagaccttaccagcagcaggatttaatgataatcatgaggacctatatttttaaagcctttaaggacaaaacagaacacatacttaagggaaaatgctcaaggtcacatatcatcattaactgtcactgaataaatctttctctcatttcaagaattctctgcaaggagattaaaaagca

SEQ ID NO: 24641 - DNA, 1189 bp, Bovine  19866880720326
cccaagaagtttcaaaatccttagctcaggttttcaggtagcagttattaccaattaaggagaattatcatcaatccaggttaaagtcaaaaatttcattttccatttttcagtttttgcatcataatacttcttgtagatcaagatattttgttttgctgttgattttgagagcttcatagctctgttacttttgatagtttatgagagtaatgagaaaattacattcaataaagaaatattttcattgcatacctcacatggttttttgttcttatacttacctaaagtgaaagtagctcagtcgtttccgactctttgtgaccccaaggactatagagttcatggaattctccaggacagactaccgaccagggaaaaggtagcctttcccttctccagggggttcttcctaacccaggaatccaacctgggtctcctgcattgcgggcagattctttaccagctgagtcacaagggaagcccaggaatagtagagtgggtatcctttcccttctccagccaatcttccccacccaggaatccaactggggtctcctacattgcaggcagattctataccaactgagctatcaaggaagccctcatacttactgaactatgagttaaatggaatgtaaagaatttaatgattcacccagtattgtatagtattctacattaaaaaaaaaaagctgatctgaattttaagttagtttttttttttatactctcaaaatcagaaggatcagtctttttctcgctatattgaaactagaaattagtaagtatttgccatgtaagatctttttttcccaaggctcttgacagggaagcaccatttgcaaatgtttcagtacaaaaggcaaagtttagtatgacagtccatcctcttctagattttatcattttaaagccagcttttaagttattttcttttccattttttggtttgcttttcttttatttccagtacttacagataggaacaaataactagattaacattttcatgcattccatttattatttatgtgattagaaatattttaataaatagaattttaagaaaagaaatcaaataagtaaaagcttacttgacataaaactaaacacttagcaaatgtatagcttagggtcctggttaaacttccattgtcaaaacaaattatttattaattgctgttaa

SEQ ID NO: 24642 - DNA, 1520 bp, Bovine  19866880821188
gcagctaaaatttaataaacatcatttgtaccaggccattataataggtgctttatgtacattgtctcactgacttctctaccactgagctgggaaaatgtttttatccttttgttatacatgaaaagacaaagacttaattatggttagggtcttaagtaaatagtatgatggacaaaatctaagttttgactcccaaatccataacatactccattctaagctccctgcctatgacatgtccattagatgcagatttttattcacaaggttagtcctgtaaaaaggacttgcacctttttccaataagtttaaggcccaactatatagtagtgtattcctatatcatttttactttacaaatattcagatacaaaaagtattacaattgcataatcaatagtactatgcagtgtaaggcaaaggatttaatttgtttgcctgactgtattgtggtagtaataaaaattatagtaattattaggtgtttacctgtatgtcagacactattcaaaatggtttatatggcctatataagacaataagatatcttactttccaccattatatcttatttatttatttattttaattgaaggataattgctttacagaatttttgatgggagggaggttcaagagggaagggacctatggattcccatgttcatacctatggctgactcatgttgatatttggaagaaaacatcattatatcttatatctttttcgaggaagtcaaaagataattttttacattgctaatatagttttcttgtctttttactaattattgatattttaagtggattaatattattttaagacattttaatagcagatttttataattgggtaaaccatatcagttttcattctaacactctgaagcgtctgaatatttttttcttcatattttaagaaatctgactacttaggaagcctaaagaaaaggcaatgaataatgtcactggaactcagcaaagggatttgaaatgttatgcagtcaccttcattatactagttttgaattaagtcatcacaaatcaatggaaaagccacacacattattattgattctttgtaatttcttctttactataagaaatcttcagggttatacctctgtgtagaaaacaactcactataataagccaagcaaaagaggtaccagagctctgttgctatagcaacccaacctggcaatgtcttctgggacttgctctaagggaagggccaatgatagggagtaatgtgactttcttttctgctcttatgacatatattgatttactgtgaataaaaagtaacatggttcaaattgcatacctttcctggtaatgaaaaatgggctcttgtataaaaatgacaaggagttttaaacaagtagcaaggagtaaaactttcatttatcttagtggaaacattgcataaacagcccttcctcagtagttgaatgttgaaaattcattcttcttgaatagcaaggagtataaatatttcatataatttagcaatt

SEQ ID NO: 24643 - DNA, 1544 bp, Bovine  19866881563315
ttgattttctattttctaaaatattctgtttaccatgtttgtgttatttaatctacattcctacatgtaaaacaggagtgggggagagctagacaatttttaagcttttttttgtcctgtatcaacacatggccatttctgggtcatgagtcgtctttgttaggccaataacatttgtgaggttgctaatgattatgaaaatttctctttcaaggtctctatacttgtttcagcaaagaaaaggaaatgaagagaggccctttgtggtcattttgccttttaatatccagatcctattttacctcatggagtgttgcactaagattttctccttttgtctgctcttcccatcttaattattgatctgtgaattagttgctcttggaactgatgcactcagcaattcctgggtggtggagggagatggttgctaggcaacctcacctgttttagatgggtattgggccttatctttatgaaccttatttgtggagaatctgagggaaaaattatttctcacatcttaagccttcataaaatacagagatttggaacaaacatataaggttttaaatagggttatcagaagaagaaacattggatagagtgttgtgtttaatttgaaggctttaggtgatttctttaaaaaaaattcctttaacactgttttccttttctatttctgcataacaaattaccacaaacgcagtgacttcaagaaaagtacttttattatttcacagtttttgtgtgttagaagtctagtcataccaagagtctcatggactacaaccagggtgagagctgggcctgtggtttaagttaaggcctagggtcttcttccaagttcatgttgttgttgacaaagcctgtttccttgtggctgttgcattcactgtgagttgcttcttcaaagtcaacaacagaaaaaaaaagagtgcttctgcagcttcaaatctctgagctgaatgaagtcttcagtcctctttcaaagtgcctggttaggtctggaccacacagggcaatctttctgattaactagcttcacctagatgcagatattaaatacatatgataaatcccttcacttttgccagataatgtaatatactcacaggacagatatctcttcatattcactcatcctcaaggagaagaacttcaaaggtgaaagtcattagagattatcttaaaattctgcctaccacagatatattttaatgatcacattagtgttttactaagatcttaaaatttaggctgagagaataacagatatagttctttaatttcttttgatctttcagttttttaatgtaattaaaagcttgtaattaaataattggctactgactccaatattcctgcctggagaattccataggcagaggagccaggcaggccatagtccatggagtctcagagtcagacacgactgagagactaacattttcagtttttcactttcagttgtgatttatttaaataatatagtagttagagttattttcttggaaagcaaagtatttttaaacgatcttcat

SEQ ID NO: 24644 - DNA, 1316 bp, Bovine  19866881703610
ccaatattgagagtaatgaagcttaagagacagttgtatgcacattaattattgtaattattcaagctactttcccttagggctaccgtatttctaagccaaaagggtattctaggtccactatgacaattagcatctgataaatgatgctactgccacactactaacacagggattgattatttccaattaattcctgagagaaatcaatggtttcttcctaaagcatatgcattgactaatttatgttaatatgaataccttatatccacaatgtgcaagggaagataggacattcaaattataaactggttactattttagagctttgatacactatttcagagctcaaaaatgcataaaagaggtataactgggcagtttaaccacagcaactaaatctgacattgatgaatgttgatccaactcaaatgcagcaaagaagcttttggagatttttcagtttgattggttctagtttggaaacattaccatatacccatcccaagaatgggaccccattcttgttgtttggatttatacttgtcatagccagcactaaaatggtttatagttcttaaagatacgacctacagggggatgctgtaatcaaatgtttgctccattcctatgtattcataaataggtatcaaatacatgtagatcagctggtaaagaatccacctggaatgcaggagaccctggttcgatttctgggttgggaagatctgctggagaagggataggctacctactccagttttcttggacttcccttgtggctcagctggtaaaaaatctgcctgcaatgctggagacctgggttcgatccctaggttgggaagatccccaggagaagggaaaggctaccgactccagtattctggcctggagaattccatgaactgtgtagtccatgggatcacaaagagttggacatgactgagctttcacgtaatatatgccagtatagtgtgaaaaccttgaatattcaagcacaacagttttgtccttactaaacttatactctagtagaaaaggcagacacacatgaacaacacaactataggaaaatgggtggtctgaaggaaaataacagggtgaaacatgtctagatagaggatcatggtgagagaatgaaattaagctgtgaagtgaagactaggtgagaacattcttggctgaactaacaatataagaagtttctaagacaggaaaaagctcagcttctctactccaagaactgaaagaattcccatgaggctgaagtgtatagaaattggcttaatatagaatagcttattactatcaacaga

SEQ ID NO: 24645 - DNA, 3310 bp, Bovine  19866880505381
accgtgcttgatatagatgtttcattgagaaagagacaagggacttcaaccctgacagtgatatagctcagaggccatgagagtctggcttaggaagtgagaaagagaaagctgctttaccttcatagtttgggctgttacagctgcaatttccatatggcaggggactggttcaaactgattttttttatataacatcaggcatttaaatgacttaagtttcatttatgtttatcagaggcatttacaagaaatagccttagttatgttttgcttgtacaagctaagttagtttataaaataaactagctgaggcatctgttgtgtagcttaactggttttgtctccatggggaaactgcaaacctggtctccaatttatttcattttaacagatacaatagatgagattcccattttctagatgagcagattgaagctttgttttttacttaacctgtagaagcccacctggaaagacagaattttagaagtttttgcagaaacatagatagatgtgttcttattttataaaacagattgtatgttagcacatgtattttaaaaaaatgcccttttacttgtttttgttttgcatactggagagtcaggtggtagagacttaaaaatctttagaattatatttgtctcacattgatttactataacactatcagaaaaaaaggcaggcttccttggtggctcagtggtgaagaatccacctgccaatgcaggagacatgagttcaatccctgatccaggacgatcccacatgctggggagcagctaagcccatgtgccacaactgctgagcctgtgctccgggagtcacaattactgagtgccctagagcccgtgctctgcaaccggagaagccacctcaatgagaagcccgggcatcgcaactagagagtagtccccacttaccataaatggagaaaaacccttgcagcaacgaagacccagcatagccaaaaataaacacataattttttttaaaaagaggtagatttgaaaacaacatgtaacaagcgtaagggctaatgtctcactaagaggttgttattacaaatgatggacagaggttcaatgaggagggggatgataaccactgaaagtgagagaaaaattaaactcttcccacctttgaagtcaaaccaaacaacactgtaggcaaatccttctgctggctttgttgatctggtttgtttctcaaacctctaccaaacttctgccttgaaactctgatacttctggaccaaaaagagaatggaaacttctaagtaagaaagtatcaggtatgagaccctgcctggtaaacttgagtcacagggagtgcatggctccttcagctcaggtcctgagcagacacaaggaacaaagtgtctacatgtctttcggccaagcgagttttatagattaaggccacaatccttctgaagtacatctatggtgatggcacttatcagagcattgaattagtcatggtaaccttccaagggaaggacccaacgtaagtatatttcaaattaccaaagcagagggcggaaccagatgagatgtttataagcattccaaaatttgcagtggaaattcttagtgcaaatgcctttgaagataatgggagagagaagccaactttcctgacaactcagagtcagaatactttaggagaccctggggaaaggccagatgaccatggccaagctgcagttgagaccaaagctgtctcaacagcaaatgtaaaccttccaagagaagagaagttgccttttcttcacctctttaagttgatttaatgttgttgggctttggctaatgtcctttggttttaacccaccaacgcaaggtccggtccgctagcatggatttaaatatgtaagagaaaccttctctgaagcacagagaagagagctctgtgtttccaagtaaagagagagtgtgcagaaatttgaattaatggtgcagtgtaatcggtgcaggaggggttgagttgcagagtgtggtccctccatcctgtatcaaggatgtccagctcaggagcttagtggaagttgctcagttgtgtccaactctttgcaaccatatggattgtagcacatcaggcttctctattcatgggattctccaggcaataatactggagtgggttgccatgcccttcaccaggggatgttcccaacccagaaatcaaacccagtctcctgcattgcaggcagactctttaccatctgagccacagggaagacctggtgagtgaaacccacctcttaatgctcgccctcctaacagcgacatcaaaggcagtagaccaacaatggacaatattgttattttttttggtttaggaaaaccctcgtagaagaaaaattgtactttttagaataaatgaataaaagagatacacttgtccaagcgttttctctgaagcaaccttagagggtctggcggaggagcaagaaccgaggtgcccgtgttctcccagcacccccgaggctcagacttgggtccacctgggtccaccacctcttactcaagtgctgctcatatttacaacagctcttcacagtttttctaacttaacacctgaaaaatggtcccccttataatgcatattccaatgtattttgtaccccaaactacttaaaaagaaaattcaataaaattcaaaataaagaaaatgaaaaataaaattaagaatttaattttgtttataataaaactaaaaatttattgagtgtttctatatattgaagcattttgctaagtgtttttgcagatagtaacttgtttaacaatcttcataagaatcctggaggtcaagtactatttttatctcctttatgtagataaagaaagtaaggcacaggagtttaagtatatttttaaggacaaaataagataacagcctatacttttaacacatttaagagagaaaggagttaaaaagtacacagacacttataaagaattgcttattcagggtctttcttaagggattttcataaacattataggaagatacggagtacaaaaggaaaacactaaaatagttctgacctaatgatgtaagagaacttgacaaaacttggcccagatgatgataaaggcaagaatcttgtatatcacctgccataaaatgtcatggcctcatctcacagtctgttctgcctttgcatttagcttgtttacgaatcgagccctgtggtcctccgactcccacgtaaatgcagtattctctaaaattgtattcacctgcatctgtctgccaaattagagaatcaacttaccttccaaatcctgataataaa

SEQ ID NO: 24646 - DNA, 3272 bp, Bovine  19866880547785
ctgtttggacctgctctgggtgaggacatttcaaacttttatcattatagaaccttagtaaatggggctgggggatgatttgtttagtcctgttctgtgaggtgataaatttctcttccctggtaacaaatttcctcctcttgagagggaaggaaattatttgaaacatggtcttatatgtctgtctccttctagactgtgactcccttgagggcaaagatggcatgtctttctgttttccgtctctgacatctagcacagagcatgccgtgaaattgacactcgatgcattttattgatcaaattaatgcagtagaataagatggcaccaacacattgcacaatctgttcttccttctgaatacttcctctgataactccatctttgtagacactccaagaaaacaagcaaacaagcaataagccaggaccagtgccatgggcaaaaccctggagtcatccttggaccttctgtctctcttatccacgtcccatctatcagcaaacctaactggctccccctgcaccccagctgaccacccctcctttccatctctcctgctaccacaaagcttctagtcctcctttgctgggatgattaaaatcccttcctaagggggtctgttttgcctggtcgccctgagcctgtgcacaaccctgcagcctgcatgaacctttaacatcttgagccagaacacaccgttcctgtgcttgagtcatgcccatgattccaccatgttcagcatgaaagccagcatttcaacagggctccgtgagcctgggcatctcaccccctgccttgcttccctggtttgctctactgtagccacaccacctggttgttgaattcgatggacatttcagtctttgttattgttgtttagtcactaagttgtgtctgactctttgcaaccccatggactgcagcatgccaggcctccctgtccctcactatctcctagagtttgcccaagttcctgtccattgaatctgtgatgccatccaaccatgtcatcctctgtcaccctcttctccttctgctttcaatcttttagttttcatctgatgcaaatgggaataaccatttgaaattaccaccttaaaattaacaagaaatatgagatcaaggaggaactatttccaaggaggagccatcatttttctctgagaaacagcccccctgaatgggacatgtacaggtgtggtagccgcctgcccttcatcactgggtcatgagcatttaagtgtttgtccaacatctgaatagagtctaccgttacttctgggtcttcttctccttctcagacgtgtacagttatgatttatggagcccatttctttttcctgctcatgaaacatcatgcatgtgactctcatcgggcttttgaggcaagcatggccaaggataggcaagtaacctgtggtttctataagaaagacaggttccctggaccactgtagtgcgagaaggctttcagaattccccctttcagttggacatgacaaatacctgaatggactctgggactgagaagtagagcagcatttaaaaacagacttcagactctggaaccagactgcctgggtagggctaagtcactcagcaatctgtgcctcagtttcctagtctgaaaaatggacctaatagttggctcttacttgtgttaaagagaccatctatgttttaaagcttttagaaaacagcttggtatctaataagcactcaataaccttcagctagtattagtattggaattaaaatcagaagtaaaattaagatgaaaataacatcagtatcactactcatgttattcctggaatggctgaagggaggttctagaaatgacagtaaagatgagtaagggcagagtagatgacaactctttatgtagagagtacactatagagacaagtcatgtatacctgcctttaagttgcaaatagatgttttacagacattgcctgtcttcatgatcaagaaattccaatactttgaaatacaaaatctcaaatataaacctccagtgtctcttgggtgctgttcatgcacgactctagtgagtaacttaccagctgacatttaggatagaaaattaacagttttaaaggctgacagaaagtcatttctattctatatagtttctgaaggaaccgaggttatgagtaacccttttaaaaatgatgttcccataaattatactaagttgttagtcttctgttatgtaaggcattgctcttcatgcaaatatgaatgcaaattttccattaaataatggtgtgggaaagtcttattcatgactcactttcctcatctacagaacaagggactgtagttactaattggatgatctctttggtcctttgcagggcagttattgtctctgtggctctgggtgtgaagcaattacaaagacatgtcttcaagttactcctgagttattgttgctagagccgtcatcatgcgatgcagaaaaaatcatggctcggcacaatggaggctagctgttggttttcaccttaaattctaagtagatagtgacttttctctcaaacagaatttaaaatgaccctgatattgtcatagtcacaggacactgattgtgctggagagagcaaagagaacgaaaacgacagaatggtttacactggagaagaagaaagtaccagtcaactgaaccattatccatgattgttttccagcaaggtgatggtttgaacacaaacctaattatttcctgattcccactgcaatgatgagaaaaatatgaaaataaagaaacacttaaggggatcaatgcagaagaaaaaactaatttcacatcagacagaaaaactcacctgttaatcaaagaactacagaagaatcctacaaatctatttaaacaaaactacaatcacttgaaaattagaataacattctccaaaataactgtttggtagagaggaaattactatagttattggtaatttagatgactaaatgagaacactgcacaaaaaacttatgggatatttcatgttcatggatttaaggatttaatattgttaaaatggccatactacccaaagctatctacagatacaatagaattgctatcaaaatcccaatgacattttttcttagaaatagaacaagcaatcctaaatttctatggaaccataaaagaccttgaatagccaaagcaatcttgagaaagaagaacaaagctggaggcatcatgccccctgatttcaaactatattacaaagatagagtaatcagaacagtgtag

SEQ ID NO: 24647 - DNA, 2046 bp, Bovine  19866880630533
tgggaaggtagtttcttttctcttgtgcttcattggataacatatcagtggtgttttacataaaattgttttagccttaaatgttttctataagagtccaatgaatgagcctcatgcatcttataaactagctgaaccttggaagtaataaggtaagtgatgtcttttctacccttaagttcctgtctatggtgcttgcatcctcagttacattggttttactcatgcctgttggctacgatcactctatggactgagtgatcaggagggcaaacacactcagtgctagcccagtgcatcacacatcagacctctgactcggggtggcagggctgtctctgtggtgtgtgtggtttagtttcacaattgaaacggtatcaaggagttccagaccactcagtggcaacttctgtgtgttcattctgggtaggaaacaaaacatcaaaacatgaggaagtcaaggactcatgatgagaacaacattggccttgagatgctgtttgtgttgttgaatgtcagagactttgacaagtccatgtagtcttctttaattggaggatagttgctttacaatgttgggttagtttctgctgtgaatgagctctgagtatacatatatcccctccctcttggacctccctctcctcccttcccctctaaccttctaggtcatcacagagcaccgagctgagctccatgtgctgtacagcagctccccactagctgtctgcttgatacatagccttcttaaggtgttaaactggctgttctcggagaaaccttctagcccttggattatatacccaaagaaagaaaataagaaagaaagataggaaagaaagaaaagagagaagaaaggaaagaaagaaaaacaatagaccctggaaggacctccttgtagtaaacctgaagctaatgatagacatacctccgagtcaggaaacgtctccatacagaggatcacctgcaaggttaacttctgcagacctttgctttctgtttcacagggcgtctgtgtctttgaaaacatcatgcgtctttatgatcaactgctgctgttactttcctctcctccttctttttgtgagacaggaaaatgagatgcctaactgcgggaggcattcaggtggaaaacaattacatgatcttatctgaatctgacagccctttttatatgactaccagactatatagctcctgttattgtgagattatttgttcttacatgtttgttcaaattttatttaatgctttgtcagtttttaatatcagaatgaatcacagaaaaaattaaataagcacacttaaggcaaatcagctaacagatgtctttgtgaactcttaggtggccattatggaatttgtagaaggttatctaccatccgtatcattgaacaaaataacagcagatgatgtagcctggacagaaaatggaatcgactggaaaggaactataaattttgaaaataaaataacagaagcaagatgatatagaaagagagttatcctgaaaagcctgagaattaaaaatgcatgctaaaacggacaaatgcacacgtacacacagaaccaaagtatatgctctttacaacacacatagtaatacagaatacatttaatgaatgtatcaaagcaagtgttgacttcgtctttaaggcagtagcaccggcctgtgtgggcacctgtctccacctcagaaagcgtggcggctggccacccaggtgaccttcatctgagagtcttcccaggcagtgcttcttaaagtcatttgttcttttattttctaaatgttgatgtggcatcacaagaatgcatgtaaatcaagcacaaatgcatcgatttctgaaggatgctattctctcttatgactagagtgatgtttcatctatctgtacccagtaaaatgattccattgttataaattgtttctgaagaccctgagcaactcagcacctgaataattcaagagtagttttcaagagtaattcaggagtaaagagataaatgtaggggtaggtagtatgcttttacggagcttagaaatct

SEQ ID NO: 24648 - DNA, 1554 bp, Bovine  19866880927161
catctgctggagttcgtgctctccgaccggcctacagcgagctgctggggctggagctgctgccgctgcagagcggggccttcctccccttctcctcgtccgcctgcgaccaggacgtgatctacattgcctcagaggagcaccccaggtaggcggggcacacgtcggtgtgcgtgcggccttagggggctctgcagagctgctccattagaaagaacacaccattacgttctaaggtggaagggcctccagatgtttacgcgttaaaaagcggtccaagccattgttgttcctggaaattctaataacagaacgtagaaaagaatggctacaaagagctagtaataactaaagttagtcaaaaggaaattattttgatgaaattaaattcacaaataactcggtaattatagctcaggatgcctattgacatttcagggaatacagtgcatgtttctctaaggtgttctgggctgtccctgggtttgcatgctgcctcagggtttaaagccacacctggataggactggattacaaggattgcgtgtgattgaggtgtgccttataatttaggtaaaatagtgagcacatataactggcttgaaattatatcattgaacttatctacttaaaattgctgcatttctgtcactttttaggtcccttttcccaggtcttgaaggaagatttcttttggataatttgaagcctcaccttctagctgctttaaaggaagctgcccaaacccgaggtattatagctattttagctttttaaaaataagtgtaattataaaaatgtgaacaatttatgtgtttcctgttaagttgaatgagtatggaattgcctattggtcagcagccccatgtggttcaacctcatgtactcgtggtttgagatgtgtcagtcgtggatgctgacgtctgtccgaatgcaaaggtggtcctgtgtttagaaatctgtgtttagggttcgggtatggcagtggtcctcacccctgcacagtgcctcacgggcctgcatgcttccccatttctttccccttttttgcccccggcctcctccctggtgggctacgtggcggtgagagcgctgctgtgggttaggtggacatgcaaggggagacggggtccgcctgctctgcccctacatcacctgcctccagagttccacatggttgtgttggggcggctttggggacctacacgttgagaagagacctgtgcatcagggttgggaggactcctgggggccgaggcaggaaagggtgtcctctatcgggagtactttttaggaaaagacagaataattgggggaaaaatcaccatggttctgtttaaccttatctttcaacttctgtgagcacctttgtaagactgttgcctgaattttttctgtttgtttgtttatattctttcagccactcttttttttgttttttgtattgaaggatattgaacttttttaaagttagataccggcctgaaaaattctgggtttgttctaggtaaggttgtaaagcgtgctctttgtgacctgtctttgtactgtgtg

SEQ ID NO: 24649 - DNA, 3654 bp, Bovine  19866880955929
aggaagggggtgggctgttcctccttggctgggtggtcctgagccccatggctctggcaggggagtgagttcaccctctctcttcttaccccctgttcctgagcatctctgtttgataaagctctcccatttctgctttccatcagatcgcctgaccttgaaggagcacagagagtccactgtcttgggtgaggtttggtggtcgcacaggctttctctcccggctttcccagggtgcccagcacctgtcctctgccctgtgcagcctccactgctggtgaacatcctaaaaaccctttaaaatggtgagtctcatgatatgtgaattatatctaccataacaacaacattgtagttgatgtgaagcaaggcgttccctgcacactgtgtgtagaacccctctgggctcaaacacctgtgaacgtggctcccgtgatctttctggtgggtccagtggtttatctatttaactgtcttcttaagatgttctgggccttttccagagtggtcgaaacagacatctttgccctcaaacacatacgtgaacaagatgaactacagactccttaggagaacatgcgagttctactttgcacactcatccacgcccccccacctcaccactgtgctctccccgcctttcacctccccttcctggctctgctccagccccatcagatcagctcccctgctctctcacgtggcctttgcctgtgtccttcttcctcctccagcacctactcctctttcagattcgggaagcctatttgacttaccccgtgtgtgtctgctccctaagctcacagacccccacgctccaccatcaaggcctcacacagagtgatccttacacagaggacctggtcttcaacaagagaggccggtggcccaggcatagcttttccagaaaccacgttcaataaccaatcaaccaaacaagtgaaaaaacttccttctcttcatgccggtgtagacacagtagtttgacttctatttttagttccattcaacatgctttgggaaatgatgtcatgtttctgaattaacgttcctgcctttgcttcttccaaagagggcattatgcaccccctagagtaaaagcatcaggtaaagcatgagactgtacacgctttacctgatgcttttgaatctgttgttaatgtgagaggtagttgttgagttgccagaaatccagattgttcatatataactgggccaaagccccattacccaggaagagccttaagtgtagtcgtgcttctgaacggcaacagggtaatcagaaagaacttggcattagaaagggaaaaagtgactcaggccctcagattttgtcaaggtgacacatcttgagctgtcttaaccatttcaggaataataaaaccgcgcatggcccctgaattcctcttctattatgataatctttggtgcaacatcctcttttggaacattttatagaaaatacagggacacagcgagctaactatggcagtaggtacattaaaatgaatgtaccccatgctaataattagagtgaactgaactgaatggagtctcgccctagacacaacagtaaggaaacttttgacataaacctataaaacgctccatcataaaaattgattacactggatataaaaaaggaaatggtatgagcaacgataccataatgcactctaatacacttcttttttctgtttcttctggctatttatatttttcttttcttttaggaaattaacaatttcccttctgttttgccctttattttacatgttgcttttcttcactctccacctgtctccacccctacccccttgaaattgaaagtgaaagtcattcagtcatgtcagactctttgcaaccccatggactatacagtccatggaattctccaggcaagaatactagagtgggttgccattcccttctccaggggatcttcccaacccagggatcaaacccaggtctcccacattgcaggtggattctttaccaactgagctatcagggaagccctctgccccctcgtgtgcaaatgaactgatggtcagattctcggctctcacaccttttccatgggagggatgtcaccactccgagctcaccgcctcacctgtaggacccttccttggggttatgaagaggtgaaacaggctatcgctgacctggaagggtcacttgtattcatacaataaaaatgcacgacaaccaggatgctctaggcactggcactctgattaaggggcacagtccctagaggggtatgtccccttctatctggggggtgagtcagctcacagaaacagcaatcaggcaggtaccatgagaaggaggcctcacacccttgtcaccttcatcttcccccgtgctctcctctctggctctggaggtcagtgccggaaaaaccatgaagcaggccagtgtgtctcaggtccccttcaacctttgatctgaacttcacctcctctcctgacatgctctgtgcttgtatgcactgtatccccagctctgctgagctcagtaaacattacccctcctaggtgtaggctctctgccaggggctcagaaatcagacagataatgatcttaataacggctccactgcccattaggaactcaacagcctgtgtgctcagtcattcagtcttgtccgactcttttgcaaccccatggactgtagcccaccaggatcctctgtccatggaattttcccagcgagaatactgatgtaggttgccatttcctcctccagggagttttcctgacctagagatcaaacctgcatctactacattggcactcagactctttaccactgaaccttgagggcagccaagactaaaattacgcagaaacatcatttcaacataaaagggacatgctgaaataaaggcaagctgctgagtgccacagcatggctttccattaaaggctttcctggacgagcatcgcagtcaagaaagagactgctttcctgggtgaccctctgtctgtacagaggtctggtcttctcttcgcttgttgtctctcctcctgagcgtacccaggctcagctcccatcagctgtatccttcacacccccaccaggcacaccccttctgcgcaccaggaccccctccaaagtggccctgggactccattctggtgcattcccctgtgttcctgtgtgtttggagatatcatttatttttccttccatctctttaaccttctttggagaagaccacacacacagggagctcccagccagccctccctctccagcccgaagcactgcactctgacccccgctgcttcttcccccagtggctcagcagacacttcctggctctcaaggggctgttttaatttctaccacagtgtgggccctgggatcacagggcagggggaggtacatcacttactgcctctgaaatcctatccccaagaccgttgttcacttaaagcagtcattgggatgtgagaaatggaaaatcatgcacaataataataatccatgtggctaatgaaacacttcctaggcaccaaacacttgtcatttaatcttcactaaaatcctatgaggcatgtttattcctattttacagatgaaaaggagattcagaaaagttctaactgccccagaccacatgcagaacctgcaaatccata

SEQ ID NO: 24650 - DNA, 1326 bp, Bovine  19866880981982
tgcatgctatactgttcaatcggagaaaggttttcatgtacaaaaatttctgtgactccagagacagatgtggggttcactataaggaaaaatatcccaccaattagaacagcgcttgtttgtatttacttatcaccaaccacatgctgactctttcacatccactgtcgtatttaattcccagatgaatctaacattatcatccacaattacaaattaggactcaggacccagagagggcaagtaattcgtctgaggtttccttgcaaacaccaagtgtcaagaccggaacccagatctccattcaatgttctcattctgtgctgcaccccagaattgaagcaaaagagaaacatctgctttgagattctaaaaatctcgcagagtcagcacaccttaaggggtgcatgcatgcttgactgctaagtcgcttcagtcatgtccgactcttcgtgaccccatggactgtagcccaccaggctcctctgtgcacgggattctccagccaagaatactggagcgggtttccataccctcctccaggggatcttcccaacccggggatcgaacccatgtctcttatgtctcctgcattaggcaggtgggctctttaccactagcaccacctgggaagcccatgccttaggggtaggtgccctaaattctctcctaagagctaatcacaatcttgtattctcaagcatgtggcagttttacagtctggccagacctaggcagcacaagagcccttgggcacatgctgggaaacgcttttaaatgaatatgataaatatgtgagcatgcactacagaatagagacacagacaatgcagccgaaagggtgtgattgtacatttcactacttctgtttcattcatgatagccaattgagttacttgtttaaaactacgctcccctacatatttgagtgcctctgagagttcttgaaggataggcctgctgcagtccatggagtcgtagagttggacatgacttagggactaaacaacaacatatttagctgtgaagaagtgtttcaaacagaatccctagaccataatttgattaaactaacatcctctggtcagaagtatttgagaaatgagtttatttatgaaaaacaaatgggaatcttctttattttgtcatattttatctttaccatttcttgcttatgttcattaaaattttttttaaacatttcttattttatctcatttccaaatgtttggacttggagtaataatgtcaatgaatgatcacttcaaaagcatcatgttttatgtctgtgcagtcagtgccacaataacttaaaatataatcata

SEQ ID NO: 24651 - DNA, 1113 bp, Bovine  19866881039188
gacctatacatggaaatgatccagtgctcaataccataatattgctatactcacagcttggtcaagcaccacctctgcccttgttgacccaaagagaatgttctgtccacagccaaggttgtccagagcctctgtcctctgggaaagggacttgcttcctctggaggccagagggaactgatgtatcccagaggcccaaccatgcccaaggaggagcagaggcctggctccaacaggaaagcccaggatttacctcctgagtaatcctcagcctagtccggcagccagaagcaatgggccgacacacaaaggatgggtgtggtgcagcctctggactgtactttgaggctgctaaagtctgctaactaggccagatccccagctgcttggttccagtcctacccctatccccatcagccagtggttgactggactctctggcctcatctaaggtaggagtatgcatggaagctccactgggtgccatggcaaccatctgctggaggccagtctccccatgcacctcctgaccactcccagcacacattcaacttcccaggtggtgccaacggcaaagaacccacctgacattaaaaacattgtcaaatcatgtgacaacacccaacagattataaaagaggagttatcagcttgtgtcttccccatgaataactcagaactgatgtttaatttttatcatgtttgaatgtcctatgaatgtatttcctttgcagaatgtagaagacaggtgataataattagtttatataattatgctggctgtaaatgatgctcaatataatgttttatgcaattaaaggcttatgggacatattaccacttttttacttgtattggtaataaggaatgtttgcacctccactattgtcttgcttctggatgtgagctatgtgacgatttctgctatcatattaagcgccacaattttaataaagcaaatgtacatatgaaaaaaaaagaagctgtctgccagtgcaggagatgtaagaggcacagatttgacatttgacccctgggtcaggaagatcccctggaggaggaaatggcaacccactccattgttcttttttttttaacttaaaaaaatttatt

SEQ ID NO: 24652 - DNA, 2195 bp, Bovine  19866881070965
ctagtgggatccagagaaatatgggaaaatctcagaggtcctataggtaccttccctctagtacaacaaataaggagggcacttgtatgaccactgagatttatatatatgtatatatactatatatatatgtgtatatatatatatatatatagagagagagagagagagagagagagagaaagcaaactccaggaaatagtaaaggacagggaaacctggtgcactgcagttcatggggctgcaaggagttggagacgacttaaaaatcaaccctgaatattcattggaaggattgatgttgaagttgaagctctaatactctggccacctgatgtgaagagctgactcattggaaaagaccctgatgttgcaaaagattgaaggcaggaagaaaagggagtgacagaggatgagttggttgaatggcatcactgactcaatggacatgagtttgagtaagctctgggagttggtaatggacagggaagcctggcatgctgcagttcatggggttgccaagagtcagacatgactgagcgactgaacaacaacatttgaacacaaaccatcaaccttctttagttactaagcaagatgatagtcaaagaaatgcctaaagtgtcctacatttttaaaagaacagttatattcaggttgggaactacaggtagggaggtcctgaagaaaatggaggatgtgatgtcacgggtcgaccagaactttcagagggggcagtcctttgggtggagatgcctgcttttcacctttgtcagtgttgtgattttgtatgtgtgtatgtgagtgtgcatgtgtggttagacagagacaaatgcataaatgtttgatatcatagcaatgtcatttttcaggctatgaagaccttctaatgtgaaataataacttttcattaaaaaagtgaaagaaatcaacagaagtttttcacatagttatattgaatttcaaaggataatcatattaaactgtgtatgaaagaaagttgtcctgtccccagcatactcagtgttcccatctctgatacattcatttaaatgtattgtgtccaggtttggacgaccagacacttcctaccagggtcaagttgacaatgagaaacttgtgtaggaaacaaaatttaaggagcaaaacagtcagcaatcaagatttctcccctttcttaggctccagtatgactctgcattgttttatctttatttaaatatatttgatatttgattcattgtaatttttcattaatttctgttaaggtatttcgtcaagatattatttattttgatgaattttttggatcctcttaaattttgagccccaggttggtgtgttactggtccaagttctattcctcaaaagataaatgtctttatgaaaaattacagtgacatctcagttaactcgattaatagggaaatggtttgttcagatgatacactttctttttagcagtgtcttcatctgctgagctgtcaagttacctgtgagaagtggatcttaagaactactccccatccaattgctaaagggatctttatccatagaacacttgttcaggtgttcaagttttatggattgatctctcagccttatacttgaaaaaatattttcctaaccacacaattttaatctagtaaccagatgtgccagtgcttttgaaaaatactgcattaaaaaaagcacagagcacttccagtttcagcgccaacatgtaaagagcttgggaatcatcactctcatcctcacaataagagacaatctgaacgaactgaaaatcaaaggctttcttgaacccatcagagaatcaaggtcctagggctaactgccagcctaaaatctggagatatgggccaatctgggggaccacagccaagaccagtttgcccagagcagcagccactgcaggcattaaactggcaggcacactctagtggtaatgtgaagacttgctggaggctgggtatgggcgagattggtggtgaggggctcccagggctgcagtccagggagaccttcatcctttaatggattttaagtgaaagaacccagcatattctcatggtgggagctgaaaaaaatcacctctggctatggcataaagaggagaacaccagctgctgagaagtgggcccagtgttttctctgtgatgaacagttactctcaagtcactaagaattcacca

SEQ ID NO: 24653 - DNA, 1467 bp, Bovine  19866881238315
aatatctaattgaaaactcaggcacgccccactgccttcccactctttaaaaaaaaaaaaaatctgtggaaagttttcactgagagaagttttcagtttgattttatttttaaatgatggtcatttaatctcttaagcatttgtcataaattaatcaattaacacctgtgtattatttctaatgtatctagtagtactctgagctactatgtgtgtgtgtgtatatatatatattttttttttttttcttttcacatgaatgtcacagtcttgttggagaggagaaactgaaaccatatgatacagttagaggactagttaggactgctgctgctgctgctaagtcgcttcagttgtgtccgattctgtgcgaccccagggacggcaggcccactaggttcctctgtccctgggattctccaggcaagaatactagagtgggttgccatttccttctccatacacgtcaaatcatcaaagaaggagggatcactgtgggaaggagtgatctgggaagaatttggggtctttcgtcatgcaattattcctcatgcctaagaaaatgaaaaatatctaagtactttcctgctctcagcccatcttcaacctgaaaaataccagatccaaatctcttccccaagtttcactccttgtctcctgctagatttttctttttttttaatctttgctaaaatgttgaaggccaaataagagcaagaaaatcctgcctgtggatcagacactgggaacctctcagaaggcagtcagctcaagctcatcatctcacagggggattcctgagtacaggctcgcattccacacccccctacccgatcctcccttggcgaccttccactccaacatcatcttttgtgcagagaacaaggcaagtttctcatcacccattaatcctgctctcagccaggtgtgtagatgagcccccaggacgaggctgtcagagggcttcctgcccaggcttctcatgggtgggacactggcagagtccctgatacaacctgatggcactcgaggcagacgactataggcttcaaaattgtggtcttgtctgaacagtcacctcatcaaaaacatgacagcaggaaaagacatcccctacttctctcctttgatgttcagtcactcagtcgtgtccaactctgcaaccccaagggctgcagcacacccggcttccccgtccttcaccatctcccagagtttactcaaaatcatgtccatcgagttggtgatgccatccaaccatctcatcctctgtcgtccacttctcctgccttcaatatttcccagcatcagggtcttttccagtgagtcagtttttctcatcacgtggccaaagtattggagtttcagcttctctcctcctctcctggtctatttttattttcgcagactttagtgatcactattgaggaaaggagtaatcttgggaattactaaagcaacatgttg

SEQ ID NO: 24654 - DNA, 1092 bp, Bovine  19866881286353
aaggggcaagcgagctcccttttgaaaagtgtcttttttcaaagggcactgatttctgttcacagggctccaccttcaaagacctcattcgcccccaaaggccacctccttaatactccatattggaggattagaatttcaacatgggaatcgggggacgcagtcaggctataacaggcatttttaagatgaaaatgaaacaatgagaggtgtgtaaaatcccaaggtcgtggtccaggagagaatatcaccagcttctccgtgaccttcttacccttacccctccctttttggaagctggttgctgggaggtggcccttgctctgaaaggatgaactggtgcaagtgaaggtgagacatgaggtctgagggcagaggaagtgggttttctcttaagctagtgacaacccctgttcatgatggaatggtgggctgtgcctgtggccctcatccagctcctcgccagggacaaagtaacccaaaaggagacaaatatctctgggccacccaggccagccctctgtcagcagcagcactacctggaggaaagacactttgcacacgcactttgcacacacaggccttgatattgaatgaacttgcatctttgttttgttccgtgcacttacccttgatttagtgcatatttaaatcgactccactgtgttcctggatattccttgcatgtgtgtggcattttaatcccattattctctcttggcagaatggtccttgtgattgcctgtgacaggtagttcttaacatcccaaggatggcaagaatgggcatagccgtcaaataatcatagagtgtctttgaacaaaatgcttacaaaataaacaaatccaaacatcaaagcagtgggaagatgaaacagtaaatgaaatgagagtgcattagaagagaacttcagagtgttagtttgtacttagctttcatgaaaatgagaattattaccaacgtcctgagtgagacgctttgcactgttttggcaacattacttagtctcaatccacagctactaaatcactcttggctggttttgagtgaagcaaaactgctctgtaccatcctgaacaattttgaagtaat

SEQ ID NO: 24655 - DNA, 2894 bp, Bovine  19866880364739
agataccaagggaacatttcatgcaaagatgggcacaataaaggacagaaatggtagggacctaacagaagcaaaagctattaacaagaggtggcaagaatacacataagaatatacaaaaaagatcttcatgacccagataatcacgatggtgtgatcactcagctagagccagacatcctggaattgaagtcaagtagaccttaggaagcatcattacaaacaaagctagtggaggtgatggaattccaattgagctatttcaaatcctaaaagatgatgctgtgaaagtgctgcactcagtatgtcagcaaatttggaaaactcagcagtggccacaggactggaaaaggtcagttttcatttcaatcccaaagaaaggcaatgccaaagaatgttcaaactaccacacagttgcactcatctcacatgctagcaaagtaatgctcaaaattctccaagccaggcttcagcagtatgtgaactgtgaaatttcaaatgttcaagctggatttagaaaaggcagaggaaccagaggtcaaatcaccaacatccattggatcatcaaaaaagctagagagttccagaaaaacatctacttctgctttattgactatgccaaagcctttgactgtgtggatcaaacaaactgtggaaaattcttaaagaggtgggaataccagacaacctgcctcctgagaaatctgtatgcaggtcaagaagcaacaattagaactgtacatggaacaacagactggtttcaagtcaggaaaggagtacgtcaagtctgtatatcgtcaccctgcttatttaacttatacgcagagtacatcatgagaaacgctgggcttggatgaagcacaagctggaatcaagattgctgggagaaatatcaataacctcagatatgcaaatgacaccacccttatggcagaaagcaaagaagaactaaagaggctcttgatgaaagtaaaagaggagagtgaaaaagttggcttaaaattgaacattcagaaaactaagatcatggcatctggtcccatcacttcatggctaatagggaaatgatggaaacagtgacagactatttttggactccaaattcactgcagataatgactgcagccatgaaattaaaagatgcttgctccttggaagaagagttatgaccaacctagacagcatattaaaaagcagagacattactttgccaacaaaggtccgtctagtcaaagctatagtttttccagtagtcatgtatggatgtgagagctgaactagaaagaaaactgaacaccgaagaattgatatttttgaactgcggtgttggagaagactcttgagagtcccttggactgcaagaagatccaaccagtccatcctaaaggaaatcagccctgaatattcattggaaggactgatgctgaagctgaaactccaatactttagccacctaatgagaagaactgactcttttgaaaagaccctgatgctgggaaggattgaaggcaggaggagaaggggatgatagaggatatgatggttggatggcatcaccaactcaatggacatgagtttgagcaagctctgggtttggtaatggacagggtggcctggtgtactgcagtccatggggtcacaaagagtcagagatgactgagcgactgaactgaaccaaaacctatgctccaaatcctcttgcctttttcctctcttgaagcaactgtctatacacagtcaagtctccatgacaaccttagctgttcttttagaggacagggggacagtccagaggttaagtccatggggtttggcatcatgtctaggtttaaattcaggctccatcatggatgtggccctggggcaaattgttttacttctctgatctttctgtggtttctcaatctctaaaatggggataataacatcttatggagttgctattaaaatttttaaatgatgtgcacaatatcttagcatggtgcctaagacattgagagtcagcacatttttcttgaatcattactctgatctagctcagtaagctgtcaaggagacaaattatagtactttgaagttgctttaaggtgtagggaattattctgatggcttccatttgccacagggaaatttatctggaggtaaagaagctgttcaaaatactttctcaagagacctgaaatattcaggttgtcccaattttttttcctatgtcttaagtctagtgcaaacaaaatcgcatactattaaatatttagtatttaatatagccaacaaattaattttaggcctaattttgtgatattgcagtatggtattatatttgtgtgtgtgtatacatatatagatagatagtgtttaatgaatgtgcatggtgatttatgagattgtaaagagctttaaccacaattttgagcaatttacctcatagtagaattttttagtgttgtatcttcacatttacagcatatgaaggaaaacgtgttagatgctgagttgtgtctgactctttgcgaccacatggactgtagcctgccaggctcctgtctccatgggattctccaggcaagaatactggagtgggttgcattcccttctccaagggatcttccctattcaggggtcaaaccccaggctcccgcattgcaggcagattcttgatggctgagtccttatggtttatttaacaccaatatcttggtgaagaatacagcctccaagggtaacattagtctttaaatgatctactttttgacctgcactataggaaagagcagggacaacctgtgtattttactacttcctccatcaaaaccacaactaccaccagtacccaacaattactgaatctccaacctattgtacttcttaagcataacagttacgggaaaaaa

SEQ ID NO: 24656 - DNA, 1519 bp, Bovine  19866880549330
tcctcagctaaatgcatatttgacatagtcaggaacttaaataggcagttgttccactactgaaaattgtctgagtggaatgcctgagcactggcggtagtctaaaaagaaaataagagacatctgtcggggtccttcaagcagttcagctttctaatcagaccatctgaattccttagtgaaagataagaaaaaatcctgctacccattaggacagtcactcaatggtgataaagcagatgtttaaacaaggtacacatactatgtctgtcagtctgtcatttagtgaagcggtggagcgcactggagagggggttaaggaacagatgagggagaggaagcaaagaatcctgctagacctgagtctgtgagccatagaagcaatggcttaaaataacaatgtggcaacctaagacactgttgcaggtctgaaagagaagctgcaatttgctaattttgaaagactaggttagtgctagtgaaccatgattgatagagacaacataatttgcaccccctgtctctcacatgcataatttctgtgagcgctaggagcatttggccaggatatataagtttttgtggtgcatatcaagagaataattttcctaaggagctatttttatttgtttgtttggctgtgatgtaatggaaagtatgtgttttatgtttggtactgggtaaatcatttggtctctctgaagcctgattgcttcatctgtaaactgattacagtaatgctttgaagagttgttataagaactagaaattatgtatgtaaaatgcatgatagatatagctgtcatcagttttgatgggggtttctcctggttagttgctgaggttgttgttgatgacttatcttgtgattactgtgggactccagagggagcattcttcatgaaaatttaataggaatatcggaaagccctaaaatggattcaactcaatgtctttggactaagagattgtaactacagtgccactggagtgtctactaaggaatatttgcatttagggatatctaagcaacttgggggacagccttcacagttctttttatcagagggatgctctgtgaggacttaacatacagactcatatgtgtgtacacatgaatgttttataaattgagtgtacatgaggagggagctacacctggctttgagcaggtatttgctccatgcaaactacttgcttctttatgggagaatataaatcttaaataaagtaacagggaaacttttagatatattgttaatattcaaaatcagggcttcaaaatctgcttatagggtaaccctagagaatccatggatggagatggacttgaaagggtccttggaacccatgaacactatatgtgaaattttttatgtgcattttccttggctgaattttcatagtttctattttcaggaagatctctgatcataagaaagtaaagaatttctgtttattgtatcaaataagataagataaagaaaactgatcttaaaagcttttgaatatctgctat

SEQ ID NO: 24657 - DNA, 1319 bp, Bovine  19866880585233
aaccatctcttcctgaattacttggcaaaaaaggatattatggctatggatatgcatgacaattaagtggaacatggaagaagggcctccaattaaaattgacctcacttcaacatgagaggaagatgaaatgatagctagcaatgtttaaaggatgtaaagacgactttcaataatgaataaaatgttaaattttattatggagaagaatgttatgtatgttatacaatccaaaaggaattctcattcaaaataactgaaaaaaagtctaggatgtttataacaataagccttttaagataaatggaaaattcacatatctagagcctgacttctaaagagctcagacttcattgtatataatatgttaggaaattttgtttatttataatttaacccacttgagtcaaaatcacaaggaagtttaaggaatctgagtaacatttaaaacgaccacttcagtagattaaaagttgagcgtatcatcacactgtttctttgatatgatcactcctcctccccatgatattaaataagaggagggggtgaactctaacctaaactctaacctgcaatcatgtttccaaggaaagagaagcgagatgggaaaaacaaaaacaaaaatcaccaactcatttagaaactcatgaaaggcagagtagagtttgcacatatcagaccgatttgcctcggcgtgtgaatcatttaacaagaaaaaacacggactgactcagcttgagtgagctctttctgtctctgctgaggtcctcccttagtgtggcccctgtcgctctcttcagaacttgttccgcttctccttgctcactggagagaaacaggaagtgttgtttattaataagcctgaccagggtcacacccaaggcaatatcagggctttacctctcctgggcttggggagaggttcaaagatcaaggatatgctcctggttagaatgagaggcaaggccagactccaaaaaataaactcacaactgggacttgacataagtccctacagtgacttagagtcactctgcctgtgtgacagctcaccggttcctcccaaccctctggtgacactgtatcccttctaacagagagatggctggtgccttgacagagaagcagcttgcctaagaccatggtgggaacagcacttggatctagactttctgactcctacggttgtgtcatcttccattgatcactactccttgggagacctttacaacacagaggaaagctgcccagcatggggtatcctagctcgcttgtcatgagctgttcttttcccttggctttttcagttgtacctcata

SEQ ID NO: 24658 - DNA, 1833 bp, Bovine  19866880617514
taagcttcaaacaatattgtgaacctttgtgagtgcaagattatggctagtaaccttctgggtagatacatattttatcactcagatttaacggtaacacaggaaatatcttaatgcccctctgaaggtgattttgagaatcttggatttaggtttttgctcccaccttgctggttctttgatggtggatcagagaagaagatgcccacaatacaaacgctgtctcaaacacctgcgtccctctttgcatatatgttttctcatcatttctggcctctgaggatttccctggcttttttgcatattcagaaatgcattgtgtgtgtttgttcagtcgtgtcccactctttgcaacccgaaggactgtagcctgccaggctcctctgtccgtgggatttcccaggcaagaatactgcagtgggttgccatttccttctccagggtatcttcccaacccagggattgaacccacgtctcttgagtctgctgcattggcagtcaggttctttacccctagcaccacctaacgcaaaaatgcattagttaaaaaatatatatatatataagcctgtgtgcaggtgcacatgtgtgactgtgtctgtgtctgtgagatactctacatagagaggatttctttggacactgacacctagaacactgtatcgtcaggtctagtactgccaaaaatccaggttttaatcttatttaatctttacgataatacaatgagatagtgcttatgtgcccctttgttataaatgtagaaaagagaagcaacatgagcaggctaaccttctacgtcaatacagcaagtcagtggcagaactgagattaaaaactgtatctgccagaccaccaaaattcatgttctttcctttttgctgccctggattttatcctgtgccttgacatagcattatattagaatgttaggtccattatggaaggagctataggttcgatccctgggtcgggaagatctggagaagggctacagtacaaacagtctcaaagaatcggacataactgagcgactaagcacataaaattcataatgatgatttttgaggctgtgtaactttctaatgaggggattgaattgggacagtgcattttaaacttatactaagatattgtactatctgtcctcaaagtgcaaaaatgatcagaaactggccagttattttcttttctttaccacctctgtcctatattgcttgagtccctttaagtgttttttcctttgctttattttcttttcttttcccagcaagtcacatcacaacatctgtgcattgtgactctccaccttgggctggtgggctccctgctcttggttttgagggctctggaggtggtttccctttcatctcctgcactattctttgtagagattagtcacaaaagcaacgtgatcccaggcattccttctgctgtgcagctgaccgtgaagcaaagtaaaagggcaaactatgtataagtcaaaatggttacaggtgcagaggacagataagagtttagctttgtccaggctggacacagaattgagcttcacaggctccttttaaatttaagatgttaatacagacaaaaaacgatacctaagtgtttatattaaaggaacagattgctaattagtcacaggtttgggttttttttttttttttgcctccgttttcacttcctttcttggttcccttgcaagcgcatattaattcttttttatttctgtaacaaaagcccccagatatgtatctatgctcccagcactttgcaagcacagagtgtatgcaaaggaataagacagggaatccaccatggaaaacgggaggg

SEQ ID NO: 24659 - DNA, 1355 bp, Bovine  19866880638832
tcctctgtcctccccttctcctcctgccttcatctttcccagcatcagggtcctttcaaatgaatcagttcttcgcatcaggtggccaaagtattggagtttcaggttcagcatcagtccttccaatgaatattcaggactgatttcctttaggatggactggtttgaaaagtctaagtacatagtagcattcaataattttttgttgaatgaatgattaatgtggatattataccaacaaataacctaaggcttcataatcataatgcagacctgatagccctgcacaattggtcagggaggaagctaaaactgaaagaaacaggctgaattaaaacccctatataaagagtgttataatagtattacaatgacagcctattaataggaatagcataaaaactctattgtaaatagattttcaaagcatgtatacatgtcgtaagaaaggcaacacattacccaaccataaatactataattcaatggattaggggagtttaaacatatcatttaacatcaatccttatatgcttatgcaacaaaagagacttcagagactcttgctgaaacataagggctttttgagaagttcaatcatacctcttttctattctttaacatgataaggtcaaagtgaatatcatagtaaaattctttaatcttactactgggtctgagtacttgtgggacaacatatggaagacactcaaaaacagtgtgggtggagcttgagagcggtgcttccagcagcagcctctgagtatagaaggaaaggtagggcttaccctgaatgcacagtggaacggaaaaacaggttcccatatctgtaaatttaatgagttcccatctataaatacacttgtatgccatacctttgtgcactttctgctttttaaaagacttgaattattatttttcactgagtattgcaattattaatttataagtccttaaaggcaggaaatgtctgattttatatatatatatatatgtgtgtgtatgtacatatatatattatatttctagagcctagatcagtgcctgacacattatagattcttagtaaatatttgttggatgaatgaatgcatgcatttgtaaatgagtgcttcagtccctagacagttggcagaagaaagggtttgggagaggaaataggaaagagaatttctgaaatccagagtcagtccatttatttcatgtcttcttccgcctaccaggcctggcaatgagagagccaagcagtgatctcacctgcagaacctgctgggctagtccagtcagcaagtgaggagagtccaaccactcatgtcaaacacagtaaactggctcatagataccagaagtacagt

SEQ ID NO: 24660 - DNA, 1135 bp, Bovine  19866880700902
attggaatgaaaactgaccttttccgtcctatggccctgctgagttttaggaaagaaaacccaaaagcattaaattgtatcactgcaacttagtacacttatcaggctcagaggtagtgttaaagatgaagaactattgttctcttacaggtactttataagaagcaagataaatctgacaagtcaagcagagaaatggagatgtattggaaagaatttcagcttttgagatttgagttcaaactaagttttgcccctgatgtgctatgggacttcaagtctcaacttctctacacttctttgtcacctcatctgtaaattagaagaggaggcctacatcataagttatgtgtctttaccccagagcatggtgtacagtaactaacacatttgatagagcaattatgtaaggcaattgtacaaggtatattaagtatccagcgcatagtaggaacagaataaatggttgctgctatctttattatgtatcatttactacagtttactgatattgaatgtcagcaatgtttttgtgaggcagtgagtaaagttcttcaaagggtcaaaccatgcacacaaaggaaaaaatgagaggaaagatcaggtcaaaatcaatcgctttgtgtgtatattgctataagctaattgtttaactcacggttttaccccacttaatattttctccaccacaggatcagactgttaatacacttaatgaggcaaagaagaataacagtatatctgagcaattaaagcccatttgttcagatagcaataaaacctacaatagtctcctttctgcctggaagaacaactttatagtttattgaacaagggagattgtgattcagctctatctcttctcctcaaaagtctctgcactttactaccctcatctaattctctgaaaagattttttattaaatgggaaggactacaaatcaatattatcaggacatatcaaggctcagtacattctccaagcataagtgctatttgctacagcagtctcaatgaaacaaactttcctctatgctcttcaccaaatttttgctcttcatcaaaaattcttttgtctttctaaatatgaacaaatagggtagaatccagggaccgcctttttttctttttttta

SEQ ID NO: 24661 - DNA, 1490 bp, Bovine  19866880738828
ttggaaacatgcacatattctatatatttttttttgccggacaaatttagcatcttaatgtaataataaaagctatcatttgggaaatatacatattgcttctcccagagtgcacagaggtgttggtaggcactaagaaaggaacagagagatgtgccctgaggaagtctccatcctgtctccatgcacataggacttctacacatatgagcaagttgtggaagaagagcatggtggagggggcatgggatgttactggcatcttataagatttatgaactgctaaatttagagatgtcattttgctattgcctgtgtactgctggcatctttgtatgagtcactaagaaaaaaatagcaatcacctcctttgcaagaactagtatgagtaacacaaaatggtttcaattaatcattttaaccactgaattcactctggataaacaaagtgtgtatcagatgatatgccccagaaaggtagtcatccttacaaaatgctactctctgcagctatgctcttctcatcgtattgcaaatagttttctgaaagaaaaaactgttcaagcaaaatattaaacagcattcatttatcattttcctgtggggactaggcagcaacctgctgtggctgaaaatatgtggtcattacgaacctggtattgaattgtttgtttatctctagaaggagagagaggtttcaatgatgctactttttcattggtaactttaggcacttctgctttctagaggcatagcccctgtccagaactgaaattaactgatatgtgtgtaaacattctctgtgtgttttaatgttcatataattttctgtgtcacagctgttttcaacctgaggagtgatgatgagtttcattttcttcttagtgtgtggtgttttttatcacagtgtgctgggatgcttgttttctggagacctaaacatgtgctataaacgaacaggatgggatgtctaacatgctttgcttactgaagatagtaagacttcagctagtgcatcagagagagagagagttcaatatggtttgttgtctttttcatcatgctgcaggaagagggagacttttttaaatccagaagaatctgggttcaatttctcttctttctcccctctctttccttccatattcttcttcttcttattctttgctgtatggatactgtgctacttgctaagtcacttcagttgtgtctgactctttgcaaccctgtggacaatagcccgccaagctcctctgtccatggaattctccaggcaagaatactggattgggttgtcacgcccttctccagaggatcttccccatccagggatcggacccgcaactcatgtctcctgcattgacaggtgggttctttacctctagcgccacctggggaagtctcattgacattgtatcacagaataaaaaagtaaaccgagacggtaacaatatgcacccatctactcaaatctctgtgtagaacctatt

SEQ ID NO: 24662 - DNA, 2194 bp, Bovine  19866880806327
atgatgaacatagataagtgtaaaaatttttataaattcaaatttctgtgactctgggtattttcagatttacttggaatgtaaaattttattcagaaaatattggataagttctaaagtaggaacaagatctctccagttttgaggttacaaatataacagttttaagtgtagtaagttgattattttgttctaggaggaaaaaagttattttaatgccttgcttttcttttgccatctcattgcctttaccatcttgaaaatgtttggaagaaacatactatttaggaaagcattccttttgagcagtatatgctgagttccccagaagggaaagcatttaattattttgatcagatcaacaatttttatcttatcaatgatgtctttgtcatttttctggtcataaacccatcttctcaatatagtaagaaaatagtcgaacatttattatcttattaggaattctctctctgaacttgtgtaaatatatgactacataaagtcagtgctggagagtgctgctgctgctgctgctgctaagtcgcttcagttgtgtccgactctgtgcgaccccatagacttcagcccaccaggctccgttgtccctgggattctccaggcaagaacactggagtgagttgccatttccttctccaatacatgaaagtgaaaagtatgctacctaacattatattgtctttgttattattactcctaaactactcctagactactactgtagttatagaaaagaacaataggcttagattttttctcttttctctttaacatattaaaaacctccaggacttccatggtgatctagtggttaagaatccacctgccaatgcagaggacatgggttcaattccttgtctgggaagagcctatttgcctctaggaaactaagcccataagccccaactgtgctctagatccttcgagctgcatctactgaagcccatgtgccctagagcccatgctccacaacagtggagccactgaaatgagaagactgcacactgcaactaaagagtagtcctcattcactgcagctaggaaaaggcccacctgtagcacgcaaagacgcctgtgtacctcagaaagacccagtgcagccagagataactaggcaaacaaacaaacaaacaaacaaaaaacacaaaaacctccagcaccatataattttaaataaacaggtgattcaatagtcagtagcactaaagatatctgctcctaaactgactagtctggagctatatgaagtcaattccatctggaattcaatcacactttttcaaatggttaatcaccagatgcttatgaaagagaatgttgtcaaggctggtaggtctgaaattagctgtacagctgcattttggctatagacaaactctataacaagattagagtgtatggaggcaaagatagctatgactcttctactctttttttatactccagtaataaaagtgctatattaataaaaaaaagtatctaagtttataagaagcagtatctatcacttcctgaactccaaattaaacttgaatataatcagcatgtacctagacctgaacaatggggcttctctggtggctcagaaggtaaagaatccacctgcagtgcaggagacacaggtttgatccatggatcaggaagatcctctggagaaggaaatggcagcccactctagtattcttgactggaaaattccatacagaggagcctagtgggctacagtccatggggttgcaaagagtcagacaggactgaacaattaacactttcagacctgagcaataattaacacaatgtctttgagattttatagctggcatatgcagatttctgaattttattcatatgactgatacatttcttctgatcaggataataggttttgttttttttaattatgttttgttttgtttataattcacaggcaaggtcctaaacattttgaaagctaatagaggagggggagatggttgaaatggcctgctatagaatgcttttgaatgcctggaatttaaaagttagtatcagctatgatttttgattgaggactagttacttgaagatatctgaaatttatggatctcttaaatgatgattactctattatcaataatatctctgtttatttatttatttatttattcatttatttatttcttaccaccctctc

SEQ ID NO: 24663 - DNA, 996 bp, Bovine  19866880823708
tatatcatctgtcaatgccttccagatctaaagggtctgtcattttaggtataggctcattgacagcaggaaatttacacttttcacgttgtactcattcccaagctagtgcagtactttgtgtatcctaggaccttgcatgataaaggaatcaaagttttgatcagttagccagagacttcgatttgagttccagccatgtttccatagagtcctgtgactacagacaaattattcacttaatctgtttacttgtaagataatgctcttgaaggtgcttacatctgtgagggggaatggttaaggtacagactatattatttatatgccaatatgagaaggtatgtcttggatattttcctttgtttagcctcttattttgtcaaaggatatctctaaaggagatttactcaggtatcaaatctccactatttatcttcagtgagaaatcttctactgagtggaagtgaaattctgtgtgtaaattatgtttacttagaaaggctttacctcttttcttttttccttgctgttttctccttgtctctctatgatgcactcagggggcttgcattaagcttatgatgcctggcatgattgattgtgtttccagtggctggacactttgctgggagccgtggttatatcttggaaaatcacactaatcgaatttgaagacaccgatgtgcattctcaagtaagagcctggctcttggggctttcatctaggtcaggccttataaattaagtgatgatttttttccttaagtcagtaaataaaattcatcagtggcctcacattgccttcacacttctgcagctcagtcaacctatgagtcaagcagcatttttattttctataaagctaatgttttgtggtagttggcaatccatttattaaaggaagaagatgggaacacagggtaatttgaaaacaatttctgagatcaccaaaacactagagaaaaaggtctttaaatatatgtctcagaaatt

SEQ ID NO: 24664 - DNA, 1412 bp, Bovine  19866880861362
ataatgctctcaggaagccactcttccctctgccccctcccccccacccacctcccgcccagctcagtttctcttttgtattgacctttctcctcagagaggcaaagatggcttctggtggtctaggccaacaacagttctggctactgacagtcctagacgaagagagaccctctttctgatggcacccacacaagtcccagggaagactcccattggttcagctgacatatgcccatctgtgaacccgcccctttcacagggaatggaagtctctgattggccaggcctgggagacttacccatccccggagcttgaggtcagagtcgtgccttctgaaccagaggcactgagaataggtgaggggtgtttccccatgggacattgtggagccgtttccagataaagaggcatagatgcgaccaggaacaatgacaggaaacagccaggggcaactggcttcagtgagggccatgactgctcctgacatccaggagccaaaatgctgtactccccgatccttgtggggagtggggcttgctgtgtgtgacaggggctgggggcggggtgctacccgaccaatacgcacatagtcagggcctgacttgtgaaatgtttccctcttcagaagtagcatctctgtaagtcagatcctcctatgaggtatcccaccagcttctgtctttggcttcccatttaggtttcagagttgtgaataatcaatcgtcactatttgcagattctgtatttgtgaagttatctactgggtaaagtttatttgtgaccctaaaatcaatacttatggcacttttgcagccatccatggatatgtgcagagcagcgacaaatttgccatatgcacatgttcccaactgagactgaatgaggtgaccctctgccttcttccagttctcttaccataagatgtcttttttgtgatctatttagttccactttttttttttccattttgtgctttttgtttatgatttttctgtttaaagaggcccccaaacatagtgctgtagtactgtccaggatcctaactgtgtgaagcctgtgatgtgctttacagggaaacacaagttaggcaagctttgttcaggcatgagttataatgccagtggccatggattcaatgttaacaaataagcagtatgtgttagataaggcatctttaaacagaatcagacagaaaacgaagtactgattggctgatgaaaatgttgtgaccagaggctcacaggagcttaaccccatgttttccctatggccagtcattcattgagtgtttgagatgactttgtaaagcataactaccatgaacattgagaaaaagtgaaagtgttagttgctcagtcgtgtccaactcttttcgaccccatggactgtaccccaccaggctcctctg

SEQ ID NO: 24665 - DNA, 1845 bp, Bovine  19866880875966
tggttttgccagctgccagacagacaagcctattggcttggtttaaatccaggtctcttacagactcatggcctagagagctatcattatttctactctaaaattactctggagataattttagtcttattcaattactccttgactctcatgttaaggaaagtactttgggaaaagcatatttagaatattcttgaatccttagcttcttaaaacttagggaatttttataaaataatttgaaaattcaaaatgttacagctgtgtgtgcattttataaagattcactaagccacacaattgatttacatacttttatatttacattattttatatatataaccaactttaacaaaatatttatttaaaacactaaatattaaatatatgtagattcttacttagagaatcaaaacactgaaaaaatactacatcaaaaattgaaactaatagaaatatgtgtctattttaattctttcttttttaaaaatctattgtcaatctctatttccttgtattacattaaatcaatagcatgaataaacttctgaatatgccccaatttttttcaaaagggatttagctcctctttctttgaatgcttttttgactttctaggtttcttcttagcctctacttcagcctagtaaaaaggtttggggtacaatttatagatcccttcataaatatagtcaacttttcctattaaaatgaggaaaagaaaccaaaagcttggtattgtgacaaatcatattttattctctatacggactatatgcatttaattgccatttaaaagcagagatccttaaattttataactcaacattctacattatttaaggataatacatagattttttctcagtacattccaaaatcaatttgtcaggatgggggaaaatgccatgtgacacacacactgaaagactatacatgactccactaggggagtaatatttaaaataattattgtctgctgctatgtaagtgtatctcagtgagagactaaatgattggccatgtgaaagggctgacgagaggactattgcatttagaagttagttttaacagactggcaatgtttaaagttgtgaaaagatagagtttaaggactgaatttaaaaagggctgaattcatctgactataccatggcaatagcatgaacgtgtaaccttttattcagccaatagctaagctcccattgcatgagctagacattccaagacaaagcagaaagagatgtgttaaagattagacttgcaaatttcagaatacatagtgtcagtctagtgatgttaaaacatccatttagaataactcacagagtaactgtagcatattacaaagtggaatcatgaatatgcaatcagcaaatggttctggagcttgatcaccatctctgtcaattacagcagtcactttctgtgatggtaccttggcactttgacagtgattatacctttacatgatgtattgcagatattatgcttcggttgtttacaaatagaaccatatcttactctttcactgtaagaatagtattttaaataaggaaaatattcctcataataaatcttccacttaagtcactcatgcataatcatattgggaatatcttaaatgtcactaccacacaacaaaagcaactccctaaaatccttctttatattggtcttaaaagtgaagtaatgtggaggtttttcaatttaaatgaaaagaaactgcataaaagatcaatttacaacacagtgcccattactctaaaggtgtaggttaataaaagagaaatccatttttaaatatgaagcaagttttaagagagagatacaagcatcaatca

SEQ ID NO: 24666 - DNA, 1368 bp, Bovine  19866880877454
tttgtgttcctggggattatttgatttttatcaaagcaaatttgaattggaaacatggcatgtattaagtcattggtacttattgtctaattctttttcccatagaagtttctatgcactgaaagagcactaagtcatcagttagacataccatgtatgatccttatcatatccagacaaaataaaagccttttaagaagctacttcacaagacaactgcatagctttcctcacaggaacttgttaaacaaataacgattattaaagctattgggtcaatcgcttacaccagtttaacaagaacaattccaagatgtctagcctattccacattccatgtgactaactatggtatccagagcttggaaactatccaggcaactcacagtagcttttcttaaatgctttgtagacactggattttaaggaaagtagtaaaattaggtttacagaggagagtcttcaaggcatacccactgtcaatgctataaatggtctcaactgtatcaaaaagttgtttaaaagcacccaaagctgaaaacgttgcagatttagctcctatctatatcagagttggcaagtgcctaaatcctaattgctgatgtggaggtttattgtatccagtgagatgagtacatgggagttttgcacaagcctctaatagagagggtactgtgagttggaatgactagcttttaaaaatgtgccacattaaccccttgcttatttttacagtcatgccacaatcagggtagaaatagaagaaggaagatttagagtggaaagacaacagatgagaaagacaggaaatcaatccttgtctaaggaggatttgggcagctttggggtctttctgtatttgaactctaaaatagtaggaacagcagttattgtaataacatgtaagaggtcaggttcagaaatagtaagcaagaggaccaattgatactctaggtcccttttcttgaaaacagagtctggaacacaaaactttgaagctaaattaaatgcccaagataagagactttagaatactggtgtcagtgttctaaatccaggcaaaaaaatctgggtcacagaacctaggacaccagcactaataggcaacacagtcaaatgtttctacatttccctcttagagtccaaacttatgaagattttgaaagatctgagcccaaagttttcttttttcatttaattcatatttgttagacacttattacatattaggcactgtatgagcagcagagactattactgaactaggcagacatgctatctctttttaaaggagacacacaataaatcaggaaatgtagaaatggacaaatgactctagaagaaaataaagggcatgataagtttgag

SEQ ID NO: 24667 - DNA, 1311 bp, Bovine  19866880909093
caggattctgcaaagtaaaaagatataagcaatgtctcccagccaaaagcaggcaggtaactaccagacaggtcttggtgttgccagaaactggcctagaactcacagcaagctgatggtgttgttctgttgaacagaagcaatttcacagaacatcaatataagacaaggctactctgaccatgatagattaagccaaaaataaggccactttgtagactttacatagaaaagaccatacatcttctatcctaattaatatgggtccctattattggatttttttcttctttaccaagctttagtctcatttcattccttctaccttctcaataaaagtaagatacccaatcataatgttgacaacagaacaaaagcaaggcaaaaaaaattgatattggatcagagaaatgaaaataaggcaacaaaagtagtgtactatcactacctctattattaacattactaataattacaacataagcttagagttaatattcactaagtttttggtctggattatgaaagaccttgtgctaaacaatttacctacattatttcttcaatgtgcacaatttattaaatttacagttatactcattttgcagagtagagaaaaagtgagacttgtcaaagtaattatcacagatcactaagctaataattaaacattgaaaccaagatccaaaatctacatgccaagattttattccctcagctgatagcagtgagtagggctgatatttttgaagtgattgcgtctaaccaaaagatagatgccttttgaaatttgtctgaccagaggatgtgcttattacaaatgttcaaaaggtaagtgtgtgccaactatgaatcttcttaatacaggaaaaatccatgccagtcttggcttaagcctccattctttgaaaaatttccatgaagttaggataatttttatttctattaactctcagttccaagtgcatctgccagttcttatatgccaagtaccaactaaaaggttattatgtatcagccaaattatcattttgttccatcactcactaagctcccactgccttatcgaaagttggaaatattggtactcaagttctactggataatcggggttattatttgtccctatgatcttactttgacaaggaagatgacgctatttaataaaatattttccagatcacttttggaaattcaaataatctgcttggtagtttgtactaactaaaaaacaaagatcacaatccagtcatgcttgttagcaaaagcacttatcaattacacattttccaacttaaacttcacgtaatt

SEQ ID NO: 24668 - DNA, 1361 bp, Bovine  19866880968530
tgacatcaccctgctcgattctagtccatccagatgctcacaaactatcagattgtatctggggtgtgggcagtgcttatgggttgaaaaggagatcatggccagcattggagaaagcaagctgggagaagcttgatgaagtcaaccaattagtcagaatatagatggtaggattgctcatatatattggtcatatatatatatatatatatatatatatatatatatatatatatattccttgttcattccaagtaatcaactcctaaatatccctgagttagtccagtctaggccaaagtaaatagaaggctgtgacagttggtgtgcatgatcaccccctttggagctgggtatctaatatcattaaaaaccacatctcatgtaatacagagatatacactttataaatgaataaaacatcaaactcttttgctgtctgattcaatgttgttatcatttctgtcaagtagacaggccatgctgattatgtagatgtggaaactgaaatacaagaggttccctgaattcaattctggcaccagataatccttggtgctggaaccagtccctaggtttttgaggtcaactcggcatattttctatgatttctcatcgcccgtagaactggctttgctttctctgacttttcttagtcacttctgtggttttataccattccctccttgtcattaaataactctcaaggcaaggcagaaattctcatgacaacagaaaacaatgtactagaaaggctggccttacaagagataaaacagagataaggagaaggcctgttgtgaagtggtgtccattgctgcaaaggagaaaatggatatattgggaggaaaggaaaagagagaaaatgaaaacctctgaattagttctgaagtagtgaggagaaaaaatgttatttgtatatctgaaaacaggtatcatctggaggagctgcatctaaggtgaacaaaagtgtaattgtagaaattgtctagctgttgagattctactgggaaccatttttcaaagtaaagaaaactctgatcaacctccagtttgtttatggagaggactttgcccagctatacccagaaaacttgagaatatcacaccagcacaaccctgagacaaattgtgtttaccaaggggattttcttaaagagaaacattaagaaacaaaataaaatttgtttaattctgctgcagggacatgtgatgagtgcatgatgactttctattgtagactggcaagacttaacctttctgcatcttctgctcaggcaggaaggaaagcgttttcttagggttttgaacttacttgagtgaaatctaactaaaaaggcagcaccagagactatatctta

SEQ ID NO: 24669 - DNA, 950 bp, Bovine  19866880978978
gatcgcctaaagctacaatattggaaaatgttgcctatttttctaaagttcttttaatgactcatgttctaatagcctctgtttaagtgacaaaagaaccactgttgttcggagggatgtacagtatattacacaagtttaccctggcaggccacaggccctgatctgcaatcctgtgtcagcacttttcagtcctactaatatggatacagatgggtgtgtgagctgctccaggcttctcacggggccaaggaaaacatggaaaacaaaggcctttatgagctccatgctgaccacagtccctgcagtattgctaaaatcacatttttctctggacttgccatatacagaatacttctcacctgagagaaatcaaatttcattcacaacctaggacctaagtttgttgttccagtaagagtaagtaattgctccctttggaaaagagaaaataaggcctttttcagcctttctctacaaacttgcaaaacagctcagtagctctgaacacacagaatgcaaaccatggacaactagttagactagagcaaaggcacacggttgggctgacactacatatatttagaaaaatgaaaaaaaatgaaaccattatctgcgaccattcaagcgagagaaagacgtgcttgcacagctcctccgtcacctccaggagccccaccctagccaccaccaaggtcgtcatctcctgtccttcaccgcatctattattctctctcggaaggacatgtgtgctattataagagtttctcattagattaggtttaaatttacttgcttttgtccacttccttcactagaaatagtttcttcgcaaaggcagatgccatagtctgtctgagctttgctgctgttgttgttctgtcttccgtacatgagaatttgtgagaatgcacagagaaggcaggctaatttagtaggaacactagatt

SEQ ID NO: 24670 - DNA, 2919 bp, Bovine  19866881082929
aatagaagtagcaagagcataaacacattactctgaaaattgataaataagagaaagaatcaaggacatgtatcttacctgtcctgcatgaattattttagagtaaccaaattgttgaaaaagagaggtttatctttgtagaaaatttctagttaattaatgcaaaagaattggcagaattagaagaatatcattttgtattctaaagaacatttgggtacatatatctttagaaaacaaaatagttactaaaggggagaggcaaattagtggtatggaattaagatacaaactactatatataaaatagataaacaacaaggatctattgtatttagggaattatagtcattatcttgtaatgactttttctaacctttttattttgtaataacttttaatggcatatattctttaaaatattgaatcattatgttgaatacttgaaactaatattgtaaaaaaactatactttgataaaaaaaaatctaatgaaataatgaatgtaggcaatgatcattaatgaaagttataactaacaataatgtaaaaagtcaacaaggaaactgataaaaataaagggggggctcaccagaacctataaatcttcagtaaaagtggggcaaccagaaattttatgcatgatacagcaggaagtacaaaacaccacacatacagtactcttgccaaaaaataaaaataaaaatgagcctgtctctaataagcctcaccctaagtacaactttacaggaaataagtgggctagaaaaaaactgaatgaaaccatgaagcaaacaacagctaaatctagaatgaggaacattctataggacagataacctaatttatttatccaaataaataaagaggaaagaggaagggggcaactgttatacattagaagaaacttatgagacataatgtcaaccaacatatgcattgtgcagacctcttttggattcaaatgtgaagaaaacaggagaaaaacattcttgggacaatgaagaaattttagcataaaacctgttcaattctctagacttaataacaacctttgaataatttttaaagattttatcatgttcaggtatttacaaagaaaataagatttcttggatttgctttaaaatactcctggagaaagagaaagagaggaaaccagggacagaaatagagcagaaatagatgaaacaagacctggaaaatctcaccaactgttaaagctggataaggggtacatagagatttgtcgtaatagtttctctatgttggtataaaattttccataataaaaaaatcctaaaatattgatataaaactctttttgtgtgtgtagctttgaaatttttactgaaaccacagaatatattcctaggaagagaactatgcggtcaaaggcataagctttttgaggttctcagaaaaaaattttaagtgctctccagaaagtctgtaccagtttattaactgcactaagatgtatgtgtccatctcaccagaccatcaccaaattgaatatatattttaaaacattcattctattttgatagataagggtatattgtttcagttaatgttttttcaagaaatgggttgaaatcttttaattgtaattagtcatgtatttcttcttcaccgaattgtctggtatattctttgtccattttttatttaagccttagtgatttttgttctttgattgtaaggtgtttttaaataacagctcttcttaatctgatgccaaatatttctcctttatttatgttttaaatattcagaaataaattttttatgtaatcaaatctatagactttggtctatgctttttttcattttgttcaagcttaaaaatttttgtcctccctaagatgaggtagattcactttctcatagttttattttaatgactttacctttttaaattttttatttatctagatttcaccttggtgcatggtgaaatgcacattgtgaaatgcacatggtgaaatacaggcttactttattgtttaccaaataataagctagtcattttttttctttttcattaaaatttttttcttttattataccatctgacacataataagtctcttcatagagtactctcatatgttcctggttctcttgataacttggcttccttttactgttgaatttcgtgcctataccatattattatggctttgtacctggtgaatagacttgttaaactaactagataagaaatgagagaaacaagaagagggcacgtagaatatatatatatattatatatataatgtatacagtagatttttatcagatagagtgtatcatctatatcatccagcattttgttagcatctacacaaagtctgtatactatagaaaagagagcaaagactctggagtgagtatacaaagatccacagtctggttttgtttatttactggttgtgtgttcttggatgaagcacttaacttctctgattctgtctcctccattgcaaaatgaacataaaaacatctataccatatgagacatccttataaaatataaaacaccgtgtattttgaaattaaatgttgacaatgcccaggatacttaaaaaaaaaaaagtaacaatgatttcattgggaagatgctgaagatacttgacatgtctttttcagtaatttctgcagtaaagatgtccacttttaatacaaatgcgtattattcaatctgccagttatgctgaaatgggtttaaaaaaaaacacacacaaaaaaaaactttctttggcttttggaaattctgcatcattaacggaattaaacattttcaattaatttcaatctggtacgatcaatttgactgacatatgggatagacaaaaatctagcttcattactttgtgcctcttggcaactgcttacagactggcttcacctgca

SEQ ID NO: 24671 - DNA, 1015 bp, Bovine  19866881157705
cttccctaacgttagaattagtgaaggttcatctgtaaaaaataatctctcttcacccataccatgcatctttcctattgacaacatccactgtatttgccattgtatatttcccatcgactctaatgatagtagtaggacactttctattataagatatctaaattcccaacttgggggattacttcgggccaatacagttagaaagggaaagaaacatgtcattttatatttataaagtaggatataaaatgagataattgaaagtctgcttgttgatctttagtgaacaattggtgattctttttcttcccaagtaatgggttgttatatatttaattgctattttgagaaaggtattcttccaaatgggcattagggaaataggacagattttaattaaaccatttagcacatacttaataactccaccaggaggcatgataaaggtatgcttaattggcttagaaagatggtagcaatatgagaacttcaaatacaaagttaattacagagataattctatgaaagtgaaagtcgctcagtcatgtctgactttgcgatcccatggactatacagtccatggaattctcctggccagaacactggagtgagtagcttttacattctccaagggatcttccaagcccagggattgaacacaggtctcccacattacaggcatattctttaccagctgaaccacaagggaaacccgataattctatatctatctcctaatcaacagcaagggaagttgttgaaaattttaaaagtcaggcaaggaaatttttaaaaataggttgactttctgactttcatccaatttgtctccaaaaaagtctttctccagggtaggcatgtatgttctattttgtggatcagcttacataagggagaggctgctttattcctaaggctatctgacagcatgttttcctccagcactctgtatagtgtatctgataatgtctttcattcttctctctatccagtccactaattaacaatttt

SEQ ID NO: 24672 - DNA, 1433 bp, Bovine  19866881220917
ctattacttttagcttgcctgagatttcctgattgttgggctacaagagaaaagaagaaacaaaaaattccaggttttttttccttgcactctttctttcattattagtatcgttttaatttttttttttcctgtcttttaacaagaaatgtagagcttctcttgagactctttctgtcttaatctggtatgcatgtcagctttttgctgcctttgagttcaagctgggagatatttgagaaagaaaaaatgaacttcctatttggtgacactttgtgttctagtaaattgcttcacttgtgtcccactctttgtgaccctatggactgtagattgccaagctcctttgtccagggattatccagacaagaatactacagtggattgccatgccctcctccaggggatcttcccgaccaaggatcgaacctgcattggcaggtgggttctttaccactagcaccacctgggaacccctttactagtctacttgctataatttacttttcagaatcttaacataggtattctgtgaattgtcttctgaattttaggtgtattcagggtcattgtcaggatagaaattagtttattttgactggaactggaacctgaagtctttaaaaaaaaaagacgtagaaaggcagttatgaagaggagaggcagtaaactcatagaaaaaagatgaaaaggaagctgggactggtaagaagataatgaagaaaacagtgagtaattatagaaatgaaaaccactatcagaagatattattctttctacaaataggttaaatttggtgtcttcaaggaactaagattgaaaggactcataaagaaattaaagaacattgaagaaattaaaggacactgtgtggtagctgtagcttgtatactagtttgaattctcattattggtggtaaatggagcaccataaggaaaaatgaatgttttgtgtgggcaagtagagaggagaacttgtgaaaccagaatatgtttttattaaagtaattccctcttcatctactgtctaataagatctatgaaaagtttgattataggaaggacatatcaaactgaattttgaagatagacttattctattaataatatattgagaaatagtaaaagtagattagaaatgaatgcagcaatttaggtgttgagtaaatgatttataataccagagaatgtttgtttagtcatagcagaaggtacagtaaggcatagtaaattactttaattcaagtcagcaaaaatcttaaagatatttggttcagtaagtaccaatagagttgatacatatttttaaaaagaaataacatgcaaaaagaaatctatagcttcattagtcttggccattatgtcttaatcttggacacaacagagtatttataatcatgctaagagatagactaaacatcataaacactttt

SEQ ID NO: 24673 - DNA, 2054 bp, Bovine  19866881229595
tcggacacgattgagggagtaacacacacacataactcatttattcttctcgcatggagtagtatgaaaacctaatgaaaacttgtacaactaactaaaactgtttcctttaatttaaacactcatttcagtttaaaataactaatttgagataaattctcaatcattgaaagttctgtttcatctttaatgtctctgtctctctgggagaattcattttgtccttctggaagtaagataacagccctgataaacctaaataacaacaacaatacaaatttctatggatcaggtacatcattttagagttataacctcatttattcttcataaaatttctatgaaggtgttactattgctaagtctctcaagggaatgaattacaattcagagtttaaacaattagcaaaaagaattaggaaactgcaaaccaggtctgatcaccccaagtctgcagtctaaactcacatagttttatcacagagataaatatttacctgacaccttgtctagcaaaaggtaccagtttctccacagatgtgtttcttttcaaacacaagtgggaaaaacattttgaattgcccattggagtccacatgtgtgagaacatgagacaaatctcaaataggaaatttaaaagaaaagcattaattaattgggcaagagatattttgtactctcagaccaacacaagcactacattttccccttatacttcagattacctgagagacttatctactgaagacagctctaatctaaacaaatggccatagccttgagagcttccaaagctgatatgcaaagatggctgggattcaaggcaatgcaaaatgtgctacaggaagctttcaaagcacaaattaacccatttattatgtctgtggtaaagtagcatgttttgccttgtataacatttctcatgtttccataaaccatagtttaatatccttttggaagattaaaactagaagtcatttctagtgctaacaaatactttgattgagaggtataactgttctattgggtctcacaactcggcagctggtttcttcaattacactttttaagtagaacaaaactctgaaagcaagcaaacccttgactctgagtcctgcagtgggattggacatgctgtgctatctccccaaggcacatttccttaagcaaaagtgtgtctttgtagatggttacgtctggttacttacaacatcataaacaattacattctcttttctggttcctataggccagctatctaaaattaagttaaaatatacacatttttgtaaagaaaacagacttgatttaaatagatcacgacaagtaatcattctttctgaaaaacatgctgcagtcggcatagtttcagtgaaacctcagcaagggtgtttcaagtgtcatgattttagttttactgaatttgaattgaatttatatatatatatatatatatatatatatatatatataaatgaatatatatatatatgaatatatataatatatatatatatatgaatatataataggggcaaatagcatcttacctcttcttggattatatatcttctcttctatttcaagcaggtgttggctgtttttgtctctgccctcccaccctctccaagctagaatcaaagataatttctatgtgcaggcttaactctatctcatatgtggaaaatggacctgactattgtgcaggtcaaaatctgtcaagtattggcaatgtcacatggtacaacctactggtattcaagacattcctaaacaatgcaggctgcagccaagtatactcttgaattggtcgacatgtcaaagatgcaaatctgatgtttctgggatgaactatgtacagatgtatatccaacaagtcagttttagacacctgggtgtcatgttcttgaggaattttgaatttcagtttttcccaaattctttatttatgccttttagttcctttcttggttatagctcttaaattttaaattatacttaataccagatctcatgcatttgctaggatccagaggtgtcctagaacatttttt

SEQ ID NO: 24674 - DNA, 1574 bp, Bovine  19866881267527
actggttttggcaggtctttctccttgttttctcctgctgggtccctgggacaacaagactgcctccagggtggtggtaaagccagggtggagctgggtcatggaattgttactgggtctacaattgggcctggttagggggcttactgggcttcccccagtggctcagaggtaaaggagtccacctgcagtgcaggagacaacaggaggctcgtgttccatccctaggtcaggaagatcccctggaagagggcatgtcaacccactccagtattctttcctggagaatcccatggacagaggaacctggtgggctacagtccatgaggtcacaaagagctgtacacaactgaaacaaccgagcataaatgcatacatagtgggcttgttaccagtggcacgggcaggagtggttcctcgaagatcccaagacttaagggaatgcctctgggaccagggttgaggtggactgaggccagggctcacggccactcccaggtccacagtccggcccacaggtgagaggcctattacctggggcatgaatggggttagcctgggcaggcccctgctggacccctggactggcacaactacctctggactgtcatagaacggggccagagctgggtcgtggggctgcccacagtcaagtctgcagtcgacacacctgttgctagaggtgccagctggcatggctcacccagggcccctgggtgatcaggactgcgggagagcaaagcggaagggcctgctcgcaggcgttcagttagctctccagtctgtgggtcattccagcagcgtgacaagtgtgacactctctagttcccctgctgagaaccatatcatgaccatagataagcaggcttggagccgagtccacaggggtagagggctcttccaggcctgccgctgtggccaaggtccatggcccggccactgggatgcaggatctgccttctcaaagaggccctcctcagtcttgggctcaactaggggtttacaaactcctacctggatcccaaagctcccacaaaggcactgttatctgtgatggccaccaaatcattggtttggggctttttttgtttttttaacttctcatttattccggccgtactgagtcttcgttgctgctcaggcttttctctagttgtggtgagtgggggctcctgtctagttgcagcgcaccagcttctcattgcagcagcttctcttgttgtggagcacaggctcttcagtgtttgggcttcggtagttgtagctcccaggctgtagagtacaggttctgtagttgtggcacacgggcttagctgtctggcggcatgtggaatcttcccagaccagggatggaaaggtgtcttctgcattggcaggtggattcttacctctgagccaccagggaagccccaaatcactgtttttgtgggaggacaagggctggtaacttcctattctgccagcttgctaacattaccttctagaggtttctattgagagatcctcaagcttagagattgtttcatcagctgtctctagttcactaagtccatcaagagcattcttcatttcta

SEQ ID NO: 24675 - DNA, 1735 bp, Bovine  19866881401623
ccagtcctctataatgaaaaaggacatcttttttgggtgttatttctagaaggtcttgtaggtcttcatagaaccgttcaacttcagcttcttcagcatttctggtcagggcagtaatcccagggattactgggatattgaatggtttgccttggaaatgaacagatcattctgtcatttttgagattgcatccaagtactacatttcagactcttttgttgactatgatggctgctccattttttctaagggattcttgtccatagtagtaggtataatggtcagctgagttaaattcacccattccagtccactttagttcactgattcctaaaatgttgatgtttactcttgccatctcctgtttgaccactttcaatttgccttgattcacggacctgacattccaggttcctatgcaatattgctcttttcaacattgaactttacttccatcaccagtcacatttacaactgggtgttgattttgctttggctccgtctcttcattcttcctggagttatttctccactgatctccagtaggcatattgggcacctacccaccgggggagttcatctttcagtatcctatctttttgccttttcatactgttcatggggttctcaaggcaagaatactgaagtgatttgccattcccttctctagtggaccacgttttgtcagaactctccatcatgacccatctgtcttcagtggccctacacagcatggcctatagtttcactgagttaggcaaggctgtggtctatgtgatcagattggttagttttctgtgattgtggttttcaatctatttgccctctgatggagaaggataagagacttatggaagcttcctgatgggagagactgactgagggggaaactgggtctttttctgttgaagagtggggctatattccctccctgttatttgacctgaggtcaaactatggtgggaggtaatgcagataatggcaacctccttcaaaaggtcccatgcacacactgctacactcagtgcccccgaccctgcagcaggccaccgccaacccatgcctctgccagagagtcctggacactcacaggccagtctgggtcagtctcttgtggggtcactgcttctttcccctgggtcctggagtgcacaacgttttgtttgtgccctccaagagtctgtttccccagtcctgtgtaagttctggaggctttatggtggggttaatggcaatcttctctaagaaggccacacccggttctgctgcacccagagcccctgcccctgtggcaggccactgctgacctgttcctccacaggagacactcaaaggtagatctggctcagtctctatggggtctcctggtgcacacaaggttttctgtaagccctccaagtgtctctggtgggtattgggtttgattttaaatgcaatttcacccctcctaccatcatcctgggcttctcttttatccttggacatggggtatctttttttggtgggatccaacattcacttgcggatcgtggttaggcagcaagttgtgattttggagttattgcaggagaagatgagtgcacattcttctactctgtcatcttgtgtctatattacttctaaaataatcaagtgttctttcatttaatatgtcaatactatatatgtgattcaggattttatttaccctaaaagtttattgtttactctttgaaagcaaaacatccttggttt

SEQ ID NO: 24676 - DNA, 1464 bp, Bovine  19866881422673
aagagatgggtactagataggaagagtgaccaaggatataaacctcattctgcatcataagtccaagactttactggaataagtgggagaaacaatactgaaaatgaggagtcactatccaatgtttgttggtggtgaaagaaattgagaagagtaaaacagaaaccctggcttgcagactgccttccatattcaaagtaaattaattaattccaatgcggtgaggtgtagtaaaggcataagcatgtatatccagataggcttggaaaccaaggtctttttgagcctatatctgggagcagtgatctgcaacatgaatctggggaaatcaggtacaggagaaataagatcaagacttaaagctgaagtatctgtgccagaatcaagcactataaattccaagaattcctgagatggaatcagagtttggaaaagaattccatttttattcattttatataatgaaccccctttacatgcttttggtcacttctgaaaccttggagagtgccagagatctgactttccagcctacagactgggaatccacttaaatattaaagagctttctacattcaccatgatatcaaactagaatccaacagggttgccataaatgccccaaactttcccaaatcagtctaagattaaatcaatagacatttccatatagtatacagaaccagattataaggagcactataccctctctgtggccctaacaattgctggcacagcctcaggacaagttcttgctacttctcccaagagaagttgaataattatgttgaacatcacaagtgggaagaagtatttggaagggaaatgatagcaaacagttgaaggaaaagtactgatgaaatggttgaaaagaaaagagataaataaaagcagtgaaatgtaatttcaagacgaaattgtaattcttataaattttctatggcaactggcataaaatattttaatatctttgaagtagaatacttaatttgaggtcatgaaatgaaattaaccagctaccccaaagtgaaactgagtatgtgatcaacagctcatttgccctgtggctggaggaaggcaaatgaaaatgccaagacatgattaacccaaactgaattgggtaggaagaagacacttgcccatttaatttgatttgtgggcttagccactgcatggggacctttgcactgctattctattttaaaggaacttctagagaacaactctcacagctgtgttgatgcttttttttctaaagggaaatatcagaagactgtctctttagcactattttaattttgctcagtttgaaagtattgtacatgtgtgaatctcatgatcgtgatcttaattaggatcatatttagattcagacttaaactggagtagataataatttccattaccttgtattaaatataaggaatcaagttctcaaacactatacaaatacaggatcttatt

SEQ ID NO: 24677 - DNA, 1790 bp, Bovine  19866881497305
ctaacctggctttcctccgtactcttgcctggaaaatcccatggacagaggagcctggtaggctgcagtccatggggtcgctaagaatcgggcacgactgagtgacttcactttcacttttcactttcatacattggagaaggaaatggcaacccactccagtattcttgcctggagaatcccagggatagaggagcctagtgggctaccttctatggggtcgcacagagtcggacatgactgaagcgacttagcagcagcaacctggctttcctatttattttttccagtgtttttttttttttttctctttctttctttcttcttttttctaaagcaccagacatctttatttttttcagtgttatggccagaattaatgtgtgcatcaagagtgatttgttggtagtatggaatgaagatagataagtagttagatagacagatagatgtatatgtatatatttatagtctcccaacaaccaactgtattatatatactctagttttccagaaaaagatgccttcaaggcctggataattctgatatttatcttgtttgtagttaacaaaattgctccttgattttaagatatttattttgaggtacattttaatcagaatcgaagtcttgtaggattttttaatatgacaaatcagactttctgtactcttggtattaatgccaacttcaggtaacaaatctcaaagtgtctgtggccctattcttactgaacacctcatcagaaaagtgataattgtggggattattttaagaacaggtagatcatgtatccctctaggtaacctatgattcattattggagcaagccatacaaactaaatgggaaaggttggaccatgtagcctttagaaccctgctaaacttccttcaataatttgcactttagtgagatgttgaatttcttagagttactgtaaggtggttcttgctgtactttgtcaggtgattgtgccctttttgatgacttctgtaaaaaaaaaaattttttttttttaaatttcatagctcactgcaggaaaggaaaatgacatacttctttgaatggctaattacaaatatgtagctaaaaacacttcccttgcttttctttcattttgactttcaagaaattgagaaaaaatatttggttcagctatatgatttacataagttcttaagacctgtttatatttctacaaacttgatatcttatttgtagttttaatttctataggatgttctaagttcgctacagaacagtgtaaaacttaaaaatgtggaatgagtaaaatgaatgaatgtatacatatataaatgcatatgctttgaaaaataactatgtccaaggtattttcttatgttattaagctataacttctctattgtcttataaagtaagtacaattactgtaggagactggaggtaaaaagagttatatcactgctcaagttcagatcagtttttaaaaaactcaacactaaaactcaggattcctgcttacaactctctttttattgtgtcattgtgctaatataattttctgtgaattagagataaaatcagctgctaaggttgaatgctctcagtaacataaatcctctgcactccactttaaatagaagttctagttcattagtttttgctctctgcatagaattagatacattttaaatttctataggctggcatataatgtaaatttattctgcaagttttatagagaaacttaattttacagtgttctcaatattccagaagaaaatatgctattaacacagttttatt

SEQ ID NO: 24678 - DNA, 1291 bp, Bovine  19866881701713
acattgccctgtgcaaacttgggtagctaatttatctgtgcttcagtctccttatctgcaaaataggagtaataataatcataagattgtttggagatttaaattgttacttatgaagaacttaaaaagcagtgcctggcacagaataaatgatcaaaaatactagatgtatttattatatgtaggagctatggcatgagatggatatagtgggcaatatttctaaattattaaaatgatttatatttatttctccttaaataattgcatcttgtactttctccatgcaatatattaagaacacgatgcccaaagtaaataactcattatttagttctgagatttaaagccaattttcttgagttcctagtgacactatggccttctaaactaagatttgatgaatgagaaagggatttgtacattccaaagcttctctttataaatttaaaattctagaaggtctgaaagtagaattataatataagccattttcaaagaggatataggattaaatggattaaattgaaataactgcctggcttcaggggatctatagtgccagctagatataaggtgaagacctagtcaacagagaaggtggctgtgtgccttgggagcaattatctggtgttgccaatgccaagatcaagacggatgatttataccagctgtagacactccagtggatattagagggacagaaatcaatgcccaaatactaggtgaaatagacagcaaaagaagttaagttttaggatccaacactcctatacctctccatggtggtatatagtctctcttcatccaagtccattttggactatggattgtaaattatcttaatatttctctgaaaaagactgatttaaactgggttacacctgatttattaaatcttaaaatatttatttttagtattagtgcaagggaatgccaaagcagattaatattttattgagaataaaggactttctatttttcctgaattacagttttagtatatatatagtcacatcactagacaagacaaggaggataataagaatgcatacaaagataatgattttggactattttctgaaccactgaaaataaaccatttgagaaagatatcccaaactcagtgtgggagaaagactagaaaaagagattgatgttagagataagagatctgatattggttgggggtatgtttatctagagtaaatgctttatttttgaacttcccaatgaaggtagttaagtgtcattttagcagaagtatcaaacttaatctatgaggaacatc

SEQ ID NO: 24679 - DNA, 1454 bp, Bovine  19866880424676
agacattacttggtcaacaaaggtccgtctagtcaaggctatggtttttccagtagtcatgtacggatgtgagagttgaactataaagaaagctgagcacagaagaattgatgcttttgaactgtggtgttggagaagactcttgagagtcccttggactgcaaggagatccaaccagtccattctaaaggagaacagacctggatgttcattggaaggactgatgttgaagctgaaactccaatactttggctacctgatgcaaagagctgactcatttgaaaagatcatgttgctgggaaagattgagggcaggaggagaaggggaggacagaggatgagatggttggatggcatcaccaactcaatggacatgaatttgggtaaactccaggagttggtgatggacagggagtcctggtgtccagcgattcatggggtcgcaaagagttggacacgactgagcgactgagctgaactgaactgaacgttttaaacttgtcagttcttcctttcaatcattgtcagcttccagaaacccagttcccagcaatcccctctgaagcaattcattccaattcacagctggggcactaaactgattttctttaagcaaagtttattgatatattatataattgagtgttctgtttctctatcttctttgaggtcaaagatataaaaagacaacagattcagattgcattttatagggctgctactcaaatttctcggcttctcaggtggcgaagtggaaaagaatctgccttccaatgcaggagatgcaagagacacaggtcaatcattagatcaggaagatcccctggaataagaaatgtcaactcactccagggttcttgactggaaaaattcaatttacagaggatcgtggagggctacagtctgtggggtcacaaagaggctgatgcgactggtgcatgcatacattcaaatttctagtttattctttggctctcttgagccttatagtggatgaccacttgtatgtataaatagtcttgttaagaagaatcatttgactctatttgttggaaaagtatttgcctgtctcattttttattgcttgatgtttatttccattaaagagaagcatagttttactctaagcacactctcttaaacaatgcttcactttaaacatgccaagtttaatttttaatattgtcttttaacactcaggaacagaaaaattatgctctcacacatgcttgtttaaaaaatcatgatattgctttaattttcaattttcttcagcattattcattttctagtaagaaggctaacactgcatcaattttgcattctggtctacattttataaaattccttcatataatatatgatttgggtttcataatggcatacaaaagtaaacaggcagttctcatcatccacattataaagaaaccaaatttaagaatgggactttccaa

SEQ ID NO: 24680 - DNA, 2013 bp, Bovine  19866880506126
attctgtacattggttagaatggcatttagtaattactcaacaaaaattttaattaactgtttttaagcagttaattcttctaatgttaacccaccttggatgttgcttctgaaaaataactgtgtttcagattcttgattactttggcatggaacttttccttacagtgattgatttccttatagtgattgattgaatttctgctgtctttcttatgtattctgcaagtagtgaacatttatgaatgaatgaactgatagtcaagaaatataggattgcaatgaaatattcatggttatttagtaagttgtaaaccaccttttttcaggtgccaatgaaaaggtgctctcatgctactcacacccaacaagattgttttaaaccccttcatgctcttcttatcaatcttctgtcctaaaagtgttaaagacacaagaaatatgatataactgtcatatcaagttcttgaagccaattagcccgcaaggtagtgtgtcattgttccccttattataatgcagatgctttatctaatgcctctgacttcatggtagctctatcatcacttctataacttttccctgtcttaaatcacaatttttcttcatctgcataatatttgcttattttttgtgaattttgaaatcaccactccattttttggacatttctatttgcaacttgctccatactaaaaacagagaaatccagacaatatggccaggtccagggaacacagaacagtctttccacagccactgtgctgaccttccagtgtctggaataccaaaggaagacaaaaagtgatgaaaataacaatgatgattcttgaataaattttaaaactttgagatacggacaagaacaagcctttccagtaatcaagcacatgctttattatttcttaaccccagagtgattcaagttcaatgcattcaattttagaaatctaattgcagaaaattcaagaagattcattttttttctaagcaataaataaagccatttcttttccttctcagaagtataaaagaaccggtgctagaaaacagctgcaactccaaaaagataggctcagtatctcagaatacatggtttgggtttttttctaagtggactaaatgaatagtcagttccatttctctgcccctaagaaaaggatgcatataaagagccctttcaaacagctgcaaatatgaatgattaaagtgattcagacaatggaagaaggaaacctgcatttgcagatgtcaccttcaacatagtgtcgagttgacagctttgtttttatctgctcccatcacctaagaaaaaggaaactgattttaagctgaggaaccaatatatttattttcaagaaaaataccaatcaagtctggattttctatttttgttgtttatccagaggccagtgcactgcaacagtattatacttgatgaccatagagttgattttatctttagcagacaattgaatgcaaaaatatgtagacagagttctcagcaattttgattctcatgtaatttcacaagggtttagtgtctcttcaaaattgtaacttttagtacattttactgatctttgatttggaaagttctgtttttgttttttatttttccttcacttgcgttagtatttattttaatttttattggagtatagctgatttacaaatttgtactagattctcccttgtggctcagctggtaaaaaatctgcctgcaatgcgggatacctgggttcattccctgggttgggaagatcccctagagaaggaaaaggctacccactccaatattctggcctggagaattccatggactatatagtccatcaagtcgcaaagagtcagagacgactgaccgaatttcacttcaggtatgcaacaaaattaatcagctaacatttacatatatccacttttttttttttcagattctcttttttttttttaagcttttctttttttttctttttttttttgattttattttatttttaatctttacat

SEQ ID NO: 24681 - DNA, 1760 bp, Bovine  19866880549379
atatatatatatatcagttcagttcagttatagatacatacatttcaagtttatatgagagtacattttcattagttgtaaattataagctaatataacaatttaattagaatatcatttgcatatataagcaactagtagtcaagagtgaaaaggggatataggtgacacatggtaaaatggcctatttgattatttgaataccatttttgttaaacttttggttgcatatcagaaactatgattaattttttcataatagtgtgcatactttgtgatttttttatttaaaaatattacaggtaacaaaaccgttgttttttacaagttgttatcttattacgagtaataaaactgttggataaagtttagtaattctaaataaaaaggaaagataacatatatgtcagagtccaattatgctgataaatgaaacttcaggtatctttctgtgtgatagaatatctgctataattcttaccaattttgaacttatcttagtttttatgtgtacatatctcttttaattaggctagaaatgctgtattctttagccattaactaaaaatttaatttcaatgctagaatattattttggatatgaattaaccacctgacatatcaataaacttttttctatttaagataattaaagcaaagttatacttcctttcctgtataactaaaatgacaattttgttcaggacctcaaatttatatgagatcttctctaatggaaaatgtggagagatatgggacaagtaagacaaaactggaaaccaaaacttcaaccaataaaacttgaattcattctactcatgtaccagaaaccattcatgctgagaaacagaacatgtattatataatgactgtgtttaatatcacttttactaaagctattcacattttaaaatgcctcttttgtatttaaacagctggcacaatattagacagttcttagattgatggccatatacagtatacaaaaggaaaaatccttattttaatagagaaatagtttgaagtgattgagaaagattgttttaaggaaagattaattgccttaatccactgtagctaataagaacaggtaaattatatagtaaagaatgagataactttttccctagaaaatattcctttacacatgtttcagtagggatcttgcctggtattactcaagtattacatatattgattaaaaataataggtattaataacaaaagcaaattactatctttactaggtttaacaataacttcaataggaaattatataatatgtcatatatattttatatataattattatacaaatatatgtgtataatatacatagatacttatgccaatgtctcagatatacccattctatagtagcaattatgaaataaagtcagaagaactccagaaaataccataaaaatgtttctagaaactaggttttctagtaaggaaaattatgcataatgcaaatattttaacagtgtttgtatataaaaatttaaaaataaagaaaatatctcatgattaatatatatccagaaattgaaaccatacatttaagatcatccaacttcataagttaaagggaaaagacaggactcacaatattttgagttatcaagagaaatttgctctaggtgatctatatctttaccattttagtatgtgagatctttgttgtggtacaaattgacaatatttcagaacatactaccacattatccttagcagtgtaggactgttgccagcatcta

SEQ ID NO: 24682 - DNA, 1319 bp, Bovine  19866880643634
agtgtgaaagaaattgaattcagtctaaaatcaatcaaatggtaagtaagctgtcactaataatgagagaaatactaagttccaagattaaattcataactttttggattactgatactttctgctgccaatatgtttgacttttgttagcatatatggacattaatgacatattagtgggtgcaactacaattatgcagcattctcactagcaattgtattttttcatattactttatgatattccacatatcttaaagtttatctaactaaaatagcaacctgaatgtattttgtaatatttaacaatcattcccgtgtaggagagctgaaataccctctttctcttggaatccatgctagatagattccaaatcacttaactccttcagaaaacaattgtttcagttgcaagtttttcaactgtcaattttatgaaattaattgagattcattttgattaatatcttttgatgataaatagattgtcctctaccatgtattaaagaacagcttgtttcttttggattaaatttttatggtaaaatgcaaataattttccatttctcataatttatgatattattaccatatcctgttacataaaatgacaatgagcaaaacactcctgctgctgcaatctgtgctgaaaagcttcctcaaaatatattgtctccatttctatcggtagatatagctgtaggaggtaggaattttctcatagtgtttgctggatgatgctaatactttgttataataggcactaaaaatataacatttacttgctcagctcaaattataaacagccaaagctctctgaataagaatcatatgcttttaagattcatttctgcctgtgagtgttttctatttattagcattggcgtttatttctcatttatatacaaataaattcaataggaattgctatactctacaattaatatgatacacaatcgaagtctaagtataaatgcatacaggctcctaacaaccattttatgatttggagaactatacataattgaaagaaaataagttttaaagactgcaaataattgacaagctcagtgtttcttcatacatgaggatacaatgacctattgagtaatttacatctagatttgaaactgagacaatgcatttggtaatattgtttttgaaacaagaactacttcttcatggaaatttagattgttagattgagaaaagataacatagttttgcagttctatctctggagacaaataacttatattcacagttggccatttccaattatatgatcctagggtctcagtttcattgcttataaaata

SEQ ID NO: 24683 - DNA, 1552 bp, Bovine  19866880672088
tgagactcattgttagagttcaaataattaaagatggagaattttggttacccaatgtcttatttgagtccttataaaaacaaacccctgaaagtaaaagggtcttgggaggtaacaccaagaagacaagggatgtagtggaacatgaaaagaaagaaggcaagaaaaaaaggcaataaaatatatattgagtgaatactctttcttctattaccttagaattgtcccattaaaaaataggaagcctgagatattcaacacttgtccttcaggggtttagggtaattcctggaggtagtaattcaatttaacctctgattttttttttttttttttgcgggggggctttttcttttccccaaagcaagctgtaatgtttctggaaaaattccttaggcagaagagcaatcaaaagataaaccgaaggtaaacccagaggtgaaaatcaatggcatcttcaacattttgtataaattctaagtttcaacagacacttgaagtgaaacatagggatgcatattaaattcaaataaactacaacggcttctaaaattatacaagtcagtcaaaattcttccagataaatgattttgaatcatgattttcaatcaatgtcacattgattcataatattcttttccaatattattaagtgtttcaaaaatattatttagttaaacaatgatgatgatttctttcataattgaaaagtgaaattattagtcactcagtcgttttggactctttgagatcccatggagtgtagcccgccaggctcctctgtccatggaattatccaggcaagaatactggagtgggtagccattcctttctccaagggattttcccaactcagggactgaaccacagtctcttgcattgcaggcagattctttactgtgtgcgctaccagggaggcccattccatgagcaaactcactcaagacagaatatttaaatatgcttgataaaaaagcacattactatgtaggctagtgagagtttgaataacattgaagaatccctctatcagtgggctctttacaagatttaatttattctgtgtcaaggcaaaatcaattgactttttacaagataatgtagtttagtagaaagcactcaacagatcctcaagaatctgatttatcttccagattctgcattaaatacatgtcttataaatcgcagaaaaatgtgctgagcagggtatgaggggtattgtttttctccagtaaaataaaaattgttgaaataggaagatttaaatctctttacagctctcttatcctatgtccaagaatggtttcaaagtaaatatcttcctcagtttctgaaaatgcttagacatctctttttttcttgtattcagtattactatcatgagctgtttaaagagaggggctgggtcttaagcaaatttttggtggcaccaaagactgtttaatagacatttaattaaattaaaaggaatatctgcataattaatttgttacatgattgtttttgaaataattgatttaaaataaatttaattttggttagtttttccttt

SEQ ID NO: 24684 - DNA, 1430 bp, Bovine  19866880796290
atagaatataagctttgattttgattttaatgttttttactcatttctctccaggtacaaatgtttatatgaagagatcatactatagttacatatatataataccacatatataaaaacactaaactatataagttcattctcactcttgatattgttagatgagaggtgataggttaacagaatatctaagaaatatgcttagaaacaatatgcaggatacagaaagtattcatgtcttaaattcttggttaattactttcaagatatttgaccatccaacccaagttcaggacatgtgtttgaacaactattaacactggcgtataggtggatctatgtgcaagctccacattttattggcgtaatataaaaatcagtgcaacagaaaataacccaatatatatgttcctgttaactctggaaaaacagtctgtccccttatttcaaacagtgatagactgcacagatttcacaacactgttatgtttcaacaattcagtatgaaaaatcaggtgtttgaaccttattatacaactatgagatagatgataaactgagaacaacaggtttgaaaaatatattaaagattaaatggataaacaaacaatcaccctgatcctattgcaggcatgattggatcttttagagatggctattgctcctgaccttgttgatgaacttgtgaaactgtctcctccagatgaaggtgacgaggttgttactgatagatacaaacagaagcaagtagtcgaagataagtataaaaattctatggaggtgctcagtaatgctctataacacctgttaaaaataaaagctctgtcaaataaatacacatagaagcgacctcataaaatacaagctgaaatcagagttatgaatctccaaaagacccatatgtcaccttattctctttgaattgatatttatctccctgaaaggaaaatattaatacttctattgtttcagattctttcaaaattcagatccacagaagtcaatgggtaaataattttgtaaaaactgacaatatagcttaaaatgtatgacccgtaaaagtagcaacacacacacacacacacacacacacacacatgtatataattgttatttttctagtgatcttaatattcactctgtatcctttgatatgggaattagggaagctctgacactcacatcaggtcacacaactgataagatttgaggttccaaacctcatcttctatctatatttcttggcttggtttttcactttatctctgtccaattttagttagctaaataatgatattaagtccagtttgaagggttggatatagtgatactacctttaaaggagggagtggtcacctctatgtagaatatattcctgcctattttctatggggttaagtagtaaccatgaataccattcagatatgttc

SEQ ID NO: 24685 - DNA, 771 bp, Bovine  19866880886703
gtttctttgagctttaacaatccataattatacatatctaaatttcctatatagagtatatgaagagaattactttgggaaatgaggttcagaattatttaaaacagtaggataattatcaggtagcaatgatctgcttaaagaaaatgaagagaacaggaggaaaggtcatatgtagggtttgttagtaacaatggattattaacagagcaaaagttggcacaagggatgatatgaaaatacaagaatgcagcagagaacacaaagaatattcagatgaattaatgaatttttcaaataatctcaatttaatattatctaattcaaagtacgacagacataaaggataaaatacacaggcttgtaatacacttttttccctttggaaataggaacagcaggggttaatcaatagaacagatgaatttaggatcaaagttcaatggtgtggggagggaggtgggaggggggttcaggaaggggaacacatgtacacctgtggcagattcatgttgatgtatggcaaaaccaacacaatattgtaaagtaaaaaataataataataaagaaatgataaatggttaaaaaataaataaataaaaataaattcaatcataaaaaaaggatcaaagttcataagctcaaattttcatagagtacttaggaagaataaatatatttgaaagtgctttggaaactttaaatgcctttgaccttttgggaggatcaatgaattagcatcttaatagactttttcctaaacagaaaatt

SEQ ID NO: 24686 - DNA, 1608 bp, Bovine  19866880915294
acttgcttttctcagaggatagctagctcatgaagttgtgttactcaaagtcatttctaaatttaatatcctgactgactagtggaagacattgttattgtgggccatacagactcaaataagaaaattgttttttttgttttctttgacatcttaacagtgactagggcttcccttatggcttaggcagtaaagcatctgcccgcaatgagggagacctgggcttgatctctaggctgggaagattcccctggagaaggaaatagcaacacactccagtactcttgcctggaaaaacccatggacagaggaagcctggtaggctacacaccatggggttacaaagagttggacatgactgagcaatttcactttaacagtgactaaatgtgctaccacttcaggcatttagtattggtgctcagactcagtgagaggaaaagggactttctcggtgattcagtggtaaacaatctgcctgtcaagcaggagacatggattctatccttgggttggaaagatcccctggagatggaaatggcaaccctctctattcttgcctggaaatcccatggacaaaagagcctggtgggctacagtccatgaggttgcaaaagagtccgacatgacttagtgactaaatgacaacaatgatggagaggaaaacaaaatcattttgcctttatctcactgagtgagataaactctagtacaaatgtaaactgttggtggatatacaacccatatgaaaatgactttttgacaatagcctctgctgagaaaactgcttgcattgcattgaatgttatctaaacacaactaaaaaagacgaatgggctttgatgaaggacataatctaagacaccaccacccaagtgctcactataggagctatctaaagtataacccaagaacgttaaaggcaagctgttaaaaactactcaggaggtccaacacctgattagtcactctgagtactagagacagcacatctactccctggaattctataacaacctttatatcaagtcaacagacatatggtcaaatttaagtggaagtccttatagcaagaaactttgaaaacagcacagaaaataacaaaataagctcagtcctggattcctctgtgttgtgttttaccactgtatccagagctaactacaactctattccaaattagctctcacccagattattgcagatacagcttcctaaatgtctccctgctttttttttttttctttacaatctattctctcataagcaaccagtgtgatcttttaaaatataagtcagatcatcccacttatctgtgcaaccccctctctgacttcccatctcattcagtaaaatgtaagattcctacatagaactctcacaacctggtacccaatcaagggtcagaccttatttcctgctgttctccccttgcttattctgtttcagtcatgtagatcttctagttttaaagagaatgtaccaggtgagagccaggttcagagattcatgctgactgtttctccctcctagatttctcttaacctttatattcaaaaaacctcacttcttcactccttgaagcttttttcttttctcttctttttt

SEQ ID NO: 24687 - DNA, 780 bp, Bovine  19866880917315
tgaagaagtttaaagaaagaatctgctacttctaaaagtgctgaaatcatcagaggaaaaatgcttctttttattctattcttaaagtttgcctctgtcatctcaagggtttctcctgtcagcagcagtgaaagttctacgtaggaatgtgaatacacacagatatatttcaaaacctggaaaatttaacctaaagtacattttagctttggagtgccctcaagggtggaactgaattgctcaggagatgaataatgggattcattactatgaccagttgaaatctaacctaacccaaggtattcccatgctgttgagcagcttagaaactgtgacgaataatgcagtcctgcttcaattgattttttatcctaccactgtagccatcaacaaacaggtattttctttctaccaaaaaaaaaaaaaaagaggtgcatctgtattcattgaaagaggaaaaagtaacaaaggccatcctcttgcatattcagatgatctttgttttagctcattttagttctatgacacaaaaaaagtgcttatttatcatgcactctgtaaagttagattggatcaatatcttatggatgtaaatatttacctatacaagttgctttcattattgtgtctaaaaagtcatatgactgatgttaaatcatcaattaagagacaattttttgtcctttactctgttacacatgcaaataaaaatatgttatataaaacataaattcaacactggaaggccaccttttctttatagtatggaaaagttcaaag

SEQ ID NO: 24688 - DNA, 1165 bp, Bovine  19866881077359
tgtgcaggactgagaacttggtaaatgggcctcaggaatagataaagcttgtatcagattccacttctaggaatttagccatgcttttacatgtgtgccaaggtatatggaaaatcatgtttggactactattacttgtgaaaacaaaagatttgaaacaaacatctatcgggagaagactgattaaaagtattacagcttatctttgagatggaatacagggcagtcatccaacacaaatacaacaaactaaatgtactgatttggaaaaattcccaagctgtattattaagtaaaggaaccaaagagcataattatgtgtgtaatggttttccatttgtgtaaaaaagttaagggcaataagttatacatgcacacacatgcataagcacacacatgtatgtatgtatgtatctacacgcacaccctcccatccctgtgtatctgtgcttatatttgcattggacatttctggaaggaagcatgtaaaatcattactagtactgcctgtgggaatggacgagagatctggggtaggtggggcttaccctgcatcgttttgtatgccttgaattttaactgtgtacaagtgtcattgtcttgttggggaaaaaatagtttgctgaccactgcgtgagtgtgtgtggtgtttgtttcaggtccgggtggtggtgccttaccaggggccgtcctctgactatgtcgtggtgaggatgatcccggatagccggcttcctccccgtcacctgcacgtggtccgtatgggcaaaacctctgctgtcatcaagtgggaatccccgtacgattctccagaccaggacctggtgagcaggccaggcgtgctggcgaccttgcttattctggacgtggtttggtttgggggcaggaaaccgaggcctggtgcgtggagctcagcaggagctccccccccccgccgccccgccatttccgccaaagacagggtcctcataggtatctcctctttgctgtcatgtcctggctgctgtattggtttgttcctccttttctctgccttcgccaacagttggcctgtaggttaaatctagcccactgcctatttttctaaataaagttttattagaaccaagttatacccatttgtttacatgttatctaggctacttttagctacaaacaagagagc

SEQ ID NO: 24689 - DNA, 1466 bp, Bovine  19866881111001
ttatccatcttcaactattcttttgattaatgggtcatataatctataatttaacatttaccataagattattacctttccttgataaataaagcataaaacagaagtaactctgtatcagaaataattttctacatggatctttaaaaaatggaaagcctattatactgtacattcttaagtgacacaaatataaaaaaatgcattgtgcattttcttctgtttgttacataatttagtccattgttaaaaataatggattattgctttacagagcaacagattatttaatgagttaatatagtccagatttaagcatttaaattctaatattcaaaatgctatccaacctatttctttcataataaaacttctaaaggtcaatcacactgaaggcaggacacaactctacatagtctgaattctagatttgctacaaaaagaaaaagcaaaaacaaacccagcatcctgaattctttattagcatacatgtttccccatagagcattaagcaagtcacttaagtcttggagctatgcctctcttgtttacttaatcattgtatttggatggacctcaggactgcctatctcagtcttgtttctatttcttttgaaatctcccaaacttccctggggttagccaaggaaaagaggcaaaataagctgaaaggaagctgataacagcaggaatgaaatattatatttgttttgttagaaatacaattttaaaagactcctctcatcgactgaagtatgtgggcccattacattcccaatgttatcctgttaaattattctcctcatttgatattcttcaccacagcaaattatgctacataaaatgagtcttaactttataagtattaacatgggatattctcagactaaatgtttccatcaagtgtacgtgaatcttgctggcactcaagactcatacttcaagaaatggattttctcatacaattaaacataagcaattgcgagttaagcagatttctattgcctcttagcagccaaactccagtgggggtaatgtaggcagagctttaacctttagaattgtggctttctgccatgcccatgttaaagcatctatggtgagggggctgggcacgtgtgataatgataattaaatattacactctaaatatactgagggaaatggttgtggaagttaattagccatatgcagcctaaaccacttagctttagaagcactgcaagcaccgacagttacttcaaaaagagaaatggcaggtgaaagtgtgaatctgcaaaggtttaagtggaatgatttcattatagccaccattaccactctggcttaaaactttctcaacactgactgtcaagttgcaaattgtattcaacatttactatgcctctgctaccctacaatcagtttcctttgtccttttccctcatatttttcaaatagatgcatatgtagatgcatttttttta

SEQ ID NO: 24690 - DNA, 3530 bp, Bovine  19866881236461
actgatacacccgtgttaaatgtctaataccaatctatctcattctgaaattctgctttataccactatgctaggggcagcaagatttggcttcaggcagcacaaacctgcatagagggttggggtttagtcctttaagaattaaggcaaaaaagtgttataccatggtgttaggcaagtcagaaagctgaattggttgacctggaatttaataagtagaaaagagttgtcccataatagagataatataaatatggagcagggtagccactgggttaacccaagaccctgtagtactggttgtgagctttgattccttaaattgcaactgctgattagaggacagaattaattcaggatacatatatgaatgatgtagtttcatatgtggactaaagcaggtcttaaagcaagaaacatattccaactataaaatacagttattgtgagagcccattgtgacaatacatattagaataatgagcaatcagaagctcttttaagattgttattaaagttattgcagtgatcaagaccatccccaagaaaaagaaatgcaaaaaggcaaaatggttgtctgacaaggccttacaaataactgaggaaagaagagaagctgaatgcaaaggagaaaaggaaagatatacccatttgaatgcacagttccaaagactggcaaggagagaaaagaaggccttcttcagcaatcaatgcaaaggaatagacgaaaacagtagaatgggaaagactagagatctcttcaagaaaattagagataccaagggaacattttatgcaaaaatgggcactataaaggacagaaatgttatggatctaacagaagcaaaagatattaagaagtggtggcaagaatacacagatgaaatatacagaaaagatcttcatgacccagatgaccacaatggtatgatcactcacctagagcaggacatcctgcaattcgaagtcgagtgggccttaggaagcatcactatgagcaaagctagtgaaggtgatggaattcctgttgagctatttcaaatcctgaatgatgatgctgtaaaagtgctgtgctcaatatgccagcaaatctggaaaactcagcagtggtcacagggctggaaaaggtcagttttcattccaatcccaaagaaaggcaatgccaaagaatattcaaactactgcacaattgtactcatctcacactctggcaaagcaatgctcaaaattttcaagccaggattcaacagtacatgaaccacgaacttccagatgttcaagctggatttggaaaaggaagaggaaccataaatcaaattgccaacatctccttgattatctaaaaaacaagagagttccagaaaaatagctacttctgctttattgactataccaacgggcttgactgtgtagatcacaacaaactgtggaaaatacttaaagagacgggaataccagaccacctgaactgcctcctaagaaatctgtatgcaggtcaagaagcaacagttagaactggacatggaacaacagactggttccagtacaggaaaggagtatgtcaaggctgaatattgtctccctgcttatttaaattatatgcagagtacatcaggcaaaatgccaggctggatgaagcacaagctggaatcaagattgctgggagaaatatcagtaacctcagatacacagatgacaccacccgtatggcagaaagcaaggaactaaagagcctcttgatgaaactgaaagaagatagtgaaaaagttggcttaaagctcaacattcagaaaactaagatcatggcatccggtcccattacttcatgacaaataaatagggaaacaatggaaacagtgaaagactttattgttttgggcttcaaaatccctgcagatggtgattgtagccatgaaattaaaagacacttactctgtggaagaaaagttatgaccaaccttagacagcatattaaaaagcagagacattactttagcaacaaagggtccatctagtcaaagctatggtttttctagtagtcatgtatggatgtaagaattggactataaagaaagctgagtactgaacaattgatgcttttgaactgtggtgttggagaagactcttgagaatcctttggcctgcaaggagatccaaccagtccatcctaaaggaaatcagtcctgaatatgcattggaaggactgatgctgaagctgaaactccaatactttggccacctgatgtgaggagccaactcacttgaaaagaccctgatgctgggaaagattgaaggtgggaggagaacgggcaacagaggatgagattgtcggatggcatcatcgacttgattgacatgagtttgagtaagctctgggagttggtgatggacagggaagcctggcatgctgtagtccatggcgtcacaaagagttggacatgactgagagactgaactgaactgaaagttattgctgttataattatcaatagtctacaacttgcctttttgaatttgtgtataataatctttcacatggttgttctggcataatgctgtgctttacaagtcttatttcttaatgattggcaaatgctgacctattgttttctgaatcatcagacacagctggtatattatgctttaattcacaaactctgcaggtaacagtggtttctattctattacatttgagtttctgtagactagtcacaacataatcaacagtttcctcaattctatttaagagggcatggaacatgtgtgctgcccaggaataggtagatattttaagtaacttaaatatttgaaaaagaaaattcaaactaattttgttaagttgctctttgatagaaagactaatatcttatgtagtaaagataattaatgtcaaagtttttgaaatggggattctctggtaatttcatgcatgcaaagattcaaatagtagagctcatgatcttaataccacagatattgtaggcattcaatgagaatattttactaataaatgtaggcatgagacatgcagtaacaacagtgtctgagattttatcttacctggtgactcagatggtaaagaatctgcctgcaatacaggagacccacattcgatctctgggatcgaatgggaagatcctctagagaaggaaatttctacccactccagtgttcctttctgaagaattccatggacgaagaaacctggtgggctacagtccatggagtcacaaagaatcagacttgactgagggactaacacctcacagacaaaatattaccccaaatttctgactgatagctctgccatgactttattaaggcagaaatagctagattaaatcagtgctatatttaagactctttgatgataagtggggcttcccaaatggcactagtggtaaagaaccttcctgccaatgctggagacataagatgcaggtttgatccctgggttgggaagatccctggaagagggcagggcaacccactccagcattcttatcggagaatccccatagacagaggaa

SEQ ID NO: 24691 - DNA, 1036 bp, Bovine  19866881435853
cagcttatgcttcctccagcccagcatttctcatgatgtactctgcatataaggtaaataagcaggatgacaatatacagccttgatgtactccttttcctatttggaaccagtctgttgttccacgtccagttctaactgctgcttcctgagctgcatacaagtttctcaagaggcagatcaggtggtctggtattcccatctctttcagaattttccagagtttattgtgatcaccacagtcaaaggctttggcataatcaataaagcagaaatagatgtttttctggaactctcttgctttttcgatgatccagtgaatgttgggaatttggtctctggttcctctgccttttctaaaaccagcttgaacatctggaagttcatggatcacattttgctaaagcctggcttggagaatttaagcatcactttactagcatgtgagatgagtgcaattgtgtggtagtttgagcattctttggcattgcctttctttgggattggaatgaaaactgaccaaatgagatgtatatacttcttattttgtgtttttctgtattgtagagtcttgcagtttttcaaaaattgttagagctagtacataagttctagtgtaaaataaaatctctttaagagaaaaatatcaggtacattttaaccatatgtctttcaaagaatacagtgtttaaaatacaaacagcattctaaaagtatcataattttataggcttggggaaaaaaggctataacagaatgtcaaaatgcaggtctcaaattgtcatagaagtaaaatatgatggattattcctatcagtatactagaatctatattcttttactgaatatgtattttcaaagtccagcaacaaggctgccataaacttccccactgtttaaaagtgaacacatttcaactgagagcaaaaattttgcactatctgactttagatatgagaaattgaacagttattcttcagttagttgactgtataactgtaagggagatggcctggaaactagatattagataaat

SEQ ID NO: 24692 - DNA, 2324 bp, Bovine  19866881456198
atgagttgcattattctatagacttatcccattctacatgcaaaatgaatacaaataaatagataaaccaaatataaaatgtaaaattgggaaaatttatcacttccaaatataaatggcaagatcaggaaaaagagaacaaaatttgtgctggcaatagaagaatatagcaaataaagaaatctgtaactttatattttcaataagcattttagatgggctttgttaaggcaccgatgcactgaaatgagaagtgtgaattgtataatcatctccattcatatacgttgctgctacaggctagatatggtgttcatttatatatttttctttctcctgaaaatgtcagcattattttattcaagcaaaatcacagcattagttcaacaactaaagctacatctggctgatttacttgcaaaaaaaaaagtggttgcaatttattcatggatctgaaagtggtcaattagcctctgaaaaatgaactcttcaatcatgttagagatcattattgtcattgtcagagaatttgcactaaatgggcttcccaggtggcgctagtggtgaagaatccgcctgcagtgcaggagacatcatgagacacgagttcaatccctgagtgggaaagatcccctggagtggggcatggcaatccactccactattcttgctggagaatcccaggacagagaagactggcaggttacagcccatagggtcgcaaagagtcagacacggttgctgacagcacacgcacacacatgtgtgctaaatattagtggatacattgtgacaggagtggactcagtccagtcgctcagttgtgtccgactctttgtgaccccatgtactgcagcacaccaggccgccctgtccatggcaaaaacacccaaagcttgttcaaactcatgtccattgagtcagtgatgtcatccaaccatctcatcctctgtagtccccttctcctcctgccctcaatctttcccagcatcagggtcttttccaatgagtcggctcttgcatcaggtggccaaagtattggagtttcagcttcagcatcactccttccaatgaacacccaggactgatctcctttaggatggactggttggatctcctttcagtccaagggacgctcaagagccttcaatacagttcaaaagcatcaattcttcagtgctcagctttctttatagtccaactctcaaatccatacacgactactggaaaagtcatagctttgactagatggacctctgttggcaaagtgatgcctttactttttagtacactatctaggtttgtcacagcttttcttccaaagagcaagcatcttttagtttcatagctgcagtcaccatctgcagtgattttggagcccgagaaaataaaggctgccactatttccattttctccccatctattatgtcatgaagtgatgggaccagatgccatgatcatagtttcttgaatgatgagttttgagccagcgtttcactctccactttcaacttcatcagaggctctttgcttcctttttgcctctgccataagggtggtcttcatatttgaggttattgatacttcttgcaatcttgattccagcttatgattcagcatttctcatgatgtactctgcatataagttaaacaagcagggtgataaaaaacaccttgatatactcctttcctaattttgaactggttcattttccatgtctggttctaactgttgcttcttgacctccagacaggtttctcagaaggcaggtaaggtggtctggtattcccatctctttaagaattttccacagtttattgtgatccacacagtcaaaggctttagtgcagtcagtgaggcagaagtagatgtttttctggaactctcttgctttttctatgatccaacaaatgttggcaatgtgatctctggtccctctacctttcctaaatccagcttgtgtgtctggaagttcttggttcacgcactgttgaagcctcgcttgaaagattttgagcatcacctagagcctctagaaaggaccaaacctgttgacattcttacttcagacttccagtctccacaattgagagagaataaaattctgttgtttacttggctctgtttgtggtatttttgttacagaagtactaaaaaatgaatataccatctctataatgcttagggattgtggagtaatcccagagcatggcgtggcttggagcaaaatcaagttctcctatggatatactcccttctgtttcctttagacagttgctcttctagctctggctgtggttcctggctccttctgctccagta

SEQ ID NO: 24693 - DNA, 3066 bp, Bovine  19866880549475
taaccagtgaagcatggtaagagacttgagttgcatatagcttccatttgcccctctgttttctctttggggcagatagcttctctgactgtgaagatttaaaccaaggggaaaattttcaagtctcctgggtttcgttttcaggaagattgaggacatgatcagaaagtgctttcttttcactaacatgagggggtggggggctgtcagctttcatttttatgctggtagatatttttgatgtacagtttcattctcagtgcttcctgtttcagagtctgacaaagaggagaaaccgcagagtgctgtcatacccaaggaagtgaccccagcgctgtgctccctgatgagcagctacggcggcctctcggggtcagagagtgagccggaaggtgagcctggctccgggtggtaacagtgggtgtggctcgctccactgttgcctctgatgtacactgtgcatcagtagcatcctttcacgtgtatgtatctgaggacgagatgtgtcttgcacattcttaagttgagcctcaaattcctttctcatttgattccgaagttaacatgggatgaagggacgtgggagagatggagaactgtgttgctcctctaggagaaaggggcaaaaataacataatgaaagaagaggaaggggaagagatatccactagtgaaatcagagaaaattctaaaagataaagcaaaggaagttaatactccttcccactctcaagaacccttgtcttaacacgtttcgcaccttttgaagctggagaggggtcctttatgacaaagaggatggtaaaattccttacctgtatatggggcatcgctccttatagagcacatgtaccttaagctgtctccttcggagaacacgggaatcgtatgtgcttgtgttgcattagcctgtgtattttaaaggttgggagacatggaatccttttgatagtgtttctgagaagttaatgttattcaggatacatgttttaaccttaaaaggtgatgacaaactccccctccccccaaaaaaagcaatggtgataaaccaactcaatgtctggcatctcttctagggcctcctaacagggctacgagtaggcttggcagtatgggcaactcgagccaaggttcacaccagtaacccagcgttggtttcgtgaataaccgtgtgtcctgtcgcgcctctgaccctggctctgcatggtctttacatctgggcttcaccagccacgagagaattctgagtgtgtgtctcacatgcatcatcacagtaggggctctaccgaagacaggaatagagggtcttcaaagtgaaaatgtaggatgaaagggaggtttaaatgtaatgggatgaagatggcaggacttttaatgttgactaagctagagaaaatcaatgtttatgtagttggaaaatgctgaagaagaaagagttgggctttaatatgaaagttaaggtttagatctgggtatctataacatacaggtttttttttttcctctttttgaaaggccaagctttaccatgttaactggttaaaggctgcttgaattttgaaatataatctgctttgggtttatcagaggagtcctttacagatggttgcctcctcttcttttttttttttttttgaattttaagaaaaacagtatttagttccttactcttgtttctagtacactgatatgaagatgaagttattctttaaacacatattacgtttcctgcttatcttgtgtatttatgacaggtgatagcaaagaacactattaccagattactgaatcccataaaaacaagccatacaaatgctttcctctctcattcctaagataagatatttaatagttttatactcatgtcttcattttgagactgccactttgaggaggcagagaggaaactggaagggatcaagttttcagccctttattttatagacgctgaagcttcaagaggacacactggcaaaactagtatgtggcaaagctgacgtaaagcttaggtctaaaggagccaactgcattgccttccgttacatctttctttgtgtggcaataggtggtgcatagctattcttttgactttgtatgaattcagtttgactgattgtctaaaatgtcttgccttcaggaaaaagtccttgcttcacattcctaagccttaggaattattttatgtaatttgaatttgcttttattaagccatccaggtcactagcagatttctagcttgcagtgttactgggctatagattgggataggctattgacacagcaggactttgcaataagtgaaacaaggaaataaagtgagccttctctgaaccatgaaatagcatctctgttgtttttgttttagtctctaagtcatgtcctacttttgtgaccccatggactatagcctgctgggcttctctctccataggatctcacaggcaagaaaattggagtgggttgctatttgctactcaaggggatcctcctgacccagggatcgaacccacgtctcctggagctcctgcatttcaggcggattctttacagctgacccactgaggaagcctgtggttatcaaccattagtatggttattaaccgtgtactattttcagtatgatgtctcagggaatagggaggcctgaggaggaagagagagagaggagcatggcaggtagggggagcaggcagaacataacattgataagttgactgtcttatatggacatggttcatggtgaccccaaacagttataatagtagtatcaaagatcagagattacacatgcccataacataataacagtgaaagtttgagacattgagcaaaaatcatcagaatatgatgcagagacacgaacaaacagtgttggagaaatggtgctaacagacttgatcagtgttgccacagaccttcaatttgtacaaaatgctttgtctctgaagaccattaaatcaaagcacagtaaaacgaggtgttcctgtaatttaagaattttacagcagtatgcttaggttttcctcttccctccctttgtgctgtgctactcaggttttagttctg

SEQ ID NO: 24694 - DNA, 1262 bp, Bovine  19866880557629
ggattcctggaccactgtaagaatgaggataattagtgcctaaaacttactgccatgagaatcaataggaagccttgaaaagatagagatgctcaaaccaattcttcagagactctgacctaattagttcacagaaagatctggatctcagtacttgttaagtctcccaggtggttctaatatgctgccagtgttaagaactactgaatttgataagtcgtgtaatgagacatgtcttcatcttaatgttttacatctttataaatttacatcatcctcactttttcctttgggattcactatgtgtggaaatgcagacatttaaaattttatttaatgtaatcagatattattacaaacacactatcaaactattactcccatgacacaattcttctcagcaaaataggagaaactataaattagaatttttataggaatatagactgccaaacagtcatataaaatctaaattttgattcagcatgcccagaaaaacataaatcaggcaaaggtatcttttaatttttttcttgtgatttaaattataacactgtttttatgtcagggaaatgatgtgtagtcaattgtgtgctagcagaatgactcataccagagatagggaagggataatattaaatccacaaatctttcctgtccatcaaggcccatatttttgtagatgttttcattctagcttaagaaagaacatgtcttctgaatgaccaaatgcaaataaaatatagtacagccatgatttctcattttctaaatttataataactacttaagttacaagaagggttacaagtatatgcataaaaaactggagcatgcatatcctcggttctgaaacccaaagattatgctatttctaaaatgcatcattgctggcttgtattttccaatgcctattgagatagtcctgctttggaaaaacaatttctttgcctctgtaccttgagccttcttaagtatatcaggtcactggatctcaactgggattgatctttccttccaggggatatttgttacagattgagggcatttttgttgtcacaactgagagaaggaagttgctactagtttgtagtagatggaagtcagggtgctgctgaatattccacgatgcactgtgatatccccctccaacatgtagctagttcagttcagtagctcagttatgtctgactctttatgaccacatggactgcagcatgccaagcttcccctccatcacgagctcccagagcttgctcaaa

SEQ ID NO: 24695 - DNA, 2000 bp, Bovine  19866880582390
tggaaaccataagctagggcagtatgtctaagcctaatcaaagcatcacagactgtgaactattattaacctcacatttcctcttaatctctgtgatttctgagcacttactttacacatagaagtaatatatctcctttcactctgatgaatggtgaaattccttcctttgacactactgttcatcaaatggtgattatccttcctatgtaaaaataacaaacttttaagaaagtgacctgctgtagcatatggcaatttggtaaaatagtatagttctttatagttttatctaaatagactatggataaatgtaataaacttatgtttgtgcatgttcagtcagagttatctctgactctttgagaccccaagcctgccaagcttctctgtccatgagaattttcaagaaaggttttactggagcaggttgctatttcctccttcaggggaccttcccaacccagggactttacccacatctcctgcatttcctgcattggtaagcagattctttatcactgagccaattaagaagtccataataaacctgtttttttgtgtgtgtaatttatatatactataacataaatatcaaaaattcctaaaattgataaaaatgaggtgaaattttgcacactttgtgtggcatagatgtggaacccaagtataagaatgaaaacaggaacttagtcttttatcttagaatttataatttgagtttataatttatcaatttaatgccacacattttgaacactagccctctcatttggtataaccagtatgatgtttttcttgagtattattgtgctgaataatattgtgctgaaataatatcataattgaaacaatgttatagaacacagaaaatatttttatgaaagcaaactcagtgtgaaagtaattatagctatctacttgaattatacattttattcaatcatatcacttcatttctgagtttatatttaattgaaaactattcattatgaagtattaatagttcttttatttgttctattcagtttttctttttagccatctactttattgcttttggttcactttataaataatgctgttttaactatgaacgttactgaaacatattatttgccataatttgcaatttcaagaacatgtttgctgctcctttctagaattgtatgtcttctttgagccttaggatatatttttaatttttaaatgtgattgttctatgctgctttataatattgtgtagtataaattaaattcaaagaagactggatcctgagttttaaacttataatataataactgcacagctgagaacaaaccaaattttgaggcaccgacataataggaaaatgaattgggtatcattgttaataaactcagccccactggaacaaatagtgaagaaatcccattcacatcacaaggtcttggaacaatacaaataatgcataatgagatcggtgcctaacattgaaataaaaagcattcaataaatttatattgaacaatctatgtgttttctgctgtacactaaacattgctgctgctgctgctaagtcacttcaaaggattcttaaacaaataaaatgctctttttactcttaacttactttctgtgtgatgacatattatctaatcttagaaatacaattatagttcttcctagttttcaaagaatattaaaatcttgaataaggccgtgactttaatgttttatccaatgagatatagtagctcatacaaaaggagaatcaatgtatttgcttctctcttgatccttcctttttctgagaaaaataatcatcatcaattgatatttgtcaacaaatgatatgtccaaacttttttgcttatttttaacaattttttaaaggaggttaaaaagccaagaaactgcacaactgttagattacttctaaacttatactagttattttaattaaacaggttgtagaataatggggaaaggggaaacctaccatttagttaccttgcag

SEQ ID NO: 24696 - DNA, 1271 bp, Bovine  19866880682236
ctggaaggtgggctccgggtataaaaacttaacattgtaagtaatgttgtctccatctccataacatattaaagcacatttggaaaggggatgatcatgttcagcaatatgtctccatttaaaattttgtgacagattcagtcatatacttccaactctgaaaattttaataagaatcagaatataccaaagtaaaactcaattatattcttgtgtcagatcatttatttcatgacatgattctgtgaaagcaaacaatgtaaatattagcctgaaacataaaaataatgatagctatgggaaaacaactctattttctaaatgaggaaattatatgttgagaacatcatgtttttagaggtataagaatacagcctaatgctattgcttatgtcacaccagaaaacaacaattctatcacaaatatgattaaggtctttattcttcacatgggatcctgaggctaagtgactcagacagtcaaacccatcacctgcagttgatttaacaaggacaatactaataaaggacttacattcatactgctcactttaaatacatgtctctagaggaactcacaggcagaactggattgataaatatttcaaatagcctttatctaggagttctgagagtttcttattgacaatatcaaaggctttagggaggtgctctgaataataaatgtgcaaatacagttatagaaaggtctttgaaggacaatgctttttaatttaatagatgggttataggatgaggtagtgagcagttagccagggaatctaactctgatgaaagagtgccaactctatgactcagaatgttaccttataagttattcagaatattctgagaagtgatccaaacatagaaatacctgaaatgtcaacgttgaccccatttacataaatcatatgccatgagtctctggatcttaatgcatactccaacaacacatacgctgagaccttctggagggaatagacactagcatctgattgaaaggatataatttcacatagttggatgttcattttaacaaaacttgatgcattggccctgaaaggttttagaaaaagcaggagaaaaatataataaaatcgaattaacttacaacctttattagcaacatattgcaaaatcatggtatagtataagtttgggaaaaaatttcctctcattacttaatcttccaacttatttaatcagccaactgtcaattcaaacaggcttatggaattcttcatgacaaggctctgtgtttggaaatg

SEQ ID NO: 24697 - DNA, 1080 bp, Bovine  19866880688639
acagaaaggaaaatttctgtctttgtaagctctactgtaaagagagcttgaagactttaaacatttttaagtttttatttagttaagttttgtgcttctgagaaaaagcctacatttcaaatcaaattcattttgacatggctatatcagccacaccataggaattcacaaatgagtccacaattttttcaggtacagtgtggggacagacatttcaagaacatccctttacctgttttgggtaaaaaagtaaaactttcctcactaaatgagggctttttctattatcacaaataaagatatttgaattaataatgatagtatatataagcatgtatatgttaatataaatatcatataataagctttttttttataatttacagttcttggctgtttatatattatgttaacaaactgtgtacagcagctgtgtgccatatattgaagactttttttctaggtataaagttgttttgcaatgaaagtattctccctcccctttagataaactaatgattcctttaaaagcttaaaataacattatctactaactcacactgtgggttattggctaactgctaaacaaagtaacttatcaataaagggttttattaagaagctagtaaaaatgaagtacttgtctgtttgccaatgtcattggcatttaaaggataataagacatagagaggtaatcctataggttgcatgggaaaagaaaaagactagtatgtctttataaagctgctgcaggtacatgatttgaagtgttttcagtttctaatctctacaaagcagtggtatagaaatgaaaaaaatatatatatatatttttttttttctgtaaaagggcaactaatacatggctttttaatccttacaatctgttgcaattgttctactattatattaaaccagccatagatgatacataagcaaatggtttggttgtgattcagcaaaattctatttataaaaacaaatggccagctggatttgctccatgaattgtatttttccaagccctgaaataaaatattaagttattgcctacttaatgtgatgatgtagtacttata

SEQ ID NO: 24698 - DNA, 1943 bp, Bovine  19866880718742
ttgattctgtcctttcctacgtagagctgagaaaagccttacatttccttaagaactgatactttcttccataattacattcattaacttatcttctggttgtttgtgttaacctcaaaaacagatatttggaaacagttgcatccttaaaactgaccttgaaattaaaaaaaaaaatcattgcttatgtacattttcatagcaactagttagcccattttgtattgaaatagaacatattaatttgattgggaacacgtgtacatccatggcagatggatgttgatgtatggcaaaaccaatacaatattgtaaagtaaataaataaattaataataataataaataaataaataaatgtggcaaaaatttaccactgtatctaattggcctcccctataataaggcaaaacttgtgcttgttagagtatatttgccccataaaatatataaaaagtcagtggctcagaagaatacaaaggcaacaagaagagggcattgaatataatggtccaacaacctcatattttattctggtgtatactaatttattttttaaatgagaaaatttaaactattaaataattatgataattcatttgtcttaaagtggtttgtgggcatatctggttaaattttgagtttagcaaaattactcttttatatatcttcaacattatgcattatagaacaatgtaaatgtgttgttttcaagttacagaatctaaattttttcaggaaaattatttaaatgattactattaaaattacaagcatgtatatgactagtatggaggaagaattgattatccactccagtacactcacctggagaattccagggacagaggagcctgatgagcgtcagtccatggtgttacaaataactggacacacatgagtgactaatgcacacacacatgtaagcaataactacaggaacagaattaaacctcatattcatgttgaactttacgtttttctgtttctaatctttagtttgtttaatcattctcttgattttgatagtaaaagccctcttatataatcagtataattgactacacaggttgaaatcatactattattaaggaaatattattattcactcctaaaaataagcaaactgggatatatacattttacactgagaattttttttaaatatatgagcatattttcaactgcaatgcaaaacaggagatgaagaataacttgcagaaaataaagaacacccagtatagtaattatattattcaatgacagagaaattcaggagcagtggaaaatgtatgatactaggaaggatggtaattgctatggtatgctgagttctgtatatttatttcctcaaatgcaccaaataaaatatgatcaaactatcaaaaacaaagggcatgcattttaaagtggtttaagtcaacataagaaattttatgaagtcatccttatttatttttgtaacagaccttcaaattggcatatccacagagtgtgtcaagacaagaggaaaagatatttttttctgggcttccatatttatcaactaaaatgacttctactcttcaatctgccatctgttgtgctataaatctaacaagtttaaacatctttattttttgtgtaattatgatttctttgaagtgtggtttctgtttcaatgtcaaaaagtacattcaagaaatgtttttgtttatggtgtatttctgagtagttaatgattattttgcaaagataaaaaatatcatcctaaaattactttagtatattaagggatcctggatgaccaaaacaattttgaaaaagaacactgacttcctgattttagaacttactgcaaagcctagaatcaagtcgtcacatacatggtcaaaggatttttgacaagggtgacaatgtagggataagatggtcttttcaacagtgttgggaaagctagatat

SEQ ID NO: 24699 - DNA, 1976 bp, Bovine  19866880757769
aattgttttctctggtaaacttaatagggagtgcctgcaaatcattcttataaagtaatgccatgaggtttgtatatatcctacctgttgcataaattaattacactatactggaaacaatatattgatttatttttccatcaatatatcctgaagtctctttgcattttgtaagatgacagtgctgaccataaacaaggagtattttcctttcctgattactttatgctctaaatagtatattttattaagctcctggagagaagattactttttaatattactcttatagcatgtatgtgtattttgagtggtatatttttatctctttaataatacctatttacatttggccattttgtggttttcaattgcttttggtaataaggattcacagcaatatttttttgataatgaagagtcaagctgaaattaaaggcagtcatgaattagaactgagaaagttagtagccctcctattgagatgagtattaaaactaattttcttgcatttcaagatgtaatcattcagtctacacaaaattcagtcttttctcaataatgaacttataaaattttatattggggagatgtaaacaatttacctatttatctttatttagcaacaagatatctattttcaaaatttattcttagaagataaattcatatgttttaaaaatcacatcttataaatgttgtctgcttataaaggttgcctgccttataaaggattgattgatcctaccaatcaaagcagaaggatgtagcctggccaagtgaagtaaacaacacagacacacaggaagggcaatggttttgtaagatgagcagcttgcttggtggacgtcttattcaaccatccagcatccacagagataaacacactagagtcagaaacactattaggcagtgtcagtaaagtcacatagaataatgcaggtggtccactgtctctgacatgggttctgagttatgctggttgttttcattcaccactataagcaatcttctgctttttccaggattttggggaacacaaggttctgggttagaatctaatactgaaagtgcactcaagatagttggaaggtagaaaagaaatacaaaggactattccttggagacagtcacaagcagctatgtgaacaaatgttcagcttaccagagcttcagagtgagtttttcagaaccactggcttcatttcaaacactgacatgaatagcgaaaagaaaagtggggagatcaccactgaccctttcatttgcagaaacaaaatagcctgggcatgaatctcaaaacgtcttactgattttccaccaaattattgacttacatagcacatacatgtctctctaattagaatcgcactcatggcaaaaagtttaatgactggttactccattccactgctttcttctacctttggggtatgagttgcaaacatcagaaaagtatctagcatttccttcatttggtatgtgatgcagcagagtaacttccctcccttgatcagcgacaattctctccttttgaacaccgagaagcacagtccctggaaagcccagctaaaagtgaaaagggatttgtcttctcacatttgattcttcataaaaatgatgtcccttattagagctgtctgcaagcttcgatgtgtttaatgggagaggagaaacacatattagaatttctattcaataatatgttgattattctgaatttccatttgttctatgttttataattaatataatattctactagtatgtaacttatagaatgcaatataaatatacatatattatgaatgtaagccaataaatttttgctgctgttaatcacaattaatggtatttgaggacaatgacttaaattgtgtcacatgtagtcatctgggaaaaagaaaggtactgggttttaaaggggtttattcatatttttccttccataattccaaaagattatgatttagggg

SEQ ID NO: 24700 - DNA, 1218 bp, Bovine  19866881023141
tccccaggaaggaaatcatcttattatctacaaaccaactcatgttcttggtcacagtcatatatctatgaaatgttccacatgatcttgtgcatgtaaactgagcacttaaatccccatgtctgcaatgtttacctgctagggtactagagcaaagcctgaaaaagaagataaaaattaaggtcttgaaattactttctgggatcatattctgccttctttggggcatatagctagaaaaataacaattatttacttgttattcttccagttcaacaccatccaggaatatcaagaatcagcagtttaaaatgtgcccttttcttctggccaataactagcctactgttaactcttcatttacaacaacataggctatatttaaaaaaataaaataaaataagagtacagttattggctatacaaatacagactggcagctgaggctgatagtagtaatgaacttgagaatgaaatacattgcggtgatttctttaatgttaatctaaacatgtaattatacacagctctaatttttttttctagcaaactttaaccagcatttgtttattcttaataatattcctcccagcaatctggagttcaatacaatttagacctaaaacctctaaaaactattgagtaaagaccatagaaattcaaacaatctttttaaagccaacccgagaagcagtgatcacttgtgcctgtctagtgtacaatttagaatgagcaattgttttggatcatgtagatatagactcaaccatgaaaatagcagtttcggtcaattgctctgagaaaatgaagaaatcccttgaaaagataaaagatgaagccagagtgctaggagcaatttgttaataattgctatgggacttgattggctcataaatgcttcactctgtcatatcaaccagttccttcagaggaagatacagacccataaaatagtttccatttactaataaagagctaggctggaaagacagaacatgattgataaaaagatgaagctatttattcacatttttccagttatgcagaacccttgccctctttcattgatttcagtgaggccaattccagtcctaagaattcttctgatatttgtgttctgactttctgcatagctccatccacaggtctgaatatttctggcagtcttctctgcagaatgcttcatgcttgggatttgaaggccatggcaaagatgag

SEQ ID NO: 24701 - DNA, 3077 bp, Bovine  19866881156908
actgggttgagttccccgtgttatactgtaacttcgtactaactctctatattcaaagataaccttgaataaccaactgaatagtaaagaaaaatagcaaagtagaagaattcacactagttgattaaaaagcttttaagaaagctataccaattatgatcatgtggcatttgtgaaaaaaataaaggcagatcaaagagaaagttactatacaaatttactatacaaatgcagcagacccaattcctctattgacaacatttaaatatgtctggttttatctatttaatcattatgcctacaattctatgtaatacatttatgcttctctttcttcatttttcaacaatagttatatgctgctgctgctgttaagttgcttcagttgtgtccaactctgtgtgaccccatagacggcagcccaccaggctcctctgtccatgggattttccaggcaagagtctggagtgggttgccattgccttctccactagagttatataattctatatatatgtatatgtatatatatatatatatatatatatatgtatactctgttggttgcttggctttccacacaaagaactcaaaactgcaaaataatataactatggaactataaaatcttgtctgtaatactttccctttaaagaaagcacttgtcatctgtttctcaggttatatatagatctatctcattttttaatttcttcttatacattattttacaagagtcaaatgatttctttcttctgtccctccctacaccttgcaggtgtatcttgaatgtaatgaataatatgaagccatcagatcaaagaagcttagatcaaaccactaacttaagagccacataatcaaacaaaggcagatgacaggaaagtgcaggtcactttttgtatggaaagcaaaataaataaaagtgaaatttccgcccttccctctcttgtttctgaaaaaaataaccttcacaatggaccagaatgaagagggttttctggaaaccccagagatttaaattaaacagtctgctgcagcaaactccagctttttcttgcttggtttgtttcttgccatggattgcagtctttcaaccacagttcagctctgccagcctagccgtccttgctaattagtgaactaaaagaagaatttttagtaaatacgtcagaaattaaagaccttaactaagccaagaagaaagtgtgatttgaatcttaattactgctgtctatgatcttcactttcgcagagaaagattagatgtcttgacactactttggattaaaaaggaccctaaataaaaaagacaaaaatctagtaaaaatattgggtttctaacaattaacaaaattgattcaaattctaaatattccatctctgacatcatcccctaaataaattacaagtgctgaatctgaaaagaatgatttattctgcagtttcaacatcagggagtttttgacaagcactactaaaagggctcagaaaaggtgttttaacaaagagaattgttgattcagtgcagctgtgtttttaatctgtaacatctggcttgcctctcagtacagtctttctaaacatcaaaaagagtttctttttcttgtcttgattattacgtcaactcttaattagcaatacatttgtcttcctttcagtcaactaaaagatgtgggaagatcaagggaatgcagcagaccccttgtctattgtatcaatggccttctagttcccctgagagctctgtttgcctgtcctcacaggcacaatgggaccacaggcacatcagagacaactttcatctaattcagtgtgccttttctatcctgccttattctgttaagtattctgagtgtttgtagtaaaagcagctaaaatttattgaaatgctttacttccatagatacactgaaataaaatcagtagagtgttacttacatcctgtaatttttatttgcactaatttgtatggcacataattggcctaattatcttaatgctttgcaacagaaagaaaaatacatctaatatttcctcctgcaaagatgaatcagctttgctatgtctaaataattcaaagtaaagcaaagacttgacagatatctggttagaaggatcatcaagaaaatggcttatttaatatataaattcctcaaatgccagtctactttgttgaagcacagtaatagattattttagctttaccaaattaaaaattgtataacttaaaatatttaagaaaatattactttgggaaatcaaaattcaccacatatcaaagaagaattgagctttgaaaatgcaaattgtctacatatatttggaatctaaatgatttatcttattttatatagacatcaagcttgaattcaattacacaatttgcaagatataagttaaagcaaataaatggataacgaatgaaaagcccaagtgcagaattgcacaaaacaaagtaaatgtcacagaaagacatatttaaatatttttctaaggagaataatgtagaaaaataaaaaaaaatgagtattagttattcccatattttattcctgttttacatttttatgtaaagtttattcaataaagattaataaaattgaaataaactttaaattaaaatgcaggatctataatatgtatttgtcaatttaaattcaacattaaataaagttatttgttaataagaacaaaaatcaagtaaaaaattaaaatgtatatatctgtcttgaaggaaatccatctccccacttaggtgatttttccactgcacttgctctttcattttagtttctattagtaaattaaaaatgataataatcatagattttaaaatctaatctgtacaataacattaaaataaaatgtatacaaatatattcccctttgtgttactaatttactgacattctttgtacattttaaaaacataacattcttgatttttttttctattcacaatgaattgtgccatttaatttcacagcaacatcagttaatgtgcctgttaataaatgatacatattttaccaatacctcaagtcccctactttacccttctttccacatgaaga

SEQ ID NO: 24702 - DNA, 931 bp, Bovine  19866881325515
aaataattggagctctatttaaggcaattgatgtgttaatcagacttgtttgcttcaaataataaagctacaagttaaaccaattttgagactaattttgccaagagtcagaggcattatttgcctctatgtttcaacaaatgtcttcattaaaaaaaaaagaaataaataattaccttatttcacttgtctatttaaaataattcagtattgagcatgtacaaaaacattgaaacaaaaaactaactgtatacagttacaagaaattatttctaatattaggattttttaatggaaagagaaaattttacatatgctttgatctttggtttaggtaatactgagtaactctaatgaggttagttgacagatatttattgagtatcaataaatattgaacatcaaccttaaataatttgcctgtagagaaaaattcagtatttttttatcacttttacaattcattaatacttatttcctgaatgcaagagttgcttttcctttggttctgaaggtgaggcaatagttgttatatttgtagtgtttgcctgagagatcagtacaatctgactctctgcaaccccatggactgtagcccatcaggatcctctgtccttggaactttccaagcaagaatacaggagttggttgccatttccttctcccaatatttgttgtattgaaagaatgtcatcaattctgtcttttgtttgtgcttttactttcattaatatttattagggtataatttatttacagtgttgtgctagtttctattgtacaacaaagtgagtcatccatatgcatgcatgcatcccctctccctgggtttccttcccatttatgtcaccacagaacactgagtagaggtcctgatttaagctgacagataaaaagggataggatttaaggtgaggataaaaaaattctc

SEQ ID NO: 24703 - DNA, 769 bp, Bovine  19866880551065
actgcataatactgctggactccaaattgtcaaacattacaaaacaagaaatgtttcaacaaccattcagcatgttttaaggacaaaatatatataatatacttgatattatatatgtattttatcacatactcagtaaagtatgccaaggtgattcatccatccaataaaattgaaaataaaaattttacatttctctacttgtcagtattcaggcttctgaaggtggatcttgaactcagaatggtcagtttttgaggaaagccacataatcggtgagtctggctaactgctgctctttggggatgggtggaacaggggcgggctctgataaggaaataaacctgttaaaggaaacatccagggcccctgcaactggcttcttgggcatgactatccttatggtggagtcggcttgccagccttgttcaaggatacctttcacagcctcctctacagggagtccaacaaaggctgcgaaatcgtcggcaatgatggaggtataggcttgggagaccagggcgaaggctcgtctccgggttgcatctctgagagcttccatgattggttggacggcctcagaccactgatgggcattgatggtgctgtagaccccggggaagtccctctgccagatctgctggccaactgaccagatccccccaagttccgagtttgcagattttatagcaggtggtattcttttccaaagatatcttgcattggtcatgtcattatggagtagatacaaagctagaagctgaccata

SEQ ID NO: 24704 - DNA, 829 bp, Bovine  19866880403744
tggcctctggtctctggtgtagagagaacccttaagcccttggagcctcagtttttgctgttttgaatcaagggtggtgggtggcatggaggggaattgaaaatgatgttggaggaacatagacggtctcaaaggtctgttccagtcctaaaattctttaaaatcctttcatttccttaggtgttctataaataaactttttaaaggttaagcatattcattctctttccaatcctttgccttaagagttttgatggagtgccatggtgcctacctgcttcttttaactctatttgtttacacctggacatggccaagggtgggggactggaattcattgcctcggcaccggcaggttccccaccagactgcgggctgctataaatcactttactaggttctatttcctgcaaattccttttaggtagtgggggaagggtggccacagaattcaaaacagatttatcgaaaggcctttgagaataaactgcaagagatgacccagctgcagagctcagtgagggactctcagcgaaaaagactagtaattagtttcatttgtaggtgaaagaaggtctttgaagatgtctggcattaattataatggtggtcactgttgccatttccaaatcctgctttttaagatcagggactgtcagtttagagacggcttagcatctcctcttaggaggaagagagtacttaatgggggcgtaagtggtaaaagttggacatgcagagcatgggcaagattaaatagcatgtcaagtcccattcttagaaaactcgttcccgaaagtcaaattacaggctctctgcttttgtgtaa

SEQ ID NO: 24705 - DNA, 3195 bp, Bovine  19866880410068
ctgagcaagatcctcatttctcaacagacaacaggggtgtaaatggtttgagagcctgagtggatgcgtgctaggtcactttagttgtgtccgaccctatggatcatagcttgccaggctcctctgtccatgggattctccaggcaagaatactggagtgtgttgccatgccctccaccagcggatcttcccaacgcagggatcgaaccagcatctcttatgtctcctgctctggcaggtgggttctttaccacctgggaagcccatctgagaagccggagactcagtttctccagatttttgacttaagaatgatttaggtttgtttattctccagggacttgatccacttaccactatttattaataaaccatttcagtagacagagaattggagttttatattgaactgggggggcggtttccagagtgtgggtgcccgtagttgactgctgctgccatggcaaatatcctaaggaatacagcgccgttttcactttgatagaggtgaattactttgccagtatatgaaagagtatgcttggagtatcacagcgctttgtgtaaagggggaaaatacaacaattacggtgaattgggtagaatagctgtgttattgcagaacataagactttgattacacactgccaagattcatatcagcctagtggttgttgacagataaagtaacataaatgaaacccatttattattttttttctttactgagacctcaaggtaaagcagattttcagttcttgtagttactatgctgatagaacagagactgacagcaaaaatgtgccagtccagaaatataaattaagcttaggttcatatcaaaattccatttagtcttggaaaaggacctgctgttgggattatttttgatcctaaaataaatatattgtgcaattccacagtatacttggtctgtattaaccctttcctgtgagcaatattttcaatttttttttttttttgctttcagttgacaaagctttattttgcagtgtttgaggcaagttatcatcagagtaggttaccttttgctgaatgtaaattactggcaaccggatgatacacatttcagtctgcagaaagtgtgaaagtagattcggaaaattgatagcagaccttttactgtattacaaattcgtgtttccagtcgcagtttcattatctacctaaggacaaaagttaagtgggaaacgtgaagtgagaatttttcgtgtgtgctgttgagattgtagatgtgtcttgagtacaatttctggctgcggcatttgtaccttccttcctgttactcaagccctcctgtttcttctttgctttggtcctccctctctccctcttgtccttcctcccttccttccttcatcccttcattcttcctctctctttctcctttctttttaggcaactagcaaagcgaaaattttgctatagtttctctcaattaagacaatactaagttgcctatgaaattccagatcccacgacatggtatacgtcgtgatcgatatgcaagtgggtaaacagaggcatcggcaaactctaaacaccattataatccagcggtctcatttcttgagtatgtcctaaaaataattttgattacgttttcaaattagccttctaaagtctgcatttgaaaattttctcattaattttttagcaacagacagatagcatgaacttgtttcttgaattaccttttctgaccttttgccagatgataattacaaaaaaaggaaagcctggaagacttgtaaaaaaaaaaataagcttatcaagtagctaaaatggcccttctgtgctggtgtctatttcaaaattaacattttggttcatgtgcttctaataatcactgacccttacttcatgtactttccacaggaaatgaatacagcagaaattactttgacccactgatggatgaggaaataaacccaaggcagtgtgggatggaggtcagccaagagggtgagctagaattaagtatgtaatttttgtgtcagaatattcttccccattcatgaaaatgaggtgacaaagatcacacatgcagttccatttagatttttgcagcttacaatttaaatgggaagttttaaccactaacgatgtgatgggcagcgaaggtaatttctgatcaaggacagcaagctggtaacctagaggaagtggcagctggctttcatgtgacgctgctgtctgcagtttgctgcctttccagggcccgtgtcatgtatatgaggagcgttatcactttacaaatgccggctcagcccttcacgtttaaaaagagcattcctcaataaacttcatctagcatgtgagatttccatacccagggactagtggatttctttcactgaagccatggggccaccatttaagttttgaaccacaaaggtgtagggtaagaatgatttcttctcgcaccttggattctagctgtggttgtaaaataactatttagaattgctcattatgtgccaccgccctgcgtatttggtatttatgaaagcgttttagccatgatgattagtaatttctttgtacttacatttcgcgtatctatgagttagctgaagagaacatatcataaatatcatatcataaaatatgttcttttagcattcatacaagttgataagggtcttctcaggtggcgcagtggtaaagaatctgtctgccaatgcaggagacacaggagatgtgggtttgatccctgggtctggaagattccaggaggaggaaaatggcaacccactccagtattcttgcctggaaaagcccatagacagaggagcctggtgggctactagtccaaggggtcccgaagagctggacatgacagagcatacaaccatgccacaggttgataacagaattctctctggccaattagtgaagtggtttcatgaggttattgagctaatgacactgacaaatattactcagagtcatttgcaacccaaaagatcacatttcaccacggggctccagacaccgtatctgccgtctaggggaaggggaacatgtttgaggtatgttctaattcagtgactaaggtggtcatccaacttgacatgatgtttatgttcagttctatccagtgttaggacatccacataatgaccctttaatcctcttctaagaaccatgtttctatactattattatttt

SEQ ID NO: 24706 - DNA, 1344 bp, Bovine  19866880430500
tttagattttcaaatcactgatatctcaaatacccacaagatttggaaaggaagtaagaataagcagtagaaagagataatttgtccagcagggcagcggcttttgaaaacggtataagcagcagatccaccttcacagattagcttttctataaaggagaggagggaaatggtattaatttgctgtttctcactccatggttagaaactcatgcctttcagtttgagtttctggttaagatgaatactcgtgatgaccacctagggattcctatgaaaatccaagaaaaactaattttgagagttatttggagctttattatgggtgtcagtttcctacttactcattatatctcctaagtgtctactgttggcattttaaaaaattaatgatttgtagtgttttttcaaggtattgttcaaatactttgaaaattattgtctttgaaagcttttcagtcaaatttctcatgcgttcatggtatggaaacattgtcttcaaatactatttatgcaaaatatattaataattattttaaataattttagctcacatccccccttatttttgttctaattactttgactaaggtttctaagagactattaattaataatgtgggaaacctgggttcgatccttgggttgggaagatcccctggagtagggcatggcaacccactctagtgttcttgtctggagaatccccatggaccgaggagcctggtgggctacagtccagggggtcacaaagagtcagacacaaccgagcaactaagcacaaatattgatactggacatttaaatcatagtttgagtttccttcattagtttatttttttgggggatttgggttttgttgtagttttgttttgatacttaatataatgaagactgatttaagacagcaatttttatcctctctctggtggctcagagagtagagtctgcctgcaattcaggatacacagaagacagttttgatccctgggtcaggaagacaccctggagaagggaatggcaaccactccagtattgttgcctggagaatcccatggacagaggagcctggtgggatacggtccatagggtcacatagagtcagacatgactgagtgacgaacactttcacttttttcataatgaagactttaagataatttttatcatcttaaaaagtagctttgtgtctttagttgccattaatttaaaaaatgtttgtaaatcaatcttataaaaaaagtatttgagtgaatttagtaaagtaggtggtaaaatatctgcctagattgcagaagactccagttcgattcctgggtggggaatatccactggagaagggat

SEQ ID NO: 24707 - DNA, 1624 bp, Bovine  19866880439392
aatcgatatttaataaagtggctgctaccacataacacgggcaattccccacgcagccggagtcgtgattaggcgcccctcactgcctgctacataactcaattgggttttgtgcactggcctggcacctgtgtccctcagcgcccagcctccaaggtaataggtttatgagccgatgaacagagttgataggttctaaatggattaactaggtgtctgcagcctggtgatgaatacatcaggccaaaaaaaaagaaagtctgcataagcaggcaagtgatacggagtgttgacagacattgtgtgtgtcctaagccccacagggtaaacactggctcggtgcctgtcattcaagtgttgtctctctctctctctctctctctcagagtaatgggcgaagatatcaggccgggctgcttaacaagcctgcgggagccaggacacagagccctgctcctgaaaaggcctccaccaggctccgctggatcaccagttatagccagcgtgagaatacacctccatattaatatgttttaatgtcccaagaatgacaactagatcgaaattcctgtttttgttattgtttagctactcagtctcatctgactcttctgcaaccccatggtctgtagcctgccaggctcctctgtccatggaattctccaggcaagaatactggagtgggttgccatttccttctccaggagatcttcccaacccagggattgaacctgggtatcctgcattgcagggggcttctttatcactgagccacctggaaagccccagccgctggtggcttagcagtacccacaacacagtaaatggtctgagtatttcctgagttagggaaagaacaggttgagtggcaggaaaatcatttcggtatgagagagatgtacctacccacaggcaacttcatctagcaaatcagtgtagccctttgaagtctgctgggaatcagtttgaatcctgacctgaccttgtactatttgtgtgacctagaataattaatttcctagagtgtcctcaactatacaatagaattcatattattctaataggtttccagtagaattatatagtgtgtgtaatgatcttgcactgcacatgatactttaccggtatttattaagtattgagcactgttatttgtaactaattcattatgtagacttaagaggcacgaatatgaagctctgacaagttggagtactgggcatagggttagcatgttggtagccatgaaaaccaagggagtagatgagattacctcagaaggcagaagttaggccagaagagtgatgaaaccagagaaccttgaagatggttaacagttaaatagcagcagaggaagtagggtccacagaaggccaacaagtatggtcagagtcaggatggctagaaggtaatagtattctggctgccaaggaaatgaggtactagctgttcatcaattcccaagttttctgatatcatctcagagcaggactgtcacatacggtggtacgggttgtatacggcacaactgtagggggaagtgttctatgtgaatagagccctcagagtgatacagtacacgtcctgcaaggccacagtcaggaccatctgctatcaggatttt

SEQ ID NO: 24708 - DNA, 1746 bp, Bovine  19866880449574
aaaaatgagttgaaagtgcaaagtccccacgtaccctttcatcccatctctagtttcttctgttattaatatcttacatttgggttacatttgtgcaatttatgagcaagtatagggcttccctgcttggtcagtaaagaatttgcctgcggggcaggagacccgggtttgatcctttggtcgggaagatcccctggagaagggaatagcaacccactccagtattcttgcctggagaatcctatggacagaggagccaggcggactagagtctacggagttgcaaaggatcggacacgactgagcgactaaagcaccaccattgatggttattaggtaaattcagtagtttacacagggttcactttttatcttgtatagaaaatcaactggaagtcctgccctatgtaggttgtgccgaattactgggacatagcggagtatgtcagagaaggcaatggcaccccactccagtacgcctgcctggaaaatcccatggacggaggagcttggtaggctgcagtccatggggtcgagaagagttggacacgactgaacgacttccctggagaaggaaatggcaacccactccagtgttcttgcctggagaatctcagggatgggggagcctggtgggctgcggtccatggggtcacacagagtcgaacacgactgaagcgacttagcagcagtagcagcagcagagtatgtcatagttttgttgacatttaggaaacggggcttgccatagtgggtatacctgatatgttttgaggtagtaacactaattggacaccctgctctctgtatggactttcttcaattgatcagagccaagttggtcaggatcttctccagaacacggcaaaaacaggcaggaattggctggtggaactagtaacaatttaatatcaaggaatgatttcatttaaaccttaatctcattttaatatagtaccattatataaaacataacacagaaaatgccaatagcttattattttaagataataagctttcaggttgttgtttcatggaaaatacaagctgagccaatgttctaaagaagaaaaaaaagtattttctttcttttcattttgattcatgaagttaagtctcataggtaggttagtgttcgcattagctaaagagaaaacattgaaagtgagataagaaaagacctgaaaagtgcatttggaactagcttgcccacgactatccatttttgtcttgaaaatctattaggattccacaattgtgtaaatttcacagttctttttattttataaaatagaaaatgattacaattttgtgtaatgtattgtacaggtttaataggattgcactcttgccaagtactgtagtaacaaataaaagcaatagaaaattgctgacacactaggaaactgctagttcaacacaaatgctttctgtagataaatctggcgtaatttccctatacatcttgactatgactttcaactctgctcacaggagagcagttgcacggtgctggcaggcgtccgtatgtctgcctttcctgtacattcacagcccagcagtgcagacatgttgcttacaaatatggcagaagccacccaaggcaactgagccacaatgccgactctgcagttgcgtgtcttccccaaaggtgtattgccaagaacctacagatgcatcatcccggggaaatggagacagtatcagaaggggacagtggcttctgagtctgcttcctggtcgagt

SEQ ID NO: 24709 - DNA, 1103 bp, Bovine  19866880464293
tattttttaaaaagcaattttcccactgtagatttagaaaccaacagatctattttagccagcataatttcttattaactaatttaatctgtgcaaaattatataagaaagcaaacaagcctccatcaattttcttgcctttggatgtaacataatattttcaaaaatgaaccaaatagagtaattagcccccaggcagagcaaatggctctaatagccatctcccacatatttctatggtggaaagactgaaaatgaatacagaaatgtggcagcccatgggttaaagccctgcatgtaccctcttaagtaacagtttggaatattaatacctagggttaccttttcagaagttcaagataagagaagagaattatattttccccttaggctgccaaaatctctcttctgatgggctgcctgatttcaaccttccaggggtgcttccctggtggctcagtgataaataatctgcctgcaatgcaggagatctgagtttgatccctgggtggggaagatcccctggagaagagaatggcaacccactccagtatttttgcttggagaatcccatagatagaggagcctggtgggctatagtccatggggttgcaaagagttgggcatgacttactgactaaccaacaataacaatatgatttctacagtgcttgaaagtgaacagactttcttgcattgttaacagagggtcactttccgcactaattgtcccccagggagagaaccttgcctgtgtaagagatgacagagtgatcgatatgaaaataccaggggagtattgtttgaatagcattataggtgattctgaaatgctgctttgatggtggtgatgtgatggtgtcaggggatgtcactccctccacaattaagaaacactgaattaaataatatgactccctataagaagcattgactaatttgatgaaagtgattttgattcaatgtgtatattatattgtaaaatatagagaaaaaggcaaagcaattttccaggcgaagaggtgtccctgatggtaaaactaactcatccttccttattgcgggttatcactctctcctcttttttaaattccctattttct

SEQ ID NO: 24710 - DNA, 1760 bp, Bovine  19866880511047
cttgttgcgagttcgttactatagtggatataaagtgcctactgtatagaaagagctcatcaatgtaagatgttaatactagatggcgtgtttttttttttcatcaaaattgtcacaaagtcaagattggtttatgaattcagagggacaaaaggcaagtggtctcatgcaaaactttctcccctgctgacataaatttgcaaaattagcagttcctatattttatgttttgaaaacattttattattaagaacttattcacacaatataaatctctcttctgaaaaccccagataaaagaaatgagttcatttttattcaagactgtaaaaaaaaaaaaaaaattcattcccacacatgctaccttgttcaagaggaaaagcttagacttggaggaaatgggcttctgcatttcttaggatgtctaatgaaatttattgatttatattccattctgatcactaattagagttaatgcaacttaatgacccagctcctctccaaactacttattgagatagggacgccctaagaagttgcggatggtgactgcagccatgaaattaaaagacccttaccccttggaagaaaagttatgaccaacctggacagcatattaaaaatcagagacattactttgccaacaaaggtccatctagtcaaagctatggcttttccagtagtcatgtatggatgtgagagttgaactataaagaaagtgagtgctgaagaattgatgctttcaaactgtggtgttggagaagactcttgagagtcccctggactgcacagagatccaataagtccatcctaaaggagatcagtcctgggtgttcactggaaggactgatgctgaagctgaaactccaatactttggccacctgacttgaagaactgactcactgggaaagaccctgatgctggaaaagattgaaggcaggaggagaaggggacgacagaagatgagatggttgggtagcatcactgattcaatgagagttggtgatggacagggaagcctggcatgctgctgtccatggagtcacaaagagtcagacacgactgagtgactgaactgaactgaagtgaagaagttgtgggtgcttatccatacaccccagtaagatactgaatattcatgccctgaagaccacaattactaggaatagagaattctggtgagtattcttggatacaggaaagcctattttttcagtaattgttgtactgaaaatcattccaacctgcttaacatacagatatggacatatatcttgatggtgctccataaatcttactgcccttaggaagatcagagaacatctagtctaatctctcatttgtagataaagaatctgagattcaggatggttaagtaagttttcaagctcccacggccacttcatagcaaggtagagttttaactcaagtttcctgaggctccttacattatgtttttgctttgatttttttttcagacctttttccagactactgcttaaaatgacatgaggttttattgtttttttggggggaggtggttggctattgtttgtttatttggggcggggagtcggggcagattgaccatatcatatggcatgtgggatttaagttccccaaccacggatagaacccatgccccctgcactgaaagtgtagtcttaacaccagactaccagggatgtcccttgatttttctttaaagattcctgatgttgaaaagtctctggtcctcaatcagggatttgaattatga

SEQ ID NO: 24711 - DNA, 1469 bp, Bovine  19866880551114
tttccttcaaagaagacaggggtggatttcacttgttattatttaacatgtccagccctggcaaggtaagagtctggaaatgaaaaacaacatgggcagggtgtgtgaatcaggattgtccccacatgccagcatcctgaaggctaaccaccccgtcagaagaagccacaggaactcagctcacttctgttaataccttccatcaagttgaccccagtgatgggaaatgattcctccataggctataaatcattgcagccctcagatgggaacacacattgtctcaaatggagtgcctggctagagtgaaccaattaattctccgccaggaagactgtatacttattttgctttccagatcttcaaagagcggtgaaagaattaagtaacccccgaaatatttaaacgggcatcaacaaatgagcaaatcagacagactcgctcttcacagctgttctccgtccagtgcatatggcacaagggaagggacaagtcttgcctctcgtgtacgtgcttctgtgtctgtctgagtgcgcacgcgcagaagcctacgcgcgcacatgtgtgggaagggctttggaacaatttacaactgccggtcttctgatgaatgaaggtattagaagagcagatgtagggcatgaggctagaaagtgaaaagctaagcattgccttggagcgccaggaaatggggccagcatggtgaaaaccatcaagttgcctgggctgtgaatgttttaatgtacaataaagcactttgatagctgccttaaaaaaaaaaaaaactggtaatgtttgcaagtgtttcctgaaggcctcactgaaataccaccagcagctaacaaaggggaaagggttagtcgtcatcaataatacggggaaagttgctaaatgactctggcaaacagcacagtaagtgaaaagattggggtgcagtgtggggccactacaaggaacaccacctgatctggggaacgatgctcctcccatggggtaatgtggagtccagaaggcattgtttctcccccttaacctttgtaactgctgcaggagactttcgccatcagagttcagttagtcttaagttgttgctatttagtccctaagtcatgtctgactctgtcagacaccatggattgcagcacaccaggctttgctgtttttcactatctcctggagtttgctcaagctcagtcttcaattctgaccccttaattggcaacttacaccttccagaattatctgttggacaaagttaaaaaaaacaaacaaacaggcattcccatgcctgcccataaaatatgtcttacatctgagaagacttaacccaagaccctgaatagagagaaatcatagtttcttcctgatagtataggtccctgggtgcgaggaaggagtgtagagactgtatccccagtatctcacagaccgttcattgtttaagggagaatcacttttactccttagac

SEQ ID NO: 24712 - DNA, 1255 bp, Bovine  19866880552029
gtgctgtcctccctggttgctgtccctttctggccgatttctctgctgaccttttggggttctcagacttcatctgcatgcccttttctgctctctttctcctttagcactcagtgtttccccagcagattaatgacagctaataatatctgatatatctggacattgccacataatgagttgcagtcccactgggtcccagaagtgtcaccactaacaaattcaccagacctgcgcataattagcatgtgaagggagtgatcccgcagtaaatctgtagaggaagatggatggcccaggagagaaaatataagggggggaaaagtccctccttatcacgcctcactaaatatatgtttcttggccggaatattttcttgataacaaactgtggccaggttacctttacagtaacattattcctgccatggctgataggcagaatttcattatgtcactgctaatgtttcaatatttctgcaaaatgtcaccatatgtaaattaagagaggttagggtttcccttgcaatttcctttaaagacgcacaggccccttttcacggtggcctcagtgctcacttcacacacccgggatggcctgggatatagtgacgaagcacagacactttgccctcaccttaccaagactaaatgaaacgacctacatggaaacgtagctttttcaccttcgaaagctgaatgaaaggacctacacgctcacagacactgctttcgcagctgcaaagacaacatacaccaggagaagaaaatccggaagaaggaaacccactgtgtccatagtctaattaccaacctggagatctataactcccgtttacatctgcctgttcccgagtggttcagtggtaaaaaaaatccacctgcgataaagaagacacaggagaagccgtgggttcgatccctgggtagggaagatcccctggaggagagcatggcaacccactccagtattcttgcctggagaatcccttggacagaggagcctggtgggctacagtccagggggtcgcacagggccggatacgactgaagcgactgagcacgcacgtctgcatggcagctgtaggatttgtctcagcaatcagaacaaaattcgagtgtttcagatcagggttagggttcttgtgtgtttggtgtggcttgagggccgtccttgatcttgcaaatccacgctagggtaaggtgtgcttcttgaaagataaaggtagggctctgagggagacactttaggaat

SEQ ID NO: 24713 - DNA, 1969 bp, Bovine  19866880552387
tagactcaccaaatttgactaaaatgtaagattatggttctaggtaactgggcaacctttgagactcttggcaatgtagtgcatattttcagctcaaagtatccagtattttgcaatgggcatcatcctttccctttttaatggacagatcattgtatttgagagtaataggtacaggtgacagtaataggtgcaaacttgctttttatgttagctgtgtttttcaaaaaggtgtgtttcattctaatttctgccactcaagacttcctcaaggaagaaggggcacaacagagtacagcatccactgcagagcagaaaagatggaggctggatgggtggaaagaagggagtggatcaaagcttggaaaatattgccatgaagaataaatccagggaggacagacacttaagccccatacattggagccaccagaaaagaaaaagcatacagaaaaggggggaggatgaaacaaagggacattaaggtttgcaagtgagagctaagatttaagatattctataaacgtttattgaatggctgaaggaatgcgtacataatatcagagtcccttcactgagcttgagacagcagaggcgtaaggataggagagaaagaggggtcggaaggtgagcgttcagaggctcttacaggatgcaatcaggctgaaacaaccaagagttctccgggagctgtacagaaaaacagaacatgcagtatggcttttgcaaactcccaagaagttctgggcgatgttggctaccaagcgacacgtgtaagagtcatggtcacgctgtgcctctcagcatcaaccaggtggctggatggaaagggatgcagcgtgtagcaaactacttcacagctgtttttacgtgtggattctgaagctgccaaactacgtgaacggcacgttggccccgacggccgcacaagcgcagtgagcccccgactcgggcagacgcgctgcgttcctgcagtacccacggtggctgcagggcagctcacctcctcagagaatgcgggctgcggcagctgctggtgacggcgatagaatcagataggttctgccctgcagtttgtaagtgctgcctgcctttcaaaggcagagcctccaaacagtacaggagtgaacaagtttgcaaaggaaacgcacttgcagtctgaaaaccagagcagctggatatccaactgtgtgaagaaattcagagggctcttcctctcccttaaattgatattactcacccccgttttatagagtgaaagcatatgcttaattcctcaacaactcagaccaatttccacatcacagccatatacatggaatactcgattccacctaggtggtgactatgtgacttttttgcttgggtattccttaaggaggattataaaccaatggctctggaggtgacattttttaaataaaatgaaatgtgttgtaaatacaattgtgtatgacactatgtatgacattccaggtggcaggagtggtaaagaaaccgcctgccagtgcagatgtaagagacgtgggttcgatccctgggttcgaagatcccctggaggaaggcatggcaacccactccagtattcttgcctggagaaccccatggacagaggagcctggagggctacagtccatagcgtcgcaaacagctggacatgactaaagcgacttggcacacacacgcgtatgtaaagcacctaaaacaaacgctgcatgcccaccatccatttgtgacaatggcattaatctcctcatgctgatggtaattctattgtctccgtatcacagaggtgccttttcctggtgttactgtacttctttttgactctgctgtcattttgaacaggtaaacagactgctgctgctgctaagtcacttcagtcgtgtccgactctgtgcgaccccacagacggcagcccaccaggctccaccgtccctgggattctccaggcaagaacactggagtg

SEQ ID NO: 24714 - DNA, 3062 bp, Bovine  19866880637872
aaatgcccttactggtttgtgtccactcttctctctttcttaccttatactgttgcactcagggtctgatgcctatagtaacaatgcactctagagagtggacgtgcaaagaggcaagatctgaaaagagtttttttccttccagacagttttgtaacatcctggctaaaaattaatcactttgtcttacaatgaaaattaaaatgtcattgaaataactcaaaagagttctttagaacataaaatatccattaaaaacaacaatgtactttaacaatttgagttgatgagtcaaagtgtatgggttaattttttcttaaagttgcactctggtttcaaaactaaatgaaaattaaatttcagaaaatgtgcatttgatagaatatcaaaccaaagtttggataataattcaatacattctaaaattagaaagcttaaaaatgtacattaatgatgctaaatttgacatatggaatcagagacaccaagaatccaaggcatgaatatcgagtatttccacccccacttacaacagaggacagaaaaataacataaaatagcatcacttacaatgaatgcaaataaaataaattttattgtttcaagctgtaaatatttccagccatctcaaatggaaaaatttcacccatctatgatttattactgctgctactgctaagtcacttcagtcgtgtccgactctgtgtaaccccatagacgtcagcccaccaggctctcctgcccctgggattctccaggcaagaacactggagtgggttgatttattactactttttatacttgcttcttaccgtctgtagtccagcatttgttctgttgcacgcagtgatgacacttcaccgtgtcgttagctcctctatagcagggcactaagcctatacatcttgcgcctgtcccagcacataggatggtgtcagatctatagcatatatgtaaactcaagatttatatttaaaaaaaaaaaaaacagatcactttagtgaaacttagaaaattttaatcaaacaataaagtggagagaagttgaaatatttacatctaatatttaatgttatatctgtttaaacctaagatttattgaagtaccttttttacttcccttgcttcattttcataaaaccttattttgaattttatttaacatagaaatcacaacttataattctaaacttaaaaaataagatagtctcaatcctgggttctgggctagacttaatgtcaaagtttgtgaatatcttgtcctgaatcttttaactctgatattagttttgagccactacatttatttaaagtcagaggtacttcgtttcaagatatcagcattctattttcacgttagaaggaggagtgcaagagggatcaggacagaggagaagaaaaagaaggaagaagaaggagaaagaggaagagcaaggagaaggcaaaggtgaggagggagtttgggggaggaggatgcaaacagaaggaggaggagggaggaactaaagaaaaaagaaggaaggatgtgagggagggaggggagaggaaagaaggaaaggaaacaatagagggagcagtgttattgtcatttttctaccggaaacagaaaacccctggctttagattcttttttaatacagaagaatatttttatttgctcacattttggtggtggtaaatggggatgagggtgccagtgttctttggttacttattcactcattttcttttttttttttaataaaataaactagtaagacatcctgtctcagttattaataatttctgaaggggtttttgtttttactttttggtatcttatattcttgctgtatgtagaagaaaattagataaaatgtaacagcttgatttttaaagtattttttaaaatatctttgtgctatttgatgttctagtaccattcaagcagacattcttcagtgggccttgagctccctggtactcggatccaacatctggcatagagccagatgcagtcagggctcattgcatcttgtttgggttaaaccatttatttccagcttttcttttcaaagtcaatatatacatattttactcctgtgtaagaatcaatgagagtctctgattctataacttgttgttcagtttctaagtagtgtctgactctgcaatcccatggactgcagcacaccaggcttccctgtccactatctcctggagtttgctcaaattcatgtccattcagttagtgatgccatccaaccatctcatcctctgtcgcccccttctcctcctgccttcagtctttgccagcatcagggtcttttccaacaagtcactcatcacatcagtggccaaagtattgacgcttcagcttcagcatcagttcttcaaatgaatattcaggattgatgtcctttaggattgactggtttgagctccttgccctccaagggactttcaagagtcttctgcaacaccacaattcaaaagcatcaatcattcttcagcactcagccttctttacagtcaattctcacatcagattctataactaggatggtctgattttataactaggaggacacatttttttaaataattaaatcaaaatattctattctagatattttctgacaacataactattttcagccacaacttttctttgtaataatatttactgaactacaatttttagattaaccaaagatcttcagttacagagagttcatccttcatttaagtaatgaacagataatgcctttactagagattctccaaatatgagcagattagagttttactgggaggctccacttccactggcctagctccattggtacatgggttcaggctataaggatcagctaccatagtatgttaggctatgaaagagcagcaataaatttaatagaattgaaataattgaatgcatattccacagccacaataaaattaaattagaaaacaagagaatgtaattttggatatccacaaatattaggcaatatttggaaattaagcaacatacttctaaacaatccagggtcaacaaagattacaaagaaaattagaaa

SEQ ID NO: 24715 - DNA, 1817 bp, Bovine  19866880655672
tatttagctattttctctgataaagtgctttgcaaacattttatccaattaggccaggcagatactggcaaggtaaatgttcttcttctgaccaacagattagctgcaaaggaaagtgatttcatgaagtcagaaggaacgcttcgataataagtgtgacaaaactgcatctctgcttcctgcgctggtgtcgttcagtctggagcactagtcgccctaagctcgcgtatagcttctctatcataaagcggccctacatttgcttatatttcactctaagaaaatttctcttggaaaaacagattcattctattgtaatattgcatccagtatttgttactacagagtatggaagaatatgctctttggggtgggggaagggaggattgtgagtttgggattagcatgtgcaaactagtatatataggatggataaacaacaaggtcctaatgcacagcagaaggaactatattcaatatcctgtaataaacctgtgtaatggggaaagactgtgaaaacgaatgtgtgtatgtataactgaggggcttcccaggaacctgcctgccaaggcaggaggcttaagagacccgggttcaatccctgagtcgggaagatccctggaggagggcatggcgacacactccagtattcttgcctggagaatcccatggacagaaggagcctggcgggctacagtccatagggtcacaaagagtcagacacggccgcagggatgtggcatgcacacatgtatgactgagtcactttgctgtacagcagaaattacaacattgtaaatcaactatacttcaatacactttttaaaaaaagaaaatagttttagtaaacggaaaaaaaaaggatgtcctaaagcagaaatacacatgttaaataaaagatattattttcaaaaaggtaaacggactttggttacctttgcttcaagatgtaactttatttttgaagtttgatttcattttctttttctactggaggataagttgtgtctgcctctgcccctccccgatgcctcccactcccattcaaagactgtcactggaaataacagccttaagagtttgggagtctctttggagtccttcaacatactcaatccctgttttctcattagaacattcatacttttgtgcctcagtgggaatgatcaattatttcaatgtcagtagtgatactattacccttaagatttagcaattttcaaagatcttttaacttaattagaggcattttttgtaaattgaattaaacctgttcaaagtacaatgtgttatgctaaaagtatactacccacttggccaaggagacagaattttagggggaaaaatctagttgaaaaatgctaacctccagataaatttgtgaagttttcttttttgagacagctttctaaatgttgggagaatgggtaacagttttgtccaaagcattttgttaaatgtgaatgtacagacacttttgtgaaagtatttcccccaatacttgaaaccgtgacaaaacaagagcagatttggacattttaataactttggttaaaaaaagaaagcagatgccattcataatttacatagattaatccaataaccagcccatgattatagtaactcatttttactaatgttatttctttccaaataagtgtttcttcatcttgacatatatatatatttttttaacctcgttttcttttaaacatgatgtcacagtgaactgacccaaagagtccctaccagtcaaaccattgaatgattcactgccatgtgcttatgaggcttctctccgctgccatttagaaaat

SEQ ID NO: 24716 - DNA, 1094 bp, Bovine  19866880687821
ctggcgtgctgcagtccatgtggttgcgaagagttggacacgacttagtgactgaacaacagcaaagaatatagagaaaagctcagcaagtggaagttttggctcttcccaaaccaagtaaaatcttgtttgataaagaatcttttgaaatttaacctttcagattttcatctgaagaatgagagagctaggaaaaaagtggtctttaagttacttctttgtgttaaatattatcttatcagcatgcatattaatgtttggaaatcatttggtagtagggagaagacaagacattctaaagtgatctaatcaatgattatataacaaccaactgaactcactagatacagtttctaggtcaatgatgatgagtctttgatttgatgctaagtttctacagctgttgaaagtcagaataaactaatttttgaggaacagaagatcatttcctaaatatagcttttctaagattataatatgtttatgttatcatcacttgaattcagcaatggagatgattgaaataaaatgtatattcaagatatttaaattcactatttaagatggtattgtttaaaatatgaaaatgtataaatatgccatatatgaacatccttcacataaatgagtatattttaagctatgtgatgctttttaaaaccagtcactatagaggttgaggaaaatgtaaggtgataattttattgatacataagatggcatcactgactcgatggacatgagtctgagtgaactctgggagttggtgatggacagggaggcctggcgtgctgtgactcacggggtcgcaaagagttggacacgactgagcgactgaactgaactgaactgaaatgaactgaattcctacaatcagagtaaattttcagaagacaaaaggatactgaattttatatcaggaatcagtatttgttaatatgttacaagttttactctatgctttaataagtaatactaagatttcttattgctcatctaaagatattttaaaaaataatcattgaaatattaaaaaaattacagatttcagatattttttgaaccagtataccagtataaggaaaataagttag

SEQ ID NO: 24717 - DNA, 798 bp, Bovine  19866880706030
gggtaaagaatcccatctgccaatgccagagatgcagaagacatggattcgatccctgggttcgaaagatcacctggaggaggaaatggcaactccagtattcttgcctgggaaattccatggacagaggaagcctggtggcctatagtccatggcattgcaaagagtcaaacttgactaagcaactgagcacacaccatacatatattacagttactaagatttttcagaacccatgatgaaattccagacagaggggaaacatgtccaaagaattatccctattgaattatactatcggagaaggcaatggcaccccactccagtactcttgcctggaaaatcccatggatggaggagcctggtaggctgcagtccatggggtcgctaagagtcggacacaactgaacgacttcactttcacttttcactttcatgcattggagaaggaaatggcaacccactccagtgttcttgcctggagaatcccagggatggtggagcctgctgggctgccgtcatggggtcgcgcagagtcggacacgactgaagcgacttagcagcagtagcagcaattatactataaagcctcaaaaagttgtaaggatgtaaaattttctcaagaggatgcgtgtgtgtatgtgtgtgtggttgagtgtgcatatgtgtgtgcacgagtggttgactgtgggtaagatatttctgcctgctcctctgagctccatgaagaattgacttgtagaaacaggtcttcttgccatacaatgttaacatgttgttaagtctaatacaaaggca

SEQ ID NO: 24718 - DNA, 1135 bp, Bovine  19866880750509
taagaaatcatttgaaccttttatataagtctgctgattttctttgaagttaagttttgcaaaactgcaaatacttgatgttctaaattgagtttttaagtttttgtacaatcaaaaaatcttagatattaaatgcaatctatcccaacattcatcccaaagtagaatatctcttaccaatctttggctgaaaaaaatctggaggcttctttaccattttcagtgaagggaactcattatttcagaagaaatcttcttccatgaagccttatcctgtcctctctcctgtcacaatagtctggcatttataacataaggttaacttgtggttgtatgtatgtattatgacctagtcctctttctcaaatgcctccttgcaccctaaccttctcttcatttcgataatttgaagatttatctgatgtagagaaactatcttgaaacactagtttgtctcagaaaagcttattttttttttgtttaactatgtaatagatgtatagattttacatgttaccatttaatccatgttatagtctgataagaaaataccactgccccaatttttgaatgggggacctaaatttcagagaactgatcgatttaattaatcacatgactgtttagtagctcgtgtattcaaatccaaacctcgttgattccaaatcctttcctgtgcatggaactgaatttccataaaatttcctcagaaggtctttgttgttaagaataaggtataacaaaacaaattggttttacttacctactgtttaacttcttcagaattatttaggtgttaggtcaaaactgttcattgtctacaatttttatgactcagtttaatacacagggcttcccttgtggctcagccggtaaagaatctgcctgtaatgcaggagacctgggtttgatccctgggttgggaagatcccctggagaagggaaaggccacccgctccagtattctggcctggagaattccatggactggatagtccatgggggtcgcagagtcagacatgactgagcaactttcactttcactttagttcagttcagtcgctcagtcgtatctgactctttgcaacttccctgtccatcaccaaatcccagagttcacccaaactcatgtcca

SEQ ID NO: 24719 - DNA, 1288 bp, Bovine  19866880813985
ttggacgagaacttagtgactaaacagcaaacacaaaacccaaaacttgaccgtgagaaaactcagacaacacgcagggtgtgaactgcacagaacctagtgatgaggtgcgcatggaatgagggagagaaggtctttccaagtgactcatcggttttctcttgccaagttggaggcctgtttgtaccattctccagagccctggtcagctgatggaagcccatttttgtcaggaaagatcatggcttcatgaatttgtatattcatgacaaaatcgttatggagcaccatatactagaaactgctctatatattaaaaaaaaaaaaaattaaattcttattctagtaggactttcctcagatttgagtattctgcttattttccaaatagaagtcatttaaccccacgattaaattgttattctatggtaatatatttgtatccaaagttgatcacttccctttaaaaaatgtgtaatttactgcagctatacaaagtgtaagagaacaaccatccttttcagctttgtttgaacaattgtgtgacctaaaataatgccttatgtacagcctggtctggatcaacttcagtgaaactggaacataattgcatggtggtttcattaatttaagcacatacaatacttattattcatcagggactgaagttttaatcaatgatctattgcaaatattcaagaattctatttgtagacaagttcagattaatgacttatagaataatacagaaataacaagagatgttttcttcattcatctgtttgccaagacaatggagttaattcttcctttgaagtaagtgtaaggaaaaggagaggtttgacttgatctatgagttatatattatattcttgcaccatttttaatctcctgtagcaaggactagtattacttatgaagtttatttccattccaaaataatatgacttcctgccagcaacttttttcatcatcatcacatcaattacctacaaaccaaatttatcaagatcctgactcaaataagctaaggggaaaaaatcccccacatagtattgacaagacagcttgaaagtctgaacactgacttgatatttaataacaaggattattactacttgggatgcatggtaataatttatgaatataaaagaatccttattttttagagatacatattgaacaatcactctggattgtgactgcagccatgaaattaaaagatgctttctccttggaaggaaagctatgacaaagctaggcagcacattaaaaagcagagatatta

SEQ ID NO: 24720 - DNA, 1250 bp, Bovine  19866880825793
cctgaaatggaatttatcattatttattgccaagttctttatttcgtagatgtgcaaaatgaagcagagatggacaaattgacttgttccaggtatagcacctaagaaacagcagaggttcaggtcttaccccctagcctgttgaggattctttcctctagagcacagggcctcccctcaaaaggcattaggaaataggccaccggatcttgctgcaaattgctgagacagaagatgtgatgaaagcaagcagaataatcactacaatgcaggtagcaaataaagttttctttaaaaatagaccaaggcgtccccattgtttgtacccatcattatatgacagtaacttagaagtgagaaattacaatcaccgtctcaatattgtttattttatccaagactgtgcaggaaagaaaatgaggagaaaaggaaaatagcatttctagctaaaaactcgattttacttgccaatcaaactgctgctccggcattttgtaattgtagaagttgtaagagacatgtctgaatagatcatcagacaggtaagttctgtgaatgaaaactaaagaagagcaaggccaatgtgtatgggtaggagagaagctgttactgtcccaaagaaaagcgcctgggattattcaatcctgcgttgtagaaaaaatgcaggctttgcagtcatgtgagccttgagctctgccctttttcagctacacacttcaactcatgtgacgagagcaatctcaggcagaagatgggacaaataattaataccatcctactcactgtcagcattaaataaagtcatatacttagaagtagtggcataaaataaatgtagagtaaaaggcaattatgattattttcatatattttaagaagaaaatttcaaatctgtataaactgtagtttaatgtttacctatgaacctaccactcagcttcagtgattaaaaatgtacggtcaatcttgtttcctccaaatctacattctgctccaccttcctgtatcatttggaagcaagtcctggatgttacttctcatctttagatgttgttcagttgctaacttgtgtctgactctttgcaattccatggactgcagcacaacaggcttccctgtccttcactgtctcccagagtttgctcaaactcatattcattgagtcggtgatgccatccaaccatctcattctctgtcactgccttctcctcctgccttcaatctctcccatcatcagggtcattttccag

SEQ ID NO: 24721 - DNA, 979 bp, Bovine  19866880929308
ttttctcccctaatgtttcatgattcagtatggaactgaaaatcttattttagaatttttaacttttgtggaagtaggttttgtggcaacagttataatatttcaatgatactgaccttttaatctgttttgggatctggtgtgaaagactagaggcaatactcttagaccattttttcaccagatcatttgtgctttctagtacttcctcagggtactgtggctatattttccacacctactgccctgtgttctgaacttggcttttagaagactgccccagttcccttaaaagggagacaggtgacactccaagaactatgaatactggtatccaatatgagaacactacataccatgagaggaacagtttcatactttaggaaagtgctttggaaaaggcagactatcatttgctctgctctaagttgaagactaataatacaagtttcacattccatgactacagagggaacttctgcctttattctgaatagaataatacaaaaacaaaacaaaaatttcttcaaatgcctgtgtctgctacaagtgcatatatttacttatttttcttggaggcttcctagatgtagtattagcagccaatatcccccatggatttgttttctaatctatcagggctgtgatacagtatgctgtttctgccactgatatgttgctcggagatttaataatgggtaaacaaacacaacatgtggtaattcatttcaaattaaaagtttattaaactccggcttgatggctttatggctatttgcaatgaaaggagtgaaccttagggaggggtaggcacgtggtatgttcatggctgcagagtttctatctgaaaaatatgtttatgatcttctacaagctgtcccacattgataggctccatatgtaacctgctggatccactgcagtccccagattctaaaaaggactttaatgttcacttatcggttcacgtgtgcatgcg

SEQ ID NO: 24722 - DNA, 1509 bp, Bovine  19866880977421
tcccaccccttttaggctgtcacacagcaccagttttgagcttccatgtcacacagcaaattcctactgactattttacacatggtaatgtatatgtttcagggctactctctcagtttgtcccagcctctccctcaacagggtccgtaagtctgttctctgtgcatcaagaggagtgctttactaaggtctctgtgatgcccatgtcgcaagggttaaaatagaagagtttatatgaattggaaaatccttggggacacaatgtatcatgtcaaagacttccagaagattcaacaaggaaactcagaatcagactcaaaatcttctaaagttacatttaaacaatatgcatggtccctgtgcttacctaatgttaagttaaaaaattcatcagaccttactgacgctaatgcaggtaaagttcgtgtgggtagccataacaacataacgttaatgagaagatacaaaatgcactatatttttatacaaagtaggttagttaatcaaattgtgaattttttaaactgcatcctgttaactttttttagtagatcttttgcaagtgcatagcttgtcgcttataaatagacacatctcatcagaaggtaagtgtgaaatccttggttgggggtgagggatggaggagaatatgttgacaggactggtatttgagtatctaactagccactttctaagcacaccatatcccttcctaagcatttatgagacccactgggaaacaaagaaatttaattctagtcagcttatttactttttgacagccttaagaactttatttgaaatttccatcatggaacacccagtatttgattaggaatgcattagctgagcaaacatttctgtaaaaataaatataaatctgattatatttggtgggtctaaaaaagcactcaaattcttagactaaaacctaatgtttggtttcctttttgtttctttttctagtatcagtcccctaagaacacttgacttgtatctaggatttatacggagagaggaatttcaattcaattcaaaaaccccataaatacctcagtggaacaagatatttaatattctccacaaagttttatttttcctttatatagaaaaataaatttgtttcccactatctgaaggatataccctagacattttttctgaagtgatgatggatttatactgactcagaagcatcagatcatttatatatttatgttttgcccacaatgtttcaggtagtatattggttgctgctggcacaaagagcaaggcaagggtcttgccctcaagaatgtcaaaatctagaggaacaaaaagaaatgtgaaaagaaaagaaaagaaaacaaacttttaagatttgatattatatgtgcaaaatactgtaggaaaacagaggggaaaaatggttataattgtctgagggtggtgacagaaagcgtcatttaatctgagttttgagtactgagtatggtaaagcaattcaagctacattagaatggggataaa

SEQ ID NO: 24723 - DNA, 1598 bp, Bovine  19866880982965
aaataaacaggcttctgctcagtaataaaatatctattctgaactccatctccaggggtattttcttcttgcatcaagcaaattccaagttccaaagaagcatgaagacagttatcttttaaaggttttactataaatgtggactataatcagaactacccacgtcatataaattccaattcctgtgcaataaaaagattagtattgatttaatttgaaaatataaacttagctacagtttgacatatatgtatataaatcacacatatatgtgtacctatatatatatatatacatgaagatgatttaaaaactgtatatgacaactgatatttctctttggctttgtttttaagatcatagtaagcaatgggcagaggaaaactgctctgtgttagtatggtggtttggttaattgatagacatttctcccttgatctttttttatctctgaacttctgggatgtttgtttctaacttacccaataaatatattgttaaacttttgaaaggtcatttgagcatggagagattgatctcttccataaaatgaaaatgatagataaagacaaaagaaagaaataatgagagctttctgaagattcctcaaatgtttgtgctttaagacagacagacttatttacattttgctaagtactttcccccttgattctaaaatcatttctatttgaagtgaagtgtaatccatatgtttttgattcattaacacttaatttgttagcctccctttactagagtgctatatagcagccttttcatcttttttataagcttatgttcctcagacacaggaaatcaagtttttctaagagtaaacaagcttcaactcaaagggccatgagagagttaaagcacctattagctttgaactacttctgttcttagtatgcaaatttcttctttcccaatccctgtgaatctgatacatttgtcattaaactgagacacaaaacacggcttcctgttttctaacttactgaattttccaactatcttactctaatttctcttgatgataaagcagccaaccgctaacatattaatgaagaagtcattagtgatcattatttaattgccatattagtatttattcttattaataatgcaggagctacttatcttttaacaattatgtggtgggaaattaaatttcatgtaaagtgttaaacaatgtcattttcttttatcttcagaagtataatgttctttaccaggaaaatgaaaatcaaatactttttcacattttagtgttttttaagaaacaagttttccaatattgcttgcattagtacaggctttagtgaaactattcataaaatgcaactccatcagaatataaatagtatttctataaaatagtaaaatcgtctttgctattcctacttgttcctgttagatattttgttttatagggtgttctctggattttaacagtcacaaggctcagataaactagtatcgcaaaaatgtcaccacagcattgctgcttgttcagacaaatcatctgtttgactgtgaacacttgcattttggtagatcacagataattaaaaaaaataattcttaaaatctaagta

SEQ ID NO: 24724 - DNA, 577 bp, Bovine  19866881033676
taggaagcacatttcctattcttggtaaaataaagttattttaagaaatgtaacaggctcaagatatcatattaaatatgagtgcctcctcgctcatatttcatctttcatatgaaaacttctgtatcttcaaattgttcccttactattaaaatgatccaacagtacagtgactctacttttttgttttccggtatttcgtattgtaggaatgccttaatacttggatgacagttctgtatcactgagcttgtcaatgggataattctgttcccagaaagacaagaagtgaatttctccctgaattcagattattcagcccgtcagtcactatagctttgcaaacctcctgggttttgggagaaggggtgctggaatgtgtctctcaacccagaaaatgaactcaataaagatcctggtttgccaccaccaaggatccctgggagatcatttccaatcttattggttgtaaagagtttcctttgttcagcagcaaactgggagttaaaaagcaaggaagtaggaagttcctaaaaatttataggggctgtttagagtaaaggtgtggtagctgtgt

SEQ ID NO: 24725 - DNA, 986 bp, Bovine  19866881075701
ttctcctcctgcccccaatccctcccagcatcagagtctttttccaatgagtcaacttttcacatgaggtggccaaagtattggagtgggcattgtgctaaacatccccgaagttccttcctgctgcctttataccttccttccgggttgtctctggatattttgctgtccttttcttcatctcagtaggacacagcagggctttaagaaaggaaataaagactcttgtttattttagtttacttaagttacttcgcagcttcctttggtgggctcagtggtaaagaacctgcctgccagtgcaggagactagggttccagccctgggttgggaagatcccctggagaaggaaatggaaacccactccagcattcttgcctggggaaatcccatggacagaggaggctggcaggctacagtccacggggtctcaaagagtcagacacaacttagcaattgaacaacaaataatagtgatgcaaatcgtacggtagagagctcaaggtcacggacaataggaagtacaggctatgcgctgagaggaattagaaggagctaatgagctaagattttcccaaggagtggaagctgattaaacactgaaggatgactggaccacagataacagaagctcgggtagagagaagaacactgagaaagaaagcggtccctctgattttcttcggccaataggattcatcttctttgggaaccaattgtttattgattctctggggaccgcttcttgctgttacatgagcagtgacttcattatggtttgaagttcactccgtttcataggctggctgcacgtgttttcctcaatgctgtcttggcttttgcaaaaagtgcttcatttggtcacaagggggagggttttgtcccctgaacacttcctggcttttgctgtcagcctttgattgcttctaaaaccattccctgggcctgtaatacatccatgtcacttgtctacagaaagtttaaa

SEQ ID NO: 24726 - DNA, 1398 bp, Bovine  19866881205652
ctgcatcggcaggtggattcttaccattagcaccacctgggaaaccccttatggccctacatacgtgtaaatgttgtctttgatttaagacatctcatttaattgtatgccctttgacttgccccactgaatatgaacaaacctctctccagatgtagacagatcaaacagtggagatctaaaacatcccaataaccttctattcaagtcaacttcactactccgaaaattagtgaaacacaaattattgcactaggaaaatcatgttcattttgcataattgtgtgtgagcgaacctagagggagcataattctgtaatttgcaagtgaggaatggagggaagcaggtttctaggcatttgacgatttcagtgctattctaatgacgcacatcgtctgcacaaggatggagccataatgcagccttatcccacggagcatttcattagttgctatactggaaactttatttcattgaagaaaaatcctaaacgtggactaaacttagtctttcaggacaagtcaaacaagacataaaaagaatatggaataaaccactcgttcatgttgcatattaaaagagagattctcactgtggaattctatctacattcctcatcgattatattctaaaagaaatacataaattttcaagtgaagacttttttctcggagacataagaccaaacttggttggctacataaaattgtgtacagcatgaagcaattatgtatacatatatacatttgataattgattgaaataggaaattatgtcctttaggatacagtaacaagttagtttttctaataatttaatacattttcattccaagtggtttaagccaaccaatgagaccaagagataattcataaaagacactctttaagcagaaaagaccctagagtttaatatggatccattggcttcctaataggaagttgtggtattgcaatgtgataagaaataagtatttattcttcctctgtggcttctggcacaaaagcctctaaaacccttggacttgcctgggtgattagggtgagaggagcatcttttgttattcacaataagcccctttcaactataggtggtttatgctaataaggtgattcttggtggacctctggattgcccaggtgggggctggttgccaaaggaatcaattaagtgcttagaggtttggaactttagcccggtcccagggctctggggctgagagattggagattgggttaatcaccaatctctaataattcaatcaaccatcctttagtaatggaacttacataaaactcctaaaaaacaaagttcagaaggctttcaaatcggtgaacgcacagagttgctgggagagcggttggcccagagagggcatgcaagacccatgtccccac

SEQ ID NO: 24727 - DNA, 735 bp, Bovine  19866881235944
ggagtggcagagccgggtgcgctacgcttacatttactctgaaacccatctgccttttgttcatacagagttgcattggtaatattattaacatttgcatacaagggaaaaccttgaggctgttgctaaagacctgtgacttcctattacttaaaataacctgcatctttttcttgcatttgtttctattcccaggagctttgcaaaatgttttaaccagaagccaagttcttcctggtttccaagtgtgttttgtaaaaattgtgcaattgtggtgtgagaaacacatatttctgataacagaggcaagatgtaatgtttgaggggttaccacaattaactatgctcacgataacagaacttactctacaaagtatgtataaccacatgaggctctacatgaggtttccccaaattgcattatttctagctgaattaagcacaggtaattttgttcagaagtctgggtttttggcaatgtaacatagtttattacctttctcaaaattggttcaaatttacttaagtacttgttctgtactcctaatggttatgctaaagaaagaaacatccaggcatgatcattttacttacccaatttatctgtcggtaatcttctattgggcttccttggtagctcagggggtaaagaatccacctgcaatgcaggagacccatgtttaatccctgggttgaaagatccctggaagaggaaatgcagcccactccagtatt

SEQ ID NO: 24728 - DNA, 1642 bp, Bovine  19866881289292
tatgacgttttcttttcacccccctagtgattattatgttagacgatgtacggactcctaggcggtttggggtaattaattaggttattcgtcaggaaaagcagagattccgggccagtggagagtggggctggacagaagcttctctccagtcttcaggaggcacaagcctgccagcgctgctgtgccggggggacaaaaccgccttgtggtgggtggtccacgggaacgtaatcggagatctgcagtgtgtccactacaatcaacaaaagggcacaatagctgctctgtagggaattggaggagaagaatttgtttaaataaattctgaggttgtcagaatgtgaaagccattctcagacgttctgtgcagtctaagggaacgcagatccggaatcctttactctcaggccaaagtcctgataaaaagacaagctgaacttgaactgtataagataaaataaaagcacagataatgttactgtcagtactttagtggcacaaaagaaactcttctatgagttacttcaaaatgtagacgtttatgactgtgaagttttttttcttatacagcacctccaacacaaaaatgagatggtcaaattgttattgcttgtgtgtgcatgtgctcagtcatgttcaactctttgtgaccccacagactgtagcctgcgggactcctctgcatgggattttcccaacaagaatcctggaatggcttgccatttccttctccaggggatcttcttgactcagggattgaacccgagtctcctgtgtctccttcattgcaggcagattctttaccactaagttaccagggatctacctattagctatttatttattctacatttcaatgacaactctaattatcaagtgtagaaatacctattggaaggagcaattgtggaataaaattgtcagtggcagtcagtctaaatttttattaatcaagtatagcatgtctattggttatttctggatgtttttctaccaaaaacatagtgctgtggacatggaaattattgtggaggtccctgggctcaagcctctaaagaaattaagtcctggctaaaccaaattatgtcctgagaaagtaagaatggaaattgtggcccagggcaaagcactccaagtcattaggttaatgatgctcactgccaccccgagatcactccctgggacattacaaagacattagttaatgatgctcactgccaccccgagatcgctccctgggacattacaaagagcatgaaggaccactgacagtattatgggcaagaacagaagtttccggaacgcaaaacttttttttgtttgttcgtttttctgccacggcaaaatcaattccttaacctaaaactattcttatagtttcgtgggagagcagccccattttccactgtgttgcttaagtctgcagtgagaaaaggccctgaaagttgagaacaaaagggaacaggcaatggggactttttcatattccatcatagctctcctctctattgttacaccgagtcttgttttgagactgtatctagagtaaaacattctccatttccctctgaagtaaggtggtcctcctagaggtaggaaaactggatgctgtaaactccggcagcctagggggtcacag

SEQ ID NO: 24729 - DNA, 926 bp, Bovine  19866881431642
taacgctgcattataattagctgtctcaggaagtgagggtattttcagttaactgaatgggtgacaattacttggattactgtcgtgcttaaaatgtcagtgttaaatgattgctttaagcacataataataaattctgcattcttaagtggcaaatacaacaaagccaaatacagagaatgtttttagtggaagcaaaacttgaacgaatacctgcaacacacatttttaaaacacaggaaacaaaggaggaatagcaatcaacaagcagacatggttctgatatttaccacttcacttaaaattaggaaaaggtcaaaatcccagagagacaaccagtttggggacacacccaccatttccccagtaaatgcataaggactgctgagaatttctacagaacctgaaaggcttcttcctgggaatctgttaattatggcatttatgaaaataacattggttaatttcacacctgccattaaatcctacatgatttcctgggatatgttgtgattacactgtagctctgcaaaccatattttccccatgtcagtgttaattgtacaggattaacaaatgacaagcgccattcgctcatactgctaactgttggtaacgtctctccttgtatccagcgtaggtttggtttccttttgaatcccccagtcccttgagcaagcataaactactcaacggtggcagtttttccttcctgcaaaccatgccacctggaaagcaataccatggagcaggaagttccatttaacctcaaaagacaggtcttgcctttgccaactcaagtctactttgttaggttggataatattcttttattcatcacctctagttcaaccaacactattttaggagagcagagaagaaatattcttgtctcttgtctctcctctttgttcgcggggaagaaa

SEQ ID NO: 24730 - DNA, 1224 bp, Bovine  19866881501809
ggtacataatggctcctttttagtctttgatttctgacactggaatcacccagcttcaatactgctatgaagactctaaagttgtagggccttttgtctgttcaaaatacaattggattcggaaaaagactgacatagtagatctcaacatcttttcaacacctttcctgaggacacgcctttttttttttaacaagatgccattattctgtacatctacaaatgcaaaccactgacatgcattgatacgctgtgtgaatgcttctttgatcctttgggaagtgctgtagtaaccagaaagcaaaagaaaagtgagaggagggaagccctgaggaatagtgctttataaatcagaattgccatgcaatttacagatgagttcactgggtaccatgttagaatatgaatgcatagcaacagaagtatcagagctcatcatttttataacaaaaatgtgctacgcaaagcgtttatctaaatggaacgtgttgggacttcccctgtggtccagtggctaagacgtctcactcccaaagtaggggcccaggttcaatccctggtcaaagaacttgatcctgtatgccgcaactaagacccaattcaaccaaataaataaatcaatcaataatttttaataaatgaaagaaatgtcgtatgttgataccccctacttctttggacatactgaagcagttacttccttcatttaaattactccctaatcatgtattggacttccctggtggcttagtgctgaagaatctgcctgcccatgcagaagactagagttccacccctgggtcaggaagatctcctggaaaaggaaatagcaacccactccaatagtcttgcctggaaaagctctcggacagaggagtttggaggactacagtccacagggtagcaaaagagtcagacacagcttagtgactaaaaaacaagaagaatcatgtattatatgccatgtttgcaactatattccaggccatttgatgagtgccattaaacccagtaatacaccaaagacaagttctacaacttctagaagaatataaaggggaaacagggagaggagccagcagttgatgccatttggttctaaaaataaaatgtccatctttcattaaatgcttgattggatttagtgaagttttctgtttgttttgtaccagccacaggaactgtttttgatatattagctttattaaataaaaattcccatag

SEQ ID NO: 24731 - DNA, 988 bp, Bovine  19866881620453
cagcatacattgaagccatggtatatggtatatgtgtatttctaatggccactttcatcctgtagaaatgtgggctatctattgtcagtctcatcaaataaatgtcaagcatcccaaaggcagagaccacgtcttatctgttttatatctctgaaacaagcgatgcccaacacacaacagaagctcaataagagctctctaaaaagaaatacaacccctgcccaacattgctgagaccagtctgctccagcaacaacagactgcaaactgagaaatcagggacttagataactgtcctgattcataagacagaagtttggattaagttatccttaagatttctactcactctagaattttgccccttatttgtagacatcaatttaatctgcattatgagaaattggtagtggtaaagtgtccgcctgccagtgcagaagatgcaagaaacatgagttcaatccctggattgggaaggtcccatggagtaggaaatggcaactcactccagtattcttgcctgggaaatcccacagacagaggagcctggtgggctacagtccatgtggtcacaaaagagttggacgtgactgagcaactgagcacaacaatgagaaattaatattgagataacccctattataggtttttgatattgatacttattggaatcttcagtagctaaaggctagagaaaagcagctttagaaattctttacattcttttttccactaacaaaatcccattacaaacctgaaaatagagattgcacagccagtggtccaggtccaagcaaatcagatcttcagttttcctgaagctgtcgactttctgatcataatgtcctcggagaagcggacacttgaattttccttccaccacatccatgctgctatcatacaaagggaaggttgcccagcccacaacctggtggacataagtatatttcccatgaaggataaagagttcaatacaagaaagccatgc

SEQ ID NO: 24732 - DNA, 1047 bp, Bovine  19866881724498
tttaaatgattcatagaatatgtattattattttaactcaagatttccttaagattctccatccatagcaagttcacaacaaataggtcagcttctcattacctttcttttctaacttggtagtaatttctgacattctagttcagtctgcaggtgcacgaactatgatttctttggaaatatggcttaaaagttagatgtatttcccccgggaaacaggctcagtagtcttgatggaaggtcagtttccagaaatgtctagctgtatgtggccacttgcagatgtttcaatacatgcacacacatgtatatattgatacagagactcaaaaattactctgaaggaatttaattagctctttaatttctgaatttcctcagagctatcaacacaaattactttttataataggtggctaaataaaacaactcagaattaaattggaaaaagtgttaatatattatgtattttgttgtgctaaattatgagaatatatgaccctctattttaagtcattacttaaaagttttcaaaaaaaagatatgcattaaggattactaaaacttgtcttgttataattggaagaatttaaattttatttcaatagctagatcatgtctctgaattcaacaaaggagaagagagtgaagttttgattgttttccttattacttatttagaaaatactataattattattgatggaaaattatttttggctaatattaaattgacacttgttatgagacaagtattgggcttccctgggggctcagatggtaaagaatctgcctgcaattcgagatacctggggtttgatccctgggttgggaagatcccctggaggagggcatggcaactcactccagtattcttgccggcaatcccatggacagaggagcctggcaggctacagtccatggcatctcaaagagtcagacaagacttagagagtaagcaagacacatgagacaaagtattacattctcccttttgattgctccatgaaactttgaaataggtattgtaagtaagtatcttatgcg

SEQ ID NO: 24733 - DNA, 998 bp, Bovine  19866881754658
ttgaattttaaaaaacagatcaaaatgaaatgtgtgaagtatggaagtcaactaatgtctgttgtcggctttaaagctagttaagatgatattcaccttaaactaatcagattcaaggtctctggccaacatttattagattctagaacatatactaggtcacctgggccattctaggtggcagaatgtggtagaataaagccgtaagcaaagggctctgccacacagagtgctcaagtgtcacatttttttcagattctgtgactcagtcacccgccaagcagcagatttgtgatgaataacacccaaattgatttttccataatggagtgtaaaagaaaaatggacaggttttgttgcaggtattttcatggggtactaaattggaggattagttgcaaacagcagtactgataaagtctgctgtccatcttgatggttgggtctttctattaaaatgacacataaataacctattatatcccccacccatggaaattcaaatgcacctgtcaacatgataaagcacttgcctggaggggagcattgtttacattttcactctattcttcagaaaaagtgagattctaattatttctcccactctaaattaatgctgactgtgatggttagcatatctctatattgttacatcttttggaaagttaaataatagagctgatcgatcatgtattatgcaacgtgtattttatgacagccttctcggagctcttagatctcctctctaaatgcttattttttctctaacttgtctgctttctgcctctctttctcttttctaccccatgagaaatctttgttgatacccagttaattccaaaatgtgaacttccaccttctttaccctgtttctttcccttgttgaaaaatacacttatgattttcagcccacagttacttgctttcaatgatctaagtcatttttaatctcttcctgggatattttctccatcgatctatcatgtcgaagacatatc

SEQ ID NO: 24734 - DNA, 691 bp, Bovine  19866882057429
attaaaacttaaatgtttaatgcatatattaaaattttgtgtcatcattaacccagctgatgaattctctttgaaaaaaaaataatgggaaagatatatccagagagataatttttacaattagaataaaaatatgtaacttgaagtctggtgagataaaaatgtctaagtcggagttccaaaccccactttttttttttttttttttttgctcatgggaatcataccgccacttgttttcctattaaatgacatttcaaatcctttatcataaacataaatcacatctcctttcaagaaggcaaaggacaaactaaatttgagatctggcttgcatttctataccctacccaagactaaatagatgaacagttgctttatagattgtatctgaaggataaacaaagagagacagtagatgacaggaaacatgtcactcgaaactgacatctgccctttaattcacaagcatcatcctcaaccctgtcacttcggttgacatctgttacacatcctgatgcatgcctttctggaaaagtgcaattttatctgcagtcggttcgaaaaatgtatatatacatctatgtgtatgtttgtttaaaatgccttgctgcatctatagatatgacttcaccattattagtcttttaaaatgccgaaagaatgctattgttcaccagctgatccactg

SEQ ID NO: 24735 - DNA, 1850 bp, Bovine  19866880367521
aaaaagacaaccaggtagtcctggacagtcagaggaggggaaaaggtgaaattatattagggaagcttcaaacaggccggctgataaaaccctggcgttattcctctccaccctcttcataactgagatggcaggagaacagacaataatctagacagtgggaacaaatgagggaagagtttgtcagtgtatggaaattagaaaaattttaaattatgtttaaaattttcccactatttctgtatctatgtacaaaatatccacctctggatcctctgttgtgagccctgcctgaggtgggtcaattgtgttgtgttcttattgctcagttgctaagttgtgtccaactctgccacctagtggacagcagcacgccaagctcctctgatctctgtctcccagagtttgctcaaattcatgtctattgggttggtgatgctatctaaccatttcatcctctgccccattctcttcttttgcgttcagactttcccagcaccagggtcttttccaagaagttggttctttgtatcaaatgggcaaagtattggagcttcagcttcagcaacagtccttccaatgaatattcagggttgatttcctttaagaattgattgatttgatctccttgcaacccaagggcctctcaagaatctccaacaccacaatttgaaagcatcaattctttgtcactcagccttctttattgtccaactagttgtgttgtagcagcaatcaaacctgctgtgccctggtcaggcttagataaaatatccatggccaggctttatcacttcatttgctatcctctcaatgcttcctgtatacactgaaacctttccatccttacatttctgatttctaaagataagattctgtcttttatttccagactctctttactttgtctactcactcagtatcttcatgctaaaggcatctcttttacaattttatgtcagttttcaggcaaaaacataaagaaaattttccttagtgtggattaaaaagaaaatgatagactttggaaaaaaaatgtcttctactcaccaaattcccattcattcctggtggcttgcaaggtccatcgtgagccctacagcaaacagatgctattagaggaaatccctttcctttgagagagaaggcgctggaagaggtagttttcaaaagaactattcttacctgctgatccaaaagcgcccagaacatgggcaatgggatataaaggaacagtaccctggtcagtgccttcacatccataatgagctgcttctgcaaagaggaggaagaaggaataggctgaattggcaattaagaatttcttgcttggagtagaaatggcccagaacagtaagagaagaggtcaaataatagtaggagagaatcagtttggttattaggaaaaactctatggaggcatcagatgtttctgcagttcaacttactgggtatttctcagctgcccagtccagccagtgttctcgcttgggattgtccccagaatggttcttgaaacggctggaaatggcaaactagggcagagcatagatatcagaagagaggaaaaaaaacaaacaaaaaacccatcccctgccttttccatttcactgtatcttcccttagacacacatacttttgactgacttaatctaaccttttaatttcatcacacattgaatttcagaatatttgaaatacaatttcaacatatataactacatttcagaaaacttttgccagtttttaaaaatgattatattatttttagcttaaaggttaaatagaggcatcgagtgatgtttgatcaatcccactttctaaaagtcacagaagcagcgcagaggtca

SEQ ID NO: 24736 - DNA, 2363 bp, Bovine  19866880370444
atatagtgatattgtgtcctctgtattcctaaaaagtattaaaattgtttttagttttgaactttatacaagtgtatcatgctgtaatcttctgagacttacttttttggcttaatattatatcaataagatttgcctatatgactatgttttactacggttcatcatttgactgccgtataatagtccactgtgtgaatatatcacacttatgcactttcccactgatgggcatttggactgttgcagtaaatggcaatcctttccttcaagtttgctctaggactgtgcaggactcatgcaagagcttaagaaattctaaagaaacttgaaatggataactgcttttagcttcttgcacatttatttgcaaggccaaaaatgacataccctcagtattctatcatcctgctttcaagaagatgttctcctcaaagttaatgaaagttacatacatttaaaaaattagggctgtttcctcttgcttattttaccactgcaatgaaagaccagaggtagatcatttaaaggtagaatagagtggcttcatttttttccaggcttagcaacctaaatttctttcaaatgtttctgctaagggttatctcaaatattttctaaagagatagtacactcatatcccatggactttctctaactcttttatgtcattttttagagtatgctaacaaaacttggtaccatggttgagactgacctcaggttggggtgtaccacatcccagtcctcccatgacagatctcaggatgcgtttgctgccttttgcccataactccacactctagctgactcacatccacattctgtcatttaggtcctcctcatttttctaatacacatttgattgaacagtcctatccaaacttacatttgtatgttttaaatccccaaatatatcacagtgcaaccattaaaactgaatattatgttattattgaagaactattgcatcctgttaagttcattttggattttgttcctattttttaaggaccatgtctccctgtcaggaaatgccaggaaaattttaaggactgaataactggcctctctaactctgtacagaagactcatgagccattattaaaaaaaacaaatcctacaacatgccaccttccattgctcctgtgagaagatgctccactgttaatgacacctgctgctcttctggagaaagcctgtctcaaagtgataaactttccccaaataaatcacatctatgttcctataagcctgactttgaagctggaatatgcgacacatcctcccacatggtggaaacccattcagttgattctctgtaatgtggtaccccttaggcagaactgtgactgtataaagagcttcatatctatcaggctgggtgcagggcaatgtgaggtccttggatcagcagcagcagcagcatcacctgggaacttgttagaaatgcaagttcctggtcccatcccaatctactgaattagaaattctgtgggtgggacccagcaacctgtgttttaacaggccctcttggtgaatctattgtacacttaaatttgagaaacactgcataagctcaagtgaatagtctattctttgccctgaaaaatctgtttcctaaaatatgattttcagaatgaaactttccccccacaatactataatcacttcccccaactcctgtccatccccaccagcataacctaggaaaaccaaaatgcacaggaacaacaacagtttcccgttaattcattcttcagttttcttgaaatttttctcatgcaataattgctaacattttaagacactagtattccaggaaacataattcagaaatcattgctctcttgctagggtaactttctgaaatgcatccataagcagtacacatgttctgtgaactagagaaaatggccatttaccacagaatggccacttcttgccctttctcccaagaaatggaggggtttccattctatctggtttccattctcctctacctttccctgcagaatcttgggagctctatttttaaacctaaatctttcattattaaccattttaagatttgcaaaatttgaggtacatactcctcacagccagtacattaaccccagaagcccaggaaggcggaggaccctgttcacactgggccattagaagtcaccttcacaaacagtccctgtttagcatcattggtctcttctgctctctctcagagtccttccaggggctcagaaaggcctctcttccccaggaactgtaacagtcctgaacactccgaatccctggccatccagtatcctctagtgctctctgctggcccctgagccagtgaggggctcctgaagagctggtca

SEQ ID NO: 24737 - DNA, 1766 bp, Bovine  19866880418950
ttttttaaggattttaaagttgaaagaagcttcagtgactggcatgacccaggcatcttcaaaatgcagcccataacatttggaaccactcctattagaaagtcttatagaaagctgaaatcgccctgctaacacagaatccatctaactccctcatggactctctcttcagccattagaagacagctaacatgccctcttgaatcatttcttttccagacctagtagtctcggttttctaaataattatttcagggcatgattttcagaccctcaccactctggatgccctctgtctaatgttccctaatttatcatgactcctcttatggcatctaacactgggcacaattccttcaaatagtgtctgacttctgcagaggacagtaggctgtatatcaccacccttaatctgaacatcagagaccgttactgcacctcaagccttgacccatcttctgagagagaagagcactttctcttgaaacttataacttccagatgggatccagcacttctcctttgtctttctgatagctagaaaatgaaaatgaaagctacaattgttccagcaaaactggttttctgctcatgttctaatgagggttcacaaattagataacattctcacatttttttatgagtgcagaaaagctaagtgcagagttttgatgctgctgcttataaccgtcacacaatccatgaggacacatatcctctttgttgtaccctagaggacagagttgtgcaggtaccacatacatagctgagatcacgtaagagcttgccctgaagtaatatgtatatattaattgtattaaagaaagattggaggaggaaatggcaacccactccagtattcttgcctggaaaattccgtggacagaggagcctggcaggctatcgtccatggggttgcaaagaatcacacataactgagcaacagagcacacacgtgcacacacacacacacacacacaaagataggaaaatcagtttagcagtatagatgttttgtgtaatgaaaaattgtataatatgtcttcataacttttcaggtttaaaaataaacaaatgaaggaaatatgaagaaatattactaagagaaaatgtcacgttaaaagttagaccaggaactttgggaagctaactgatacagtgaagtataacagcttatatttctttccccctgccactgagttcaagtcatgaaacccacaatacaaagagagaacctgcgaaatcgttaggttttcttctctgggcactgatacagatcgagaacacttaccaagttctcactatgtgctgtgtcctgggagggcaaaacctatgtcatggaccctatttctctttgttcatttgcctgatttttatttaaaataatgttctttgaaaagtaatgcatgctcatttttaaaaatacaaagtataaaagagaccagaaaaagcacacgatgttaaaactcatcattctaccacccagaagtaaccactgtttgtgaacagcttcctacgcataatatgtgtttgcttgtttgtttatgaagatgagatcactcatttctctttccccttcaacctccagaaatgtcatagtttaaatttgtgactgcaaacctgaaactagttttaggttcctatgtgttaaaatcctaatctatttatattttcactgatccttttttttaaaatctctgtattactgttattaaaatacttcatatcagctacttcaaattctttactggatgatacagaaaaaa

SEQ ID NO: 24738 - DNA, 1563 bp, Bovine  19866880480430
gtgtagaatctattattttactatgaagagcactgatattttatcagtcagttagcttggctgaactcaaacttttctaggcaatagttcaaatctttgttcagttgtgtagacttttacctggctgcttggagtctgcacacagttgcatagttttgaggtcagctagatatttgggcagaatttatatgaaaaatttttggttctcctctgtatctctcagttctgaattatctcgcttcattttgtatctcttgtagttactctgagctctgtttcacattctgtcgataaactccagttttctgtttaaggattctgtcttagtgaggccttccctgatgatgctatttaaaaattgcagagccactcatacctttctggtgcttcattttttttttttttttttttttaacacaactgttatttatcaacagttaacacagtatgtgttttaactttttttatttttattttaacgttttttgtttttagaatgtaagttctttgagagtctatatactttcttcttgatctgtgctatttcttcagttactagaaaagctcagattgatgcttaataaatacttgtattaatgaatgaatcaatgcattaattaatttcatttcctgtctcttgtatagtactcgaaaggcagtggatgaggaagaggaagcagttgaagagcgtcgaaatatgcgaactatttgggtgacaggcagaaaaggtttaagtgaaagggaagcagcaacccttatagtagaagaagccagaatgattctgcagcaggacttagttgaaatgggagtgcaatggaatctacattcctttctaaattctgatacacacttactgaccagcagtgagtccgaagtaaaagaacacaaatttatacctcaaactaagagttcttacaaaagattaacatcaaagaaaaaaagtgacacaatatttagtgattctgttaatcacttaccagataccatgcaagatttagataaaagtagagaacatacagattccttttattataaatttcaggatgggaatcaagagtgtcatcattccatctccagagggaaaaaacaggcttctttgagtattaaaaaaggaaagctaggaacttctctgaatgaggggaaagcaagcacttcgaaagttgttcggactctctcatcacggaaaacaaaaagagaagctttaaattttagttcagaaaaagtgagtacaatctctcaatcttggaaacatggtaagcatcgaaaacgatccagcgacagtaggcctgtgaaagacacaaagatgcgtagaatcaatttacaagaacggactatgtctaattctattcattgtgaagactcttttactttagatgagatgagtatggaatttagaagtccagagccatttgctaaaaatgtatctttccgtgctgagagaagatgtaacataataccatttgcatcacaaacagaacaaagttgttctaggaacaataaaatacctaatgatattcttggggaacacttgatcacaggatctcagagtaaacatgtgattca

SEQ ID NO: 24739 - DNA, 865 bp, Bovine  19866880506589
aaatatcagcaatctcagatatgctgatgataccactctactggcagaaagtgaagaggaactaaggagtctctagataaggatgaaagagggagagcaaaaaagctggcttaaagctcaacattcaaaaaactaagatcatggcatcggtcctatcacttcatggcaaacagaagggggagaagtggaaacagtgacagattttcttttcttgggctccaaaatcattgtagatggtgactgcagcaatgaaattaaaagacgcttgctccttagaaggaaagctatgacaggtaacctagaaagtgtattcaaaagcagagatatcactttgtcaacaaaggtctatatcgtcaaagctatggcttttccagtagtcctgtgagagttggaccataaagaaagctgagtgccaaagaatgatgcttttaaatcgtggtgctggagaagactcctgagagtcccttggacggcaaggagatcaaaccagtcaatcctaaaggaaaccagtcctgagtattcattggaaggcctgatgctgaagctgaagctccagtaatttggccacctgatgtgaagagccaactcattggaaaagatcctaatgctgggaaagactaagggcaggagaagagggcagcgaaagatgagatagttagatggcattaccaactcaatggacatgagtttgagcaaagtctgggagatagtggacagagaagcctggcatgctacagtccacggggtcacaaagagtcagatatgacttcccaatttgaacaacaacgaacaacaacagaaagggttaaaaagcagagattactatacctgagctgatgcagctcatgctgccaggagaggtttt

SEQ ID NO: 24740 - DNA, 1742 bp, Bovine  19866880520722
tatcttatttacaattatatccccaatacctggaaaataactggcacatatttgttaaatttaagtggaaagtttttaatctttctaacttctagcacaggaaatgtactcaattttgtttgttggatgaaaaatagaaagaactagttaacactgaaggtacataaaacttgtcattaacacatattcttcctgagttgagtagcaaacaaatacttagaactttatgaacaaattgattcataatacagagatttaagaaatttcatcaaatctttgatttccacaacatgttgtcaagctgactacagctatcccccataatactgaatcattactgtcatgaaataagacaggaatacatggtattatttgactaaaagtttcaagtctctgaaaacctggaagagtcctgtgaggctttgtggtcaacactgcagtacagaattcatgactatcagtggagttataaattctacttgagataagtcttggcaaacaagctaatacacactgaaaataaagtgcctatttgttacgtatttctgttatgacataagtgaataaggatattacagtttaagagaaaataattcatgctgctgctgctgctaagtcgcttcagtcatgtccaactctgtgcgaccccatagacggcagcccaccaggctccccatgagcaatgataattaatacaaaccatcatgtctgccatttgcaacaacatgaatggacctgagtaaaataagtcatacagaaagacaaatactgtattttatcatttatatgtggaacctaaagaattaaacaaatgaatataactaaagataaacagactcacaaacaaagagaataaatcagtgattgaggataaggaggtgtgaggggcaagataacagtagaagattaattagtacaaactacaatgtataagtcagccataagaatatattgtacagaaaagggaaatagaaccattattttacaattacattaaatggagtataatctataaaaaactgaatcactatatacccaaatcactatataccccaaattaattcaatattgtaaatcatttatattttaattaattaaacccatatcattatggtgccacaaaaaagctgaaccatattcaaaatatacatcttaaattttagaaacatattcaaactaatatattttatatatatatgattattacatatatatgtgtgctgctgctaagttgcttcagtcatgtccaactctgtgcgaccccatagacagcagcccaccaggctcccctgtccctgggattctccaggcaagaatactggagtgggttgccatttccttctccaatgcatgaaggtgaaaagtgaaagtgaagtcgcttagtcatgtccaactctgagcgaccccatagacttcagcctaccgggctcctccatccatgggattttccaggcaagagtactggagtggggtgccatcgccttctccatatatatgtgtatatatatatgatttcttaagagaaatgtgtttaatggtaaagctcagcacactttacactaacactaggcatgaccaagagctaaagcagcagatatatatgagaaactaccacagagcctcacaaaataaagagatgagcaaggacaaccaaacagaaaagccctatggcctcagccagggcaaagcccagaatggcatagaagagctatatttaacagacaggttcctgaagcattaag

SEQ ID NO: 24741 - DNA, 989 bp, Bovine  19866880551506
ttttgagctttcttgaacttttcctcatgggaatgttagcactcctgattagcactagacccatggagagaccgatctgactttaggaaaactgagaccaggcctgatgacttttgtttcagcttcttgtctccttgaaacttgggaggtacagcagcacttgatgtatatttcccaactcagctccagtttttgctctccctgggtccctatggatagttctatctttgaggatggaagaggttgggatctgaaggcctcttctatctgtgaagctgcaggtgtctccttacctcctgctggatgaaatttgggatggggaacaaggatggcagattgtttcttgagagggttttaagtgcagagtgaatgttctggtacaggcttctcagaggcatcagagatgcctgagggatacagatacttgccaacttatgctcctgtcttgatactagttttcagttctttctgagcatcctcaagcagtaattttgcccaaagaggggcagggccaagcagtagccctagcacatgggagaagaggagagctgaagaggccaggcttccttgcctgggaggtgacaagagttgtctcctaggcatggtctttctaggagctgctctgtggcattttgtagaggagaaaaaacattcatgccataggaactcagctactgtttctgtatgaattgttactgagcatttccaatatatgaagaagtcatatgaggagcaatggtgactttcttatcctgaggcacttacagccaagagcatgaggaatctgaaatcaaagagaaaattcctaatcattcagaaaattcctctcattcttcactgattcaacaaatactaagcaccaaccatatgtcaggcactgatgtggtttattttttcacctggaatctaagaataaatctcaggcctttaagcaagctttgtgatggagacttttctagcccttcattttaagaatgttcttatcatgt

SEQ ID NO: 24742 - DNA, 1814 bp, Bovine  19866880556311
aactggggtttatatagttctcgctttctgagatggcccacactctgtcagtggaatgtgtttctcccagggttgttctagccttttgagacagaccgcgttctgtctacgtaatgtgtatctctctaaataaatccacttcttacctaaaaaaaagaaaagaacttgggcttaattttatatatataatatatatattgtatgtatgtatatatatataaagaataatttatagagaagtgacaggtgaaaagaaaaggtttttaggcttctaaggacagtgaactgtgggaaggtaagtatattggggaaagtaaatatgttggggaactaactaatgaaagatatgtgttatttgtgcaggttcgtcttagcataactttccatcttcatggccaaaccttgggaggaaaagtttgtgacagtcctcatttctcagatgtttctgcttttagtcagttaaaagacactctgggaagacttctttctgtgcttcgtcattctcttttgcccccagctcaaaacagtctttatgccaaagtggcatattccactacctttcaacttccccttgaaattgatctcaaaggcataactgtgtctctttgtttgccttagggacagtgattataggcagcagtcactcagataaatgttgattgagttaaatgaacaaaatcctttaaatgcttctttgaaatttttattttttcatagtttatagaattccatccagtgaatgaaccagaatttatttatataactcactgttgtaggatatgtgcttctctcgtgtctcaatggtaaagaatccacctgccagtgcaggagatgcaggttcaatccctgggtcaggaagatcccctggagtaagaaatggcaacccacttcggtgttcttgtttgggaagtcctatggacagaggaccctggtgggctatgacttaacgactaaacagcaacaacattgtaggacatacggtttgttttcaacttgttactattgtaatgctgtggagaaaatccttgaacataaatattgacatatgtatcagatttttccttaaggagtattagaaatggaattaattggttatgatttttaaggtgtttgatacatattttaaatatttctccagaaaaaaatttgatgcatatatccaaatatttcttcagaaatgttgtacacgcagcacatgaaaacttatttcatcatattctaactacactttaaaaatttttttgctctctgtacttatatgattactatcaaggttaagccttttttcatatacttcttgagtagatatatgattatgaaaattatgtgtacttaatgtttctgtcatagatctaaacgaacaaagatgttaatgaagctaagtagacagaaggaagaagaggaccacagattacagctgcaaattcaaaggcagagagccatgagactttcccgagaaatacggctgaatatgcttgaaatagttcatccaggtgtgtggcattatcagtttataagcataagattgatagggtagcttttgataaaccaaatttcatagctacctgatgagttaatttttaaatgtggacctttacccctgtttcagctttttcaggtaaatcttaatctcttcagtcaaaaaaaaagtcttatttttttctgattagacttactagttgatgatgagcaatctctccactaatttttcttaattttcagataaatcagtgaaacataaaattttatgcttaaagatagatgtctttgacataaagaaagaacccctgaacttaagtaagatgttagaatat

SEQ ID NO: 24743 - DNA, 1369 bp, Bovine  19866880572499
cgcatgctctttgctgaaatattttccacttgtcaaacttggccggtccatcccttctttggttgtggctaacgcctctcgttcttcttgacttatctctaccacctccccattcatggctgacagagagcagcctgttaccaaaccagcatcctccccacccaccgctccatccatttcctcccagctggcttcaccattcataggaggttcctcttccgtgggttctctagtttctgggaaaagttctaccattttcagagacctaaaaaggaccttctggtcctgaagggccagggctgtgtccaagcattcctcatcgggggtctctttcatgatgttctcatgaagcgttgtttcagagtccacgtttggccaacggttccactccatggagcagcagaccacgctggcaggacacacttgcagatgcttggccagcttgtggcgggacatgaagagggggcagccatattcagagttgaggcatggaacctgctctaaagggcagagtagctcgtgctcagcctctttgcacatgtggaaggtagcaccgcaggacaggtggcagtttatcaccgggcaagagacactgggctccacaggcatgtggcagtgacggttgaagcatctctcacagtgtctgtgctgccctggcggaggcctgcgtgtcctaccctagagacaccaaaggcaggggaaagagaaaacaagtgactgctggaagataagtgtctgtgagtgtttaagttttaattgacttatttcctgtttatacatgctgattgtaggaaccttggaaaatacagaaagtcatagagaagaaagctggagaagaaaacggcaacccactccaatattgttgcctggaaaatcccatggatagaggagcctggtgggctacagtccaaggggtcactaagagttggacacgactgaatgagcaggcacagagaagaaagcaaaaacttcataataccacaaccagaaataacaactatcaatactctttattttccagtagtttattttatctatgtactagatgtgttgaaaataggggggaaaacacatacacacaggaaagtaggctacagaattgacaattggtatttttgagttgtggattattgaggatttatgcacatttaattgtctgaatacaatttttctgctttaacttgctattacgttatgtctaggctgttttataaattttcctttggaaacttttttcacagcggccatgtaacattccagagcaagtgttctgtcattcacatgatcaaccaccagggggcagggctggggaggacccaaggtgggtctggttttgttcacatctgcgtcctcagcacctgtcacaggg

SEQ ID NO: 24744 - DNA, 1630 bp, Bovine  19866880576361
tgtaaatcatggttttattattggaaggtgagcaaaatgaagaactttcaccaagtttaaacccatgactaattttcttaagtttcacagatgttccaagaatatctggaaatgccaacttagaatcagaaggaataggtgtaggaggaatgagtccattatcacgaactatacagttttctttacaaggcaagagggaggtttcaccatgaatgacatcgttctgtagtgcctcaagattgcctcttactacaattttaggtgaaaatggaattccttgtacttgatttggctccgtatttgaaatcacttgtctgtcatttacctctgcattttctccattcaaaccaggcaagtctgtagcagttaattttggcttttcattttctagaggactggacacttggtctaaaatcctttgcagtcctggacttaaatcaaatgatgctcctgaccatagaaatgaattatcttgccttgtgccagttaacttggatttttgagaccttttatctttttcttctccaattacttctctttgggaatcatcattacctacagtcacttgatcactccgtttcagtatttttagagattctgcagtattatgtttctcctgcacaggaactatgtctacattgtccaaagctgcaaccatctggacagaatcgatttctgaaaatataatagactcatcactgaaacaagacaatggctgctgattatcttgattctcattcatatctggttttttaattatgccctctggttgtagacacagagaatcatcgaaatggactgatgttatttcagaaggaaggtgttctttttcttgtccatcaggtcgttgttcttctacaaggtagtcttcactgaaactgtcaaacagtaaactaccactcaaattcaaacttgtttcaggaactggcagacactctacttctgtatcagtaggaattctcttttgaggaatcacaggtataactggcttcatagtttcttgtgtttgataaccttgaagaaaactatttaattgggagtcagtaacagaaagttcactgcctttaaaacatgggccattttcccctactagtactggagaataaaaaattggcctttctggagtcagggtatcaacctcatgtgaatcagtgctttgcttcacaacatctacagtcttatgtttcaaatgatttgtcatttctagtgaatgctgttcgcctggaaaagcaacatgaggctctttctgaaaggagctcattgagctctgtttgtctaggttcttctgaatcatccctgttgccaggctggtatccttgggtccttcttggttggcatttgcagttgctatctgctgaattattttctctgactgagtatccaggtagaaactatcttcaagatcacagagatctaaacctaagtcagaaacacaattatttttagttctgtctgctgcataagcatctgttcttccttgtactctaggagtatttagaatattctcaggctggcctcttaatttaccaaatgctccacttggtagatgtacttcactgggtatctcaatgctgcttatgatatctcctgatgccttaagattacttgatttattttcctcaacattaaa

SEQ ID NO: 24745 - DNA, 3045 bp, Bovine  19866880604258
aaagctgagtgccgaagaattgatgcttttgaactgcagtgttggagaagactcttgagagtcacttggatggcaaggagatccaaccagtccatcctaaaggagagcagtcctggttgttctttggaaggaatgatgctaaagctgaaactccagtactttggccacctcatgcgaagagttgactccttggaaaagactctgatgctgggagggattgggggcaggaggaaaaggggatgacggaggatgagatggctagatggcatcaccgactcgatggacgtgagtttgagtgaattccaggagttggtgacggacagggaggcctggtgtgctgcgattcatggggtcgcaaagagtcggacacaactgagcgactgaactgagctgaaagaccctgcagacagttgaaactacaaaagattactgttaactaaagaaaaccaaattactgtttattaaagaaaagctatgacaaacctagatggtattaaaaagcagagaattacttgccaacaaaggtccatctagtcaaagctatggtttttctagtaggcatgtatggttgtgagagttggaccataaagaaggctgaacaccaaggcaactgatgcttttgagctgtggtgttggagaagactcttgagagtcccttggactgcaaggagatcaaaccagtcagtcctaaaggaaatcagtcctgaatattcattagaaagactgatgctgaagctgaagctccaatacttaggccacctgatgcaaaaaactgactcactggataagaccttgattctgggaaagattaaaggtgggaggagaaggggacaacagaggacgagatggttggatggcatcacggattcgatggacatgagtttgggcaagttctgggagatggtgaaggatagggaagcctggtgtgctgcagtccatggggttgcaaagaataggacatgactgagcaacctgaacaacaacaaagaaaaccagatatctcaagttaatgaattttctctgcacgagaagatttaagagtctgggctcattgttatgcatcttagctatctagggctagtgtcctgttctttcccttgctgagtccccttaagtgtgcctttgaggtgggtgcagtggctaaggacttggcagggggcagctcatttgtctccatcctgagttcccttagggctcacctgtggcttgatgtcaaggagcatagcaaagttcctgctggtcttgaagtctccactagaaagtgatgtgttttacttcttatattttgctggtcagaacagtcagccaaaccaagactgccttcaagagggaagggagggacagaaaatcttgtggattagtaatagaatgccacagggaccttccgtcatctcgtaccacctagttctttcagatttcttcctacttctgtggttgttcagacactaagttgtgtccaactctttgtgactccatgaactgcagtatgccgggcttccctgtccttcactatatcccagagttggctcaaattcatgtccattgagtctgttacgccatctaaccacctaaccatcctcttccacctccttcttttgccttctgtccttcccagtaacagggtctttttcaataagttggctgtttgcatcaggtggccagagtattggagctacagcttcagcatcagtccttccaatgaatattcagggttgatttcctttaggattgactggtttgatctacttgcagtccaaaagtcttctccaggaccacaatttgaaagcatcagttctttggtgctcagccttcttcatggtccaagtctcacatccgtgcatgactgctggaaaaaccatagctttgacttattgcttgggactaaatctttctgaattagctctgactcctcacctccccctaaagaatatctgaaaattcctccctccatgtctatgtcttacctttcccctatgagttaactcccacatctattatatgtaacccccagttttaagtactgtgggtaatgtagtgagtttctttttaaatcctcctttcaaaatccacataaaaatcaattttttccattaatcctttcttgatcccttcagtccataccaaattctccaaatttctttattataaacagatgcaactgcccatctgtttagggtacaaatgctattctacagcattcttctatgttttctagttaaatattttgcttccctgaccagactataaattctgagagagcagcacttttttttaaggacctccggaactctcaaagtcttgcaaaagagcaagcacagaacatttaatccttttttatttaaatgcctaagcagaaggaactgactcaaacttcaggaagcagttgtgaagacagagtggcaggaaatgacagaaaacctgaatacggaactgaaatagcagcttagagtttcttgctctgaagtggcagcagctagaaaggggtcgagtgtcttcgtgaggagctgagagagcaaacgcacagttgaaggtgggtactctgggcagtgggtatacgggagcacaggacaagggttgaaatgagacaatgctacctggctgttactccttgctgagaggtgaagtcattactagtagtcgtttaaccttttatggccagaaggccagcctggtggtgagtggttgtagataatgagcatgtgaggatggaaatagaaacaccggagcccagggaatgggattcagctgccatccaggtctcttggtttctgccgacaacctgcaattctctctaaggccccttgcttctaagcactgagttgggagaaggattactggaggtgaagacagtctctgcccttggagagcttatgggtctaacagagagacaaaacccacaggagacattgcaacagatcaggaagtagttgctaatgtacaccagtgctgagaaccaagcgccaaatgaagtcacggtgcttcgactagggctggtttctctgtttgtaggatcacagaatcccagagggtcagaaatacagggga

SEQ ID NO: 24746 - DNA, 790 bp, Bovine  19866880612697
ctcccttaacccatattctcacaggagcttaggaacagagctgggtgatctgactcccagtccctgtactttactgaggcagcctcataagtagatcctcgatcatgcctgatattcatggcaccaggcctcagccagttactctctaggctcccacctctaaaaagcacctttggcttccctattcccagccagtagctcaaggatgctaaattggctctgtgtcaggaacctttctgtttcaaaaatacatgaggatgagaggcttatgggagagtcaggctggggcctaagaggagcagtaagaaagaggacaggaccatcggtcctcactgcttccttattgctcatgaatatttcagaaacttctcttttccagttttatgtgtgaattccttttatggcagagctgccccagagccaggaccataggtcttatctacttgccccccatccagtactgtcaccccctcgggggaagcagaactgctcctggcagtgactggtcccgcagtccagctgactcggttcatacttccccagtgccctctttgcatctcgttaaccaatctaccccagatttccctttggctggtttccaaggggtttttcaaggagctggagaaggatggagttttcaagtgaaaaggaaaattggagagtctgagtgcctggctggagagactgtagatcttaggagtgattgtaagaggggctcctttaagagacagtaaagggtatgggagtctgagcaggaagggtgggccagctagcaagggtaccaaggtca

SEQ ID NO: 24747 - DNA, 3438 bp, Bovine  19866880616138
atccaccctcttccccatccaagagcttaacttgacaagtcctgccctctctgtgtaatctcctcttgtcaccaaatttctcaggacagactccccaggtgactcactttgaaagtgacctcatctgctcaagttcaaggatctttctttgtggcccacatttccttatctcaccagttcttctaaatgaaatctaaccacttgggagaaaccactttctcccagaacctgttaatcagcttacggacagtagacacatttatcgctggtgctgactgtgtccctagcccctgcctgttttgagtgccccacagacttagggattccgagaaagtatcctgggagagtttctctcatctcagtctttatattacagcaccgggagcagtgactcctacatgacctccttcccagaggagggaatagaaaggcaaggagctccatggcccaataccgagttctctgctatttcttgtctcttgaaggagcttattggcatctcagccaatcccatagcgatctacacagacaggctgtggcagcctctgttgtgggaaattcacatactgtaagtcagacgagaacgaatgcaacaccgcattgtttctgctacttaccttgtgtgactcctctgaccttcagtctccttattgttaaataacaatgatacctgccttctagggttgtgaggattcaaaagggaaatatatgcaaaggccccacacaccagacatccaataaaagttagttctcttttcctataagacagcaacctcagaacacaggcctgaaaccagactcggaccattgagcttcctgacattatagattaggttttgtttctaccttaaaagccaatttctgggtttcttttaatatccttcaaatggaccaaaatgataacagtggttatatctgggtgctcagatcagttttttcattttcctgaatttctcagatttcctacaaggtaatactttacttataccaccaggaaaaggaaatgctactttaaaaacacaaaaaaaatccttcctttaaagctgctgattctgctccatccgttcagtaagaaaagatctttgtggaataaactttcttcttttgtcttcaccaaatgttttagggcatgtcacaattctgttttattaataaaaggccaaattcaagcccaaagaaagatcactgttagaacaagatcttctgccttctctttcctttgtctaaaacagagactctcaaagtgtggcccctagaccagcagtgtgaacttctgagaaataaaaatcctcaggcccacgcaagaccgattaaatcagaaactccaaagatagagccggcaaccaagttttaacaagccctccaggagattcttaagtttgaggacccccgctccaacacctctctctcttctgatctgttcttttcaagtcatctctaggaagtggccttctctctcattgttccatgcaaaccactccctccagccacctcatgtccaagcaaggtcagagttgggggaaaatactgaagcagaggcctatcagggctgctgaggaaaggactccagtggacagacccatctgaagggggccttaggcagtctagaaggtgaacaggcataagtcttcccgcctggctctatggcttccctaagcatcattttctaaactgagcccaaagacctctgagcctgtgatgagaagggcatagagaagaacctgggagaatgcaaggttttgacgtggtcatgtgaaattgatatgtctggggcactaggcttccgtcccgccccatcccactgctcatctgtccccctcaccttcctggggacagcagcagcggttgggacagcaagggcagcggaggtagcagcagcagtactgggggcaacactggcaccagcacactccaatcagcaggagcaggaggagggctcccaggatgatgaagatcacgggtcagccagtctgcaggggggaagccaagcaagggtcgaactaaatcttcaggggcatgctttagcttgtaacatgctaaaggtctgatctacacagctcttgacctataagttaaggatgagcaatatacacgcagaattaaaaattcagctttggtaaagtacttcagaggctggctaccgaccacaataacctaggtttgcttgtttctgtttttttttccctttatgtaaaagtgtcccagtgggggtggccaaatagaaatctccaagagcacttacgcaggacgatgagcttcacttccttatctgggtctcctgacgtgtcccctggggcctcaatggtgcagtaatacactccatggtcccaccacatcacttcattaatcaccagatctgctcctgcagtgaaggaggggaaggtgccagcaattaaaggagagggcatgggtttctgatttctggtagcttcaggtccccagcattatacttccacatcctaaaagggcctctcatagttagagaaaggcctctattccttcctttgagattctcttcttcctctgaacagtataaaggtggtaaaactgaccacttagtgagctctaccaggtaccctgaaaggagttaggatacatcaccccacttccttccttccacaactctctaaatgggtgaggtagaggttaccagttacctcccaatgtctatcctccctttctctcatggtcgtagaatttttgctcatgtatcaatacatagctatccagaataaagtcactaattgtcatcctctcttacagatggacatggacatgtgacttggttctggtggacagaatataaacagaagtgtcacatgacggctctcaggaaccttcttgaaaacagtttgggaacatctttgctcttttcttcttcatttcttcctccactctgttatctggaaagcaaatgtgatggctaccatcttggaccgtaaggaaagagatgacattcttagtgagcaggaaggagcttgggttcctgaggaattaatggaacagagccaccacactagttctggtctgtctagccccaaatttacacctgtatgtgtgcgtgctcagttgctcagtcatgtctgactctctgtgaccccacagactgtgtagcccatcaggctcctctgtccatggaattttctaggcaagaatattgggtttccatttcctcttccaggggatcttcctaacccagagaccaaaccagagtctctgcctgcattgggaggcaggttctttaccactgagccaccaaggaagaaattaactttttattgtttaagtcactaatagttggggcttttgcttactcgaaatcaaatttaatcctgatacaaggggtaggattattagctgcatatcagatgaggaaactaagactagagggaactggaacatagagaggtaacaaagagaggtaggttcaaacttaag

SEQ ID NO: 24748 - DNA, 1496 bp, Bovine  19866880649275
ttttatggaagcacctagatattttgcatagttaaaaattcaaggaaaaaggagttttgacctgtagagaccaccccagtaggtaagagaatctggaaaaatcttaatttctctttgagaatgttcctttttactgcgttttgatgattattcttcagagtctctgctagatattttttaagtgatttattctgtaccattggtaaaccttgaattctgaataaagaacttgtttcctagaagtagttagaggcaggcagattcaaaaacattttttcagatttaagtaaccaagtgccttcaccttgccttgcaggtctgatctacctgcaaatgacacatttattagcttactcattatctgtatgaattacatgtactatttttgttaaactgtttctaaaaccaagtgaccagttctattcatgtttggtaaacaaataattttcatggtagagaagcaaagccctctagaaagagtctagaaagaggttgtctgttttttggtacagtttgtaatcaggagtttactcacaaagctcttctctgtcaaatgtttgtccacttccaccaaacaggcccttgagaaagcctctgttttgagcttctggtgtctctataggagtaaacaaatctcccagcatgtcctatatcaaatttaaagaaaaaagcattagactaaggataaattaatagatcaaaagataactggtggcatgttagagcacgtcatgcaaatgctgaaaaatctgttctccatatattttcgtggtagtttttgcttagtttctaattccctctctctctggcactttttcctccaccgtctttctttcctttcctttctccaagaactggcatcttaaaatattcacttttatgacctcttgtcttcttccttctacagttagaaagcataggaagctaatattcaccctaggattaatttacagattaatcctgattacagaattcacaggctttattaacatactaatcataatttacatttttatttacatactttatttacatactaatccggttatctatgtataacttgttctaacttttttctaacttaacttgctataaaatgttttaacttattttggtctttctgtatgtgttagtcgctcagttgagtccaactctttgcgaccccaaggagcctgccaggctcctccgtccatgggattctccaggcaagaatcctggagtgggctgccatttccttctccaggggatcttcccaacccagggatcaaacccaggtctcttgcaatgtgggcagaccaccaccatctgagctccagggaagcccttggtctttctaaagcagatgaaaatttgagaaccgtggatttggaggaacttcaatccagagtcagatctgtgagctagtatcagcttgtgtgtgaacttgcaggatgactgtcatcatcttccgccctcacctctactcctagacctatgcttttcctcccaaatccctt

SEQ ID NO: 24749 - DNA, 3381 bp, Bovine  19866880703512
tctgagctggagtgatagtctgtgttgggagatcagggcaatatcagattgttggactaaacaagtgagagaagtgtaattgccttaaaagaaaaacaagcctaccttctaggtaaaagattcaaggaattagtctaaaatatgaagaatataagtgaggaagctaacagcagagaactttaacagaaaaagagagaagtcaagagagacttggaaattctgcatttgaaatgcagttgtcattggggatattacagtcctaaccacaggacagagatctgcttcagacagacttcagtcttccatttgcaaatgaggaaagtgaaatgcacagaagtcaaaggacatttttaaagtgccatgctaattaggattagaattaggtctagaacttctttcttacagtccgcattctttcagttttatgaacaagttaatgtggaaaaaggaaaggggaaagaaagaagttttaaattttatttctccataagaatataaaaagccagagacattttaaattagagtttaggaactgagaaggagtatgtgcaataggcagagacctactgtgacaaaggaagagacctaacataaagagggtcagctctgactagacaaaaaagatagggggaaggatatgctatagacccactcagagaaagaggaagtgtagaaaagacatccaaaagtatttggcaaaacacacttaagagagtgactttcagtgattgctatgatcaggagaccagactgacaggcacaggtcacaggtataaaccaacactagggactatgactaaaaatgttattctctcttaaaagcaacttggcatcaaaaatagcatctgagcatgtagttaaccttctcagtagatacttatagaaacagtaaaaagccagtatccatgtttaaaaagttgtttttcattgtgtatctattggctactttctcctacatgtagccctgaaggaagtttcacctctctcctgacacagtgagttccttgtacaaaagtcagggaccgtgggtgcccattttctcttaacaaagctaggattctgggacttcatatagaggaagtacctttaatatatgctgtgtactaaattcagaaaattgtggtttgaaggtctgagcaatgtttctaatgttacgggaaacttttcatcctgaagctaacttctgaagaaaaggaaaggagtttgaaatatttgtttgttcatgtttttgtcatcattgtctttggacatgtgagctcaccacacccccacacatccctaaagaacaagttattcatgttttctccaacccactttcctctgaaagagatacctattcattcctcaaagaattttgttattttaaaagcaaccacaatacccacaacaaaataaaagtcatcttcacacctgcccacacctaccctgcccacagtcttctgcctgtgttcatctgagggtgatatatttactaactgaaatgttttttgtgggcctcctatgtaccaggcactgttttaagtgctgtggataaaaaactataaatgaggctgttttctaagtgtttggaagaagatattagattcatatacacatagttattataagagagaatttgtcatgtgagggtgaaaaatacggagttcagagaatattagattaattctggttagtggtgaaaagtaaggggcagaggatattccattgcataggtggcatgtgaactgagccttaaagagtttggatgtggaaggctggggaagaaagagatttcatgaagtagaaactatgcaaacagacatggaaaagagatgttcctggctattattaggtaaatattagtatttggttcatctattggacattcttgaaagggagtaagtatgacagtaagagcagaaaggtaagttggatgagattagtagacaacgtgtaagtagaaatgtttagcagggtagtaatgtgaatgggagatttcttttaggaaaattaatttgacagtagtgcaaggattcaattatgaacaacgattatgggaaacaatgaaaacgtcacacatatccattataatagtccagttcagagcctaaagacaaccaaaactagagtagttgtgactcagtgttgaggtaggaggaatatgagacataatatagaaacagaattggtagaatttaaaagctgattggatgcagaagtatagggaagctaggagagaggataaggtggaatatccaggagatgaatgctaatgtgcagttacaatgcacacttggggcttgagtgataggttaagattatagagtttgaggagacatcagcatatagctaaaactgacacacagaacttgctaagggaaaatctggagaaagggaaaagggtaaaagttatacactggggaaatgcctacattcaggaaagagtgaagtaaacaaaaagcaaaaaaaaaaaaacagccaaatttggaagaatccaaaaaagtaaaagaaccagaaaaatacagtgttagagaagcccaggaagtttcaagaatataggagcaataaacagactaaaatgctcaacatgaataagaatttacaaaagatcactcagtttgatggcatcattaccagtgatcttagaaagaggaatttcaataggataaaaagatgacttatactattattgcacttaccataatctgttctgtattaaagctagttgaccatgagcaatgtgaagcaggtattatgtcttatctgcttatccctcacagttctttggacaaatagaagctgctcaataaacatttattatattaaaatcaatgaaattaaattgaatctaactggattatattgcactgcactatattattctgccctaagatgtcaccacccttatggcagaaagtgaagaagaactgccagtccaggttcaatgcacgatactggatgcttgcggctagtgcactgggacgacccagagggatggtatggggagggaggagggaggagggttcaggatggggagcacatgtttacctgtgatggattcattttgatatttggcaaaactaatacaattatgtaaagtttaaaaataaaataaaataaaataaaaagagcctcttgataaaagtgaaagaagagagtaaaaaagttggcttaaagctcaacattcagaaaacgaagatcatggcatctggtcccatcacttcatgcaaatagatggagaaacagtggaaacagtggctgactttattttggggggctccaaaatcactacagatggtgattgcagcatgaaattaaaagacgcttactccttggaagaaaagttatgaccaacctagacagcatattaaaaagcagagacattacttgtcaacaaaggtc

SEQ ID NO: 24750 - DNA, 1174 bp, Bovine  19866880728189
tgtaagataacttattgtagattctggggtatatgaggtggatatcttgttggtggcattattctgcctatcatacagccaataccaagggtatccacaagcaagtgcagacattgctgaagttacagaacccacttttacagacatctcatatctatgtggctcggttccttagtacctcgcccttctccagtgatatcaaggctattctctttaaccaaatttgctggcacaggtgactacctgaccaaacgatgtttcctaccagtattctctgtcatattcttgagaggcttgttgtatgtactatgctctttcctgtggttttctgccctttaacactcatatctcaatctgaccatctcaaatgcaacagatagcttcttgaacatccttccagcactctcatatgtacagacacgtcccctttaactttctcatctagtctcctgaatttttctgactgcttcttaggggaagagacatttttacttgccttttctccatccctttgctttgtttcatttgtaagctagttgtgtgtgggttctcactcactaaatcacgaccagctctttgtgatcctatggactgtagctggccaggctcctctgtctgtgggacttttctcagacatttcctcttgcaggaaaccttcccaacccagggactgaactcgtatctcctgcgtcttctgcactggcaggtggatttttacaactgagccacctgggaagccagcataagctaatcattccattgcaaaagcaaatttaggaaacagcttatttccaagcagaaggttgcatctgcacatttacctaaatctaaatggcaatgagattgagagagaaatagaagttaaaaactctcgttttgaaaagtcaaagcctggacaaacataatacatctgtaacctgaccctgcgctgtgaattttacttttatatcacagaaatctctcagcacactctgtgctttggcagtttgaatggctctgccatatgctttgtgtcaatgtattaaaactggattatcacttccaaatttactgtttttggaatacaacaggatgaaatgaatggactactgatgtcatctatttattttcttaaaatctgtacctgcactcttaagatgctgaccagaagcattacttatcttgtgctttttac

SEQ ID NO: 24751 - DNA, 2533 bp, Bovine  19866880852195
atagggatccgcctgcctgttcctgggagtaagttgatactctgttcagggtcataagaaatctaaagccaaaaactatagaggtcttggccatggtcacatatctaattaaggcagtcaaagtgttggttgctcagttgtgtccaactctttgtgaccccagtgactgtatcctgccaggctcctctgtccatggaattctccaggcaagaatactggagtgagtagccaatcccttctccaggggatcttcccaacccagggattgaacctgggcctgcagcattataggcagattctttaccatctgagccaccagggaagcccatgtgaggcagtgtcaggattaaaactccatcctctgagcagtagctccatctccactttccacttgcaaaaacctacctgagaataagaaaactcaagtcctgtgacagagaacatgacctccccagctgtaacaagagcatattgtggtagctgccatgcgatggacattttgttggctggcatgtattccatcttccaggcctgaggaccctgattggttctcttagtgagggaaacaagaaatgggcttgttaggagtctcaagtaaatattcctggcctatgtcatttatgatcttacatccatctcctgattttattgtcattcttgttgtaccatgaagagattgagcactttctacacagtttcaggtttttgaaattccttttgataacactgcactcacttggctggcttcagtcaaccagataccattattgcagagcccttaaatggtagactattttaatactgtagtttggagtccaaacatttgacctactgcatattttgatcctggtcaacattttaaatgtaaaatggcatctgatatatgaaaaattatcagaaaagcatgtacttaaaaaagttaagtacaattaaaatatttctaacattttccatttaaatatcttactaaaattactttatcagagtaaattatttcttggtaacccttacattaaagattttcctgatcaatttttaaatacctgtatcaaataccacctgctattttgtcttctattttctggccattatttttaaactcaaacttacacataaaaattttgtcaaaaagatgctatattcctataaaattttggtcaaaaagaatcttttcagggtcaattttttgttatcaatgttaccaaatatacatgattcaacagtcttttttccctaaaactacttttactgtatgcaggttctcagctgtatttgattttactgtacaataattgtaatgaaatttttgaaattatatatttttataggagtaaaaccaagttattaggtagcaggtgttattaaatagtagatgtaatacacggatatgtcatgagattaaaaatagagataaaatatcaagttcaaaagtcctgaaataaaaagttcttgatgttgaaatgcctttgatttccttatttggaaatagagttgttgcagatataattagtcaagttataattaaatcattggtatgggccctaatctaatatgactgatgtcttcgtaagagtcagagtcactgcatttaaaatgcagtaagggaagtgttgctttcgttgatattgtgaacattactgggcatatatttgggttttcttagcctcagagaagaccatgacctgaggttgtaaataaaagtcacattcttaaatactcacagacaaatataataattaagtaaacaaagtagattgaatgggaatgatacaaactatggtaaactgtctaaagcatacagccactatagcaccagccaagtgacatggtaatactcgttacaaaattttctgatctaataacaaagaaatgttaggaatccagtttctttggtgaaattgcttgaattttaaatattgtcaattaataattattatcatttttgtcaagactgcaaccagacaaaacagaactacatgaggaactgggccctcagtacctctaatttatgatctctactctagatggttattagatcctcacattcagaaacaatatatatagcctctaacttgagcagtatactatagacagaacaaagaaaaactgaaataacaccaggaatgcaagtgttatgagttgagttgtgtccccctaaaactcatatgttgaattcaaacccccattacccacctgagaatgtgaccttatttggaaatagagttgttgcagatataattagtcaaattataatgaggtcacttgggtgggccctaattcaacatgactggtgtcttcataagagaaatttggacatagacaaacatacagggagaattccatgagaagatgaaagtgaagactggggtgattcttctatacaccaagcaacaccaaacattgccagaaaaccactaaaaactaaaggaagctaaatgaaatggattctttctcacagctctcagaaggaacctactctaccaacaccttggtcttggacttctggccttcatgactgtaagataataaattt

SEQ ID NO: 24752 - DNA, 1149 bp, Bovine  19866880854751
atactacatggcttctgagcctgtgtaattaaaaaaataaagatttcacctccaaccttcctttctcctttcactctctctcaacacttattcttggaacctagccactaggttgtgaggaaacctaggccacctggaagggctatgtgtactctaaccattagcaacaagagttctgagattttattttccttattgtttgtaaagtgaacactaaaatattagggatctaatactatactgggcttaggagggggcaagaggaaacagtgatatataagttatgaaggctaagtgtagaagcaaataaactttggtgatcaggatcttgctcctaccacatttaattacaataacacaaacacccaaactgcagctagaaaagaaatagatatataagtttccttactttcaaagggactgtacttccctagaaacaccttcctgctgagaagtgagcatcaattcagaagaacttgcctgctgctttggcttcctacatttcctcacttcactattggtttggcgacatcttagacatctatagtctggctatacataaaaaaacttcaacaggaagatgctgtgaagacctgaatttgaatcatcataactgtcaaagagaagaaaactccaattacatgtatttgaacttgttcctctgaataataaataataaatacttgttcctctgaataataaaaaatgtaaattctgttatacataggctcatgtacataaaatcattaaactatgttcttcccctagaaaaatccataattaaaaacatgtttttagaatattatggttagtttgcttgtcaattaaaatgaaagatttcacttaacatttattaataatttcttataaagggacattgcatacacatatattttacctctttcaatatcgtccatcggagatgctggggacatcttgtcttcggatggagaatgttttataagattaggagtcctagctgaatttcgcatttgttgctgctgctgttctattcgatactgaattttactgcttccttcaaacctgccattaagaatagcaaaaggtcaaaaccagtatgatgattgcaatataacaacaatttcaacttacaaagctgctaaaactgacagcttggtctttattctg

SEQ ID NO: 24753 - DNA, 1130 bp, Bovine  19866880865322
ataatataaattattattattaatatataactctatattaataagatacttaatgaactagaaacctatttcttgaccatattgaataagaaaatatattgtaataaattcatgactctgcctaacaaagaaataaaagctcacattaaactttgcttagcagttgggaaaaaaaaacaactgagtgattttggataaattacctacatgttccacacttttgtttccactgctatataatgaggatagcaaacatctcacagggttgttatgaatattaaatattctaatacacataaggtatgcagaatagtatctgacttatagtaaatgctcaattaaagaaaagctatcataaggtaacggtaatacactgaaccctttccttctcaagtttctgaatttttattcacatgattttgggggtgatggggattttttttgtctttgaggaaaggcagtataggaggtaaagagtaattaataaatgatgtaaagattaaaaggctgtcaagctctcaagcaaagctctattttctcaataaagttagggaagatcactgatcttttcggtcattatgttattacactatatggcatatttaacacacaatcttttgtgaggaagggagcaaattattcactgtaacctcatcgataaagtatcatatgccatctgttgagatatgaagatggctggattatatagtttttcccctgaattgttacctgttgtgacagagtttttatctgcatgctttaatgactttttcacaacacaggtattttgttttccatataccatcaataaaaatgttctttttaaaaatctcaagaaaagaaagaatatatgtattacctttgtagcaggcacttagtctcagtaaaatcaaaatttcctgatgggattcagccatcaacagtagtagctttgtagcagtacctcttatgactggactaggagttgataaaagtttgaaaacaacttcatctaaaattgaatgcaggattttcccttctattctgagtaaatcaccactaatagaataaaagaataaaaaatgtaccattactaaatgatggatcagtatcacaacaaattaaacaaaaaaggtgcagcaacttaatat

SEQ ID NO: 24754 - DNA, 4341 bp, Bovine  19866880935303
attacctgctttgcttgttgcctcagattatccccaacagactctggctcaatcatcttccattcagctgcaatactcctgaaaacatcagctccagtgtttagcacttgaatgagacgacgatcgtgggataaatgagccaagatcctcagctcaagttgagaataatcagccgctaatattaaaccacctgaaacaaatgattttggaaaagttggcacaaagacaaaaccaacttttatagtactgaacaggatgacagaaattcagttccaacaaagaaccttgagatcatgcatccaaaagctaaaatcttgctcttaatttgactcagttcaattctgtaacatgtaagaatttttctgcttggctttcaaaggtatgtaatacatataaagctacctttgacctctgcccctcaaccactgtggtagtgctttcctcagtgttcctataacactgacataaatgtcagagaggttctttcatgcctcccccacgtaacacttagctactagggacaggatacttaatcttcctttgcattctacagaaatactcagctcctggtacctaacaggtcagaacaaatggatgttaattgaatgaatgaatgagtaaataaagaaactggttcctaatgtgtgcgcatcttaagggagcaggaaagtcgttcaacaaaaaacaagtcaggtggtctgtatgttcagaagagttattaaggggattcaaattatttatttatggactagaaatttatctatggcaaaaaacaaaataaagaaaagccaggttaaagaaaaattagaaaaatatttgcaaatgataccacaaaggactcattactatattacaaaaaaggtacaatcaagaacaaaatataaatgagcagttcacagaaataaaaacaaaagaaccttaagcatattaaagaatgcttaatttcattgacaataaaagaaatgctaattaaatctacaataataatttttttctacttatattgcaaaaatccagaggttggacagcacattctgtggcaaggctgtgaagaaagaaacattcatatattgttactgggaagtaaatggtaactgtgccccacccccccaaataactacacagcaagtttacaatagttataggagctaaacctattgcaagaaaagggaaatggaaaaaacatccgtaatgtaaattatggataaagtggtataaaattattagaagctagtctgtgatgtgatgcatattgtaaactccaaagtatctaagatacagaatttaaaagaaataaaacaataataaaaagtcatttacagtttttaaagaagaataaagaacagatagaacaaaatacaaatgacaagacaatagacttaaatccaaccatacatcaacacttactctagatagttaactaaacagtgtattcaactggcagatattttcaggttaaatccacatacatttaaattatcataatttttaaattttaaacaaaagcagtataaaatactgttgtgttaaacacaatcttattactaaagtaagaataaatacatactatgaaatattattcagccttaaaaaagaaaaatctgacacaaatgctataacatgaataaaccttgaagacatgctaagtgaaataagcctggcacaaaagtacaaatattatatgatttcatttatatgaagtatagagaatggtcaaattctagagagaatggtggttgccatggctgtgggagttagggggcagttatatttaatgggtacagattttcagttggggaaaatgaaaagttctggagatgaatggtggtaatggttgcaacacaacatgaatgtacttaataccatgtaactgaatactttaacacagttacaatggtaaaatgctggtaattcatacttaaaaagcaaaactgaaaactgtcaaatggcaatgacactatcatagacgtgattttagccttagaatataaacttctgacagaactaaataaattgagctgattaactgcactcacccagacctgccagatggcaaaagataaaagggcaaatatgtgtactaacagggctgatgctttgggagttagatcatgacttaaaaaggttttgatgatgagtgctaaggagaggtcagacagaagacagacagccttgagggctaccccatgcaacaggaagcagcagtggggagaactgcagaagaaacgaagagcaaaacaagttacagagagaccaaaaaaaaagtgcctttagaagtcaagggaggagaaaaactgaggaaacagagggttgacagaatgctaaatgctgtagagaaatcaaagagaatgaggactaacaaaattcactggattctacaaaaaggttgacaaagacagaggataacatgatttcagcaggatgctgagcaaacgccccagaagtttcccacagagcagatcatgaagacaattatgagtgacttacaaatccggcaataaaaaagggaaaaataggctccaccaaagagaggaaagaaggaggaaacaatgcattcttctgagtcttattcataatttgctttatcagtgctttgaaaaccattcctacagcaataagaagctcaaaaccatcatcagtcacctgacctgtgaaaggcacaaaggcatgtcgcatgctgaccgagaagggcattcctctgtctgaggctctctcttccacctttgtctggcgcccagcgttcatggcacagtccttctttcttcctcctctgttggtgcaaaaaacatccatcagttggacatgaggtagtctcaaacatatgaaaagggtctgagcttttcagtaagtcagtatttccatctaagaaatgtaaaagtcttatttgaaacccactttaaagcttaataagatactagaccttgttcagcaaacattcaattgaacaggacgtaaggtatttttctgtaataacctttcccacaaactgcttcactcaactcaataaatctgactgtatctaatataaatgatctgtgctttttcttcctttagtgaacatatggagatgtcaggaagggagatatttcagacattgctaaacttgtccctttaatatctaacaaagaagcatatagtgctggttgatataattagggacccaggatttcagctttttactgccaaccagtttcttcatagacagactcaggatttgaaatgggtagtgcttgaaatagaaatgtgtatgcctagaacagaaaattaaactaatttcattattttacccaataggctgtttttgagccattcatattcccaaaagtatattaacacaaataaagacatttgagccattcatattcccaaaaatatattaacacaaatgaagacaaataagcgtctacctgcccataggaagtaggccttttcctagagcttgggaaggtgggctttcctctactactgctggcatttttatctcaaaatctcttggtacattctgaatatttggctctataaaggttattcgtcctaaaattaagcagaatgaagacataaaattagaggggtaagggaggaggggaaatctgacatttattttaacataaatactgtgtctgaattatcctaaaatgcatgctctattatttttaaactaaagaacaatctcgatgtaagtgaatatatgaatcagctataatacagtgttttatattaacttctacagaaacaatcccatgataagaagtaatatgataaatcatactatttccacactaaaacaaataccagaaggtagcaccataaaacactagcagttaactaatgagtaaaagacaaaacaaatggatcttaggagaaatgactgtcgaagaatttaaaagccaggaatgcacaagacacagaaagatctgaagcagaagagcaactgagtcctgaataggaacaactggggccacaggagttaactaatgcaggagatggagtagcagtgaaggatggtgagcacagcattactttctaaataccacctggccagttttcctcctcctcctcctcatcacttatcataagaatcaatggtagacagcaccgacatggctagaaaccagaatcaggtggccaataaattttctaggaaacagaaaccaatttgatttaatgcttatggctttattttcccctaaatattttaaattttatttatctacttattggatgaattttccaaaaacacaagtgttgttcaaaaagtttgggtctaccagcttctgcatataattccatcttcttttgatgaatcagacattttaagtatctcagatacagttttactga

SEQ ID NO: 24755 - DNA, 929 bp, Bovine  19866881018422
tggttctttcccctggctttgagtaattttctgcatgaatgtgctgatatgtactcagcttatttgagaagattcttaacagattctgagttctgtctctgtgctgctgtctaagtttttattagatgccaggatattggatggaggagcctggtaggctgcagtccatggggtcgcgaagagtcggacacgactgagtgacttcactttcacttttcactttcatgcattggagaaggaaatggcaacccactccagtgttcttgcctggagtatcccagggacgggggagcctggtgggctgccgtctatggggttgcacagagtcgggcacgactgaagtgacttagcagcagcagcaggatatagtcagttttactttgttccaagctacatacttttgtatttctataaatctttttgagcttcggcctggaagacagttaagttacttggaaacagtctgatcctttttggtcttgcttttaagtcttgttagttgggaccagagcagtgctcattctggagctacttgtaccccctcctgaggtactgcccttctgaatgttctttccaacgccctgtgaattatgaggtgttccagtctggcttgtgagcacaggcagtattccaggccctgtgtaaatgctgggcgctgttaccgctaatccttttgggtggttctttccctggctttgagtaattttctacataaatgtgctgataagtactcaactgaatatctgagagaattcttaagaggtctcagagtcctgtccttgtgttgctctctctttttgagcatgctgtcttgggaactccagctgccttggtttctctcaactgttagcactcatctcctcaacccagggggccttgtgggctttgcctgggtttcttctcccctgtcccaggcctaaaaactctct

SEQ ID NO: 24756 - DNA, 1285 bp, Bovine  19866881083138
catgcattgtgggcttaatcagctggattatcttgggctccagtaagggatgccctctatctaggtttatgactgccaccaacaaacagtttaaggtagaagataagagaaaggagtaagccaagtgttggcttttgagaaattgagcattgttctagtacttgttcttactgtctttcccaaatattcacattcagtcagctagttagagaacaagaaacttttgacaaatttggtatagaataaagagagaccagccccatcagatgtacaattacagttggcttagatgtcactctacataagagatcttttaatttgttttagcttacaccgtgttttactttttgactcgctagtattcttatccacaacgattttagttcttgggaaatgagacttaaatcaattctttaggcataaccctggggttgctagtaccctggttagtctttccttcctgggtctaatgctcagaagatatgacttttcctgcattgatagatagccttatttagcttctcaaagctgattttagaagcttctcttattcttctcaaataatgccttcatctggattcttcttttcttacttactggttttttcctctcattattctttcttccccctggccgtggtagcaccaacctgtctctccccatgtgactttgtttcttctaacttttccctctgctatgttgttatatttttaagttatccattttatacctgccccctcttttttaaagctctgagaccttaaacaaatcagcatcatgtagcttcatttccttcctctgttaaataaaagggttagattaaatgatttctaagtttcagcagctagtcacagcagctctttaactattgtttacccatgacagagcttgatagtctctggaaagtgtagttgaagaaatgatggcaatcctcagatacttgacagactgttatgtgaaagaaagtgtaaagttattctgtgtggttccaataagcagaataggttcattttggagggaggagtggtggtgaattcagttgggaggcatctggttcagtcgaaagaagagcttttgggggaaaaaaaaagactgttgaaatatgttaattcctcccctccttctgtctcttttatgatttttttgtccttcacttagcagctgtgttttcctgaattctgccctctagttcttcaaggcagtgggattatgagttttatgttaagttttagtcctgtatggcactgactgatttgccctcagactaaaaactataaaaatagga

SEQ ID NO: 24757 - DNA, 732 bp, Bovine  19866881083362
caggcccttgcacactgtcagtcccactgttctaatttggggaatggaggctgttgctaagtaaagcaaggcagctatgacaagaagtaaagattaagcctaaaggcctgtcctggagtcctagctccactactcacaaggtacttcattattttgagcctggtttcctcacctgtgaaatggggggaccctgcccgactggcctcggagaactgtgatgagggctggagccaggctgggggcgaggagcccctcctgaagcatcaagcttgccctgagcactcacagttccttccaactctataagaggtgtctcacggagcccagagggcaagcggtgcaaaacagggaccaggggccctccatggaggcatatgaggtggcctgtgtcagcctggatgaagagtccttactgcccattcccgaccctcagcaggaagccccaggctcaccaagcgcctcttcacactcccttttttcttgccgttcttgcctgagctgacatccagcgagcggtagctgggtggcttctcctcaggccagtttggggagcacgagcgacgatggcggcgggtctcccaactctggggctgcctctccttctcctcctcggagctccaggaactgaggccagagggcaggggaggggagtagctgtggggcctgcgcctctggtgcccctgagcgctttccttgaggctgggcctgcggggatctctctctgggtagcgg

SEQ ID NO: 24758 - DNA, 777 bp, Bovine  19866881130598
attctgaaaattggcttattgttttaagtttgtcatctactaactcaaagtatttgtttctgtttaatgtgtaaggcagtgtagtactcagaagcactccagtggtatttttcatggtcgatccacttaattgattttgagtgaaaacttcttccgtgttctagacagtccttcagagtacatcactaaataaagtttcagaatacagcactttttaaagttgattattaatatatacatgtattattgacgtattcattcaacaaatgtttatcaagtgcatgtcccatgcatgaaactagaagagaaatggttcttgcctgtagaagatgttctcataggtgagtaggatatatgtgtacctacattatttaggtacaggatcttgattatataatttaaaagtggatatgtgtaataaatatctaattattaaaaaggctccctaattcggggacttgcttgtgtcagtttggtagttggtgctctggagaagacattttggagattctttgttgctgctggttggggagaatggcaatgtctgattctttaacttgtcatccctaacatccaaaaatctcaggacacaagtctacctgacattttgaaagtaatcaggtaatgatgctcatgtgttagcacattgtatctgaatgtttccttctcagaaattaagggtgctacagaggaagcttgaggagcatgaagaagccttgctgggccgcactcaggttgtggacctgctgcagcaggagctgaccgctgctgaacaga

SEQ ID NO: 24759 - DNA, 917 bp, Bovine  19866881332901
aagtctgtccacaatggttttgccaaggagttttgggaagaaacatttaactgccacctgcaggagggtgctaaaggcccattacccgtggacaccttcctgagaggtcacgaagaaggaggtgccaggttaagcaatagttccagtgccttccgacctctgtgcactggggaggagaacatcagcagcgtcgagactccttacatggattatacacatttacggatatcctacaacgtctacttagccgtctactccattgctcatgccctacaagatatatacacctgcatacctgggagagggctcttcaccaacggttcctgcgcagatatcaagaaggttgaagcttggcaggtacctccttctcttagatagcagttcactgtgtaataagcagagttggactgatccaagcaagacagattaaagtggttacctcaaaaagtcaatacctgaatgaggtcactggatgtagccttggagtcaaatatccttttcaaacatctgggcaactgacttctgaaaactgacagtaatttaatttgattctctgtttcaagccttgagctcagctatttgttaggctagtggttcaaaatacctggagtatggtccctaaatatctttaaatatcccaggacagatttagtactgggcggagtgtctttatagtgcttaaattaaagatattgttcccttgtagacaacaaatatttcttgagtacctattatatcccatatgctaaggggcataaaaccataaaattagtgtcactatgttcagccacctcttttgcctttatattactcacaatataatgtgttggaccccaagaaagtcaactaagcttaggacacaagtaaatcaagggcacagaagaaaaaaaaaaaaaaaaaactcttcttaaaaagat

SEQ ID NO: 24760 - DNA, 848 bp, Bovine  19866881404214
aaatggaggccccaaccacagcttacaagaagacaacacccatagaggctggtgagttttaattccctctctctgttctcctcaatctcctctgccttctcattctttttttcttcctagactacctactccaagcatttaactacctaggttagctgaggtagacttgacccctaccctcatcttcccagattctttctcctaaaaaaaaattaggttaggtggatatctgagtgacactggggaaaaaactgtatgtagagaacacagggatggggggagccatctgggaaggacacaaagggaaaggaactttggatgggggacagtgggtagatggtggtctgagggtatatagatttaagaaatgtggacaaggaaggatgcaggttaggggaccaagctttagaaggagtaagagcctgagatcacatggtctggctatgtgaaaatctaggctccagggctaccttatccttctctaagccccttgttccttcattaatacctctttacctccatttccatgagtcctgtcttgattttctcttcttctggatgtttaactgactcttcttctttccagtgctactcttctacttctgacccaagacaaccctaatttttttgactgtgtctgtagcttctagtggtgcccgtgggctgaaggcaaaatttgagtccatggcagaggaaaagaggaagcgggaggaagaggagaaggcacaacagatggccaggcagcaacaagagagaaaggccttggtaaagatgagccatgaggctcagcaaccagtggccactagggaagagccggcggcgccagccccattgcctaagaaaatctc

SEQ ID NO: 24761 - DNA, 1686 bp, Bovine  19866881405338
ctgaacgctgaaagaattgatgcttttgaactgtggtgtggagaagactcttgagagtcccttggactgcaaggagatccaaccagtccatcctaaaggagatcagtcccgggtgttcattggaaggaccgatgttgaagctgaaactccagtactttagccacctgatgcaaagagctaactcatttgaaaagatcttgatgttgggaaagattgagggcaggaagagaaggagatgacagaggataagatagttggatggcatcaccgactcaacggacatgggtttgggtggactccgggagttggtgatggaccaggaagcctggcgtgctgtggttcatggggttgcaaagagtcggacacgaccaagtgactgaactgaactgaaggagtgataatgaagagtgtgaaaggaagacaacaaatattaagtgattcttttaaatttttgcaggtagtgacaataagacaaagaagatagaaaaagaaaggttaataatatttttttgtttacagccataagatatttgccattatttctaggacaagactacctctgaagaagaatctgaaggcaagagatggaaatattgagggtacaaagataccaatgagagtgacctaggtgatggtgatacatatgtaaaaattcatccagttgtacatttaagcctttcagatttgtatactttatttaagttatacatcaataaaaacaaattcaaaataattaaaattacctcatgaaggattgagattgagggtacaaggagagatggccaaatttcctctgaaatagtcaggaagctattgtttaccaaatcccagagctatactttttacaaggcagtcatttaaaaaataaattaaaatactataaatacgaatcttttattctgtaactgaatgaagaccataccatggcttatgcttttttctgcatataatgccatccttctgtctggatggacctcggtgactactactacataaggagcacacatagacctcaggcacctgccatctctctcccaagaaactatttagtactgtgttggtggctgtagcactacattaggtgctgaataaatactttagaataatggatatatctagcccaaagtgagatagaaaccagtgtttactaaagaggattccttggaacactcggtctacaagataccctgaaaaaatattccacagtcaaacaagtttgggaaatgctacatattataaccttctctggagaaggcaatggcaccccactccaatattcttgcctggcaaatcccatggacagaggagcctggtagggtgcagtccatggggtcgctgagtccgacatgactgagtgacttcactttcactttcatgcattggataaggaaatggcaacccactccagtgttcttgcctggagaatcccagggacaggggagcctgatgggctgccgtctatggggtcgcacagagtcagacacgactgaagcgacttagcagcagcagcagcataaccttctcttggagattttataatattaattagcatgttaaacagagaaggcaatggcaacccactccagtgttcttgcctggagaatcccagggatgggggagcctagtgggctgccatctatggagtcgcacagagtcagacacgactaatcgacttagcagcagcag

SEQ ID NO: 24762 - DNA, 1638 bp, Bovine  19866881490476
ccaccataggcccatgtgaggagaggccacttagtcctgtcttttcctaccaaagctgttccaaaactggtgaccctgggtcagtctgctcttcagtcttcatcttagaaagatcagtttagtatcaggttttccatattttctcttatatgtatttcttcctacagtgggccgaattcattttcttttcctgcctcatgctggtggtctgcctgatcttctccatcatgggatactactatgttcctttaaagccagaggatgttcaggggtcagcaaataagcagacccccccccaatccaaggaaatatgatcaacctggaaaccaagaagacaaggctctaatggttccctagactctgcccagaccccagttcctgcctctggtcttggccatcaccatcttcaagcattttttactgcaacttggttggaagagagaagtagcatcacaatgaactgatctccttcacttttctctgatgatagaggcaattctaggactgggtttttcagtacattaaagcaaggtccctgagactttatgtcttcctatatgtcactaaactcagtaaaccttatgtggttttgctgcagctagcctggcatctccaaaaacacaaaatgtataattgagattgatctttgtggttatcaaagttctgtatgaattcttttacctgccatttagagcagatgaccccaccttttgaagtgctgatttagggccaaatttcagaataacagagaaatggtattttcaaatgtcttcattaacagtgtatttgttgtttataaggacttcaagaattggtatgtctggtgtgatctcatccagggcctgacttgtcagctattcaggctcactaagactgtagtaaatttttcagtacaaataataaaagacaaaatgatattttattaacacacaggataagatgtatctttctgataattacagtattttatctactaatcaaaaaacccctttctcagtattgataggtccttggaaaccaaattaaagacagtaaacatggttctgcaaaacagcaaagtataaactgtagaagtcctgatgaacaattcttgtacagtatacgcttttcttagggactataatgttttaactctagattatgcccacctgtggacaactgtatagacactaattatcattttccaaccctcattttcaatgttgttggcccacctttttcttattatattatcttattcattgctgctgctgctaagtcgctttagtcgtgttcgactctgtgcaaccccatagacggcagcgcaccaggctcccccgtccctgggattcgccaagcaagaacactggagcgggttgccatttccttgtccaatgcatgaaagtgaaaagtgaaagtgaagtcgctcagtcatgtccaaccctcagcgaccccatggactgcagcccaccaggctcctccgtccatgggattttccatgcaagagtcctggagtgggttgccattgccttctctgtatttattgctacaaatatttaataataacagtattttttatgaaaacaacttcctttcttactgggtatttccttcagcttcaaagtagggggatctgttttgatattttttcctgtttta

SEQ ID NO: 24763 - DNA, 819 bp, Bovine  19866881614938
atggagctggttctggttacagactttttacctcttgctgaggacacatcccccaatgtgggttattataagcacctgatacacatttgccaaagaattagagacctcttatctgtgatcaccgatgtgactgatctcagttctgtgtcagacttcactctttctatatgagagcaggggacaccttgttttaccatgagggccctctttcagcaccgcgggagcacagactgctgggtcacactcggctgcctttctccagccctgctcaccactgcccaccagctgcacaggttcttaccctccatctccctgacgacaggtgtgacttttgaagagtccatgcctcatttagctctggtaatggcttaattgagtcggaaaatgcaaggacaggagcgtgataaaaaaccagctgagttgggttcctgttagtcattggaaaaaactaccagggaagggacaagaaaggaaggatggactggagtggggaggagcagcatggggtgccgagcaaagtggggcagagagctcagacaaagcaaataaagaagattaataggagaggaaatggacattcattaatgttgtactatgagctccttgatgcagggtctgggacctggaggggttccgtgaatgactgaatgactatgtgtgtggagggcccagggcatgatacactgtcttagaagtttacaaaactattgcaaaaagagacagaagaagaaaaaatagaatgagagttgagggggggtgaaaattccaagttaaaaaatgacaagaaatgctcatttctctggttgagaatctcgtgag

SEQ ID NO: 24764 - DNA, 1114 bp, Bovine  19866881668777
ttgattttttttttctctagagttgcatttgggaactgcaatgggttggctgtggtggattttatacagaagactgtactgttaagcatggggaccattgacctgtatagatcaagtgacatataccaacgacaaccacggtctcctcgaaaaaacaagcagttcattgcaggtaggagataaaacaagatgattatgaacttatttagttcacctgttttttttcctttagatttcttgtcttctgtgatgctattcaaatgcacagcagtataaaatcagcataatttataatgccatgtaagtaaaattgggcagaaatatagcaagactctgaaagggtaaagaagttgtttaaacttcaatttgttattaatgttaggaagcatctcaatgttcttaaattgaattcctaagaaataacaaaataagacactattgaatataaaaatgctaagaaaactagtctcttttgttgaaaaaaactacttacaatggttgtgtgggataattttcttctaatatactatagctttaaaaatgtaacagttattcacccattataattttttaaattagctccattttttagctgtcattttttcttgttggatggtgactttcttggaggtattttcacaaatgcagtaaatgctaattaacattttacagtgctatgaaagatgatacttttcttgacaggacaattataaaggaaaatatataaagttattaaacaagccaaaatactttctacatgtaatatcaaactttgatatgccaagttatgcaatgttttactgaaatttcagtaaatatacaaatagttggctttgtaaacattgccaatattttgtatattttctgtccactgacatagtttagttggtaaaaaaaactggttgagctaaatggtttgcagctagacatgcatctacagtattacatattatattatacagtttctaaaattttctgtatttttaaaacaatcagttgaatattgacacttttactaaacataccaagcgaagactattacaaagttaaaaaaaaaaaaaagtacatgattgtaggttttattttttaaattgtaagtgtgccaaatttaaca

SEQ ID NO: 24765 - DNA, 1274 bp, Bovine  19866881753226
actagtggccagaatgactgaaggttgggaaatattattccaaaatgttttgatagtaggactttcccatttagtcagtcttaatattttgattgctgagtacaaggaagaaaagaaaatttgaaaactacatggaaatatgaataatttgctgtgctctgataggtggggtaatttcatgtgttacaatacggaaaccaaaaagaccctttcaaattaaaaaccatagattgtaaaatccagaggaaaaccccaagtgaggcctattcgaataaaggatgaagtttccaaggtatgcacataaagtggctgaggggaagtaacgtgagtgagggcccaggacccacacaggttttgagaggccacagtggaaggtgaaggggtttacaaacctgtttgggggaagaatgatcatccacccagtgacggaaggaagatctttgtggaaaggtcaaagtgaggattggaaagtccaaaaggaaggtggaaaagcagtgatgaagactaaatagcagcagagcatgctatgtgccaggttatttacatgcaagacctcgtttgcttttcacaacaacagagcaaggaggctattactagtcacaattcatagatgagaagactgggagatattctataacttgcccagcgtccagtggatcaagccaagatttgaccttggactgaccaccagttccaaaaccggagctacttcccctggacctcttgcacccagtcaacaccaagcagttttcactttgtcactttcaatgtctgcagcctcatggggcaccaccagtctctacgagaagggggagccctgctcagaggcaggctgtctctcctctggactctaatgctgcagatgaagtggcacataattgtccccaaattgagcagaggttgttgtaaggcctgataaggtcagaaaaaagaagccatgtgctgggcaggattatatatgtgaagcctgtttctgcctaagcactgagtttggaaagatgcacgtggaattcacacacctttcatacttcttcttgtgactcttccccaaactcaatagtaccatccactaggacttccctggcggtccagtgcttaagactctgggctcccaaagcagagggcatgggttccatccctggtttgggaactaagatcccacctgccacctggtgtggccaaaacaaagagtaccatccacttccaggaatagtggaccaaggtaatagagacattctaggtgagcacaactaggattagattaagataatctg

SEQ ID NO: 24766 - DNA, 809 bp, Bovine  19866881756861
attaggatttcctcccatctctggtattatttgattctatgaatgcttagcattgtattgccataatcaatgaaaaatttcacttaaacaagtatcaaagatccaatgccaatacgctaaagtttggtatttagggcacctatgagcacgaatgagttggtgccttgcatacaggtgctattccatctgctctgctatatcaaatgctatttcagaggtacagggccagagcaggaggagccattgatataattagatcttaaaggcatctgtgcctctagtggttaacttggctagtaacttctgactgatcatttgttttgtatccagtcattaaccaaactaggtcagaaagggcagtactttctgaaagaataactacagcttaatcattaatgtcacaagcagaaatgaagctggactctttgggtaaaggttgacgggagagaaacaggatgaggagtgtaacagaagctgagaaagaaacatggtcatagtctgagatagagtttagggaggaaagagtagagtttatcctggtcttatttgtcaatagattactcaagtaggtaatgtaagaattttatgagggatagaatcataggttctcatattctaaaataaaataatgcattctcctatttcctgacttcttttttggtttagtccttatttatcttatttctctctagccattctttccttttccatttgactgacaactaaatgggcgccatactggttttgttcttttacctctttgactttgcaaaaataataattatttaacaatcatggtctggatcctg

SEQ ID NO: 24767 - DNA, 895 bp, Bovine  19866881826976
cctccttcttaaaaattccactcctcacattaaaactgtagctaaccagctcaagtcttatttgcaattgtttttcatcttaaaccagatgtgtgggaatctatttagggcacttttccaaaaaagctttactcacattgctgaagagtaggaagagcaacatcgtgttttactggaaaatttcttttaggtaccaacacatccgtgtggtggtgcacctttagaattttccagataaaggtgtgtgaagggaactgcaaaaattacacttctatggttctgcactaccaacttgaaaattgcaaatccaagttgacaaatgcatattttaaaggttcgcagaagtcttctgtgctttgcttttggttacagagatgacacagggaagtgagcctttgggtaatgcagtgcctcctccctcaaccctgctgtgaaatggaagctttaaaaaatccagtggtttttttttttttttttaaacaagcttagtcatattagctgtgctctgtatgccccagtctagtttattttattttgtagtgcccattttatttatactcatataaatattttgcataaaaaggtgctttcacagatttttgtgcttccctaaagttgaaatctgctgccgtttgttaaaatgtgttagttttgttatgtttatattctctcctctgcacacataggaaaaaatatatggaagtaactcttctagcaacttttacattttagaatattacctcattttatttcttctaactgaggttataaaggaaatgacaaatgtcaaatgctttgtcatttcagaaactgttgagaaagaaacaacagtttctcaaaatgtgtaagcacctattcttaagcaaggggccactttaaattcagagatcacaat

SEQ ID NO: 24768 - DNA, 1516 bp, Bovine  19866881967839
tctacagcaaccatctaatcttgatggccatagacacatgcatctatatcatgtcagattcctgccccagtgagcaggtgacctcttcagggctgcatctctgtaactgtcccatggtgcctaacaagacattcagctttatctagattcaaaaccaagccttttgaatcccagtatgttacctttactaaaccatgatgcttgtatatgtttattttaaactttactttaaaaacacagtactataaaagatgttcaactaccagtaatgaagggaggattatttgcttacttctaaatttctctctggtgatcacagagagaagagtactcaattattttcttaagagccagataagtggataatatgcagcagaagcaatttatgtggcagagcacagagggcgttcatagacatagggtcatctttgagtaccacatgaaaaagcaagccaaagacttggttttgaatctatgcctcttgcttccctgggaaatgtgttctgacaccaatgctcctgatattctaggagagagaatcctagtacgagacaagcagaatgtgaagcttttttatgtgaagccccacaactcagaagagaccccagattcaagagaacagagaggcctgggtctccttgacatccaaacttcatggctgtcatcccatcggttgttttgttttctttatccttcacctacaatagagggaagtaaaaattagttacaggtgactagagggaactgataatcataaaatttgatcataagatatatccttggtaagatattgatgaatcagtcttcatactctaagataattagaaactaggccattcttcaacttaccatcatgctagaaatactttccccatcttctcgaatgatcagagtgtaccacattttctcctccacagaatgctcagtgtagacagacaccattgtgatatttcaattggaagtggaaattctggctttttgtcttcaagtggagtttggaatagtgtggcatattctgcagaatgaagagcctgttacattcaccttctactccaccttgaacactgcaatctcatagcaaaccagggcagttgacctcatcagatattttcaacattactctttaacttcataataccatttctggtaatctatcataggatgaattacaggcatgaataaagacttatgagtaaggatgttcataataggattacttataataattaaaataccaataaggaaatattttactaaactatgatatttccacagaatggagtattatgtatccattaacaccacatactcaaagtttatctaaggacacaggaaaatgcttttgatgcagtttatcttaagaaaaattcaaagtcaatacagcatatagtgtttcaatactttaaaaaaatttgtttattcatttatacaaaactgctatctataattcatctctgtgtgatggacttataggggattttatatctgttaacacactccctatttttaataataa

SEQ ID NO: 24769 - DNA, 2032 bp, Bovine  19866880391783
tctcccctcctgcaaaatctcttatgatttccttacctatctggtacaggaacatgtgagtacccctagctgaatacatccctgtccattttcctcttctttagacccagacttcctaaccacaaacctcccaaatttgaaggctcagggtgagtgtgtttggctcagctgttttagtcccatagaggttctctgtcttgcatctagatttttcagttcagccgttactctgggcaccatggtcctagcaagtctaaaccaaaaaaggagtccctttaaggtgtttgaaattagatccccaagactcgcttgatgttcccatgttcattcttttgatttatgggtctcattactggggaaggctgaaatagctctcttctttctctccaccagtggcttcaaagcactgtatgcttggttacccaaatacattaaaactaatttaaatcatcttaagcaccagtgtgctcaacaaaccagaaaagactctggaatccaaaatatatggtcacattttatactgaataagatgcaaggtagcaaatccatcagcataatggtataggttgttatgggcacaagcaagacatttcttaaatgctgtactacctaatactgccttttaaagaggaaattaatgtcatccttcagctgaaaggcaaacttaacgacgatcacttataaggataactccaactgaccatgaatgtctacggctgtggaaggataaatgcttacatttatgtaaaccacagtataagtaacaagttggcaccattttccatttatccttaaagcactgtcacttcaacgcacacatatcatgttagtttctgtgttttatccctcgctacagtccacggggctgcaaagagttggacacaactgacgcgaccgagtctacgccacgaccagtaatgctgaagaagctgaacagttctatgaagaccttcaagaacttctagaactaacacccaaaaaagatgtccttttcattacaggggactggaatgcacaagtaggaagtcaagagatacctggagtaacaggcaaatttggccttggagtacagaataaagcagggcaaagactaacagagttttgccaagagaatgcactagtcatagcaaacaccctcttccaacaacacaacagaagactctacacatggacatcaccagatggtcaaaaccagactgattatattctttgcagccaaaaatggagaagctctatacagtcagcaaaaacaagaccggtagctgactgtggctcagatcatgaacttcttattgacaaattcagacttaaattgaagaaagtatggaaaaccactagaccattcaggtatgacctaaattaaatcccttacaattatatagttgaagtgacaaatagattcaagggattagacgtgatagagtgcctgaagaactatggaatgaggttcgtgacattgtacaggaggcagtgatcaagaacatccccaagaaaaagaaatgaagagaggcaaaatggctgtctgaggagcccttacaaatagctgagaaaagaagagaagcaaaaggcaaaggagaaagggaaaaatatatccatttgaatgcagagttccacagaatagcaaggagagataagaaagccttcttcagtgatcagtgcaaagaaatagagggaaacaatagaatgggaaagactagagacctcttcaagaaaattagagataccaagggaagtttatacacaaagatgggctcaataaaggacagaaatggtatggacctaacagaagcagaagatattaagaagaggtggcaagaatacacagaacaactatacaaaaaagatcttcaagacgcagataatcacaatggtgtgatcactctcctagaaccagacatcctggagtgagaagtcaagtgggccttaggaagcatcactacgaacaaagctagtgggaagtgatggaattccagttgagctatttcaaatcctaaaagatgatgctgtgaaagtgttgtactcaatatgccat

SEQ ID NO: 24770 - DNA, 1329 bp, Bovine  19866880431415
tgaaggcatcatggcctttggaaatcacaccccaacagaaagtctattgttcttttgaggtgagactttctctcttagaaagaattcaagctctggggaaattttgacttactgtgtccttttcaaacctgtgaaaaatgtttatgctggggaccaataattttcactgaagccagagagtacctatcaacacgaaagcaagtccaaagccatcagaagactaaacaacacggaataaaataacattgacattctcactaagactgtcaggagtgatttagaatcagtttcatgatcaccataacaaattgtttcagagatttactaacattcaaaagtcaatgtttggaaattcttaatatgtaatctacccatagatgtatatttggactaaaataatgttgtatgttgtgtataaattttggttttgtcacacttgcaggttttttgggctgcataaggtcttagttgcagcacgctggatctgcattgttgtgagggcttctttccagttccctcaggcacttagttgcctcacggcatgaggaatcttagttccttgaccaggggttgaacccacatcccctgcttggaaggtggattcttaaccattggaccaccagggaagtcctccatacttgtagcttttaattggctggaatttattttatttttaaaaaacaatttgatgttaaaaatatcatggcaccaaataactacttcaaatgtattgtctttttaattaattttgtgggtgatgtttagacaaaaatctcaaacccacttataactgaagggttttggaaatgctttaatgcaatggattatttggggctcctattatttaactctggggatttatttctgttcttttatcaggttctccaaagtacttattatttgtgttggataaaccaattcagcagactgcatcctcaatgcatttgccagtgatgaaaactgcccttaatattctttcaggtctggatatctatctgtgtaagaccaataggtaagtatttctttaaactattgtagattatgtaagaaacttgccaaaataattatgagaggaaaaaccgaaagaaacatgccatggtattaacaagagttctttggatgattaaattgtggataatgatttttctttcctttttcattactgtcctattttaaatgatgaatgcatattgcctttgtaataaagaaactttacttttgaacaaacagttgtagacacaataatatccacacaaatgaaatggagatctcaggtacatatgcagggggatagaattctaaacagggacacagttacatctcctgatt

SEQ ID NO: 24771 - DNA, 2502 bp, Bovine  19866880436703
gatcatgtgtagaagtacaggaagagatgttaatttagagaaagaagaaggaaataggagaaaaaaaattctgtgacactagggcatccagcggcaggtggcctcatcagcaatggaatcgaattcctgaaagcgctgaagccaaagtaaggtaatgactgtcatagatgttgtagactaaactcccagacagcgtctaggaaacatgccagaataacagcaaaggttgattgcctgtagctctaggattgcagaatttataaggtgaaatattacatctagtaagtattcaaggaatagtgttgaaattatattggccatattagaacttccaaagatagttttgtctatagcactatctctgttgcaagaaaagacaaataaaatctcttgaaagattcttccttcctaatggcagatatggtcttaatatataagtaaccataagtatgttcccacactcatatgaccttcatatggagacaaggggattgctccaaaagcctaaatcctttgctaaaatgagcagtagttattacaaactttcacactttaagttttaacaactaaggtgtcacagcatttgtaattctggcaacactcaagcttaatcttcctttgtctacagagacatgaaattttaaaagtactgtgattatattcactgagactccacagtagaatcaagattattgagttcaataagagaaatgacaaaactatgaaagatagttaatttatttgacaaatattgtaagtaagtgttaagtgttagtcactcagttgtgtccaactctttgcaaccccatggactataagcccaccaggtttctctgtccatggaattctctaggcaagaatactggagtggataggggattttccaggggatgttcctgacccagggattaaacctggggctcttgcattgcaggcagattctttaccatctgagccaccagggaagtcatgacaaatattgggttggctcaaaagttcatttaggtttttctgtaagattgtacagaaaaacccaaatgaattttgtggctaaccctatacttattgagtatctaccggacaccagataccaagcaaggtacacttgagtggctggtagaaaaatttggagacaagcagagagaaggataaattgacgaacaagacaaacataattcttgctcttcagttcagttgctcagtcatgtcctattctttgcaaccccatgaaccgcagcacaccaggcctccctgtccaccaccaactcccagagttcacccaaacccatgtccatcgagtcggtgaggccatccaaccatctcatcctctgtcatccccttctcctcctgccctcaatctttcccagcatcagggtcttttcaaattcttgctcttatactccagcaaagaattaaataagaaattaaagtatcctgtgaagggctggagcactaagagagtctaggagtcagacgagttttagccaggccaagtgtgggtaggatgatagcaattaagaaaagttaaaagatatttagaatgactgatgtattgaatggggcaagagatgagcctaaaaaggtcagtagcaatagctcatgaactgtattgttagctatattaaggagtttgggctttatcagaaaggtaatgagaatccattgttttaaaagtaagtaggagaatggtatgatcaaatttggattttttttaaagattcttccagctgcaatatggaggagaaattagtaaagactacactaatgaccagttcatagtcagttataactatctatgcaagagatataggttatctaaaacaatgtgtggcagtgaaaatggagagacgtgattggtcacagagcatattctgaaggtagatccaccaagatttgctgatctgttggctatggggaatgcggagaaaggaggaatcagggataatttccagatttccagctagacatctggttgggttacaggccatttccctgagactgagaaactaaggaacgggggaaggagtaggaagttcatggagagggcagcaaacaatgaatgcatttttgaatgtgtggagttagagatgtctgagacatcttaaggggaatgttgagttagcttctggatatctgttacatgtttaagtgctaagcatcagtggaaagggaaatttaaggggcaagagaaaaagaacttctataacaaggtctttggaaagacaacagtgatgggctgtgcccaggtggagggatttaccttggataaagcagaaggttgcctctttcaatgtaaaggcatggaagaggaaaaaacaggtacagatacaggtgtatgtgtccttttgatagcaggaagtcaaggaagttcctgtctagtgacttctatttactctaaaagaaggagacaaggtcatccgctagaaggtctgatggaagcagatctgaggtttacccagaggagaaaagaagcaaaagatctgtataagatcagaagaaaga

SEQ ID NO: 24772 - DNA, 749 bp, Bovine  19866880505636
caatcatccaggcacctgcatttattaatctttgccatgtaaatctgtttctatgaataagtgaccagagttgtagccccaatcagactgtgtaaacccacacacacaggtgatgtctgcagaccagtctcagggtgtagccgaggtttcaagtgtctgtgttcagactgtctccctatcctcagtggaggatagcttcacatagcaggtgcctacacctgggcagcttctcatctggaaaaaagacaacgatagagtaggggaaataatttttaattgtaaatgcagcaagcaacatcatgacagagaaatcttaaagggttttgaattaaattttgggatgctgatggaaaaatctgaattccagaggtaaaagctaagaaataattgggtttttgctgagaaggaaagaaaaaggaaaaaaacctcaatctctagctatctctctgtctcagaaattgaaggaaaatttagaagccaccaggcatcatatttctggagaaggcaatggcaacccactccagtactcttgcctggaaaatcccatggatagaggagcctggtaggctgcagtctatggggttgcacaaagtcggacacgactgaagcgacttagcagcagcagcagcatgtccatgggagcgcaaagagttggacgtgaccgagtgactttcacttcacttaattctgctaccatcactcctctattgtatttaccagttgaaatatgagaattagttaatatgaga

SEQ ID NO: 24773 - DNA, 2750 bp, Bovine  19866880552366
tacccgtatgtaatgtgacatgcccttgagcaattctgaacagctctgtgcccacctgaatattcattggaaggattgatgccgaagctccaatactttggccacctgatgcaaggagctgtctcattggaagagaccctgatgctaggaaagattgacagcaagaggagaagggggtgacagaggatgcaatagttggatggcatcactgactcgatggacatgaatttgagcaaactcagggagatagtgaaggacagggaagcctggcatactacagtccctggggtcgcagagtcagacaggacttagtgaccgaacaacaatgtgcccaccagtaggtggcagcagagagcagtggccacaaccagctattgtggctcacagtcggcagttggagctgtgcaggctgaatatggaagctaactcttctggtagcgatccccatttgtctacagttggggttgatgaattccaaaggcagcttgcaaaacgattcctaatgtatgttgtctgtggtcatagagtgagacacacctgaaaaagagggcagtttttgcctgtttctttctggcccaccatgtctactgcaaggaccagaattgccttgagacaaaagctgtgagagcacatactcaatgtgtcttcgaaattactatctgcacattgcagagtactaatcctagtggctatcttagctctagactggtccatttcatggaatctcaacatctccacatgggtattcctgggcatctcaaactcatcatgttaagattggattccatttcttttccatttatttatttttttcataggaagtaggtgagaagcactagcttccttcaaagcagctcctgaaaccagaaatctggtgtcatcctagaatttttcccttttcctctgtcttactggcttcaaactgcttagagaatctatgtggaatatcagtgaattaaagaagctttgttgcctaattggaaaaaaaaaaattagtaaaaggcaaatctgggaaagacttttataatattcaaatgtctctcttagaagggaattgtgagcaaatggagggtggagatggtgattgggaagatggagagagagttctgaaaactgtagctccgaactgcaggagtttgagaacaaaaattcgaagagttgtttgactccagttgcctgattttgaaatgcagaagtcctctgacaggaaaccctgtgtagaaaatacagactacaccatcctgccattgtcagccccaggggctgagcaactggagcagaaggaagttgctttttttggtattgttttatttttgtcttaaagaaatatccttcttaatacgcatatgaaaatcttgaaagcttacaagagatggcaaccatactggatgatagaatcagagtctcaaaagatcttgataggctaaagtaaaaggacaaatgacaggaagtggaatgagtaggcacaaaggtaaaattctacatctgatgttaaaaaacccagttgcacatgttcagaaaggggagacatggcttaacaggagccccgtagttttcaaacttgctgttgatgttatgttagtcggggtatgctaatgactataattttaattcccaggacttcagtggttctaagatatcctatggaggaaaaagtggcaaagggatgatagtcctgcttcattcaattgattgcttctagcaggtttccagacattccaataatgtctgcccagtaaggggagtttcagctaatatctccttttaactaagttaaccctcatattggaaaaatggctttaaaaatatttcttcaaaaaagaaacaggtaatagaaagataacaacaaaatgaacttaaagaaaatggcagagcgaacctttctacttttagtacaaatcagctgcattatggtttaaaaaaaaaaaaaaaaaaagtaacgtttgtaattagaatagtcccatggctcaggggtaaagaatcagtgcaggagacacgggttcaatccctgggtcaagaagttctcctagaggagggtatagcaacccactccagtattcttgcctggaaaatcccatggacagaggagcctggtgggctacagttcaaagggttggacagcaaagagatggacatgactgagtgactgaacagatataagaaggaatccctccaaatctaaagttttcaagaaaaccacttgaaatatggatatacacccacttatattaatggacttctccattaatggtagttggttagcatattatgtcctgagatattaactagtaatactatgaattccagtgattagccatttaaaagctaagcattcagaacaggaagacaaacttcagtttttcagagatacttaaagttttacggaacaaacctggttcttgacaaatctcatgaaacctactaataattgcttagaagcctttcttgaggtctttcaatatacaattaatgaacaaaagtcacaaatcatcggcatctctagttcttcttgccacagtaaaaactgtttgaaataattataaaacaaaagaccaacaaactcaaaagcatttctttgtcagcacatttttagggaagtcacagaaacattgccgaacatacgaagaaacaaatattagaacagattggccatgcatttgggtgatagtacaaatgtttgtaacatgtctccacttatggtgcttgttagagtctatttcaatagttacattgccaaagaacttcttttt

SEQ ID NO: 24774 - DNA, 3467 bp, Bovine  19866880560851
aatttgcctgctgttgctccttgcaggggaattcttgagaactgtatggtgcaactataaattttataaaaagtcagcttttgaaactgtgcaataatgtttatgttggcaaaaatttttttccctctgctgttatgctgctactgtcgcttcagttgtgtccaactctgaagcatagacagcaccccaccaggctccactgtccctgggattctccaggcaagaacactggagtgggttgccatttccttcgccaatgcatgaaagtgaaaagtgaaagtgaagtctctcagtcgtgtccaactcttcttgactccatggactgcagcctaccaggctcctctgtccatgggattttccaggcaagagtactggagtggggcgccattgccttctccctgctgttatgctagcaattattttctcaacttctcatatcttctcagggaatgtatgttttatttatcttttttttttcaaggttaagaatcttacaaaaaagtataataattaagatttttgactctgcagtctcacaatggccattaattaattgtttatcttagataaattatttatcttaaccaaaatttagttctttatctgtaaaatctgtataacacacatcttacagaatattgtgaagtttcaatgagataatgtatgtaataagtatggttagtgctaggcactggaccagtgaatagtaaatagtaaataatgagtagctatcatattattatagtttctattgttttatctgattttttctcaatgaggaaatcctgccatgatctaaaaatgacaagaccttttctgggagaacacacaaaaagcttattatactagttattactggagagttgagatagaaaatggggaagagaataaagaaaattctactttttatcttatactctttcatttgtttaaagttttataacataaacaatattacttcttttttttaatcttagaatatttcctttattttagtgcatacctgattcaagtcctccccccaagacgtgagtatattaaaggctcagagaattcccactataaataaatgtgtaattttgttttaccttttattccaaatgtatttcaccataggatctagaattctgtcttcttggcataacatttacattttgaggactactagtgtactacagtgggagagggcaatggcaccccactccagtactcttgcctggaaaatcccatggacagaagagcctggtaggctgcagtccatggggtcgctaagagtcggacacgactgagcgacttcactttcacttttcactttcatgcattggaggaggaaatggcaacccactccagtgttcttgcctggagaatcccagggacgggggagtctagtgggctgccgtctatggggtcccacagagtcagacacgactgaagtgacttagcagcagcagcagtgtactacaggacatatttgaggaattgttctaggttgatatagactaaaacaatattccgagtaccatttcatgcttctttcatttctactcattatctttggtgatacttttttctggataaacttaaatataatattgagttttggggaggtttagatcttcctataaaagtaacttattcttcttttagagcacagtgaaagcatctgtatatttttgagagtaattacctgtcttatcaaaatattcaatgtttgatcactctgtaaaaggacttattgtggttttctctgtttttttttttcatttttattttacaaataatttgtagcaattacagaaaaattggaaaaatacatgccataaacaagaattacctatatagatattttattttttaatcatttttaaaattatagttaatttaaaactctctttagatgtctgatatatatgtgtgtgtgtgtatatatgtatgtgtatatatatatatagtgttagagttttcatacctgtgaaactttttccttgctttggagtcatttaagaaaaagtatctggtaaatggtatcattttgtaaaagaagcaataaaacttgaatatgtttataaacaatctttgaaccatacagatacataagcaaacaaggatcacaaaatttaagttaattgttgttttaataattatgctatatattgaattttattgtggtaagatgagtgggaaaacagtcttcctatataagtgatttaagaaaagttctcagaatatcaggaaatattttggatatgctgttggaagcttcagcagtaggaaagtgttagggaccaaatgtgctttttcatgttgtcacactcttgacttgagatcacatcaagaggagactgtggagacttcctcagggcatagaacacaattctgtattttatcggaagggacacaaatccttttggttgtctgaccaaatgcttcatttgcaagttcaaatctttcagaaaaaaataaaatacccagttaacaccctcttcttttaaaaagagaaaagcacagccgttggggtattttattgaacatgcagcaaatccagcccttttcttttgttgcacactctggatctagatgtaagcacccataacccctctctctgtaagcctttcccaggcactaagactctttgcatactccactgggacccgacaccacataaatcctgaattgcatttggcatttagttcatatagggatgggctaaattatatcaaaacaggttttctggtgcagtgatgatgatttgagccatgaaagacgtgttatcagcactgacagtttacattcctcaccagagaataaacacaagcccaagagttatatgctaatactgccctccaatccgtagttttagaacaagttgtactactgagagactaaagaactggggatatgtggagacaaacattttgtctgatttctttgcttcagactgtactgccaactctgggtggctaacccgtaaatgtccgcacctcattgggagggagtgacaggggtaggtcagagaggggatggatgaacttttgtagatctaaaaacatccccagagtggaacaccacaggccctgtatcagtagctttatctttcaaagaagagcagcccagactcagaactagaagtgcctttaaaataatgtggaccaaatcccccttgttacatatgaggaaattgaggcccagacagatgatatgagttacctaagggaataacagttctgatcaaataaaccacattctttggtattctgataattactgaatacttattataagattatttcttgagtatttaaaattgatacttgttgtgtctataaagacatataaatctttgtctatatatcaagtggttgggatttaaaagcctccattctgtttatttatttatttggtggtgaatttagtctcattgagcttccttgatagctcagttggtaaagaatctgcctgcaattcag

SEQ ID NO: 24775 - DNA, 866 bp, Bovine  19866880638968
cgggagaaatgatttatttttgccctcccaaatcaaacattctaggaatccaaggtgaaaattggattttaactgctaccagcatttggagcatataaaatcggcaagtgttgagagttttgcttgatgaggagaagaacctaaaggggctgggacgagaatggtctacatgtgatgtgcactggtgtctgacataaatctgactgatcatactggaagtaaaccacaagcacgctttggcagctgattgcaaccgtggagacctctgtgttcttcacatatcattttgtttgcagtcttaacgcctggagcgttgttccatcttccttcttccttgcttcgtatttcaggtttaagccttctgttattaagctgaaggagcctgggaactacctgaatgcagccagtatgtgttgttcctccccgaggttctgcatttgtacatgtgttcactttctccccgcattgcccccctcccctcctcctgctcatcatacactatttttggagagaatacgacatcctgttgaaatcttgaaaacccacaaaaacctaaggacttcaaagctatgatgtaactccaacttcattagccgagctctgccttctctggttttgttttacaagttggacatgtagtcagagccttgttgggaatgctgcctgggtggacctggagggcaggcagtgcggtccctggaggcctgccagacaactggtatccactgtctgctgcccttctacgagtcaccacctgtcccaactttctgcccctgagtgctgctcaccagcctgggctagtttgctagtttccattgttttccccaggaccattgcttgcttgaatggactgaaactggtttgtt

SEQ ID NO: 24776 - DNA, 2142 bp, Bovine  19866880681265
actgctctggccttgtttttctttaatgggagaaatatagctgtgagattggacatgtgtgtgtagaatgcttagcatagaacagtttcttcctgttctcattagcgctttttcggacaacaccgagaaggaagctgtcatgtgttaagtcagtagttctcatcgagagtacttttgggcgtttggtgccacaggacatttggcgatgtctggagatgtggtggtttgtcaggacctgggagactgctgctggcatctgtgcataggccagggctgtgctaaattattccgcaatgcccaagacaagccactaccataaagaattctctgatacaaagcatcagtagtgctgagcttgacaaacagtcagtcatgaaagtatagtattaaagtattgagcaaattaaaaaacatcactgtgcgtatcttaagttggataagatattattctgttgataagtagcaaatgaattttttcagttcttgatactttggctcctgaccaaagttagttttcctagtttctgtcaatatcagggattcttgtcaccaatttatttatgtatgttaagaagttatttgcattctaaacagtagaataaacaaatgcctagtgaatcattgctgagctcagcaaacagtatcatttgatacagttacaactgccacagaagactgaaagtattaacttgctagtttgatcaaaatacatttgattgatttactaatgttgattagctaatgctgacatgaaactgggtgacattatctgcttcatatggcacttagcccgcagtctaaatctggtaagctctttgatttttttaaacattaaaataaaatttctacttccctggaagaatattgtggatttctgaggcaagagaagagagttggaaattttgggtaattccgctgttttgtttctcattagacattgggcggcgtatcatgtttgagttagttgtacagaatggaagagactttgaggatatattttgtgtttattattgttggcttaaaagttgacctttttccctggatgtttcgtgacacatcaggtactcacttggtagggtagcagttgttgactttggtggtctgatgtttctccgaaggggctctgatgttgctcaatccttcactcttgcgattttgcgctcaactcctgggtgcagtctcaaaaatggtttctcgtagtggcactgatgatacttagtacttgagtttgttttaggtacaacacggcttttcatcacgatgctgtggggtgtaactattcttatgattcccctgttagagaggtcaagtgacttgtctgtggttgtaatatgacctagagggtggtggggccaggccagcttagtgaccttcactctcttctgaggagggagtctagttgatggtggtgtaccttgagtgggaaaatacagagagagatctgacatgaaccctaaaatgcaacagaaataatacatgaactgtagagcaccaccattttttatagctctgccaggacagggaagggacttactggtggaagaatttttttttccaaatgtattttttttctttaatttctcttttttaaaaataattttatttatttatttttggctgtgctcggccttcattgctgccccggcttgtctctagttgcagagaacaggggctgctctctagttgctgtgtgccggcctctccgtggcttctcttgctgtggaacatgggctctaggcaagcaggcttcagcgtctgtggtccacaggctcagtggttgcagcacatgggcttagttgcagcatggcatgtgaaatcttcctggaccaggaatcaaacctgtgtccccttcattgccaggtggattcttatccactgtgccaccagggaagtcctttttctttctttttaattggaggataattgctttacagtgttgtgttggcttcttccatacaacaacatgaatagccagaagtatatatatatatcccctccctctggagcctccctcccacctccaccccattccacccctctaggttgtggaaatagggttttaaaagccttgtgaagtcagtgtccctcccttttgctaagcagtgggggcagaccgggggaggtactgacttgcaatgactt

SEQ ID NO: 24777 - DNA, 1667 bp, Bovine  19866880736216
aaaatctcactaacttgctgatcactctttcctggatctttattaagatataaagatttaacactaattccttagttcctcactagtcatttcagtttcacagaagcctttgaggtgaaatgagaaaggaggctgtaggtgtgtttgtcagttctattaatattttcccttaatgtcacctagatctgctaatttatatatgctccttagattttctaactcttcattcacttctactattctgtaagaaattcttttgatagaattctttctgtttattaattgtctatatatagagtcaaagttggactcctactatctccataaattgttgtcgaaggtaggggatttaagctgaggtacagagaaattactaaccttggtattggcaaagggtgaaaaaaatagctgggctgggatttgaatacagacctttctggcttcatggttcaggcagcatctagggcaccaaccatctaggtagtatccctccagggtccccctagggtccccctagggtcccacaggcaggcagcaacacaattttgtggcctgttggctctgggctgagggttttggcgtacctggtgaaaacagagagagcatcccgtgaggaaggcagtcaggacagcactgaggatgaagcaaccacagggtgctctgggagggatttcatgaaatttcacagggggaagggaactactaaaggcatgcctaaaaatcacctgtgtgcctctcctccctttgtggtcttctctttaccatccccccacagcttaacacacactttctgactatgcttggctccctgggtctgctgcaggaaacttttggcctgttcagtgcagggctgcctgggaaatatgacgttattcttttaaggatcatggatctcttttcctaccactgtctctggtggggcatgaatttggaaaaacacagctgtattactttcttgggagaaggctaacgaaacagtataaggaaccatacagagaaaaatcatggtcagcatatccaagattgccttttgtgaactcgagggaaggattttgtccaaatggtttcaatgcttggacatctgatccctgtttttgatttggctgcaactgctctttgagattctcgcagtcaccctcctgtcacagatctttatcttctgatctacatttgacccttgggtagcccactgtggagcctaccttgcctggggcttagagcttgggacttgttcccttggatttcagaactacctggactagtctttccaacttccatgccccataacaattgcttggaaataacccaggtcagattcttggttatctcactaacccagaggagatgttgggttggataaacagttggtctcttggaacagggaggaaccaagggccaagtgctagagatgttgtgttctgtaacagtcatgttcaggtttgtctggatcaaattacattagttcaactaatcaggataggttgtcaaatacttgctatcctggagtcctgagctggccttttagaaatatataggtatcccagataaggttgctggccttagtaaataaaaatacatgatacctagttaatttgaatttcagataagcaatttttttttagcgtaagtttcaaatattgcatggaaagtttttttctagatttcat

SEQ ID NO: 24778 - DNA, 1176 bp, Bovine  19866880962460
ccaatagagattatacagtttaaaaacggcttcccacttctggcccagcatataaggaactcggaagtcgcactccctgctaatactttaaaagctgaacaaactgaaaaatcaagaactctgctaagatccatcagagaagttaggtaacagggaagccactacccctcaaactagagagacagacatttaagtgcagagaatcacaactcattggaacagaaaccccacaaggaggagtctcccaggaacctgtaaggggttaggaaaatctgaactataattggggagcctgtgacaaactctgagtcaaaaattccaggggacccatcacagagcgatccccttacttttataagtttttcttctgggagttctatctgttggtcacaatgaaagtcagataaaaataccctatgtttccagcagcaagagaagataaagaatctttttaaaatattccatggcattctgttcttaataaggcttgccttcaaaagatattatttcatcatacctgatcttactagagtctaaactaaggagaatgcaaattcaattcagtgagaaaaagttaatttacagtaaatggtgttgaaacaattaaacatctatgtgcaaaaaactgacattgatccatcatatgcaatataaaaactggctcaaaatgggtcataaacctaaatgtaaaacctaaaacttaaaaacaaaaacaaagaagatttttgtaattatggattagacattgcttatatatgacactaatagcacaatccataaaggaaaaaaaaataagttggatttcattaagtcaaacactttttaaaaacagaatcactgttaacagactggcaagagtagcattacatttaggaaaatatttgtaaatcctatctttgacaaattacctggatctggtaatattaataggaatttaaaaactcaattataaaaaatacaactaaaaaaggcaaaagatttaaataaacacttcagagaagattcatggatagtaaattagcacatgaaaaattgctcaacatcattagttaatcattagaataaatgcaaattgaaaacatgagattccactacatatctattaaaataactaaaacttaaatgactccttgtaaactaaaaataaatcaagaaattttaaatcagtctgctgat

SEQ ID NO: 24779 - DNA, 759 bp, Bovine  19866880983640
taactgtggctgacattggcagttgctttttaaactctgaagaaaaataatgaaaaatttgacatttattctcccaactgccattggatttataatgacatgctgacatttaatggttttaacacttgttacagatgatgtagcaatttgtatgctgatcattaggatctaactttttttgattcaaaattggttaaaactaattaaagtgtgacactcaagactttgcagaactatgaaagtcttaactattaaaagattccaagagggccaactcttagatataaaattccaagttttgcttacatcaagaattaaatagcaataaataacatcacctgtaattgcaagaagcttattgttttctaagacagtaagcaaatgctgtataagaaagagaacatcaaacttgtatcagtcaatacgtgaccttgggcaaaccatttgtctgttgatttcttcatctacaaaagggagactggtggctttgttacatatttcaaaatgccatgaacattaatgaagtaatatctgtaagacatagaatttgtgagaatatttctttttatgactcttgctaaattctctgctttgtaattcagctcctccattactgggcagcttattaaagctgcaattatgcagggcagttcttacttattttaagctaaaatctgtcttctgctaatttttatgcatttattgtagttttatcctctgaaaccatgctatctttaattcgtctactacatgttagca

SEQ ID NO: 24780 - DNA, 742 bp, Bovine  19866881081502
taattggatttgaatgaaaaaaaaaaaatgatccccagaagcataagctattttccagtaactgacagagatggtaggaggaaaaaaaaatcacttctaatagtttcacattgagcatcactctctgcctgaaacaactctgcagagtaacaaggcaacagagtaaatgatttataagtaaaaactgtaatacaagcaatgcattctatgtagagtcattctgagattattcaaggggaatcagtactgggacaatgggaaaggaagcaagctgttctcataaaatagaattctttattcacgtattgaaaaaaatgcctttgttcataaatgtttatcctctgatatcctccaaaaagaatttaaacagcttatgataagaagcaaaaataaaatgaaactgaaaatgattaacataggaataaaacaaaggccaaaataatgccagtctaatactcttaataaaataccactgtatcaacaccagggcaaaaatgagatacgaaatgactagcccttcagaataaggttcaggaaaagccaagctgagaggttcacaacacaagctgacaattcgtgatgtatcaacttgtctgtctacctgtgtgtgggttggtttccctcggtaaacagtacgctccactggtcaaagatctggtccatttcattcatcactggatacccagggcctggcataatgtctgggaaggtagaggtgtgtattcagttgatatttgttgag

SEQ ID NO: 24781 - DNA, 1565 bp, Bovine  19866881191396
tgtccacctgcttgctgacttgccaggatgagctagaaataaacttagacttgttttaattctggttaaaattacgccctctttgggacttttcttgtggtccagtggttaagaatctgcctgccagttcaggggacatgggtttgatccctgatctgggaagatcccaacttgccacagagcaactaagctggtgcgcctcaacaactgaagcccatgtgcctagagcccatgatccactacaagagaagcctctgcagagaaaagcccatgcactgcaactagagagtagcccctactcactacaactaaagaaataccatgcatgtggcagcagacttggtactgccttaaataaattaattaaaaaaaaattactccctctttgccaagaaaactattgttaattcaggcatgcccactgagttggtacatttgacctccaatataaggcagatgaggatttcattgagaagaaaagaataatggcttttattgggagagttagtgtttgtaagggagtagtaacgtttgaggctgatggagtttatatgaaccagatgactttaatttgattccaaagaattgtatcagtaatccaggtgcagtgggctgggcttgtatgcactcagctttttttttttttttgccatgtaccatacagtactttggccacctcatgcgaagagttgactcattggaaaagactctgatgctgggagggattgggggcaggaggagaaggggacgacagaggatgagatggctggatggcatcactgacttgatggacgtgagtctcagtgaactccgggagttggtgatggacagggaggcctggcgtgctgcgattcatggggtcgcaaagagtcggacacgactgagcgactgatcctgatctgatctgatctgaccataccaggatgttgaatcttagttccctgactagggattgaacctatgcccactgcattgaagcgtggaaccttaactactggaccacgagcgaaggcccacttttcttccccatagaaagcagaaaaatcatgtattccaaaagatggcagaaataagaaattcatcctgacaaaagtataatatattaaatacactggtataattctggtgggacagattttccctctgaacatgttctcctactgactgcccccaccggagtctgtcatacaacagtttttaaccactgcttattcttatgttgtgagcagacaggagccatcttcaaatccacagattccaaggagagagtaacgttatttatcagaagaacaggcactttcaatcttggaagagggcataaacattttatagaagcagtacagtttagattaaataggcacatcattcatcaaaggtgtaaaaaagatgacaggaaaaaaataccacattgtaaaataagatattcagatgttgtgtgaacgtttaaggcagctgatggccaaagtgggtgtgttaaggaaggtagcttggatatggaggtgattttacatctagaggagttctcttcctgacctcagtgactgagcactggcaaacaaacaggt

SEQ ID NO: 24782 - DNA, 626 bp, Bovine  19866881232595
tatctgttttgcaaaagagtggccttacttcagctactattttttttttctcttcttttcttgagaacaattttgcaagcttattctgacttgaaattatgatcgttatgttcatttcctcttctttaatgcatgccattgtatctcaaacttgcccaaccattggaatcaccagtaggggtgaaaaatggagattcttagattattcctctggaacagtgatcctttaggtctaacaggtttcctgaaaccagtgttttagcaaatgccccatgtggatcttaagatccagcaaattttggactcactggaatgtgactttgagtcttggcccttgctctcctcaccaacactatggtgtgtaataattgtgtgtctgtgtatgggagagtgaaatgcagtgaaacagcatgttaaaggtacagattatagtcattattcatagtatattcatatgtgtaagatgccatgtaagtgtgaaatgaaagaaatagtgatgttgttgtgaaacagtgtctcacctcttccatgaaacattctaatttatgatttttcaaagactccattataactcagagtctctgattcttgctttactagttcactgattaccaaagctatgtcat

SEQ ID NO: 24783 - DNA, 770 bp, Bovine  19866881280061
tgtggttaatctcctgtatacaatgagttttttttaaaaaattcattttattggaagacaaggcagtgcagagcagtgagtctatttgaatgcaatagtgctttttaggtccagccaatttctgattctctgaggctaaattctattaggcattaaaactcaaatttcaggcaccttgcattgtgaacacaaggaacatctgtagcaaatgtctcatattataactactggatactgattactatcagaagaactaggcttataatgcttatgggctaaaatgaagaaagattaatttctaaaaacacctaagtatcttacttctatgtttgaactgaactggaaggatggtggatgatgctgataaaaacaacctgcaagttctcagtttgatctttttttccctccagagcgtttatagggttaccaatagacatgttaatgataagtactattaattgggcatctaccacattctaaacattttagatacattattctaatgtacatagtaatcctgaaagtcaatgtatcaccttaattttacagaagagaacaataaggctcatacagaagttaagcatcttgtcttgaagaagaaaaattaaaaatttatctccttctccttctgcctctgtaactcatcttgttccttgcaaagtctagatcatgtaggtctcagaaagtggggactcacaatactaagaactagagcttatctcactcactcttgtcctgctctttgcaattgccctagcccctgcaaacca

SEQ ID NO: 24784 - DNA, 1633 bp, Bovine  19866881409419
ctctgaccatagtagtttatttagggatgagcacaagacacaatacaggccaatgagactcaaattcaagatggatgtaactgttgggaaagagaagctttatactctttatactgagaattataactctgtgaatatcatcaatctggagctaccagaggccaccaaattgagagtcttcctgagaatacaaccagcacaaaatagagtcaaatagcaggagaatcacagacaaaattctgctgccatttgttgagctctaaatctaagaaagaattatgctgatgcacattgtaaattttcagtaatatgagctaatatattctttttaatactgattgatataaacttgtatttaggagttccataaagcctgtgacaagagacagtataattaagtagcctgggctcactgagcctataaccagggcttagcaacccgaatgaaaggcctatagttagaggctgaggactgagatggagacataaagtgagaagagcttaaaagcagtgactggaggaaaacaaaccagggtgtcagtagaacaagtcttgtggcagaagatgaaaacattagtctaaggcagaaacaatggaaagcaagaagagaacataatacagtcccttttaaaggaggacttggcaggtggccagtgcaataatgctctcggctccttcttcagatttatttcccaccactgctcctctctagctccctatttcaagtcatttccaacctttatggatgacccacatagaccttgtggagccattcctcagtgcctttgcgtatacacctttgtatccctaagcctaaatgtcctcttctttcactcagacttcaagacccagcctaaattttcctctgagaagccttgagaggtcccctctctaccttgtgatccagctccatgggaaggcctggacttctggaaggcacttccttgttttcactcacctataacacaagctcttttaataaagagaacttgtctaattcactttaacatccccatacaatatcttatccataatgcatacttcaaaaatatgaattgataaaatacaaatcgcatgacgaaacattaaaggtgagcatcaacaaaatagtaccataggttctacactttcatcaaccccaaataaaaggctaaaacaaaacaccatcataccagaaggtcaaataaatatattcagcatttactatagccatagcactagaaaagaaatttctctacattctagtccaacctctactcattcttaaatgcaaactagatcttcctacaatttccttattactctgcaccccataaagttgcctctatgccagatcaaggcattctctgtaagtcaagttaatcttaaaaatgcagcatgtgctcagctgtcagaatacttttgctttctgtcagcctcattatcttccttctctgtattagtaaacaactatagaagtgatgatcaaatatttgtatgtgtcattttgttattatatgtagctgagtttttattgaatagttttagtgatcacaatttgacataagaaaatgaaagttgcttcagattctttaaattgatcataaataaaaaagcaaatttttatttcaggcgaatacggactttttaaaac

SEQ ID NO: 24785 - DNA, 968 bp, Bovine  19866881653966
atagaggagcctagtgggctacagtccatggggccacaaaaagtcggacacaactgaaagactgagtacatacacatttatagactccatacagtgtgctgttctgctgtagacaatttatgcatcactagatacttcgggtcagaactctagggggccctgaatcccactcactgcagtctatggaagctcccagttagtggcatagagagaattctagtatgggtctttttccttcctccttcctgcctttccctttgcctttctactttcctttatatatttattgagctctctctatctcagtctgtcctgccagactacagaaagaccctgtctccttcttatttctcaaacttaatgcaatccctgcccttttctccctacatcccaagactcctggatataacttttataattctgtcacttttgacattataatagttaggacttaattcatttttttttttaatactgtaactctttcttattctggagtactagaacacaccactaattctcctacatcatttgacctgtgtcagaaactttctaagtagaagaaatgtgttgaagccacatgtcctctttgctaatgaaagtatcacatattaagttgaatttgccttgggatttgggtcactgctgaaaccaggccttgggacttgtaataactatagggagcaaggatttctgcttcattagtatttgagatgttccctttagaaaaggacatatgtttcttcataccataaaccttttcccaggaagggccctctaaggtcatttggtctgttgcatcaataagaccatgtcgcaggagcacagacaccctctagcatttgatctcagctcatttaaaggcctggagacatggacttgcctttgctccctgggcagtattagattcatggcttcatccttcatggttttaccaggttattacacaccatttctccttctaaaat

SEQ ID NO: 24786 - DNA, 1027 bp, Bovine  19866881934303
taaaaagcctatttctacagtaggtcaactcactgcactgaattcccatacttttccctttattttactaatcatcattattgaaacaacataaagaaaagattggtgcctcatctgtaaaagcttaaaagctagctagaggaaaccaaactgacataggcattcaggctcttgggcgggccacccaaggacgctgacacaatcaatcaaaatattcccttggaagcaacactgctctaaccacatgaatgacccgctcaaacacaattccaaagcacttggattccattaacttcaagttttgctattcatctaccaacaattaaaaaggaacaatctcctcaagatcctaataaattttccctacgtggctatgttaacagttttctcgattgagggctttacctaaatctattaggcctctgttttctaattagtaaatggaaatgatacccatcattctcaggatgaagagaaattctatgtgaaaatacctaaacctatgatgctactgtctggatcacaacaaactgtggaattcttaaacatacgggaatacccgaccaccttacctgcctcctgagaaacttgcatgcaggtcaagaagcaacagttagaaccggacacgaacaatggactggctcaaaattgggaaaggagtacatcaaggctgcatattgtcaccctgcttatttaactaatatgcagagaacatcatgagaaacgcctgctgggtgactcaccagctggaatcaagattgtcggaagaaatagcaacaactcaaatatgtggataataccaccctaatggcagaaaatgatgagaaactaaagagcctcttgatgaaggtgaaagaagagagtgaaaaggctggcttaaaactcattcaaataactaagatcatagcatcaagttccatcacttcatggcaaatacatggggaaaaaacagaaagagtgacagatttcactttcttgggctccaaaagcacttcggacaggactgcagccataaaattaaaaaatg

SEQ ID NO: 24787 - DNA, 1956 bp, Bovine  19866882003152
caaagagtcagacatgactgagcgacaaagcacagcacatgaatggctgctgtgcaaggcatacaaaccatataatgtaccgtttggtcagcgagtcttctcattgtttatatttgcgttaaaaaagaaaattgcagtctgtcgatgtgctagttctttcaagtactctatttctattttccactgtgaagacactgtccttttgtgcctttttaacgacggctgacttaacaaacagacttcttgcagtttagctttgtagaggtttggctagatacacgcagtttgatcatttaaatgcagccctgtgaggaataacaaactgcagttactcagcttcagtaagtgaagtgtggaactgtggaactgattgaaaaaatgaaagtagttgtgctatatcaagttgttagaagacagcttaatttgagtttggcagagatacagggctaacatctgctatcacatgtttgaagcacaaatatttccttccaggaaacaagtgacattgaaatttcattttcacacagcatttataggtgctctgacttcctatagtaaaagaatctttctgaaccaatgcatggggagaacattttaaatagtttttgaatttaaataatttgcagttttggagctatactatgatctgtaatctatcctagaacaagaagaatgttttgtatcaaatttaattgaaatcaaaatatagatgttcccattgattttgataagagagccaggtatgtagattgaaggagcaatctgatcaagtctctctggaaccttaggcagagttgttttttttttttcttggaacacgaaaggaggtagatgtttgtcacttagtttcttccatgaattgaagaaaggaatagaataatatgtaggcgtctaaaataaccaaaatcagcctcacattgctcagcaatgatatctttatgatggcgaaattggaagtagcctttgtagatttcgtcagactcactttgacttgcaataattataaagggagccacatatttggagggaataagggtgatattttccactctgagcagctgagttggtggcttgcaatattattggcacactgtttccaaagaaatgatacatttcagcatataaattcttgatttagcatagtgtcttagtagctcaaggataggttggaaaatcaaacctttatttctctggcgagtatttacaaagtggaaacatctgcttcaattgttgtgggacaatttatgctctttgtggggcagttaggaagccagggcatttttgtaaacctttccatgagttgacatttgataccttcctctgccagctcttcctaaactttctccgtggcccttgcagaccagccagaaattattctgactttcatgactgctttgtgtaaacctttgtaatcatcatggcccaaacgttgtaaaaactattttgctcatcagatcttttccagaactcatcagtgacccctttataaaaacctttgtccctgaagcatattaccagcgtcatgacagcctcaataaactatgtaggctcatggaagatgaactttgttgcatgtaaaatcatcatgctttaatatttccagctctgtttatttatttattttgagtaatcacatgagcaggaaaaaaacaaaaggtcagcatattcattttcatatcttgccaaaagctttctttttcatttaattctaaaagacaccagactcttaaatctatccctggctgtctttctgggacaaatagaccatttggttttccattggcttttggtcatgactcttttttccaaattctaaatggactcccgggaaagatacaatgaagtccttggcctgatgtaggtgaagctgtttcaggggccgcgtgtgtaagggcagtcctgcaccctaggggaaatatgatgggcattatgaagggggacgcttccaagagtcca

SEQ ID NO: 24788 - DNA, 1061 bp, Bovine  19866882059339
atcctgtgtggccgggagtgaacgagcacatgccggggcgcgtcttacctgtgcctggaagggggcatttctcacagtgcgggccccaggccttgcccacactacaacagcagagctgcttggtgaggtggacagacagagggtgcatacactgccttccggaactgaccagtcggtaacacggccctttctcttccgagatcacaggggtgtccgctgaagcaaagagataaggcctgatgtcacccaagaaatgacaaaaaccagtttgacatttcacataaatactaaaaggaaccttaaagtttgtattagaagccatacttcaggataaatctatctagatgtagggcattaccctacctgatgtagggtcagctgacctattgagtcttaggagtcaggatatcaaacatccctgttgttgcctggccccttcttccattttagctagtgttaaaaatcagttatatgatcctttaattagaacttaaaatttaaaaatatcagttatgtgtgcatgaatgaaaataaatcattgcaaccaaaataaacctgcctaaataaacctaattgtcaaaatcatgatttcatttgctgttttgtaattagccataatagaggttattttgggcttccctggtagctcagctggtaaagaatctcctgtagtgcaggagacctgggttcaatccctgggttgggaatataccctggagaagggaatggctacccattccagtattttggcctgcggaattccaagaactgtatagcccatggggttgcaaagagtcagacacgactgagcgacttttacacacacacacaggttattttaggatagcatctattgaatagccaagtaccatggaaaatcaggatttgaacataattgatacaagtcaactgttactcttctcacttggaggacagtgagagcctgcagggcctcatccagtctcatcctagaccagcgaccagaaatcggaggctgagagcagcttctgactggccctgccacacaagggccccctgtccagccagaaagcacaccagaa

SEQ ID NO: 24789 - DNA, 777 bp, Bovine  19866882059810
ctggaagaaaaagttggaggatttaaatatgcccagcgtttcggtacattccaccattcacagtggtccacaaaactagcaggcctcaacaaactaggctgagaggataatattcacagtctacgccacaaattggaacttagtttaaatgaataggtactgatctgtatacaaatatgggcaaactgaattttcgacacattggggctataaaaagctagactctcattcttccctgttatcttagctgactataaaaatatttcagctgcttgtccccgaaaagcgctctaagaatgtgcttgactttcctaaaggcaactcccagcaacaccctggcccctctacccaccccctcgctttgtgcgccagcagactgtttcaagttattgtggtcaaggcagagcagagcaaactcccatctgaaggaaaacctacatctgtcattttgtagaagagacacacacatgattttgatttgaagagctacttccattttcccacttgtctctcattaggagaataatgttctcttaaaggcgttcaacgttttggttgctatcccttgcaaagtgaaaagaaaagtaataatatttttagcaagttcaagttatcactttatctctcccctaaatatacctaccttactctcttttaaaggatacccacagattctattcagccagaaagtaggttaatactgtagccgtttaaaggtttcagataacaaaatgtcagataataaacactgcagcaaaccattgctcattttttaaa

SEQ ID NO: 24790 - DNA, 697 bp, Bovine  19866880412871
tgcacaggcttcttctgtcgggacgtttgggttgtctttgcaccctttcgtctctgcggtacatgtacactgacttataagaagggagcagtaagggaactggaaattagcatacaaattcaagtcttaaatttgtggattttgtataaaggaccacattctttcactgccagaattctatccattagcagtagcgtattatgcatctaagctacaagattatttaaaaacaactatttcaaacattcatttgatttgtgtattaatattttattgttgccctaacacagatatatatctctgttgttatatattcttgtttcttggggaaaaaataactgtcaaaatgatggaactatatttgcttatgcttttcatttgttcaatgcatcaagctttccgactacccagtcagtaattttgcaatgtctcattattattcaaaattgtgaatctttggttctgcaaaatttcacatttttcttagtctaaaattactcaaaaaaatactgctactgctaagttgcttcagtgtccaactgtttgccaccttatgaaccatatgtccatgggattctccaggcaagaatactagactggattgccatttgttcctccaggggatcttcgtgacctaggggttgaatagaaaaaatgctctaccataccaatttaatgctttcttgaccatcttcaa

SEQ ID NO: 24791 - DNA, 3744 bp, Bovine  19866880553092
ttttaatcactttctgtaacagccacttgtaagtcagacctacttttttttccctttataaaatgtaattttattttttatatcttctttattaaaaatatacatcctacttctttattagattagcagacattaatactaggtatttaatatagaatatttcccagtttacatgaatctgaaatttatttaggttaatttttcttgtatttagaattgtttgattgtaagcacttacttttctttaggccaattaaattagaactcattcacaacttcaataatattatcagaaaaaaagcaaaagacgtaacattgaggtatacataaatccagacagacagagatcttattgttttctgcttgagatttaaaatatctctttaacaccctttttctttttcttgcttgaagttctaatttgcccaaggctgaagtctcaggcaaagattggctgtgtatttcaaggacatggaaagggttaacttcaagctttttcctaggccttttaacaagctagttgtttgtgtggatcacaataaacagtggaaaattctgaaagagataggaatacaagaccacctgacctgcctcttgagaaacctatatgcaggtcaggaagcaacagttagaactggacatggaaaaacagactggttcagataggaaaaggagtacgtcaaggctgcatattgtcagtctgcttatttaacttatatacagagtacatcatgagaaacactgggctggaagaagcacaagctggaatcaaaaatgccgggagaaatatcaataacctcagatatgcagatgacaccacccttatggcagaaagtgaagaggaacttaaaagcctcttgatgaaagtgaaagaggagagtggaaaagttggtttaaaactcaacactcagaaaactaagaaaactaagatcatagcatcaagtcccatcacttcatagaaatagatggggaaacagtggctgactttatttttctgggctccaaaatcattgcaggttgtgattgcagccatgaaattaaaagacatttactccttggaaggaaagttatgaccaacctagacagcatattaaaaagcagagacattacttcaccaatgaaggtccatctagtcaaggctatggtttttctagtggtcatatatcgatgtgagagctggactatcaagaaagctgagcacagaagaattgatgcttttgaactgttgtgttggagaagactcttgagagtcccttggactgcaaggagatccaaccagtccatcctaaaggagatcggtcctggatgttcattggagggactcatgttgcagctgaaactccaatactttggccacctgattcagagggctgactcgttgaaaagaccctgatgctgggaaagattgaaggcaggagaagaaggggacaacagaggataagatggttggatggcaccaccaactcaatggacatgggtttgggtggactccaggagttggtgatggacaaggaggcctggcatgctgcggtttatggggtcacaaagagtcggacacaactgagagaatgaaccgaactgaactgaaaaaagaattggttttgcagtttccgaaaagaaaaatttttctcattccatttagttatcagtcatgcactcacaatcattcagaggctattacaatgcctcccttctcccaagtccccaggtttccttaactgttgctcacttcctgggagctccaagtaggcgatccatctcctcttctatccattgggacctgactggggactggccctggagccttaccttatcctgtggccattcctggtgagttggtctgtccctccaatgagtccagtcagggctccaccaaccagagattgggaacaccggtccaaaagagaacctaaaataccatcaggtggcgtgccttcttgtttgtcttgtggttccttcgctccagcccagctgagccaccagtccaaaggctcaaggggccagcatgtttggaatctcactggggcccccagaaatattgcagaaaccagtcatcaagaaaccaagcaccacacatggagagttggagaactcaggcttattacaccagaaggcccagaggagttaacactctaagctctgagccccgaacaaaggggttacagagtttttataaacttactatagtggcaacactagctgctaatacgctggtctaaactaagggattttgtgtgtacgggaacagtagtcaagatggggaggggggatgcctgatttacacggacaggcatgattaagcaggtttgcaggggctggtcaattgcaaagagcaggacaaggggtgagtgagataagctccagttcctagtatattaagtcccccatgttgtgagactacggtgacctacgtgatcccagactttgcaaggaacaagctgagttacagaggcagaacgagcaggaggttatgtaaaattttaacttttcctcttcaacacctgctaactcatctgcaggccagggccatgcgtcctgtccaccttcagcttgtagactgctctgccctgctttagttcatggacttgttgagagggctgtctttatcataagactgtgaccttactgtatttgtcactcttgtacatctagtctttaacacctagaccatgcaaggtggttcagtagttcaagctgtgtatgtctcagagtcacctcaggagtctgaagatataaacacccagaggccctggtcctcccgcaagcctggccctctgatcctgttgctcctctcagagatgttgccatgagtcaacctctgagaacctcatgcaacgacaggcagtgaaatccagagctctgcagaatgttctagagcatcccacctctcttttgctttctctctctctgcaccgccacccttcccaacccctccccgtctttctctccttgagttattttcatacagttcttcatgatctgctctcttggcacattgagaagatttgtattctatgatgtttccaagtgtccaggtgtttggcatcttatattttaatatacagatgcttgatgggagctaggccttgcacacactccccaccaaggcatgcacggactatctgatgctttctaccggtttaaagtctcagcagtccctattggcatggtaattgtttatagagatccagcttgaaagaatccttgtgaacaaagtagagaagaattctaataaacaggctaggtttgccctgctggaattataggattgctctgtcttctaacaaaagagaatactggtgataataatatgaaaagaactatctaatatcaattcaggtagtctgtggtctctcacgattgtgtaattatctgaacagaaacagaacatccaaataggttctgactttgccaaacacacagccgtttccttctctggatcgataatcacaggaggggaaaagaacacctggaggaaccaaataattgttttagttcttcccaaatcccatctaccagatgaaattgatgctcaagagagtgatgaacatttgcttcacaacacaaaaatctcatatggagcacacagtggagatttatgaattaaaagtacaagttattagactcatggagctaaaaacattctgagcaattggagacatagagaagaaaagattgtgccaaaaacaattttgtgtatgataggggcaaattgtaaaattaggaactagacttttaaaaacc

SEQ ID NO: 24792 - DNA, 627 bp, Bovine  19866881815188
tgtggtatttgcccaatacacagtggtgatggtgtggcccacgggacagactgatcgaaagcatctcacaaggatcacttggatcggttgtccccagatgtcatggaaacacattcatttaacaagtattagttacatcttacagatattatacaagaaatgtcaggagtaaacctttcaatggaaaatgatccttcgtggtatttttcaagcgttgatacttggtgatgaaacacagatgtgcggattgactggagacaggaagatggcacctttaacaaatcacagagatgggaatatggcatttttaataaatcataggaagagttatggcatttgaaatgaaaattgaagttcatctaaattactttattttccataaaatagagtaatgcctccctacttagttttatagccatgttatgaagtaggtacttcattatgatttcataaatcatgctatggaaatccttgccaccgtgccttgtaaatacacttttgatagacatgactgttctgtgaaggtttcactctgttaacattgatggttctgagctttgttcacatactggatgctttaggacaagataagggtgcatatattacatttctaattattttccaaaa

SEQ ID NO: 24793 - DNA, 1576 bp, Bovine  19866880129808
gactgcagcctgaaattaaaagacgcttactctttggaaggaaatttatgaccaacctagatagcatattccaaagcagagacattactttgccaacaaaggttcgtctagtcaaggctatggtttttcctgtggtcatgtatggatgtgagagttggactgtgaagaaggctgagcgctgatgaattgatgcttttgaactgtggtgttggagaagactcttgagagtcccttggactgcaaggagatccaaccagtccattctgaaggagatcagccctgggatttctttggaaggaatgatgctaaagctgaaactccagtactttgggcacctcatgcgaagagttgactcattggaaaagactctgatgctgggagggattgggggcaggaggagaaggggacgacagaggatgagatggctggatggcatcactgacttgatggacgtgagtctgagtgaactccgggagttggtgatggacagggaggcctggtgtgctgcgattcatggggtcgcaaagagtcggacacgactgagcgaccgatctgatctgatcagtcctctgtctctccctaagaaatctctttatctccacttggtgtctgccttattgcttgagatgcattcttttctggatcagttatttctgtatgtctgcctatctgggtgtctcccagtcactagtgctccgggacaaggccttactgttccccatggtgccggcacaggactttgcctatggtagactgtgatctaagtgtctgtggttcatctgaaagcaggggcccaaaagcgggctggggacacacagccttcataagctgaagttgccttctgggggccatgtgaactgatgagcccctgccctgtgtgtgtgacagtcactcagtcatgttcaactgtttgtgaccccatggactgtagcctaccaggctcctctgtccatggagctctccaggcaagaatactggagtgggtagctattcccttctccaggggatcttcctgacccagggatagaactcaggtctcctgaattgcaggtagattctttaccatctaagtgccctatctatctgtatggtcatttccttgtcttctggattttctagggtaatccccaatttttaaatgttgacaaaaaatgccttttttttcactttacattggtgtgcaggccaaataaaatcaatttggctctcagatgcattaaaaacctctaaattaaagccccacaaatagcccgcatatgcccttgtcctttaaaaaatagtttctcaatgcatatgcctaattaaatgggccttggcaattgggtttctgtctttcaagtaagtgtgtcagaacatccacttcatgagtaggaaaaattttatgcagttgttttactcagaaccataacaataccaataaaatgtattttatgaagttggtgagagggttgtaatctggatgctgttttacagggtgcagaactgatccacgttgtaaatgccgttgacctccccctcgactgctcctttggtgacagatgtggagccacctccctttaagagtcccccctcaaag

SEQ ID NO: 24794 - DNA, 1710 bp, Bovine  19866880168491
aaaatgccttaagtaaccccacatgattccacctgcttctccaaaaagaattgatgaaaatgtgtcttgtagcttaacattctacttaaaagtagcttgggtcatggactgtgtaacaaaacctttcatttgtgccattaagcaatgcgtagaaagaaaacaatgggataaaggagcaacttaagatctcatgtacaagacatccatacgatcattctcaaactgctgtgaaagaaggctaaacgccgaagaattgatccttttgaactgtggtgttggagaagactcttgagagtcccttggactgcaaggagatccaaccagtccattctgaaggagatcagccctgggatttctttggaaggaatgatgctaaagctgaaactccagtactttggccacctcatgcgaagatttgactcattggaaagactctgatgctgggagggatttggggcaggaggagaaggggacgacagaggatgagatggctggatggcatcactaactcaatggacgtgagtctgagtgaactccaggagttggtgatggacagggaggcctggcgtgctgcgattcatggggtcacaaagagttggacacgactgagtgactgaactgaactggtgctcccactactaagtagaatgaagaaaccaggctaaaactacaacaaaagggatacaggttggaggtgagcaggaactttctagtacagtagcttcataatgtatagaagggaagttgggcagttgctttcactagaaatgcttttcaatcttttatacacaaagctgtttagaggtgggggtgacctagttagctgcccccaaaccttccaaccagaagggcctctgagtcctagaaaaagggtcaagtcactcttgggtgcctgagagtgctcagctgctggcttagaggcaaacatctgtcactttgaaggagtgatttagtgatatcaaatagaggggtgattaatcaagaaaacaagtgagcatttgacatcagagagagaaaaaaaaaaaacaaaacaaaacagcctaggagatgctttggggaaaatgggcacccaggcttggaatcccaaccaatggtgctttcagggatatttacagagcataacgtgttgcgagagagatcaatctgctgaacggctaaattaatatttaatttgctcaggaaaagtcaatcccctgggctattagggaaattagcaaaagccctaaactgaagctgtttttacctgagccaccagcgtgttctaaaagtcatcagtgtcattccctcatacccttgtgaactgatgtgtccatccccaccccactccaattctctcctctcacccctcttacttttcctctgcctccttctcttcttgtcatagaacccttcctttaaacaaaacctgatatagatgcccagtaaaacaaaaggctgtctgaacagaggtgaggtctgaagccccatcctctgactgttcctgtacttcccccacctgcatgtcccctgagagatccttggagcacagcttgcaactcctagacagtggcccccgagcctctctaagcagcagaacccatcaaggtgtggactgtaaaaaacatctgtggccctactcatccctaccgatttatgatcctcagggtgagctgtaggggccagaggatattaggttgggatccttgtgatcctggcacaggttcagagtgc

SEQ ID NO: 24795 - DNA, 1329 bp, Bovine  19866880378164
cattccattatttttaaatgttccatatttctctacatactcacacaatacttacacagttgtaaatcaaaactcattgtcttacaaattaaattttcccagtcattttcccactgatgggaaaataattgtctaagtatttatcatactctaaatcatattctaaaattataaatccattatattagactttctaaatgcttcaaataccttaagaaataaacaaacttcaaatatcacagtcattttaaaactgattattagatttctattaaaaccatttactaaaatgctagtacctgaatttatttattttgctagtgtttaccctaattctttattctaatatctcactgaaactttcttcctaggatttgcaatgattgcaaaggtttagtttttttttctttttccataaaaaccatctgtgtttctagttttctcagtgtagactgcttgtaacaaaagatgcttctagcaaattcagcttcaaacttggtaaagtctcatttacttcacagtgttaatataggttatgtctggggagtgtcagtgagaagaaaaagaggagaaactttaaattttactgtatatatttatgtattgttggagtttttaataaagcatttactacctttgtagtaataaatatgattttacccattggagtttatttgacagagaactggctaaaaggaatggactattgagcttttattcaattaataaatacaattttaagtgctctgaatagtaaaaactaaagcacccatggtaaacaatgttaatttttttgtgtgtggttccttctagtcttttatttctctgtagtatctattccattttgctcaattagaaccataatctatatttacttttctcatcctacttttaattttagcttaccatcatgtcacaagcactttctcactttaaatattcttgggaaacaaagggcttgtaacagctgcacgattctctatcatgaagacacaccattattctctgagtcatcttccttttgttggcaaagaattgattcaaatctgggaagtacaggaaagatcaccccattgagtttcttgttttccagatgggaaaactgcattccctgaagctagtaacttgtccaaggatgaccagctggtccagggctcggctgggacgcggcactcccaggcccagacccctgctcttgctctcaccacacgctgccttcctgggcctctgcaaggcactttctgcaacctaactgccgggcactgcctacattctttctaaatgacattttgtcatttggggcccattattcctgcctgtcaagctcat

SEQ ID NO: 24796 - DNA, 2894 bp, Bovine  19866880383586
cttagaatctgtgagtgcaacatgtaaacagctgagccaagagctaatggaaaaatatggagagctgaagaagatggaagtgcacaacaatgagtacagggctgagatcaagaaggtgagaggtgcaaacccctccgtgtttgtagactgagcagtgggttgggaggttatagtagttaattttaatgagaggaaaatgtcatccagaggccatgtgatgctcatgagtagagtgcctgtaaggtgcttaggagaatgtctgtgtcattctcagggatgccgtttaagtattttcaagataattaaaggctgccccctttgaactttacaactttattttaaatatgtcttgatgaaaaattttctaaaagataacacaccttcttgcttgcatgaacacatgaacatattaactgagctggcatttagtattttcttactggctgaaggtggtgatggatgtgtgttctcttctgtactatgggtagttatatcctcattggcatttgaagtttgtggaatttgtctctgtgttagtggccctagctgtcctgtttgttgagtcatttctttttattacttctttgagattacttctagctcctttctttttctctttctgttatcttctgtggaccaggaaaccatataagcaaattttgagatttgcaaccagaaagagtgaaggtaacgaatgctgtcctctagactatgtgtgcttcggctcgttgatgctggttctcagcatttgagtcagccgtctctcactgtttggagatctaataaataattgtgggcataaccacctgaccttcagtacagatatgcagcttggtaaattgctaatctttcgcagatttaattagggaaaaatttatgatttgaggcaaggtaaaaattactctattattaatattatatttttctgtctaacatgtcttttctcaatttgtaatgctttctatttttttgcagttgaaagaacagattttacaggctgaacagagttacagttctgtactagaaggaatgaagatggagatctcccagctaactcgagagttacatcagcgagatatcactattgcttccaccaaaagttcttcctctgacatggaaaagcgactcaaagcagagatacaaaaggcagaagaaaaagcagtcgagcataaggtgaaacttgaacaaaaattttctttatttgaagtttgtttttgaaggttcaatttattaaaggtataatttgcatagtgtttagttcagtacatttttattaacccccttctttaggctggttaacaagtggtctagtgaagattggcaggagttaagagtagctcagacaagtgaaagggctgtttctgtggtgagtggtgacggttacctgttcactgtggcaggtgggacaagtggtaaggggtgagatgggaaagcagggcttagctcctgaaaggcccacctgccctgtgtgggggttttcatgttatcttgggatctgtagagaatgggttaaacaggagcaaaaagtgtctgtggttgtatggagaataagaaggaggcagagagaccactcagatgctgtcacagtagtgagatggtggcctgagcactgcgcaggggagacccagggaaatggatcattctggagatacttgcctggtaagactgactagactttgtatttgactggacagggagagtgagttagacagagttagggaaggatatcactaggatttcagtttgggcaactgattagagagaggtgctctttaatgaaatacaaaaaagataaggagcaggtttggggaggataatgaatttgtatgaatattacacaaaatggggaagctggcagatgggcactggtttgagataaaagctggactttcatatggaaatatctaagttccacagaaggcctggagtgcaagattaaaatcaaggtaagacatttagccgtggaagtttttacatgaagttggcatttgaaaccccaagagacttagatattgtaaggagaaggcatagagtgtgaagaggagagacttgaacccaacttaggaaactactcatttagagtaaaaaggtgccagaatgatgtaaaaaggaaagagacaataaggaagaaaaccagatagttttcagaaaagaagcaggaagccaaggaaggcaggaatcttcaagtaggaataagctacttgaaaggagtgcagattacaagatgctggaggcagaggccaggaagaggagttgccagggagtcaccagtgcctggattgatctgtttagaataatactcttaattgcatgcatacaaattcatgttgaaacacctcttcaaaaaatgttttagaaagtatttgtatatatgaatgaagaatgtaacttcacctaatgaaaattatatatagaaaaaatttttaagatggatttgatttattcattacatttatttctttttttctacttttcccttctcaggagatgttgggtcagctggaatcactcaagttagaaaatcgtcatctttctgaaatggtgatgaaattggaattgggtttacatgaggtacatatatagaaacttgctttttctgctatacaagccttaaaagaaattactttgtaaatactgatattgtagagaaagctaagatcaaactatgaaataatccttttgcaaaaactttctcaaaaagaagacagtgataggagtgagcaaaatatgactcttcagcaactggaagatttaaaaaaatactatatgtgataaaaatgcatgtaaaatagaatatatataaagggtttagcatagtgtctggcatttagtagatatataataaatatttaatgctggtattattactgtaattactattttcacagtctttt

SEQ ID NO: 24797 - DNA, 1244 bp, Bovine  19866880402714
aggctctttagttcttcttcactttctgccacaagggtggtgtcatctgcatatctgaggttattgatatttctcctggcaatcttgatttcagcttgtgcttcctgcagcccagcatttctcgtgatgtactctgtatataaagttaaataagcagggtgacaatatacagccttgacgtactccttttcctatttggaaccagtctgttgttccatgtcctaatgaagttccttgttgcacatatttttgataacttaatggaagatattctcaagataaatttcagtagaatttttggattaaacttttccctatttttaaggcttctgataaaattcccagttgccattcaggcatgctatactggtgtacccttcatatcctggctgcccataagtgaccttgattgtttccagcaatgctcattgtaattctttttaatctgtgttattctgacagcagaaaatgatgtcttatttatttaattttagattttttaaatttgattgccagttgaactaaatatttgtatttcttctgttgtgaattgcctgtttttatactttatccgtttttatattgatttgaaggatatgaacctttgtcatatatatttcatttttcctaaatttgtaattagatttagaacagtatttttgcagcaaaccttaaaatttttatgtagttcagtctatcaggttttctcttaagtgcttttcccttcagttcctcctttgaaagttcttcctcactctaaagttatataaatattcatctgtattttaccatattacttttatggctcaatttttcatttaaatattagtttagtagggattcattttggggatttggtataaagtagggatttaatttgttttccagtagctgacttgtgtcttttcctcatagcctgagtaattcactctttcctcccgactggaaaggccctcttcaccacaactcacgctcttttctgctctcagatctgctctgtgtcaccaagatatctgaagccaccttttcaacctgcgagcagcctgctttctctcttcgatattatcttattattttccgtgatgcgtctaggatctcttttttgctgactttgcctggtgagcccatctgtctgtatacacaggcctttatcttcagctcagtaacattttattccattatatctctcatttctcttctgcttcatttgttgtggattctattttaggagtcttcattatcta

SEQ ID NO: 24798 - DNA, 744 bp, Bovine  19866880428873
agccgggtcccagggtggctgtagaagcagtgctgtgagaggagcgacagctgaggtcttgatagtggttggggtggtggggggcagggatggtgctgggaatggagtactccagctctgactcttgctggccttgcaatcttggacagaagaccacctttctaagccttggtttactcatctgtaaaatgaggacagtaagagtaccgatcaaatatgactgttgtgaggcataacccacgtgagaatgaccatgtacgtggcctggcagggtgcctgacgtgaggttagcactcagcgaaagtgatgacaaccagggtgatgatgatgacagcagcggattctgtggcccaaggacttcattgctctatcccaggacacggccagcctctcactgtttaccatgggatgtggggaggaaaggttgctccagcatccccggggcagagagggccctgctctccacagtctgtgctctgaccccactctctctggccaggacagcagatctgggcacacaggagctgggggagaggggacaggtagtggcggaaccttaccttggttgtcgtaggaagtgatgacctgggtctgctgggcatgctgcttctccaccaggtttcctattgagggaagacaagaggggcatgcagtgaccatggggcccagagtaggatggaattttccctgggcagagcagagagttgccaggctgggtatcaacacgtgtgaatcagtagaatc

SEQ ID NO: 24799 - DNA, 1780 bp, Bovine  19866880431337
acagcagttccgcttaagtgacagttgcagctcccaaccccaggagaagcccgggtgagccaccatcagaacagggggcctgggtggaggtcctgggaacagagtggtgtggatataccctggctgagagagctcctctcccttgtgtccacaggaaacgtgcttacagcaaagaagctgtgtacagtgataagctccagcattacagcacgggccgaggtgagtagaaatcctgagccactcaccacctgagctccggagtcaaaaggcaagtgcttgagggctccttataggcagactggcccgtccccactgcgagccccctcccagccaccagtgcccagaggctgggtccccagggaccaaggctgtccaccccatctgtgtccacccatcatgggcacttattggatgcctggcaggtagattatcttcctcactgataagcccatagaggacacggaatgcagggagattggttttagcaagtcaatgaatcctgaaatcagactcagtggaaaaagatggagggttctctattaacatcttctgccttatcttatccaatggggcggctggggaatgtgttaaccaaattcacagataagccagagaacttgaacggagggaattaaaaagataacagagcccaagaggccaaagtgttgggatatctcccaagtgttttcttttaagcaatgtctttaaaagtttttcactcattatctactctctttttttcaaaacctatatataatatttttataactaaaatttccctttatcgacttgtgatgttaagtcctgtgtcagaattcttctttgaagtgtgtcatgacagcactgcagggtctgcagaggtccccactggtcagctgggttatttcctgcctccaggaagcagaatgcttaaatcctcatagcagacatgctgtttctaaataactcctttcaaattccatggacacactcagaaacctgccccggcgctgtgtgctctgccctctctgtctccagcttccttcgtgagctgcatctcacctcagtgctgctgtggctgtaccagcgccctctccctgctccctgggtggtgagcatggaaaacaggctctgtctacacacaccataggcaggccttctctgggtggttctgggagtggacatggggtccgaggtaaaagttctcacccgaggtgaccccaggcaagagagtgatgcaggggtggccacatagcagtttcgccatggaggagtttgtattagagtgagggcaaggctggggctctgcaaaggttgctctgtagatatggcttttttccccagggttttcaatccaagaccaagaacctaccaagggtctgtaaaggactaagcccctggcacctgggttgctgttttaagtcatgatggggatggggctgtggactgggcaccggctgagaccctgaggctctctcagggtggtccagctgacacccatgttcaacaacacaaactggggtcgggggagggagattgggagagcagcccccttctaaggctacagacacagctcctgcaacactccaggtccatctgtccctctttctctcccccagcaggccacctgggcctccattttaaccagacgtcactggttttagagggaaatcctaatgtgttctctctcctgtcctcacattctgattttgcacctcaaagcaaaatcttcagatactttcacttaatataaactgatgcatttcccttccaggcaggtcttagcttcctaaggacacag

SEQ ID NO: 24800 - DNA, 2700 bp, Bovine  19866880434717
ggcacgcttttcttaggctgcctttccgtcctaccttactgcccactgacctgcaggcacttcttgggatcacctcccagataatcccagtagggatcaccacctacttgctttcacgtcttgtcttaagttgttgcttctgaagaaacctcaagtgagactgcctgaacatgctggtcagggttgttaggcatccatgcggtttgctcgttcttgctctttacttgttctccagaccaaaggagaaagagatgagcctctagttctatttttccctttgtccactgctattaaagtaaaatttccattctctctccaccgctgccccagggattaagacattctatcataaagatgaggattttctttgttcaaagttcaatcaatagattccagagtcaacattgtcatccccaagttttcaaagagcattttgattgatgtctagcacacttggagtgcttttatttcatgactgggaataatccaaatttcagaaaaagtaattcctctgggtggggtacctggctttaaaaacatttccgctttgagttcttggctgcatcttccttctccatctggattagactctggcctgacctggtgactagggcaacattcatttggggtcaccgtagagccaccagaactttttggatgggaaatgtcattgtgtgataatttataatatataaattatcataatatatgtatatatatttatacacatataaattgtgttttcaaggctgggagttgctgagaaggagctgcagtggggagtgtgtgctgagaggacaaagctcagggaacctaaggttaccttagccacagccacggcacgggggcttttccccacctgcctgccctgatgacctgcctcttttaggaaccagacaatagcagcggaaagggaaaacgactgctcttcccaaggctgccatgccagactgttctgttcagcctttgaagcccacctcccatctcaccacccccaggaaatccctttccatgcttgcctaatgacacgtccaacatggtgaaaaatgacgttgtgatgaatccatttgtttcttgggttccatttcctgtttttttcccctctcttctacttttcgaatgtattttttctgcaatgacaattctctattttgtccccgtgcgcacctatttatcttgccgctgtaaacatcagtgacaaagtccatattcctttatgtatttctcattcaccattttattcacttttcatacttcactgtgtctgaaggcatgggggttcaattaccatttcttctttcattccacctcatttattctgtgtagactttacaattttctctctcagtattttctatgctcttctcttcacgttttctgttctggttactggcttggcactcctatcttgaggtttttctaatatccattcctttttttgtttttaatccatcctcatacctcttccagccctggacactgctgtcagttataaccttaacggtggcctccactcaggaaagttgtcaagttgataaatattgatatctgccctgccattttaccaccacttttctgctaatgcatttggttggcatcaatcagcttctttgccttctatgagcgcctggtgtgggaactggtcccgatctgtcacttataagtaatctgctccacatttcatcaagagctcaaacacagaaaatatggaggagaggtagaggacagagaaccaggctagcatggcccagagggaagggagacagggagatccaacaaggaaaagtgaggcagctggacgtgtaggagaggcgcccccaacccagccagaccattactgctggggacagcagccagtgcttaatgactgctgtgtcctctttgggatgttaaccctgcttatctcctccaaaaaggctccccagggatgaagatctacattgaccccttcacttacgaggaccccaacgaagctgtccgggagtttgcgaaggagattgatgtctcttttgtgaaaatcgaagaggtcatcggagcaggtatggctcttcttccctcccctcctttctgccctcttggtgtctagacatcctctttcaccactctgggtgatgtctatcatctttctcccccaaaggtgcatctaagccatctacaatatgtgtctaaggatcttctgggaccttgttcatggtgtccaagcttatttggtgttgcagagaagtcaactctggttttaaaagattcagaaatagctctggaagtggaacaccaaatgcaaataaagagagagaaatagggtgataagttgggaaatgcacttctcttttcagaagctgaacttagtatcccaagcactgactccaatatctccatggcctcgggccaaagtttattcccacacttccagttttccttttctgatatacatggatttggagacagactatgatgaactaaagaaggaccactatttctagaagaaaactcacccatatccatattttctacaaaagatccatgatagggatggtaatataagacagacttccctcccaagaaatgcgtgttctcatctacattggaatacaaacccagcccagcaaagaataactgtctgagatgctatcgggacactctacctaaaggctggtctagcattttcatcttcctttaatagatcaatagttgagtcagttg

SEQ ID NO: 24801 - DNA, 857 bp, Bovine  19866880465226
acatgcataccccatcctgcaaacaccccaaatcctgaactgttttgactccccctgtcccttgtcttctctggtgctataactgaatgctgcataatcctggatgaaggaatgcccaccaatgagagtcactataaaaccatgcttctatgttcaacaaataaatatttataagctgttgacagtttggagccctgtgatccatatctataaacaatggccatcaaaataaaaactgaaatgttaaaattcactaccctagatttaggtactgaaactgtaatacactaatactgtaaaactgtaatacaactgcaaacagagttgctgtttcctgattcgattttgacaatttgttttgaaatagccactctttactaaggcagttattcctagtttgaaaggatttgaatttcttcaaagaagccattaaaatgaagttcaaattttcacccatcaaattagtaaatctaattctgtcataaaacatattcctaaacatcaattagcatatcagtggttaggaaattaaaataccagtacaacatattaatagaaactgtgtcagttaacatttgtatcttcccagacatggggaactagaatagcaggtaaagaactataactttcagtggaaaaggaaaagaccctcactcagttcagctactgccaggcaggagtcccgctcggccctattttaagaaagctaaaacagtgaaaaagggaactaaaaataagcatccgcacaaaaggttctctcctcagaggagcaccagcagtctctgtgtggttcctaggcccaggaagctgcacgctcccttaggcccaacttgatggcagcaccaccagcttaaaaa

SEQ ID NO: 24802 - DNA, 1822 bp, Bovine  19866880471253
tccctgtgctatacagtaggaccttgttgtttatctatttatgagttctttttctgcctattaactctaaaaatttcttccttctattacatagatcttttcccattcaatcaaaacccacatctttagccacaaggatagctggcatatatatgctgatccaagcaatatagcctctctccttcttgaatgttgactaccataattattcattcatttcagaataaagattacgggtgggatagtctggtgcgaagaggatgggcctgggttgggcagatcaccctcgacttttggctttctgaatttccttcgcccacgtgtaaagtggggacctggccaccctggtcattgtgggttattgtgaggctgaattgagacgacatgttcttgcttggagaatcccagggacgggggacctggtgggctgccgtctatggggtcgcacagagtcggacaagactgaagcgacttagcagcagcagcagcagcagagggggggcgtcctcgggatctgtgattttcctgctgctgggcaaggacagggatccgactgtgcaccgacaccgctcaggagcggctttagacctggtggaatgcttggtggaatgcggcgggctataaataaagaaaataaggtgaaaatggagacttcgacgggagtctggctccctgtgattccgctgcggtgccggcagggagcgttttttcggagcactgtggccggagtgcttccctccctgccccctccccatcctcggattaaaaacaaacagaaaaactttcccgaattttcccattccactgtggcctggctgcgaatgctgaaattccagcccgtgtttgttgtcacccgcgggcccgtttccacggttacccagattccagattcctgcgctggccccaggcccgccacaatgcatccctcaaagtctccttggcagaggagagacattcctcctctctgccgcacgccagggccaagagaggcgctctcctcctcccctcagctctgcctcacccccatcgtgtgtgatgtgcgtgttctaggtgattctgttcagagtcagttttggggggtaagcaccatgtaatagtttcctccacttctcttttcctcattgaaactaggaattactttcttagaccaaaccttacacccttggcaagcactccagatggttctcattaaaattccaattcctttttttatttttgcaattcctttacccccattctcctcacccttctatcccaaaaataaacaccaggtggagaacagatgaagggtcctgtgacaaggaaggagtcctcaggtcctcttcctaccagtggccacctctgcccttcctggggttgactggcataaataggcactggggtgggatatattttaagttaaatacaggctctctagggcttccctgggagaaggcaatggcaccccactccagtactcttgcctggaaaatctcatggatggaggagcctggtaggctgcagtccatggggctgctgagagtcagacatgactgagcaactccactttcacttttcactttcatgcattggaaaaggaaatggcaacccactccagtgttcttgcctggagaatcccagggacgggggagcctggtaggctgccgtccatggggtcacacagagtcggacattactgaagtgacttagcagcagcggcagggcttctctggtagctcagctggtaaagaatctgcctgcaatgcaagagaccccagtttcattcctgggtgggggaagatcccctggagaagggataggctacccactccagtattcttag

SEQ ID NO: 24803 - DNA, 1930 bp, Bovine  19866880540036
tttgagcaccaagtcagggaataagcatgaacgccccaccctgtgcctgggaagggctccctgagggcttggggctggagggggtgagactggcctgggttgagccaggagaacccgttcattccattgtgaccttgccaggctcatcatgggcaaaacgaaaggttggcgttaaatgatctctaggggttgattctccactgacaggctgaggagaagctgggagggctgtggggaatgcctggggcagaataaagatgaaaaaatcccctcagcggtaagcttctgccatgcttgactatgatgtgaggatattttattacctggcagcagtgtgcaagatgagttggacaaagcagtcgtaatgtagagcattattgttaataatccataactctcacgcaaaaatgtggaactagtcattctagctgctggttgctggtcaggtgacccacaaccacctcaggcctccaaagattgctgactgtacacactccgtgcaaaacactctacaggggatcatatcccctgtacgatataatatcccatgtcatatcatttagaaatgcaataaatactacaacataataaattatgatgctctaaaaataaagctcactggccacccctcgatgttctcatagtaggaagagaatgaatatgtgaatcatgacaaaaatgctagtgatcagcacagctcttgggcttccctggtggctcagatggtaaagaacccacctgcaatgcaggagacctgggtttgatccctgggttggcaagatcccttggagtagggcatagcaacccactccagtattcttgcctggagaatccccatggacagaggaacttggcgggctcgtaaagagctggacacaattgagaaactaagcatagctctttcaggaaacccaaagggggaggaatttgctggaaagatctgagagagcactgaagaaaaggcagaggatgagaaacacttccacctcttaaggaaccccgaccagccatcctagagcccaaaatatcagccaaggagatgtgtctagtaacctcaggctgcagagtcttggtttttacttttgacagtgtggaaaacctcagcgccaggggtaatgctgcggagacgatggatccagactgtgactgtcactttaaacagcagggtgctcagggctggtgcactgggatgaccctgggggatgggatgggggaggtggcggagggggttcaagatggggaacacatgtacacccatggctgattcatgttaatgtacggcaaaaaccattacaatattgtaaagtaattagcctccaattaaaaaaaaaaaacaaaaaccagcgacaatccgggccccggcagcaggatggctgagcggcctggggtggacggtacaccccacacatcagcccctgaccacagtgggcttccttagctctgaccacttctccctggatgtcgggaccacatgggaaagagggagggtggaaaggacgagagctgtgggagaggtagcgaagcatgcactgttttcctctcttgagaaaaacactgtgatttctaatagtaaaattaggaagcatggtttcattacctttaagtccaatggccagtttaactgggcaaacacatgaattagaatttttttagggcctgcagttcccaaaatggtccccaagaaggtcacagaaaacaaatttatggttcccaaaggggaggaggggggaaatcaagtaggaatttgggattaaaacatacacactactatacataaaatagataaccaacaaggtcctaccgtatagcacagggaattatattcaatatcttaaaataatctataatggaagagaatgtaaaaatgaatatatacatatatatacatgtataactgaatcattttgctgtacacctaaactaacaccac

SEQ ID NO: 24804 - DNA, 2952 bp, Bovine  19866880540132
tttgagatttttcccttgccagcctgccctcattgtttcagtggttcttaggaaaggattccagagcctattcttcaaaacagactgtggcttgtttcccctcctcctgagtggagtgccaacagggtggaatatctccttccagtcccaagaagtcctaaggcaggaggaaagaagagttcttacaccattcttcaggtctccaactccatcatgttcgagatactccctcacacacacacacacacacacacacacacacacacacaagctgattcttcatggtgagtctctgatatagccatctggactctgatgctttgtaattaggaatttttttttatagctttaattatttcctctgttctcttttcttttttatatacaatgaatcattctgctcctgagagaggaaaaataaaaagatttttgaaagttatagctctaatttcaatagaaagagatggggctttgaggaatatgagcatttgttgtattttctgagtccatttttcatccccactggttaatgaagatgttatttctctcttgcatttcggttgctaactttctgacaagtgtgtttttcagttatggctggttgtatgcctcttggttcatccctcttttgtatactttatgaaatattcagttcttcttgataggatgaggcttgattctcccctggctgtgattaattgtgttcgcattttgggacctaatttatgtttatacaattcctctagtgtttccattttcttttctaattatccattttcctccatctttttccctgaaattagtactgaattagcttgcctctgattacagtcttggacgcatcccaaagaatattgttggacagctccccattatcatttcattccatgaattctttgttttgtttttgcaataaagctttattaactctccgtgaaccctccttttcatttgctcagtcatttctgatgggaagtcacaccaggctacgaccgggtgttaaggcagtcactcccacattctctgctgctgtctgccaagtcaagtcaagctctttttaaatagtcagaattctagggattaaaaataagatctatgcctgtgttgaagggccagtttcaattatttatttatttactattctggtgtggacatctgttgaggtagctctgccgatggacaagaacccatctctatcctttgcccggtctcctggcctgcatgtctttcctgctttataatgacagatcccttctgacccggctttatagatgactggcactcagtctctgccagtaggtctctccagtggccccattagtctgaggcaggtggggccccaggtgaagctgctctggaatgaggtacctctcatcatcatccaccaagacacctttatctcaagtcagcctgtttacagactagggtccgtaatttgcttcttggtaggctctcttttctgacaattcatcaccccatctgcctgcacacctctacatgcccctcccaccacacgcaaactacatacaacattctactatgtacatgctacacacccaatatgcccatgtacctgtgaaacacatgcccactgcctcttcccatgaacctgtgggacctctgcctccctgggagatgctattttctgcattagggatgttggcacaagggctctgggtgactgttaacaaaagacccttccacaggcagcaaaggcttggctactctcaaaatgttttgaccagggtccctctgcaacccttgacctgccaaggtgagtgcagaaatggtgctgttccagtgatgaacaactctacgccccttaactgcaccccaagtccagaacccttggctatggaattctcacaccaccccttcctctcacagataaagcaataacatctcttccttcttgaaagcaggacccagaagcccaattccaacctgcctaaccttcctaagaggacaccgcagagattctccgcagcactgtgagcctcaccgctcgatcctgcagcccagatgctcatcgctgcagtctcggcctgcaagcgccggctggtgctccgagggcccaggaagatgaatctaggctgagcagcgatgtgaaccttgctgtctggccttgtgggccctggtgatgggccctcgatgctgtgtcctctgaagtgatggagacttggctgtgtgaagggcaactgtagcctccaggaagaacctctggtggggtgggacggcatgctgccccacccttagcagccctgcccggaacctttctgaccagtggcaagaggaatgaacaaagaaagcagaaccagcctttaccacccgtgggccgaaccaggccagcgccgctgctgagcggacaaaccggccctgctggcctcctcaccaaagcccctctgtaggcccaagagactgttcatgattaaaatgtcactgaggtgtcctgaagaaacacgctaccacagaaggctggagcaaagcagccaggtctgtccgcacactcccctccctgccccccaactttccccagtcagtccttcagcagctgcagggcagcaatgtccctgtcacctctgcttctgtgtttactgtctggccagctgcaaaggggccagttcagaccaaagcaaaatgtttcctcccacaaggtctcttccagccatggagcaaaaggcacagttgcaaaaagctgagagcaaagcgtggagcgccatgtctgggaagccccagtgtttggggtggatacaaagggacaggatcccaggatgctcagagatgtcccttggggtatgcggactttttccatcctcatttatatcacttccctaccaactggatcctctgtgtgtgtgtggtaagtcacttcagtcgtgtctgactctttgtgaccctacagactgtagcccgccaggctcctctgtccatgggattctccaggcaagaata

SEQ ID NO: 24805 - DNA, 1936 bp, Bovine  19866880553235
tttcaggagtctgttcctagtgcaactctgatgagccaatctgccatcatagcccctttgtgctttatttggactagctggacaagctgggacttgtttgtgagctggaaacctctgtaaatagagtacgaatctcagaatggcaggaccgtggctcactggagatgtgaggcctggctggagtttctgaactctttggagggagacagcccagggtctgccagacacaagaagcagaaaagaatcagcttggttctcctctaacatcctaggtctcatatccagtctctaagaatcgcagctgccacacaactgctccagggtctgcctaacttttcaggcccctttatatttaacactttagccagtgcttgtgaagccctagaaaaataaacaaaatggaacaaaaataacctctcagaggctgggattcccccattccttttgggtctactgcgaggcctaaatgagcaggttcttaatgtgcccagggtttatttacaaaattgatccactttctcttcaccttggaaggggctgaccagactctgacccacttcctagggacctgagtcgctagagcaggtggctactcatctgtacctgggtctgactgccaattagcagctcgagatagtcacacatggtggttgaaactgccctggagggtacaggttaatgatgctcagagagagtaaatggaattgatggctgttcagccctctctcaccctgggctggagcagtgctgagagtcctcagagatgctgctggcaaggtcaggtactcctggcacatggaaagtgttgccacaagagggctggtaggggtcctcctattccatagacctcctcataggctcaagtatctggagtaggccttcctttccccaaggagcatgccagaatgaatatatgtacccacagagggagggatagtttcactgagggcagtcgctaatccttggatggcagacaagcagcccctataatgcccttgtccttagagggctcagggcagacaccctgaattgatgcctgcactcttgcttgctgagctaaactctggccatggttcctctcaaatgagccttctaagtagtactatcatcaatcacagttggtagcagaaatggaatccatttgccatccttgcattaatcttttatcggagattaacttgtctgattggccagggatttccaatagcaacaaaatttggcctgcagaggctagggtctcaaggaaatgggccacagaaggggaggttttcattatgttgatgggtcactgagggaatgatcgagcagtctggggactccgaggctccgtgagaatgtagtttaggagagctgtgtgagtgaggcccctccaggcttaggacagccctcttcttgttcctgttctgcagtgtctggatggttgacagctttgtaccttttgctccatggcagcacaaagttctggcaaatgtctctcatttgtacatcttattcccagatgaccaggttcaattctttactacatagctatcaattgctgaacatatgtatcctttgaaatttcaggacattgccctgaaatgtgggaggacactttccctcctgccatctctgtccccagatgacaacgtttaagagtgttggaccttgattacaaaagggcacccaggcagacgattcaaggtggacttggggacagctacacgtgtgtgtgtgcacgtgtgtgctggggagggggccgatcacagaccctcagccatgtcagcatgtgtctggaagagtaactgaggtgggggtagtctatatttgtgaagaattgaggcttcctgggaagagggagtcaggcagctgttagcctcaggaacaaaccccctgcttgtagaggaattttcccttgggtctgtccccagctcagtgtccccaggacacatgtaag

SEQ ID NO: 24806 - DNA, 1366 bp, Bovine  19866880588238
ccaggcaggccttagaatacagaacaccaatttcggcaactttcaccttatttttcttttcacaggcttttgttctgactcccggtccttatctcatttccaaatatgatttgattatcatcctgtgaggtctgttctgttggcgcctttttgacctgtacagcccagaagagggtgaagagacctctccttgtggggcgtgacctcctccgcgcagggtgtccctgcagctttgaagcctcactgcacagcctccctttctggtgggatgagaccacatctttcaccttgcagctctcaaagttactcttccagggagaggaggaagaaaaggagaagcagggggagtagaagtgagagaccacaggcactggggaggctttggtagtgagctcagtgccggaagatggggctgcagccacagtgtttccagggccctaaatggtagctataaagagggccctttccttccactgtaagggctgctctgcagcctcctggttgtcacacgctcccactttctgctggacccatgaccaaactcaggatctgaagagatcacataacaattaaaaaatattgattagattttcagaaggcaaaccattaagatatttccaacaggataaaaggcctataggaaagagtaagccttccttcactgctaaccctgggtctcatgacctctcagagtattgctcttactggctccatggaaccttctagagacagtctatgaatcaggcacgccctcagttccttctgccgtgtcactgtccatggtgctgctggtcttcctctgtttcctctcccctccttgtcctctgcccgccccctgccgccatgtccccttcttctttgagataatttatcttgtaggtggctccataccaagactcataaacctgcctcattctaaagggttgcatagaattctactgtgtggatgtataataacttattcaacaaataccctattaatatttctttggttgtttctactcttttttattttaccattaaaacatgctgcacaaaagatttgaaagcagagactcaaacagatattcatgcaaaaatgtttataacagtatttattcacctgtacaggagccaaaaggcagaaacaacccacatgtccttcaggagatgaatagataaacaaatatggtatatccataaaatggataataatccagtcataaaaaggaatgaaatgttgatacatacgacaacatggatggagcttgaaaacagtatgttgagtgaaggacacatgtttatgattccatttgtgtgaattatgtagaataggcaaattcatagagataaaagagaatagaggttggggggtagggaaagggga

SEQ ID NO: 24807 - DNA, 1770 bp, Bovine  19866880588677
cagcagcagcagcacggcatcagtctagatttggatataaatcattctacaacaattctgcagacctgtcttttctcttccacaattttgtccaaactaggctccttcccctaaagctcaggaaatggaaccaatctccccatactgaatctccatcctttatatttcttgatggaatcattgtttggtaaatgcttttggcttggcactgggatcaaatgttggttttccaggctgagaagtgatccaaagactttcccagaaagtcttaaaacttgggctctgctttctggccagctctgggcaccttgggtatattactctatatatgagcctcattcaagttttctgaaaaatgggaaagaggattgaaaggagcagggttttctaggtaagggggagaagcagacaccattgtgacattaaaagaaattttcgggtagcaccagacaccaaactaaatcatactgaatgacttagaaagaaatgcagctctttctaacttcctttccatccttttgattaccttaaagaagaaagtcttagtttgagtctgacttttcaataacacctctttaaaccttgatactcaaaaaccagaaaaccagctttagattttagctaaagcttaatatttttctcattcgattcattttaacagttgccttccattgactgcatattttccgtgttctagattgatttaaactttcttttacaaatgagtgcacttaggcttttaaaaggtgaatcaacaataatacaatggtgaactgacaataataaactcctggcaaaaattcatcatggtggttggtatgtgaacgacagaaatggagatgctgggctctgtggccctctgcatctggactcctggctaggaaacccgatcacgaccataatcacagctatcacaaggggataagatcctccctttccaccagccagagaagagccctgtctccagcactcagcccccagcccccagcccccagcccccagtggactcacctggtgcatggcaagcagatcgccccctgatggccagggatgacaatgccaactccggggggttagttacctccactgacacagtggtttttaattcctaaggtttccagcctctctttgttctttaataactttactatcagctaccaactatccctaccccactatctggctgattctccattaagagaagagcaaatataaatttggaagaaggaaaatgaattattcagaacagctaatttcacctgggccattgtcttaagaaactgcttgaagagcagcttgaaaattgttcttaactcatgatgtacaaatatccctcagaaagatcaatggagacagaaggttctcctccacgaagcaccagccttcccaaggccaccctcagctggggtgtgagcagctgacacacccagtacggccctcacctgcgctgggaggacctgtgctcacatccacacaagggcagaggtggggaggggctggccttccctcagctgccaccccaccccctgactcaactgcaccctggcagcactgagagctgaggcatgggtgagggggcactcctactgctgaagggagggagaaaggcccagagcgctgggtcctgcctgaaccctgcctggctgggtgacactgtccggctgggcacagcctccccagggtccccaggtgaaggggaggctgcaggcccccctccaatagagccacacctcctctcccacacaggaaagcacatgtgagtgaggggca

SEQ ID NO: 24808 - DNA, 2586 bp, Bovine  19866880590843
tgcagggctgcccgcttagacacaatgggccctgtgtggtctcacacaggcctaaagggaaggctggcgatgtagcccaaatagccaaggggctcccctgacccccacctacactctgaggcccagggaacacaaacacatcaggcctttcctgggccccatgttattctcagtgccctggtgctggtgcaaagctggtgaagctggtaagcaggggtaccagccacagcttttacagccagatccccaaacccagtgaccccaatactaccctcttcagcacatgcctccccatcccatggggcatgggctctgcagccagagggcagcagcctccagcagccaggcctggggcccacagcacctctgctgggctggacacagggacattctgggttaaccaacaacaaatgtctgtataagggccctggtcagggatggggacccatggtggcctgtggaatggggcgggggggagagggttatggactcacgcacacgcatgcccgacagcccgtcctgttcatgagtgtggctccagcagcctctgctacggaaagcacaggtcctcttgggccagggcggcatggcttcattcttcaaaactatggctgaagaatcaccggtttgagaacaacagtggtgctgggtagtggtctctctcatcaacagtctcgcttgccaccaaggagggtcccctcttgtgaagccaccaagaactgaaggcaagagtctctcctcacatccagagaagcttgggaagaggtcaacaagcagctcaaacatgactgagcaactcactttcacccttcgagttttccccagggccaaggtcagggacagcatttcagaacagaggcagggcccccacacacctgtgctattacgtactcatcgtcctgatggatcaggaccacagggtccacctttcacagtgaaaggatttcaacagtgttcttgcccaagtggaggtggaggctctgtgccaggcccgcccttgggagactgttcccttgtggggcccagcctgtcccctccccacgcccctacacttatcctgcatggcatgccactcccatctggctcctcagtggaggaggggatttggaattcaaggactggcagctgctctccaacaaaagagaagccctgagcaagtgagactatacacaggcgcaaggaaaagtggagactgaaagtcttcattttaggcacaaaatgccaaacagcccctctgtcttctgcctgattccttatctacattcttttccttttatctcagctccctttcccattccagcgtctatatttcctgatccttcaagctggccagacaccctcaaatccacgtgcacctctcctacgtctgaaaataccccatagccagagaactgagaagaaaagtgtgtctcacccatcctggctggggagctctggccctccacagcatcaaatatctgtaggcagaacccaaaccagccagatggtgtcagcgggtacaggcaaggtaggcctgggaggctcctctctgcccaggcatgatggtcagcagccccgggcacacccaggtcatcaggcactggggggcctttaaccagacctgtagcagagctcctgcccaagccctcacctcctcctgacccagcttcccaccccagcaccaacacgggtgccttccagcagcaaggagagagaagagacccacccaggaccgttgtggtccagggacatcctttatctctctgctccagcacgctgatggtgccggcctggctgagtgcccactgctcagtgcttcacctgtttgcatttttgtggggagagtcaaagacccattaaaatggagaagcctggcattttgcagtctcctagcactgaattctaagggagattagatccgtttgccctggccattttgacagccctgtgagttggcgccaagggcacacaggtaagaatcatgcataataagccagctgcctccgctcctcatccacaggaggaaagagggctcctcacttgctgggggatgcgggcacctgggggcatcaatcaccctggagaagagaggggaggagaggttgcacgcccatgcaaaatgactctctgcagccctaatgaaggccggcgatggatggtggcctgggctcgttaatcagaaggaacatgctgccgtctgcctctccttccagccctcctgtgcccgcatcctggattgatctgtggcacagtaactctcagatgtcactgccccctgccaggggcaccagggggaggactctagtagggacttgggggatgtgccagagaaaaaaggagtgggggctggcaggcaggccctggccttctcctggacatatcctggaccagcctggggctgatgactcccaaggggccaccagagctaacacacccccttggggcctcttcacagagtgcctcccaccagatacacagacatcctcttccaggggtctgtatccttggcatggccatgggaggggggtgctgccccacagcaccactctcctggcctccagccttcatgcccagcccaccttcctctctccagacagccagactcca

SEQ ID NO: 24809 - DNA, 1398 bp, Bovine  19866880700563
cacttcttgaaatatgtgaaacatctcctgggcagctcttttcctgaaaaatgtgtgctggtgtattggcatttggatggtgagaacccataatcacttcattgtccacacatccttcaagaagtccagtgattaaaatgagtatcagtccttgttctctcaaaaccattcgtcaacctcaggcagataagagtgaagagcagagttgcttttccttttcttcttcttctttttctggttgcttatgattttgtaagtgtgagggggacagatgctgcagctgttgagggcagagaccatatcttctttctccatccctaacatgtagcatggggctcgccttgcctgggtgcccaacacctcagtgctattgaataaataaacagtcgactttggaccagtaatttgaacccatggatggagcacaagatattgccaaggtctgagtgagttcctgtcagaaaatgaagggtagaaataaatttgaagggtagaaatacccaaggcctaaagcagtctgtcctcacctagttaatacgaagagcgaggtcgacgtctaaatgcttaatcattaagacagccaagagcagctgtagacgttctcccttggtttgcctataagcactgacgtcaggaatgaaaagtgctacaagacagtaaacaggagagaatgatgaatggaagcatattaaaatggggaagaagatgagcatgggagagcttgctggcatcagcttgatggcatctgagctctctattaatgagctattggaggagatgaaagcctcattgattccactcacagtactgaagttgacaggtgtcccaagcacaaaccaagagagtgatgtggagtgggagacccagacttggaaaactacagcctatgaccaactacctgtttttgcaaataaagttttattggatcccagccatgcccatattctatcgtcatctatctattgcccatggctgcttcctgctataaaggtacagttgagtagttgcaacagagactatggcctgtaagcctaaaatatttactagctggtcctcacagaaaaatgatgttgagtcctagtttagaagaagtggcacaggaagaaggaatgatgagttctatttctttgggttgaatccaggacatctactgggctgagttctgtttgtatcttctaaagaccaggattccacacccctgtggaacaggcaggcaaatgattctggctataagtatttgggttgaaaattaagatacactgtcttatttccgaggccaacaacattgcatcaacattgcatccagtctttcattgaactcagaaatatactgaaatataataaaaatatctacagttccaattctgggttccctagctgggcccagaggttaagggt

SEQ ID NO: 24810 - DNA, 816 bp, Bovine  19866880712295
aatgggatcctgtatcatcaactcgtctctctcactctcctacatcttcattctctcccatatgcccaataacttactagacatatgtgcctaataatcttacagctctcaaacatagcagattcaaagccaaatttactatgcttccccaaacttgctgtctcctttactctaggtctcaataattgcaagcagaggcacagccagccagggaccagaacccctggggcagtatacagagcgaactgcaaataaggttaaaggccctaattgtagtctgagggcagggaccagaccagcactggagagcctcagtgtggcagggggtgagggcagaaggtagagaaatgggcttgtgaatggagctgggtagcatcagaggcatgtggtgaaaggggttgagcaggatttctgagaagcccaaccctttggccagcagcagcctggaacactaaaaagtgtgaaggcacgacgcctgccctctgctgcctccctttttgagggactgcctaaacatgaaaggcattccaaagcagttctcttctccctcaggaatcttcagaatataaaattttaaattgtagtttctggggttagaaactgcttattattaaagggcagttttttatattttggcatgccatcaatctatatggactctcactagccaataatcctttgaagaaacagatctgctctaaagctaacatttataatctactggaacaaagaaaatctgaaaatcagttgtttatcagaacaaagaatgagccaaaatacttcataaaagaaatgagaaaaaaatataaatatttg

SEQ ID NO: 24811 - DNA, 715 bp, Bovine  19866880717974
atgacaggtattcgattcccaaattctcagtaggggccaagaatgtattggttcatcaagcagagcacatttctggaagcgctctcaccatttgggaatcaaataataattgcaataccaacaccttgactttctaatgcattttttcaagctaaagggtttcaacacattcccccaccaaacccattcttagattcatcttctttgtaggcttctgaaatagtgaaggcgctagttttatttcttccattttgcagaggaagaaattcagattctcaactcagaagctgagtgacttacataaacaaagcatactggaggcaaaggagagatagcagacctttcactctggggctccaatcacttgagtacacagcttcagaaacatcacttcttggatccaggccctgagccggatgctagatatacagcacggggtaagtcagagcccccattctcaaggaacatcagcgttatgaaagatgctgacagtaacgacaaaataacatgattaacgggaaaagagaggcatgtatagaagtggggagaaaagagacagtcccctctcatattggttgggagagaggacaggtcttttggagatgacagttttgaagcatgaataggagtttactaggtagataaaatgaaagaaggcattcaaacaaagaaaacggcgtgtgcaaaggcatggtgattgggaaagggtcaagga

SEQ ID NO: 24812 - DNA, 2233 bp, Bovine  19866880719767
cttttttttttttaagctcagaaatatgccaagaaaatgaaatagaataaaggggaagagagagagagagcaaagtgcctttaatttgaatagctgtttcccatgtgaaaaagcgacagttcattgcaaaatatttatcttcattacggttggtatcattatggatggagaagctgtacaaactaatgggaaaatctctctaggaggcctgaatccagatgcaccgagtctccaccttgccttagacctgctcggtgagcacggcctttaatttctgggtacccccagctgacccacgggtacagccagaaagaatagtggtgttggctggactgtctgcaccgaagtgggatcggtccttcaggtcagggtgtgaggcctggtagttgggactgcttcttgcttgcctgtgtgtgttgctggggccctgcttagtaaaggagcgtgccaagtagggagaagataggtggatgactgtaagggcgagtatgtgttagaggaataggtgggccattgactccattttagccattcatttcaccaaaagggtgagtgtagtccggagagggactcacacccctcagcagcagagctggcctggggctcagcccctttcttcccaggaacctctctgtcactatgctgacgaaggttgtaaaacaaactagaatgtgctcccgcagctgattttgctattcagaataaaaggagtttacaaaaatcagagtgtcatttaccatgacgaatgtttcagaggctcaggttagcagctgtgggaggtgtaattcatgtgaaaatcaagtcttaggtgtttaccgccccagccaacagtgaaggtacagagctggtcttactccccacccatcccatttcacagatgagcccactgtggcccaaagaggcagcagcaggtctcacccacgacctcacaggcagcaaggatttaggaactggttctggaaccctggtgtttggggtcaactcttagggtgaattttgctggcccatggccacctctggggacacctgggccgcgtgttgaatgtgtagccctgagcaggcggagccaggactcagctgggttttcctgtgcccaagtgggttgattaacacaggaggtgctgagaacagccctgactttgaggaatccctcgaggggagccgagtgcgtcttcccaagcttattagctggtctcagaactttacagccacacctcataaattggcacagtgtggcatttggctgtccgcggggaagagaaggcggggtgatttagagctgccgcatgcaggtttccggtctatgtcagtgcacggagagcttttgaagggtggaggcctttatgagttgttttctgctttcacactccaccaccttaagcccaggtttactgctctgaggttgtaaagatgccgaggaagggagcctgggccaggctttgcctgcaattgcctcagatggtacctgctaatctggacaaagatagcatcatgaatgtgagatgggagacactgctcaccctgtcttggggcgtggccagggctccagcatgcacacccctcccaaccgcagaaaggaggcatccaggccctgccctcccgcctcctctcccccaggcgactggcctcccctgtcacgcgtccatctatcctgtgctctgctgacacctccttctgactcaggctctgcttcccttcccccagggagtgctgcggctttgaaatgatggtctttaatcatttcttaagtgaccagcccagaaatcatttcttagtgccatacacacaaattaaatcataaatccacactgggccttgcctgggtaggacggaagtatagcctgatttggagcagagaggagacctctgcaggagacaggaatcagcctgtgcctggagggaaggccagcttggtgaaaagggaaactcatcttacgtctgagcgggcactgctctaacaaaattccacagactgaggggtctaagtaacacacatgtatttctcccaagtctggaggttgggaagtcaaagatcaaggtactagaagattcggtgtctggagaagttccgtttcctggacagtgtgttgttttctgattaagtcctcacatgctctttctttgttacctggaaggggggcgatttggggtagagagagagaaacagagagagagagacatcatgggggccccactctcagacctagtctaagccccatacttcccaaaggca

SEQ ID NO: 24813 - DNA, 1306 bp, Bovine  19866880734839
tacagtccatggggtcacagagttggacacatcggaagtgacttcactttcacttttcgtataaagtatggtcctgttaaaaatatatctaggacaggaaactatagtcagaactatggtttttccagtagtcatgtatagtttttccaggatatgagagttggaccataaagaaggctgagtgctgaagaatcgatgcttttgaattgtggtgttgaagaagactcttgacagtcccttgaactgcaaggagatcaaaccagtcaattttaaaagaaatcaacacggaatattcattggaaggactgatgctgaagctctaattctttggccacatgatgccaagagccgactcattggaaaagagcctgatgctgggaaagactgaaggcaaaaggagaaaggggtggcagaggatgtaatggttagatagaatcactgacttgatggtcatgaatttgaacaaactttgggacatagtagaggacagaggagtctggtgtgctgtagtccatggggtcggaaagagttggacatgatttatcgattgaacaacaaatggaaactctaagtgcatatgtcaagatgttaattgctttctcttttattttctctcttatggccttctttttgtttgtctgtgcttttgtttttggttaacagtaatacttatataattaaagatatttcaaaaaacaaaagaattgtagcagagcacaggctgtacagtcagcccctttctcgatgctggcaagagggctgagccaggattaccactcccactttctagatgaggaggctgagctcagtgaggtggggggactcgaagaaaagtacccactggggcttggtggaaccagcccttgcatgctgccctcctgggattttaatcaccaacagccctgtgtgctgggtctcttgcctcccagcttcttccaaacagaaacctcttagcctttcttcttcttggccagccgttcctgcattgacctacctcttccactgatgctttctcaactgagagcataactgtaggaagaaaacctgcaagaaatatctgggtgggatatggctggccctctctgggcttgtgagggactgagtaagggaatgagaaagtatttccagtgtcatgtttttctctctggcacagacacaccccacagattggcatgaatcataagtaattctctgaggcccccgtctgtctggaaatgcctggtagtatttcccagagttcagaagccatcagtccttcatgccagcaaacttgcttattcctcacgcagccgcaaacctctgaccg

SEQ ID NO: 24814 - DNA, 1323 bp, Bovine  19866880752365
catctcttgagaaattgaagggcatctgagaaaagacctctagacccctgaccccagtgaattatcaccttgccatctgaccactagatagtttgatctatccatcaacaagccccaggcactcaccttgaagtatgaacatctttcagtgctacacactaaaatatgaatagatggcctggaatctcagaaatgatttttaagccagcaaatgagatagtaaacttacaaacaggaagcacatccagaagaaaaagaagcaaagcagagaactgaaggaaatgtctaaaattaaattaaataccctcagggagatgggaaggtattatactcatgaaaaaagaataggatgctatgaaaagaaataggttttataaaacaaaaagaaaagaaaaaaatcagtaaaatgattgtgtgatgaaattaaagaaatcacctacacaggagaacaacagcaaaaatatagagatgaaaaataggaaaaagattattttacaaataaaaaagaagatccgtccaggaggtctcattcatatttgactaatgagtgttttaaaaaaaagatagctaataaaatggactgaaagaaatgattaaaaaataaaaacactaggataaatttcaccagaatactccagcaatgagtgttaagaaaaacaaaagcatgaaatttcagaatcccaggatataagaagatactaaaaacatccaatgagggaaatcaaacaaaagagaatacaaaataaggaaactcaggatgtcactggaacactccaacagcagcactaacatgtagaagaagtcaactcaatgtcttcaagtgattttttaacctagaattcatacccagtcaatcaatcaagtacaagagcagaatgatcttctcagacatggagtggatacaaaacatttacctcccaggcaatttaaaacaaaaaaaaaaaggaatttctgaaggatgcactgaagttaaaaaagacagtaaagcaatacagggaagacataagactcaggaaacacaggaagcgatggatgaaagcagtgaagtcctaagacagacgccaactgtgcagcaggactgaagagcaaggtttcagcaggagaatggaggatttcaggaaggatgtgggaaatcatttgaattttctgagctgaggaaaaataatattcattatcacaggatcaatttgattttgtgaaaaaacatagatattccatagaaaattaaatgaaaaaaacgaggaaactattaatcccaaattttataaaaagcaaacaagagagaaaataaccatgtaacttgatatagcactgaaaaatgat

SEQ ID NO: 24815 - DNA, 1288 bp, Bovine  19866880814137
ccaattgtagcaggcaggtattatcatccatattttactgatgagaaagctgaggctgcaggaggttaactgccttgtcgaggtcaagataccggggctcaagcctgatctgtctgcagcgcctctgttcctatgactcagtcctgcacgggctacagacatgcataaacaggaaagagcacagaaagatgggggctcaggttctgtgtccatccctggggtgttggcagatggggccggtgctaccaccacttctgttgttataaaaagccgaggtcctggacaacccccaacctgacagccggccctacagaagcttgagctgggcatggtctccctgaaaacttgtttattgcccatgtggttgtctgaagaaagagttgtctgtcctctctcaatctttcaggccctcagaaggtaggctcaaattaccgagcacatccacctgttgtcctgggctgggaggggctggagagctcaggtgacccagcacacgcctgacctgggctggggtcagcagtgtccttggcaggctgaggggctggccagccgggagccttacagtcaggggcgccagcgggctcccatggccagagtccggatgggggccagtgggggtggctctgggccctcaagcttccccttatgtcctcctggcccccactacccacccaagacagagcacaggctcctctctgagacggctcaaccccagcagtggtgagggcagctcccagcaccggaaaaggtcagaccaatgcaaggaacagcagctacaaaagctgccaatgctggtgacgactgcttaggtaccaggatccctactcagggctccctcttcattgtctctggtgacttcccaacacactgagtgagtgaaacactgtcatgcacattattttagggttggaaaaaaccaaagtgacttgacaatctgcacacagctggcacagcatgtcttgcttgctacatctagcaggaagttcattttctcagccatgacactgaagtgcctcccccaaagtaaaggattggggcaagtcggttttatttcacttcccttcagtaaatgatggcacaacaccaatgttggggaaagtgtcaaccatgtgcaacctactggatactattctggtgctctcatgaccaagtcctgcagactacagctcagaaaggtcaggtgacccaccccaggtcacacagctctctttgctttcacagaacaaactttgatcccccaggagaagttctcgaggagcgtgaggactcattttctgacaccctccat

SEQ ID NO: 24816 - DNA, 1036 bp, Bovine  19866880861359
attattacctgtctgctgcagcctcttgacttttagcccctctggaatgcattgtgtctccatcagctcatccgtttccacagttgtcttgcttgttttcccagtggtcatgtatggatgtgagagttgggctataaagaaagctgagcgcagaagaattgatgtttttgaactgtggtgttggagaagactcttgagagtcccttggactgcaaggaggtccaaccagtccatcctaaaggaaataagttctgggtgttcattggaaggactgatgctgaagctgaaactccaatactttggccatctcatgtgaagagttgactcatttgaaaagactttgatgctgggagggattgggggcaggaggagaaggggacaacagaggatgagatggttggatggcatcacagactcaatggacatgggtttgggtggactctggatgttggtgatggacagggaggcctggcatcctgcggttcatggggtcgcaaggagttggacacgactgagagactgaactgaactgagctgaacttggttgttttcagactctcttgggtataagaagaccttagggaagggaggaagatgactcagggaaactgttcttcatttgctttggagctgaatcagtaatggtaatggatatttactgcattctctggttagtagagatcctgggtgtctgagtcagatattgacagaataggaattaccacgtatcttcctacctatttctttaaagcaagttctttctatagaagagaatttggcatatgtcatacatgtgcttgataggtttttctccacccagcttcatcagccttataaggcttgtcagttccttctacatcctggcaattaggttgtctgtcagtgttcattcaccttgttactctgagtcttcatatttgtctgtatttgctgaggcattttccagagaaataaggagaaactttgtggaagctactagccagaggccattttttacagaaagtcccacaatacatttcaggtctgtcttcccagg

SEQ ID NO: 24817 - DNA, 993 bp, Bovine  19866880900068
cagagaagtggtctccaggcatccacccagtggattatccaactactgtactagatggaaaggtctctgaaggttgatgctaggtgttgccctctctgcattttcttctccctggtactgagcacaggccttccacatagacacatgcattggctgcctggaggtggtggcacatgcgcaggccttgaaggataggcaaaagctgacgcagaaatgggagggtgaggcaaagggaaaagagtgccccaagcctcggagagaacaggaacagcacttgtctggggaacttggaaggagaggcgacctggcagtagaggctgcccggcacacacagcattcatggggccacagcaggaagtgggctggagtactcaggtgtgtctgactgtatacatggggccaaatggatctccaatccctgccttcatgggcccagtgccagcagtaacagcctgtgcagagggaacacttagctgtgtcatacagtcgcatcactcttagtgacacttgctgaaattgatgaacgctgcaggcaccatgacatagacgagactgtaacttccagtgctattaagctgctcaggcagtagcagcagcaagcctagaacacatcaatcagcagggaagttgttaaagatgcagggtcagggtcaggggcacttagccttggtggaatggggagatcactggtcagaactgaaggatgacaaacagaagagcagtgtcccaagggggaggggcaggcacttagatccttgtccctgatggcgcctatccctagggaacagccgggcacagcacagccaagaccaggtttggggagggagactggactggggatcagagcctctcagcagggaattcagggctgcattctgcagtcctggcccaagtcagtgtttaggtggtgggatagtgtgaagcaaacctaggggttttctatgatctaggccagtgattctcaacctgggtctctagaccagaaccaccagc

SEQ ID NO: 24818 - DNA, 4228 bp, Bovine  19866880908607
catttaaagtacacatctgggtatgtcattctctgctcaaaccccacatgaggtcaagtccaagccttcggcatggcactgggccctgggcactggcccccatctgcttctcagatgtgtttcttgtcatccctgtttatacttaagctcctcctacccagaagtgccctgggttgcagtggggaccacaactaccccatgtcactctacacacaatgtcctccaccccctcatccccttcccgaaacattcttgctgtttctttatgagtggaccaggtgacatgttcttagagatggtttttttttttttttttttggacactgcatccctacacccttactcaggccaggtcttgggctcttcctagtttccataacttattgggatttatctctgtgaggctatttgcaacgttgttcaaatggttttcacatttatgcatctgtgtgctactggaaggcaagggtatgtatatccagagcctcgcatagtcttggcatctaccagatgctcaatcagggtttaatgaaagaacagattgaactagaatggctattgctctgtgttagccactacatgccaggcacccctctaaggactcttaatgtatgaattcatttaaattccacaacaaccttatgaagtgggcaccacagctgcccccattttacagatgaggacactgaggcacaaatgaggctaaataacttgcccaaagttggcacagctagattcaagcccaactttagggactgacccgtacccaccacagtgtgttgtttcttcagcccagctgtcacccatccctgacttccaccccacatccccctatgctgggaatgccagtgccccatcacctgctccaccttactcgggacccagctaagaccctagctttgcacatgctcagcccaccctgagctccctggcctgacaatgaaattgccttttacacgtgctgttcattggaacaaagctctgcatccccagagctcattcggggcccagaacaagttgccttgcaacccctcaaagtgaattggtgacctacaggtccacccgacagaggccattaagaaatcccaccatcaatagtcatgcccctacatacgatctttttttttgtggggaatgtgttcgcttactcaaaaggaaaaagagacctatgttttaatgactttcatttatttggtatggttatagttcttattgtgctgctacttcttagctatatcttatttgatctccctgcttccctggacagagttcaggacaggttggccccaattcactgaagagacaactgaacatcagccgcgctgggtaatgctgaggccctccccagctcactgggacctgtttgctggctctaagtttccactggttcccaatgattctgacactctctggccacaagccgaccccaggacagtgtcattcggccggcaggcggctgagaaagccctgcttgtaggtatctcagtgcggcccaggggcctgtccctggggttaggacttaaatgtatttgcagagcacaacttggttcacaagtgtatggatgctttttaaaagtatttatttatttatttttggctccatcgggtctttgttgcaggacgcgggatattggttgctgcactcagagtctcttattgtcccacctaggcttctcttgtggctcaaaggcttctctgcagttggagagttcacacttgccccaaggcatgtgggattttagctccctgaccagggttcgaacccttgtcccctgcattgaaaggcagattcttaaccactggaacaccagggatgtcccaatatgtatgtttttaaaagagaaaactgccttggtaattacaaacacagtgggaagcctcagggaaagcgctactcagatgtgactggatgtagagatggagtcttaaagaggtgctgagatagagtgaggtggttctggtgagtcctgatgtgactgagtgtagagatggagcgtttaaagaggtagctgagatagagtgaggccattctggtgggtcctgatccgataggaccagtgccctcacaagggaggaagagataccagtgatgtgcttacatggggaaaaggccatatgaggacacagcagaaaggtggccacctgcaacccacagagattggcctcaggagcaatgaatcttgccaacactctgatggtggactttagcctccagaactgtgagaaaacagatttttgcagtttacacccctcaccccctgcccccggtttctggcattttgttctggcggccctagcaaaccaattatgtttgtttagttgctcaattgtgtccaactctttgcgactgtctggactgtagcccgccaggcttctctgtccatggaacttcccaggcaagaatactggagtgggttgccatttccctctccaggggatcttactgccccaggaatcaaaaccaggtcttctgcattggcaggcggattctttatcactgaaccaccagggaagcccagctgttttgttacagttgtctgaatgtgcttctcttcttgggatgaggtgactgggtggcagagaggtcagagaccaacaacctattggtgggaaggaccccagcctatgaatcagtctcactgattatcgcttgactagctgtgtaaccataagccagttacttaatctgtctaaacctcagtttcctcctttatgaataatatacacatatattttaaagctctgttgaatcctgtgaccatatatttacacttcagttttttaatagtcctaattttgttgacactgttaagcttgcccaaacactggccattgagaaacaggctccataactcatgctgaagtcaccctttgaggggctgtgcactgtcccacatactgatgaagcgagagctctgggtaatgtccagtctagggtaacaagcagacttgactgggcctcagtttcctcatctgcgcgatgagtatgtgaagacataggactgtttccttcccgccccctaaatgccatcaattcccgatgggagagggtaggagatttctggctcagtgatgctatgagatattcacgtttcagactgagagggtctgcagccccccacccatctccttctattgaaaagcttaaatacaaaagcccgtttggttcctttgcaggaccagggctggtggctcgacaaagagatctaaaagaggctggaactgccagctcacaggagaggtggcaggagttttacaaggacttgagcgagtgcctttgaaactttctgctattcaagtctgtttaaagctcgcttctgaagcctgatagctttcaactcgggtgtcttaattcttctctcctgccccgggggctgagcccagaagagctttgcaggacagcggcacttgtgagtgaagccccaggacaggtggtgcttgggacaggagcctgggaacacgcgggggcgggccttggagaaggaggaggttcaaggatggggagagctggtagggggaagggcagggagctagaccctctggggcccaggtcctgaacgaggccttctggttttgaaggcagaacaggaaaggacatattttgaggcagatatcatgaaaagggggctgaagaggggatggaattagcctcccgtggctgtacaaataacatgtcctgtgctctgtggcaccttgtaaactgtgaagtgagggatagttaccctgcccctttggagatgactcgcaaacacgtggccaacaggaatgctggccaagcacagatgggaaggccagaggctgctgcaggtcaattaaggaggagactttcatttcggggtacatgtggccctgggaggcctgtggaggggcttcatggagtctgagtcacatgcaaaagcatggtcattttgacagagataaggactacagctttcattagatcctcaaataaatctgaccctcagaaggttcagaagctctaacttggggtgaaatacagtgaatgttaagctaaaacctgctcgaatgcttttcagtggtagggtggtcatgacgttaaggcaggagaaggtgggctctgggaaactgggtttatccatcactcctgggggagagtgctccacggaccaggggctgatgctggctctgggccagaaatatccccgagagaaggcaggaaacacaaaacagtagtcttggaccacctgtttggtgagccgggcatttg

SEQ ID NO: 24819 - DNA, 1772 bp, Bovine  19866880964899
catgcttgtgacagggcaggattcatgaagcatttttactgaggtcttgcaaatagcattcaagaattccccacccatctgaccagggataaacatccatctcttttgaaatcagtgcacagctagcattgggcaggcattggggatcgccctaggtggacttctattggtcatggccaggcttgtctcacaccacattcatcattaacgcccatattggccagtgcctgtcttagacatgtctgtttgctcggacggatgagactcagaccacaagctccctgtggtgaatgccatcgctgtctgactcattgtcacagcagatagcctagcctcagccacaggccactgtttctcatagtcagaaaaattacatttaccaagcacttattccatgccaggtgtggggtaaatcctttaatcatattatcttgctgcatcctgtggcatcctctggttatcactcaaaaagcagccttgggcggaggggcagagacagtactgttagggagagtgaccattcacccctcccatcctttggagatggccccccacacacaccctgattccagttacctcctcttgtccttgaacttcaacttcatcctctcccctgactctactttctctacctaaatttgcataagtcatagccacttaaaacccaaacatggtcacctggcatatctttctctatgttgaatgtcccctcttcactctccagccaagcttccccaaagtggagtcacacatcatacaggctctcctctctccgtgttcaaccacctgcagtctggtttctcccccactcctctttcatgcctgcccccccttttttttggacaggggtagggtggtgtggggggttccctacttgacaaatccagagaatttggtccttacttcctaacatactttgtggtcactggccagaacatggggacccaacacacagttcgtcagcggcatctcctttcctcagatcttttccttcctctgtatctctatcacctcacaaaaatgggttccaccaattttccttccctaaagcaaagcctctaatcaatccttcaatcgctttccatatctcccatctattctcatccaccagggtgtgcctttcaaaatgtacatgggatcatatcattctctgctcaaataccagttatttaaaagtttaccctcctttccatgtccttcaagtccccatatggacttgctgctcttgatttcatctctgggtcatactgtgaccaacaggaagttcctgccacgtcctgtgcacactgaactcacttcacatccctaagcctctgcactgcattctctcctttgtccggaattcttctccttctatctactcgaggaactcttgctcacccttccagatccagcacattttcactaggagacttccctgatgctcacagtcacacacctcccctctgggcttctataagctcatttctggctgtgtaactcagaatcgtatggaggtgagagttggaccatgaagaaggctgaatgccgaagaattgatgcttttgaactttggtgttggagaagactcttgagagtcccttgggacagcaaggagttcacaccagtcctaaaggaaatgaaacctgaatattcattggaaggactgatgctgaagctgaagctgcagtacttttggccgtctgatgtgaagagccgacttattggaaaagaccctgatgctgagaaagactgaaggcaggagaaggggatgacagaggatgagatggggg

SEQ ID NO: 24820 - DNA, 1748 bp, Bovine  19866880970164
ctttggctgagtactgctcagagcatgcataaagaagctacacagaacagagcaaaaataaaaggttaacagagggtaacacttcacaggttctggagtatcacctactcacatctgccagagtcacaggagcaagtacaaagaaaggtcttgactcagaaatacttagacctacactgagcctgctcctgtcctatctaacaagtctaaatacctagacctgaaaagatcaaactgtttccaagtaacttaactgagtaccagaataaaacctaaaaatatttacagaaatataaaaatatccaggacccaacaggataaaattcataatgcctgtgtctattcataaactatcaggcatgcaaaaaagcaaaacagatcaactgaaaccaacgcagaactggcagatgttagaatcagctgacatgaaaacgactgtaactgtgcccccacaaaaagtcaagaagagacatggaagacatgaaaagacccaaatcaaatttctagagatgaaaaaatacactggctagggttaacagcagattagcatttcagaagattagaaatctgttttccagcttttaattattttgccagaatctctgttgaatattttatatccttcagctgtagtgtggaccagcagtctgctgagagacagctgcgtgccaagccacaaggtagccttagtgaagcagggcactagagaatgtgatgggcacagtgaccacatggtttatacacggcatagagctatggaagccaagacggggacatctcacccagggagcagggttcaggggagagagttgggaaaattaggcgacttcaaaggaagccattataactaatttatttaaacgtccatttgcaagttgactccaatatccttttggataataactaagtgggcaaagggaaatgatcaaaagaatgagaactccagtaaggcacaagatggtgaagtaaaaaaaaaaagtatgattcattcactaactcattcactgaattttaactgaacagtacctgactatgtgccaggtactgtttcaggtgctggggatatagagtaaaacagtataaaagggtcgcctggtgggctgccgtctatggggtcgcacagagtcggatacgactgaagcgactcagcagaggcagcagcagctattcaaacagaattaagtttcctacagagggagatagaaacaacaaaagtcaaagtgttagcctctcagtcgtgtctgagtctttgggaccccctgggctgtagctcgcaggctcctctgtccatggaattctccaggcaagaatattggaatgggtagtcccttctctagaggatcttcctgacccagggattcaacccaggtctctggcactgcaagcagactcttcaccatctgagccaccagagaatcccacctaaaagaaaacaaagtgacagaaccgagtggcactgagggtcagccctagagaggcaaagctctctgaggaaggaacactaagctgagatacagaaggctccagccccgaaaagatctgcgataagtacataaggcagagcaagagttgactgcagaccctagggtgagaagagcttggcaccaaaggaactaaacggtggtgtggtggggagcagcgacaagagaagaaacaggtggcaggcaagagtctccatataaacattaatttataaagcaggacgacggaagcctagatacatgatatttatgaatcactgttaattt

SEQ ID NO: 24821 - DNA, 1423 bp, Bovine  19866880988053
tactgggtaggatatactttgctggcacatgaaggccgtctgaaagcacactacagggcgctggaccatccagaagcacatggtagaaccccagcctgccgagggcacagttcaacaaacaagtcagctctatttccagtcggcttcaatgccaaggttaagttagtttcaatgaacgagttcccatattccaagtctttaaaggaaaatgagctctttttggtgggccttcaaggacaagccccaagttcaggttggggttcctctttccagagccttctgagccaccttggtcagctctccccttgagcacagcgctgggtcttttcatttaccttttttaaaaaatgttttctcagtggtaaaagtatcacatgatacaaaacatagtattttaaccatatttaactggaccattcagtggcactaagtacattcacattgttgtgcaaatttcaccatcaaccattgcctgaatttttcaccttcttaaactgaaactctgtccacatgaagcactaactccccactccctgtcctccacacccccagtccttgacatctaccaatgtactgactctatgaatttgactattctaggtatctcgtataagtggaatcaatatttgtccacacctaatgtatattggaatgcatttttaaggttaatttaatatatgtcctacaaacagattgtcccttcttttatagtgagtacatggcaatacttgcctcattgattggcactaacgtacttctttggttcaggctccctttactatcctgacccctactgtgatcccgttcctgtcctggagcttcctcctgagccctgagacgcccacagccatgttgtcacttctacagcatttgtctctcacacccggatactcagacaatgattcatttctcccaaaggggcagcaagcagaatttggaaaggacttgctccccggaacctgctgtgcatggaacacattccccccttccaagtgctactcactccagccacagaattagccttcagctctctgggttttccttgttgtcaattttcaatttagtctccaaattattcacctgacagagaaatgatctcccctccaaactctcttcatctgtagtgatacctccatccctggaggcattgcttcatacataccaataacttggagaataaactgagctcgactgctccaagcagagagctctgctgaatgcaaaccctcccccctaagacttgtgtccagcatcctccaagcagtgttcacataaggctgatctcatggtacctgagcgtgctatcacccataaaatactccagtgcttccactcctttgaagactcactgtgtgttgggcagtggttctcaaacctggggtttagtaaagccagagactaggccccatccccagagtttcta

SEQ ID NO: 24822 - DNA, 1315 bp, Bovine  19866880990127
ttcagaattgcagcctctccccagctggcctcctacattatagcattctgtatcccttctcctctgatccatttttttcccactgtacttgacatttttaacataccttataatttatatatttactatgtctaagtctcagaatcccgccactagaaaataagctctgtgaagacagaaaatgttaatctgtactctctagaacctagaatgattactggcatatgacagatgcccagtaaatacttgtttaaatagttaattacgtggatctgggccatgatcctaagttgggaggaagtgaagatgcatgtgatagttgagtcaggatcaaaaattatttccacttaattgacaaataggccaaattcgacaccatgaaggcacatgtaaatccctgtagtccaagcaaaaagccaactctatagacaaaagatgaggagcataccatgggaaaacctaaaggttatattgactgtggtttcaaaatccaatcacaggtatgtgtttttgaagcaaaggcttctggtcctatgaatagatgcatagtacacagatcatggtagatattagttttactctaatctttgctgttcaaacagcagtgagagaattggattcacctcagggccttatgcctaaagagatttagataacaagccccatttggaagacagccacctcaggtggcagcatatcatgggagaaatttccataggatctggtcattcttttcagcaggaaaaactcaggggagacctaactagtttctttagctatttgacaagccattctgtgaaagagggaacattctgtattacttcagttggcagaactgagaccagtgggaagttccaagacatatttcagataaggataaggaagacgtgcacattggtgagagatatgcaggcatggagcagcaactcctggagtcagtgagcctcctacccccagggatgcagcagggctggcagagaataattgataaggggattcagaactgcatcaattcaggtcctccattcacagatgccacgatgaaaccagatataccaaagatttactggggaagtggggtggaggccagaggaggctgggagagctatcagaccacagtgaagatctgatccctctaaaggagagagggaaggaagaagaattgagtgggaagagctttagacagacatgagttgcagggaagtgttgggaagtccaatggggcatgtttgagcataagtcacccatcggaagagttaagaatggacctgccatcgcatccccaccactttcagtcatgggtggagcagcaagg

SEQ ID NO: 24823 - DNA, 1617 bp, Bovine  19866881003331
attgcggggaaagcattctgggcagattgggaggtggttaaggtttgagtgagaaattgaaacttggagtgtgtcagactcagtgtgtttgcggggacctccttccggtggaggaggtgcactcaggaaggagtagagggagtgccagtttgctcccctccttcagttgaccgaggggcataaccaatcttgcatgaggaacagagtcttcaacaattagtgccaccattgttaaacttttcaattgttggattttttcctgaataaaaaaatgtgtaacattttgataacagctgttttatttttccttacttatttttgtgtagaaaattacttttgcagaaccacatgcctaatgatgtgtcccatacatattagtgagataatgcatgtgagtgcattgtatgccatctcacagacagtagatgctcaataaatgggagctcctcacactgtttatgcttcctgtatttcacaggaggaccctggggcagagggagaggctgctttgtccaaggtttgtgttccgaaataactagactaacccagggtatcttggctcctcccacttttccctcagtcagagcatctcagtgcctggaccatgctctacttacataacccacagcactttagggagcagctggggctggactgattgggaaaatgtgtttttggcagcacggtccagggtccacttgatgtaaccagtgtgggtgggcaatgtccaaacacagtggctttggcgaggtggagcaaggcacacattcattcactgacaagctgtctgtaaccatggaggagggagggcagccaggtaagaaacttatgggaaagaagacacgcttcaggttggcaggaggtgggacagcaacagctctcgtttactgggaaggtccacaagccagacgtggtgcatgcacttcttctgaccaaccagccctctgaggcacatgtgttatcccagtgtccaggaaaacatcttaacatttaattctggggccaggaagtaacgtaccagtcattcatccagcaaatgtttgttgagctgcatctgtctactcaaacgtcgtcagcactgggaatgctatggcaaccacaagagacagagttcttatctcagagcagcagagacaggcagacacacagccatccacacatacagctacaccttgtgatatgagctgagaaggaaagtaagagcatgcactggaagatagtaatatgaacgtgctaattatgggttggggagggaactgcttatagggacactcctctatgaggaggtgacatttaagtggagatttgaggcaagtgggtgttgactgtgggggagaagcagagaagagcctgtatcagggccctgaggcaggaaaggcttggccagggagggaattgaaaggtcatcaggcactgtgccttcagcatggagtacaagacgaagtagcataacgtgatcccctggggccctgtgggccaagctgaggagattggcactttcccttaatgcaataggaggccagtagagtgctttaagccagccagtgacatgactggatttatgtcttacaaggatggctctaacttcccttagagaagggatttcagaggggagca

SEQ ID NO: 24824 - DNA, 949 bp, Bovine  19866881023521
ttaaggtagaaatataatacaaactatatactttctaataaatacacacaaaaaataaaagaagcaggttaaatttactttaatataatttaacacagtatattcatcatttcaacatgtaatcaacataaaaattacaagatatttttacattttttatccttaattcttaaagaatggcataaatttcagtatattttataccaaaataacatttcaatttggactagtcacatatcaagtgctcactagccacaggtagctaatgggtaccatgttggagagctcaattccatagtgtctggttgtaagcctggttttgttgaaatggccaaacggtggtaactagcttggaccacaaggcaggtgaagccagaaggacctgatgttcttgatggtgtggggtggctggattgcagttgaggactgagatccacaatgaggctgaagggtaatgatgagtgggagaagagaagggatgggctggaagcctgggaggtcctgatccaagagggcaatttccagggttggagatcacagaagtggggcagtggctgatgctgtggctgtaaaaaggaggtgcagataaggactgcttgcttgaggaactggaggaactttcaggacactgcttttaaggtctttgaaaccatccatggtagtcaaccttttgttgacttttaagtcaattcttaactctaatttttcaaaagaaagatttccaaaggtgagaagtgacaaatgcaaatttaaccagcatgcattctattgcattattgagtccttggtgtaggtgttgaaaaaagcacacatttcacattgacctccttgaaaaatacttgtggattttacattaataaggaccctttggttctcactctccaattaactgtgtgatcatctcacagtattttgatctggactgtatttcttgttataatgattagca

SEQ ID NO: 24825 - DNA, 1595 bp, Bovine  19866881055904
gacaagatttccgggaagttgctttcattgggttttctaagaaagcaacactggtgttctcaagatcgtacagtgcttctgcccattcacccacctacccatccatccgtctgtccatccatccttccaaggatggtccttgagccctagctgaatgtgcagagcgctgggtccatgctagcctgagtatacatctttgtttttgtaccaggcacaggaaaagccctcagaatccagctcactctcacaggtgaaaccctacctctccatggtctcaaatgcccatcacctgataccttcactcctgggaggaggcctgggtgcagactaacgggttggatgtggctgcagctttgctcctgcacggaagtggcccaagtgtcagccccacagacagacaaaaggggcatagacgcctccagacttaccagcttggtttgtggtgatgttgacagagacgtgctgtgggggaaagggactcttgctggagaccccattgacagcctggatgtcaaaggtatacggggtatgggcccacaggctgctgatggagacgcggcactcagtcaggcccagctgcctgggcacgaactccacgttgtcgtcacagcgggagcagctccggcggtctgcccggcacttcttacagatgatgttgtaggtcacgtcatcccgcccacccgtctcccgaggagggtgccactccagaatgatggatgtctcattgacgatggagatgacattgcggggacctgatgggacacctgcagggagacaaagaaaggcccagtgaggctgagtggaagcttggccagcttctctccatccctctttggtgtgatcccaccctcctcacatacacatatctcctctcttccctcaactccagtcaaccatgtcccaatcctttctgagaaaaaatgacagatggagatgacaacctgttgccagctccccttttagtcatcccagtgaggcttttcttctctgaatcatgtctgccaagggagaggaggatggaggtcttggatacaagcccttttgttctcaggactcagctgcatcctccaggcagctttagcatcagtgacatgtatgtatattggactcttattggattccatgtctcttcttaacttgtggagaactcaagtgttggaggacaggactcaacatattcaggcatcttgcatacagtttcacacaacctgggatctgtgtggtatgtgcatggcagtgggagtgtttctctgcaggatgggcttccagaacacctggagaaatgaatattcacattgtacaagctgtggttcaagaagccatgttgggtaggagattcacacagccactatttcttaccccataatacaagaagagcatagcggtttgtcccagacactctgctagctaccagagctggtcttaagctgatacggcactccaaacattggtggtcagatcttttcatggaaaacaagagatctgaacagaccgtctctcctacaaaccagtcaggctcactgggactcaaggagggcagcctctttcctccggacagctccataccatggctgctgttcacacacctgcaaagg

SEQ ID NO: 24826 - DNA, 2343 bp, Bovine  19866881152667
gcccaccttggcattcgtttcttctgggtctgctaacccccatggccctgaggcagtgtggtttgcagtgggtctgagtccaccccgaatgtcagtgcaagcatgccagccaaagagaacattgcactccctgctggtggtaagtcaagtgagggtaggtgaccccaacccagccaatctaagtgaatgtgatggaacagttgatgttgggaagtgggaagggggttccttatatgctaagcctataaagatgtaagccatcatggaggttctgggaccattttagtggcttatgagaagaacctgcctgaaaatgaagtaaacatagaaagaggaaagcaagatgagagccagattgagtcctgatgatatcatttgacccccgtgtctaaaaccagagtccaggacttctcatttacatgagcaaaggatatattctctatttttttgcacacttgagttggtttttgtatcacttgggttgataatataccccaaccttaagaaagaatgatttcccttctcttttatttaacacttggccttacataaaagacctaggttatttctaatgtacatcaaattcttgctgtgtgactttgaacaagtcctatccatgtgtcctcatgaaaacagggcatggggccccatcacccaggtcctttcccaccctgaagttatatacttttactagtatacaattctaccttcatactcacacttagatacaaaactgttttcttcaagagtatgggttgaaacattaaaataacactttcaaaagtttaatcaaatttcagatgaggaaaaccacacaaggtctctttgctttagcaaaatatagaaccacaatcatggtggagacgtgtcatccgctagtttctggtgccaggaaacttctactcccttctccccttctaatgagtaccacttagccttttaatccgtgaaatccgtcagaggtgggagagatgtaacagtttaacaatcttcagaggcttaaaaacagaactgtagtcactttatctgtagactctgggtaccccattcacagcccttaggtgactctctgtcaccccagatgccaagtcagacacctgcccaccagttcccatcctcctctcgctcctgcctacttgagcatcctaggcgtatcacttaatctctccaccctcagtttcctcttctgtaaaacggggataacagtcgtacctctttccaagtgctgtcataaagactgagtgagtaaacagtgcctgcagcgcagtgcatgccgtgggtcctcagtcgtgtccaactctttgagatgccatggactgccctccaggctcctctgtccatagaattttccaggcaagaatattggagtgggctgccatttcctactccagaggatcttctcaacccagggatcaaacctgagtctcttgcgtctcctggatcgacaagcagatgctttaccctgtaccacctgggaagccacatatagttggcacagtataaatgttcacgctcatcttcatcgtcattcttctggatggactccttggtgcagatggatggctggatgaacaaatgggttaatgtgaaggatcaaaatagttcatattgtgtcagttattagtagatacatagtgatgagggtattctagagatataaaagtagcaattcagaagggacaaatcacacagcctgctcccctctctgctgttcctccctgctcttgagccccccacaaaacccttcttttcagagcttttgctgttgacttccggaaccagaatgtctagttaatgatgattttgcagctcttaatgcaaatttgctcttctgagtgtctaatatgaactatttccaatacaagtgcagacccactccccaattacatctgttttagcaaagagatgcccagagtgaccagctgaccccagaactcaatcctccgtgggcactcagaaataaaaggatttgggaaccaattctcctaaactgttcttaaatgaaaccaactgatgactcagaaaggccatttattgagcataataggagttagattagaccagagccccaggatcaggcatgactcagagaattccctcccaaaagatgtcaccctgagcccccaaaaggctactggctggctgggtcagctgattgccacccccacaggtggcttcagagagggctgaggggtccagtagggctgggtgggtactccagcaagatttgtttgcaagctgggtgactttgggcaaatctctaacttctctgagcctcagtttcttcggttttaaagtaaggctgtggcactcggcccagggtagctgtgaggaattgactga

SEQ ID NO: 24827 - DNA, 780 bp, Bovine  19866881161865
tggataactctaagcctttgtcttcccatatgggaagtgggagatacatccccatcagagttaagttgtgatcatgtatggttaattcttattagttatgacagttatttttattaagtctccgggaacactgagctagtgaatgctgagccgtgcccctaggggaaatatgtgcgtttatgttcctgagacccctgggtcacaatatttcatcaattgatcaacacataaccttgttttatgtgcatatctatttaaagacatcctaatttctatttcttataaataatgaattatatgtaccttctatataataaaacactagctgagaaggatttaacatttccttgactctgggtaacatgaccataaatttctttggctttcagccttacaatattttccactatgctttaaaagaaaaaaaaaaaatgagcatattatgaatccaccagtacagcctgtttccacagtatcatcatgcacttcgatgttacttgagtactttccagaactttgatgcatatacatcagtgaatttcctcttcctggatgtaccatattgttgattcattaacactgaactcacaccaacagcactatatcatgcctgaatgaagcttctctcacacatgtattttttctgtaaaccacagccttcttgcactacacaactgcagcactatacctgggggctactttatacagtgaaatcaccaacaaaaagcagagaaatacaaaaaagtgtcactaaatagactgcaaaaaacaccctgttta

SEQ ID NO: 24828 - DNA, 1650 bp, Bovine  19866881178608
ggaggtagctgagaaagacttgccccaagggaattaggcttggctattgggtcagcatggcctgtggagaacacataggttgagtgatgtgagaagatgccatgtctcgggattaaagtgatgagtaggcagatgacgtcacacaccatcccccaggtggcttggggtcattcagtagagccttagcatcaggacacctgagatctgtacctgactctgccatgagctgcgtcctcctagcagacctcttcccctcagccgtaggctctgcagaggagccccagggttcttatcactgacatttacagtcctaagtaacttcactgtccagtaattcttctgacgcaccatttttttcttttttgaccttcagaaactttaatggacaccaggacggctactgcagagctgggctggaccgccaatcccgcatcaggggtgagtgtcagaccgtctgtcctcctgtcctgatgagcagtcatgggagcagggcctgacttgcccctctgggatgtggattacaggtgtgaatggctttgtccgtggcccatccgcagagaggcagcagcaggtggccagggcctgtgtgggactggggccagtggctgccagtagttgggtgttcaggtcagtggtgatggggaggacagagatccggatgcccctggggctgaagaggggccagggcacgaggcagagctcgagttcagaaaggctgaggctctctttgacctggtactgccttagagcaatgttctggatcatttgttcagtgttatgcacctggtcagaatctgtagctgcaaagatgaatactcttgaggagctcatgacctcccgtgggatccagcacatgcatgaatgagctgaaatgtatccctcctgggtggcagtggggagactgacagccaggtgtgggcacagaactggaagtgagacactttagagggagacaagaagcctttaaaaaaaaaaagtgcacgcaagctgggctttggagagtgagtaggagtttgacagacagtaaatagggagtctggaaagatgttccaagtaggaggaatagctggttaaaaggagtgggagtcatgaaacgacgtaagaacaagagtctgtgcgtctggaccatgggagggtgtgaatagtgctgaggtggggctgggctgtggattgggcagtgcacagcatggggaactgggactgacctgctgagttagccatgtggctttctcctataggtaaaggatggatcttgtcacacttgctgacacgactgtagggaacagttgacagaaggctctttcagctgtcttggatgggtcagaagcatcagattaaaatgggatactcaggacagttggagcaaagctaagcaggaggccttggtagcatttggcagtgagtgaagacattggggtggggaaaaggcagagggaggaggtgggatgggattcacatctcaggctcgagtggctggctctctgtgaggcttaatcacgaaaggaggggacaggaggagtgcatggactcttcatccccgcgagggggtgaggcaggggcagggttagcctggatcttctctttaaccctacaccttctctctcctccctgcctttggtcacctccagcctgcagcctcaggccactctg

SEQ ID NO: 24829 - DNA, 1062 bp, Bovine  19866881263226
tggtagtcctgcaggtgagagaaaattggcttcatgaaatagcactattagaaacagagttttcctacatgaaggctgacaatcactacaagccaatcaggactatgaacatacctctatttttccagttaacctctcaatttcagaccgatcttccctgtgatttttggcatttcctctgaagtctcttacatgttttttctgtagcttttcatagcttctcttcagtctgcttaactgtaaacacagttatttctagacttaaaatttaagaatgtgtaaacagtgctgataaaacaaactggcattatgaaagcacaagtagagctaactaccatcccagaaaatagagagcacgttagataaaatacaaaactcaaaactacataaagtaaacaccagaaaaaaaaaagtcaaataaaaaataaagaaaaagtttaataaataaaacaaaagtctaattttttattataatatacaatagccctgcacttagggacccccacaacccatcctcacaataaaagcaacaaataaacactctttttcttttctccaggcctgtggttcttgaagcattccccagtggaacacctgatattcactatgcaggaaaggaatgcttcggaattgaataaaacgtattttttgccaatctgaagaaaacaattcagttaactggtagaattttcttacctttctaatctatcccaaaatgcttctgaaacctttgaatcttccattatttaaaatctactgactcaactcaaaaataaaacatttaacgtaagcttttggtatcagcatttcatggtattatacaaaaatagctctatttctttcagatactcaaccaagaaacatattttagaatcactgttgtaggtaatatcaaatatataaaaggcaaaattctgggtttaagaatagagaaagatttctaccccaatatcttccatggaatatatacatccactttataaagtagaaaccagctcattaacaaaattctcaaggctgaagagacagaattatacaatatataatagaattaaaatctta

SEQ ID NO: 24830 - DNA, 1551 bp, Bovine  19866881284494
gttcttacagagccagttagcggagctcctgcccagacagcacagggctctgtggtcccagctccagggacagcggggctaggcattgcctgagccgcgggggtgggagaggctgggtgttctgtgctccaggtgtccctgcaaagtcaagagccactaatggaaataaccaccggggcatgatttttcaagccctgattccaatcacagacctgtcatccaagaagaatattggaggggaaattccatttctttgtaaaccaaacgttcccccacggaagccaaaggcttgtggaaacagttctgattggaaagagttgagcatacattgttctggcttcttgagctagcggatgcaacactcattgtttactgagtgatgagtttatagcacagagagatcctgtccacacatggcaatgacctttcttgcttccatggacaagacactcagctcacaggaggaggctgggatgcatctggttcgtgtgaacagacagatgtgagtcctggcaggtggcgaagctgggcatgacttactacagggcagaggaatcccagagggcaagaaggggctccagacccctcccagagaatagcgcagaggccgatgatccatacgcccttctactgctgcagccagtccacacattggaaacattaaaggacagagaaaacgagagggtggcagacccgctgggctgagcactcaacacagggtcaggcagcgcagctcttgatcttcctggtcggctacgtgtgcctgtgaccactggcccctggcactttctcttctaagcacgtctaagtgataaactcagtgaatcttcacgaggggatggagtcctagtactatatctgttttatattggtggaagccgaggctcagagcagttaggtaactcgcccaaggtcacacagctagcaaatgccactgagatttttgccatctcactgcacgcctccctggccctcctgcctttgctctctgccttgttcatatagtaagatggtgaccagccaactcttccgtggcctaccctagcatacctttccccaaagtggatgcttctgtgctctaatgaggctgcacctcataggagaaggaatgttcaggacccccaccacctatggaggctcagcaggctcgcttggaggtctggccagtgggcttggggccagaattcagacttgggcgggtgggctgttttatttgaagggaccccaagcaagaagtagcatgggggtgtgagtccttctgggtaaaaacgcttatcctgatcaccgctttgttcaccgtgtctagcaccattcctggtcttaggagcttcagaaacaattgttaagggaatgatccaagaacagccgtctggcaaagcttggaaagcaggctgctgcatcctagaatgtcaggttctcggggctctggggggagaccggagctggggcttggacccagccaggtgccacagcaggagttctaattctgaataactgtttttttttttttgtaacagttttgtgtcattctaagttgggtctaccacagaa

SEQ ID NO: 24831 - DNA, 1314 bp, Bovine  19866881347003
gatttatctccagcacagagaaaataaatgatctggaaagttctaggctgcccgtggacagagaaagggtgacgactggtgagcctgacggtatgtccctgaacggtcaggtcctgttcagttcacatgaccagggagggtccatgagccagccttcctgggtctgaggagagcaggcaggagcggggccagggggcctacctgctgcagacgatggagatggccaccagggacaccacaaacaccacccccagctgccgctgagccagcgatcaggggcagctgctcccgcagctcggacttgtaatcatctagcagagagagaggtattagaagcttcctgtctgccctctgcatggggctgctactcagcgatgccaccaaggacatcagagtgatagacagatagagtttctatacttcagagctgtaagcctgacccaaaccaagagtaatctttaagtcacacacactcacaaaagtaaccccaaacaaataatgtcaacaataaaagcaagataacagtgacagagaacctcacaactaagagctgatgacattggccccagagcagaggtaactctttctccatgcactcatgaggaaggcctctcaaaggtctgccagccatgctaaggatacgtctaacagggggcatggaaaccactgctgaagtaccttctaaggcacaaagttgctgagatgtagccagtcaacagattcactgagcagaggcttaagagcatctgcagccacccagtaccacatccagtgctgcggagaatgaagacacgtcgagaaacagcccagaactctaaagctcacactcaggaagaatagggtcccggcttccgccagtgttagaaacacatgggggagtggctgcctgcggatcacagaggtggacagagctctctcaaacgtggctttaccacggggaagcttagtgatcttagacaaagcatctagtctttgactctcagattccttatctgttaattttttaaattaaatcatgtgacacatatttcagtgtctgatgtatcacagatgccccaaatacaaattctcttctccttaatccatacaaaccactcggcccaggggcctattgttattattgtggttcttctctcacttggtgtcaaggagccatcacaaaatttcaggacggaggcagatgggggtcaagctatgtatgtcctattacaactggggctgccagatacagcgagtgaaaatatgggatgatcagttacatatgaatttcatgtaaacaacaaataaggttttaatctaactgtgacccaaata

SEQ ID NO: 24832 - DNA, 1031 bp, Bovine  19866881364844
cacgtgagcagcctggtagaaagacgccattttcccagggaacaatttcccttcagtggttctggtagggaaaccttcagggtcccccctccaaccacggggggccgccatccgagggtcagggtggtgggggcaggtctgagccccctacacagaggaaaaggcagctgccacccagctctgcagacggttcccctttctgtctggattggcaccttgggatgtattgacatttgggatgaattagatgcccatcatggtgaaagagagctaaataaaccctctccttacagttctgccactctttctggagagacattaatcagacattcagctgaaaatatttacaacgtccttccgtggtggtaacaatatacaacaacatacacagatggaatgggggcttccgggcctccagtgagcagagcctcatgtgtatttgataaggcaaattcaagaaccttccaagcagggaagaaccagcgcggccgtgcagtcactgcctggtgcagccttccgtggctcacagagctcccgaaacccaggagccacagcccagagtcgctccacgaatccaggtcctcccaggtaaaggccaggagttggaggtcagcccactgcagcccaagcctctccctcagccttcatgaggggctgggatcactggaagaaggctgagatgcgtggcatcagggggtgatggtccccattcagcaaaggttgtctgagtcgctcccacaggcaggtgggcactgtgcaggaaccagagacagagcagaggaaaacagacaccctggccctcaaggactttgcagacaagtgggaagacagaaattaatcaaataaccacgcagctaaatctgcaattacggcctcgctgagcggcaggaaggggaatcccagggacagttgtgaacactgaataaaatgacaggtctgtgaagcctggtgcacagctgacacttcttgctttcccagccccggctgatggaggcacagcgaccagcccctttcacacacacacacacaca

SEQ ID NO: 24833 - DNA, 1517 bp, Bovine  19866881373494
gtgggcccctgtctgagggaatcagttcgcctcccttccccttcctgtctgacctgggaggccggtgggccaggcttttgcatcctttttggggtccggcccagagtttggctggtgaccttaggaactcatctcccaagggattggcctgccatagggcttgtggcacctggacagtcttcgaggtggggaccctgcacagtgacaccaggtgaggaagggggcagcccagttcctcctccagcaggtggctctcctggctcctggggagatgccgggccttgtcctgatccttttccatttgaatcagccaggaacagctgacctgcccgcctgatccctcactagggcttgtgttggcaggcagaggggagcagaaggccagctgggagggagattgtgggcagatggaggtgctgctggcactggggagggtgtgcatgtgggcagtgtggagaggtcttggcctgggtctcactgcagggctccagggagtagggggactagtggcctttgtggtgccctgggaggcctgggcacatggcctggcagaactattcttccctgagcttctgtgcggatgctgccgtggtcacaggaagttcctcagcaccttcgagctctcatttccacattttataatatgtggataataaccacctctcaacatggtgatgagctcatgttgctgagagggcttgaaacaccatagatcactacacctaagtgagaagattattatgtttacttatttttattccacttctcaagtacttatttttcgtccaggtctttaatgcactttttaaaaaagacttccaaatggaacaggtcaggcaagtgaccacagggcttcttttgagtctttgtcatctcctgctgcagaggagaccattgcctctgccctctaactagcctcccagcaccaggcctggccgcctctgtgccgtcgtcctccacacagcccctggagggagcgttgggaaactgctcctgtggtctcgtcgtctttctgctccaaacctttcaggtcataactcacataagatatgtagcctgagttctatacaaggcaagcagctaggtgggagaaggatgaggcacagtcctgtccccgggctcacagtctggggctgctctgccactgagggaaaggatcctggctcccaagtcttctggtgtggacccctgcccatcatcctcacccccctgcctccccaagctccaggtgaaactcccagcaggtgcagttctcagacacacccaggctggtgctgggttccctgccctttcttcttcctcccttcctcttcatttgccagtttcctgcccagccttcacgattcagcctttggaagcttgcaagagatagaaatgccactcaaaatagcttcaaggaaaaggaagtgttttgattcacagaactgaagagctttgtgcaggtgctcagacagcaccaggacttgatctctcctatcttgtggctctcttgtcttccctggaagcttcattcttag

SEQ ID NO: 24834 - DNA, 1190 bp, Bovine  19866881442353
ggtggcaccagcatagcctctccctgagtgaccctgagcagtgtgatagggacacagtccatcaaccattcatccatccatcatttaccaagggcctcccttgtgccaggtcctgggctggattctgggggaccctcagagaccctcaccctgcccagagtcagaagtgattcagtgtcagttgcatccttgctcatgggcacaagaggtgcttatgagatgtgacacggggcccaaccgtgcctatcaattcttgatgacaccgcggcgggcctctacatctttgtcatgtgtcaccgcccccatgattactgtgatcactgatcatcatcatgcaaataccaggaaacgcggctgaagcgcctacatcatccccggtgttgagaagcctgaggaatcctgcatctgtcatctacattcagaaatgagccaaagtcatgacctatggcatgcacataccagtgaaatgcagcacagaccagtggatctgggaagcctctcaagaggcggagcaggagaggggtgatggaacgcctgggtgccctactgctgggcccagcctgaggccaggcatcctgagcagtgccacaccagccctcagaggacagcctgtgatgaggaatcacacctttccccttaggaaggaaactccaaaagacgcctgtaataagaccaccctggagaagcaggatacttgggggtctctgcctgatttctgccaccaccaccacagaggcccaggtccttctacaatgctgggcaggggcagggcatggaccctcccttcaaacccaggagtatggcagagacaggcctggcacttacagacaacacacaggaaacaagcacagggtgacacaacccggatgacctggactgtggtttcctgcagaggctcacacattctcacggcagggaccactctgcaaggttctggctctgatctaggaatgcatttcctccctgataactgacagccatcctcgttgagaaggtcatggacccctgccccacctctaggaatgagacccagcaggtaccaaccctctctgcataccacagcaaccacaggggtcaggtgagagtcggggagaagctcccctggaacctccaatcaaccatacacatggaaaggggcccaaaacagaaaacccaatcacacacacacacacacacaaaacagactaaag

SEQ ID NO: 24835 - DNA, 1187 bp, Bovine  19866880139212
tgcctggaaaatcccatggatggaggagcctggtaggctgcagtccatggggtcgctaagagtcgggcacgactgagcgacttcactttcacttttcactttcatgcattggagaaggcaatggcaacccactccagtgttcttgcctggagaatcccagggatgggggagcctggtgggctgctgtctatggggtggcacagagtcggacacgactgaagcgacttagcagcagcagcagcagcaaaaaattaaaagttaaaaaaaaaaaaaagaagaagaaagggtgaggaaaacaaagcctaggaaaacaagacctttcaaaaacgaaattactcaaagcttctttaaaacccgccaccagtgggaacgtgacattgtaattatataaccggtgagtgtaattaggcgcttcctttctgtccccacccacttctcccaggctttgggtttgggagaaggtggaagggggttcctgagagcctccagactctccgagtaacgccccacattctcctgcccttataaacttcctcaaaaaataggatttggatctgtctggagccaaaccctagagcttcccgtctatcaattaatatttacagggccttcacaatgagctcagccggcgcataaaagacaacagtcctgtagactgttattaggccagaggagaacaagcacctcgccttccctttcacaaggtggttggaagctgggtggttgtgtctgggtcaaaatgtatatccagacactcatcctccagacatttacagagagctggatgtcgcaggcgctgttctaggctctggaggtgcggcagtgagccacagaaacaccctcccgagaggagtggagggtggcccagagaagcttggggcagaagctggaggccgatgcccacccgcggagcccccatgctgtgtctggagcgaccagcctgctagagcgtagtctgtgcatttcatgcctccctttctgaaatccactctctgggctcagacatctgcagcttcaaggccagtgggcaaaggggtctgagtttagacatgagacgtgcgtcatctccatggaggaatcagatgcttcttggagctccagatctctgacctaaatgaaagatttggtctacagccgcaaattcatagcccagacttgagagcacacctgaatgtccagtacagatg

SEQ ID NO: 24836 - DNA, 1543 bp, Bovine  19866880234487
attcttcgatgctcagctttctttatagtccactctcacatccatacctgaccactggtaaaaccatagccttgactagacggacctttgttggcaaagtaatgtctctgctttttaatatgctatctaggttggtcataactttccttccaaggagtaagcgtcttttaatttcatggctgcaatcaccatctgcactgattttggagcccaaaaaaataaagtctgacactgtttccactgtttccccatctatttcccatgaagtgatgggaccggatgccatgatctttcgttttctgaatgttgagcttaaagcccactttttcactctcctctttcactttcatcaagaggcttttgagttcctcttcactttctgccctaagggtggtgtcatctgcataccctgaggttattgatatttctcccggcaatcttgattccagcttgtatttcttccagcccagcgtttctcatgatgtactctgcatataagttaaataagcagggtgacaacattttggcatagacctcactttatcttagaagcctgccatgatgcccagaaatgagctagacatcttacagatgtgcaggcacaggaatctgctgacattctcctacagcgcccactgcactatattgtaattctatgcttattggttattttctccctctagatatgaattccttgaaggcagaattgtatctttaacctttggatcatctacatatgtcatgaaagacattctaggaaaaaagtattaaagtaataattatatgaatgtacataattttctaaatggtgtatttcagttttgatgaggatacatagtttgatcaagattttgacataaattcatgacagaagtagaaataaaagtggcctaacccctggtggttcagcagtaaagaatctgcctggaatgcaggagatgcaggagacacgggtcaatccctgggtcgggaagatcccctggaggaggaaatggtaacccactccagtattcttgccatggaagtcccatggacagaggagcctggtgagctactgtccatggggtcccaaaagagtcgggcacaacttactgacaaaacaacaactgaaaaaaaaaaaaagagagagagaaaaaagaatagaagcaggaataagactagggaagacggaggctggggagagttaaccgaagttgctctgatggagaccctgaacctctgccagtccctgagaagcttgctgttgttgttcttaaggctccatttcattaagaccaggagttgggcaaggtgccctcctgattgctgggccaacatgctgctctgttattgctaccattgagaaggaaagggaaaaaacatatttggcatcatggcttagacaaatttacatttcattgtggaagattcctgtttgttcaactcgactcagttccaatctgtttcagtcaaataactttttatccttcttccacattttgtaggagaggaaggaaaagagaggagcaagagagagagatggagatagaaaatgagagagaga

SEQ ID NO: 24837 - DNA, 3542 bp, Bovine  19866880370201
gctttctggagttaactaaacattagatttcccatatggggaagactcgtgtgtgtgtgtgttgtgtgtgtgtgtgtgtgtgtgtatgtgtgttagcacacactatgaatgttacaaagttacatgcgagcagtggtatactgcttgttctgtccggatgtgtgcatgtagataacatgcaatataaaataatcattgtgacttggtcatttatatccagactctatttctttcaacagaagcttgtctgatagccttctgcgtgagaaatgaggctgaagcctgtaaagacgtggattcgtaggaacggggttatagttaacactttgtaaatgtatttcatagacatgtgcaaagtttaacatctgtaggttttctcagcaatgaaccatagatgcctgaaagctctctcaatttggcatcacatagaaaatgtcctctttttttgctctgcattgagagtttctttcccaggcctgtgttttccagacagtactgattcctctggaaacaacaggatttttaacatggctgctctaagagaaacctgcttaatatggtagggaatcagtaacatttgaagaataaaggaatgatggaattgtatcctgggctgtaggtaatggtcacctctatatttatttacacacggaggcactcttttgggtagaatattcacagagttattgtaccagcagtctggactcaacgggcaaattctttcaatgtctcatttatcagtaacttaaatgtagttaatcagtcaattggtattaggtaatgcaggagaccacctgcaaagcaggagattcgggttcaatcactgggtcggggaagatcccctggagcagggtatggcaacccactccggtattcctgtctggaaaatcccatggacagaggaacctgatgggctacagtccatgctgctgctgctaagtagcttcagtcgtatccaactctgtgcaaccccatagacagcagcccaccaggctcctctgtccctgggattctccaggcaagagtactggagtgggctgccattttcttctccagctacagtccatggggtcgcgttaggaggacatgaccaagcaattaaaccaccgccacgtacatatcacaaatctttctatcctccaaactttctttgtatgtctctcctaatcatctatgtaatcaatatatattgagggggataaaattaaagacttcattttctctgtgattacaggtttgaaatatgtctgcagtataaggatgtgggtaccaagtttgggaacaatttaatttccctcctgaaactatccctaactcttgaaaggagactggatgggccagcagagtgatagcacagtggtcaatggttgttattcacataaggtgcaagggggagtgggatttcctggtggtccagtggttaagacttcacacttccactgcaggagccatgggtttgatccctggtcaggaaactaagaccccacgtgctgtagcgagcagccgaaaaaaaaaagttgcagggggagatagcacactattgagcaccacccacgagctgagctgtaatctacagcagggttgtagtaagcatttttgcccaaattgggcaaatcaattgccagtgacgtctggccccagacatctgcctctaacagacttatgggggcgtggggacccagggctcagacacatgcattgttcactgtttacttcctctgcttattagccttgtgggtgagggcagcattaagcactggcccgtcgccttctagaactacgtggcaaaatgcagaacacactgtctcgtgtttggggctttaagagcctctgaggtgacctggtgctggggagaatttgagagcagaatggcttataaccatcgctcttggctaataattacactaatcttttcgagggaggttttgtgtgcatgcatgttccccctttcctcaatccccgagtcgagaacaatagaggaactgtgcttctgcactattccatgagataggtcaggggacagggtgcagaaggtctgcggtgaacgacccgccaggcatttgcccggagccatctcgaaggaacctgagactcgggcagtaggctttggccaaaccaaagggaaagagttcagcagctgagccttttgaacagcagctgttttggcggtcagcagatcccatgccctttggggagacctcaggagcaagtgcaaggcttgctggaagagaggagagggtgtgtgtgtgtgtgtgtgtgtaaggggggatggcaaacatgcttacccttaatgtcaagttgtcagctctatgagttaaaataatctacaaggctattcttcaacgaggacatgccctctgatgtagcaaatgttatttaaatattgtgatgagagtactcctaataatttagaaagtaagtactaagtaaatactcacgcctagagttcagaacaacaagccaagggttatgagacccaagggcaggtaaatctcccagaacatctttcacagtgtgcgggaatgtcccatcttctccccgaaaccgggcacacggtcccgtcaaacatcttgcatttgccacttgttttgtgaatttccacaggacggctgggcattgcagaagcaggctgcccacgtatcagctgggagaagcatggaggtttgctttaaattaatctgtattggagtatagctgctttacaaccttgggttactttctgctgtacagcaaaatgaatcaaccatttcttgttgtcactatttagttgctaagttgtatctctttgtgactccatggactgcagcacgccaggtttcccagtccttcacaaccatataagttcacatgacatggactgccctgggggctcagacagtaaagaatctgcctgcattgcaggagacctgggttcgatccctgtcttgggatgagcccctggaggaggaaatggcaacccactccaggactcttgcctagagaatcccatggacagaggagcctggcgggcttgggctacctccctgctcaggttaccacggaacttcgggtggagttccctgccctgtacaggatgtcctcattagctatctatcttacacatagtgtcaacagagtgcatgggtcaatcccaagtgcagaggattttaacgctcctctgcctctctgccctgggtttcccagttacccactttcgggggtgttttcatctctccccgtctgctccctgttcggcagctgctgggtttaggaccgaggaagctggtgtggctggtggggagaggacgttgctagtgtaacctggcagggctgcacgctgctggcgttgaagtgcagtgaaaacgagaggcgggggggaagtttccacggcggcggcaggacaaggtaacctagctggtggctttgatgcgggatgcccttggggagctgcttgatctgaatcagactgagagccgggcaaggacacagtttctcctctctcagaccccgggagttctccagcctacctttttccggctccccacgagcatttccaaattgaa

SEQ ID NO: 24838 - DNA, 1474 bp, Bovine  19866880473662
taaattaatgaagagcaacgggacttcccctggcggtccaggggttaagactctgcctcccaaggcacagggtacaggttccatccccagtcggggagctaggatcccacgtacccatggctaaaaacccacagcatgaagcagaagcaacattgtgacaaattcaatagactttaaaaaatggtccacatcccaaaaagaaaaaaaaaaaaagaacaaagggagagaacttgctgaaattcctactctgctctcttccgggtggttgcgagagttgattaaaatgacaatgtttatttttgcggttgtttctggcatctaaagtgtgacgattaataggttctcggcttctagaagcagcgagcagacttatctttaactgcgctgtgcatatgtacaaataagtgttgctttttctggtatgcgtgtgtgtgtgtgtacctgggcccatgcttcctggctggcatatgtatttatgcacaaatatgtgcaggactataaataaaaaccacaaatgaatgccttagagggaagcatgagggctgccctttctgcttgctgccgtcagcgaggcaggcgcctctgcttaggcagtggagtcaggaagagcagatgcgggaggggctggtggaggctgctggggctctgggggcttctgttggcccagtgggtgagtcttcctggtgctgactttaaagatgaaccctggttttgaggctccaaagtcatacagtatggcctcaaagacagactctggtaatcctccacaggtcttcctacggacagcgtttgtctgggtctaagaccatgtgaagacttccgggaaggtagactgggagggaccccttgtaagcagaaacagtaaggaatggaggggtctaggccttcgcagtccagtggttacgactctgtgcttccaacgcagggggcatgggttcgacccctgatctgggaactaacatcacacatgctgtggggtgccgcttggagaattccatggacagaggagcccggcgggctgcagtccactgggttggcaaaaagtcagacaggactgatcgactaactaacactttcacttttccttttgtgtgtgtgtgtgtgtgtgtgtgtgtgtgtgtgtgtgtataactgactcgctttgctgtacacctgaaattaacacaacattgtaaatcagctatactacaataaaagttaattaaaaacaaaaacagtaaatcaactctactccaataaattttttttaatttagcatagaaaaaataaaaaaagcaaatcttaaatgtacagctcagtgaatttttctgtatacctccatggaaccaccattcgagtcaagaaatggaatatttccagccttctggaaggtaccgccttgtcacctctcagtcagtaatgctccctccctccttctcttagccattctatggttaatcgtactgttcaggtggcaaaaggcaaggcttacagt

SEQ ID NO: 24839 - DNA, 1458 bp, Bovine  19866880487489
atacatgagtatgtatatcacatacatacgtgtaaacaaggacaagagaagagctttggtaattttattgcatacgattctgtttactcctatgaacttcatgctctgagcactgtctcctgtcagtacagaattttttataaacagttttaagggtttggtggtaaagcacttcgtgggcacagcataatgtttctctcaggattatacaagaaggctgttttcaatttttcgctattataaacaagctacaatgagcatccttgtcccaagcctgtagaatttgtgaggatgaaaagggatgatccatgtaaagtttcaaatataagagtgataaacattcaaaacgttatcctttccaactctctggtttcacctacttttctccttctctaattttaatgtattttccccctaagcagtgacatttgattttcttgggcttcagaatcactgcagatgatgactgcagtcatgaaattaaaagacacgtgctccttggaagaaaaactgtgacaaacgtcgtgtgcgtacttgctaacttgctttggttatgtctgactctttgcaactcgatggactgtaacccaccaggctcctctgcccgtgggattccccaggcaagaatactggagtgggttgccatgccctcttccaggggatcttcctgacccagggactgaacccacatcttctgtgactcttgcattgcaggttgattctttaccatttagccattaggggagcccaatattcatgtatgcacacatatatctgaaagtcaacaatattctaaatggctaataggttcatgagtgatatttattttcttcttcacacttttcaaggtttcccccaatttttacaatgagcctaattactttatcaggtagtcaaaatatttcatggaaatagtttatttacaatatgcttttcatgcatatctctgaacacctattcttccccattataatgctgtcatcagtgggattcagcagttcacgtagagattttttgctcagttatcccaccctcgtgagccaatctccttgagtctgtgcggtgttccagatctagatgtgactttccattcatctttgcagctttggccacctccctgcccaaagctctggccctggggccaagtccctccgtctctttccagcccaccattgccagctctggccctggggccgagtccctctgtctctttccagccaaccattgctagcctccttcctgcatctttacctggtgctgctgagttcttagactgctcatggccaagccaggataaaacaacagcctctggcgtccttctggccagtttgtagctacgaggaggagcagcagccgctggcggaaaacatgtcaaatagccctggctcctatgggaatcacagaggtaagcgttctcaccccttttagccacctttcacatttgattatttttttcga

SEQ ID NO: 24840 - DNA, 1105 bp, Bovine  19866880516540
ctgaaggtgggcggaagttgtgtgtgcagatggctctctttctgactccatgtctcagaagtgttgacacctaaaggcacagctttgagaaatgctctgtttagaaagggttggcaggtggcctagactgtgttcccatcagctagaatgtcttagaaaagtcgatcagattgaaattctggccttcccctttctgtggaccctcatcccctcactcccctgcctcccatttatgctgggggcatgactcactttttctctgtgaccccttgacaatttagatttacatctttaacattcttttctttttaaggtccaatgtaaggcatttgcaggaatcaatatgggtccaatgcctaaaaaaaaaaaatcctaaattatagtagtagaggtaaacagttgtatgggacttccctggtggctcagacagtaaagactctgtccacaaagtgggagacctgggttcaatccctgggtcaggaagatcccctagagaaggaaaggctacccactccagtatccttgcctggaaaatcccggggactgcaaataataaaacttttatagcagtggtttcaaaatgcaagacatttaattgcctcacatggaagtctggaggatagtcgtgcagggctaattcagtgctgaataatgtccccaaattcatgctcccttctacctttctacactgccctagcttaatttgttggcctttaacccccatggatattgtcacgtggtcacaaaacagcttctgcagctccaggcattatatctgcattcaaggcaagaggaacaaagaaattaatagtactagctgtatctgtcccttctatcaggacaacaaaagccaatcttaaaatatagatcagagctgacaattattttcagggaaggccaatgcaatctaaggttagttccaaattctgggttcattcatgttgctggaactttttctctcctcccttccattcgtgtagagggaaccctaggctctgggtcggggctaagttttcctcctttccgctttgttgtcgatcagttgctcagtcatgtccaactctttgccacaccatggaccgcagtacaccaggcttttcctgtc

SEQ ID NO: 24841 - DNA, 883 bp, Bovine  19866880528863
tctcccgcattgcaggcggattcttcaccagttgagccacaggggaagcccaagaatactggagtgggtagcctatctgttccccagcagatcttccgacccaggaattgaactgggctctcctgcttgtaggcagattctttaccaactgagctatcaaggaagcccagaagtagaagttggtttaaaccaacaaatatttatgtgctgagcaccagagtcacttttcgctggggattctggacaagtgacagctgtgtccatcttagccttgatgcctaaataagacagctcatggtgccctggtaatggcatgtccccgggggtctaggtgtgtgctgtgctcagccccagggagctcctgaagccagagttgaatccagtcctctccttgacttttgagaggacccagcacaggatgcagagctctgcagatacctcagcgccctgcggagccacactgagcaaagaggctcccctctaagcctgtaggctcctcgctgtctgaccccaaccatctaccctcgattcaaattacaagtaggattggaagccaagagccagccaaatgcatcatggttcccgctaaggagataaaccaagctgccagccagcagggcttggctacaaaagcccatgaagctgcaaacttatcccgagaaggtgatttgggggggtttgtttctacatgcagcctctctccctgcagatgctacgtgtttcttcaagtgcttttatacgcgtagatgagcgctgttgttgggcgatgtcttctgtgaagctgtaagttgcatgcaactggctaatctcactggcttcatttaagataagggcaccaccattgggtttgggcttcattaagtttaactagcctggttctctc

SEQ ID NO: 24842 - DNA, 1385 bp, Bovine  19866880554024
ccgatgctcagggcccctgaccctggggctaacttcccgcccacttctcgtgactcatacctttcatcacgtctcagaagagaggcgcctgtcacctccttctccctgaggctggaagggccttgggcagaatctgagctggaacccagagcagccggcaccaggaaccacccctgagcaattcatgaagctgggcgctctgcttccagccgagtcctggacctttcctgcttcccagccccgttccgcccttcctgctcgaagccttccaaagaggaaggaagcctttctcgcttcttttgcctctgtcctctttgagacatgattctgaaggacgctgaggattctttgcttcggagggaagaggtctgtgtttttcgctggcagtgtgcagcacgaacgggcaggctcagcgctggccttgaaatgcagaccaccggcgtctcgcctccctccgcgggggctgacccttttcctgcgaggcttccggagagggtcttcgctcaaaacccaaccagagcccttgccaatgtgcttgggggaggaaagcttacttgacatcagccttccagtgcattcctgtaattacagctcaatgctaaagcgctaaatggttattattatgaagccagggtgtttgctgccaaggcgataggaaagacaccaacacgaggtttagggaaatcaagggtttttactggatttgagactaaggaggggaggcgagaacaagagatggagacctttagtcatgtatgcaaaggcgccttagactggtgacagcagagatgtagaatgtacaaatacaggttcaggtacccattttcaaggattctggaatatataggcagcttcaatgttgaaatgtatgcttccacaaactcttcgtggaattttcacccaaagacgtctagtgaaatctgggtcgctcctccccaaaaggagctcttggcctgtggtcagatcattctcgattccagcccacactttccctgttggcgcctgcatcgctgcctggcgtttccaaccctgggaatgttgaacccaggacaagggctagcacacaggaatgggagacgggggacagcgtggagaacggagaagggggcgtgggaaggatggggaaaggactgggagctgaaatcaagctcggagggaagctgaggccgaaccagttgaggttgtttttcctaagagggaccatccgagcagcaggagggagatgtgttctaaccgccgagatgcctggagtttctgtttgcgccgctgctccccttagcttcctgtgagcggattcatctcatggtggggagcaagcaggcgctgatgagctaatgttcccaggaactcggaaggagggcccgcctttcctgccagggcagcgt

SEQ ID NO: 24843 - DNA, 2743 bp, Bovine  19866880567597
taaagaatctgcctgcagtgcaggggacccaggctcaatccctgggttgggaagatccccttgagaagggaatggcaacccacaccagtattcttgcctggagaattccatggacagaggatcctggcgggctacagtccctgaggttgcaaagagtcaggcatgactgagcgactaacgctttcaatggagacgcacacatagagaacagacttacggacgcagtgggcggcggcgggtagggagaaagtgggatgaatgagagggcagcttggaaacatggaaaatagatagccagtgggaatttgctctgtgactcagggaactcaaattggggctctgtgacaacctagaggggtgggatgggatgggaggtgggagggaggctcacgagggaggggacatatgtatgtatacctatgactgatctgtgatctatggcagaagccagcacaatgttataatgatccttcaattaaaaataaattaacgaaaagaaaaaaaacaggagtgagttagtgaacgctgactcccaccccagctggggttggtgcccggccctcctgctgcagaagcccatgatctttcctagccagtccccggagggggagcaccgtttatttttgtattgtgtgtattttgtctggtcaactgattccttgtttcactgagaaacttatattcgtgtgtgtgctgtgctgagtcgctcagtggtgtccgactctttgtgaccccgtggactgtagcccgccaggctcctctgtccatggaattctccaggcaagaatactggagtgggttgccatgccctccgccaggggatcttccctgcccagggatcaaacccaggtctcctgcattgcagacagattctttaccgtctgagcccccagagaagcccccacttacatcagtagtcagctctagtttatgtgctggataattttttaaaagagcttttttgaaaagctttttgatctttggagatctacagatttatttccatatgaactggttattttgtataaagtacagtcttaaaatagaaaaaaaaaattatctttactccccaagggtcagtagacattggctgggagcacggtagtctgaattattagaaggaaggactctgaggaaaggggaagcaactgtagaaccccactgtttcagcttttaaaaggagagttgccttgaaagctttgtgtttcaaaagtgaccaacggtggatgtttcagagcctcttgaagagtgcttgtcccaataagctgataccaggtcccctgccctgtgtcttaaaggtactggattgcagctttgcttgaggcgccctggaggaccctggttcattccatctctcatagcactgcttccagcatccccagcccttaatctctccgcccatcatttatagatctcacctcctacccaaatagaagtagaggagcgaatgtttaagacggttcgagaagcctctgtggatactccctggtcatcgaggaatatcccgggtatgttcccatctcaaaaaaataccccagaattcatcctgcaatcttttgttctcacaggctgagcatttttaggcctgcggaggggagtttattttggtatctaggactccttctccctcttgatggaaaggcaagacgtgtaaaataagacatatatgtgggagggtggatagagcatttgcctttgaaattgggttatttacagtgagacaggaagataaatgtaaagactgtgccagcacaggctgtaggccaattgtctgggacagccggcctcgcaggcgtctgtagttacagtattaactgaggacaggaaggacttcccgctggctcctcgggcacactcagagcctgaaccgcagctcccaggcgtgtgtaggcagggcagggtacgtgtccatcagattccagctgggtgcccaggcccttgtgcccgcattcctgtccagtgaattcctaaaacccaactcagtggacgtgagtttgagtaaactccgggagttggtgatggacagggaggcctggcgtactgcagtccatggggttgcaaagagttggacacgactgagcgactgaactgaactgaaggttgtaccacgagacctcagcatgtgctcaggcccctgtgaggctgtttccagacttcttgtaggtttctggtcttttgccccatcatgacccctgggtgatgtgacaagttagagaagatgaatatttagcgatctgaaggacgagctttgaccagtccgaagaaacttgtttttgagcatagaagagcatttctagtcaagctaatatattgttatagtgtatataactgtcagccaattcccaggtggctcagtggcagagaacccacctgccaatgcaggagacgtgggttcaatccctgggtctggaagatcccctggagaaggaaatggcagcccaatccggtgttctcacctggagaattctagggacagaggagcctggcgagctacagtccttggggttgcaaagggtcggacttgactgagtacacacgtacagtgaacatctgttgccccttgggatcccagtctgacccgggcgcctcttgtctctgaatgtccgtctcccatccctttgcaggccagcctgctgccttttagaagttgttgctccctttgctgtgctctgtagttctctggatccactgtcttgtcccggtcacctttccctactgtctgagctgcagactatgtacgtcg

SEQ ID NO: 24844 - DNA, 2767 bp, Bovine  19866880577611
ggagtggatgactgttggaactgggtgatgggtacgtggggtttgtgacgcccttctatttacctgagtgtaggttcaaaacccttcacgagaaaaggtaaacaaaaccaacctgcaaagagaaaagagtaaagaatgaacctaccagcgttgggacttacacaggcatcgtaaggcggccgatcagacccagccgtgcttgtaaatggtactggctttgctttttttttagtccagacagcacaaaggtgagtcagtgcctgcccatgctggacagtgagccactcgtcattttcggttaggatccagaccagcagaccgtcactcacaaagtatgtctgctatagtacagagttacgtcacacagtagagaccagggggactctaaaggaagttgctaaactcgggatatactgtaatcaaggctgtgaaactgaaaagtgaaaaagtcgctcagtcgtgtctgactctttgcgaccccatagacaatgcagtccatggaattctccaggccagaacactggagtgggtagcctttcccttctccaggggatctttccaacccagggatcgaacccaggtctcccgcattgcaggcagattctttaccagctgagccacaagggaagcccaatcaaggatgcagggatgatttttaaaaagacatcacacagagaacaggctcgtggctgccaagggcaagggggcgtcagggagggatgcagtgagagtttgggcttagcagatgcaaactatgatatctagagcaaataaacaaagttctactgtacggagcagagaaccatacgaaataccctgtgatgagctacagtggaaaagaagatgaggaagaagcatcttattcttgatccaggaagatcccacatgaagcagagcaacaaagcctgtgtgccccaactactgagcctgtgctctagagtcggggagctgcagctacagaagccatgccctgcaagtgaagagtgtccccccaccccactgcccctaggaaaaaagcccctgaaagcaacgaagacccagcacagccaaaaacaaaataaattaaaaaaaaaaattttttttttaaaagacgtcacaaagacattaagtagaaggaagggcaggtcggctagctagaacagctgacaaaaatcccttttcatcacctggtcctctcaggtaaagcagcgaaggagcctgaaggacttcgctattatttctgtagagatttttgagaaagcagcggctccattcctaactggcacattggaatcctaacgcactaatggaatttgccgcatctttgctgttactgttcgtagcggatcgaggcgaccattagagagggaataccaaaaatcaccagttcaatactttggccacctgatgcgaagagctgactcatttgaaaagacccctgatgctgggaaagattgagggcaggaggagaaggggatgacagagaatgagatggttggatggcatcaccaactcaatggacatgagtttgagtgaactccgggagttggtgatggacagggaggcctggcgtgctgcagttcatggggtcgcaaagagtcggacacgaaatgagcaactgaactgaactgatacctgaatcataacaccttgacatccgaatgcacaggtcgtagcttctctgctgattggcacaatgctgaccttcttctcgacttatttaagcatctgatatcctgagctggctcaagttccctctacatctgccaacaatatctgaacgaagaatggtattgacctaagcatgaggcatggtcaaggagcaggacatcgagggttcatgggtcatatctccaggggccagacagctgggatcagcctccctgacctcctccctctagaggagggagaccatgaacgctgaactggcagtgggaggaacctgggtgtagggggtggtggccgccctgggcagagaagggagtgttttcgggggagccttgtaccctacttatttgctgcacttttccaaaccacaaagccctgctaggagctcccctgccaaggctgattgcaatctgccacgctatctgcattgtcatcaatcgtgcagacacgaggttggtgctgtgaattccaagggtgctccgttggggaatcgtgccttttcccaaagccaggttgtctgggcatctaggtacttttctccatcagtgccggggttgtcaggtgcatctctgttaacttccctctctcctttccaactggccccaattctcctcagtcctaacctcaactcattactgcccggggcggggcgggggggcggggaggtggtttgcagaaactaacgcctgtggctggtaatttttatttgggccagcccaaacttaattctgttatttcactaacactttgcaggttattacactccatagttacactgacacacctgtgaagacttctgcagcgcccggagtttcattttcactttccgtatcagaatcaatcactaaggtttcttgtctttttgttggtctcatattcatgccgtctgaatcagaactatactctgaagatctgtcaccatctgagacactagtacatatgtcactgggaccatcgaagaaagtagctgcacaaaatttaccgaaaaattcttcactcagaatttctcgatgtgtcattttttttaattttaccgtattacacttgcgcttatacatagggttggaacaaaaaccaaacagagcaaaatgtgaatgataacgacaatcgttaagttgta

SEQ ID NO: 24845 - DNA, 1879 bp, Bovine  19866880581434
ccaccagggaagcctcattagtgagactgcctactcttttttttatgtgaaatctaggaaacccagcgtttattttcctcttgcagcacacttcaattcgcttgtcacatttccagtgcttctgtgctggacagtgttgccctagagaggaagtttaagtgattaaatttggggggagggaactattcatcgtagacagaaataaaaaaaatgagcttaaggacttaggtggacagatttcatcagcaaatgcccttgactggctgtcagcgcagtgcttccatctccccagacagggcctgttcgcaggaatccattggctgctgggctcccctcccctgacccctttgtcgtccactctattcgcttttgtttcaaccgaatgagcacacaaaaaagcctgcattccgccgggcagtcttattcaaacgtggcatggctgcgttttctcaattaatcaggagcctgcccccccacccccctgcccctttctcctccacgtttttctcttctcggcatcttaatcagggtccagctggactccagcttccaggagaatttcgagggcccgacagacacttgcccaggtaaataaaaaccagcttgggtccctttttcctcctgcatgaataagatgtatcagaagacttttccttagaagagatgaagggagagagaagcagtcatgctggtgaacgacgtagggctgaaagcagaactttggagagacaggctgtgtcctttgggtgagacggggcagggagagggagtccaggagggaggggatatgtgcgtacacctggctgatccccttggtgatacagtggaaacaacgcagcgttgtaaagcagctgtactccagaaaacaaacccaaaagagcaaagcaaaattttaaacacggtaagggcttcccaggtggtgctggtggtagagaacccgcctgccagtgcaggagacataagagacgcaggttcgatccctgggtctgggaagatcccctggaggagggcatggcaagccactcccaatattcttgcctggagaagcccacagacagagacctgaacagctacagaccatgggtcacgaagagtcagacacgacgtagccaccgagcatgctcgcgcgcgcacccaacatcctacaaggcacagggcagcgtccttccataaagagttacccagcctaacaggtcaggagcaccaaggttgagaaaccctgtgttggagcatctttcctttgaattttagagacttttcacctaaaaagaaccttcttttgacttacagaaggcactgggaggggttggctacacctgtgcatatatatgactgaattactaccgtgttgatccgttcacacctgctggggctttgtgggcagctagttgagaataagacctggatccaggaggtgtctgggccggggacaagccaggtggggatgagagctgagcggccacacaaactaaatgtcacaacttttctagttttctaagagagtgggtgcttccctgggcaaggtcccagttctttctcaccaaagccttctgctctatgagcaaaaccccagtcaagtccagctggggatccattagctgcatctctgaaggtagaataatggatcggcttttcctgacactgtaagtaggatgctttgcatagatcaggcaaaggtgagccctccaccttcccattgctcttagaagggccagaggcagccagaaacgtttcatggcagtccctgtagggaaagagaacgagggaaaaaaggagaagaatgctcaacctactggtctgtcaaacccgtggtatgacttgaccttcaggtctacctcatgttggctggactctttttgcctggccacctggtctcaat

SEQ ID NO: 24846 - DNA, 5242 bp, Bovine  19866880589013
aacgagtaggagaaaggagaaagaaagaaatctttctaaataggaaaaagtataggaattcagagtcttcccccatggctcagtgggtaaagaatccacctgccacataggagacatgggagaaaaactgatcaaatttcaaaaaaaatgttgtttcatcatcattatcattagaattttagttagaaataaatacccaaaagataaaaaagaagaaaatagataaaattttaaaagtaatttttctgaagatgtgtgaaggaatgataatagagatcagaaaatattcagcactaaatgtaaaactctaaagcaacaatacatgaaagtactataattatacccttgaaacactagtggaaaataagttgtataaacataaaaataaatagctatataagtgtaaagcaagaagtcaataaaataataaaaaatgtaatacaaaatattctcaaatagtagctttttgaaaagaaaaactaatgaattagagaaaccactgacaagactgatcaaaaaaaccaaataaattaaaataagaaatattaagaattaaaaaggaaaatacagtagtgattttcataatatacataaaaagaatgtattatgaataacagtttaagcttggaaagtttagagaaaatagataatatactagaaaaatatattttaccaaatttaactcaataagaaatagaaaacattaactaattgtaaacattaacagtattgaatcatatagttaaaattttaatcccagagaagaaggaaggaaagaagaaagggggaattagagagttaggggaaaaaagaaagaaggaaagaaaaagaagaaaggagtcaaagtaaataaagctccaggaattgatggggaaataaataatacttacatataaattgttctagggatctgaattagagcaaatgctttcaaatcaacgtgtggaccagtacaacactgtgttgtagtaatatagtccataaagattctatggactggtgattatagtaataattgtagtaatgtagtccataaagattctatggactggtgattatagtaataattgtagtaatgtagtccataaagattctatgcactggtgattatagtaataattgtagtaatgtagtccataaagattctatggactggtgattatagtaataattgtagtaagtgtagtccataaagattctatggactggtgattatagtaataattgtagtaatgtagtccataaagattctatggactggtgattatagtaataattgtagtaatgtagtccataaagattctatggactggtgattatagtaataattgtagtaatgtagtccataaagatgctatggactggtgattatagtaataattgttgtaatgtagtccataaagattctatggactggtgattatagtaataattgtagtaatgtagtccataaagatgctatggagtggtgattatagtaataattgtagcagtgtagtccataaggtttttactgagagtttccctggtggctcagatggtaaagcgtctgcctgcaatgcaggagacctgggttcgatccctgggtcaagaagatcccctgcagaaggaaatggcaacccactccagtattcttgcctggaaaactgcacagacagaggaacctggtaggctacagtccatgggggttgcaaagagtcagacaggactgaagtgactttgaacgcgtgtaccactatgtataaaataaacagcaaggatttactgtatagcacaggacaactatattcagtatcttttaggaagagaagtggaaaatatatttgtataactgaatcagtttgctatatacctgaaactaacaccatattgtgaatcaactatacttaagtaacacaaacgcccagtgaagtaaatctttatgtgctgacctggaagcttcttcaagacattctgttaagtaacaaggtccaaagcagtatgataacttcagtaatgatcataacgatcagactgggtattaggaataaacgtgggggaaactcgtaaaaatttaaaaaataaaagaggtgatggtggaactgagcttcgaatttttcaactaagggagctttttccctcgcctcgtttgctctgcctgctgggccctccaccccagctcccagcccctgctggtcacaggctgtgctgtgcggtttgaggatcccgggggttgggggcggtgggggctgggagtgaaggcagcctgggagcagcagcctcggctccagagtcagccccccgggatgagctcggaggtgagcctgaggaatggacggaagccgcgggcccacgggtgacctggctgggagcacgggttatgaatcacccccagcctttgctcctggctctggaggagtggctcacacattcccaagggagccagtgtctgggagacgtgacgtcgtccctgggagaggagtttcaaccacattggcctcacagggactggttcccatgggtaacacccagctcctcagcctgaaaaatcccaggctaaggagatggggctctgactttcttgtgtgtgcgtatgtgtggtgtgtgcgtgcgtgtgtgtgtttgcattttaaaatacctgtctcacctattatgggacctcatcattagctactgacgacccgagttcaatccctggcttggggaagatcccctgaaggagagcatgacagcccactccagtgttcttgcctggagaaccccatggactgcagctcaccaggctcctctgtccacggggttgcaaagagtcagacacgactgagtgaacagccgctgtgtccgtggaggctggtgaggacccccatcttaaggatcacaaggaggactcggctctgacagagagcccgcctgtctgtagccgtcccaacatttttctcaaagactctccctccgcaaaatcctgctccaaacccatgatttgcaagaaacattcccgatttgaccatggtgtctcctcattggcccacatgctcgaatcgtgtggttagagggagctggcaaactttaattgatttcagaaaggaccgaccagccctagacagctgcttatttctcccagcaacagccttagagccctggcaccttctagataagtcagtccctcaggccttcttctgcatggatgcttcgtaagagaagaagcagacatcacagcagcttctctttccaccaccttctgtctctctcttctgaaaaaacatttatttggctgagccaggtcttagttgcagcatgtgggatctagttccctgaccaggaaccgaaccctggtcctcagcattaggagcacggaccaccagggaagtcccatccactgccttttctcttacaaacctgactcccaaacaatcagataggagatagcccttctcttcacactggtaccggtcattgctgaattaacactgttttatactttcataaaatctttatttctgctcacctgtgataccttcctgttgaaaagcctgtagctttccccaaccttccagggtaacaagaactggaaacctttaaggtagagcatctcttgaggatatgtacatactaagttgctctagtcgtgtccaactctgcgacgccatggactgtagcccaccaggctcctctgtccatgggactttctaggcaagaatactggaatgggtgaccatgcccttctccaggggatcttcctgacccagggattaaatccacatctcttatatcccctgcttgacaagctggttctttaccgctagtgccacctggaaagggaaccaagaagagggggaattcagtgcatgcctccttacgaatccagtgaagacacagcgcacagtgctggggtttgcgtgggggtcaaccacgtggcgtgtgaactgggggcaagacttggctggggaagccaactcatccatgatgcttgcgggctcactggtttgcaggcctcactagtacacactacgtatttaaagcaaagcaaagcttccagaaagcaataacttgagcttacaacttcatatttagaaactccttgagtccagccgtttcctgtgtcatgtgctggtagcccacatgggcgcctatggtggtgcaccccagcatgtgtgcatgtgtgtgtgtgtgtctctcagtcgtgtctgactctttgctatcttgtggactgtagcccaccagactcctctgtccatggaattctctagcaagaatactgaagtggggaaccattcccttctcctggggatcttcctcacccagggattgaacctgggtctcctgcactgcaggcagattctttactgtctgagccaccagggaagcccccatcccagccgagttggtaggaatttccaggcaacacccctaaccccccaccatctcctcttgttcttgatgagcaggtgtgccttgggggcctgcagttcctcagaagcagcgagagggtgtttgtccctgggatgctgagctcacacctaggggcagggatgtgagttgtttgtctcgccccctggagggcagaggggcagagaagggggcccccggtgggcacagccatcacggaaacgaccagcgctcacacgccgtggctgtccttggcttgtggaacattccctgaagcactggatttcttccccctcgtctcagactttgttttctgtttcctttctgccacgctccttctgaaaacgagagtgtcgtggagccaggctccccgtggggggcagtttgcagagcgtctggagtgtgggaagcagagggccgggtttcctttcaggccgtggctcagctgttttctagtttatcctgtcttgggtaccaaaccctggccaagtctctcattttccaagcttgctgctttctgaactgctgtcagggattaaggcttgaatacaggtgggtttcttccccctccggtccctgtcacctggacattaccatggcgataatcctcccctgaaacaaaaataaaaggcagaaccggttggacagaaagtgcggccacaaacctccattgagactgagccatccggagcctgggggctgccaggagctccttcaggacgggtcctgaggagcaggaggcagaggctggctggcacaggggaagggtcagccggccatcagactgccctggagggaagagcttcagctcggttccttcgtgggtttggtgggggtacgttgctctgcagcccggcagtcctgtctggcctcccca

SEQ ID NO: 24847 - DNA, 2226 bp, Bovine  19866880668698
ccctggccagggaactagattcctcatgccacaactaaagttcccgagtgctgcaatgaagtcccagcacagccaaataagtcaaataaataaatattaaaaaaaaaaaaaagaatttggaggaagttaggcaccaggagaaaataaagtttccaacttaaacttggactttttcccccctttgaaagaagagaaaatgcctcacccaactggttaataaaattagaattccagatctttccgggtgccttgatagatccctttagaggaaactgctcccctgaagccaacagtgctcagaaattacaaccggtttcagcaattaagagaagtaaaacattaaaaagcatgaggcaaagtacatttgcatgctaatggccccttctgtagggctgggaagctgtgttttacaacaaagcagataactttcccactagagcaatattaacccctgggttctcactccagcttcttggacccactcgtaacgtctgggattcttctggccccgggtgggcaagatatgggttaactctgcatatcaatccatctgctatggcctaattctctctggcttgggtaggagaagaaagagaaagagaattagaagttctgaatgtgtttgggaggagcgggaggaagatagaaagatgcaccaggggtgggaaaaagcgcttccatagaaagcacgctggaacggcaggcgggacgcggacttaagtccagctcccctccccctggcgatgtgacgtcagacaccacggtactgaaatcctcggggactcagtttgttcatggagtggggtggaatgaggattggatgaggtaatgacggtgactctctgccgctggtgacgatcgtggttatggtaaggggctggcaggtggtatttgtggtgtttcaggaggaacgttacaaaggccttttgggtacaaccctgtgaggaagtgctgtggctttactgaagatgaaaagcagtccttgctgctccatacagagtgtatgaaccttagaataagggcagattatggataaagactccttttctttctttccagggtggaaaccacctcggtctctgattccatcaaagacggcagccctcaagactacaccatccgcctccaggaatcaggccctcaagactacaccacccgcctccaggaatcaggccctcaagactacaccatccgcctccaggaatcaggccctcaagactacaccatccgcctccaggaatcaggccctcaagactacaccatccgcctccaggaatcaggccctcaagactacaccatccgcctccaggaatcaggccctcaagactataccatccgcctccaggaatcaggccctcaagactacaccatccgcctccaggaatcaggagaatcgggatggtggagttcaaggatgtgcgctcatctcctgcgagaacaccaaaatcgcaactaactgctgaacaactaccgacaggaggctgttggaacgcacccagaaaagataccccacgtcaaggacaaaggaaaagccgcagtgagatggtaggaggggtgcaatcgtgttaaaatcaaaccctgtgcccaccgagactctgagagggcacaaacgagaccttgtgtgcaccaggaccaagggaaaggagcagtgaccaccgcccccccaaaaaaaaagacggagtcagacctgcctgtgagtgtttgacggtctcctgcggaggcgtgggtgagcagtggcccgccgtggggaccattggcgcagcaactcctattagaagacgtgatagcacctatggcttgggtttgggagctggatggatctggatttgagatccacttgctttgaaactgcccggctgtgttcctttgaataaacatcttaacctctccatgccccagtttcccactgtaatgaggatgataaaaatctcactcatttttatgtggaggttctgccagtcagcactcaatgtgcccattattaagggtcagttcttgcttctcttttaaaaatacatttttcccccttgcctttccccatgacacaatgaggaagcaatgcccaaagggtgtcctctcttagattccaagctaattcattgaaatcaagttaaaaaaaaaaaaaaagaggaaagagcagtttctattcacccaccagcatcctcgtcactcccactgctgatgggaaagagaggccgccggaaggaagcgaaagttcatcaagga

SEQ ID NO: 24848 - DNA, 1641 bp, Bovine  19866880837394
agtacttgggaagcttcagatgtgtcagtatcagtcaactaatggaagccatgtgtttgcagaatgggaaagaaaaaacctggcatcttaaggatctagacatgtctcactgtaaatgggtctaaagtagagacttttttgaggccttttctcggtagatctttggccaccctgctgtttaacagttgataatgctattcaaataaccctgctccaaaacaggaatggccctttctccaagggccaaggaagcagccgagatttattgagtaccggttttattgttcagtcgctaagttgtgtctgactctctgcaattccatggattgcagtactccaggcttccctgtccttcactatattgagtttgctcaaactcatatccattggggttggtgatgccatccagcaatgtcatcttctgttatccccttctcctgccttcaatctttcccagcattcgtggtcttttccattgagtcagttctttgcatcacgtgaccaaggtattggcgcttcagcttcagcctcagtccttccagtgaatattcaatgatttcctttaggatcgactgatctgctctccttgctgtccaggtaatctctgatcatcattatagtaagaaattgcagtgcgtattgggtcctgtgcaatttcttactataatgatgatcacacagattgcatctgctgttacgaatttagtgcatatacctaataagagctctgtcttcactggatttatttaatcctgaccctaggtggggaggtaggtgttatcatcttcatttatggaaaggacacacttctaattgagtaacatttctgctggtggagaagaagtgcaggggaagaatcagtacagttttatatgctccctcatgggacagcagattggaaagatggaggtgatctcccctggtggttgtgagttcgatccctgctctgggaagatcccacaggcccggggcagctatgtctgcgccccgcagctactgaagccctctcgccctggagcccatgctccacaataggcccctgcagtgagaaagccacacactcgaggaagccctctcacagcaatgaagacccagcacagccagaaataagtaaatatatacagaaataaaatttttcaaagaaattatgattctaattttatagctcagagagctgagatttcgagaattggattgaattttccaaggacatgtggctggttaaatgacagtggagggatcttagcacgacatttaaaatagtctggttggtcttctgtgctttaccacagggcagtttctgtgatgaggaggatttgatgtcctgatagacagatgagacacacacttcatgaacccctgtaacagcatagacataaggagaaggaagggcttcctgggtgtgtagaggtaaagaactgcctgccaatgcaggagattcaggagatgtggatttgatacctgcgtcggggaagacccccccagagaaggaaatggcaacccactccagtattcttacctggaaaattccaagggacagagggagccctggcaggctgtacaggtccatggggtcacgaagagttgattgcaaatgagcaccaacacgcgacgatagggaagcagtttggaaagaattca

SEQ ID NO: 24849 - DNA, 1397 bp, Bovine  19866880852169
cgactctaagctggtagggaattgactgcaacataaagcatatttagtggatctcaacattaaacacaagtacctcttcacaccgggctttcctgggggctcggtggtaaaaaaaaatctgcctgccaaagtaggaggtgcgtgttccatctctggtctgggaagatcccttaagaaggaaatggcaacccactccagtattcctgcctggggaatcccatggacacaggggcctggtgggctatagtccatggtgtcacagtccatgattaggaaccaaacaacaataacaacctctttacacactctgtgctcaggaattctgttcaggtagaaaatcaagagtagcctttagatctctacttataacaatgaggtgtctcccttggtctttggtttctacgtggttcaaccaatatgtgctcagaaatgagaggtggttgtgactgacaccctttcccttctcccgtgtctctgggtttctccaagggttcttttgtcttaggagacgggacaggttgagctggttgtctccagcttcttgaaagaattcccagatcagagtgaatgtccctgccaggtggttggaacaggaagaatttctagagcagccttcatgttgggtctagttcccaccactaattaaaatttgtaggtaatgggttactaatttgttggttccttttatcatgttattgccttctcaggactcagaggatgtgtgtgtgtgtgtgtgtgtgtgtgttgctcagtcgtgtctgactctttgcgaccccatggacggtagcccgacaggcttctctgtccatgagattctctagacaagtatactgcagtggattgccatttcctcctccaggggatcttcctgacccagcaatcaaacctggatctcctgcaatgcaagcagatttttactgtctaagccaccagggatgccgatgttattgtataaataaaaagtaagtaaatgtcgctcagtcgtttccgactctttgcgaccccatggactgtagcctaccaggttcctccgtccatgggattttccaggcaagaatactggagtgggttgtcatttccttctccaggagatcttcccaacccagggatcaaacccaggtctcccgcgttgtaggcagacgctttaccatctgagccaccagggaagtcagctctggtctaattggggagtaggagtctagcaatgatcttcagaatcatctaccttggttctctttctctgatccagtgtcctgggtggcagagttcaaaagggcctttcatcttgggtccctagacagtggaaatctgagctaaactgaactgagctatccttaaatttaagtggaagatagcaacacttcccttcccatagggaaattcataattcaatgcca

SEQ ID NO: 24850 - DNA, 2244 bp, Bovine  19866880866044
aacatagttatctgtctttggaacagaaatcaattatctatatgacaggtgtgtggaaatcatttattataacttcataccacatagctcagtggtaaagaatctgcctgtcaaagcaggagatgcaagagatgcaggttccatccctgggtcagggagatcccctggagaaggaaatggcaactcgttccaatatttttctttggaaaattccatggacagagaagcctggtgggctacacagtccatgggggtcatgaaagcatctgactcgactgagcatgcatgcatgcagttagtatctcaaccttccttcctccaaacttatccatccagcagcttgttccaaggtgacctgcttgagaaggtgtgagttcccccttaaagacgaagtaaaacggtagtgtgtgtccacggcagatgatggctttgttctgcagtgggacagctgatgacacttcattcctgaaagggacaactctcccaggagcttggagacacctcagcgtgggaggcagggagctctatttaggatggaagatcggaccaggcgatgacctccccacccagctgaggcttccagccagtgccaggcgtgaggatggaggtccggtcaccgggcagtcctgggcgcatggtctctccgcttttaaaatagcccagcaatccggccccggaacctgaaatgcgaaggctcggttaaacccagactctgcaattccctcttccccacaggccaaacaaggactaattttaaacaaaccaccatgaccgagcacgggggaaaagcccggttcgcgcagcgatttgagcggcgacgctgcacgccccacccggactgtttacttctacggaacctctcggggatggaacaccgggctggggcttgggacgtgtccatccttccctgaaattcccttttcaggttaagattaggaaatccttccccacaccggtccccaccgagccagaagctgctgccttcctcccttctggttgttttcattaggaactcacgtctggattcctataatagactagccaaaaaaacagtcctgctaaaaattgtctacataggtgttgaagtcatgggtttttatgtcagtgaaacagagaaacagagaaacagaagaaataggacattatatatacatgtgtatgtatttatgtatataaaatccatatttattattgattaatatataattaatatataatgtgtaaatatatgtgttgtaaatatatatatttgaatatatatgtattattatatgtattatattccttatttatgtttatatatttctagacatactttgaagaaggaaatgccaacccactccagtgttcttgcctggagaatcccagggacaggggaggctggtgggctgccgtctctggggtcgcacagagtcggacacgactgaagcgacttagcagcttagcaacagaccattcatgtttaaaataaccagtgatatgttagagattgagtcttcctttttatcttttttacctgcccattttttcttaatttctcatctctaattttcttttcttacatttttctgagctactttttttaagaaaaataactagcattttgagatataaatataaaccttttgattttcctaaaagaagcagctcacttttgcaatacaaaatacaacataacaatatttgtgcaagggctatgttaagattagaataccatcttctgaattgcaccaaagcatgagaaatttgacaggtcaatattcacatccagtttcttgccccctgaaaatgcaatttatttatttattcacatccaatttcttaccccctgaaaatgcaatttatttatttattcacatccagtttcttgccccctgaaaatgcaatttatttatttatttatttattaatttttaattactttttaagtattcctcattttattgttttcacaatggttgctctaggtactataatataaaaatgcaatttatcacattttattgatatcagcatttactacttccagtgaaatgtagaaatcttatttctaattaggttcctttaccttccacacttgcaaaaatagctgtcttaagaatttcctcaacagattttgggcaccacatcagatgaagctataattcttgtttcaactatcaaatatgatttgagaatcttggaaggtgtggagaaagggcaaccctctcacactgttcgtgggaatgtaaactggaacagcca

SEQ ID NO: 24851 - DNA, 1049 bp, Bovine  19866880913807
gcatgtgcagtcttacctccctgaccaggtgttgacccttcccccccctgtggaggaagtcaaagtcttacccactggactgccatgagtcccgcaccaacagtcttgttttcagcaaaatgaggttttgcattctcacaagatgcaatggcttatacacctggttcatatgcggaagtctactggcctggcctgcatagtccgttgccgccgtgtgctggctttgcttgtgtccaatgggcctggatacagaagactctgtagcctgggtgatggtggtgaaacagagcagatatttctcttgttcctgacagtagttaaaatgtcaagagtcacatgggtttgaagcttctggtagtttaatttggggacaaatgtccttgatagttaaaggcagtgccaattgttttcttttttaaaaaatttaaatttatttatttttaattggaggataattgctttacaataatgtgttgatttctgctatattatcaacatgaatcagccacaggtagccagtagttttcagtgtttctaaagtgctagatccctcagctgtggttcctaaaccccaaaacaccgaagtctagtatagttccatgtgggcagatgatagaataaaaatcaatacattcattgtagattgaactgaaagcctttgatttgaaattcaaaagcactcattaaaagcatcattctggttatccttatttgcctagtgagaattacttcatgcattacacatggccagttatttagttttctttaaaatcaattgtgaaaaagaatatcctggtttatagtttgaacaaccttctttggaaatgtatcttgtattggccttttgtagtatttttttttctttgtaactgggggatctcatggtttaacattttatttccccccttaaaactagcttattattgctgatgaattggccttccaaattgttaagtcaaccttaccctctcttccttccagacatcagtcaaaatggattaaattttcccagtgaaaatttccagttacagttctgtatatccagtctt

SEQ ID NO: 24852 - DNA, 1235 bp, Bovine  19866880922488
tctgggttccctccagcctataaacctcgtgtactaatgtcccgactcttgcaaactcgttgagaaataagctttaggaagcttccagatgttccgcttgcagggcggtatttctctgcctctgtctccaggggtccactcacgaggcccagcagcctgcctgcccaggtgaaatctgagggccaagaggcaccgcccgggggtgggcggggagacgccatttcccgcaggaccacactcaaccaccgtgttcatctgctccacccttgcaaagacacgacctcctacaccccgtgtgttcttgcaccaccccacgccccgtttctttcactctccccggtgagccctgcatccctggagtatgattcatgctgtgcgaacacctccgagcgacaacagagaagcaagtccgcgactcccaaacgagtaagctttgtcctctgtgagcatccaccgcacctctccctttttaaaactctcattggacagcccctgtaatggagcccgggacccaacaacacggggcggctcttccacgtgagatgctaagtcaacaccggcagagacgtcttaggagcctgaccggccagaagaacaagggaatggcgttcgtgacctgtcaaggcccccgcggtgctggtggcctctgatctctaggaagctaactgccaacgggcagccttgtacacacacagccacgcacacacccttccccacacgcacacccccgagggattctttgcacaaggtgacgcggtgtccctttgatgctcgccggacgtgttcccattgggcaaaaaccagacctcaataaaaccgggcattatcaagaggccgctggtgggcgattgcgcccgcctgttatctccgtggccctgggcggggcgctctgtggttctccacggaaaagcattaacttctaggtggatcaaagacccttccgaaccggccgacccggatctcttgtttatccacaggggattgttccccaagatggactttaagataactgggaccccagtcccagactcctctgtcctctgcttatctgtcacccagtatgtccctcgggggccgcctaacggccaatcacaagggccttctgctctcccacttttccaggtggcccatttaacaacagagtaggggactggccctgctgcaagctggggacctgggggcagagagacacctactttggggggcaatctctccataatcacaccagggagggg

SEQ ID NO: 24853 - DNA, 1156 bp, Bovine  19866880933512
cagaggaaaacgctgagcacgcagagggcaggttcgactgccttgtgctggtaccccaaagctgctccagccaccttttgagaattgaaaatccgaaagcaagtactcagggctccttggactgctctccttggctcccgccctctctcctggctccagcctctccccggagctgggcagtggccgctcctggcctgggaggaggaacgtcctctgagtcagggctcagtgagtagctgttgcttcacccccagtccccgagggcttggagagccgacccgctttctccacaggaaactgtagagctggggccagtgcagcggactagtttgatgtgaattagccaaaaaacaacaacagcagcaacccacaagtccagactggacttgtttgaaaacaacccatactcccaaccagccctctctcgtctgggcagcactgtgcccagtgtctgcctttgtgtcaggggaggaagcagaggctggtcccccaaacctagacatgggggcttggctcccagcagcccgcaacgacggatccgtagaaagacgtgggctgcagcaccagccctgaagtgaatcccccgctgaaaggagagcaaacagagagctgggccaaggctggatgtgggagggagcctctgggccctcctgcccccgtggacacccatgctggagtccagaaaggggagcgagggagcttcccttctaaacatggcaaagcatctctgaggagggaaagggctcttgcagacatgccaggaaggcagcgtttggagctactgctggcagggccagggagtgggctggggctgtctactcccccaccctctggctcactgggaaccccgtgcgtctctgacatcatggatgaaaatcaggccgggctttccaatattggggccgtcccgccccactcagccccgccagctggaccctcccaaaacgggatctcttttgtcagctgccttttatagaactataaaaaccaaaagttcaagtaagaagctttagaccagtcttcaaagcaggcaggctctgtctcccatgctcttcctgcctattttcttacctcgaggctccccattcaaggctgctcagttgctggcttccgtctcaggctcataaagatcctacaaccccaaagtcacgttaat

SEQ ID NO: 24854 - DNA, 867 bp, Bovine  19866881019516
cctcatgctggtcctgtgcatacgtttgacttgcgtgctgggagacttagctggtcaaggtccccgaggcatctctcggggagtagagctcacctagccagctgtaggctcctctgtcttctgacacggagaggtgtgcagaggtggcctgaaccaccctctgacaccaaccctgccttgtggcttgacttcctggggctcctcccagccctcttcagggagggcggccgacttgaagggaaccgatgggtcatctcatcgctccagcccgtggccagtaagcctcccagaagagaaacaaggggtgggggaagatcccttgcgtgctaagccagctccaccaagcaggtagggctgggcagccctgcggggagcacccagccccttcccacctgcaggctcatcaaacacctcaacaagcagcccgagtgggaagccggtgatgtcactgcctcgcctgaacaatcgggcctttcacagcaggatgataacaatcgccaccgtgtgtaagggcctgccacacaagaacacacacgctcatcactcctgggaggatctgaaagccgaggtgcagcagggcttgtcaggaatatgccggtctcctttcataatcagccggccagagaacatagcccgaagagccggtctgcgggctgcaaggaggctcacttgccagttttcagagaaacccgtgactctctccaccatttccccaggaggcctcgcctgcaaccgcagaaataacctcttttgttgttcagtcgctaagtcgtgtctgactcttcatgaccccatggactgcagcccacgaggcacctccctccatgggattctccgggcaagaatactggagcggattgccatttc

SEQ ID NO: 24855 - DNA, 1789 bp, Bovine  19866881050394
ctgtcggaggaggagaatggtttggagcgaaaaggggctgctgggatttctgcttctcagtgtcttttcttgcattttgcataaaacatggccgattcgataacctgctggtctatctcacttcccactggtactctctgtctgcggagaactcatcttttggggaggaatcaagattagaatcctctggttcaaacttggtctgtatgcgaacacgtttcatctgtgcagcagacactggtgtttaagactcagtcgtgtacagcctgtggggaaaaggttgtgatgctggtttgaggaaagaggaagctgatgcttgctttcagaagcgtgggctggacagatgctccggagacttggagcggagattccctgagcatcttgttgtcctttccactgtttctagctggtctcctgagcatccagattagaaaccagctgggctcagccttcatttctggcaatttatcattgttgttcagtcactaagtcgtgtctgactctttgtgaccccatggactgcagcacgacaggctcctctgtcctccactatctcccaggctttgctcacattcgtgttcattgagtcggtgatgctatctaaccaattataggcaactatttctgtataattggttggggaaaaatgaaaagatggggataaatgagaaggtgggtaaaagtgattgcacaggtactatcattaaaaatcttacggacataaaaagtataataagaaaatgttctgaacaactgcacaccaaaaattttacaattcagaagtagataaattccatgaaataacaagttataaaaaaaaaaaaaagtgattgcacaggactgtctccagagagggtacagaacgggtgcagaagacttcgagagaaggacaaagctcagttagtttagttgcacattttttgcgatgtttcctgagctcagatcattctcagggcagccaggggatctagtgggggcaagaacaatgacaaactcaaatgttatgactcctgtctccaggaggcatccagtatgtcctaacagcgacacagagccctttaaaaaatcagtgcatgttcattccagaaacacttcccaagtgtctaaagagaggtctagctcagtgccacacagcttcccaaatggacccactcaagggcaacttcaagtcttcacccatcgtggaggctgtgctgatttctcagctgacgcccttgcctgtccagtttttcgcaaagaaatgccactttggggacctgatttttttttaaagtaacacatctgtgccacatacttggacactgccctctgccttcaccgcctgggtcggacactcgtcagtctttttctaagtctgtggccacgaaggtttccatggatggtataaagtgctttgtgtattggaaactgtgaatcaaaaggtagaggaataaaaaaaaaaaaaaaaagaggagagagagaaagaaagaaaagctaaccctcaagctcacccaaatcctaaacctcagactcttggaagaaggaaccagtggtataaaacataaaacagtcccagactgcaaacagaccgtcagcagggagccctttctgaagagagtggagatgcggccactgtggaggcttggcatccgcaccgaggcatggagagcctttttctaagtttctgaaagcaaggcaccttcttcctacctgccccccgacagctgcccgcaacaccctcaaaccccactgcctcccaggaggctggtcctcttccctggggtctcctgactgatcctcccccacccaa

SEQ ID NO: 24856 - DNA, 1535 bp, Bovine  19866881072162
aattagcattcctgtaaaatggcctgttattatagcagatttctgctaacaattacctggcagtatagaaagagatctgactcctttaggctcctggtgggttttcccttctctctctctctctcttttttccccctgtggagccttaaaaaagaaaaaaaagtgtagacttcgacaggcccagtgtatttctgtccatgacatcaagggagatttactggacaagtcattatttcatatggatgtgcgagcgtgtctgtgagtccgtgtgtccgtgtatgcgtgttcttcgagaaaacaaaatgggggtaatttctttccttttgtgatcacgttttctcttcttgagaactgaattgtaggaaaaaatgtaaggagttgctgaattttagaaaacagaatggtagggatggtttgctttcacaaacgcattcagttttgtttttttttttaatctgatttgagcaaatgccttgaaggtaatcggtgctcaacagatatttgttgaaaagaattgcacctgctctgcttgatgtgttttcgtgaaagaagtcccgagcgtgcgctggaactactgagggaggagtaaaaatcttattgatgatttgtgaaataggagagttctgaagattcagaggcaacaaagcttaaccaggtggtcagcacaggaggttacacctcaaaactaattttggggacttccctggtggtgcagtggttaagacttcaccttccaatgtggggtgtgtgggttcaacctctggtcagggagctaggatcccacatgcattgcagccaaaaacccaaaaaacattaaaaaaacccctaatttttgccaacacaatgcaacccccgtataggtctcagtaaatagttctggatccaagaccactgtgaacactgtgtttctgtgaatacgtggtgtgaccttctgagaaacactttgcttctcgaggaggctgctttcttgtgttaaatgagaacttgtctgagtttccatagatattttttcttttttaatttgtttttaattggaggaaattttcttcaccgtgttgtgctggtttctgccgtacaacaacgcaagtcagccgtaattatacacctgtcccgtccctctccagcctccagcatctcaccctccaggtcatctcagcgcaccgagctgagctccccgtgttaaagagtacttctcagcagctgtctatttacacatgggaggaagctgcttccacttgagcttactagggattttgacctctgaggtaagagctgggtttaaaaagctgttccaaaccaaacagctggcattattagcattgttattccattagatctttttgcgtgatagaggagccgggggtggaattggtgggtgatctaaatgccccagcctagcgagaggtaagatgctctgtacatatctcttgtaacccaacagacctccagagctcagtggacaactaaacagaaaattccccgaataccaggagattgggttgtttggggaggaggaagctcccttagacttaagc

SEQ ID NO: 24857 - DNA, 1135 bp, Bovine  19866881106170
ttgctgttcccgtctcattcccactgtcccgtgttccgtgcctggataatctttgcgggttgcgtttgtatatgttgtgtctaaattaggctggttggaaaaaatccttcgtaggtgtgattttttttttccctctccctctcagcccagattccctcataaaggtgcattgacttccaatgtccttgtcccaccttatttccaagtgctaatctctgcagctccctggggagggaggcgtggccattgtccctggtggtgactgattaaaggtacttctgtaaacttgcctgtccaggcagagtgaccccaggattctcaacttaagagttggagcctgtggctctcctgcaaagaatcgaatggtctgcccttctggaaaccagaccacttacagtctgagcccagctgggccaccgctgccctctctggaaaggtcactagagcctgtccgaactccccctccttcgtaatagcataggggctgctgaatttcctgggtctgatgttctctgattctggaacatttggcaagaaaagaccatcctcgctctccttccagaacacaaaacaaaaaatgccaacataagaggctcagaggctttgaacatccattcaagaagatgtttatttaacattggctaaaaatgtactactttacctttgaaaaaaaaaattaaatgacttggagaacttcaaagcctttcctctcccctctgctttccaggaggagaaatatttttcaaagtcatttgaattttaaagaggagggccccagaagcccttgggatggagatctgtgagtcagtcaattatttttcagaaagtggttttatgcacagcttgaaacggagacccttcccctgtcccgtgtcgttccccacttcctttcctatttttaatttctcacttcaaccctgtacatgtgctgagaaacttaatccatttgtttctgattcatttacacttaactcatcaaaatgctatttagggagagtatttcgagtccgggaggtgccaaatcctaggagcaggaaattgtgtcttgtgcagaggaactgactgcagacctaggctgctctgactctgctcctgagccagaccccagagcgaatctctgtgtccggtgcctctg

SEQ ID NO: 24858 - DNA, 980 bp, Bovine  19866881198813
cctgccagtgcgggggcatgtgagcgcagtccttgactggggaagattcctacgcctcagggcagctgagcccgtgagccacagaaagagagtaactgagactagagactgcctgcacccagcagaatacaaataaacacagattgtgaacaataaaaggaggtaacgggcaggcagtcgagcagagaggagaggcaagagctctcatcccaggtgaaggaggtcccagtaggcgcagacgcgggctagagggccaggtacgccggccccagagctggggactggctgccgtctctgctcggggttggggggaccggcgcggaggggagatgcgttcaggttgaacttgaaagtgcaggacacagaaagcgttttgtcccctgcggagagcgccccattttccactcaggtccaatttgcgtgccacagccctgagtctgcgatctttctctcaatggatgcttatgttctggccaggaagggcagcccttgccaaacgttatggtttggaagggtccttcacaggggtggaaaaccgagttaattcaattaaggcccggggtcctgggctttgaaccagccacagtctcgattttatgagaggatgaaaagttaattatttgccgagtttgagcaaagtccactgtgaaaaacccctttccaaaagaggcatttgcctgtcaacttccctgtggaaaattaaggcaatttgaaccagggtcataaggagaccctaggagctgggtgatcagacgggggttcggggctcccccatccccaccttgcctctcttcatctcatgtctgaaagggaggctggagggtgactgcaaggtcaccgaagcttatgtttacttccacaggctatttggaaaaacagaaaagaaaacccaagttgaattcagaaagtcaagtttttagggtgcgcttttatcagtgagtgtgctaaggcattttcgggttgtgtcaaactctttgcca

SEQ ID NO: 24859 - DNA, 1291 bp, Bovine  19866881221745
agtctactcaaactcatgtccattgagtcagtgatgccatccaaccatctcatcctgtcatccctttctcctcccgccttcaatctttcccaacataatggtcttttccaatgagtcagttctttgcattacatggccaaagtattggggcttcggcttcagcatcagtccttcccaaatgaatattcagggctgatttcctttacaatggactggttggatctccttgcaggccaagggattctcaagtcatctctaacaccacagttcaaaagcatcacttcttcggtgctcagctttctttatagtccaactctcacatccatacatgactactggaaaaaaccatagttttgactagttgggcctttgttggcaaaaaaaaaggttcatcttagagtcccagttaaataagaaaacaagatataaaatccattgctggaaaacctgaatgaatttcttttagtgtattgctaatgacctctccctgaagattcaattcccagtggcttcctggatccagttttcaggcacatgtaattctggtacttgatgtttggaggtcagttactggcctttactctggaacaaagaggggatgtaacaaccattgcccaccctgttaatacacgctgcagcctatcgtccccaccttgccaagctatttccagaggggagcatctttagtaaagtgcagttggtcatgacttcacaaatatttctactgaattgttaccaagaaaacttttgccttatgaatttttttgttttattactctgctaaaacaaacacactccaaaaagacatgtggtcttccacttcactcagatgctatgcctcaggccccatctctctgtctcttttcttctaaagagaaaacataagaaatgccaagttataatacacggccttttccaggtgcatatggtattttcagtccttcgtcttactctggttgggttagctggatttctgatttgaaaagccttcaagtgccctcccccaccccttttaaattggagtgtaattgctttatgatgttgggttagtttctgctgcacaacacagtgaatcagctgtaaggatacatggatccccctctcttgggtctccccaccccgttcccctcatctaggtcgtcacagagcaccgagctgagctccccctgcttgaagcaggttcccactggctatctgttttacacaccctagtgtgtgtttgtactttggccacctgatgcgaagaacgactcatttaaaagacccgatgcgggaaagaccgagggcagga

SEQ ID NO: 24860 - DNA, 580 bp, Bovine  19866881245149
ggggcggggtggggggggcggggggcggcgcggctgggagggagaccaggccgggtgggggcggggcggctttcacctgatctgggcctcggggatgatgtcatccataatcacgtagaccatggcgccagccgcaaaggccatcgcgtagggcaggatgggctcggccagcaccaccgcgaaggcgccgaagaccccggccagaggctccaccatgccgctgagctgcccgtacctaggagagaacagacgcgtcccctcggggaggctcgggcagacaccccgcgtgctccgcgggctgcctcggctctgcaaaaggtgtgcattgtcctccacgtcagatcctgcatcgctgggcaaaaccacctcattgtgtgtcgtttctattaacaccacctctgtctgttttcccaactccctattattacacagtcaccgtaggcaccccctcccaggtttattttagagttttaagtttcccacattgtcttcttaaaataacagccttattgagatagaattctcctaccgaatggggcacccactgagtgtgtacagttcagggttttcagtgtattca

SEQ ID NO: 24861 - DNA, 2415 bp, Bovine  19866881294987
acagagacgttcttttcgccgttctcttttccttcccttttatcccagattactgaatgtcatcccctccgctacatagcaggaccttcttgttgtcctctgcaacggtctctcacacctcacgcaccacccaaaccagccctaaacggaacccaacatcagaggcccaccagcctctcacagcctacttcacacactcacatagtaggtattcgggaaacttcaccgaatttcactaaacctgctgcaaataaaacaaagccacgtctgccctaagacgaaaggcctgggccctcaggatgcatgttaactctttcatgctctccagaccccacacgtgtcactcgagattaatgagcaccgtgtccccaacgtccccagggtcagcctactggaatggaaacaggaatgagcaaggaacagcctcagaaggtcagaaatccccaaaatgacggcgaaacacacaaacaaaaagcagaaacgggagtcattttgtctggtagctgactcggagaggagcgaggttttctccttgtcgcagaacaaaccgtgatctgagttcggagcttttcaaactgaaagccagcaaacgcatctaattaaatgatacagtaaagccctgtgcactttctagaagttgccagaattctagaagggtgcccaagttgatgtggaagggagaatgcactgattttttttaatcccagatcttattaacaatgacccattactgtccacatgctaaatgccagacccaacacggtgctttacagttaccagcacacccaatgctcttacagtcctcacctaaggacccctgtcatccctgttctgcaggaggaaaaaccgagagcttgcagcgaggtgagggcagagagaagatttagagggccagctgactcgaagcgcacagccctaacattacacggactctctgatccagagaggctctgctgcacggtgtgcggagcccgggtggccgacgaggaatcggctccaggacttgttccatttctgacccaaaggatggaagggccacagcacttggcaggatcacggaggggtggagggctgcccaggagggccccttccccacacagccaccccagaccccagcagctccagaccctgaagctcccgtggctcctgcccagcccagcagggagggaggcccgatggtgtccatgaacatccaaacgagctcccctaggaggcagcgggaagtctccgtagcagcaggccagtgacggggagatcagaagctcaggtcaagacttgaggaccaggttaagcctagcccagatgtccccagcagctgccccatttgtcctttgcaggagtcctcaccctgagcagagaacaagagtgaattctggaatctcacgtccatcatgctaagtacaagaagccggacgcaaaaggccacggagcacgcgaccgttggcacacaatatccagacctggcgaatccagagagatgggaagtagattcaaggttgccagggtccacgaggaaggaggcagggagggagggtcgtgactgctaacgggtgcggggcttccttccacggtccttccggaagctcctggaacagacggtggtgaaggccgcacgacatcgtgaacgtccttaaggccactgacccgtacactttaaaatgatcacaagggtgcatctgatgttataagccttctgtcatcgttatgggggaaaaagggtgaatctctaaagaaccgctgaactcaatcaagtgtgaggccaaaagcacagagccaggtctgaggctctccgaggtttagaactggacgttcccctaaagaccctccagtttatgaagttgctgtttagagagagggtggagtgggcagggagggaaggaagaggcagggaaggcagccaggccccagagccagagagctgaccggctgagctgcagcccggggagccccttccccagcccactgcaggctcaggcagccccaagaccccgcagcccgccccccaccgcctccacctggcaggcgtcgccgcgactttcttggggccgggagcccagtgtccttggtccagatcacagacccaacaccagtttatctgcagtgggcaaacagggcggcagcaagcggcggaactctgacaatatttaatgactcgggggtaggggcggctttgcaggatgcaggaaggcaggcagaaaactccaggggaaattccgtgggggggcagataaaaggggaccgtaaagcaatcttgacaggttaacagacaggtaatattccaacggtgttgacttaaccaggctagcgctgcatgtggccccgatcaagccgggcgcaagagcctgggcagctgagggcttcacggaaacaaagatccagtcagagaaaaccaaacaacagccagtcagaggctgg

SEQ ID NO: 24862 - DNA, 974 bp, Bovine  19866881316633
cagctagacccatatagggtgtgccaagccctggagggggagggtgggggaccgattgtcccgagtttccaggtctggctggagacgaatggagctgagaatccaggagcatctgtttgagactctcagctcccttataggcaacttgggaggtggatgaattcgggataagggagggaaatgtgaaaacccaaataaacatctgaacttgtaggtggcacttattcagattaccccaaattctctggcctggggagagctgatgcacattgatgcagataagggatcttacagcaagattgtgtttatgggctttcattcttggcagcttaaagcacatagaaacggtgaggtttgctctctttctgaaaatccctggtctctgtaaattcatcaagcaagagacacttctttcctagggttccccgaaacaaagagcaaggaaggaggctggagcctcatttccccttaagctagggacccctgagtcccagaatggtcaggtctctgtccccatctcccagtcaacagacccgcctctctgcagagccaattttgaaagtccctgaaatttctgaagccgtcactgaacatgaacacacatctgacctctgagttgatttcatcacccagctggcccctgtctgaacccctgcctccatggagaattcttgaaatccatcctattctccacctgcagctgttttctgggatttgaaaaaaaaaaatgatatggcatttttaaagtctccccaatggccctgctctgatctcctgttcccaccaagactctttcaactccagtttttcagctgtgttatctggtcatttcagctcaaccacagtgcatggtgtctaacccttgaaaaccaagcatgcccccacatgccagagagcagaatgaaggtggcaggagaggaaactgagtcagtacagcatcaaaaatcagccgtgagctgcagtggatcaatgaa

SEQ ID NO: 24863 - DNA, 1380 bp, Bovine  19866881326224
aatattcaggattgatttctttaggagggactggtttgatctccttgcagcccaagggactctcaagagtcttctccagcaccgcagttcaaaagcatcagtcttcagcacttaaccttcctttggagaaagaaatggcaacccactccagtgttctggcctggagaatcccagggaagggggagcctggtgggctgaagtctatggggtcacacagagtcagatatgactgaagcaacttagcagtagcagcagcaaccttctttatggttcaactctcacatctgtacatgactacttgaaaaaccatagctttgactatatggacctttgtctgcaaagtggtgtctctgctttttaatacactgtctaggcttgccatagcttttatgttcctgtcccttatttgaggaccaggtaaggcttgatagcttcgagttgaaagaggtttctaagtgaaagccttttaaaggacttattcgcggtttcctgggcagagggtgatggtgctgaggccagtgggagaaatccacattccttcctgcccatccctccccttgtccactccggtcatgtctcctcccttccccatgtaacagtggctgtcacagaaaagccttccacaaatattagctcagcctggacctggcctcagtacatctccctcccagggtcatcccaggcgctggggaggccagccctcctgtgcctggcaccctgcagagactgatagaattccagagccgggagcaactttaaaattcatatcgttcaacctctcctcctgggagccgggacagggtgccccatcccctggccccaggccccctccgtttctccatcatcatctgtatccttttcacccccttcagtatataaagagctattttaggtgcccctgagcttctccacagtggaagttgaacaaaactaccgtgggtgggacaaatccacaaccttaatcttggctcttgaagtgagagctgcttgaatacatcgtgctgtttatgcaaatcccatgcaaatcagggtgactggattaactgggaaagaaaaaaaaataccatagtgtgtctgagccttcctagcactccgtgttggctccagaaaagatgaattttttttttcaagtgctgttttctgttagaaacttctcttctgccctgggagccttagccagtatcccaagttggctctttccatccaccgaactcttgtgtgaacagggaggtttgttttaggctctgtcaacggagccttgttggaagttgccacaccttaagcaggcttgccaatgtctcggtgggggttgagcgtggggaagtggctggcaggaccagggcgtagggaaggcccagtccagggagttgctcagccaga

SEQ ID NO: 24864 - DNA, 2129 bp, Bovine  19866881400135
ctctatacggaagagagccaaggagtatgcgtgcggcaacatggtggaaaaggaaaaccatatacttggtctcaattccttctgctaatgaaatcttaagttgatgtttagatcactcagtgcaagaatggaatgcaggggcctccctgttctacgccgggcaagcgtgacgcagccatcactgaacaccccacggggagcttcgtacccatggtccatgggaggcttgtggtcagtgtcaagcatcacagaggccctgtgtgtgaagaccatccgtctcacagcttcatccttccagcctcaattctgtgctccattgccacaaagaaccagtaattccttaaagaaaatccaacatcccgtaacaaatggcaaatgtggctcttgagaaagaggacttatttatgtttctgtagaaaataataatggtgccgagacagagttctttcccagacgccttagtaaattgtgccttccaagggcagacagctaaatcttgtggtggaggccaggtggcattggtgccaccgtggaaaccacgtgtttctgtaaagggggctgatctcatgagtttatttctctgcccaggatccagcgacagggctctcaagtgacttcactgcaatcagtattgctgactaatgcctgtatcaacacctacgccgccaccactagagctttggcgattttacgtttagtttgatttctccagacagaacttttccacatcattggaactaattgaggtaatggagaaattattctggtgccagaacactccgactttcttttgcccacttcccccaccttggtattgaaagacaacaatgctccagtctctccatgtttctttacagcaaaaaaaaaaaaaaaaagggaggggggagttggtgaggtcgctcttgcacccagccggctcttggacaattagggctggaaaatacactctgagctccatctttcttggcttcccaagtctgcacactctggcactgtggctgtgccattctcctgagatgcttctcaggggagatttgggaatccctcttctaattctccagactgaccacaagaaatgtccccacctttgctaaagcaactagcagatggagacaaacatttatgagaacatactccaccttaattacaagcattgtctgccaatgtttatagcgtctcagggagtttggaggtaagcccgagctggctgaagatggttttgattatgggggtttgtatcaaaggtgggacggggctctttgcccactcctcgcccctcctccatggtctttactcgagaaggttgacccagccattttttaagatggcatgacgtactgagaagcccctgggtttgccccatgtcaacagttaggggctcagcgagcatttgggggttttaattttggtggaccacagtgaacctctccactgagggccctgacggatttggatttagggggtccctggcagcgtgggagtgtagggtgggcttccaacagttcgcagaggcctccgcttggcccttgaaatggtagttcatatgcaggagtggcagggcagttacagatgagtgggaagtgtgcacattcatttgaggtcggaggaaagactctagcaaattctgaataatgataaccctacaaataatgtttagcttgcctattacccctatgttcctttatttctgctttttcctactctctccagttactagtcttccacactatcccttattgatctgcccactgaggagggtcacagaaataatgcgatttgagcaacagattgcaaatgtgtccgagttactcctggccagcactccaggcagcgctggggaagcagtggcccttgcagctcggagctgaaatgggtgttttgcattacttgctggattttatttcgccacatcacctctgaccccttttgcaaagttaattgagagttggcctttttcaaattgactgcaggaaattgacctttgtgttcacgctatgttaggaaagggctggatgaagagcaagtcaggaggcaaaatggaaataatctggccctcatagtcacagtcatgctccagcaccacgtgaaatgagcacagatgccttggtgcaatcctgtaggcgacggat

SEQ ID NO: 24865 - DNA, 1231 bp, Bovine  19866881421410
gtgtttgcatgttgctgtacaagcagccttggaagagcatccctcctcattgtatgtgtgtggggtctggccccacaggctccaacatgatgcaggtctgtgcagaaattcttcaggctgtaaagatgctagggcgttggaggggccctcgcagggagctggatcctgaaggctggcgtcacccacgttcaccttctcggtttggattgcacacaggtgcacgtctggaggagcagaacacggacacgtcttctgttgacacagatgcgtgatcagctcccagcggggcagtcggagtccacgtcagaacaccgtgcttcgttacagactatccagcggccagagttgatggtgtttctagaggaccccttctttccagtgtgtccggaccatagatggggccccacaaaacccaagtcctgttgatgaagtgaaccttttctgttgagaacaaaacagctcatgatgaaacaaaaataatacagccactggaaacaatggaaaatagactgtgggatgtgtgtgtgtgtgtgtgtgtgtgtgtgtcacacgtttgtataaaataagagccaagaagaaaatttctgcatcttagctagacagactaagagctaaaaactcttggggtggtgttgtctggagagtgaaggagttggctggaagacttcctgacattcctttgacctctagggtcccgtaaaatatcaggggcgtgtaaactgggccgaagtgtgtgctttctgtctgaagtctcctggataaccttcgaggtcagctcagatgctgtagactcggaactcccctcccccaattcccttccctttccagacacgggctttatctgggataaggcagcggaacttggtagtggtagcgggggagagagaaggaggttgcgccagccacagtttgggggtgctctcgacaagtgagaacaaccagaaggcaaattacaggttcttcccaggtgagtgaaagccaggctttcgggagcgcatgccatcctgaagttgttgcttcttgtcagaggatcagggctttatctcttctgctgaaagacaggcttaagcatctcatctaaccctgctcatcttgtttggtggccccggcggggggcgggggtgtacggaggtcatcacctactagggtagagatgagcacgcaagcatctggaaaagactctgtcactgcacacctgtcgagataaagacccaacctcctgcacgtgtgt

SEQ ID NO: 24866 - DNA, 786 bp, Bovine  19866882236431
ttaccccccaaaatagactttggtatatatagaagagtgagcttatgattaaatttggcattcaaaattataggagaaagaatcatgaaataaagctgggacatctttctctgtgcattctctgtctatcatttcttctacaaccaccatgctgttttgattacaatctattataatagctcttttaaaaaaatgtcttggctacttgcaccatttctgtttccagatgaatgttagattcactttttcagaggtcttttagcctatattattagggtttttattaaaatcatttatatcataatatagtatcagaagaatgtgtatctttatactatctgatcttctgaccaggaacagctatccaaacattattgtgtatcttttaaggaaatgtttagtatctatcctgctgctgctgctgctgctaagttgcttcagtagtgtccgactatgtgcgaaccccatagacagcagcccaccaggctccccgtccctgggattttccaggcaagagtactggagtggggtgccattgccttctccctaattagggtcaaaaaaattcttaatgtcttatttgaattgagaatcttgaaaacatttttactgaattgatgttctattagcagtttactagcattttcatgcgtgatttttacatcaataatcatttgtgagttttcttctataaaaagtacaattctttaataagtctttgttttctctcctccatatcagccatcttactttttggcttttctcactctctttattttctcttca

SEQ ID NO: 24867 - DNA, 1551 bp, Bovine  19866880397466
gagaattcctggactgtatagtgcatggggttgcaaagagtcagatacgactgagagactttcactttcactgatatcacatgttctttgggcttccgttgtggctcagttggtaaagaatctgcctgcaatgggggagaccttggttcgattcctgggttgggaagatccgctggagaagggaaaggctacccactccagtgttctggcctgtagaatcccatggactatagtggattccaggctctatggacagagaaagcctggtggtctacagtccatgtggtctcaaagagtcagacacaactgagtgactttcacatcacatcatgtctataagtgagctccaggtcccaagcatttaaaatcagtattattttcttctccacgtttaatgccatgtcagacattccattatctcctggcagggcccatggctgattttcttccagcctttctgtgagaggagggaagactcatactacctgacaagttctccatactaccatatcagtacttaacgatgacagaagatcaagaaagtagatttattattgaatgttcctacttatttttagtcaagtgcagtatattttactgttccccgtggatgattcataaccatgtctcagcaggcaaactcaagttgggaatctaaataattcactagagacttttaaatcagtgtggacaggatatctactttttggtttctttttaatgtttttttttttgactatctagtttctctgtacagtcactgtattatccttaaaaaataagtattgttcatcatctgttttacatggtccctatgaagaattaggtaatttgtgaaaagaaagacttgatttaagaataaaaaaaaataacctagagcttagaagttgtttgttctatattttatgatttcttgtatattaagtggtataaatgccacccatttggttttacagaatttagatggcattgaggcttcccttgtggctcaggtggtaagaatctgcctgcaatgcaggagacctgggttcagtccctgggttgggaagatcccctggagaagggaatggcaacccattccagtattcttgcctggagaatcccacagacagagaagtctggcgggctacagttcatgggggtcacaaagagtcggacatgactgagtggctgacacttcagacggcatcgggccccgggacaactaatgtagaaggtgggctcctcttccatccccacacccgataggacctgattgaacctggcatctcacttgtcactggggttttgattgtcatctttgtgttaggcttgccttttcccagggagaaaattcttgtgtgtttcctgacatcttcttctaaaagtaaaagcattttactctagcaacattcaattgctgctgctaagttgcttcagtcgtgtccgactctgtgcgaccccagagacggcagcccaccaggctcccccgaccctgggattctccaggcaagaacactggagtgggttgccatttccttctggcctccatcaactaaaactaaatttaga

SEQ ID NO: 24868 - DNA, 2376 bp, Bovine  19866880427449
cttgaacatctgggaagttcatggttcacgtactgttgaagcctggcttggagaattttgagcactactttgctagcatgtgagatgagtgcaattgtgtggtagtttgaacattctttggcattgcctttccttgggattggaatgaaaactgaccttttccagtcctgtggccactgctgagttttccaaattgaggccttacaaacagctatgaaaagaagagaagcaaaaggcaaaggagaaaaggaaagatatatccacttgaatgtggagttccaaaaaatagcaaggagagagaagaaagccttcctcaatgatcagtttaaagaaatagaggaaaacaatagaatgggaaagtctagagatctcttcaagaaaattagagataccaagggaacttttcatgcaaagataatagaaattttaacatgttataaatcaactaatcttcaataatatactttttaaaaaatatatatgtattccaaatatcaagaagtagagagcaaaaagtaagttgaaatcacttttactaaagaagatgaaaacatccagcagctgcacctgcttgatctacaaaagcaaggcaagttactttactttactgtttcttcttttggttaaaattgttgaaatggccaaaatgctaaagcatctagggtttttgttctaagtggtgattctctggaattatcctgcactcaatgccagttgaattgtttcatttatttcttgacgctactgctctttatgtaaagttaatggtgtgaagtgcattaaagaaacacagcttggatttttttccttttaatagtttctaaaacaatctaaagattgttctaaccattaatgaaactctttttaattttttatccagttagttgtctattctctcttcatgggccttttctgggtaattgactcttttcattccacttttcagctgtgagactgatgcttgttcacaccatttgggaccgtttttatctctgttgcttccccatatcattctagatgcctgtgtgtgtacctttttaaaagtaaagaatcacaggattttcctgtttatttatgtatttctttactctgggctgcgctgggcttttgttgctctggcagggcttcctctggttgtggtgaatgggagccgtactctgtcgcagtgtgaaggcttcttgttgacgtggcttctcttgctgtggagcacaggttccaggcacacagtcttcagtggttgctgtgtgcaggctctagagcgtgggctcaggagctccccggcaggtggaatcttcccagaccagggactgaaaccatgccatgccccctgcattggcagttggattctgatcccctgcaccaccagagaagttccgtgtgtgtgtgtgtgtgtgtgtgtacttcttaaagaacaaaattcaaaataaagtttgctcggtttataagatactaagatgtcctccctgcatcccatgagattggccttgaagctgcaagctgactttgacaccctcaggggccagagccttgctgtccaggcttgcaactccagcataaagctccacattctaggacttggacagtgaagaatgggcctcctgacagctagaccatgaattccccactgagtgtaaacactcacagcacataatcaggacacggtcaaggccacttggcatcctcaacagttagccaggggccccctcctgaccaccaacaatacatcaagccctgttttaaccttcccatctcacacaggaaaattattcagataccccagtttggacaacattcccccccagattagcctgtttctttaaaccaattgtagaaccatccaccattaacacaaatcccacagaagctccccacagcacctcagggtaaattatcttttgctgcaagttaactcagtctcactttgactcaggatgtgttccagaagggcgttggtcggtaagctttaacagcaggtccttaataaatgcttgattaataaattttctttaaagcacatttttttatgagcagtctcctcttttccaaactccttctgacttcatctctgcagctccagcctcttctaaccttcctgctggcccctcttctcctctgactccctctgtgttcccttttctaaatctgcccatcttaggtaccaacctaggatgacatccatttccctcttctttttaaaaaaattagttttgttttttttcggaatatagttgctttaaaaggtgttaatttctacagccggagaaggcaatggcaccccactccagtactcttgcctggaaaattccatggatggaggaacctggtaggctgcagtccatggggttgctaagagtaggacacaacttagcgacttca

SEQ ID NO: 24869 - DNA, 2580 bp, Bovine  19866880430556
tcctagagactctgggggctggcgcagcgggcagccagtgagccagtgagcaacagcacagtctctctgctacaaggtgatcagaagaaatggaactagaggggcttatacagtccttgggctggaaccaccgaggaattctgtaagtttttaataatcacaactcttttctaatgatcacactcacctcttatttcaatatgccaaaagctctgtaagcatttagtcacatttatgaaaaatgttaatttaccagtagtcctagtaccctgagcatcttgctttcttgagatctggtagtctctacaatccctgttcttggttgctgtacccaatggaggaaattcaagtttaaactccacaactccagtgtttgtcctgaaatctagtcatgagctctgtctcaagatatctttctcaaacaactcttccacttactgaaaacctatggaccaaatattctgctacacatttcaggaccattatctccaaaccaccaatgggaggcattattcccatcatgacaggaaagtaaactggtgctcaaagaggatcatagcctgcccaaggtcacaggagtagttctgtccagcccttgcctctgtgaatttccacagcccctcttagccttggtttaatcattatagccaatgtccttttgttcctaaattgtccacccaaatgtaagcatctttgcctaggctgaattctgaacaccaattcttattttattcctctggaaacagaaaccagcaagaaaataagaaccatctgtcgctacttgagcttgcaagaagcagaggaaagatttttcttcatccaaagtctaagataaagaaattcactgaataccacccacattatacagtcctcccaccatcccacctaggtgtccatttatgtgcccaacagtcatttcaattgcaatctagaggtcacccctgataataaagccctcttctttcattctcagagcactctggttcccaaagtcattagtgcgaatttgtttcaattgctttcaattctgtctgcacataggtttctccatagggaccgctgctattccaagcttctactccccttgcaaagactgttgctaaggagaagagagttctgtcttcgcaattactgcctgaagtgtttctgtaatctctaccagttctttccctaacatcaaggtccctctggctcaaatctgtaaccttgctttttgtacctttgagcaaggcttccatttgaagtcctgagtgtttgatgtcctctgtaaggacttcagattcggttactccaggagcctctaagctttgaggaactcccctcagataaagagaagcagtttagatgttttccaatcaaagtcacaaagccaagaagttcctccttcaccacagtactccatttcatctgattctgggaagacagccacacaagtcatcatgctagtatgaaaatggttttctgaatcagaaactttatctctaaaagtctcctttttcccaaagcggtctgtccctcctccaggcatagctttaccctcacagtcaaacaaggtggatcctaaagcaggttgttccagacctggttccccagagggccagctgcatcagcagtgtctggaagcttgttagaaatgcggaatctgcattttaacatgaccgcagatgactcacacctgcatcaaagtgagagacaccccgtccgagactcagctgaaaagaatctgactaatgagttcattggcttccctggcggctcagagggtaaagcgtctgcccacaatgcgggagacctgggtttgatccctgggtcgggcagatcccctggagaagggaatggcaacccactgcagtattcttgcctgggaaatgccatggatggagggcctggcgagctacagtccatggagtcacaaagagtcggacacgactgagcgacttcaccttcactttcaccaatttcattaagaaatggacagttgatgcaaactggaatttttcacttaattatggtaggagttgttggaatttgtttttaagactgtttttctaacctaaacctgagctgggtataaaaaagtttccagagaaaagctaactttctaaataccatggaatcaggccatctcgtcactgaccaaggtgaaagctgacactctgtgacaccatatgtgcacagacacactaaccactcacagatttttgtaggtgagcttcaggaccgtgtatgaaataactgcacagcaagcagtgggtctcctgctgaatgagccccacgggttcccttctacggtcactaccaatgccaccggggtggccgggaaaggagccttttttttttgttttaatataacagcatcaatcctgaaatgaagtaaggaaatgacaaaactatgttgatgttaaagctatacaaaattgtgttttacagagataaaacttcctcaatgtacccttcagaggttttgtgcagacaaacacttataaagcaaagatccaaataacaatgcctatagagcctaccctctgcatctgtgagttctgcagcaatgggctccaacaagagcagatagcagtcaag

SEQ ID NO: 24870 - DNA, 1765 bp, Bovine  19866880449084
aatctgcctacaggagatgtgggtttgatccctggattgggaagatgccatgaaggaggaaatggtaaaccaatccagtattcttgcctggaaaattccatgaacagcggacgactggcaggctgcagtccaaggggttgcaaacagttggacatgactgttgaactgtggtgctggagaagactcttgcaagtcccttggactgcaaaggagatccaaccagtccattctaaaggagatcagccctggctgttccttggagggactgatgctgaagctgaaactccagtactttggtcacctcatgtgaagagttgactcgttggaaaagaccctgatgctggatgggactggggacagaaggagaaggggaagacagaggatgagatggctggatggcattaccgactcgatggacatgagtttgagtgaactccgggagttggacagagggcctggcctgctgcaattcgtggggtcacaaagagtcagacaggactgagcgactgaactgaacggaatgtctgcataatgagttggagataaagattcactggcgtccatctgctagtgttgactctgtagttaagttttatagctcttcttgcaatgtttccaaaggagatttctttgccagtgaaccaacttttacagcacaaaccatgctgctaccttaggcaatgtaagaattcttttcctcagcctttcagcaccggacagcctattagggagaggagatccgatgatgtccgtctcagaagccctgggtgtgtttgcagaccctgtcgggtggggggtgattctggtggggcagacaggggcctggcagcccccctccctcagaagcctgctgtggcagactgtctgcctctggcatctgtgctgagtgctctgccctggcagcagagctgcaggcgctgccccagcagggtgtgctctgtgttctgtgaaggctgatgtccatgaggtagacgaatgagctgacctgctgttactggtcggtaatgctttaaaccaaaaaggaaggccttgaatgatctcttcgaatatttctctcaatctcatgtcctctaagctcccttaacacgctccttccctgagtgcttccttcccctctctcagcattctcctgccatctgccatctcctcacagccagtgagtgtcgggcactcagattccagttctcaggcctctctcagccctgtcctctgggctccaccttcggaggcagtattccttctcacctgcagtgtcatttgctcgcttcctgtcaccttgctcacccatctccgtggtgtggatcccgcagccctctgctgacgtctgaggtccccatcacctgggaacaaagtcctccggagaaggggagccgggctcctgagagcctgacgcccccgccggcccccctgcacaggctgccttccccaggcccggcagaaagcgccgcccccagcccaagagtggggtctctgcttctcccagcaccgcagcctccggagcctcgcccaagcccgaccctcagccctgccttctccccaccgccttgcaggtcaccacagcttcctggctccttaggccttcctgaaagttctggaagcggttccctttgtggtgatccatcccttcaacatcctgtttcggaaggcagtgtggccagccccccttctcaccgtttggtacctcccccccagcatccattctctggatgcactaagcttcctgagcttcgcactcccttgagtggacctctcccgtccacctgaa

SEQ ID NO: 24871 - DNA, 1329 bp, Bovine  19866880500347
gtcttaccctggggaagaataataagcatcttgaattatttgtctggataataagaaactttccctggtatgagtaacgatgtctgtcaaggcaccaccttctaggaattccatgaccaccccagagctcatcactaacaaggtagctgttgtacatatcaaccacgttgtcatggtgataatcccgcattatcacaacctgggcaaaatggaaagacgttatttgatttaggaaggtgaaattaagctttttgttttcttgtgactacatctgggctgtgagtttaatgatggagaagtaatgatggggagggagagacagattcagaagcctattacagataaaggggcagcgctgagagttgctggtaggaatggagatcacgttagcaaagtcagagaaaacagcaggtcagtgaggcttgggaagaatcaagaataaagacaggcagaaccatagaagggtctccattcgcaagagtgaggttagttgactattctgggggatgtgatcagatttctcatgggttgctcttaaaacccactgtgcatactctgttaactgggcaaaagagtcaccaacgcaaagtaactgagtctcataaatgaatgaaaatcacggtcattagggtttgggccacatgagaccaatttcacttcttgggaggtctgcgttgagtctgaaagagtttgggctgaatacaaaggacaagtcttgaaggtaaaaaaattaggatttaagcataaaaaggtcaacttgtgtctgcttgctagagagagcatccaggaattcctgtcctgggcctgcttgtggtgacactttcagaatcagtattgaataataaattatacagttatttatctaagtttgtttgtcctgtctcttctggcactgcaatttggaaataagttccagaaatcaggagctgtggatcaggaagaagctgagccccactgacctggtgctgtctgtgagatctggagggtgggaaagaaatgaacgcctatgggaggtagaaatgcacggagctactggtggcttcacatgaagccccacagcagaaggttcaaagtcacagctgagggcacagttacagctgtatgaacctgctgtctgactggggctagtcacataaactgagtccaggtttccttgttgctaaagtggagataacatctttctgtcacctgaccaatgcttagcacagaagggtgacccacagggaggaacttcctaaagaggcagccatataggcacagaaaaaaggatgccgctttgtatttacatttttagcattctctaatgtcataaaatgtacaagggctatt

SEQ ID NO: 24872 - DNA, 1291 bp, Bovine  19866880554079
tatctggttatgctgggtacttgaataaattaacaacaggaagagagataaagagggtctagggtatgtgtgtgtaagggtcatagtaaaggtcatactaccccatgcactttggtaacttgtatttttaaacttaaaaaatgtagcaggaatatatactatgtcagcaaacatacttggacttcctagtggctcagacagtaaagaatgagggccgtgagtggcgatgagggataccctggttcgaccctcagtagagaagattcctgggagaggggtgtggctgcccagtaccttggagaactccatggacagaagagcctggagggctgcagtccacgaggtcgcagagttggacatgactgagcgactgacactttcaccttttcactttaaacatattgtaaataagtattattctgaatggcatactctattgatatgaatgaaagaggttttgtaactagttatccaatgttataaaacaagtcttgcatttaaaaaaaaaattgcttctgtgagcaaggttataaggaatattattccctaaagataggctattttgcacactcatagaactcttaggataaattcccaatagcagaattatcaggtcaaagagtagtcttttgttaggagtttggttatgtgcccaatgtgattaaaaatattacacagctctttcataattcaatttgttttcctttccttttcattcttccctcttcattttcaaagtttcagatctaagcaaaaattaatagtattctcccaatttaaagagctttgtactgtgataacatgctactttaatggtgaattttttgtttctgaaatcagattcttattgtaagtgagaggcttagggcacttgtaattgcatcattgcacaagtcaacaaagtgctgtttattgcttacaaagttggtatgaaacaaagaaaaaagacattaagcacaacacaccagcagctttgaaaatgcaggaggggtcaagagcaagtttcaacatgtcatttcatttgctttttgttaaggtctgaagaaagtctaagaatatggaaacgcattacaaaagaagcattcagtcttaagagaaaatcattttatttttttcaacacgccttgggactagagttcttttgtttttgttttttaatcccagcataataaaataaaattcgttaccgcagatgaaaaattctgactgactgccgccctcgctggtctctctcaggtggccgtctgtgtgacactcgtgctgacggtacctgcactcacctgcacagcat

SEQ ID NO: 24873 - DNA, 1752 bp, Bovine  19866880583994
cgaaggtgtggacggagaggactccaggaggaggcacccgcagatacagtaagccctgagcagagtatgtgctttacaaggctgaggagggtaacgtagctggaacaaagcagagggagcagagggccaaaaggaggtgacatcagcaagaggaagccagattattcacggacactgactaagcctgattctcagtgaagaagccaatggagaccttttaagcagcagagttaaatagtcggacttaagttttaaaggaaaccgctgtttggagaactaactgtagcaaggcaagggcaaaacagagaaaccaattagcaggctgccccaggagtccaaatgagtgctggtgaacagctgacactgggaaaactggtcaatttggtgcatattttgaatgtagaggaaatgaacgtgctaatggattccatgtgtagtgtaagaaaaggaaatgacttcaaaattgaaaactagcatcagaaaggttaaagaaacaaaatcatttggtctgaaaaccaatgaatgatttccttttgacaaggatttttaggaatctgaaatacagtataactgcaacgacaagctggcatccaacttcggagcaacgggagggaagagaggaaactgtgatggcctctcccagtaagtcgcttttggaacacttgctgccatcagtcaccgagggagagtcgttagaatgctgaatgaaggtcaaaatcaggataccattctttcccttctgcccgaaatgacttttatgtaatacattccatatcagttattgtagttgagtttgacaggaattatccagatgaatggattaaacaacaaataaccaaaatgactgaaatgtaaatagatgaaggttaatgcaatggagagcaggaaccaacaagcagaaagagataagatgcaatataacaaattataattccaaaagattcataaactgcatcaattgtctagaaaaataaaatctgaaaacctgaggtttggcatacaaatgtttttcatctctctcagaaaattaaggatgctgtcaagatgaaaaccacttctcataaagataacctaatgtttcaagactgagaataataattttaaagaaattcaagatggtctggaaagactagaaagactgaaattgtaaatatcagagtacaactttctcctagacttcagtgagtctaccatctgaggtttaagggtgagagaagagtcaatgccacactaattaacatgcttctcagtatcccgcagagacggggacaatttggaaccagagcttcccaggtggctcagcgctaaagaatccgttggccaagcaggacactcaggttcaatccctgggtcgagaagatcctctggagaaggaaatggcgacctactccggtattcttgcctagaaaatcccagggacagaggagcctggcagaggagtccgctgggtctcaaaaagagtcgaacgtaatttagcaactaaacaacaactcaaactactgtcctttaggtttgttcccattaccttatacaatatttctacaccttaagtgcttaataaatgcttactgaatgaatgaatgagtgaaactttctaccacaattacccaaggaaaaccttaggatgaggatgaatacactgtgggaagataaacacacttcctttttttaatttttttaattggagtataattgttttacaatgctgtcacacagcaacagaatcagcatgaagtatacatatatcctctc

SEQ ID NO: 24874 - DNA, 974 bp, Bovine  19866880606533
agaggagaggtgagaaagagacattcattgctttgtttattgagtaaagtgctaccacctatttttttcttttaatggaaaggcaatgatgctgctatttttaacatctccccactcccttcctaatatttttgcattattctaacctatggagcagaacattttacatggtacgttattaaagaagatggctcataaaaattcatcccagaggcgctactgaggatttatgatgacattaaagatgcagttattaaaattgtgctttggattctgttaaatgctaagcatcgaagaaaagttgtagagaagagtggtcttctattaaactttcacatgtgatgacaaaagagaaactatggagggcttggaatgagccatctctaagataatcagagatacctcaaaattaaaataattcagttttcccatttcacaatcacacctgatggaatcatactgcctgttaatcattatgatagttctactgttttgaaaatatactaacaataagaattgaggaaaattgtttttcttgaaattgggaaagaaatttattttagcatttcattcaaagacactgcataagaggtcacacattctatgtcacagaaaacaacttaagtggtcatttgatagttgactacttgttctttgcaaagcaaataaacaaaattatttgtttattctgaaaagaaattagtctgagctggtggaaaagtcatatgcttaaataactttttaaaatataaacggataaatttagaaaggcagatgagttcttgctgggggaatgaaggaagctttagaggcagcattctaggaggttgctttaagggttagatatgcacatgaccagtgcattctcttggcaaaactctattagcctttgccctgcttcattctgtactccaaggccaaatttgcctgttactccaggtatttcttgacttcctactttgcattccagcccc

SEQ ID NO: 24875 - DNA, 1755 bp, Bovine  19866880637616
ttttattttgattacaaaaataagctgttattatgaagttcaaaatgcacagatttggatttgagtttagacaacttccagactgctcatcatactttctgtaggttgtaaatatttggcaaaccccataaattatgctttgtaaccaagtcatcaaataaacccatgattgaatactgtagaaagtaaattacaaaaatgttgtgtcttctttttgtagacaaaaaagataaggtcagatagtttattacaggtaataaaatcgtattttagtcaattggattgaatgtcagaatcactctgctgaattgaaattatgttgagtggaagaatcactgcaaaagttcttggagaagggatttattctttgttttgttaaggaagaaaaatcaagttcacatttagtcagtgctggctaatggctttgctcacactctgcagagctcccctgagatttccaggtggtgctagtggtaaagggcccacgtgccaaggcagagacaaaagagactcgagttcgatccctgggtcgggaaggtctcttggaggagggtgtggcaacccactccgttattcttgcctggagaatgccatgggcagaggagcctggcggactgcagtccatagggtcgaattgcaaagggtcacaaacaccactgaagcgacttagcactcatgcagagctcccctcctttcaactaggtcctctacccataggcaagcactgacctactcaaagggatctaaccagaagcctcacctgggactttcttaaaaatgcaaattcttgggtcttttgccagcctaataaatctgaaattctcagaatggagctcagctatctgttttgtttctctttttgttaatcaaagtgtaactgattaatataacagttatattaatatacaatgttataaacaattaagataaacaatggtatgttaatttgagggcacatcatcgtgattcagtatttttacagtaatattttaactagcctcccaggtgattctgatgctggatgaagtttaagtccccatttgcttagcatacaaatggacttagtccaaatattttagccactttgaacccaaacaagtttttatcaaattaattgacggcagcagtcaggtgaatctatggacctactgattcctgtggccttaccagaaatggttagaattcactaatacaaaaagcatgattaaaatgaatttatttctgtgaccctaggtgggaaaaagctatttcttgaagtgtagttttaattgtgttagctatccagtggttctcaaagtgtggtccctgaccagcagcttcagcggtacctgggaacttaatccaagatgtgagatcttaggctctgccctagtgctcaagttgaggagctcaaggttagagctgctgccctgcagaaaagctctgtaaggagtttctcctgcttctcttgcagagcagccttgaggaacttgcatttactggtttgaggaacttacatttactggtttgctgcctaggctcacctgagccgatgcctgctgaatgctaaaggagctcagttgtaaatctgcatttcccatccatcgtccaagccccaatatactaattgatttaagttcttcaccacattgtctcatggttttttgaggctcaagtttgagatggggtgcgtgtatgtgagcgtgtgtgtgtgtttcgtgtttccaagagtgactgttggcgtgcttttgttttattttttctttaaaccatccc

SEQ ID NO: 24876 - DNA, 1573 bp, Bovine  19866880673800
gcgcgaagccgcaaagcttttgtctggcctgccgtctcctctccatgctgacacaatccccagaactgtggctcagctgcaactttcacaaataatcgcttcttttctttaaagctttgtacctaaatatacaaagtgtgttggccagagttttattatgatcatttacatacttacaattcctgagtatttaaatactattggcaaactaacatgggtaaaaactattatgtgagattttgtaagagcccaagatgaagaataaagacacttgggatggtcctcaacgcccttctatcattgcattaccaggattctggctttcagggacattctctctaaggattagagctaatttagttgaaaaacctaggaattgtttattgagaactattttatcatagagatctctaatctaggaattatagtactcacatgtcaaggagtaaaatagaaaatgggttttctttttaatatttttttgtctcttgaaactggagggcagtggatttgaaagcagtccgtttgtctatttgtccatccatccatgatgcatacttatatatatttatttacttaaatatgttgtatatatttaaaatattttctctacgtatattgcatgtattaatatatgtaagcagaagcagacttactcattgtttgggtacatgctatgcatgcatgctaagtcgcttcactcatgtccgactctgtgcaaccccatagacagcacccaccaggctcccctgcccctgggattctccaggcaagagtactggagtgggttgccatttccctctccaatgcaggaaagtgaaaaatgaaagtgaagtcactcagtcatgtccgactcagtgaccccatggactgcagcccaccaggctcctccgtccatgagattttccaggcaagagtcctggagtggggtgccattgccttctcctacatacctttaatctaaagaagcctgtgttgaaacttagtaacctattatcagtgaaattgtattataatacaatgagggtatgagtgcccgtaaataacctcttactcactttgggttttgtaccatgtatattacctatctcttaaattggttaatccattgactttttaaaaacatgtgtaaatgttattatacacatacttctactatgacatcagcaaacatgttctaaaatgagtgcatcttgctgtgtcctgctacacagctgtatctaccctgattatacccaggtataaggcccactacttgaaaaatccagctccctttgatttcagatcacgttttccgttctctgttgcgcagacatcagataaatgtgatttctgctctattttgttgtttgttccattcttcttccttctgtgttcttttctttattcattctcagctgctattaatttatacacaattaaaaggacagagaagcatattaattgaaaaattgattacataaccttgaaggcttgcttgcagtgtccaggaacagcattttccctgattgatttatctgccctgacttaatagaggatttttctaccaacctgacaacatcttgtgttcaga

SEQ ID NO: 24877 - DNA, 741 bp, Bovine  19866880741728
ataaatacataaaaatttcacctcttaaaccctaaataagatgaaggactctttgagtattaggcctaggatttctattgcatgaggcatgaaaactgaacccagaaggatttttcacacaataatcgaagtgctttttaactaacctaagggtaccctcatttcaatgtatttttaagcagacaggctctactcaaagagccgttacatcatatattagtcacaaaactcaccgaagatagaaaagaacaaaggattagtttagaattcctaggggagaaaaatcaggagagtacatagtaaactgaaatgcagtaaataacatttaattttaacttttaatatgattttttttctgacccaaaggaatagacacatttaaattattttgcttatttatttaccactcatgacaactctcctagttaagtattccaaaccttctaaggaatgaaaaagaaaagccctggggaatataatgtcatgcttattctcagctccatgctgagtttcacttggttaagtcatttgagggtgaaagaatggtttccaaggagaataataattccttaactctaactggaaagggattaaaagaaaaaagtatgtggacagaaattgccacgtttggaaactcttctaagaaggataatttgggggaagtgggcaaagagccaactatagaatgttcatgattgcgctcagttttgtcccaaatctttgtggcccacgtactgcagc

SEQ ID NO: 24878 - DNA, 1850 bp, Bovine  19866880769626
tctatgaagtttttaatatatgcatgtctttactatttgatttttatatatctaaataaacatacatggtaagtagcttcatcgtgtccagctttttgagaccccaccaggctcctttgtccatgagattctccaggcaagaatactgaaatgggttgccatgcccttctccaggcgatctttccaacccaaggatcaaaccagagtctcttaagtctcctgcattggcaggcaggttctttaccactagggccacctgggaaaccccagatatacataagtatatatttatatgtattgtatacatctatataaccatatgagaacatattccatgatattttcccaaaattctaaatagacctataggctatatatgattatctaaaaggtacctgaccagagtacagttaattgaggattttacattgtttttcattcatgaccacacagggcaattatataaatgacagtgttgaaataaactatttagccatcctttaaaaggaagcagagacttgatcgatcctgataaatagaaatggaaccaaatcggttgacccacatttcatttgttcagcctatgttttatatacttaggggaatatataattaacttcacatcacttgatgttttacttcatccgacaacccatccatactggatgcaagagaaaggagccattttatcaaagtgctcagtcgtgtctgactctttttgcaaccccatggactgtagtccaccgggctcctctgctcattgagttatccatgcaagaatagtgaattggtaaccattcccttccccagggatcgaactggggtctcttgcattgcaggcagattctttactgtctgactcaccagggaagcctaactttcaataaggtttagacataaaaatttcaacagtttgtttgatgttacaattactagtcttcttaccacaagctgtgaaacatcctataaagtggttatttttatattactatgactgtctttggctgctaaatgtttgcttaattcatgattcaaaagctcccagacaagtagccaaactgggaaggagctggtacatttaggccttaagaacctgataacaacagcaccagccaaagatttacaaacaagtactttctccttgtatcttacaccattttctcactttttccaaaagaacactgcacatagtttacaaagaacctattaaagcaacttaattttaattaacagctgtgcttaaaatagtcatatgaaagtagaattttgatgaaacaagagaagcaagcgtttcctttagagttgactaaattggggaaggtgaagaggtggataaaggaggaatgtgggaatgactgggaagaaaaatgaggctttaattctggaaaatgggcatcaaagagggaacaatgcctgacggtaacttggtttaaatcactgagctccaagtcacatgtctttatacgtagcagtgtgatttctagttggaaagaggtcagagaagctgtttggctctttgtctttctaaactaagataacttcttttggtttctctcactctaattggaagcttgactttcgctttcaagatgttgctccgtgtccaagaatattgagaccttctaggatattcaccactgtggcccctgacatgtaatctgaaaatgaggccatccaactggaaaatgttcaaggatccttctgctttaaaataacaaaattctaaggtcacattagttctttcaaccaaaagggtacctacaagcttgaggtgatgacaatgtgggtatagtcaagtgctgacatctggcaggaatgtacatgtggtcgtggcctgtattgttaattct

SEQ ID NO: 24879 - DNA, 1302 bp, Bovine  19866880858051
gacagaagggcctggtgtgataaagtctatgagattacaaaagtcagacacaacttagcaactaaacaacagcaataataaagccctgtccattttgagaaaaattattaatttaccttaaagccaaagttatttaaggttttggaaattttctgtagatgaaaacagtccagagaactagacaggataataaatggattgaagtccattgaagaatgaattcagttacataaaaattccattggtctgaagatatcagacatggatacatttcagatgagttgaaaatgtaggaagtgtgttacagtattagttgctcagtcgtgtctaattctgcgacctcatggactgtagcctgccaggctcctctgtccatggcgatctccaggcaagaaggacatgtgaataaatgatattgttacttttgggaagagcctctagtcatggaacccccagttctcaaaggatttttcacaggaagtgaaaggaaatccacctgtacttctgaacaacagaaagcagaggttggtgacattcagtgacactggctacaataattgtcaaagaactataaattcatacctgtgaggtaggtgttgtgtgaggaattaatgaaatagtgagaaaggggctgagacatatcttcattcaaatccagtttctcaggtgaaacgactccattttcttctccactcagatagcgcataaatccatccactgatatctgtcctagaggaaatgaagagttaagaggaatgtgaatgtaatatttttatgggtttctgatatcatattattatttttttgcagaaaactctggtagcatccaagatggaaaacattagccacaactgcaatttgatatggataaacagtagtctagggtcatgctgctttactattcttatccccgaatgccagaaataatagagaaaatgtaattacaagagtctcacagactttcggagaatttaaatacctaaacatggatcaactgcttttaaaatataagaatggttacaatcctatgcatggacaccaaaatgtttttagtgcttatctctgggtagtaaagttaagggtacatttcccaatgttctctcataaaaacatgttacttttatgatcaaaagacttattcacacatggttttattatttaaaataaagtgaaaatgttttcaaataataatctttttcctctgaaaaaggaaataaatatgaccataactgaggaataaaaatctgaaggttcataaaaatgaaggtccttaacatttcttatttagaatacttttcttca

SEQ ID NO: 24880 - DNA, 946 bp, Bovine  19866881083438
caatgttaatcattagatatatgattattcaaatttacatgaagaacaaccccctagaaggatggtagtttagcgattgcagctgctgggagaaattttcacagtagctgtttggaagtacagatagtatttccttttatttagagtctttttggacctgtgaggccctccgagaaccttaagtctggcctcattctgtccatttttcattccctttgaaacaatttcaaagtaactgggtaaagttcctctcttatctgtcacaagaaacacaccagaaatttcttgtgcagctaccagaggaaaagaaagaaatttaaaagctcagatgatttgggtattaatacctaccctgaaagttagtgactctgcttgaaccaaattctgctgtaccattctgtcacatgttagtttttattttctcagcttgaatttgtaaacgcaacagaccaacaggttttacatcaagagtgacaagcagaaggaacccactcctcaatcagagcagtaaatgtatttttaaaacctctgaaaatgttctactttttccccaaaccaaacctctcccagcactcttaaaaagcttaaaattgaaatatatttataccaattagtgataccaagggaacattttgtgcaaaaatggacacaataaaggacagaaatagtatggacctaatagaagcaaaagatattaagaagaggtgacaagaatacacaaaagaactattcaaaaaagatcttcatgacccagataaccatgatggtgtgatcacttgcctagagccagacatcctggaaggtgaagtcaagtgggccttaggaagcatcactatgaacaaagctagtggaggtgatggaattccacttgagctatttcaaatcctaacagatgatgctgtgaaagtgctgtactcagtatgccagcaaattggaaaactcagca

SEQ ID NO: 24881 - DNA, 2907 bp, Bovine  19866881089853
ccccttttcttgctgcccttgtgtctgcgtgtgggcaagagatttaattacaatgaataaaactgaatggtggtctgagactcttaaaatcaaagtggggatcatggctgaatttcattagcaaacataaatacaaataggcacatcttgtttgtaccaatgccatgtgactttcccccttttgataatttcaatctaactctgataaatttcagaaaatctaaactgaaccatatgatgtatagcactgtaatacgcaaagctcttcattaaacattttccttttttgggtacttccccatgttataaatatcctgtgaaaatcatggaggacagtttgtcagacagcagagccttgatttaagacagtggagggagccctgccctctaaataagaggtcttctctggctggcagaatgggaaaaagacatagcattaacttccattctattccaagtaactgtgagcctataaatcttacggaatgtgtcattttatacatgtttttgtctaagtctgtatcatattcttcttaaaagttatttcagcattctggatataaacatctctcaattaaaattaattattaaaaattaccatttctaattgcccaagtcatctcaatcaaattatatgagagatgtgttaatttctttgctgtcattgagcaaagtaattacatggttgatgcaaacagcacagtattttagagaaaagttttttgtgaatgttatttttagcaattttatatgagtctaaatagaagtgtaccatttctatgcttaaactattctttccatgatactgtatgcacttaaatacatttatggtagtaataatttaatggcaataatattaagctttttttccccttacacctaaattataaacaattaaaacacaaatttccaaactattccaagctgcagacacatgttatgtataaacagtaccaaattggcagaagttagtcatcaaaatccccatggcaggcagggttggggagagaggtgctcagtataacaacagttaattcttatttttcttgtttgattcaaagctctccaggaggcaggaagttactattttatttgtctctgtatgtccagggtacaatccaatgcataacatataagtaggtgctcaatagacaatcatctaatgaatgaatgcatttgatttgcaaatagcttagtttcctctggacaatgagaaatgctaacatgtattcaccatgacagtaggggctgagatattgtcagctccgaaaaaatcaggtttagactaaatacttatcatttcaccagataatcgtcagcagcaattagtaggaaaaataaattagtgaccttgataattcagtcataaacaatgctgcaaagagtcactctgatgttagttctcagttcccactgggagtgtttctgggcttctcattactgttatctgccaggagtaaacacttttgcatcaatggagccaactgccttgtgtgccagaaagaaagaatccaagtcatctaaaacaacactattgaattgttttgttgcatcgaaacactttaagttccaacattcttttatggaaaagcttacagtagtataaaataatgttctaaaagtcttggttgggtggcagtattactcaattgtattttccattttcaaagttgtcaacaatgatataataaaaattaaaagaaaacactgcctcagtggcctttgctatgtcaaaaaatacaacatgagggataagtacatgaatagcaacagctgtttaccaatggtcaaggcaccaatttagaacagtaaacaaattataattaaaattctcaagaatttttagaagaaaatgaataataaaattacaacacagaactatcaggacacagtcactaataatgaaaatcactgtggtagccacctgagaaggtatacttttgtatgaacctattgtcattcattcatttaataacataggttgcgagatgcagtggctacagctgtgatcagagaagtggttcctgcccttcacgttgaacagcctaatgggggagacatattgaatgaaaaatgacaaaggtaatgggaatcacaaaatgagagtagagtataacgggaccaataagagcacagtagaggtgggtggtgatcaacagtgtttcttgaaggaaaagacactcagctgaggccaagctggggatggggatgagtggtgaaagggcaggacagaaaaatgttctaggttaagacccagaggacagatagcctgacttattccaaatgccagtctataggctatgcttgtcacaataaatagcaagtctaagacactaacccacaccacctaccactgaagggtttatcaacattcaggtaaaaaacgatcatgttatattaatgttcaactaattcttttcaatcactgctttagagcctgatataaactctttacatcaaactggaagaactggaggacttctggtttctgatccagcatggaagaagtctggaagttgctactctgtccttgtttactcaagtgaaagttgaacaaagtgaaaaatcaagaactcttagatccaaaggagaagtgaagtcacagggcaaaccactgtccttaaaacagagagacagacgaagagtcacgacttaatggaacagagatctataagcaaaaaccgctgtgggaaccagtgctggggtgggggacactgaactgtaactgacagactgctaacgctcagtgtggacaaacctggggctaaaacccagggggactcagacacgggtggtggggtggggatggggaagggagccacgcttttgtgagttttagctcctggaggtcaactaggttctcacagtgactatcacagaaaaacctcttcatgcttccattttaaa

SEQ ID NO: 24882 - DNA, 1205 bp, Bovine  19866881116045
tgtaatgtattttgccaatgaatttgtaatttttctgtacgatagttttgataatttatagtactttgatgtcacgtagccattgtatcagttgaagtaatacctgtttactagcaagagtttgaaaaaagtctttcctacttttttatccctttcagagaaccaacgattctttaggaactttgaatactgaatgactctcaatcaccgtcagctttagtagaatatctttcttatcttaacaagtgtcttatgtgatggaagaagacttaagagtgatggtgatgggggtgggtgcacatttcatttatccaaccaaaaataatgcagtgaaatttgagccacggtataccaccaaaaatattccttgggagaaaacgaaatattttgaaaaaccacattttccttcaaacctattagtagtagtaaaccatcttttgcacggcagtatgttcccccagtaccttctcttaaatgagtatgatgtccccttgtggccaaatttcccctccaaggagcaatttcagtgctaggatggtttgatgtatctgtgggaggtgctgaactccatgttctgcccctgtgccatcttgattcagcaccccagtgctagggtcatttggacttcattccccaaattgaatgtttctagaagactgcgagaattctagtctcacagaaggaaaagagaacagggcaagatgtttggttttgtttgccactgtttttaaagctctgtatgctggcacaccaaactcttgtctgtgcttacctttgtaccgcagtattcattgctgttgtttttgtaccgtacttggaagtctggactctagaggatgcattaggaaaaggggatttttcccaggtgtgatctgaattcagttgtgaccatgttacgtgtttctgacataggagagttgtgctgctgactagatcttcttgaatgttgataaacatgaatgactactacaatacattttgtgttgcttgttggaagaatttgcatgttaactgtaggccaatatagatttgcctttaaaactctggaaaagctacatagtcatcattagtttctattaattctgcatcaaacaaaagccatttgttaccaaactggaaaaccagaggcttttcttaatgacttcacatactgtaacaaacatgaatttaaaattttgaaaatgctctggctactctaagcctaa

SEQ ID NO: 24883 - DNA, 950 bp, Bovine  19866881175494
attgcaggcagattatttaccgctgagcccaagggaagcccaagaagagaaccatggtcatgcccatgtccaagatgaggaaaaagagacccaaggacattaaaggacttcctcgagatcacctaggaaccattcctggaactaatatagctccattcagtgcatcctctctaccggaccctggcggtgtgtcagtacctggggaattacctgtaagagtccaaggaagtacatttgctctaatgacccaaagactagccagtggggctccctttcgttcagtttatacttggcgcctgtcatcgttagggttaagccttaggttctgggaatcaggtcccaaagacgtccttttccttccctgtaggttttccagacacggactggggagcgtggactggttcactggaactcaagggagctacctctcttgatcatttcaaagatggtcttaaacctgacctagctccttcaatgtgatttcctttctagaatgaatgaagagcagatagctactgtctgtctgtccgttctgagagctctctcctaccttcacaaccaaggagtgatccacagggacataaagagtgactccatcctgctgacaagcgatggccgggtaaggttttcaggtttggtccgtccccagtttgctctgtcacttcatctgtcacgggtattatcttcccaagagcactttctcataattctgattgtccataagtcacctacaacacttcccagaaggcttacaaaaaggaaatcaccatcctctgtgtcatcctgttaatcagaattatctgtgaactgaatttgaaggataattttccacttaacaataagcatgggaagtaaaaatatggaaaggtcttttattttcctgctacatgcttatttttgttggtggggaaaaaatgactttctaggatgtgtccaccctagtatcacta

SEQ ID NO: 24884 - DNA, 1594 bp, Bovine  19866881233700
caagaatactggagtggactgccattcccttctccaggggattttcctgacccagggactgaacccaggtctcctgcatttccagcggattcttcacagtctgagctaccagggaagcccgtatactgtttactataagcaaatattcattccatcctcacagtaactctatgaaatgggtactatttttatgcttattttatgaatgagaaactccaggcaagtagcttgctcaaggtcacatggcttacaagtgaataaaatgggatttgaatgcaaaaccaggttttttgttccatgccattaactactatgctagcctgctgtagagcacatactctagtactggaaaaaggcatcaataaatcatcaccatcatcatcatcccaacaggaagggctagcattacctgggcagtgatcatgtgccaggcacagaaatcctataagaaaggtactttttaattcccattttcagttgagcaaactaaggcttagagaggttagcaacttgtctaaggtcacaggggtactcaatttgagtgctggaggcagtgccagggcaacagaaaggcagatggtagtgagtgtgactgacgatgttttatctccataactttcccagcactagcccggatgagaaacaaggatgatgaaaaggagagaaccctgcctctgtagcagttggcgtcaatctgggcaccacagattagtcctaaaaatagccccaaatgtgaccaaggaagcattttttcccatgatttacttatctctccaaaacgtgtgactttaatctttctgttaaaagaagctgggctcaggcaggacaaatgacccatctggcagaggcataaggaaggattagctctttgatttggctttgtctatcaaggtctaaaattcttttccagacttaatttacattctattctctgcaagtaatttagaggcacccgctagcatttttattctcccaatcatgagtctaactcttagaaagaaaaataaaacacaggaaaaacatgttgtgccaaggtaagcacagcaaaagtgctaaacagaggctgtgatattgctttgtgggttttgaaaaaaaatatacaggttaccttttaaaaggaacagccaaatgcatgcaaatattatctttcaaggctggaagcacagagaaatctctacaaattatgctttggaagacagatggcctaagaatcctcacagagttatcacacagttgagatgggcaactggacaatatctctgccagctagcgtggccaccagcctcactttttggagtcaaatgccaattgggcaggatctggcactcacatgtttggatgtcactgggattaggcagttgaaaatccattcatcatcattcaaaccctgctcttactgtaatgataccagagcatgttggaaagttactggtccgacggcttagcacctcctaaaaccacttccaagcagagccctcagaagtaatttccttggctcatattggttctcagtgctgtgactgtgatgtgtgttctgctagaccagctaggagaaagtaagtgcagatagttcaatatcccagggctcaccaaa

SEQ ID NO: 24885 - DNA, 1882 bp, Bovine  19866881292173
tccccaaaataacccataaaatatgcatcaaaattattttagaaatgtatgaaaagaaaacatgtgtttatagacttcattccatgagaaacaataaaatgttcacacacaaaacaagagaaaaaataaatcagagcatgattgcaatattatttaaaaatacacaaatgcatagatgaaaagtgggtatttgtatcgatatattagcagtgattatatcagggtggtttgcttatgagtgctatctatttccttatataaatggacattttctttatgtttaaggacatattcaaaaagtagccttttatccacaggtttttttttttttttaaatagtactttcaatgggattattttaaatcataaattggaacacctggagccttgttcctaaaacttgccacagctgacacattgcacatcatttttaaagaagtggggttgaatatgtcaccaaaacggcagtgattccttaggattataaattttaacataataagtcattatgcaaccatagtaagtccactcaggcctgagggaaactgttaaacaaatggacgtgtttctctccctggcctctttctcaaaaggaattgaatgtcaggagaatagatccattattaaaagggaagcatatttcaattgcttaaagaccttagcatttaagaacataaattattactctgatatcaatgtttatctactagacattccattttctatttaggtctgttgttattcatggcatatattatctctgaatctcttgacagtgctaaatatttataataacttatttttgttcccagaagtggaaagttcacatcaaaggattggaaacatgtgaaccatgacttagtccaggtctaaataaatgataattcattgaatttaaggcaccgtccgttttcaggtctcccgttactcatggagtgcctagaaggaaaagcaccaacaaattgtgactatccattaactatatgatgcatcttagttttagaaatgttaacatattttttaagtgcatattctaaaattgattaaataaatcaataaaatgcagactgttttaagctcaagctctgtcacattaagtgttttcttggcattaaataaaacagtatgtagtcatgtaagctaccactaacctcagtggtgcctttgggcaaatcacagtaaggaccttccttcatcttactgatttatactggagcaatttatgagaaacatacaaacctgccatgtccatcctgtgaatagtgcccctgagaaatggtgctcaagaacctgtgcacacatttgttaagccagaaactgttaaaaactgcattaattctttcatcatcaccataacaaccttaagaaatagacattgtgtgatccttgaagtgaatccttttggtgcccacccaagttgcctctgccatctggtgctcccagctcccagctgtagtgaacgttggttgctaacagctcagaacttcctctgcttttgaaaactgccttcacggaaggcacactgatcgggaagagggatttctcatctgagaaatatctagctgctgtgtcaggtactcgatcatgcagcatatctcattatatccctttgagctacttgttacacagctgtgtctctgacaatgccctgatgcatttgatgttctaggcatcaaagatttgtatcaaagcaggtgtagtgctacttgcaaacattagcaaaccacacggagaaggcagtggcaacccactccagtactcttgccgggcaaatcccatggatggaggagcctggtgggctgccatccatggggtcgcacagggttggacacgactgaagtgacttagcagcagcagcagcaaaccacagggatagatgaag

SEQ ID NO: 24886 - DNA, 733 bp, Bovine  19866881315941
atatgacaaccattttcaaatcagataaacagtgggatataaaacagaggctcataaaaataaaaggaaaatggcatcattgcacattagttcttagggattaactttaaatatactctaaaattgggaggcagtttatcaaagcagttcatcctgtactggcattttcatttcacaaaggatcagaaagaaacatggttaaggtctgtgtagcatgcatcgaagcaaaccaatatttttaagataaattctgattcaactgccaatattaatttcagctttacaatcctttctgtctcctaataccttcatctatgagtcgagtgatgattcaacagagaaacgtctggtctctctgtatctgtgtcctgctgaatctgctaacttaagatttcaaattcacgtattccaggaaaggtgtaaagttcatctgatattatcaatagcagaagcccattatttggcaatgcgtgaaatgactgtcatgtttttttaaaaataaaatgttcactgataacaaacaggttggaaagtcacaatgttccctggtgaatgaaaagcaagtcctgaagtttacagagcactcatccacaatcttaccacatccacaactcattcttagactcatggactagaaattgaagactctgcttgacgtacatccctgagcccaggaagatgccacaaaggcctccgaacagagaccaaagagatcccaggaaataaaagtcta

SEQ ID NO: 24887 - DNA, 891 bp, Bovine  19866881363673
ctttgttttgtggcctttaaagagattcttgggtcaagcctccaggggaccacaaaaagcagttttcaaaataatgattcatactggctatacttactaagattttttttttcctaccctaaactagagctggcaaaaaatatgaagtcaagctgtgaatttcagactttggtcatttttggtcatctctttgctagtctctaggaaataaagagtttcaatttcaggatatcagttaacactttaattttaggaagttacagttatttggccaaatattcatcattttaattttataaactaaatacagtatcctcagtcaacacgtcaggagcccttgtacactgctttactgcttaaagtgacatgccactcccaaattatatttctgatattaaataaccgaaacctatgggtaaaatttttatattgctaacttcttttaacgacctagaaactaacagaattatgaagacaacaagcacttcagcagcagttaaatgacgctggtgcaaagggaaaacatgtctttgaaaattctgtgctctgttctctatttaaattatggaaatgactgttgtttggcttaaggaaaagaaaaacacaagtgatctgaagaaatgagatataagacaaaccatgaaatacagataaatcacgcatacccttattcaagaaagttctcgtcccttcagtttatatcacaaagtaattttattaaggttttatggaaaggtcactattacatttctgtaatattaaaatctatcttagcatacagaaatcccccatgagcctgaaatattagttcaagactaagtttattaaggttttggcatgactcgatattaactttctccaaatatgacaaccattttcaaatcagataaa

SEQ ID NO: 24888 - DNA, 894 bp, Bovine  19866881400181
cactttatgaaaatttaagacagaggtttcagaacccataaagatcccccaatcttctgaattaatttgacccagatgtttacattatatctctctctacacacctttctgaagctcggtggaagctttccataccaacgaatttaaacaaatatgaagctctttaacatcagtcctccagaactacttgacccttcagaaatgaatttcaaaacatccattcatgttagaaatatggtttgctaaaaatacatactggatgtgattcaagtgcttgtttcaacaggagatctccaaatagatcttcacagtatttggacatcttgtactgttgatatttgctggagggaaagaaccgacatttgtaaactcaaacatccattaactgtccaggataagaacaagaaacatccattcctagcgattaaaaactcccactcaccaaaatgattgtgtctttgacgctaatgagctaattgatgtaggttaaaaagtagattttgctgctgaactaagagctggtaagcagaaaaaaagtgtctttcaactccatcacatctgactacaaatatattgccaagtcttctaactccatggaactttgagcaaggtgtcctgctctctgacctttggtttagaggaagcatttctaaaacatattaagaggactctttttttctcttttggaggtgttggggaatagtggtttgagttccttcttttttttcccataagactataggtagttagcacttcacaaaagaaactgttcagttattcaaaaagatgcagagcagggatgggaaatggggattagtaaacaacacggagagacagggtagaatgaatcactatacctgcagtgattttcaaaggagagaattacaggatatt

SEQ ID NO: 24889 - DNA, 835 bp, Bovine  19866881406343
attgttccccggcctcccttctccccaatatctgtcactttgttaataaagtccccaatccttgaggcaactgacacgtcagagtagctcatgggtgcttggctagaaaaatatatatatatacaaatgaaatatgtctgataatgcgtgtcagctgcagtatggggccaggaaagggtgaccccgggcatgggctgagtcctaaggggcctccttcctgtccccaagtcaccacgagcttctgttctagagctgctggtccatctgcatccctttttcctaagaaagcaaattgatagggtcaaaatttattactgtggttgtctagtggtctggatcctgcatacatatgttcacaagtagcccgggggactgtctgtcttagaatcaagtcacctgactggcacaaccagctctggtcagcagagggccatttcaggagccagtttggggagtgaaaaatacccagaaaggagaagtgattttattttcctttttcttttcttctatcccaccatcttggatctttgcatcacagaaaacagaattaatagcaactttttttttttccttttctgccctagtattactagaacctttgcatcggggaaaacagaaaaggtgatctttcaagcactcaaggagctaggtcttcccagtggaaaggtattcattaatttaataacattgttctaaaaccactttgtgtatttttgtcctcatgtaataagtaagattatttatattaagctgattcagttagattcagaattaggttcagtcacatatagtacagttaatttttcctttattctcttcccttctatccttcctt

SEQ ID NO: 24890 - DNA, 781 bp, Bovine  19866881485953
aaacactcttttacgtgcgccgtatttctagtaggctggcccacggttggaccttctggctcctatcaggaagagtcagaggtgaaaaccctgggattacaagtaatcatcactctgctgcatgaacctgtcagttctgtagatcctccaaagagagagaacggtgcctgatttatgacaatgcttctgttctttccagaatgatgaaattgagcctgccgcatttacttatgaaaagttctatgaactgacacaaaagatttgtcctcggacagatatagaggatcttttcaaaaaaatgtaagttccgtttatgagaaagtgtcacatcgaagttatccttgctcttttagactttaaaaccattttttgtcctaatatcttcatataatatgttgacagtatctaggaatgtctagtcagggttacattttcaccccttagtttatttggtgtaaaagttcactctgattttttgagaaacttttacataagttggttgcagcacctggaacttcccccctcctctccctgcattggctttactaactacctacaatgttaacctgctcctttaggtattaacccgttatgtgaactaacgagattcaatttggaatgttattatgttgttcaaaagtccattcattccaattatttcaaatggatgacttacatgttgttttataataacgcctttggataatgcaaaagaaggattgcggatattttctataagttagggggagtgatttattgcctttgctgtcttgggtgtttt

SEQ ID NO: 24891 - DNA, 1292 bp, Bovine  19866881545868
ctaagtaaaggttttctccttcccccaagtacaggtcttgttgaaggaactggctgctgaaaaatcacacgccagctgcctaaagcaacccaaatgggacatgatagggtttggaatgcacagtgtaggggcagagagtcatggtcccatgtgccctgaacatcctatgtgtgagcatgcagggtgccatctgatggcttgtccttggaaggaaaaaaataatggactcaccagaggggaaaaaaaggtttggtcatcaagttttcctttttctgaggtttgtgcttgcatagtttaaattgtaataaaaattaaaatgcctgaaatgtttgtgagttggaattctctgctgctttacctcatgggtgcctcccagaatgcttcctgagatagtgacaggacccctagcagtgcccccagagaatgttctttgaggatctcactggcagtcagaaaagaggatttggtgttctggtggttcagagggcaggcaggggtgtctcctttctaaggttgcttgttgtccatgtgtatgattttatcttttcacatatgtcctagatgggacatccttataaacagctttatcttggtcagcaaagtcagagatttggtgtactagggaaactcacatattactagacacactttgcttacctttgtggataattgattttctaaaaaccaaagttgttaaaatactaagttttatatattttatcataacccaggttgtacaattgctagtctaacataccagactgttaaaatatcccaaataatttaactttcgctgattctgaacaaccgtgtctccctgggtcattatcagtatggtatgaatgtcgaattctagttgttggggttccggtttacaggtagagtcaggtggacatctgagcagtgcatcatgcggcctgtggcaggtgacaactgcaggggcgggcgggaggggcttgaatcaagctcagaacatgagttttgctgaacatgggatgtttttgtttttcctggccacaccccacagcatgtggaatcttagttccacgacaagcatgtagtcttaaccactggacctccagggaagcccctcaagtggtgatgtcttagctggaggggcttgctcctgttggaggcacagatttctgctgatttaggcttgacctatgactgtgcttgatgaggtgttaacatgggtagtgcagatgctgggggcacagaggggaagggagggtaactggattgcagagttttgagagaagcagtgatggcttgtgtagcatctgaagggg

SEQ ID NO: 24892 - DNA, 2097 bp, Bovine  19866881782886
acttgggtttcactttaaaggactcctaattggcaaagggatgataatgaaatccaaacatacagaattttacaacacagtttaaccaggcttcgaatgataagaactattatttattactttcagcatctgatgtttatgaaagcaagattgtgcagttttgcagagatcaataatacaataactgcaagagtaccagtaaatctcatgctgcagaccagtcaggcattaaaaatcaatgcaacccaatctacttgagtttgacgccatggttctcattgtctctcctctgtgcctggaccagctcaccgtcagctctggctcccagtgacagcagccatatttcatggtccttctttctgaggctgctggccagtgataagctataatggatctgtccctaagaacagctgtctccccttgatcctggaaagagatgaaaaagtgcctctgctctcacaagctgtattaaccctgacaataataaagtgtgtaattaacagctttgccctaataagacctcacatttcttttttgaaacaatgacttctatcctcctcaaaaatgtgtttcattttgtctttctggtaaacacttctcaggaggtcaataagctagacagtcccctgagtcaagaataagccagggcctcttagaaaataactgactttcaaacaagccatctaaacttgtaccctctttgcagagaacccattccccttttctcacaaggaatatggctagaaacagctgggtacataatcccaacaaacaaacagctctgatatactttcatccttatgggaagaaatgttggcttttattttttttaacatcaaaagaactcagatcttctaacttctttcagttttctacacatactttttttgataaccgcagagagtgaggctaatcaggtgagtcagtcgagaatcacatactcctgcaaaatatgagaattagggcagggtatctcaaagtggaggaggtaatgagggtttctaaccattaaagccattttaaataaattatgcaatagtcttaatcatgcaaaatccaaataaacaaattcctttactataaatattatgttcaacagaaaatataaaaaaatattaacagaatgcatctaaggaaggttctgtgaattttgtagagatcaagattttgtcattacagtaattgggttttctctgcctttgaaagcacaataaatctaacacatttagtcatcagttcatacaaggataacacccaaaggtgacttcctatttagtgttaacttggcaaagcaaatgtatagtttatagccctagttcttgctgcttgcgacatgcaaggcagccaggctggagtcaactgaagtcagtttgcccagagttaatagttaaaagggtggtgttggagaagactcttgagagtgccttggactgcaaggagatccaatcagtccattctgaaggagatcagccctgggatttctttggaaggaatgatgctaaagctgaaactccagtactttggccacctcatgcgaagacttgactcatttgaaaagactctgatgctgggagggattgggggcaggaggagaaggggacaacagaggatgagatggctggatggcatcactgactcgatggacgtgagtctgagtgaactccgggagttggtaatggagagggaggcctggtatgttgcgattcatggggtcgcaaagagtcggacatgactgagtgactgaactgaactgaactgatgttatagcagcctgatctatatctttaacacaccaaggatgacttaaattaacagatgtattaacaataatagccaccattgttgtatataagccatgtgccatgcagtgtgctagatgctctcagtatatatgatctcatctgatctttcacaataactctattaggtagttattatcagccctattttatagattaggaaactgaggcccaatgaggtggacaagactgcaatgaactgttgacagagccatggcttgaactcaagtgtttaaactttcgattttgggctcttcctattaccctgtgctgggtacttacctgctctaaatgagtt

SEQ ID NO: 24893 - DNA, 1500 bp, Bovine  19866880052542
cagtgacttctcctgtggtggagcacgggctttggggcgaaggggcttcagtagtggctcccgggctctagagcacaggctcagtagttgtggtgcacgggcttagttgctccatggcatgtgggatcttcctagatcagggatccaacctgtgtctcctgcatcagcaggcagattctttaccaccgagccaccaggaaagccctttatttagacttttaattagagattgacatgtgctttgttgtgttactctctgatgagacaaatgctagattttttcccctctcttatcacactattagttgttattttagtcactcagttgtgtctgactctttgtgaccctgtggactgtagcccaccaggctgttctgtccatgggattctccaggcaagaatactggagtgggttgccataccctcctccaggggatcttcctgacccagggatcgaacccgggtctcctgcattgcaggcagattttttaccatctgattcaccaaggaagtccagagaaagagagaagtacagatacacacacgttacacagagtttacaaagaaattataaagcaaattcctgcatgatcccaggagccatactagtctcttgagcaggagcgacaagatcagatgtgacaggctggccaaggggacttgggtaggtaggttcagatttgagacctccagcatgcactggtgggagaagaggagctgaggggagtagccagcaggctctggatctgctggtgggctcagatggctgaaggtacccactgagtggacggctggaacggggctggtgggctgagccaggcagagcaggagtgtggttggggaccccatggacaatggggtggggaggcaactccgggagctcttccctcccccatcctggcaccagttgggagtacagctggggcatccaccgcactgtgtctttaagaggctctgtccttccagcttctgacgtcagggctagggagggcccaggagattcgctttacttttcctggaaggggaggagattgaaactgagtggcctcgggatggaatggggaagcccccggggtgcaggaggcccctgagtgaaggcagagactaacatggggtgagcttctgtgccagtgctgtgtcagagagagagacaaaagagaggaagagagtgggagagagagattagagattggtggtggcggccctgcaatcatgtgtcattcatcgtgctcctgcgtgtgtgtgtgtgtgtgtgcgtgtgcgcgcgcgtgtgtatgtgtgtgtgtgtgtgtgtgtgcctgtgcgcgcacaggcggcacctcctgactcccactgttcctgtcttggggccttggtctgggccgcacagtggccagtggctcctgttttatgaatgcgattgggtattttgagtctggggcgggagggtctgtccttagtccatcccaaagctgtgatgtcagctggcctatgagatggaagaccctccacccagggtgg

SEQ ID NO: 24894 - DNA, 1303 bp, Bovine  19866880197737
tcgtagttggactgacatccctggtgatcggatcctcctgtttttgttctgaattgttagcctcaattggtttgtaggtttggaaaataataaaattggaactcaggcgatgtgaagattgtctatttctgtgtccctcagtacatatgtatggctctgacctcacctcctctcccttttcagggtgaaaaggctgatagcttttacattatagagtctggtgaagtgagcatcttgatcaaaagcaaggtgagtttatgtgtgatgatgtgggttgttccaggggagatccagatgccaggtatatgcacagaatgtaactgtgtttactttaatagtgtgaagtgtatttcatgtgccagaatcataattgttacgtgagatatgtgactgacagagaccagggtttaagccctttcattgataaatatttagtatatatatatcttttttgttgcttttacctctgttatgtaattaaggatatgagaagtagtgacctataaatcaataagaaaaagggtaagtaccctaatagaaaattggaagattattgaatatataacaaagaatacattgtgagtgttggttatgaaaaagcttcctttttagcatgctaggaagggagtctctagggcagttattattgtggccatttaatggatagggagacccagaaaacacaatgacctataggtggaaagagtgattcttacaataaattcatcatcattagatattgtttcagttttttttttcctttcagcactttcttttttttgttttgtttttaaattttattttatttttaaactttacaatattgtattagttttgccaaatatcgaaatgaatccgccacaggtatacctgtgttccccatcctgaaccctcctccctccccataccctccctctgggtcgtcccagtgcaccagccccaagcatccagtatggtgcatcgaacctggactggcgactcgtttcatacatgatattatacatgtttcaatgccattctcccaaatctccccaccctctccctctcccacagagtccataagactgatctatatatcattctagaaaatgttggtctattaattggggaacatttttattttattacttttaataatagaatacttaagctgcattttactcaaatgatgatctcagctccacttctgtcacctaattttttacccattccctgtattgttaatggtacatttactctgaatctttaaatgaaaaccaaagtcgtataggaaaccccagtgcacaggacagagaagttttta

SEQ ID NO: 24895 - DNA, 1886 bp, Bovine  19866880403748
cttcagaagattttatttgcaggaactgggtagtaagaaaattctatttcccatcgctcttgtgtctgcacattctgggattccctagcaggcccagcacttcagtcatccatgggccttcagcacacggccctcaaagtactgaagaaataggaaatttgaagcatctctgtgctcaggaggcagccgtgttctccgtcttcaccgagagagggaagataggcacacacagatcctgtgcagagccctatagacacataccactctgtgtgtcccaggcctgaggtcttcactgagaataatcacaagagatgcctcacaccaaggaggtgagacgcagtcacccacttccactgtgtaactgctaccggtaaggaggacaccacactggcatctttagagaaattactctgcagcataaagaccctccaaactaagccagggtcatgcaaacctgagcatttccttttgacatgacccaaatgcatggttcacaaatggtactgccttggaggaagtaccaaagcaggtcagagaaatattaaaagtcatctgtgtttagctacagtgctaaacacaatgcaaaagaagaagctaaggttttattgcctcatatgactgtggctaagatgctaaaaactgttaaaatgatgaaaagctaaaagacaaaaatattttaaaagtcagtgttaccggatcaagatttttgaaaagaagaatatctttgcaagcttcctgaagtctgcaccgctgttgatcagttttaggatgaatcacctgccaatccaaagaaaacaagggaaattttaatattctattttaaaatattacttaacttacaaattagaatatttctttctcctaaaaatgggaaaaattaagagcacatttaccataattttaattttatacaaataccaagcagtaccctgatcgtggacaggcaatgggatgggggtatggctggcagcaagtcagctatctgctgggagccccagaatccccatccataaagcaggaggttacatgttcattcattcaataaacattttcatcaactaggtgccaggcaccatcccagctctggggacagagcagtgaacagaagatacaaacacctgctctcaccatcaataaatacataaaggatggtagagagtgacagggctaaggagaaaaatacggtggggaagggtgattaaaagcgtgtgtacatgcaggcatgtgtccagatgaggcctgagaaggtgacatttgtgtcaagatcctaaggaactgaggacaacctgagggaatgagtcatgtggacatctctgtgaagatgacctcaagcagaaggaacagcaaatgaaaacaatatgatgggtgaatagcatgtttgagaaaaaccaggagacaggtgtggctgacaaagagcgaggggaaaagatcaggaagagacctggttttgggcttaggtggagggcaatgtaaatcacagaactggaacttttctctagtgacatgggggcactgaggaaggaaagagatctgacagatgattttaaaggcttaagttggttcctaagtgaagaacagccttgacggatacaggagcggaagccaggaagcgtctgtgattatcctagtgttaaactggggattaagaccaaggtggtagccatggaagtgttgagaagtactggaattttggatataatctgaagaccaagcccattggatttgctgaaaaattgaatgtgggtataaaaaattaagaggagctgagggtgaccttaaaattgtggacctgagcaacaggaaggatggagctgccatttaatgagctggggaagactgtgagtaaaaagaatgtctcaatgaaatcatcaggagctcactataaa

SEQ ID NO: 24896 - DNA, 1720 bp, Bovine  19866880453162
acctgcaggagaggaaatagcaagagatgatggcctggcttccagagcccttgaggacttagggctcgaaccagggaagtgtgtgtgagtctgtgtgtgtggggtcaggatgtgggtggtggtgtgtatgtcttgggtgggtgggtgggtaagtgtgttttgtgtgggatgtgcttccgggtatgtgtctctggctcgtatgtacaggcagtgtgtgcatgcatctaggtgtgtgctcacacccatgtgtttgggtgttggtgtgtgcatgcagggtgggtggtgtgtatacttcttggtgtgtgcgagcatgagtgtgctcacgtgctggtggcagcctggggcaaggcttggcctgggcctgtgggcagggcatgtacctgggcaccctgagagggcagagtttgggcagagggcaaggatgggaaatgctgagggcgggctgtaggggggatagggccaaagtgggggccagactgggcccaccggccactcaactcctccatagctgccctttcccaggccctgaggatgcctggttccgctgccctccccctccatgggctccgaggaggcgtcccctgtggaatgtgtttggtggctgagggccaggctgggcccagctccactagcagactgggcagcggggaggggtacctttgtgctgcctctgtggtggggggcccatgttcctgccgcccagcccccagctccatgctctgctctctccccggctaggtgactcccgctcagggcatgccgttgtctcctgatccagccggccctgccaggtgagcctggcctcacacccaagtgtgggactccccacctctcttaggggctctccaagctggggtccagctgtttaggccctgtccatggcagccttgaccctctcatctctccggtctgttggttttctgcttatcacccttctggattcctagcctgaaaggcccttcacccacttcttgccctgccctaacatgcaggtggcccataggatctcgccctctcgtttcctgcccaggaaaccgacatccatgcagaggggccttctgggtcccttcttcccattccctggctctcctgccccttccaggccctggtccccaggagcaggatgtttcccgcatctctgcctctctagcccctcacccttggaccctgtgttgacaatgggcagtctaggtgtggggtgggggctgccggtctcctgagagagtgatacttacagagaacaggcagtgttgacgttcccaggacagcgtctgctgagcccttgcaaatgtgtggtcctgtggtcctcgtaagcgcggtgccatctcagcctggttctcgctgtcttgggaggggcatcttggcagtgtcacagccctgtttctcaccagtggtcccatggggctcaggtggccgcccgagccctgctcacgctctctgtctccctgccaggtgaccatgcctgcccttggcctagctctcctccaggcgctcttggcccggatgggtcctcggcctccaacccctgccaccgacggctttcactcccaatggtacgcgtctgcagcacctggctcgagaccccacctcaggcaccctctacctcggagccaccaacttcttattccagctgagcccggaactgcagctggaggccactgtgtccactggccctgtgctggacagcagggactgtctgccccctgtgatgcctgacgag

SEQ ID NO: 24897 - DNA, 1417 bp, Bovine  19866880484057
ttcaaaaccttaaatacatgggttcatgatgatgcggaaaacctcactggttacctctggaggatgttaagaaaccatctcgttatttcaaatagtaaactaaggaaaataagcatttaacctgcctttcctatttgaactatacttcatgataagcacgtagttgataaggaaaagcttctctttcagcaggattccagctcatgaatgaaaaaggaatgacaaaaaaccacctacttaaaaaactgatttaaggcaatggcaatacaaaagagagggacaatgaaactctgcttcccatcaacaggtaaataccatttctgaaggagtcttgcctccactccctcaaactgcccctgaatctgatcaagcctgtagatcaaattatcaacttaatagaaacagaggggaaacagtaatgtgtaaaagacaccacaagatgtaatcagtaaaatccagagggtgggtaactctagaagaccgtttctctgacaagaaatttccaagaagaaaaaaacagaaacgtatttttaaaagacttaaacgtttcaactgaatgcaacatgtgaacatcatttggacccgcattcaagcaaaccataaataaaacatttataagacaattaggaaaatgggaaaacaaattagatatttgacagtaacgaattactgtccactttcaaggagtaacgatagtattagtgttttaaaatatctttatcttttagagatatacgctgaagtgtatacagatgaattatcggacacttgcttcagagagagttcaactgggggttttgggtatacagagacaggagactgacatgagcgggttaaccagctgctggaactgggtgacggtaccattaggttcagtgcattctctatagtgtgcatccaggttccctgattgaaaaaaagaaaggagcctttcccttgtgatttcttcatgtggcagcctggtaaaccagactgaaagatcagtccaaccccaccgcagactctggcatttaagctctacttggggacttctgcaagtgtgtgaaaacataaaccagcttcttgcattccagcgtaaagcacctcgaatgcaagttggtccctcaggaacccatcaaacttcctccccagcacctgcattcccagaccagcgctcagcccagagggaagtgatgtctgcccagttatcacgcagggtgtcctggcacaaccatgactttaaaaaatccaatttctctctccaagcctgaagggtctcctcccttgtcctcccctctccccaatgcagagatgccctgtgagcaaaggatactgtactggttccggtgtttcgcattctccttcattctctgtaactgttgctggtgacacttcatgctccaagggttgtagtgtttaagctgagaacttacattcc

SEQ ID NO: 24898 - DNA, 1327 bp, Bovine  19866880526958
ttccccgacgcagcacagctgtgcccgggacacacagagtctctcaggtgctggtgcagccagagctcactccccgctctcctcacttatctctgtgacaatgtctatcaggctctggagcccaaagatatagccagcatcctggccttcgtggaccacagtgtcctcaccatacagcctgcacgtggtgtgcgcaaaatcgatcatgcgcacgtccaccgagctagtgccgatgggcttgtaggcataggcgccggctgactcgtcagcagactcttccgacaggtcctccaagtcctccgcgtctgagtccagggccacttcagcccgctccttgccgtcatagatgatcagcagggagcttgagtagaagcggtaggattcttgtcgctccagcacgcccttgagttcagtcagcttcctgagcaccgggcccaggagctcccggcgcaagtaccggccgttgtggaaaaactggaaaagtgcctctttgaagccctgtacggacagcttccgtccgtggtacttgttcatgaacatgagctgcccactgcccgcctggtacacctgtgggagggagaccagcaggtcagggaccgacaggcatctctggcagagatggcccagccccaggagagtggcagcaaagacgacagccctggacccgatccttcaactcgttcagtataccagtcacacgaggccctgtccttgccagtcaacacccctacggccctctgacttgggcgccgtcgctagccctctgttcagtgtgtggcttggtggggagtgcccaatgtctctcctttcctctctctccagtccatagcttctggactcagccagtttggccagccccagagagcattacccacacacacaggctttccttcctcaccagagagcaacaggatcagtccaatctggaatcttttgagaaaatggggctctgccatggtgggagagtggcagctcccagctgcccagccagcccacccccaccacatgccaacactcctctcacctgcatgccgcacacgcgcacaccgatgactgccgacgtgctctgctggcacttgcggatctggttagctgccttctcctctgaagcatcgtcaccatgctggcgtgtccccattttgaggtccaggacacaaggcacctcataacaggaagtcaggttctccagtaagataaattctgagtggttaaaggataaggcccctctaaagaaagggtgctgctccatggcactcccagggtacagggcctacacatggcgtcccagaaatcctgctctacctcccaggcgggcggcccagggctg

SEQ ID NO: 24899 - DNA, 1023 bp, Bovine  19866880531824
tcaacccttgcctcctgtaatggtctgtgagctcccagagcccatgagttggtctgtcgcgcccacgtctgagttttggattcaagccacccaaggcctggctggtggtggatacggggtgtgcatgtgctgctggctcgttggaggtggacaagatgtgtgtatgggggaagacacctgaagagctgtctcccaagctcctgaggggcatcccgggggcagccaaggtcaaccccatatacttgagggtgaaacaggttcaagctccacgccccagaagtggctttatctgtgttgcccagtctcctccagctagagaggtgccgtctgggagtgggtgtggtgtggactgctggtcctgggtgggggcgagaagccctggatcttgactggctttatttaggttcttttcttttggccgtgcacggcatgtgggatcttcgttccctgactagggatcgaacccatgctgccagcagtgggagtgtggagtctcggccactggagcgctgactggctttctgtcaggttcggcacagtgatcgccatcggggtgaccctctttgtgatcgctgtggtcaccgtcattgtctgctgcacctgctcctgctgctgtttgtacaagatgtgccggcgcccgcaacgtgagcatctcccctctgccccacggtgaccccttggggacaggtgtagaccccgggtggtggcagtgggtttatcggggccctgactggcctgagctggagggagggtggccagctcggcggtcctgactggggctctctttgcagcggttgtgaccaccaccatggccaccacggtgacccacaccccttacttgcaaccgcccagctaccctggaccaacgtaccagggctaccacttccgtggtcccccagccggggatgccaacagcaccctacccgacccagcccacgggcccccctgcctaccatgagacgatggctggtgagtatgcctgccgactccgccatgcgtgaccccctgcagccgtggccccag

SEQ ID NO: 24900 - DNA, 918 bp, Bovine  19866880610390
tcgccaggcctgtggcagctccagctttgtatctggtggtgcaggcagggtaaggtctggtgagatcccatggcgtctgaaaggcccggggaatggtgcatgccagccttggttagagaccccccccccccctaccccagagtctgggggtccgtgggaagctctctgctgccaggagcctggaaagacacatcggaggccagtcctgtgccctgaagcagaggaaccctgggcagagaggcaggggcgccctgggaggggtccaggcctcgtgggacaccgtgttccttgcctttcagtttgcatgaccaactgtccaacgctcattgtcatggtggggctgcctgccaggggcaagacctacatctccaagaagctgactcgctacctgaactggattggcgtgcccactcggggtgagattcagcctcggcttcccaagcagggcttggggtctctgtgggggaggagtgagaaggctggactgcaacggggccagaggggtgggtgaaggtcgggtgttgggaagggatgctgttgtgtgacaacagagcctctcctttcccccagagttcaacgtgggccagtatcgccgggacatggtcaagacctacaaatcttttgagttcttccttccagacaacgaagagggcctgaaaatcaggaagtgagtgtgtgtctatgcgtgtttatggagaaggccctggagcccagttgctagtgatgaccaagctgttctctgagcctgggccttgccctgccctgtgggctgtgacagagctggtttcttggcatctcaggctgtggtgggggtggggatatgatgggattgggaacaaagggaaagggttttgtgggctactggtggctgccctgccctgccctgccctgccctgttctgttatctctgggagggag

SEQ ID NO: 24901 - DNA, 908 bp, Bovine  19866880651011
tccaccccaaatctctgtaacttggccatagtctggcacatcctctgctctaacccggggacagccttcctgctccagggttcagttcccgccttacagcggcacacagcggggtcacgcaggtccttggtcgggtcccggtagaagaagggccggcagagctcacattggcgcccggctgtgttgtgctgacacccatcacacacgcctccactcacattgccggatgccaggtatatggccatgtcgaagtgacagctgtgggcgtgcccgtggcactcgcactcttgggagaggggaaggaagagagggcaaaggtcactggagggaccgtgccctgagaggaagggacttagggacccccagtgccaccttaggtccctgccaccggccagaatttgtgggtgggggtttggctttctactgggcccctcatcagagcacgctgttgagaagggttgaaggagtccccgggggcattgagaccaggatgaaaagtgaaagtgttagttgctcagttgtgtctgactctctgtgaccccatggaccacagcccaccaggcttccctgcccatggaattctccagcaagaatactggagtgggttgccatttccttctctaagggatcttcctgacccagggtcaaacccaggtctcctgcatcgcaggaagtttctttaaccatctgagccaccaaggaaggccccttcacaaatccttttttttttttggccacgccttatggtttcaggatcttagttccctgaccagggattgaacccaggccctggcagtgaaagcgctgagtcctaacgactgggccaccagggaattccttcctgatatccttcagacacaatctaggtgttagggacttaaccaaccatctctaggttgtaccctggg

SEQ ID NO: 24902 - DNA, 1743 bp, Bovine  19866880667137
ctccccctgcagataccaaaatccctggatgctcttgtaaaatgatatattatttggatacaacctgtacacatcccctgggatactttaaatcacctagagatgacttaatacctaatgaaatgtaaatactatgtaaataattgcaaatgcaatgggcatagtacagtgtaaatagttaccagcacagcaaattcaagttttgctttttggaactttctggaattttatttagatttttttttcccgtgtcgaggcatgtgagatcttagttccctgaccacggattgaacctgtgcctcctgcagtggaagtgtggagtctgaaccactggactgccaggaaatcccctttttggaatatatttgatcaaggatggttgaatctgcaggtgcagaacccatgggtacagaaggctgattgtatacgcctgggtgaaagtgaaagttaagttgctcagtcgtgtccgactcttagcgaccccatggtctgtagcccaccaggcttctctgtccatgggattctcccaggcaagaatactggagtgggttgccatttccttctccaggggattttcctgacccagggtcgaacccaggtctcccgcattgcgggcagatgctttaacctctgagccaccagggaagcccaactcacagtaattgtatatcaattagtatttcacaataaggctaataatgaccaagtgaaatacaggtaaaaataaaaacctttaccaggacttacgttacaaagtgactttatttatggaacccaaacatacctcataatttgttatgttattgtctctgtgattgtttaattcatctgtacctctctcatgagattattaaaaatgaacaactaaatagtggtgattcaagtcaattcattcatgaattgattttgattccttttctatgcccatttggaactcacactttgttcaaggctttgctcagtttccacccattccacatagggttcctgactactgagaccattttctatctccctttgctttccacactccacattaatttggggcattactttgtacctaaggagttcagtcttatggggttaaacccagtgcttgtaaaaaaatagaaggatttctggcttcttctttcaaagctttcttctcaccaccccattatagctcttcacttaagtttggccaagtgtatcctctttattgggaatttgaatcttgagcaaagtaatacagaaacaaaatacaagaactaaagaaatgactagaaaaggtcaatttaaaggaactttaaaagcattgataggaattcaattcatactgctgaattaattttcaataagaagagtacaaaagtaagtaatcatcaagtaagcaaactattccttgagttatacttttcctagtaaaatctaaaaacatcataatggaaactattcactaaccacaatatcttctataaaataaagccacattcatgtttaaattctacaattttttgttaaatacaagacaaaggcttttatctcaccatgaagaccaacagaagagagaggaatgtggaattaatagtcaaagtcaagtgaagtaataaaatggagttctccgtgacccatggccttttctgcagtactttagtacattcctttgataagcaaataccaagatcacattgcattcataacacactaggaacttgcacaaagagattgatttcattttttattattcaaaaattctaaatgagt

SEQ ID NO: 24903 - DNA, 2263 bp, Bovine  19866880678386
caccccagtcccacttgcaggtgactgacgatgcagtagggctgggggccgcgcaaaccacaggtggacgaggcggtcagtctgtcagcgcggcccaccagcaggtcgcctgtggcagggtagcagcttccccgagaacagcttggcacatccggggctggggcctgggccagggcggtgaccagcactgggaacagggggtcagctggttctactacactaccccactccccgcagcccctgatccagctaccccaggacccacccatcacatcccacccccgccaggccttcaccgggccctctcaccgctcagcagcaggcccagatgaagctgccagggcccaggctgtcccggcaggtccctccctcgtccccctgctgcgacccactccatcctgaagaggagaggaagaggatgatgggggatgagaggcctggggcccgtgccctcctatcccctcccttcgggtcccatgttgactctgcctgtgtgggtccttggctgattccccactcggtcctctgtcggtccagcggtccctccactagcgcggagtccagcgactttgagcaaagttgggaagtatggcaggaagtaaagcatggagcggatctcgggcgggagcgcagctttgtacagaaaacccctacctctctgggaactctcactctagaaactagacacagaccggctcacctggaaacctttattgtgcccccaggcccaggtctgcacaaagccaggggaacactggggtttggggtcctaggccactgtagttcagggacaaaccaagtaggggttgtggcataagccaaggagaggagtgtcatcttggagacctcaaggggccatggagactgtgtccccagtgttgtcggtgctatgcgcgtctccatcacttaggcttttcagtcccagggctccagcatcaggggggcggtggaaaggcgcactcagggtgccaagccccctcttccgggactgtgagaagctttaggacagcatgaccggaaggacaggacaacatgagggtttgggagaggtggagaaaggccatcccctgtccaggctctctgcctcccccagtcgctacaacaagtaggcatgagaagaactgtttcctggtatgaaaaagggagctgggcaccgacaacagaccacagcggtagcgagtgaatccagatcttccggctattcatccactccggacgtttcggcccgccgggagcgcccagatccgggcttggaatgcgggctgcgggagcgtgtgccccacccaggcccctgggacctcggcggggaccagactccggggtccatagggccctgtcgggacaactttgagcttgctacatctgcgcctactgtcttgagtcaggtggagagtaccctggagtggcaggcccagggaaaaaagctggggttctttaggggaaacatcaaggttcaccagttatctggagtggggtcaccagacaccaggggggtcacgtggtcaatctaaggggctcagggatactagagggcgctcagaattatggatcactgagagataaggctctatcaggatctcggggagcactagatggcctcagggagttgtccgtgacccctcctatttgtcaagatcagcgcaccactaaatgacaggctgtcacatggatcactcagggtcagcaggcactctggtgtctctgggctctcaaggtcaggggattcctgggtcactgtggggtcacttggagtcagaccgaagtcagcaggtgccgtatgccctggcccacagccgcatgtggcccagtagctctgctgcccgctgctcgagagcccacagcgtggccactttcttgcccagtgcctcctcattctgagccaggcggcgttccaaccctggggattaaggtcatctgagccaggctctgacctctggccctaatctctgaccctggtcgtcatctccatcaagaccctgactctgatcccagccctaaataagctctaacactaatcaacatttgacccctctgttctggactttgaccccagcctgatcctcatatgaatatggacccaacctggatccagccctgaccctcccacaccatccctctaactctgaccctgaccaccccctgtacccacccatcctggcccagccacataccctccagtcttctccagctgttctgtacccagtgttagcagctcttgggcctcagcgcgcgccccggtgtgcccgctctcctgcatcctgca

SEQ ID NO: 24904 - DNA, 1032 bp, Bovine  19866880791951
ccgggtgaacgtggagcctggctgttcatgaccaacgcctgtgcctctggaccctgccctccccacgctgactgccgagacctctggcaaaccttttcctgtacctgctggccaggtggggcctgggtgggggcagggtgatctggggctcatggtgaagactgggggacctggagaggaggcaggcgctgagaaggacagatgccttcttcctcccatgcctgtggccagtgtcctcagctccctgacccaacccacaaggttactatggcccgggctgtgtggacgcctgcctcttgaacccctgtcagaaccaggggtcatgccggcatctcccaggggccccccatggctatacctgcgactgtgtaggtggctatttcgggcaccactgtgaacacaggtaaggggctgggggctgaggtgatggaaagagttggagagggttggggagggtcgctgagctatggcggaggcatctcacctggttctccaccgcagaatggaccagcagtgccctcggggctggtgggggagcccgacatgcggcccttgcaactgcgatgttcacaagggctttgaccccaactgcaacaagacagacgggcagtgtcactgcaaggtgcgcctggcccctggcctttcacctgtgctgtagccattctgtgatgcttgctgacctctgacacagcccctgaccccttacccctaccctgtgacctaactgccacctcttgtccttgacatctgacccctcccttatatttcccttgaggcccgtcttccttctggcctgtgagcactgttctgccaaccctttgcccttgattccacccactccccaagccctgacctgaaatcctcaccttaagccctgacccctgacctccggcccctgaccctgtctcaaacaggagttccactaccgaccgcggggcagtgactcatgcctgccgtgcgactgctacccagtgggctccacctcacgttcctgcgccccccacagtgggcagtgcccctgtcgcccaggag

SEQ ID NO: 24905 - DNA, 809 bp, Bovine  19866880805093
agttgacggcactcattgacctggactacgaagctcgccaagaatacataattgttgtgcaggccacatcagcccctctagtcagtcgggccactgtacacgtccgcttggttgaccagaatgacaacagccctgtgctcaacaacttcccagatcctcttcaacaactacgtatccaaccgctcgggacaccttcccctcaggcatcattggacgcatcccagcttatgatccagatgtctctgaccacctcttctactcctttgagcggggcaatgagctgcagctgctggtggtaaaccagaccagcggagagctccgactcagccgcaaactagacaacaaccgcccactggtggcctccatgttggtgactgtcacaggtgagggacgggggttaagcaagtgagccagtgaccttagcctgtcaggtcctcagggccccccacaaggcacttcaaagaggggtttccagactttccaagaatcccttaagtgctgcgttcctgcacgccacaggatctgccatagacctcccaggttagggtcatatagtctctgcttagggtcttggacagtctccactgaaccccgaagattctagggcgttatgagcagacctcataaagactcttaaactgctttatttaaataattacttttttaaatttctttttggctgtgctggctttctttcagttgtggcaagaagggtctactctctagtttcagcatgcaggcttcccattgcagtcatttctcttgttgcagagcgtgggctctggggcactggacttcagtagttaagc

SEQ ID NO: 24906 - DNA, 1038 bp, Bovine  19866880806015
acaccgtccacagaacagcccctccccgcttgagtacccagcacacacctccttgcctggggggccccgctcgcctgggtcccccttggggccgcgacgccgttcaggcgtgggcaggaagccaccagagctttcttcccaggtctccacgatctcccgcagggcagatgtctgggtgacatgcagggtcagaagaggaaggccaaggctgcagccacccatgccctggccagccctgggggcattacatgtcccgtggggctccccgcggcccctgtgtccagcccccatcaacctaccttgatgccaatattttccagcaaccgctctgcattctggggacacaaactggatgaggggatgcccacagaagaaaaggccccacattgccccccaaaacagcctctataccctcgtcccctggcttcctgcctagaggaccctttagcccttggctggggtgactggaggccactggaagcccctccctggcatgtcccatcacccaggttcccgtccatgtagcccacaggaatcccaacagggcaggggcccgagcatataggacagcacctgtggctgcaagcggaagggggcggaggcggcccacagacatgcgtggaacagtcaaggaccatgtcccaggcttcactcaccaccaggctcccaggctctcctctcaggccacgctctcctgggaggccctggagacaccaagaggtaagctgctggacccagcctggggtgcagcatgtgggtgcatgcgtgggtgctatggctactggggcaagtgaaagaggtgggggcctcacctgctcccctctgggtccagtctccccacggtcaccctgagaagaagaacgactggtgggaaaatgcccccactctgggcagcccgcccaccgtacccctcacctagcatccgcacactcaccttggggcctgaactccccgggacgccagggaagccctgagatatgacagaacacaaagaggtcacgggggatcacggcctccaggggtggcaacctaaggccc

SEQ ID NO: 24907 - DNA, 965 bp, Bovine  19866880817373
tcccatgaccttggcgtcatcctgcagaagatccgcaacatcccctacacggacccaagtgggaacaacctgggtaaggactccaatggacatggactcttggggctctcccttggggagctcggtgcccctgggttctgacatgtcctttctcccaggcacagccgtggttacagcccacagatacctgctggcaccagatgcgcctggacgccgccggcatgtgccgggggtgatggttctcctggtggatgagcccttgagaggtgacatcttcaactctatccgtgaggcccaggctgctggtgaggaccagggctggtgggaatgggacctgggagcagccttggccccggcagggtcatcatgcaggctgctggaccactccttagggctcagagtgatgatgctggggctggcgggagctgacccagagcagctgcgtcgcttggtgcctggcatggacccttcccagaccttcttcgctgtggatgatggtctgagcttggagcgggccgtcagtagtctggcagcagccctgtgtcagacagccttgaccacgcaggtttggaaggggcatctgggggactaggtggtggagaagaatgggtctgagggctctgggttgaactgcctgacctcaaggagaccctgtatccacagccacagccagagccttgctcagtgcattgtccaaaggtgagtgtccagggttgagagtgtgagtgagggccactcttggggcaagccactctgaccctcactcgacttgtctttccccagggccagaagggggaacccggacagatggtgagtggctccgatggggggtagagaatgggttggggggcccagtggggcaggggaggccagcagcagaggactcactgatcacctttcctagggcctgaaaggacaagccgggcctcctggcccccccggcctcccggtagtcctccccacgc

SEQ ID NO: 24908 - DNA, 801 bp, Bovine  19866880885020
tcacctgtgtagcctgcccggcagtggcacacaaccttgctgcgagtacccatccctgtggcaggaagtagcaaagtgccgccggctcccagggccttcggggcaggggcagggccggcactggcccccgtagggcagccgggggtccccatggaagccagcaatgcacctgcagggagcagagggaaacgctgcatcctccctgagcggtgtgcctacccacccgctcgtccacggctgctccaggctcacctttcacagtgctcacccccagtgtggtcccggcagcccaggcaagtgccagtgttggggtcgcactcgtctgcgtgcccatggcagacgcagggccggcagctcgggaacccccactggcctcgttggcagcggtcacagcgaagcccaaaggcaccagcttggcaggggcactgcccactggtggcatcacacaggccactgagcgccccctcggggctgcactggcaggctgggggcaaggcagagactgagccagggaggggctttgaggggaagctgggtgaggtcagggtggaaggtcaggggatggaagagaaggtcaagtgatcagggctgaggatgtggggtccgaagccagaatgagaaggaagaagtagcaccagaaaaaggaggaagaacagtagtggggaggggggcagacaactggagggatgaggccagtgaataccttgacaacccgtggggccaaagccatagtagccaggggcacagaggtcacagcggcgcccaaccactgcaggtttgcaccggcactgaccgccatgg

SEQ ID NO: 24909 - DNA, 921 bp, Bovine  19866880901057
actggtgagagggctgggtgcttccttcaggctgggtgggcaggttggccgggcacagaggaccactgatgtcccacgtgcccccggcagacacgtccgtcgagcagaccctgcgtcctgtcatcctgggccccacgtccatcctcctctcctggaacctggtgcctgaggcccgtggctaccggctggaatggcggcgtgagagcggtccgtgcaggaggccggggtgggcaggtggggtagatgcctggcctcggctggcctaaccccgtcctcctgcaggcttataggtgccacagaaggtggtgctgccctctgacgtgacccgctaccagttggatgggctgcagccaggcaccgagtaccgcctcactctctacacgctgctagagggccgtgaggtggccaccccatcgaccgtggtccccactggtgaggaccctgtgggcacggtcaggtgagcagggacgggaggagggatgtcccaggccgcctctcatgcggcgctctcttgccggtccagagctgcccgtgggccccgtcacagccctccaggccaccgagctgcctgggcagcgtgtgcgagtgtcctggagcccagttcccggcgccaccgagtatcgcatcactgtgcgcagcgcccagggtgaggaagacaccgccagactgtgcagaccctgaagttccagccctcggggtctgactgcactcttactgcatccctttccactcctggggctctaccgcctcctcctgtctccttgtccatccatctcccaagaaggccccgaagccacacctgtcacggggcctgtcttacccctgtcctgcccctgcctagctctgcacctggatctgtctccactcctcaccccacatccctgaccgggctttcatcttctccacaaccacgagctcaac

SEQ ID NO: 24910 - DNA, 803 bp, Bovine  19866880907906
ggcccacacacgcacggtgtactcagtatctggctccagtccatccagctcggccaccgtggcctccccagaaaccaactgggatttctctgggcctaggagtgaggatgagtgtagccctaggactatcctgactctgacccccaatgtcccacctggacccctaagaaaccccctgctcccattccacccagacctgccccaccccaacctccaaaacctctgttcctttcccaaatccctggttcccacctcggcctgagcgccaggagaccctgtaccctgtggcaccaggaacccggttccaggtgatggtgacagatgagctgctgactcgagtcacatggaccgatctcactgggcccaagggatctggaggggagaggcaatgggggagtctgatggaagaggcagcggagggtctgataggggaggtgttgggtatctatctactagaggaaagcaatgggagtctaaccggaggcagggatttgacagcggaaggcagtgggtgggtcagatggggaaggagaggggttcggacagaagggacagtggaaatctgaggcggcagcggacaggaatctgggagaccagagcatctgacagagaaggtaacagggttctggtggaggtattaggagtagaaagtatataagtctaagaggagggtcagagctagcagaaaacaggcaatgtggtctgagaggtgaagaggtgggaacctgagggcaagaagagcagggtgttgagagagaggcagaggaatcctgaagaaggcagggacttcgggggagccaagg

SEQ ID NO: 24911 - DNA, 1331 bp, Bovine  19866880925243
ttcccgcggcaggacccttcgcagctcctttctgctccttctactgatcagtgcctcctggctctttggccttctcgcggtcaaccacagcatcctggccttccactacctccacgctggactctgtgggctccaggtaaccctgacaccgcccccctgactctggaccagatggggcttcggtagggtggggcccggggccttaaccccaggcctggagctgatgcccacccgatgattgacagctgactgctgctgagcctggactggccttcatcagtgctgaggctcctggctgcttgctggtccacaatgaccttcactgactccagtcactcatgacttctcactacttctgttgcctttccctcattcccttactgggtccccctggggcctccgcacagcctcactctcatctgcaatgactgatcccacttgctgaccctcattgacttccactggccctagctgaccccctcacagccctgctctgacctctcatggccctcactgtctcctctctgatcctcgctgacccgcagggcctggtggtattgctgctcttctgtgtcctgaactcagacacccgggctgcctggacaccagcctgtctgggcaggaaggcagcgcccgaggaggccaggccggcgcctgggacggtgaggggccctccgggcagaggagttggggtagggaccccgggaggccagcgttggaggcttccccagggctggctcacgcgcctgtcccctccaccaccccaggggcctggcgcctacaacaacacggccctctttgaggagagcggcctcatccgcatcactctcggtgcctccactgtctcctcggtgagcagtgcccggtccggccggacccaggaccaagacagccagcggggccgcagctacctcaggtgagggcagggccgcctcgtgagggggcatacggcccggggctggcattaccgggtccttgggctggctccacccgtcttggccatctgtgcctctgctctgctgcctctgccccagtgtcttctgccacacacccaggggtaccttcagagccataccgtgtgcggctggctgggtactcacaggtgccctgcttccaaaacaccccgtcacatccctctttgatgggggctcctgcgtttctagggacaacgtcctggttcgacatggctcggctgctgaccacactgaccatggcctccaggctcacgctggccccactgacctggacgtggccatgttccatcgagatgctggtggaggtgggggcccgggccagggaggagggactcagagggtctctcccccgttccc

SEQ ID NO: 24912 - DNA, 2060 bp, Bovine  19866880950390
ttcctccgggtggagcccagctcccccagggctgaggatgctcgtggccctccggtgtctggactgggagcctgagccctggccttcgtcctcacccacgtcctgtcacctgaaccctccgccctccagaaagaacagggcagctgtgtgtgccctggcgactctccatcaccggagccagccccctgaggcatcatcttgtgctgtgtaggtcctggcccagaaccgcctggggaatggacggtggatgactccagagaacattcaggagatgtactctgccatcaaggctgaccctgacggggatggtgagctcatatcttgtcactgttgtgtcccagagcctcctcctgcccccagccaggtggcccctaggcccagctgctagagtagctggaggtgaggaggtgaggggccagcagagcccttaccccagaaagaggcaggagctagacccgcccgctcccccttggtggcagtccagagggcaccctcttggcctcgtcgggcagcatgtggggtacaggaggtatggctgctggctggcagagggcagagcagtggagcgggagtgaaggaacaatgaggtcagcttggcatccacttatccagccaggcacatggtccccgccagctgactggtctaaccagggccccccttgcctgcctcttgcctgcctggagtcctctaactgccgggggtgggtgtgggcaggagagctgtcctggaagcaccctcccctttggtaataacccccaggaagtatctcaggcgtagtcatttccctcatgcacaagttctgcaccagttgaggaagcaggacttggaaggatgaccttccaactggtgagccccgagtgaagaatctggcccggacccgtgcctggagaggcactaggctgctcccgctcccgctgtgacacactcacagccctcgagtgcccccaccctcagagaagccccagccgaagcacgggagtgtgtcattgggatcaaccttgtagcaaagacaccaggccactcttccggaacccctagagggtagagcccagctttgtggcttgagcaggaacaggggagagtgttctctttggggagagtggcctgattgcctctgctgagggagactgtcttagcaggcaggactggcctggggtgttccacccaggatgagacctgaggtcatgagagaactcctggggaccggttccagcttacatcctccagtgtggaaggcccaggacaaaacccagcactgaacactctctttcttcaccctctacaggaccggagggtggccaccacgctctacagagccaggctggagggccaagggcagtccttggcctagggtcttggccatatggcctaagcttcctatggagagcccgctctggccaatctgacagggttgggcttcatccttttgggggccaaatcagggcttaaactgaggacacgaacttctctgggtcttcctgtagggcctgatgtgacagaagccaacttcatctgacccgagtccaggttgggggacaggtgcacatggccccccagtgcctgaggccaggggtaggtaggaaggtgcagcctccccactctgccctccccacacgggcgtggtgggcattgatggtgggggggggatgccctgtgcaggagtgctgagcctgcaggagttctccaacatggaccttcgcgacttccacaagtacatgaggagccacagggcggagtccagccagctggtgcggaacagccaccacacgtggctctaccagggcgaaggcgcccaccacgtcatgcgcgccatccgccagaggtgagcgcccgagcctgggctccctgctgcagggaggagaccatgcaggcccccacagaggtccttggctgggaccaagagaacagcgctcaggactggaactcactggagaccggcaattaacaaaggcgaattagccctaatggtgggcaaacgatatacacgtgcgattagtaccagattgaatattggttttctgctaactagagaaatgatctcttaactctgtccacagga

SEQ ID NO: 24913 - DNA, 1506 bp, Bovine  19866880954220
ttgtcccagcatcatctttggttatcttttgtgatgtatacaatcactgatctaccttcttattttctaccttcctaattcctacatgcattcagaataatttagataaatgtctgatggaaaaatatggtctgttttaaagttacataccatgtgtagcatcttttcatgccattctgtgtgctgaagtacagcagtaagacatgaactgcattatcatcagaaatgtgttatctgggatatagtcaccttagttagattaaattatcaggaatcgagtggcttctcctgtaaaataaaggtatcgtaaataagcgctctaaagaatctgtgcctgtcttacagcagcaaaattggagatgtctcataaagggatttcaagtattttgtctctactgtggtttgtctgtggtgggagtagttttgatcctgagttgggagttgaatgcctgtggaatgtacttctctttctgaccctttagaacaacgtccccacactttcaatcactaaccacatggataaactattttttgaatatacacctaagtatatatttatacattgtattcttatactactatatgagtatgcgaaaacaaaagggctgacttttaaaaagaaggtaagaaatgagcaagagttttgatatttctcgtgtgctagtcttgagtgctctcaggtggctgtgtgttgctctgaacgcagcatattcagagattacggcttcctcagaaggctggagtatggcagcccctcctcctcacagtacgcagggctcctgcctgagatctctgcccttcgggactgggttctctgtgttgtccagttcactcactgccacatcttgttgctgcaggtacaggtacaggtacagcagtctccgcagcaggtctcggctcagcagctctccccgcaactcaccgttcaccagcctgctgagcagcccatccacgtccaggtgcagatccaaggccaagcagcacagccggcagccccctccatccagaccccatctctgcagagccccagcccttcgcagctgcaggcggcccagatccaggtgcagcacatgcaggcggcccagcagatccaggctccagagatcccggaggagcacatcccgcaccagcagatccaggctcagctggtggctggccagtctcttgctgggggtcagcagatccaaatccagactgtgggtgccctttccccaccgccgtctcagcagggctcacctcgggaaggggaacggcgggttggcacagccagtgtcctccagccagtgaagaagcgcaaagtggacatgcccatcactgtgtcctactgccatctcagggcagccagtggccactgtactggccattccacagggccagcagcagagttacgtgtctttgaggcccgacttactgacggtagacagtgcccacctgtacagtgccactgggaccattactagccctacaggagaaacttggaccatacctgtttactctgcccagccc

SEQ ID NO: 24914 - DNA, 775 bp, Bovine  19866880973204
actgtagcctgacaggctcctctgtccgtggaatttcccaggcaagaatactggagtgtgtagccattcccttctccaggggatcttcccccacccaggtctcctgcactgcaggcaggttgtttaccatctgagccaccagggggttggcccagccaagacctttatttcttcgcggccttagactccctctctgccgggttctaccgcttctggaataaccgcgcccaacttgaccccgggtggctcaagagtgatgcccaatgctcagcactgacttccgccccccactctgcctcctgttcccccagccccgcgccccgctcacccgtgaagcgcggccggcaaacgcaggtgtagccgccctcacgccgtgagcaggcgccgccgttgcggcaggggttggagtagcagaggtcaagctccgtctcgcagaagtctcccgtgaaaccgggcgggcagcggcagcgcaggcctgcgatgggctggatgggtctaaagagcgtagaggcggaggccaagaagggcgcagaggagtcaaagcgcagcaccgacacgcacttcatgtagttctcacagggctcgcgcaggcacacgttgtcgtcgaagggcagcacgtccagcagcgagcgggcggccagggcggcgcggcgcacgtacagctgctcctgcagctcttcggagctgaaccaggggcctgtagagccggctccagccccgcggggcgccagcgccgagaagctcacgttgagcacggtgccccccacgtccgtgt

SEQ ID NO: 24915 - DNA, 755 bp, Bovine  19866880993664
atgggcaaactagagaatggagttgcgaatttgcctttctaaaaggttagtggtaggatttcttgaagtgggtcatatccccaggtgtggcagggcagtgggagtcccaccttggtttcctgagtatgggttgactgctggaaaacttgaaagggtcagtctacacaggagcagagaagagttgaggaacgctgcccctccagcttctcattgccccgtccttactgaagtctttatattctgagatcagacacatagctttgaatcaaaggatcctagttctgagactgaggtcaggagagcagtctcactggctcttcttgctgtgtgaaaatttattattcatttatttagtaaatctttaagactgtgcaataaggaccccagcaggaaatgagctggacactaccccactcctaacaaagttaatggttcaggacttctcccaggagtcaagaaacttgtccagggagacactgctctttggaatcatagacttgcctggcctggggcctgagtggcttctacaccagtggggatcacgtattcctgcttctagatgctcagttcccagcagcactgagctcctggatgtgtgccaagacaaaatgagaggtcctagtgaggctttaattaatactgggtaattaccaggcagagcttaaccatcccaaatgcctttcagattcccaaggctatatctaggcactttctgacttggcccagcagagagacagaatgctgtcccatgctta

SEQ ID NO: 24916 - DNA, 2776 bp, Bovine  19866881045177
accgctggatggatacaggcctgagtgctggggacccggccccgggcgttgcacctgcaggctagggcacacagctgtcagagtgcttcgggactgctgcgggggccggggtgctattagggcagtaactggggacagagcaaggaggacctggggatgggggtcacgctgagggtcactcacgctggcagccttctgactgggtgaggctcaagccatagtgacctggccggcaggagtcacagcgctggccccagacgtgaactttgcagcgacactgcccagagaggagaccccgggtggtgtctgtgtaggcatcacacaaacccccttccagggcacccatagggttgcagtcacaggctgggtcaggggtcagaagtggggacagagtcaggtcagaggtcatgtgaagtttaaggatcaaggtcacaactgggatcggggactggagggctcacgtttgcaggagtgaagggagcgggggtcctccagggggtcccggtggaagaagggctggcagagctcacagtggcgcccggccgtgttgtgttgacatgcatcgcacacacctccactcacgttgccagatgcgagatacagggccatgtcaaagtgacaactgcgggcgtgcccatggcacttgcattctggagccgggcaaagaaggtgggcatggagtgggctgacccatggcaggtgtggccagacaaagcggggcatggcacctaccctggcaggtgtgggggtacccaggctctgctgcctgccacgggtggtcctggtacaggccctggcaacgttcacagtgggtaccagtggtgtggtggcggcagacacaatggccatgcacctaacagggatgagggcaagatgagtcggccctggttccctggcttaccctcccaccagccactggtgcccctccgggagtactcaccatgccttccacgctgggtggggacccgggtgcgggcctgcactcggaagcatggccgtggcacaggcagctgcctgcaatcactagctcatagagagcatagtagtagaaggggtggcccctgaggccccccaaggggcctgtcacccagtgtgtgcagcttggagaagttcacacggaggttagtcacacgcaggagttctggagacatatggagagccctcaggtgcacagaggttgtgacccctctatgccaaaggtggaggcggcactgtggggtttctcccctctctacatcactgaagccactcctccagcacctgcgctgtgcgattctcccaccccaaccccctgagtataccgttttaggatgagcacatcccagtggcgattatcccacctctgcgctgcgtcagacctgccatcaccccggggctgagacaggcacaccccactgctccctggacacccctttccagtatcactagatacgggaaacctgcttccccagtgcagtaaagggccccattccccagcctgtcactagactcagagatcaggtcttcacccagccaaaccacttgcggtatgtgtatttattgactgcccatcttatttgttatgtgagctccaagacagttaccctgtctatcctctccactgagcactgcccagatgccaggcccacagtggggctccacgggtccacagccccctttctctacacagcttaactcagttaccaagccaaggccacctcctgtatctctttgccagaggtcccttttcttctcatcagaggaacacgctctaggccttagaagggtgaaaggtgtgtgtgcacatgcatgcccagtagctggtagtaatctaagtaagtcaaggtgggtggagatcgtagaacatagataaaaagctactttggggtttgtcgtcctgttctggccctctcctggcctggttctgggctgccctgctgggttatgttatgtttctcttgtcctttaacaagatttatttcacaaggaagagatcccacccagagacacgatggcaccacctggtggcagcttccggaatgcagtaaactaaggcggggtgggagggcagacaggaccatgaaggggctgtgatggggaacagggacagtggctcacagtttacggggtacagtgtgatacaagtagaggtgggggaaaaagattggtctggtagggccaggagtgatggggaccacagtagggcctcctcacaaaggacttcagtgatggggcagaaatataaactgctagcatgctggtccctatgcattgggcacaggtatggggagcactaacgggacatgcatggggagccctgacaggggccacagtaaaggaccaggatgcggcaaggctgcgaaacaatcgctggggggctgagctggtttgcctgccgctctgccccactagtgcacaaacttaggcaggatctctcctcccacaggtaggtttctggttttcctgacacacaaggaatccaggactgaccgtgggatagttaccctgaatctccgcgttgtttgtgttctccgccagaaaggatgggtccagaacttggaaaattacctgggaagaagcaagcctgagcctctggcttcatgccagggccccaccctccttcctctgggcctgacctctccctcagtggcaggctcgatgtctgagtaacgctggtcacagacgaggtcactgactctgcggccaggggcaggagggatcccaggaaagaggcctgagcagttgtgggcaaagtagcggaacacatgccaggagtggccatggtccactgagcgct

SEQ ID NO: 24917 - DNA, 1267 bp, Bovine  19866881132826
gtacgctcgtacctgtcccttgactgtgggccgcctggggcaggcagcggtgctcacaggcctcccgggtcccaaaacggttggcattccctccgcagccaccgtagacgaaggggtgacaggccttcgtgccccccgccccagcccgatgataccagcgcagggtgtaggcactgcaggaaccctcgtccagtggaagcgagcaggggtctgggggtaacggggcggggcagagaggtcagccgggacgggctcggcctgccccctcccccatgcccctgtgggcccagcccccttcctcaccaacgtcatcccaaggagccgcggggtcctggtattcctccatggaatactcagagtattcatactcatcgtcctcggggggcacctggcctgcacgcacagtaagggggtgctgtgagcagggccactgcggggcccggttcgtgcggcccaaccctggcctcccatgcgtgttccctgcatgtgctccctgtacacacggcgtgggccgtgcatgcacgagcggccctatgcgtgtgtgctcccgccccacacgccccccaggctgcagccatcctcaccgtcctcctctgcgtgggacacgcggagcacgggcacggggtggagctgcgggccagcggtgtctgctgcgtaactcgggagaggccctggagccgagagcaggggcccggggcccgggggtcagcctggtggccgccctcaccaagcccctgctaagacgacccaggcaatgggcacagcagggcctggcacgaggcaagctccgggagcagaaaagaccagaaaactactcacgtgatccagatgcgatatactggccctgacaggctggagagggcagagaaggggccagggagagagacaataacagagaacaggagacagaggcggaaagaggcagggagagaggctcacggggggcagagacatacggaggggacggagagagtgacagacggcgggggagaggaagggaagcagacacaaggagagaaagagaccaagggggagaagtggaccaagggcgagagagaagaggggaacaggccagccaaaggtgagagaaggagagaggcaaagggtcaggagccggcaggaatggagaaggacagggagaaggcagaggaggaaggagatgagcttcactctgatgccccccagggccgtcagagcccccgccctgtaccccggcgccatatctggcttgaggagccggctctgctcacacctcctcccctccaca

SEQ ID NO: 24918 - DNA, 941 bp, Bovine  19866881310893
cccctcactgcaaatgacctctgacaggcctggatactcaggattcagccccaggggcctgtgagttcttcactggcacctgctccctgcactccctggttctggaccctcagggaagagattcccatgcttgatgctggctccgggtcagagctgggtctgtgggtgcttgggggtcagaggtcactgacagtggctcctccccctcctccggcagttctgtaccccagcggcagcagcatggaaaatgccaccacctcgagcatggcacccccaccagcccctccagagcccgaacccgagcctgggatctccattgtcatcctcctggtttaccgcacccttggggggctgctccctgcccagttccaggccgagcgccggggtgccaggtatgagtagagttacccccaggcctctcaaccctgggctgcctgctcgctctgacccagcttagaacaacccccccacttatggtggacagacaagcaggttcaccatcatccagagatgcgcctggccacactcctgctctgcgagtctcatccgtgccgggctccgccatgtcagtgtgtctggggaactagatagacacagagccacagctgggccagtcacataaaggatacaggagccagccagacaggcagactggcctatggagatgggctgaccgaagggggccagccgcgggcatgcagggagacacaaagtctacagctgcttaggctgcaggctccaatgtgagcaatggatccaaagcccctcagctgtaattctgcagaaccaggccatggactcctggtgttgaggccactcagtggaggctgaaggagttctcagaaacaacacccagcccagggtgccccaagctctgggcaagggaagacagggaggtgggcagtcagcttggaaggcggcggcatccaagctcaggtggg

SEQ ID NO: 24919 - DNA, 873 bp, Bovine  19866881369983
tcccttggatatgactgcaaaaccagaagggaatatatggagcagagtgaccaaggcttaatgcgagaagaagtaccagttaagagaagaagaaaggattccctattccaatactagggagtggcaggaaagtcttctagtagagaatagccatccctttgctccactgattccccacctgagggctctctacttccccgcagtcttgaacacctgtgagaccaacggaaagaggatgggggctcagccacccccagacaaggtggagttggagagaaccacttggaaatgatccctgtgagtggatcagcttggacacagcatttctgttcaatatgaagaaactggagcaaagggagtcatcacagactggattttataaagatcactcttgactgcagctggtggaaggaggtagtgcactggtcagatgtgtcgctgcagacagaaggaaaataaaaggagtctaacgatttacagaagattaaaatttataatgtttagtgataaactcaatgtttgctccataacaacatcaactgaagttatacacctacaattataaaagaaaaagtattcaatatgtgcttcagtcaatctataaataagggtgctgccatggatccccaagttataaaatgtcagagtggcaaagcatttatgaattcatctagtctggtcatggcaagcaagtttcatctcacatgacaactctaattgatgtcacgggtccacctgaatcatcctgactccttcctttctttcattactcacatctgcttcattaataattccatctgttctcccacccactttgtttcttgaatcagtctacctttctccatatccaccctagtctaagggcatcatttc

SEQ ID NO: 24920 - DNA, 1561 bp, Bovine  19866881385391
caacgtggaccccagccgggcgcggcaggcgctgttccagcaggagatggcacgcctggccggcgaaggtggcgccgactcgcagccggagtgggccttggaccgggcctaccgcgacacgcgcgtggaactctgaggggtgaccatcccagtctccagccgcaggtcaccctaagtcgggggccctgtcgtccccctgtccagctgcaggctgaaggcctggccgatgtctagccctaccccggcctcctgccgcgattagggcacagtccctacatccatgttatttattgtgtacagacccgtgcttcccggacaaataaaactacgcggcaatggagctgcagggccgagaggctcggagtaggctataggtacagtgggcggggcggggcgccgcggccgggtggggcttgtacgtcatgtgacgggggcgattcggcccggccaatcccagccggacagcatggggcggagggcggtcgtcattggacctaggcggcggccgcccctgcctctgctacctgttgctacgggagccgtagagctgcagcgcagcagcacgcgggaaggctcgtctcgtgagagctctgctcctttcttggccgtggcagctgcagcggctcgagggaccgccatggacgctcacgaggactacgtttggccgcgggcaacctcggagctcatactcctcccggtcacgggtctggagtgcgtgggggagcggctattggcgggtgagttgtggttcgaggcgcgggctagcggagaagaaaccgaacgctcgcctggggaggggccttaagaacaaagggatgccccttgtgggaggaggacgggcggcgggcgggaacccacggcatggcggggctgaagcgcagcctaaggagcccaggaaacaaagagctgcggtggttcccgaggcctttcagaaactgcaggtgatgcggagagggcggctgggggcggcagaaaggtgcagggaaacgcggtcggcgggggggcgggggaagggaataagagacgcttgtggacgagtcgcgcgggggcttcatcgttccagcgaggatgcggggggagctccgtgatgaagcccccagtgggcgagtccagggtccggggcgtggcctttcgggggtgggccagcccaggagggggtgtggcctctcgagtgagagaggggcgggtgatgctcttccctagatggtgggggtgaagagcttctgagcagcatggagtcgcgggaaaccagaggatgagatctttctgagtaggccagtgctcggggaggcggaggctgaggcccctcccgagatggttggggtccaggaaatcccatgtcagtgcctcttctgaggagggtcggctcgggtagcaaaggacagggacccgaggccacagagccccatcgagcggtggagtccgactggaagctagaactagtgacttatgttagagctgctgagtttaataagggtcgcaaggcagggcactggctggcaagccttgagtgagctgctccgagtcctcagaggggggatgtacgggggtggagattagg

SEQ ID NO: 24921 - DNA, 952 bp, Bovine  19866881561759
caacctccaggtgaatgcagcatctcgggtctcaaggcacccctgagctctgaccattcaccctaaggccccacctcgtatttgcacgctgaccctcacctggatacagccaaccagaccctgaggagcctcctcttcagcaccatggggcaagcctcccacatggagtcgctttaccttcaggccctgcagctcactccccactgccaaagtgtcctgggggaaggggacagtcagcacggtgaggggggaccgatgaacccctgccctaccccagtggcagccttggccttatcctagccttgcaccacgctctggacgtctggaccagagggctggtctgggcatgagatgctcccgagtacagaggacctgctggagcacaggggataaatgacaggaaggtttagtctagagctgggctctggattgggccctctctcctggaccccgaatagaccctgaaattccatgattttgagctgggacgataaggagaccagaagaagtttggcaaagtgctagctacagaggtaccccaagaccaggccagaaatctgcatagcctccctgacatgaggagggcggagcaggatgggcttagagcaaggacgtgaggagggggactcgggagacaacatcagactatgtgcagtggacggaagaagaggagttggactgagtggggttctgatgaggtgggtctggtcggaaggctgagaatggaccaccccagggttagaagtcagacctggaagagactgaagtccaatgagaccatgaggacatggtggccccgccggccacctggctcctcctgcagctccagccgcagatcgtgccaccggccatcactgactatcatctggtccaggaggaggtgggcagcccggcctgaggccctggtcactgttacagacagcaacccccgatccagctgcgggcagagagg

SEQ ID NO: 24922 - DNA, 1095 bp, Bovine  19866881755947
tcctcaagccagaccctcaaggggccctaaaggcagtgagggtctggactgatgatccatatgtccatctgcagttagagcaggaagacttaaacctgatgaactctactttgtaaaacagaaaccgtaagtatgctgggggtgtcacagagctcctatgaaggggaagactgaactgggatgtgaaagagggcaggacgagaagtcctatccctagcagcctgcaggagtgactggctcagaattcacagctggccctaactaatgctggcacggggatagggtggggggtgtaagggggcacgtgttcacagagtccttacacagtctgggggcaagatctctgcgtcactcctgaagcccaatgtacctgttacctgcgtgagagacaggcatggctcttgtctgctaaagtgcaatgtctgctttcttaatttatgtgataataaagcaatgccatacaaaagaagaaccttggaaaatcatggggaaaaaccacacaggctttcccggtgctagctgccggttttggagtattagttacaacctttcccaattctgagagctgcaacacagactgccgactgagagtctttctgcttccacttcatggagaacaaggaaaagggagaaccgagcaaggcaatgatgagccgccgctctaaagatctctcaactatactgtctgcggcaaaagcagacagcctggtttaagagggcaatggtgactgcatgggctccatcgctgtctacaacagggatgacttgagccccagcatgttaatctcccagggattcactgggatatacaagtttaaaaaattcatatcagaaagggcctcttgatttaatataaacatggctatgacatccaaatttatctttaggtaaatgtcacactgctcctaggatctcttgtaacatctgattctaggtcattctgaagaaaaaaatttcattctgaaatatatctagttaattatgataattcatcagaactctacctgatataatcaaaagggtaaaaaaagctaagttactttcctgtgggattaacaactggaaccccaaatatcccaacatcttaattagaaa

SEQ ID NO: 24923 - DNA, 750 bp, Bovine  19866882003283
cgggaagatcccctggagaaggaaatggcaacccactgcagtattcttacctggagaaccccctggaccccagggggtggcaaaagagtcagacacgacttacagcgactaaacaacaagcaccattgtatcaatagtatcatacggtgtattttcactgccctaaaaaattacttgtgcttcacctatctctccctccccatcaaacgcctggcaaccactgatgtttttactgtctccatagtttttccattgttaaagttttcactttgatttgcattccttgctttctgatgaatttgaacatcttttcactttgtaaggttttgttgcttgcctcacaatacccttttccccttgatctttgctaacaaacctgaattttgtccagagcagcaagtgtccagtcccaagtgatcctctgaccccattccctcatctcttaatctccatatatctaggagtggccacagatgacccagttttaatcattgggaaataaatataagtctactgggagttctggaaaggtgtttgcttaccagataaaggagaaagatgtgggtggctccaacagcaggattttcttctgctttgcatactaatgtgatgtctggagagacaattaccatcttgtaaagctgggtccacaagcatgaagacaaaagtcaataagctaaggatgatggtggtatatgcactcatgtagtggaatactatgaagacatgggaaaagagaagactaaagca

SEQ ID NO: 24924 - DNA, 3449 bp, Bovine  19866880444781
gggcacttacctaggttatggcatatattgctttccattaattttatgttagatttttttttagtccttctttatatatgaagaaccacggaataaagttacagctaaatgtgacaaagacagaatgtaaatctcaaagacccattctgtgaatcacaagcctgtgtttgtcctatcaaatccttctactggttctagcaaagaaccaatgttcgtgtcggcagaaacgacagggagtctgtgttctactccgtcagcaacagtgcaaaagaataaatagggttgtgccctttgtggtattttttcccatttacgttatgcctgctcacacctacttttctgattaagatcttataggtagcacataggtagagatgctactcagagttccacatgcctctagagggggaaaaaacagtgagataaagtttaggatttgtaaaagaggtagctataaatgtacattggtgtttggggagaaacaaagtaaaaccattgttttcaaagtgtatcttggatacttgaaaatacagtgctacaaaaagttaaattgggctcaacagttcttgagactttgatctaaatcaaaaggtttttggacagcttatggattttttctttcttccctgaaactgttggaagccatagatttgaaaaggaattcacacacatgtgattatcacagcaccaataaactgttatctctacagaacagaagtaggcaagtcagtgttttgtgggaccaagttcctcagccatggagatttcaaggactgttatgtgagagacatgctgaaaacatgagatataatgcatgttacagggctcacgatgaaatcgcatcagcaaaaatttcaccaggtcactgtaatataaataagatggttttattttgaatggcttagaaaaaggaatttttcctctttcttttccaattttaacttaacaagaaaatagctatgccagctaaaatgttaccatctgaagtgttaatagttgcttctgcattttccaaatggcacctcttttcggtaaagtattttaaagtatgcttctccaaattatgttatgcttatttattttacaatttcatgatgtgttaatatacattgtaaaaagtacatgcaaatggaaatttaaagcacaagtaaaatgaaataaatgatattcaaaaattaaaaacaagttttgcttttacttaaaatactagtagtattattactagtagaaatgtaattgagtatgtttcattccttttgaaaaacttggtttaacactttgtgatccagttatttgaaggtttatatctaaggtcagtttatttcacagcttgcttttaaaaggtgataaaatacctcagtgacaaagatacctccctaagataaattgaaaaagaagaaagaaatgttatcattggctgcattaatctatcatggaattcataaaaaatcatctaccaattttgcaagttttaaattaatgaagcacaagctggaatcaagattactgggagaaatatcaataacctcagatatgcagatgataccaccccttacagcagaaagcaaagaggaactaaagagcctcttgatgaaggtgaaagaggagagtgaaaaagctggcttaaaactcaacattcaagaaactaagatcatgacatccgggtcccatcacttcatggcatagatggggaaacaatggaaacagtggcaggctttctttccttgggctccaaaatcactgcagacgactgtagccatgaaattaaaagatgctccttggaaggaaagctatagcaaactcgggcagcatattaaaaagcagagaattactttgccactaaaagtccatctagtcaaagttatggtttttccagtagtcatgtatggatgtgagatgtggactataaagaagggtgagcgctaaccagtgaacctgttgtggtagaaaagaattttctagtgacttcttatattgctatcaagtataacatatattctactatttaatatttttgttttagtaaatgtaacagtacaatgatattataaagtaaccagctacagtctcccacaaaggctgtacctgggagggaaggatcattaaatactctctggtatagaatttattctttctgcaggttacttcacagctgtgttgggaccaactcacatacaaaatattaatatgcacaaatttttagattaaaaatgaataatgctgctgctgctaagtcacttcagtcgtgtccaactctgtgtgaccccatagccggcagcccaccaggctcccccgtccctgggattcttcaggcaagaacactggagtgggttgccatttccttctccaatgcatgaaagtgaaaagtgaaagtgaagtcgctcagtcatgtccgaccctcagcgaccccaaccctcagcgaccccatggactgcagcctatcaggctcctccatccatgggatttttcaggcaggagtactggagtggggtgccattgccttctccgaaatgaataatgaggaagttaaaatcccagcagattattctaaacacctggagattacccactactttggagagcactgagctgaagaggtggttctcaaactttagtgagtgtaagaatcatctagaaagagtgttaaaatacgagtctctaggggcttcccagagagattctgattaggtctgagtgtgacttggggattagcagctgtctcaagcatcttggatatttcaaatgtagttccttagtagactatactttaagaaacccagactaaggggactacaaattcccccctattttcctcataatattatccatagtttaagattattagcatatcaatttcagtttgaaactttgcatacgtacccagggaatgaaatggagtgactgagtaatggctctttaatatgtttaattagagagctttaatgaataggtggacaagatacacctacctcatttgtgcatagcagttaacaaattataatcaggcgccaacccacagtcccattctctgaccccatcgatagaatttccttgagcatgttgtcatacgttgtagagatccaatgtggcaactggatttctgggaattcttgagtaatttacatgttttagtggtcattaatactggctttaaactcttattcttgttgggtctcatttccagtatctgatctgttcactctttttttgtgtgtgtgctcaattcagcaaatcaataattttttctccccctgcccaagtaaactccattgtacttatacaatgcatttggatgttagacatccttgatcttcaatgttatttggtcatccgcacatcaaaactttctcactggccacctttgtccatggtcttggggtcttttagcagtgaactgttttccctctccccaccaaatccttctcgattgttacaagtcgaatttactg

SEQ ID NO: 24925 - DNA, 1913 bp, Bovine  19866880526961
gggatggaatccaggccataggttaaaaatgaccctttacttgggcatctcttccatcagggaggggaggtacagatgccaataagcttataagaaagagggagaggaagatacggttcttatcttgtgtccttggcttttcttggggaaatggcagaattgtcatcggctgagtctgataaagcttggtggcaaaaagagggatttaagacgagagagaagatttagagcaaccactgtcagctgatcagacatattgactatcaataaggacccagccttagtcagaaagcagcaatatatagtgacatcaatggtcacagctgtgtaatttttctccaggaactctcagctgctcagtctaagggccaaagaaagaggatggctgtataagaggtgaaagtgatactgaaagcatgatttaagtggtggacaccagtgtccagggctggacaggggaaaatgggaagacagaaggggctgattgattaggagaaaatggaagactcaaagcactgggggtcacgaggtcaaagagcaagcatagttcaagtaagaacaagaaagccagcagaagcaaacggtggagagaagcagatgtcttgcttaaacatgaagcctgaatctgaatctctctacagaggaggatttgtgttcatccatcttctgtcgtatcattctttcttaggattcctgatctttctgtgactttcacccacaagctggatgaccacttggtggggctcttgcagagacaatgtcagcctattggttgaaaatgaagattcccctgaaaaccggaaatgctatgaaattttgcagtttagtttattctagcactttagtggtaagtactgagaagtactttttaacctcacttctttgagttacctagtccctggtgcatcaaacagaaaaacagtctggtatactgaaattttgggaaattctttgatcttaactaaacaattactattccctttattaccagcataactctaagtttttctttcagtagaaatcatctttaagatgagaaaaagggactataggaactccctggtaaaccagtggttagcactccatgatttcactgccaagcacccagattcaattgctgcttgagatccctctagcagagtttttttggttttttgtttaaaaaaaaaaaaaaaaaaagaaccacagttaggacatagttcttttagtcttagtctgttaatactatctttactacttcacttcaaaagttgaaaaaaaaaattctttctattccctagtgccacccttccttactgctgactatgaaacagtaatctgttgactaaattaccacctaccttttatcctatagcagccatgtgttaaaactgaaaggccagtaattaccagtaaagacagtggcattatcggctgtggcttcctgttcagttttactttgaaaaagttttagcaggtgagcttacttggatattgtgtaccatagacgacttattctcctgtccttggcacagtcccccaaaatacaccttatctctgcaaggataaaatggctgaattgttgcatgttcacctctgtaactggcaaggtgactcaaaccacaaaatttcattacctagggttcatgatttcatcttggtttatgaccaacaatgcatactttctattgtagtgtgagcaaagacaatgtagactagtacctttgcagcaagatgcttgtgtactccttacaattccacccagtggttggaatcattatactaaaaagctgcttttaagtaagctgtcaatgtaagtatgcttcctgctgctgctgctgctgctaagttgcttcagttgtgtccaactctgtactatcccatagacagcagcccaccaggctcccccatccctgggattctccaggcaagaa

SEQ ID NO: 24926 - DNA, 1867 bp, Bovine  19866880625366
ttgaggagagttctttgtttcgtgacactgacttgacgaaaagaaagggccacttgttctgtagaatatttatttcttttttttttttttgatttgtcttgcgtccttgtggaaagacctatataaatcacagtaaatgttttggtaggggtgtatactaactatactctttactgtattacattaggggacacataccatccagcttcccatcatttgcattgctttgactatgcatggtaatgccttcccaatcatccactatgatattacattttctgcctgctgtcagaaaatcgtctgtgtgctgtcactctggtacctcacaaatgtcagatccctctatacatttacattacagttttaatatcacttgataatgcttatctacagaagtaatttcatttaagtttacaaagtgattgtttatttgttctgctacgccttccaagtatattttctggcattctttttaaaagtagagctttttcttacaactgaggctgtttaagatgcattttctactggaaagctttatctttctcataattcacagattttcaaagtgagtaattggttttaactaaacgcctcaaatgttgacaagtgaggtagcctagctttctctgtgtaagtgtcatgaaggacacgctaatgttcacgattaaatgtgattcagttgcctacaattattctgaaaatgtactcgcatgacaggagtgagctgtcaagaagcaatgagctgaagacccaaaggacaactcattatgacaggaaacaggtgactgcgctgccaagacaactcaaggcttcaaattcccttattagccttttttgggtaaagcatccaaggaagaggcccctacccgtgaaacactgacaggagaagacacattccatttgctttgagaggtattcattccaatgtggcttaataaagccaatccaggaaattgtggccaccaatttttattattaataatagatacagttttttaaaaagtcagggtgctaagaaacctttcagggtatataatctttgcaacgtgtttgctttgagcctattttgggaatagtgatggtggaagaaaatgctgttctttatggtatttataaccatgctgagcttgcaaagggaaaacagactgacatcattggacgaatgcagcaaggcagttacatgtaaacacaaggggagtgatttatatagaagtcttcagcatttttctctatctcctggagtttttttttttttttttttcagaagatcaacaaacaaaaaacctagtagtgaagaattggaaagcgtttcctgttaccttggtttgaagtgccaaatgacgttggtaagactgttggcgatagccacagtcataggttttaactgtgtatgttcaaggagttgaacttctagcagatgttttcaatcatctctcttggatgctgtcaccccttccttttgttcaagtctcagctaaagggacatgaaatctgtgctctgtatggagaaaatcactatgatggatttgttgatgcgaaagatagtcctactcgttccctcccttgtttgctggagagccaggtgttattccttggaaagccacatagaactctgaactggaaattttcaacagcaagtaccattagctgggatcatatctacccttcctaggacccctgtgccaggaattctcctgggttgaccttaaacccaagccagtctgacatctttcatctctgtcactattctcacacccattctctagcactggaatgagttactggttttccagaaatttccatacatacatacagaaatatatgcaaaagtaacatcctgagaattttccaggttgaacttcctggt

SEQ ID NO: 24927 - DNA, 2523 bp, Bovine  19866880661229
ttttttatttatttatttttgctttggtatgaaaacaaactttgggaattaaatgacttatagtactattcttaggtaaaattgtccttcatatctgtgggtttcccatccgcagatgtggaaggttgtctgaactatgtcattttataaaagaagcttgagattctgcagattttggtatctgcaggggagatcctgaaaccaatcccctgcagatactgagagatgactctattttaaatattttgttcatcaaaacttcattagatcaggttgttcagagtatcatggccattgtgtacaactaaattgcttaagttatttcaatatcaatttataccatttgtgataacggatgaaatttgaggaaattgtgaaatacataagagaaagataaatcctacatgataatcacttatatgtggagtctgaaaaagccaaacttggaaacagaatagagtgttggttgccaggagctggggatagggagaatggggagatcttgggcaaagagcataaactttccattataagatgactgtttctgaagctctaatatacagcatagagattgtagctaatgacactgtattatatacttgaaagtggttaaaagggtagaacttaaatgttctcaccacaaaaacatatggcaattatgtgacatgatagaaatattagctagcacttcggtggtaatcattccgtaatatatgtgtgctcagtcttgtatattttgtaatatataagtatgccaaatcagtctgtgtataccttaaatttatacaatgctaaagtcagttatatctcaataaaactgggggagaaaaagaaaaaaactcctggagatggatggtagtgttggttgtataaaatatgtatgtacttaatgcatcagaactgtacatataaaatggtaaattttatgttatgcatattttttcacaaaaagattattttgaaagctatttcctttggacatcaagtaagtaggtaaaaggaattgatattcatcagtgtcatttatgataaaaagagaatctgcccccgccaaaagtttctgaaaaacaaatactatcctattcacaagtaaaagttaagatgaaacaccaaaaattttactctattggggaacttgggcgagtgcacaattgttacagattaaaagtagtgttagctcacctaagagccaatctaaagagcagagaatggtcaaatgctttctagaagagaaatctttagtttaaaaaatatctaactaaagacaaaaaaggcccatttctttatcatctgagccaccagggaaacccaacaagagtcaggcctaaaaaaggttcgtttcttgtcctgacatatttttctattccttctaattatcttttcccaagcctgtggtacgttatttcttctctcttacactgaacacaattacaacatttctcattgttatagccccaagtgttaaaaacaattgcattagcaggaagaaacttatctttttctttccaaagggagctttttagtctttattgagtgggttgtcttttcagtggtatctagaggtaccactttcctagatcgtcctagaatgtcctacactcatctctccagcttggtacaggaaattgctccttccactgcctcaaactgaattcaccttaaatgtctgtggtcttgatgtgagaggagagacctctccaaaaaccatgttggtctttggtcagactttttctaagctcttctggtccaggcacatgtaaaaatgcttaagtcctgccaacatcatgaataaatgagttgtattcattgccaactcctttgtttacaaagatgtcctgggcacctggaaaagcagtcaaacctcacttgacactaagtttaacctctgagctgagctgagggaaataagctctttaaatctgctgaatcatcgattctcacacatctttttatgggaaccatagatcaggaggtttccctgggtgcacttacagctggaaaatatctatcattttttcactgctcagcctggacttttggaacataactccttcttgtaaacatattaagttcagttcagttcagtcggtcagtgctgactgactgtgaccccatggactgcaacactcaaggcctctctgtccatcaccaactcccagagtttactcaaactcatgtccattgagttggtgatgccatccaaccatctcatcctctgtcaatacctgaaattttaaggcttttcttctcttggtcatcctccccttctactctacctcccaaggtcctctgaacagctcctctctctgtcttgtccagagaacagcaagagatgacacagtgatcacattcagatcagagaaggcaagcagatgactattctaaaatagaagagaataaaataccttaggcaggtaatattgctccttaatgttgaaagaaagtttaccttattggaacacttgctgctgctgctgctaagtcgcttcagtcgtgtctgactctgtgcgaccccatagacgg

SEQ ID NO: 24928 - DNA, 3541 bp, Bovine  19866880691281
taattctgaagctgtcacaggtctaattcagttcaacacattctgtgagtggcatcggcacaagagaactctgccatcattgactttattactgaatacagacactctcctaaatttcttgctccttccctgtctcctttggccttgagcaaattggcagcagactgcactggcttccctgccctaggttttattctgcctcatccagactcaaatgacttccaagaaaagggcaaaatgtccttttccctccccacccagaaaaagagaatgagagtgcaggacccaaggactccagaggccttcttataaagtgccaaagtacaagactaaacactagaggccttccctgctcctaacaaagatttcatcacccgatgcaatttcatcaaataggggctttggacctgggcgaggaagagcggcagagattcaatatttcctccttgatggctctttcccaccaaatctcttcctgctcacactggaaaaggaccgatactgtggtttcttgttgcttttaccactgttaacccattttcttcttttactcttttgtccatctcttcctctgtggtgaatccatgctattatagtatgaatatccattcagaggaagctgaggtcacaagaggtatgacacaaggcccatagttttggcaattagcagcttaaaagagcagagttaatggatttaactagccttcctttaaccttctaaaagacttctctttgtcaccgccccggctgttcaaactttgccacccactgggtacaatcaggtcaccaactgaaagacagctctcacatgcttgattaaacttagatctgcctctatacgctgctgctgctgctgctgctaagtcacttcagtcgtgtccgactctgtgcgaccccagagatggcagcccacaggcttccccatccctgggattctccaggcaagaacactggagtgggttgccattttctcctccaatgcatgaaagtgaaaagtgaaagtgaaggcactcagtcgtgcctgagtcttagcgaccccatggactgcagcctaccaggctcctccatccaagggattttccaggcaagagtactggagtggggtgccattgccttctcccgtctctcactactttatattaaataaggaaacaacaaagacctaccgtataacataatatcttgcaataacctataatagaaaataatctgaaaaagaaaaaaatttatatatatatattcactcaacatttgttgagagcttactatgagacatagtatatatacatatatgggacagtcaaacctcactcaacacttgacattaagtttaacctcctccaagggaaataagtttttaaaatcttctgaatcatcacttttcacacatctttttataggaaccatagcctaagaggtttcactgggtacatttacatttggaaaatatctattattttttcactgctcagatgggggtttttggaatataactccttcttgtaaacatattaagacacttgaaattttaagacttttcttctcttggccaaacagttagaaccgacctagaacaacagactggttcgaaattgggaaatgagtacgtcaaggctgtaatattgtcaaactgcttacttaagttatatgcagagtatatcatgtgagatgccaggttgaagcacaagctggaatcaacattgctgggagaaatatcaataacctcagacaggcagatgacaccacccttaaggcagaaagtgaagaggaattaaagagcctcttgatgaaggtgaaaaaggaatgaaaaagccagtttaaactcaacattcaaaaaactaagatcatggcatccggtcccattacttcatgaaaaacagatggggaaacaatggaaacagtgagagactttattttcttgggctccaaaatcactgcagatggtgactgcagccatgagattaaaagatgcttgttcattggaagaaaagatatgacaaacctagatagcacattaaaaagcagagacattactttgctgacaaaagttcatatagtcaaggctatggttttttcagtagtcatgtatggatgtgagagttggaccataaagaaggctgagtgccaaagaattgatgcttttgaactatggtgttggagaagacttgagagtcccttggacggcaaggagatcaaaccagtcaatcctaaaggaaatcaaccttgaatattcattggaagactgatgctgaagctgaagctctaatattttggtcacctgatgcaaagagccaactcattggaaaagaccctgattccgggaaagattgaaggcaggaggagaggatgatagaggatgagatggttggatggcatcactgactccatggacatgagtttgagcaaactccgggagatggtgaaggacagggaagcctggcatactgcagtccatggggttgcaaagagtcagacatgactgaacaacaacaaaatgtatgtatatgtgtgtaagtataactgaattactctcccataaactgacaatattataaatcaactatacctcaataaaaaaagtattctaaatatatccaaatgaaacttctttaataaaacttaaatctgtctcatctagggcttctccagttgcagccctatttgctcagatggttctctaaaacttgaattattgcagtggcttagacaagcatacaatggtaaatattaaaaaaaaaatacacaaagatagttttaagcagccatatttggttcaaacaaattaacaattccttggagttgttacaaactgtttttgctctggatggaaagtttacatgcttaatcaacatgggcatgtgtattagaaataacatgacaaggaaaaaaagaaggtggacataggacctcaaatgacattcacatgcattcatttacagtcatttaatttgcttatttctctgaatataatgatatttgctgcaggtagcaaaattctaatgaaaaacccacgagacacgactgtcttttaaagtatgttttagcttctattctttcacatgataacaaatatccttttcttatttcaagagagaaataaaatactcacaattaagactttaatgggaccttgaaataaaagatgaattttagggggacatgagcattatcatattttaatgttgctactgctgctgctaagtcgcttcagtcatgtccgactctgtgcgaccccagagacagcagcccaccaggctccccatccccgggattctccaggcaagaacactggagtgggttgccatttccttctccaatgcatgaaagtgaaaagggaaagtgaagttgctcagtcatgtccgactcctagcgaccccatggactgcagcccaccaggctcctctgtccatgggagtttccaggcaagagtactggagtggggtgccattgccttctccttaatgttgctgctgctgctgctgctgctaagttgcttcagtagtgtccaactctgtgtaatgttgctagtgcacggtaatca

SEQ ID NO: 24929 - DNA, 1638 bp, Bovine  19866880741191
atggtaaagaatctgccctgcaatacaggagacccaggttcaatccctgtgttgggaagatcccctggaggaggacatggcaacccactccagtattcttgcctggagaatccccatggacagaggagcctggcgggctacagtccgtgggatcacaaagagctggacaccactgacacaacacagcacacagttgttataatcatttctttgcctggattgggaaacactgaaagcttgcccaattcttataattcatctttttatattttacttcatggacaagtgggaaccttcagctatttgtcatttgctactatgaagcaaaattagtttatattttcattgcaaaaggtttctcacagtgccatcttctagatggatgatactttatattctaggtatttttgtatacttcatagttaaatacactgtttagaaggaaggaaatctaagaatactatgattttaatgacactgactgctaatacaccattatgtatttgaaagaaatttctaacctcatactatgtaatctctttatgaatagagggataattttcttgtgtatttagaattcatttctagagaaagaaatctttgtggcataggtataaaaaatgtattttgcattcaatgttgtttattcttttaagatttgtaacttgccagcacattatatgtggtttttttttgagaaggcatttttattttattttttttttgagaaggcatttttaaatgattattatttctcatgttatttattaaagacaagatgaaaaaattaattgcttttcagattcttccagatgatcctgataaaaaaccacaagcaaaacaattacagacacgtgcagactacctcatcaaattacttagtagagatcttgcaaaaaaagaagctcagaggctttctggtgcagtaagttaaaatatgatgcttaagagcactttacttttggataagataaacctagtttaccccatcaccctggattcctgtggttaacatgggctcatcattgtgtttatctgtaatttagtagctttgtttgaatacggtagtattttgccttaacagcattcatgttgaaactccagtgagtcatgtctttcagaagaagaatctcttttttcctagtatttagtatgggagcaacttttggagtgaaatggggtgttttttgagaggtcaagcctccattactggagacagggcagtaattggatttggagacattgggcagcttaaggaatagaagtattgaagatcaccaagcttatttattgattgtgttccacaaaagaaggaaaaagacagtaaaagagaggtgattggaaactaaagcaacctttgaaagtttacctgtgaccacagtgtcaataactacctctgtactatttaaaataatttctaatgctatctctggtggcattgtttagctgaagacaataatttaggattgtgaacagccttcctacttctctctactctttttttttttttttaaggaataattacagttggttagcatttattcagattaatttgcatttgattaagctatatcacttttgttgataatttctaagattggtgtaccaacagactaaggattgggtaggaatgtgtgt

SEQ ID NO: 24930 - DNA, 1052 bp, Bovine  19866880925419
gggatcttcccaacccaggggtagaaaccaggtttcccacattgcaggtagattctttaccagctgagccacaagggaagcccaggatagaatatggtaatattaaaatcaattagacataacagaaataaaattaaatatattaatacaaagagtgaattatgaatcacaatcttctagaaattagagcgtgccccaggtgttggcagataactgtataaataatgggttggaggccatttaatctgatgacctaagaataaaaactgcattttccaggaatctggatgatttttgtcacccaaaaaatgtgatgaaaaatgttaatgaatatattaatagtttttcaaaactattatcactggatcatttggaacaaaaatattgaggaattctcaactgtcccattccctcccgccaacacttcagtctccccgctcagaagacctaccacactgctgggtggtcattgtaccatttgccctctcaatagactctaaatattaatattgcaaaggccgtgtatgatgcatcccagttgcattctcagctctagccactgcttgtgaagcactcatatttggtgcttcataaatgctgttgaataaaggaaaagaaagctggtctttgtaaatcattttaaaggcgtatgtcatgagagctatgtcaggcactactctaagagctttgaatataataatccatttaattctcacaatcccactttgagattactatcactagtgttcccattaatctacattacataatttgaaaaaatacatgcaccccaatgttcataacagctttatttacaatagccaatacatagaagcaacataaatgtccatcaatagttgaaaggataaagaagatgtggcattatatatataatggactatactcagccataggaatgaaataatgccatttgcagttacatggatggacctagagattatcgtactaaggaaagtaagccagagaagacaaatatcatataaccttgcttatatgtggagtctaaagaagaaatgatacaaatgaactta

SEQ ID NO: 24931 - DNA, 1112 bp, Bovine  19866880946289
tcagaaaatgtgatatgcttgctttgtgggaaaaataaaaaggcaaggaattggtaattgaactagtggaagttaaactaagcactaaattttgatttgaaaatagatacccagatgttacttttatatatataaaaagactaaatgaaaaaataatgagccattttatgaaaattcctttaactgaagttagacaaaagctggttttatggactcaagttttgtctctacataatgtaagcttccctggtggctcagctggtaaagaatccacctgcgatgcaggagacctaggttcgatccctgggttgggaagatcctctgtagaagggaaaggctacctactccagtattctggcctggagaattccatggactatgtagtccatgggtcagagagttggacacaactgagtgactctcactttcacaatgtaagctccttgagaacgaccctctccggtcgaccactacttttgcactcagcctggtgtttatagagttgagcacctgaaatttctcttgatcattgtcctttacaccctatgtccagctaacagaagctacattgctccttcacaattaagttccttgggtggttaggtagttaacaccttctaactgttaggtagcagtgaagaccatgggtgtatttttcctcaacctagatatgaggtgacacattttacaacgtgagaaatcaagaaacattgagactgaattttgaagtcagcaagcatctgtcagcatgaaaacatcaacacagtcatcccactcctcagtattcccagtgaagtctagctccccttccgggcctctgacaagcaacttgtgtggaaggtttactcaaggcagatggaataatattagagcatcagaatccaggaccaatatttccagcaaaatatttccagccaatacatgtacattgaacacagtcatctcactgctactgctgctgctgctgctgctaagttgcttcagtcgtgtccgactctgtgcgaccccatagacggcagcccaccaggctcccccgtccctgggattctccaggcaagaacactggagtgggttgccatttccttctccaagcaggaaagtaaaaggaaagg

SEQ ID NO: 24932 - DNA, 1719 bp, Bovine  19866881003671
ctatccccccacccccggggggcagaaggcgctggccggggcgggaaaggcctccccagctcctgacccgcactgtggccgggctggcggcgcggcggcaggaacacacccgccaaccgagcggcgcgcccagggcacacgggagcggcctttcgccctgcctcccgccagcccgcccgccgtctccgccttctgctcggaccgtggatggatctctcctctcgcagccacttatcaaagatgtagcgcgcgggcggggggggctgcgctcccgagacaaacgttccggatgctctattgctctctgcatgggtgtttttactgaaagtcgggctgggatcaggtttccgccgccgccgccgccgcctcctaggctggggagaccaggagcctggttgctgctgccgccctggagttgggggtggcgtcgaggcgaagaaatggcacccgatgggaagataattctacccgtttgaaaacctgggggttcatctcgaagtcacttaagacttctttaaactgggatcactttcatatttgcgaaagccccttttaatttcagctttcaccccctctttggaaaaacttggtgctttgtggctagccgcgtgttttggggggttccaggagagtgtgaccgatctcttgccttcgggaacttccccggtggaagcagcagtgaggaatctgttcttagcgaagaaaaatctttttgtgttagcgacgatgagccttcttgcgtgttttgcctgtttttctttttaatatcttttcatgaacacaatgatgtatgtcagttatatctcaagaaagccgggggggcggaaatctagaacgccctttataaataagtaccattcctagcagccatatctagacaaaaagttttttcagtgccaaattgaaaaagacaatctatcttttagtttgagagcacctagagcattagatacgttatcctttgagatctttttgtcctgtatttgtgggacagcaaccacaacactctgatctggagaatactgaactgtaatgccacccaactgtgccagagttaatttttatttatttattaagtcataccagcggtgttaaaaatccgggaggtcttttaagtaatggggaaaaaatgtgacatttgagcagacgactaaatttagttttgcagtaactttgcattgtgatgtaacagcctgcattttaacacctgtctcttgtggaaacagactgaagtcttaatagagagtgtaaatagcaagttttacaatgatgaaggtttttaattagtgattttagaaccttagaaaataaagtcagtctgctcacggttgcgtggaaaactttttatgacgtgtcaaaaaatatattcaggagtgttttgtgtggaaaaaaaaaagtgtccataatgtcaaagtgtagatttcttgaaatggaaattgagctggtgggcaggactgtgaccctcttgactgcttagatgttgtttcctttagttgccatagggtcctgtaacaggattggaatgtggtccttgaagctttcttcgatggcctctgaaaggcctaagaagttggtttaaaggtttagaaaattaaggtgcctgagttcaagaacttggaatgtgaaactcctctcagtatcctaatgtggtcacactgaagtccccattagattcgacccagagttgctgtagtgagtgatatctgtggctagattgtt

SEQ ID NO: 24933 - DNA, 1526 bp, Bovine  19866881026500
aattgtggtaatgattatttgtaataatgagctacagagtattaatcttgaagtaaaaacataatttttgaatatctggctttctttatactgatcataaaattttaaaaattcattccctcccacacacagacatttctgtttgcttcagaaaccaaccagccagaaatatcaatatatttcaaagagctttattttagattcagttcaaaaggagggcaaagctaacagcagaatcctttatgggagctaaccttatatgagagaatctaataaaggatgccatatatttgtaagggaaaaaatgcaccctgaaacattttcaaagatgctgcacaaaaaaagcaaaaactaacatgacataaacaaactgtattgattatattttatcttagaaacattgagatcttgaggataaatgaaatttggctgtgttgatcctcccatcctgtgaatttcaaatatctaagtatctgctgcatgtaacatccatacttctgcccctctgaataagtcatgcttactgatagttgctgctgtatttttgtgttataaaattcactttttaccactaaatacaaagctcccaggtgaataaacaaacctttgagaagttttttaaaaccacagtctaacaagcatgccatacagatgaactctgactcgcatgaaaatactggtgaactctatgaaacttgtcaaactgtgacttaaaatgttctttctactataaaatatatgatgctcttgattttgataatctaagtgctttatacaaatgagatttactttgtgtgaaaaagctcactgccatagtggtgccagggagcttcagtttcaggaacagcaatgctaaccagcaagtcatttgggtgctttgattcattggcctcttatctgtgagtgtaaatctatgtgacagacagtgcctggtgaacaggaggagcctgtcttcacaatcttacattctattaaagtagattaggaaacaaaaaccaaatattaaacagaaaaagaacaaaaataattaaaagttgtaaaagatactgtagaacaggacactatgaaagaaaatagaactgcaaagggcagaggaggtcctacttctcacaacatgtttaggcaagacctcccggagtaagtgatatttaaccaaaacctagaggatgataagaagacagccatttgatgaaagggaggaagagttttcaaggtggagactcagtaagtacaaagagctcacaataggaaaaacttggcctcatagggaaatgtacgatgcctaatgtttctgcagtatagcaagtaggacagagacacaaaatgagactaaagagacagtcagaggcctgattcagagcctggaaaaccatggtgtaaggaccttggaacatattctagtgcatggggacctacaggcgagttttaagtagcagtggccaattgtacaatttttaatgttcaggtagagtaagaactacttcctccaaagttctggtttcctccatcaaaatacaaagagaaca

SEQ ID NO: 24934 - DNA, 2271 bp, Bovine  19866881093025
taatgtttgtaaaggccaaataagacaacattaatcgaaacatctaacgacaggacaaatgccacgagcattctctcatgctttggaagtgaaaagatgtgctttcattctacagataaagaaaccaaggcctagctcggtgatcaccagctagaaggaaattgaacaccaccacaatcattgtcttttgactccctggcaagctcttctccaggcaaatcatgaatatccctcccaggggcaaactgggtctgattaactgaaagcctaagagggagccaatcttgagcagggctacttctgttcccagcccctcaccacacccacgggggcagccagaatttagatcccttcctcttgttacacagggaacctctcaaggtctggggagcaattttggagccattctggcaaggccctggcagattctgtgtgatttctgcagcagcagccagctgattcaaggctgactcacgaagccacctgggcaagagtgggggccaccagcagctgctgcctgacctttcagaccttctctcctgagtgtgtctgggagtctctggggcagttgtgacaccctgtggccagcttggctcatcacagcagagtgtcccttagtaaaaccaagaggaataggtgggaacaggtgcaggcagaaagagagctgtttgcctgagtttgtggaacattcccggaggctcagtggtaaagaattcaccttccatgctggggacacaggacacccaggtttgatccctgggttgagaagattccctgaaggtgggcattgcaacacacttgagtattcttgcctggaaaaatcccatggacagaggagcctggcgggctacagtccatgaggtcacaaagagtcggacatgactgagcatctgagcacacacatgtacagggcatgggtagaagccctggacagcagctctattgatgtctcatcgtgcagtcaggatcaggtgagccatctagatatcagtccaatagagtcctttgataaattaagccccggatacttgccaaatgcaatcaataagagactccaagcaagaactgtctggctgttccagccaagtcaaggatgtaagggctcataataaactgttgctttatgtgattataaaaactggaacattgtattttctttgtcagaattttactcctaaagagcttccaacatcatcacagattttctgtaacctctggaaatggttgaacagcctgtggatttgaaaaaatgagcacaaatcacatttttctatctatctatgtatccatctatctatctatttatctgtcttctatctgtttatgttagctgcagtctggttgccagctgggacaagtgggtagattaatatttgagtctcagtaactttgccaaggactgggttcaataaggtacttctcaaggttggcaacaggcaacattcttacagttttctgagttactgtcataaactaaaattctagaacatcataatttaagggaacatcgagctgactagtttgtccctggtggctgtgtgagagtatacttggtggaaggctttgtcctcagggaaaaactgcacacttgaagtggcacaggaaggagacgatacaaacgtttagtggtttaataatgtgaatgcaggaagggcagtctgcgtgtcagttacaatgaactgattccttatggtgtatgacttgtaaaagccagcaggaaagaatttaccataagtactttcctcatataagagtctaaatcctgaaatgtgcccatttcagattcagtcatttgtgttcttttcccccccgctaaacctccattaaaatgttaatattctttgaagaatgtgacttgaacaaacttatactcaggtattaaggagtttcagatataatcttttctcctacagggacaagaattttcagaagtgttcttgtttaaagagcctttaaagagttgctggtgttttttagtagatgctgagtgttgaaatagagaaaaaggagagatgacataaatcgctacctcataattttatctgagcttatgctagatgcagtatgtacttgcatttctatttatgccgttttctgctgatctcctctgaagtcatacgctctttgaagaaggttcatgtatgtacatatattatagtaatttggtaagtcaatagcatttattgcctcctactgttaactggtaagcatttcttttatcagctttattccaggtcatatgtaaatgtatggaaaacgacaatacgaatt

SEQ ID NO: 24935 - DNA, 1378 bp, Bovine  19866881209321
tatttaattcctctattttcccttaaatagaaagactaaatcagagcccactaatatgaactccactatgtctactaacatgtttctacatattaagtgggatttcacctgactccaggttctactgtcctaagaaactgaaggagttctctatgaaaggctttattactcgttagttatttaaaaataaatggtttatgcagtgggacttaagacaaagttatatctcactattattttattttttaaattaattaattttttattgaaggataattgctttacagaattttgctgttttctgtcaaatctcaatacgaatcagccataggtatgcatacatcccctccttttgaacctccctcccatctcccaccccatcccacccctctaggttgatacagagcccctgtttgagtttcctgagccatacagtaaattcccgtgggctatttattttacatatgataatgcaagtttccacttatgcaatgggacttaagataatgttatacctcactgttattttagaagaaacccagagaatagggtagaattgaataatatggcagtgattaaaacactttagaaattgtcattaaaaaaacacacaggaagtttgaaagaaaactgctttccattaaaatctcctccatctctcccactcaccctattaccacgtcagggacacatcgaagtgtacccaggccagtttaaattaaacacatcaatcatcccaagggtcaagaattacctaatgctatgatgaacgactcctgtgacttagcttttaggctttgctctttgaagattttctatccatgtgcatttattttctagactgaggcaatcagtctgatgcaaagttgaaaaaggcagttgcttatgttttgttcagaatttctccagagtagcctgctatgtagtgcttggcgttcctaccatcaggattatttctctgaatgaagatttatgaacagaaggttcctgtttggatttaaatacattttcttagaggggtgctaagataaacagccaatcataattaataaatctgcggactaaagtgcctttcaagagagaagttctaaaaaattaaagccaaaggcaggtgtattttgattggaggctggataagaaccttctgaagcatgacgtcatggcttctgattattagcatcccgagagtaaagaggaaattggaggtcactaagaacctaagggtgggtgtatatagaaaatactgtagaaagtaggttttcagtagaggtcagggagatcttaggcaaataccgtctccttaagcctgattttattttagtacactaaactgctgcaaaaatttgaacaacctttttttttttttttttccccaatc

SEQ ID NO: 24936 - DNA, 1919 bp, Bovine  19866881234443
gccctttgcagtaaatattttatcctattattttggaagattatttttgcattcagagcagaagtctactgaataaaccagaagtaccccaaagaaatcacggaacgttgcttcttaggtttgttagttgttttgtggcacattatctcacacctccttacagatgatctgagagcaatttttggctttcagtgcaggaggatcaaagaaacgcctatcaaatgttgcccctaatcgctttagacagttcaagcttctgcaatgccccagtgtttcagtttaacatttactgtggtgtgccttgtgcaaatagatacagttgaaatttaagcctgttataatgggagcctgaccacgtggagcagagggaggaagatttctaccaaaatttgccagctccatattttgccctggtcctcctggggtaagttcagggtaccggctcccattcatttccttcggcagcaagcccagaagcccctgttcgcagtgactacaggctggatattatctaaactctcagtgaatcacagctgacagtgctgctatttctaagccccggaatcactctttgaacaaaatgcaagcgctgtgtcttttcaacctgttcttcagcggcggaagcagcagggttccagcactgtataataactgtcagaaacaatttctgctctgtaagtgaggtgaagcaaaatgtcaaaatatttgaatacatttcattgaggatatcttcttttaaattagtgaaggctagagaagaagaatcccattctctcgcataataaatatgcatggaactggggagccacgtgcattctaataaagccgagtcctggctggttaatgcgttataggtccacaacaataaaacacaataattactagttaaagagatgccagtgttggccttttaccaacatccctgaacatataattcataataaatttagtaaggctgaagtcggcctgttaattaacccattttctacaatgattgggatggaggaagccacgatgtaatccgccaaggtgccctcccaaaggtgcacagctctcgctggttggactctgcagtttggacccatgcgcatcaccacaggatccttgcttgtgctcagacaggtgggaacactgggggaaaagcgctaaaggaatatcttactctgtaactaccatatttgagaaatgaaattgcaggacagtatacacactgactggtgggtttccggggccttttttagaaccaacaatttaggcaaggaaagctgaggagaggggcttagcaactcagggactggagtaagatggtggacagaagacatacgtttttccttttttttttttcccacttaaaaccattaaagtgacagaaaagacagaaacatgtcacagtgctagtaaataggaaagggtatcatattctgccaaaatttaagacattcctggactacagagaatagaagaaataagactggtcagagcagagagtcccacagtctaacacaaaccaagaagaaaaccaccctgaacttatattttttctgagactgctctgcctacctggtaaatgaataagaagaggaaaaagaggtcctgggaaattatcaggatttcttttttccttcttaaaaacctgttatagtgagtgtgcagtgtgtaaatactttaaattattatggtagaaaaataaagttacatacccttctgtggaaaaaaaaaaaaaaaaaaaaaacctgttatagagcattccccccttcttcctctctcacattgagcagtatgtagcagaggggctcatcaccaggctctgagtcaataactgctctctaaggaaagtgaagctggggcccacggagtgctgcaagttgggtgcaggacctgagggaacacaaactccatggcaaatgtcgggtgggaag

SEQ ID NO: 24937 - DNA, 1225 bp, Bovine  19866881267622
tgagaaaattttttaccagtaactttcatttaatcctttatccaccttctgtgccgagctggccaacagaagttccagtcgtctgaagaatcaaacatctgaaagttacagaaggaaagaagaaggaaaagaaaagtacacttgccttatttgtcgcagtagcactagatccagggaccacgggcacgttcgtcacttgaactgaaagataattattgtctatgagtggccaagcaccttccactttgcatgtctggaagtgatccttgaaagttctaaggtgagggtctccgaacaagccacagaaaaggtaattgggagggttctggtccccgcccctgtgttctctggctcccgcgtggctgtgatagttacaagggtcatgggtcacttctgggttggtagatgatgtgggtccatccttggaacagtttctctggctcatgaggtcgctgatacccagcacagcagaatggtacactaggttaccacggcaggctttggaagtccgctgggtgcagccagcataggcgcgcagagccttgcagaactcagagtcaaagccatcgacggcggagttcaggtgtgaggtcagggacacaaagtccgtggtgcatttctggattcgacactgggctggctgctggcagtcacctaggagaaagacgattaagaccaaatgtttttaaaaggcttcacaactttctgagctgcatgagaaaaggacattcttcccctgggaactgtttgttctatttcctatactcctattttaagaaggccttcagaaatagggttgcattgtggcttcttggtctctcacaaagtaagccacgggaagaaccactgcatgcagctggttaacttaacaactaaagcgcgggccactgcgagggaacaggagtttagtcaggtgttcttaggctaaactacaagggaacaataaaggaaatattttatcaactttgctcttgtttacagattttgagaaagatccctttgctctaaggccaagtcaaagatgtgaactttgttttgattttgaaaactgcataagtaatttgctttgaaaagcacagtctgtacacaaaatcatgagtaaagcctgcacacttcagggaggggaaactcctaaattatagcgtgattagttaaaacacctttacctgattctactctagtacagggcaagaatatcaggaaaaaatccaggtactaagttatt

SEQ ID NO: 24938 - DNA, 1209 bp, Bovine  19866881313022
ttgtgtatttggcagatattttctcaaaataaatgaaacaagcctgtcatttcaagggaaataattgacaatatttgtttccaatgatgatattcaagcttccaaataggttagaatttttgaaagctatctacctctgtgagcttaaaaatttggcaataaagactttagatactataatggtgatgttaattaatgtgatttacttttgatatcatataagggtatgtgtcaccatatggaaggtctgaataactcaatgagccaatatttttgaaatgattgaagcgcagtgttccaaaatcacacatgctaaaagattcatttaaagtgtaagatagaccagtagttttaatataacacagtacattaaacagcaaatttaagttaaaggcaaaagacagttgagaaaactatctctaacacatagtaacactttgtcagaaataaaaagctttttatatcattaataataagtataacagaccattgagctgtttctacttctttgggtataaaaatgaagtagctttttaaaaagaaaaaccaaaccattgcttgaaaatgtgctgtgtttaactttccttttttatcccttaacattttcctggacagattccaaaatcttatagggattttgttattaaatgagtcccgaatagcttaagaccataacctcatatccccatccctggtaccactagaagctgtgtctctggccagtgggagtgacttcaggaaatgggtatagggagttcaggaaacactacaaaaactgcctagcctggtgctttatctggggtggcagagaggggtgagaggagcctggaagaaatagcattgtttctgctacctttttctaccttagagggagggagaactctctagtgaaagctttcggtgacattttggcacagtgtatctctttagcacgtaggatacttttacctctgaacctcagctttaaacctgaacctagattccagatagtggacatcctattctgccagaaaaatactaatactgcagtaaaaaaaatgaccaaagtgcttaaacagaaaatacccaggaaaacaaaagactcacttttgctgtttcagatgacttatactagtataataattttatatatttcagtttagttgctcagtcgtgtccgactcttcacgaccccatgaatcacagcacgccaggcctccctgtccatca

SEQ ID NO: 24939 - DNA, 1322 bp, Bovine  19866881443865
ttgtagcctatctcttctaggggaacttcccgaccgaggaattgaactggagtctcctcaattgcaggtggattctttactagctgagctaccagggaagcccataacaagtgtggtagcatcaaatcaccaaaaatcctaaacactggtattcaaatatatacgcacacacactcacaaaacaatccttttctgctcttgattaatatagatggttaatgattaaatgagaggcttactttttaacctgatactgtgaaaataacagaaacaaaatttcagaggtaaagcagatagacatcatttaaattcaatcccttcatgaaaaccgaattccaaagaagccaagatcacaaagctaactttcctgaccccgagctgactttatttctaatataatttaaaagcaaaaattcaatttaacaagaatggtcaacagaatcaagtattgcagtaccttgtgtgtcagactgaggtcaggatccattttaatcatctcccagcttccatatccatattcgtagataccaattaacaaattggaatcatcttctttgccccagtctatatcaaaatgagctgccttcgtgtggcatgggatgatatacctatcattaaagttaacaaccactgtcaggtttataattgcctcattaaaaattttgaaaaccacgtttgatcattagaacttcaaaatattgcgctttattttatttttaaaaacatttcattcaaattggccatggaataaaaaccacttctaacatacactcatgtccaaattattgagtaacaagtattttacagcagaaaaaaataactcactgctttctttcttctggatctgaaggaatggatttgtgcagcggtattaattcttcttcatgggagatgaccagcttggcattcacctgtacacctgatattcggaatgttgggccctttacttttccaagtctaccacctatatttggaaaagaatatcaaaaagtataaaatatataattccacaaaatacaaagcaatgtatgttattacttatataaaaaagtagtagtatttatttacctattatttttaagtattacttatttgcattaacgggagaggcttgctggcaaaccttaaatttcactctaagtcttttcactacatactagtgattataatacagcgcaagaggattcacaaaaagcatttcacatactacagcaaacacatgtactgtgctgtgctcagttatcagtcatgcccaactcttggactgtagcccccagggactgtagcccgccaggctccctttgtacatgagatttttcagg

SEQ ID NO: 24940 - DNA, 1495 bp, Bovine  19866881449157
cacatttgacattattgcccacatgaaaggaaaccaaatggatttccaataacttttggccttttggattctggaagtgttcagagacctacccttttaaaccaaatgcatctgaaaaaaatgtttccagagcatgcagtttagattttacagatcatctcaccattctgatacacaatattgactaaaaaagggaaaaggaaagaaataacatgtatctaataaaatagtcaatataaaaaggactataatggaattaagtggcctgcaagtgacttctgtgtattgattttgtgtcctgtgaatttgctaaactcattgattagctctagtaattttctgatagtatctttagggttttcttgtcatctgcatcatgtcatctgtaaacagtgagagctttacttcttcttttctgatatagattccttttatttctttttcttctctgattgctgtaactaggacttccaaaactatgttgaattatagtcgtgagagtagacacccttgttttgttcctgatcttaggaggaatgctttcagttcttcacaattgagaattatgtttgctgtgggcttatcatatatggccttttctatgttgagtaaatggtacttctatgcccattttttgaagagttttaatcataaatgggtgctgaattttgtcaaaggccttttctgcatccattgagattatcacatagtttttatctttcagtttgttaatatggtgtagcacattgattgatttgcatatattgaagatttcttgcatccctggaataaacccaacttgatcatggtgtatgaactttttaatatgttgttgaattatgtttgctagaattttgttgagtatttttgcatatatgttcatcagtgatattggcctgtagttttcttttttagtgttgtctttgtctggttttggtattggggtgatggtggctgtgtagaatgagtttggaagtgttccttcctctgcaattttttgaaagagatttagaaggataggcattagttctaatctaaatgcttgacagaattcacctgtgaagccatctggtcctgggctgttttttgggagatttctgattacagtttttatttcagtgcttgtaattgggttgttcataatttctatttcttcctggttcagtcttggaaaattgaacttttctaagaatctgtccatttcttccaggttatccattttattgccatatagttgttcataacagtctcttatcatcctttgtatttctgcactgtctgttgtaacctctcctttttcttttctaattttgttgatttgattcttctctctcttttttccttgatgagtctggctaaaggtttgccaattttatcttctcaaagagccagattttagttttattaatctttattattgtttctttcatttctttttcatttatttctgctctgatctttagatttctttccttctgctaattttggggttttt

SEQ ID NO: 24941 - DNA, 1732 bp, Bovine  19866881592707
tgatgctggcaaaggttgaaggcagaaggggatgacagaggatgtgctggttggatggcatcaccaactcgatggacatgagttttgagtaagcttcaggagttggttatggacagggaagcctggtgtgcatcagtccatggggtcacaaaaagttggacctgactgagtggctgaactgatccttggcagactgggatattaagtagaaaccatccctctggccccagaattttttgccatattacctttacctgttatgaagctcttcacttcccttttatctaattcacattaaatacttaagttctcaaaccatgtcacttccttttcagactagggttctgcattacgaattctcacggccctaaatgtttcttcataccatttttctgagttatgatctccaagcctgattgtttcttgcactagactttaactcttgtctgtttttgttctattataaccctccttccctgttcctgcagaatgcctggtatgcaacacagtgaatgaatgtcaatataatgcgatggggacaggagctcacactgtagtatggaagtaactgtttatttcaatataatgatacggtgtacctacagaatacaaaattttaatgtcctaaaagggaggtgagagagctgcattacatttctcatagggtatgagaaatgtaatgcagggtactggcacaattgtgacagggtactcaacagctgttttatttacacctaaaataaactgattcataagatagagggactacatccacttatgagactaataccttcccaataacctgaagaaatgtgtggctagaatattgtctcccaggtataatgggatgcaatgctggaatcagactgtgaaggaagtaattaaaatattacgtatggaaatacatgtggtattaagtagtggggattaagcagaaaagctgaacaacaacatatatgaggtaaaatggacaatatacaaaggatttggcagaaaggaatgataccttatcaaggcactaatctgatattctgaagctagctacttaaacaacttcccctccaccaccacctctgcacacttaaatttttaagtagaatcattgaatccacttcaatacctgttttatacacagttgcttcttagtgtcatctccaagaatttcacatctgaaatttaactatgattttaaaaattagtaaaatctccaaatactgtggccatcaacaaggtgggcgagctgttggtggttatcagaacaatctagtttttccaaatactacttagaacctcgaaattgtgcatttcagaaagggacagtttggcacgtgtaattaagaaaaacttcccaaggtgactgactcctgtccctgcccaacactgggaaccacggctcctctcctctgatttttatgatcaagcaaacagaaaatgtccagtaaattttcattatgaggtggtttgggatttcatgggttctgtttatgaaggactttgtaaatttaagtatcatatttggagggctctttctgtttggcaagaacatggggaacaatgtcatagattgagattctagggtattttaatactgtcctgattgttttagcagcttcttgtacacaaatcttctaagcaacgagaacaaatctggcatgtaaaacatcaactgaaaagcaagagtgctcattgtctttatgctgtgcatctcataattcggtaagggctttcaatc

SEQ ID NO: 24942 - DNA, 663 bp, Bovine  19866881610959
aattcctgatttctcttttattagatattacagtgatagagagaaacacagaaaactggatgatcacaggagtagagaccacagatcaaatctggaaggaagtttaaaagacagaactcattctgatcatcgttctcattcagatcatcggttacattcagaccatcgatcaagttctgaatatacacaccataaatcttccagggattataggtatcactcagattggcagatggaccatagagcttccagtagtggtcccagatctccactagaccagaggtctccttatggctccagatctccatttgaacactcaattgaacacaaaagtacacctgagcatacctggagtagtcggaaaacataacgaaaactgatactgtctttctggacttttcttttagccatatatcataaaccaacacagtaattgccttacatgacttgaaagatataaacagatcttctgtcagtagcagtattgttacttctttccaggatgcaaggtctattatcccaacagaagagaaaatatttttatatttaaggattatgctgcactgtactacaaatattgtagtactattttttttcttttttaaagaaatggaaaatgtttactattacagggacctcaacactgcccttccatgtaggctg

SEQ ID NO: 24943 - DNA, 1183 bp, Bovine  19866881621191
atgaaagtattgaattatacttgtgtttttattccctaactttaaaggaaatgctttcaaaattccttatagacttaatcttggctcctttatgcaaagtgataaactgttttaactgtagggattgctttatgggaaatttttactggctttttaaacttaaactgtcaaaatagtcactctgactttctcatgaattgaacaaggctgaaaatactttccagttattataattcagacggattcaaagcacaatcaaagcagagtctccagcccattgtcaggagggaaaaaaaaatgaggttgtgaatgctaagcactaaggcatcttctgtaaatggaccggcaaggattgtaaagtggtttatttttcagtattactttttcccacaagccaggaaaaaaaaaaaaaacacacacacactatatgttaacagtggcctcccatttctccagtttacaaatggcttacattccccctaatgattttatatcttttcacttcttcaaagtttctggtccatgggttattaatttgcctctgtgttttgaaagagactaccatgtgctttctagcagccatcactctttttggtgtggtttcttaggccattagaagatgggcatcagtgatgactgtgacttccagatcacattcttgttagaaattgcccaacctctctttccctctcctattgcctttaatgcaggtatgatgctggtgacacagctctgtccatacagacaaaggaaaacatcctgaaaaatggtggatggatcaaacaaaggaagcctggtcctcaaatgtcctgctagatcataatcatttacatgcatcagctggtttcttaccttttatataggaaagaaataagtttctaccatgtttgggtccctacttttgtttttctttattatagcacctcagcttatcttctattgcaactgttttatttttcattttataaagtttttttttttttttttttactattctggatgagaatttaaaaagtctcagtgagtaaactccaaaaagtaacacaacagtaatactgatacaattagaaagtgttttacattaagttaacaattgtctaagaaatttatcatgactagaagatgacaaacactacccaaaagtttataaaatgtcccataattctgaattgggcaaaataaa

SEQ ID NO: 24944 - DNA, 810 bp, Bovine  19866881679933
attcaactcattttatatattttgcaccatttaaggaagacacaataattttgtttaaatttaatagtgtatcacttccttataaaagaaacttaaaattaacacacacaagctcggaaatagaaattatggctactatcccaaagtctgaaaaaaaaggaacattcaaagatcaaattagaagaataaaaattttaaagcaacattaaatattcaggtttgctttcagtattcaaaaaataatgtctttttaagctattttgttcaaatgagtttgcatacataaaatattaagttatttcccagtttggttcagatgggattacaattggtataaaatgagagttagttatgctaaaaaacatattcaaagcccaaaagacttaatcaatattatagaatagctgtataaccatcaacatatactaaaaggaattctttccacaagctataaacatatagctctgcaaagaactgtgcagagatcttatctttaaaatacagtattggaagaatgtaattgaatccaacagttttattaaaagactgtatattttataaagcttataaactacatacaaattatggacattgactttgtcaagcttaaaattctttagtatctctaatgcttagacacccatcagtagggtcattcctaggcaaagtttgcaactcctcatagcaaagtttctacttttctctttacctgttttgatggtctcctgctctggttctcaggccatttgtctctcttgctcaaaacttcttatccagcttattacacgattaatcttgtgacaggccctg

SEQ ID NO: 24945 - DNA, 4178 bp, Bovine  19866880382725
cccagaatgaaggcagtctgttttagagtttttaaaatatatgttataataatactgggaatcatagctgggagctttttttttttaactcttaatcctatactgcttgtacaatgttgatgtttatattttgtgtaaaagatttatttgtgcaaaagcataagtcacagagagaagctgtgcctctcctcagcccccgcttcatcactgggtctctctccgtttaggtgtggcatgcacaacagtttggcagatgcacacccactcccaacccttctcccttgccttcttctattgaagccagagttaaacactcaatttcctcccctcccttccagccaggagtgactgtgtgactcagttccagacaagagaacttagccaagttcaaagaatataaagagagactcccccaaaaaggggagagctgtagctagtcctgctttggcctctctgccccgttcttcctgccttgaatttggatgtcacatctgaaggtatggtagccatccttcaaccttggagttagaagccaacaccttaaaaatgggacagaaagaaagcaggagactgggtcttctacaatggtaccaggcctggattaccaacttgccactataagaaaaatatcacttgtttctttaaacaacctttggccagactttctgttgttttagccaaacacattcctatatgatacacattcgtgtattcctatatgagatttctttgatgtgctgctttcctattttcctcagcttcttggatagctctttctcactctccagccccagcccctctttctctgcctatgcctgaatgctgagatttctgtgttttctgtccttggtctgttctcatttcttgaataattttctccacgggcacagcttcaactaccccttatgtaccaacaagttccaaatctagatcatggacttaggcctccaacctgaacccggaccattattttcagtacatttacaacctttccccttataactctggagcaaattgagcctgctgctgctgctgctaagtcgcttcagttgtgtccgactctgtgtgaccccatagacggcagcccaccaggcttccccacccctgggattctccaggcaagaacactggagtgggttgccatttccttctccaaatcttggggatactgccaggcaaaaggaaaggtcaggcttgtatgtcttgtgattgggtgatcttgtgtgtgtgtgtgaacatgcatatgtgtgcgggtgcatctcatctttcctgtaaagcactctgatctgctcacagcttttcttccacctgcttttctgtcattaagtgtgtggtctattatagacaagtcaaaccctggttaatgggtttgactagaattgatataattttattagtaaaagtgaagttaacatcccttagatatttaaggaaaatttatgcaaattaccattgcctgttttatagaaaagacaaaactgaaactttggttttgtgacattgaataccaacagataatctgtgaaaataaagctcaatgttattgtcttcatagagcataagacaagtaatattcatgaacagctctcattgtattatagatctttacttccttatgatcagaggcaagtttctttaaacaacttgaaggttctgttcacatgtttaatgtttataacattaaatcagaacaaatgttcatagtagtttatgtataatttcaaaaaactagaaacaaccaaatgtcccacaatatgtgaggtgttaaacaaggtgatgcatccataccaaggagatgtatgtagcaagaacaaggaaacctactattgattatgcaacaaacaacaacttagatctcaagtgcattatgctgaggggaaaagataaattaacattcttgaaataacaaaattacagaagtgagaacagagcagtgactgtcagggctttgggaggatgaatgtgggaatggctacaacaggggtggcaggaggaggccttgtggcaatgaaacagtcctgaatcgtctgtggctgtggttacagtagctacttaggtaatacaattacatagaactaaactctagtcaaggctatggtttttctagtggtcatgtatggatgtgagagttggactgtggagaaagctgagcaccgaagaactgatgcttttgcactgtggtgctggagaagactcttgagagtcgattggactgcaaggagatccaaccagtccatcctaaaggagaccagtcctgggtgttcattggaaggactgatgctgaggctgaaacttcaatactttggccacctcatgcgaagagttgactcattggaaaagaccctgatgctgagagggattgggagcaggaggagaagggaacgacggaggatgagatggctggatggcatcactgacttgatgcacatgagtttgggtgaactccgggagttggtgatggacagagaggcctggtgtgctgtgattcacgtggtcacaaagagtcggacatgactgagcgactgaactgaaccgaattgaactgaaacacacttaaaactcagtattcaaaaaacaaagatcatgacattcagtcccatcactccatagcacacagatggggaaaaagaggaaatagtgacaacttttaattttggggcttcaaaatcaccatggatggttactgcagccacaaaattaaaagatgcttgcttcttggaagaaaaactatgacaaacctagacagtgtattaaaaagcagaaataccattttgctatggtttttccagtggtcatgtacggatgtgagagctggaccacaaagaaggctgagcatcaaaagtattgatgcatttgaactgtggtgctggagaagactcttgagagtcccttgaactgcaaggagatccaaccagttcatcctaaatgaaataaaccctgaatgttcattggaaggactgatactgaatctgaagctccaatactttggccacctgatgtgaagagctgactcactggaaaagaccctgatgctgggaaagggtgaaagcagaaagagggggcaacagaggatgagatggttggatggcatcatcaactcaatgggcatgagtttgagcaagctctgggagatggtgatggacaggaaagcctgacgtgctgcagttcatggggttgcaaagagttggacatgacttagcgactgagcaacaacagaatacacaggcataaatgagtgcatgaaaaactggggaaatctgtgcaaggtaccaatgtcaatttcctggtcatgctactgtactacatagccatgcacgatgctgccactggcgggaactgggagtactcaagtacacttctctgtggatcatattttgtggcttcctacaaatctatcagttcaattcaggtcagtcactcagtcgtgtctgactctttgtgaccctatgaactatgaatctataatcatttcaaagtaaaaaagtagaaaacaattcagcagggttaggtttggcttcactttagttctttgccctgaactgatttttctatatgcaattagttactcaattatcctcatgtaatacataagatttaaaacaagattgagaatagtggagtaaagaggaagcacaaacaatgacaccactgtccacttgtgaatatccatttttgttcttcactgttggcaagcagagctcaggtgaccctaccctgggctcatttctgctttgttctgtaaatgacgtcattatccttggagcaaaatataccaatcagactgcccactgccaatatgatgcaaggaactgtgctgcttctcaatgaaaatgtatccatcgtatctgttttctgctcttcaggcccccatacccacttccaatgccatgttttcttttctttctatttttactttttatttaaattcttccctatactttaaattttaatataaaataaagacgccattttaatttaaataaaactaatttgtgtgtgtctgtgtgtgttagttgctcagctatgtctgactctttctgaccccatggactgtagccccccagggtccttattaaaggcatagtcatcaatcatatgaatatacttatgaaactggaggtattactgtattgtttgaaggtttctggtgaatttgcattatttttgctgctaaaaaa

SEQ ID NO: 24946 - DNA, 1598 bp, Bovine  19866880492314
catctatttcccatgaagtgatgggaccggatgccatgatctttcattttaaggctgtgtattgtcaccctgcttatttaacttatatgcagagtacatcatgagaaacgctgggctggaagaagcacaagctgtaatcaagattgccgggagaaatatcaataacctcagatatgcagatgacaccacccttttggcagaaagtgaagaggaactaaaaagcctcttgatgaaagggagacacaagtagatggtatttgagactgagaatcttaaaggagtttctacataggaagtaagtttagagagaacaggtccacgggctgagcccagatgcctcccacaagtgcagaagtctaggagtagagcaggaacccaagcaaaagaaggagataagccagaagtgtaggtcagtgtcatttctcaggtgccaagagaagcccgtgtctcttgtcgtttcccacaactttatgaggtcagtgtgattttcacctccattgcacaggtttgaaaactgaggcgcatcgtcaatgataaatcccttacccagagtcaccttggctggaagtgacagggatgcagtttgaacctccatcactatcactttgaatccagcagctctatagtcttcaatacacatgatatatggtggtggttgttcatttgctaagtcttgtctgactctttgcaaccctgtggactgcagcacatcaggcttccctgtccttcactgtctcccagagtttgcacaaactcagggccattgagtcagtgacgccatccaaccatctcatcctctatcctgcctcccttctcctcctgccctcaatcttccccaggattagggccttttacaatgagttagctcttcacatcgggtggcccaagtattggaggttagaggtattgcatgttattgaagaaagacaccaaggacatagaaataccatacaagttttcaacttatttaaatgactagtgattttgaagaagcagaaatatctcaaaaatgtgtcaacatcctgttgactatgactacagtaccaatttttgttcaattctgtacagcagataacataatcctttcattttctggttgagagcaaaattaatcctgttaaaaatagaaatctgagttgtaaatacatattaaagttaagtcaaacatcagaaacttatttttaggtaaaaatgaaatggattaaatgaagattcttagccaatgattgtcatcaaaactgacctaatagggagaggaatttgtccacgcttgtccctcctgtacccccgccaaagagacatcaaactcactatttagaggggatcacacactgtaagcctcacattccacattcttggagatctgattcattccctgatttgttaatactttcaggtgcacctgttataagaaagaaaaaagtgcctaatcctatttaaaagctttgcagtctctgctgtcagttttctcagaggaaacctgaggtctcctcaggtaataagcaagtttgtttatcacatggtgcttggggacgtggtcagaatgcagtgtgatatctggctgcttctgcccttttaaattgcatttcctatacttg

SEQ ID NO: 24947 - DNA, 5245 bp, Bovine  19866880520923
atgttatcttgttaatatacatcttttgattgaaaaaaaacaaccaaactctataacttaaactatcaaaatatccaaaaacaacttgaggtttaagatttttgaaatattataagcaaaagaaactttgataattttgtgaagtattactgcaaaatgtaaatcttacggctttatttttcttaaaaaattagtgttgcttttgaatggataatagcaaagaataaaggagcaaaggaagttcaaaatggaaagaaacactgacatgaccaagggaaggtggaatcctttttagaaaaggaatatgacataaacgaaacctgcagagggaagataacaaacatctgctgatccatgaggaagccagcgaccgactcgcagggagctcttgacatggaaaataattacgaagctgcaagggtaaagtgtcgtcagtgcattgtctgcctcatgcctccaaccccacatttgccttgggccagagaattcaactggctctgttccatttgaccagcgacagatttgcaaatgaatttctatctgctagattttatatagagtgtgtacacgtgccagctaatccatgttgatggatatattcactgattcaacacctatttactgagtaagcgacttctagaagttttggacaccatcatgcttaagaggagaaagttccttgccttgaaaataagtcagtcatcacatttagagatgaaggtactgaaggaaaataaagtagggtgaggagagtggtcagtgtcagagggtatactgttttgataaggtagtcatgaaccttctttttgaaggtctcacatttcagcagaaaacttcataagagagccatgctggaggaagcatgtgtgtttctcacacagagggggccagcagggaaagcaaaggctctctgcaggagtcacttcagagtatttacagcagtgattttatcattcatttaatccacattgtctttaaaaagaaatgccagttagtatgtgaactctttacaagttcataccacaaatgatcataaaaactgaacagatattttttgactcaaaatttcacagtcacagtagccgtattttaagccaaagaatttgaaatattcaacaggagatcacacataagaagctcatgagaactgcacaacaaagattcagctcaaatacatacatatagatatgcatttgaattgtcattccttagaatatgattaattctcaaacctttatttattccttgcagatttatctgcaagactcttaaaagtgctgattcctgagcacaagatcctctgaagtctaactcggtccatctgagcagagagttggtgctgtttagttgctaagccgtgtccaattcttttgtgaccccatggactgtagcccaccatgttcctctgctcatgggatttcccgggcgagactactaggtggacgtttccttttctaggggatcttcccaattgaggaatcaattcgtgtctcccacactggcaggtagactctatacaactaagccatctggtaagtccaagcagggagtagcaatgtgtatttaatgggcaccaccatgcttctcggatggcttagctggtaaagaatccacccgcagtgcgggagacctgggttcgatccctgggttgggaagatcccctggagaagggaaagactacccactccagtattctggcctggagaattccatggactgtacaatccatgggattacaaagagttagatacgactgagtgactttcacttttcgcttttcaccatgcctcacctttctcctgcagaaatcaccctgacggcctccctgtcccagacaaagcggagagggaaggcataccccaaagacagaaatctgcatttaatatgttattaccctccatttacacttcttgctttcttcaaatagtatcattcactaccactaatgccaattactttattgactagaatgaaacagattcattctcttttcatgggggtccattcatattctcttaatttctagactatacaatttctggttctctaattcaacaagaattcacttgctttctcacagaaacaaatggttgcatgttttcatgtggaagtatcaatactaggttctgaaggacacactgccattgacttgtttccttcaaatttggaagccagtttcacatgctcatttgcaaagaaatggaaggagaaaaagaaggacctaaatgacatatcgatcagtacagcaagctgactcgaggagtatgtggccagacggcggagttgaacacttttcatttctgagagagaaaaagagttgtctgcagaagaagacagcttatcatgctacatagaagactcgaaagtaaaatctaagaattcagtttttttttttttgtaaaccatgcaatcagttcatacacgctatttatgagtaaaaccacatcttcaaagggcaaagtaggacttttatagagacatgtagagtccggaagaaaaggaggtttccattcacaaatccccactatacctctttccttgctgggggctctgacttccaggtatgttcctacagatacgccggcatcactaagcgacgtggccaagcagcacagcctgtgcgggcaggacgcattctctgcgagggtttctgactagttcaaagtggactagttctagtggactttgaatgtcttaaaaggtctggcttgttatttgttatcattaaactcccgggagaaaaaaatgccctcagcaaatgagcactatcagaaatacataaatttacataattttggtgaatgttatactttgggcacgtgatgagaagagccgactcatttttcaataaaagaccctaatgctgggaaagactgagggcaggtagagaacggggtgagacaggataagatggttgggtggcatcactgactcaatggacatgagtttgagcaaactctgggagttggtaaaggacagggaagcctggtgtgctgtagtccatgggatggaaaagagtcagatatcagtgtctgaccaacaataaagttgtaaattggcacaggagtaggaagtagagcttgaattttgatttgtgtcaaaagcaaaaatcaagaataaaacaagtattatatagaatatttctcacatttaaggtataatatttgcataatttgcaatttaattccagtatttaaaagatctccaaataatttctgtacaacctgagtcaagtccatatgctaaatttcatttgaaaatgaccatcatttattgaattagtttgataccttatattggtataaatgttaaaatacatggacatatttcctacatataggccatgaaccatatttattggaagggaaattattaattcatttgtattcaatgatgaaactgcattgaagattaataattttagtgtaatgggccacctgatgatataaaatgattctatgataagtctgttctggaaagcaaagaatgcccccccatttcatctctttcataaaaccctaaattttcctatattttgctgatataatacagccttgctgctatcgtgaagactgctcacacggtctctgaaaacaaatctaacatagaagcatttgctcctgtgattttcttgacaaagtttccaatacaacttattgtaattacaacacttcacctcaccttttactaaatggatagagtcatctactgggactcaaacactttccagtaagaataattaaggccaaaatccctggccagtgtatccctgtgattttgttcccttgtctttcctccctaaccataagcatttctttccaaagctgttaaaaaaacgggcttcttttgtgcaattccttttgcacaggcaggcaggtgcacagtcatgagacagtggtaatgaaatgtgagtagtgtggaatctgatatctctgcaccctgaggatggaccattgccatttttattttcagtccagggtcgtgtggctccacgtccacactgaaggatggtattctgtgtcacacacaactccaagtaaagagcccgaggaaacatacctaagatggcactgtggtactagtgaaacacacaagatacacagcgtcgatctggcatccatctcttcacttttttatctcagggaaggtaggcagtagctctgagtgcaccagcagtagtgtttcagtatttctcaaaaagtcccctgattaatatttaggttctgactcaacaggtttggggaagagcctgaggtccttcatttttaacaagttcttgggcaattttggtgttgctggtccacagacctccctgtgagaagccaggatgtactgatttagctatgattgtgtatctcggttgctagacgttttcaaccctggcatacttctagacccctggacacactttgatacccacacactcttctttatcaacgagatggataaaactcaatgagtgtcattttatttctctacagctacttctcaaaaccctaccagtgcagtatttccactgtatgtctggagtctggttcagacccagttgccagggataattatgaatctttccaagaaaaagaatccaggacaaggtgctcctgacccatcgtttttgttatatcaagatataaaaacagactctggctgcaagggaggggaagtcttcattctgctttacaaagactgactgttgtggggggaggaaaactcagttttcacttttgtgcatgtggtttttgcccaaagagcacagacgacattctcaatggatggacaaggagaagggttgcatcagtgaaagtaggtatgcaattttcttcataaatcgctttaaacattttgaaaaatatctgtactaagaggttttgcatctcagcatcttaaacagaagacccttcctcagattgtattaggtatatcatagacagaggcacaaattccttttcaaaattacaagtgtgcatgctcagtcatgcccggctctttgtgaccgcatggatcgcagtccaccaggatcctcagtccatggaatttttcaggcaagaatactggaccagtttgccatttcctaattcttttaaaaattagatatttgtgaaaacacaaacttcaaatattctcctgtatcatttttatactgctttccatgctcctcccaccaaatggccttaatggtaattccagaagaagtaggcaccgttgactctcaatataatttggggtggggggaacaggcaaataa

SEQ ID NO: 24948 - DNA, 1264 bp, Bovine  19866880521453
gtttccccgtggctagtagtaagaatctacctgccagtgcaggacacgtgggtttcatccctggtcaggaacatcttctggaggaggaaatggcaacccactccagtattcttgcctggagaattctatgaacagagaagcctggtgggctacagtccatggggtcgcaaagagttggacacaactgagtgactgagcacgagcataataatccaattctctgacattagaaggactggtgtatttattgtcttaaactcttgtttagacacaaacacactttatctaattacatcattttttaaagctttaatatgtctgtaaccacatggcatacctaattaatatgctatgaggtaattctgaatgctgtttccctcatttaggctagtatgctctgactaaattgacatgcttcatgggtcccacttaggcagaatagagttctgatttagtaactggggaactggaatcttgtgaattcaccagtactttctagcgggtagtatagctgttttcaccaagtagcagaaaggctattctaggaagagatatcactgcgtcttaccaaataaatgaaacgatgggtcaagagtctctcccacaaataatgaaagacaatgcaacctgattttcatccaagagaggttgtgtctgccttctcattcagggttccgatttatgtctgaccaattgcagaagtatattgcacatttcattgcttgaaaaagaaaatgatgactatcaagtcaagaatttgtgcctgtctacgggtagttataaacttggcagttgtacaatgagtctgtcccccaaaaccattcatcacctgtctcatcattaagatatcttagtttccataatcactaaattacataatcacttctcaaggcataattattaaatggagttaagcatgtcatagacaaaatggtgggatcagcagctccaagaatttcagtgccttcaaggtgaggctgatgtctaggtcacacaggcagcagcatgtttctataaagaatgagcaaattgagtggagagggtgatacctacatattatagattgcatgggtttttgtaactccaaatcgatatattttggttattttacacatcccttcctcctttcacaaggagttaaaagtcactaaactaagtcattctacaaagtccctggaaaagtccagtagctcttaccaggaggaaaatttagtgtaaactcatcttcagaagttaaaggtagtaataaaatataaaacctaca

SEQ ID NO: 24949 - DNA, 1020 bp, Bovine  19866880527050
caagtgaaatctaacaaggaatacatccgtatttgcatccagaaattcaaacaagaacttgcaggaatgctgagttgatgactgtaccacagttgagataatctgttatatgtcaaagcaagatgaaccatgaaccatcaatctcttccctagtcatcatccccccaatctccccccaacatggggcagtagcttaatggacgtgcattatcaatgcaggcttcttttccatcataaagaacagtgtaccaggagcatctggtacactgaatttgtcacactgcagacaagctaatctcattatgggagcccacaggggagaagagaaaagattcacatttagtccatatgaactaccaggagacccatcaaggcagttgggctagctcatgatacagcagcttctagcaaattaccagcccataacaacttagtcataatgagctgcaagaccctgcaccataagctccaagccattaaagggaattcaagtacatgaattcgtgtacacagtagaaccttaacatctgtctgtgctaagccaatattttgcttatatctttttaggaacagcaaaattacccttgtgtcccctgaaactagggactggaattttcatcaactgcagttttcacctgcgagacagggcagagccgatccacttcagcctcccccggccaccgagccgggcagcaagccgctcattctggcggctgttttgtacatattaggctgattttctcccaaaccatttcctcttgctgttcaagtgggaaaaacaatagtctagtcataaattaaacaggcaacaagacatgcggatccacgaagagcctaaacatgataattaagcaaaataacttaaatcatatcctactaaactcagcatggagaacccctccccctgcattttaattaatttaggccattgtgtctgtttttcctgttaaagcaatgtactcctcttcttcccacggtggggtcaatatttagggattcaggaaataaaacagcagtaat

SEQ ID NO: 24950 - DNA, 1473 bp, Bovine  19866880634993
acctcattccagtccaccctgaactcctttcaggggtgttgaaggtcagcagtcacagcatcttgtgatttaatccttgtagaggcagatggcaagtgccagtttttagttggcaacaagacctgcagacctttccacactacccagtcccagcagaagggagcaggctctgcgatgacctgccagcctccctgggcttggatgtggtctttgtagtgaggcagagatagtagagcagtggcccacatgcatcaggatgggattgggacaggaagcagcatggtggccccaaagcagcaaagtgacccaaaaaagggtcagttcctgaatcagcagtggtccccactcatcagggtccccagaggggaccctctccccagatgcatccctcctctctccctgcacggggaggccagatcctgtgcctgtagcagagaccaggccagtgagtgaagagtgggatggtggagcaaataccctctgggaccatccacccagtgtctgaggccttctttcgcacagtgaaaatttgaagaggcactcttttaactagggtgtctgtttaaataaaacataccttttgtctgggataaggacttgtccaaatcagagcttatataataaggagagcagccagacaaagactgtgtgatactcaaggatttgtgtgtggtgaagtctattaaactgaaactaaataacacagatttttatttcaaactcaagcattcagtgactgtcaacttaggagtcgtttgattaacacatacttgactctgacaaccccccataacatctttctaaactagcaaaaatggccaacatctgctgagatgatagtcttgtgaatttcttttcagataaatgtgatcctgagtggagaaaacaagctttctatggtgaatgtgtcagcttgtaataaagaatgaattatcataggtacatagcaaagggaaaatctgctaaatgtcctgataagattgacaaatattgcaatgtaaaaaggaagaagaatgtgatgaaaatatttgtctggatggcaaaagcattattttaaaattttaattttctgcagtaatagctattacttcgtaaagttatagagggattacatatctccttactttcataaaattttactactattcttcaataaaatataaataacattttcaattaaaatcatcatttgagtccacgaaaggtggaatattaacagtttattacttattaaatgctgttacttcaaatgataaaaatgactacttctcattagaacaagtcagatgtgatcctctataacctcttagtttaaaattttacctcttttaagtctaaaaagtcaggggtacattattacccagttggagatttttaataagtctaatgataaatattatcttaaaatcaatgaaagcttccagattcttagctatatctgttcaccaaaatggtagaaatacaaattctaat

SEQ ID NO: 24951 - DNA, 1230 bp, Bovine  19866880644099
tgacactgtgtaaagtaagtgtagaaattcagtatattggacagctaaacttgttgcattgcatagccttttttcagagataatttggtctcttgtagagataatgtagtcctcactgatgagcgtatattgagactagaatataataattacatgttttgatcattctaaatgctgcaggcgtaaatggggtgcaggcatcccatcattatagaacaccttttaccatacaagtgtttccagattgcttttattcagataaacttgttgaaagaatcatcgaccaaatttacaatgacttcatagattttacctgtgtcgctgctcgagttaaaatatttgtgctactcaagagtttaaagaaacaaattgatttcagaatgctggcaatttaacagatgacaattgatgattgctgtacattgctgtgtatttgtaagagacatgtgcattgtagaattgtgagtacaggaaaatggaatgccttgtaaagtctttattttctttttctttaaattattttcaaatggagacgacaaacagagattgactttcaacttatgttaatcagaaattagcacttctacatgcttaataatatttgaaatttgaatgactttgtaccccaagtactaagtataaataatgaccatgttgacataaagaaatgatttatttttatcagaaatatattgtcacatgttttattattttaattgcctagcatgaataaatttaaaagatgctaacaaagacccccatatactctgggggtacctcttaataaatatttcatttcagttaaagttaaaaatgtatattatcatattaaaggtaagaaatctgtgtatttttaaggaatggaagtaaaccttagtggtatagattgaggataatgttttgagaaaactttgacctttgaaagtgttttctatatatattggctgttattaataatactgtctaaatataaaggtaaatggcgattaagcttcactttaggaatatagttctaggcattcactttgggtaacaccaatgtgatgacgatccaagcaacattaaactataaagcatagtatgtgcattttatccaatagtttttttaaaaataaaaagttaactgacatgcagagattctattaccctagattgccaagtataaatattttttgtgggggaggacatttaaactatttttaagtaacttctttttaaaatccaggtatt

SEQ ID NO: 24952 - DNA, 843 bp, Bovine  19866880841389
ttatggcattaagcttccatatcttgatcctagaccataaaaaattttaacttgaggcttaggatatttatcctgattaaaattctgtctttcaagctttaacccatgattccagtgtcttgaaaattcactgaattctttttttccaagtaataactcttcctagtcaaatcacaaagcaaagtcagctgcatactgtaagataactccttgtctttgaaatagtagatacttttccatgttgtcattaagtatcaacctctatctactgttacctcagtaaatttttaaaatgttttctgaaagattttagctacgggttctctacaaatatttttgataccttgatacagaccaaacattatattatgagtcgagttctagtagaggaggctggtattaaagcaaattattaaaagcactgtaatgcacacctaatgtaatggcataatagagaacatctgttctagggaactactgaacagctgctggtgactctacctggatgaactagggtctgccttgcagagctggcagcatgtgggtaggtcttgaagaatgatcagaaataataggagttaaaggacattccaggatgctatgaacagacttttaagatgcttgactacagtccacaaacattgtctttgcagaattccctagttcttccaggactgatgcatctatcaaaaagacaaaagatctgtattataagactcgcttttcatgatccaattttggagcctcgtgatgaccagtaatttttcaaatgctttctgaacacctctgcaaattaactcaaattgtattcaccatctctaccggcaactaaatatagataag

SEQ ID NO: 24953 - DNA, 812 bp, Bovine  19866880914397
tgttgaatgtatccagaaaaaaagagcacagagaataaaaacgacagtgtttctacgatcacctgtagttctctgcattgagctgcaggaaaaaagtaaggagttttcctacctagagagcagacattcaacttccaaagatttcaatagtcatgaaaaagttacctgtgatgaattgccctggaatttttactactttgtagtggcttgaaatgattatgttttgtctaagtgtagttactgagaaaatgaaagaacttccagacctgccattgagattgcgtagatcccaacaatggggaaaaagtaaccagtgatgaaagtctcttgagtgtgttgcctgtttattaggagggatggagtggggagattgggctcaacgggttttggggatgaaacctgcttttccttgccagtttggaggaggtgacatttctgtggtccttacgcccatcaaagaccaggctgaactggggattcgctgctggttaacaccatatgttcagcttaaacaagacactgtgattgaaagactaatattttgtctcctaaaacacctgacaacaaccccagatttattgttgattttttttaacctcatatgaaagtatttggtaattgtgtcactctagtaacagatgctgctctcatatgttccccttcttgacataaatggatgcctgtgaagataaataggataaagaaaaggaacttgttgcatacaggaggcaggtgtccaagggctttttaaattcacacagtaatccccggtgtggaccggtcggcataacaggacgcaggcaggaattctg

SEQ ID NO: 24954 - DNA, 1874 bp, Bovine  19866880947699
cttcccaggtgatgctaatggtaaagaatcggactgccaatgtagaagatgcaagagacccaggatcgatccctgggtcgggaagatccccaggaggagggcttggcaactcactccagtgttctggcctggagaatcccatggacagaggagccggggcaaggtacaggctacacagggtcacaaaaagtggcaagaagtaactgagcacacgtgcatacatatatagctctatagatatataaaatgcataactaaatcactttgctgtacacataaagcattataaatcaactacgcttcaataaaaaaaattacagttaaaaacaaaaataaaccagtgtttgtgcttagtcactcagtcatatccgactctttgcaaccccacggactgtagcccaccaggctcctctgtccatggggattctcccaggcaagaatgctgaagtgggttgcacagtcaaagaaaataaggtaaaagtccagggtttctttttcacattcattaggatattacggagggtcttaggttaattttacattcagaggaattatttctgctacattgtgacttttaagacagtggtttccaaacatttgtctgaaaccaattttgattttttttgtaaaggtacctttatgcaactgaaaagactgtccaatattccaaggttatttcctatctacctttcctgtgtgttaagaagtggctagaggagactatttgcaaaggaaagccccaccaccctgggctggcacccacctgcttttggaatgcaattagtgtttgcattccaaaaacactggaacctctgtgctgtgtttcacagtcttccggtccccgaccccctactcccgccctgcagggctgtgttcactatagcatctgtcagtatagagcacctgagggcggagagaagtcctcacttcaggggtctctatgcaaacataatgtagatttttgcccagttagcagtgttcttgcctggagaatcccagggacagaggagcctggtaggaggccgtctatggggtcgcacagagtcggacacgactgaagcgacttagcagcagcagcagcaaaacacaaccagagttttcttggtgtgttggcttcagttttaaagagccttctaaaactggtggcccatggtacaaatttttttaaaaattcaaaaaatttaaaaaaaacaggcattaaaaaagcaaagcacataatgaaatgcccctagaaaaccaaaaaggtaaaacaacataaaaagtgaggatactgtctcatctcagtctaagagatccttccagtatataaaacattctgtgttgctagaatgctgcacactggatttgccaacaaatgtcttctttttctatcttccttctactcgtctttctactcttaacagaattaagtggatgctagaacacactgggttcgggaaaccagttaaggtagccgaacatgattcttcagtagatgaaaaatgttatgctaccagatttgtaatgtatcatgaacaatgaaaatatcacttcaaagtacacttttcttactataaaatgctaattttccctctatagatgtcagtgcctccaaattaatgagcaccattagctgcaaaacatctcaagaagcaacggaaattaatttccattagtcacaaacggacagccaactaccacccgccttagaagacaatgagttttgaatgctccatttttgtcctcaattgcatgttcaaagtcagatggcgaaaacaagtgacttaagatatccagaaaaatattaacactggtttgcatgtgaaatgaccaaaggggatttcagattttctgttgcaatgggataaacaggggaggttatgaggatggtgtga

SEQ ID NO: 24955 - DNA, 737 bp, Bovine  19866880986176
ggatatcttttctgaacagcatttctgcccatcatgatttatgaggatcgcttctgaaacatggctggacttgtataaccaggggattaattagctgaagaatcgcagtgacaataacacagataaaggacctggggctctgggtggaagcctggagagcagacagaatggggtggaaaggaaaatgggaggaacaggcgatctgtgcctcacccccaaccccagcaaggagaggtcagcatgtactgaccaggttgaagcaggccggagcaggagcggggtgagtgaacctgaatgagaagggtggtctggctgtggatatgtgaagaggagacattccagccagcggcaggggaggaagagaggggaggagagagacaggagattccggatccttccatacattggacctttcgtactgcggtgtgcagactgatccatagtcctcgggatatttcacttggtgatgccatggcgttgtccctgttctgtattctatactgtgggttcagttgctcagtcgctaagtctgactctcgtgcaaccccatagactgcagcccgccaggctttctctgttcgtgggattctccaggtgagaatatggagtgggttgccatttcctcctgcagggcatcttcccaacccagggactgaactcatgtctcctgcattgcaggcagattctttcccactgagcccaagggaatccctctgcattctgtattcccccaaatt

SEQ ID NO: 24956 - DNA, 874 bp, Bovine  19866880999566
tatcaggtataaagacccccacacaaatgtctttctaactcttagactgagaaagctggcaccagagaaatgaagcgtgatggactgattaaccctgaaccctctatcctatgttggaggcaaaaataaagttaaaacctttaaatacctgtctaacatgctcaacctattctacaaggaggtcttgataattcagcctttttggcgcctgtggatgacagtctgaacacccacaggcgctgtttgcttggagggtttctgcccaccccagctcctaacgccttggcctcccctcatttgcagtggtctgtatatatccgagctgctgtccggaaagagaaaggcctgcccatcctcgtggagctgctgcggatcgacaatgaccgtgtggtgtgcgcagtggccaccgcgctccggaacatggccttggacgtcaggaataaggagctcattggtaggtcccctccgattcaccgcgtctccactttttttcttttaaatcgaagtataatgcatttcctgtgtttgaacccacatgcagaacatatatgcgcatgcagaaacagagcatgtgtcagagaccttgtttttccagctctccttctagcggaaatcaatgcgctaatttatcttttagaatttagaggaaaacgcgaagcttgttgacattcctaatccttgcaaattaaaaactaccgcagtgctgagcactggataccgttgtcctgatcctctaaatccttgccaggctgtttgtatgctttccatgttgtgaactggaattctaatggggtgcagggctcttctcctctctgtgttaaaatttatttttacattagaccagatggctctccagtgcatttttcaagaatca

SEQ ID NO: 24957 - DNA, 1780 bp, Bovine  19866881074293
aagagtatttgagaccctgcgaactggatgtgcaagcgccctaaggcacagaccaggtggtgcatgtgaattagagtatattgaaggcagagcccataggaggtcctggggaattgactttagggttttcaaaacagggaagagataaaagacgattgccgtggttttgtccctggttttgtcccgagtgaccagaagaacagggttttcgtttcctaaggtgggggattccaggagatagataggttgggaggcagcaggaaggggtaagtggaaacagtttggggcctatctattttgagtactatggggttggccaaaacgttcatttgatggtaccaaaaaacccaaacgagccttttggccaacctaatattttctattgaagtggagactggaagctgtcactcagtgcataggtgggagaaaactgtgagagtcatcggcatgtgaatcccatgcgattagaatctccagagaccagaggagatgagcaggatcccccaaagcttgtaaagcctttgcagaaaacagggtctagcagagaaaatcaagcaaaccagtagacccaggacaatgctgtgttttgacatcgagaataaaatagccaaagaaagaggaagtaatcccaattgtcccaagcggctggcaggactagtataaggaaagctgagaattaaccattggatttcacagcatgagctttcggggctggggtgctaaatcctgatttatcagattctccagaatatgggtgaagaaatgcaggaatgaaatgtagataaaattcagagagaaggttgagagtatgagctaccttggtttgaaccttagctcatctgggtcctggctgatgtgaccttggagtagtcagtaaacctctttgtgacttggtttggtcacatgttaaatgaagatgttaaatgttaatatcatgttaaatgactttatagttaataattacaggattcttatgtggagtcattagggtaatatgtgcaaactactgaaaacagtgttttcatgacataggtgtttgctatcattattaatatacttttggtattgttttcgttttaagcatttcttggaatttctttttctaagaagatcagggaaaggaaaatagcagtgtttagatgcccgtgtggggtcaagtggggcttccctggcggcttagactgtaaagaatccgcctgcaatgcaggagacctgggttccatccctgggtcgggaagagcccctggagaagggaatggcagcccacaccagtattcttgcctggaaaatcccatggacagagaagcctggcaggctacagtccatggagtcgcaaagagtcagaaatgactgaagcaacttggcatgcacgtggggtccagtgcgtatgtatcgttgcttgctttgttttatttcagataagagattgtatagcatgttttaatgctggtgggaatgccagagaagaaggatgaaaccttagtggtgcaggagaaagagggagaattttaggtaaggatcttacatatggaagaaggggtggattgagtggtaccaaagcgaacagggactcctcattaatttgaagaaaaggatcagcggagggtggggggggcggggcacagacacagctgtcttggaagatctggtggagatctgcgactccttttgcttttagctgagataaacgccagctcctcagttgagtttgaggggagggggcaagagcctcaggagctgggagcttgaggggcaggtgtgcgcttacccatcctgtggt

SEQ ID NO: 24958 - DNA, 1840 bp, Bovine  19866881099380
aaatattatattcagcaggtcattttgaaaaatgttcccaaccagaggtagggccttaaataaagactactggggttgtggaacagttagaagaaactgaccaagtgttagatgaggctgagtaaagaggaagttcccagagaaaatcactagcttcaatcagagactatagaaaattacaatcataaaaggtcagatgtggaagaggcagcccggaagaagagatcacacagaagaggaagtgggtctaaatgccatgttattaaaaatgttgattctgtcacatcttgtcatatcccttattgttcaggacaaagtctagtggctggctttagaggaaattaataccctatcataatctattcaagctattgttcttgacaagcaatgaggggaaaagatgttttgtcttgacagctctgtgacttatgtgtgtgttggtttaggacttctgactccactgaagctccagagtcaaattattctctagagaatcattaagaattacagaaagcatccgccatctctccttcctcttttataatgggatggacaaataacaagcaattcagagatgtttcctgtttataacaatgctttcctatatcttgagaacacatgaaatattttaattttgctacattcacatttacttcattcataaaaaagacaatacaaagttccattttctttacttggcatgagtttgatgttttatattattatgcaggcattattttaaagctgatgcaggcttatttacaataaatatgggtttatttaggcaataaatacagaagagtaaaatccacattcctttaatctgttcccattctttttcattaagtaagtaacattacatatttaatacatgttattattaacattatgataaaaaatatatatgtagttttgcattattttaaactcttttgtgatgccatgaactgtagcctgccaggctcatctgtccattgatttttcccaggcaagaatcctggagtggggttgctgaactttcctccaaggaattttctggatccagggaatcttatggactcaggtatcaaacccacatatcctgcattggcaggcagattctttactactgtgccacctgagaagccccaaggatatatgggagtttttgcaacaaagaccaggcgatcagactgtcaggaccaggtagttggaacatcaaaagattactgttaattaaagaaaaccagatatcttaagttaaggtagttagcacttctctgtattcattccttttgacaggcacctcagctacccgggcccagcagcctgtgttttctcatcctgagtttcctcagggtgtactggggaggctccagtggctggtatctgcaacatcctttgtttcctgatatggcaggcaacattcttaggtcacacctgtattgcctgagatatttaaacacaggccacatttatcataagctataaagggcttccctggtggctcagtggtagagtccacctggcaatgcaggagaggcaagttcagtcctttggttgggaagatcccctggagaaggaaatggctagccactccagtattcttgcctggagaatcccatggacagaggagcctggagtgttacagttggcccatgggatcacaagagtcagacccaacttagagactaaacaaccacaacataaatcttggtatgctttttatggatatctataatttgctttaaaacattgagaatggatacctgtgttagtttaagccatagtcaacaagctttttctgtaaaggtgaaccaagcaggaccctatgggcccttcccggccagatccctgcccc

SEQ ID NO: 24959 - DNA, 3276 bp, Bovine  19866881152222
gggatgggggcggcagggacaactctcgaagccttgctgatgccaaatgcaaagatgctactgtgacaagtctgattgccaagcagatatccagtcagtgctttaagtaacatatttaggaaagaagctagcaactcagcaactacttgtgacgcattctttctaattaccatcgaacatttggctctctgtagacactttgctgccaccaaaatactgctatttcatgcatgagagcttgcttagcaaaaatattttcaaaaagaacaaggacagctgtcaaaaatgatcacaacctttgcaatgtgaggaatcctgaaataagctgttggggatcttcgtgtgtgaaatggaagctgggtatagcacttggatagctacctcaagtctcgcaacacatctctcttgcacacatccataacattttacaacattagcaagacacacttgcgatctctacaatcagggcagttgagtaggtatttttactttcctttttaaaagagaaaagttcttcaaggcttgaacaggtttaaagatgaatctggtatgaccccatgtggcaaactagattctagactagtgttctttccactacagaatgctgtccattcttcatttcttgatgtttcagtgctaggcaagttttattcacacatttatagggtatgtgtaatatcagaaaatgtatatacatatatgagtgagtctgtccctgcaattctctaggcaagaatactggagtgggttgccattcccttctccaggggatcttcctaacccagggattaaactggggtctcctgaattggcaggcagattctttactgtctgagctaccagggaagcccatatatatatatatattatatagtatgcctatatgtgtgctttctgtgaattgacttttctgatacctgtatctacatctatatagctatgcatgcatgcatgctaagtcacttcagtcgtgtccaagtctttgtgatcctacggactgtagcccatcaggctcttctatccagaggattctccaggcaagaatactggagtgggttgccatgccctcctccaagggatcttcctgagccagggatctaaccagcatctcttatgtttcctgcattggcaggagggttctttaccaccctggagccacctgggaagccctatatagctacatctatatttatatctagagtttgtctgttttctgctggctttttttaatgaaagaaaaaaggccaatataaactacagtaatataaaaagaaatataggttttgatttatacagttattcttacaatgattgggtttgagttacagacctcaatagttttgaaccacttgcttgttaggtgattaaatcctggcttgccatttggaagacaaagggatttggttaaggtattggacaacatcagtcattcaatccaaggtctgcagagtctggaggctcaagtcttggggtgtctggggtacagagggaggatgtgagatccttgggttcacagccatcaagcaacttgaaagtccatctctctgggctgagttacagactgggcttctgagggaagatttcactagaaactcaagattaaaacatatcagaaaatctctgatctttaaggtcactttcttatcatttaactccttaaaaagatacattgattttaatgtttactgtgatcttatataatatggcatttccatgctctacacatctgtgcaaaatacagaaaagtacaatatcaccgctttaatggagctgacaatctaatggtctagaaatcattgttatctatctaaaatgtgtgtgcatatcatatatatatatatacacacacacacatatatgtatatatatttaagaccctgacatgagcagttgccttacttagcttactttagtttaactacaagtactcaacagtaatgaaatttcatttaacacaatactaatcttcagactttatctgaatcaatgaggttttccatattgccttacttcagaagagcaactactatcttaagaaaaaattctgaatttggctttgctaatatcctctataagtcttcattataaaaaaagtgttaacaatctgataagtattaacctaggatttatctttagataaatttgtggttgagaatttagatttacagatggatgaattctttcttaaaatcaattttaaaatacatagcattaaacaagtgccaaatatcacagtggtttaaaactttttataaaaaatactgataggatttgtgcttaaagaaaaatatttaaagaattgtttattcaatggccacccttcaggaatcaatgatcaatttgtggtttttaggaatatattagttttcataatatcctgacaagattctcaatcttccagttgataactaatagtcattgttaatgttaggtaactccacgaatattttctgatcttcaagaagatgtgggtttgttgctatgtcatcagacatgatggatcagttggctaaaaagaaggataagtctttatttgaagtaaacattttttgaagctccattgtatcaacagctgtcacttattcatttcatttgcaaaggaagggagctttctgctctataatgcatattacaacatggctcaactctgtgggagtagccttttgaaaagaaatatggctgtgaaataaatggaaataattttcaaagagatgctgccaccttttggttgctctcccacgaagcatatactgtctcctgaaagcctgcaaaggtaggagaagcagggaatgaaatgccggaatatttcagcatcataagcaattttgttatgttgggatttcttacttagatggctcccactcttgttgataggtttcagaaagactcattgatacgaagtaatttttccaaatgttaatacagcagtagaaaagatccgttcaagaaatggagaaatgttctgagttttattgaggtcagatatattagtactatgcttatcataccaattggggcaataaaaagtaatttttttctactgaacaaaagactaggaaagatcacatacattttctgtactcagcattccatttagacttcaagtctcatttcatcattgattatttctcatatttgtgaatatccttttactaatcccactgtctaagtagagtaggggccacatttcttttttcctctgagttctttacaatttcttttgttcctaagaagttaatttgctttaaacgtgaagcaactaatacttctaaagaa

SEQ ID NO: 24960 - DNA, 862 bp, Bovine  19866881369682
tagagagctgtcagtgcatgcatgagagggaagtacccaaggctgaagaaaaaaattcctgaaattattagacaaaaatgaaacttggcacttacacaggaatggatatagtgtgcgttcccaagagccatacaggaaaaccctgtgattcgtggatccttgagcatagcactctcagagtcttgcctcggtaattaggtataattagccctggactaaatatgctctagtcttccctatcagatcttaaaagtgagatgcagaggatcaatagtttgcaagtaaattaactgcatcctagactaaagtttaaaaatacctatagaaatacaaaaatacccagcatccaatgcattaaaattgagaatgtctgacatccagttgaaaataaacaagaaaaagtgattcatgatgaggagaaaaatcaatcattcaaaagcagttcaaaaccaaccaagatgttaaaaatatcagacaagcagttattataattctactccatgtgttcaaaaaaaaggcagtgtatacccgtggaaattttaaaataatttttaaaaaaagagcaggttagacattgctgaagaaaagattaatgaatttaaatatagctctggaaactatacaaaatgaaatggtgagagaaaaaaacaaagctaccgatcatccatgagcctcaagtggtctactgtacatgcagttaaagttcccctaggagaggtgagagaaaggagaaagaaaacaggaaaaaaaattgaagaaatgatggttgaaaaatcttccaaatggttccatatttttcaagtttaatgaaaaccacaaactcaccgatccaagcctaagaaacataagaaactataccaag

SEQ ID NO: 24961 - DNA, 1960 bp, Bovine  19866881418652
ttaatttcaagaaattgagagtcagtaaaacatggcaggggcatcacagaatttatttcagttcagtcacttagtcatgtctgattgtttctgactccatgggaatgcagcatgccaggcctccctgtccagcaccaactcccagagttcactcaaactcaagtccatggagtcagtgatgccatccaattatctcatcctctgttgtccccttctcctcctgccttcaatcttccccagcatctgggtcttttccaatgagtcaggttttcttatggtggccaaagtattggagtttcagcttcagcatcattctttccaatgaatattcaggactgatttccttcaggatggactggttggatctccttgctgtccaagggacgctcaagagtcttcaacaccacagttcaaaagcatcaattctttggtgctcacctttctttatagtccaactctcacacccatacatgactattggaaaacccataccttcgactatatggacctttgtcggcaaagtaatggtctctgttttttaatatgttctagattgatcataacttttcttccaagaagcaagcgttttttaatttcatagctgtagtcaccatctgcagtgattttggggtcccccaaaataaaatctcttgctgtttccattgtttccccatctatttgccatggagtgatgggactgaatgccatgatcttagttttctgaatattgagttttaagccaactttttcactctcttctttcactttcatcctgaggctctttatttaaatgcacaaattaaacaactatgaaaataatatcttcagaagagaatttaaatgtagtaaatcttgacagtgatttcattgcatacaacagtgtatcccatgatttttacataatgcactcatgtctgaaccagcccagtcattccaaagacaagtctaatgtatttaaccctttattcatttagtttcagcaataattcaaacctgggtaggattttgtttacaatttaaaaggacaaagtagaaatctattttaaaccactattttatggaagctaaaataataggcaatgggcaaatattcttgggaaaacattcaaacaattgaaagcgaacaggatctgcccaaaataaaaaacaaaactaggcatttacgtgattataaacgatgtttggtttaaaatgggttagcattttgtaattaccatataggatcttctcctttctccttctgttgaaaggtatactgttagtacttttcattgatttgttaggtctatcaacaatatgaatgtaaaataacatgagaggaaaacgaaatgatatttctttaaaatgagttataggatcattttataatttaaagtttggacatcatttaaaagttctaaattctttcccttgactttagttcattcatctgcaaaaatagacaatttatctcagttcaatgaatgctaattctaaaatggacaatttaataaatgaaaagataaggaagcctcactctgggtctaaaaattcatcagtgataacatactttttattctagtttctaagaaattggtgtatcttcaaattgcccttgagaaatttatgcagcttttttatttattcctaaaaagattttgagttgaaagtaacaatgatgtcacacataggctgctattttttaaaactgttagctctattggcatatactacatataagttcagtcttttaaacctacaatttggtgtttttttggtaccttcacataccagtataatgatcaaaattctttgattttacaacattctcaacacccaaaaaggaaatattcattaatagccactctccattttccactctcctgtccttcagaaccactcatctatattctttgagaagatttgtctttactgggcatttctagaaaaggaagcatacatgtcatctttttgtgactgg

SEQ ID NO: 24962 - DNA, 701 bp, Bovine  19866881453892
tggtggtttattgaataggtctcacaggctgattacattcttttacaagtagctcttttgaatttcataatttctcccagatttctaccagaatatagtcctaaaaatatacagaaacttattaaacctggaattagactgccaacacattttctaatcgaatgtttaatttcataattggaaaatgatacatctgcttggagaaaatcagtggggttggaaaacaaattatgtgtcgacagtgttggtacagaaaaattatacatatttatgaatggccaaatcatcttattactggaatttgaaaatataattaccaatcatttataaggtaatgattccaagtgaatgccttatctcggggcaagtgttttatgtgtgtgtgtgtgaatttacacatatatgctgtataatatgcagtatctctaggcaccatctcatttgatttttttcagctagaattcagattttagggaattcattgctgcagcaaatatatactatgtgaaatgattaataaaatagattgccacttttaagctctggaagaatgttgtactttaatcaaaaattttgtgtattttaatcataatgtataatattttattatacattttaatcataatgtgtaagtattttaataataatgtataatgtacactttaagtacattgtgtgaattgttcaaacagaggctgtat

SEQ ID NO: 24963 - DNA, 1298 bp, Bovine  19866881559049
cagggtgatttataaatggcaagtataattgtctaattttatgcgctaagaaccaatacaatgctagaccatcatgactgatgtcctctgttgttatctacttataaacccagaagaatttaagaaactacgttgctggatatcattcacatgatttaattgttgctgtggctagaagtaacaattacagttgtttacctaaaacatgttctggatatttagagccagaaaaataagttgatgtgttgccgtacatattacacaaagtgacactttgttatctgtgtcctctgtctggcatgacgtgtccctgtcagatgcctttcagatcctattatctaggttgttttcactttttcctattgatccatttattgattccactattaatgaacctttcccactgtggagaagatggccaaaagtaacaaaatctgtctctagactaagtgattgtcttgtattctgtgcactaaatgcttaagaaatagaattgaggatctgcctccatcattggcctgtcttgagtatgtgacaactggagtgagtcattttttaacctgccctcctctagacaaaaagttattttccatgatgattatgaaatcagatgaataataaagatgaccacagaaaagacaaaattgaaaatttctttgcttgtatttagtatatatattcaggctgataaaaaacaagcaagtgtaacagtaaagggaaataagtcatcttttcatatttcttagttagattagtgcattttgaggaaaaaattataaaggaaacactgctttgtggtgtcccacagtaatatatcatattaaagtttaatcacctatattccaaaaacatttaaaaatagtactacttcttattaaaatagtttaataagttatgatataagaggaataacaattttaacataatttgctaaagttgccattgaaacaagtaaaatattacatatatgaactaaaatttgcacgtgcacacacacacacaaaactataccttacagtttgcagtctattttgtcattttcaatttgaaacacaagtaaaaagccaagggcttacatatactgtaactcaagatcagtttctttgcaattatagttcagttcagttcggtcactccgtcatgtccaactctttgcgacccatggactgcagcatgccaggcttccctgtccttcaccatctcccaaatcttgctcaaactcatggccactgaatcagtgatgccatccaaccatctcatcctctgtcatctccttcacctcccaccttcagtccttc

SEQ ID NO: 24964 - DNA, 1822 bp, Bovine  19866881675838
attcctgaagcatattttgcttcattgttttttcaaccagtaatgacattgtgaaagagagaagtcgaaaaatatatgaggaaatatgaagctggtaaaaagaaatgtagtagtatttggaaaatgaataataataaatatgctttctataggacttccagcatgaattttcctgtgttgagcctactaataaggaatacaaaagttaaaaccattacagatgcaaaggggcaggcaggtaaatattcctcatccgggaagataaggagccacgcaagtggggaaaacccatctgcttgggtcctaagcatttaccttgtttcctgtcaatcactcatacactggagaaaagatggtacaaaatctaattttgtaactgactggtgtctataattcttactctccttactgctttacaagttaccttctttcagttctgttgaaaaatcagcattccttgaggacaaagatgtttaagcacaatatgtgctttcatattgtaaattaattctacatacttaaaatagagcccaaatggacatgactgtacagatgagagagcaaaccaaagagagaaacacacttgcacagcaggaatccagtcccctcattgatcttaggctcttctcatcttgtccagcctggaacacctgtgtgcccaatttagcacctaatcacacagcaccttgtgtcagtagctgtcacatttcaggttgccaaactattttttctgagctcagttactacatttccagcaaactgattgaaatactgtaaactcagtggaggtattgaaatacagtgagaaatgatagtgcttggtcattttgaggacttcatttggctttcttgttcatcatttttccagaataaaaatgctttggacaagagaattaatatccaaacttgattgtaaagtttgaatattagaagataagaaaaatctcgagttggacccccggtgggatggcctggtgtgtaaacctgtagcagggggacaggcttccccatggtcagccagagaggtagagaaaaccacaaaccaatgagcctcacaccttttaccatatttcttagcagttgaatttaaaataatttataccatgagtattggagtcatgtacagatatgagacttggaccgtaaagaagaggaggcactgaataattaatgatttcaaattgtggatgctggagaagactcttgagaatccctttgactgcaaggagatcaaaccagtcaatcctaaaggaaatctaccctgaatattcattgaaaacactgttgctgaaactgtagtggttaggactttgctgtccactgcaggggatgcagtttctcacccttgtcagggacctaagatcccaagatgccctgtggccaaaaaaacaaaacccataaaacagaaacaatattacaaaaaattcaaaaaagactttaaaaatgatccacattagtaaaaaagagtgtatgtttagagtgagaattgggggttccatactccagtaaaacaataaatgacaaaagattccattctctatctctggaaatttatattaataatgtttctgtggaaaaattacattcaatgcatacgataatttctaactatccaaaacatttataatttttctcaatgtgcatcaagagttaatcatgacatgtattaaggagtttttccaaatgtgaaactgctttttttttttccctaaataaatgtagcttatgtgttttgtccctgagttagtttatcatttcaagtctttgttggcaagagtttgtgggctgtaaatgggatctggcaaggaagctttccttaggg

SEQ ID NO: 24965 - DNA, 1225 bp, Bovine  19866881891002
acaaaataatgccattcgcagccatatggatgcaactagagactattgtactaagtaaggtaagtcagaaacagaaaggataaatgccatatgatataacttacatgtggaatctaaaatacaacacagatgaacttatccacaaaacagaagcagacagagaacagatttctggttgccaaggggcaggagttgtaggggaggagtggattgagagtttgagattagcagatgcaaactgatatacaagatggataaacaacgatgtccttctgtatagcacaaggaactactagcaatacttatgtgataaaccagaatgttaaaaatttttctatataaatgtgtatacatgcacataaaatactatcttaatctcaagaaaagtacattctaatgaaggagacagcaggtgacagggcaataaataatgtaacttcatattgcactaagggacatctaaaaaataacagtatatcagttagggtgtgtttagctgcaagtaagagaactaaccaacacaacaaattaattcagtatcttacttctcttgaagtgacagtcagggttggttgtgactccatgtatcattagggaccagagatttcagagtctgcttttttgtgctccttgtggtctccatcctgtgaacgcaggacctctgcccccacttcatagttctctgttggctgccagcctctataaggccacttgggtttgtccacttctagatgggagagatcagttacttgatgagtagctgatcctaatctcatgggtgccacagtggccaagaacaaagggagttttggctgggatagtgtagcttcatgtgctcactgacaaagtctaaggatgctgagtttcccattgataccgtatgcatttgaaacagttgatcaattaatttgccttcaaatacagggacaatgaaatgctcgtgagacgaaagcttagctctctcttatgaagaatatgatatgtcattaaccttaacaaaaacaaatagtatttttataaagcattgaaaatattcatttgacctcctagtaagcaagaaaaatgaattgtgatttttaaaaatttggttttttgatgtatagtttatttacagtgttagtttctggtgtacagcaaaatgattcagctttatatatatagatagatagatagatatagatatagtttttcatattcttttttactatgcttattataggatatg

SEQ ID NO: 24966 - DNA, 944 bp, Bovine  19866881932123
cctaaagactgcagacatggccaggacttcgtgataatggtgcctggggtacctgggagactgtgatgacaaggaaggcgagggtgaggtagcatacagcctgataaaatgagatcagagtcagtaaaaatgagctagaggagctgggcagatgcaggaggcctaagtgaaatgcagagtgagccacatggagtttcccttcatctctccttcagtcacccagggagtgcaagggcgtgctcatgtgcacacacacacacacacacacacactcaggtgtgtacacatctcagtgtgtacacactcaggactttgcacacatctattttgttgtctcgtcctaattcaagcctaaaccattagtagtggttgtcccttcatgacagatggctgcctgtcatgttttcatatacaggcattgatttttgtaattacctgttgtccaaatactaatcttgcaggcaccagcctttccaaatttactcagtcctctagtctttctattgcattttattgaattgatttagcccttcagtctacatttcattattggtattgactttgcctgcacaatggataggccattgagcaaaaggcaaaattaaatctcctgtatgtgaagggtcataaatcatgcctttctcattccttattacagtgctttgtacagttttcatttaatgaagccaagaaattcagctttgttcatgatgatgccagatctcataggtataaagttgagaattcactcccataaatcagcagatagaagcactgtcccaaacttttcctactggtccagtgaacttgggtttaaggcagactgcctgttccctgacagcaaggaggtggaacttaggggagaggaatgggcatggtcagttcaggaagcaccagtgactgtgggagagtctgcagtccactgggtgccctgacctgggcca

SEQ ID NO: 24967 - DNA, 2052 bp, Bovine  19866880156113
gagaaggcaatggcaccccactccagtactcttgcctggaaaatcccatggacggaggagcctggtgggctgcagtcccatggggtcgctaagagtcggacacgactgagcgacttcacttttacttttcaccttcatgcattggagaaggaaatggcaacccactccagtgttcttgcctagagaatcccagggacgggggagcctggtgggctgccgtctatggggtcgcacagagtcggacacaactgaagtgacagcagcagtagcagcaagattaaaatgtaagtgctaaacagtattttttccctccgagtagacaaattcaactcaatttcagaaattctttcatttttcgtaattatcaaataattttgtcaattaacatgaaatcaaagggttaccaatcgacttactcagctacataacaatacgtacaaagcattcctgatgcttagtttgaactgtacaggcgataggaaaagaaggaaaattaacctttggtacatatttcctctgttccagagactgtgtgattaactttttctgttcttttatttaatcctcacaatgtaggtaatatgtacatttttagatgaagaaagtaaggctttgtagaaagcaggcattctaatgcagtccgtctggcttcagagccagatagattcaactacactttttctaaggggcagaaaatgtttagtggtggtttccctgtggaggaaatgaattgcaggcttaggataccatgagattcttttgccctgccaaccagtagttagagtgccctgctggggaagttgaagcaattttcttctgcctgataggtccctacattttattattatttttaaacagttgctattgaggtcaagtttgaactactcctgatatgattgtttctctgcttctgcatcttgtctgtggctgcctttattgttgactgtccaggcttgtgaatgattggtttttatgttctaagtactcataatctaggtcttcctgctcttgctccaaagtttattttgcttcaaatactgttttagaactttaactttccagatagaaacagttgatgaaaaaatctaattttgctaacatgactttattgatttaaaaaagttgttgccaatattttggaccaaaaaatgtatatctatatcactgttttaaatggcatttacttgattaccaataaagctgagcaacttgcctatttattttccaacattacttctttttcaaattgcattattttattcatattctaaaattaatttgtaaactctacatagcaaagaaatctgtattctgagatgtgatgcatatcttttctcataatctgttatttgtcttttaagtttgtttataatatattttgtcaatgaataatttaagatttatgagatttataatatcaatagtttactttctggattcccatttttctattttaagaataaatgacaatgtaattcaaatgttcttttatttattattaaattgaaatatttactcatagtaatatagtattttccctaatctctagctaattttaatttttttaaagtaaactatcttgttccaataaaataaaaatttattttaaaattatgaccttagtttccttatatcaaaggatatattcccatatacttccctctatttctggttgctagtctgttctagctacttctctattctagtggtcataagcagtgtgagtgcgcatatgcatggattcatgtagtatagtgaagacagagatcttataataatattcacttcattaggagaatttgcagctataaatccctcaaaaacattgctttatctgtttttgtattttatattttcattataattttgtttcagacattaaaaaatttctattgtggtttctaatttgacccagggattctttatgttttaattcctttataaatcattttaatttggtctgtttggtgagagaaatcaaattctgtgtgattttaattcttttaaatatattggaacatgggattatggcttagcatatagtctgtctag

SEQ ID NO: 24968 - DNA, 1206 bp, Bovine  19866880207888
ccatctcaacttcccccaaaattctcttgtctttcttcctgatttcatagtgtttgttgctgctgctgctgataagtcgcttcagtcgtgtctgactctgtgcgaccccgtagacggcagcccaccaggctcccccttccctgggattctccaggcaagaacactggagtgggttgccatttccttctccaatgcatgaaagtgaaaagtgaaagtgaaggcgctcagtcgtgtccgactcttagcgaccccatggactgcagccaaccaggctcctccgtccatgggattttccaggcaaaagtactggagtggggtgtcattgccttctccatagtgtttgttaggagagtcttactcttgagagttgatagtagatatttgaggtcattcaagtgagatttctgtttgagcattagatttcatgctagctaagaagcaggtattgttttatcaagtctaaaattatttgaaaggtgaattagatcaaataaagtatgcttcttttaatgatgttttgtttggatgtaatagtggataagatgtattatgttagtaaacagaagttctttctttctccagagcgtcatggaaaacagtgacaggtgtgctttgtcatctccatctctcgccttcacaccaccaatcaaaaccttaggtacaccaacccagcctggaagtgctcctcggatttctaccatgagacctctggctacagcgtacaaagcttctactagtgactatcaggtattttaaggattggataaagaacatactttaaaggctgcagtgcatagtgtgtttgtttaactttttcgttgggttgatttgtatgcaattaaatgccattaaatatttcctattgaagttgattaccttgatgaaaccaataaactttgtgttttaaaattttctattttacaaattacagttttggccagtggaaatttatcttgaattttcaaaaaaaaatctttatcattttaaaaaacattttgagagttgttattttagttttttctaagttacgtttgcgtacataaaaagtttcttgtggacatctctggcgtgagagaatgttaaaactctattagttgataactaaatctaaggtatcacaaaccttagattggaagtagttttggtgatcaaaagaaaacattgcctagctcccatttcaaaatttaaccatttcaaaaaagctta

SEQ ID NO: 24969 - DNA, 1639 bp, Bovine  19866880426907
aaactaactgtaagcattgcactttcagtggatcctcaatctgtctagtgaattataagaccttagagtgggcttgggaaagcctgaatttgcagccagcaagtctgaaatgaaagtggccctggggacccgtaaacttacagtcggcacctgaagatacagcagtcttgcagggactgtatgctcagacttgcagtttgacaaacgcattgtacccggatgaatataacaatatccaaaatagtacgacgaactgaacaccagtattcatctccagcatttgtcaggtacctaatgacaatcactctggaaagtccaaggttttggagaccacagaaggtgtgaaacagactcctggttgaaatcaaggaaaactagtttaagagagtatataataaaggatgaaaaggcaaggccttcctcatcttgtgcagctactccacccccaaaacaccaaggtgttagtccccaaggaaaagaaatgtcaatacctcaggactatggcaccccactccagtactcttgcctggaaaatcccagggataggggagcctggtcagctgccgtctatggggtcgcacagagttggacatgactgaagtgacttagcagcagcagcagcaggtgggtcccagtcacagtggagaataactatgtaagagactaagcgaaaatctgcatattgaaaagaagacttctccctttctacattcagaacagcagcttagacattaataccgaatattaaagaatttttctttgggaaatttaaaagaaaggacctatatatactgaaatcagatatttttccaacaaaaatttatctaactgtccgatgctcctacagcaaagcccaaaaagaggcagaataacctctctccactaatttcccccttcctaccactgtcaacacacacacacacagactccaagtagctatttagtgcctcattcaatatatatgccttcactaagaaaaggtataagagttaaaaaaaaaaaaaaaagaaaaaggagagagggaaaaaaaaaagatctagaaggaaacagacagtatgaacaggaataaaagtccaacgtgaacttcactggtaagttattttaaccatgaaacaagacaggatgctacattttaaatactttaagagaatagcagcaaaaaagatcattgaatattaaaatatcaaaataaattattagatgcactggaaattgagattatggacacctttcagaaagtataatacagatatacaagacactctaacacagaaaaagtagaaatttagaaatctctgcagcactcacaaacagaagaaattccagagagatagagaacacagaaaacagtgggaaggctattatcaaatataaggaagtttgccaaaacccaggctaagtgtcttgatttaaaggatccaccaactccccagaaagataaagtcccagaccaaggcagatttgtaaaactgaaaacactaaccatacagagaccttaaattttttgaaaccaagcccctacaacagcttaggaaccatcactgcgtctgacttctgcagaacactggaagccagaagacaaagtaatgatgcctccaaaattccaatctagaactctatacttggccaaacaagcaac

SEQ ID NO: 24970 - DNA, 3116 bp, Bovine  19866880429569
tagtctgatgatattgatccataagtacgggaataggagaaagaaactacttccgtttcatcttttctgggctgaactgattgaaccatagtaaatttcattgctatactctcctttgcctgttgtagatttctctctacaatcagatttctcggattctttttttttttttgtactgtcctctgtatgtatcccagaaacttctggtctataaagaaactctgggtagaaggctgaaaataaagatgaaataggatcctgggcctggagcaggactgggtatgagctatgaggatggaggttatggagccaatgccactatttcttcctaaaactctggctgctgatgtttttctggagatagcttaaaactctgtaaactttagacttaaaaactctgcccttcaaattgctgcaagtctcttaccactctttaccaagttatgttagaatcaataaattaaatgtaaatgactttattttggaggtgggctggatttatattattacttgcagtaaaagaagtgataaaatgaagtagcatataaagcagattaatctgaaaaataaaactggttaatttgaatctatgtctaatggtaaaaacaaagagctatattttcagtggttgtaagtggtggtttctttctcagagtaggggaaataaatttggagagtttgataatactcagccttaaatagatagccataataaagattttacacagcacaaaatcttttaaaatatattagaagtcagagagaacttgtccttaatggattctcatgaggattatattttaatccatagaagtacccttcctttttatttttccatatattcaaataaaaagtttaaataaactccagtgggactacattatggggccattttgatgtcattatgttctgacattatctgtggaagtagtttcttaaaaaatttttattggagtacagttgatttacaactttgtgttagtttctggggaagaagttttagagtatttcattagataaatgcctcgatgagagtacaaatagttagagtgataatttaaaatagtgcaaggaaattgaggtagagttacccatgataatgaaagctaccttcgtttggaaaagcaagtgctcctatcaataaatatagttctgatttcataactgaatttgtaataattggaattatattatttaaaatggtggcagtatattttcttggtaccaatcagccagatcttcagctaaagtcaagcagaaaattggaataattgttgagggatatttagataaagaagctgcctttatttgagttaattataccactaaaataaaagaaccaaagccaatcatcactagatagcttttgcagagatgctgtctgccctttgcagaacttccataaaaatgactgtgtcaatcagatgcttgataagttttagatatacatcttaacttcaggcccttatctaaaatggctgcttcgttttttttttggttatttgtctatcaggtactaacaattgaacttgtgtcaacagaagagttaaaaaaaaatcatttataagtgatatagcactctcagaacaagtgaagtacattgtgtgatagtccctggctctaatttgaggcctaaaacagtgttggtcagacttgaaagtatctaagaatctttgggattttgcagacgtgcctaggggattttgacatagtagatttgggttgagattttagaattttaacttttaacaggtatcctagactggcagatgtctgtggttcaaagaccatactttggaaacgctgacttaatgcttgcagttgttttctacattggccattcttctgcaattctccttaaaccctaaacaacataagacagacatgacctggctgcagcatgtgggggtcagagcacagaacatccatctactccctcgttttctactcaatttcattaacttaaataaatattcatttgccagtggagtgaggataagggtatctaagggaagagatggtagacctgaattaaaaaaaaaaaatatatatatatatagccattaagaaacttgaaagccttgtaataataaagaaaaggaattaattttgttctttactatgtcccaggcacttagaccaatgcctatcacttcacctatgctcaagaaatatttgttgactgtgtaatgaatgaattacaaagcaaagtgcaattaagtgatgtaaatatgtgaacaacaatctagacgtgggtggagcaggataggagtctagttgtgaggttactgatgtttccaaaattatgtcatccctgtaatttgcttccctccaaaccccacctcagggcttccctggtggctcagctgtacagaatctgcctgccaatgcaggagatgcaagtttgacccctgggtcaggaagatcccctggagaaggaaatggcaacccactcctgtattcttgcctgggaaattccatggacagaggaccctggtgggctacagtccatggggttgcaaaagagtgggacatgacttagtgactgaacaacagcaaactccacctctcatacctctcatatgactcacagaatatgataatcttaccagctcacagaatttttagtgagacttttctgagctagaggtccagtggacactgtggaagaggaggttggcaatgagtagagctgtggctgaatctcagatctaacggtgagtggctcacggagtggctgctgttctgtcactcagctgtgttcaactctttgtgaccctggggactgtaacccccaggcccctctgttcacagggctctccaggcaagaatactggagtgggttgccatttccttctccaaaccacgtgacagagtgtcctaatttctccatttcagtggattagcagggacaatgcaacctccctgattcacagagatggtagatgaaaactgagagcataactagggaggtacttcacactcgagagggagaataaaatgagatataaaattctgagttcctgggatgcctttgttactcactacatacacttttctcagagcaggacttattcaaaattgtagctcaggtgaccccttccctcatgtcctcc

SEQ ID NO: 24971 - DNA, 641 bp, Bovine  19866880453527
ttaagtcctgtgatgtctctttataaaagctgtcaacctccgaaagttaaaatttacaaattatagaagttttcatgtatttaacattaaatgtaagagtttaaaaaacgaaagtctacatattcttcctcaattttttcaactcttttattcaatttcttctttagtatcgaccatgcatcatagtcctcatgcctacaacatgatttcaaaagtattctttttcaagaagaagcattctttttcacttatgtcccattaagactttctatacataaattctttaaacttaaaggagaagcagctgtggctcccagtggccaattttatgacagggatattttcctatcacagtttttatattttcacatatggtttctaaaattacaagaaactcatagaagttacagtattagaaaaaaaagattaacaaaaggaagtttaattagctttaaccctgtactcttctacatgacagcaataagaatattataatgtatgtttttagacaactaagaaaatgctttaaaacatataacacattacttaaattacgtgcttttgcatttccaaagtctctgggagtcgtttactgactcagccaaacaatcactattatagcaaacaggtcaagtagcaag

SEQ ID NO: 24972 - DNA, 645 bp, Bovine  19866880495760
atgggaagagagtagggcctttgcccctcaactaccctgaaaacaaactcagctggtggtcttttcctttcctggagaaaccaagcactgaatacacacgttgttggctattgtcgttcagtcatatccaactctttgtgaccccatggactgcagcacaccaggctcctctgtcctcctctatctcccggagtttgctcggattcattgagtcaatgacactatctaaccatctcatcctctgccacctccttctccttttgccttcaatttttcctagcatcagagtcttttccagtgagtcagctcttctcatcaggtggccaaagtattggagcttcagcttcagcatcagtccttccaatgaatatttagagttgacttcctttaggattgactggtttgaatacacatgtaattcaattcaattccagaaatagttcaattgcctattaaggacaaagagactgcatgtttctcagagaagcacatttaaggaaagctgagccacgtttaaattttgacagtgctacaattctttggggactggctgtccaaggaaaagcagcaagctcatgacattccctgaagggataatggccgcctgtcagatccttgtttgtggtgcaggctgactgcacagag

SEQ ID NO: 24973 - DNA, 792 bp, Bovine  19866880527492
gcttaataaatgactgttgaactgagtgaatgcatggataaacagagttgtcagatatgatcctgaagaggtgaaacatttaatttagtatgtatattcactttccattttattaataagaaactacagactggagctgcaagataacctttactaatgagagtgacattgcatacacaaacaactgaaacctctaaccaggcttgtaaagtgtttttattttacaaccaaatttgatttgtcctgccaaatttgcattgctctgctcattattatcaatagcaggctttgtctttttttttttttttaacccatttctatttagatcatagaaaaaattgtaacttgttcagccaaagattttttctttgaaaagtaattgatggtagtggtaatcctatcagtaaatgagagttttgaagcctataaatatggggaccagactctgggtcttattaatttagtaaggccttgacaggctgcttgggaaatatcttggagttttcttttgaagtttttgcatttactgtgggcctcttgcctttcacattcatcatgtacctcatcacaggttcatggtattattttaggcaatgcatatggaaatatagggcttcccatgtggcactagtggtaaagaacctgtctgtcaatgcaggagatgtaagaggcacgggttggctccttgggtctggaagatcccctggattagggcatggcaacctactccactattcttgcctggggtaatcccatggacagaggagcctggtgagctatggtccatagggt

SEQ ID NO: 24974 - DNA, 738 bp, Bovine  19866880562364
agagccctattgttgctcttataactccctgacccctgcttttacctctctttcaccagatcctcacttcctgttctaacatgccaggttttcccagatttatgttcttttcctcactcactcttcttgaacaattttattcatattcatgtttgtaactatagccttttcagttaatgagtttggaatctatgtcctcaacctactatttatggaatgcctactacgtgcccattatgctagggactttgcataaattatctcatttaattctaaaacactccagcttattttacaatccatatggccaggaaataagttcatgccaatacatttcagtacccaggaaaacctgttttcacttaaagtaagattttttgaaaatcttaaactccactcctcaaaagtcattttgacaactattatcttgaaagaaagtttggcaaatcaaaatcacttgggaggactcaagtcctcacctctaatatacaatccatgaaacttttttcttaaaaaaaaatcttattactcaaatccctcttttattctcctttcatctgacaaagaggatataaaattagaagcagacagaagcactgaacccacagtactgttgtaatgtcccaaaaaggcctaaagtatgccattttttcctattcttttttggaaattttctggttttatcaattggattttgagaccactgttgctcagactagactctgggagatagtgatt

SEQ ID NO: 24975 - DNA, 816 bp, Bovine  19866880567446
tttaaaaatgggatcagcagtattagcattttatttccctcatgacccattttcattgctatgctaacataattttgagtaatcattaaaatataaccaaagcctttgacctcaaaattaaccaacaaaagaaacattaggaaattcatagcactttgcaaatgttctggcttgcttagcccatattaacatgtcaagaagcctacagcatgttcaaacttttccccccttggggttcaattcagtaagtacttacgaagactataatatttttaagcaattacaataaagtgaaagactccaattactcagtttagaaagattattctccctttctaatctaacatattttccaagatatctagcttttactagacttatacatgcaaaaatgtgttcacacatgcatacacccacactcactcccatgctgatgttactaagtctgttgtagttgaatacttaactatttgagtactgaacacacaagtgtattttaaagacagaaactcaaatcacagacacataaaagaatttatatattagcactcataattatgaagcaaacatatatgctgaccttgttgactcagatgatgtaggtagcatttacttttcttctcagctctgacattttctgtatgttggcttaattcttttgcagataagctttctgcatttggtggtagtaagttaacagggaagacaagaaatgtgagatgtggaggtatggttacaaagaatttcgcaattgtattgaacttggtaacaccaaagtaaaggtttctcatcctacacctgtacagaaaatatcaa

SEQ ID NO: 24976 - DNA, 2650 bp, Bovine  19866880641317
aaaggaaatgaaggggaatctgatgataaacaaacaaactaattttgactgggagttccaggaaaagccaagataatgatactagataacatttattgagtacttgcattgtgtcatgctctgctccagtgtcttacatgtattaatgtgcttcatcttcataacaaactctgaaataagaacactttattattcctattaaacagatgaagaagttgctcctaagcccacagctggtaaggggcaaagctcaggctattaaccacttaatgagaacactgatgtaggtcagcagaattggtttgggaaagataggaaagttttctcataacttctattttctcaataattagaagtagttcatcagcataaaagggaggtcatgtgtcacaaatattgaatgtttagcagaaaaaaaagcctaggttctgggatcagactgacagagctggaatcctggttttcacacttaccttggatcttcgacatgtgactaaagcactctgaacctcaatttttcaccttaaatgaagattattgtacttattagattgtctgaggaatgtatggaataatttttaggactgtaccttgtgtaattcagtgaatataagtgtttcttgttactactatggtgattattattattgtcccagcctgcccagttgtgtgattttctacattggtatgtggcacaaaaggaatgaagagctgtagatttttctgtttttaggtgagtgctatggagagaaaaagtggcaaaggaattgggagtagtggttagagaataatgtagctaactgtgttttaagactcaaccaaaaaaatttaaaaacttgtctaattgtattagcattgctttgtttgacaaattcctatttcaaagtaataatttctgaaaaagacagttcctctatttcatgttagacatatagcataatcattaagcttctaagtgttgattatatgcaaatgttagggacattaaattttttcttataaaatatacattatgctaaatattataaactcattataagatgattttcccctactaaaacatcactgaagtctaaatgtttaccataagtcaagtgttcactgatgcttaaattcaactttctatacccacttaaattcaaatccagtgttacttaaccaccatcatacaaactaaggtgctactgtttccttgctttaaagctatgaacattcattgtcctacctagattatttgtatggtagattatttgtcctacctagattatttgtatggtaaaaatgtatggtacatttttcccgtttcttccattatttctaattacttcaattgattactattttccccacaaaactttagaatcagaatttatttaaattttccacactttgtgtgtctctcccattcccagtggtctttatttgtgctacacttgaaataataggatgaacaattaactttaagtttgtgaaaagaagaaagccatgtttcacagctagtgtcaagttttgtttacttatttcatgtcgtagattctacatttacaatattaggagaatgttcaaacaaactttagcatatgcatatgtatgtgtaaatactttcgtgtgtcagattttaattatagaatagtttgacctttgtaagttgaaggtatttataaatagctataaatagaaaatattttatgttatctagtatattagcttaaaaatggtagtcattctgttatctaatatattagctaaaactgcaactgctagattacaaactatagtacttccaaacaccagaaggggacattggtagtcaaccagttctggaaaaaacaaagttagtgtagctcactctcttgttttaagagagggtgtgacagacttaaggctcatgacttgaatcagaagaacggaatgaagctaacaactcgtctttactcatttcccccaaggagttgaagcagaacaaaaataaagctgaaatcatcttttccttacattttggtctttataggccaaattaattcttgattctaattaaggttcctaattagctttggatcatggatgctacataaatctaacaaaactaggcatcctgtccataaaaatatacaaaattttagtgcaattttaacaaacttccagtctcattaaagcctatataaggcccacagaccaaagattcagaactattctggactgtaacaagtccatccaaaaagctacaggaggaggagttgtatacccaaagtaatcatgtgttaaatgtccaggtttaacctgacataaatattgaaaaacaaacgttcagaccagcattcagaatgtaaaagtgtctctttcctgatgagttcaatgcataacaactgactctctggtaatctttccgcaggatgaaagtgtagactttgtagtcaacatccttatcaggactaaatatcccgctgtagctggattactcaagttcctgctttatctgcctccttctggtgccagactttggcacctccaacagaaagtaggaaaaagaactgaacgcatgaaacttaaatgatttgattttattttcagttgaataccttgactaaatagcttggtgcaaaggaaactgctattttgctctaagttttttccctttctcttacgctat

SEQ ID NO: 24977 - DNA, 1206 bp, Bovine  19866880649620
ctcagaatgaatgcagaaaaattgtaaatttagtctcagaagcatgctgctaaagcagacccagccagcttttcagccttcaaagcagctttgtataaagcagcacatttggaaatctgtcgctggtacactctattcatactggattaataagaagtaaaatttaacatgacgaagaaaaggacatagaatataagaaaggatcacaaaaatggaaaaagcaataaattccaacaaaatccagtattagttaagttttcaaatacctagacatttatgtttttgaatgctgacaatatactcttattaatgaaatgtcccctctcttgacctcaaagcccagtggcaaattcctctttgcagtgtacatttgcctgtgttccacactgctattgctttttcaggtaggcaaaaagtaaatatatagtaaataccaccactgtcatttaacattaaatgtttgacacaaaataatggacttgactacaattatcggagttaagtgagctgcctcaaattcttcgtggaataagatcatttcaaaaaagataataaaaaattaagattaagggatttttttcttatctccatgggtgacagtttagtttaatttatgtgaaagatttctttttcttttatatctcttttatttcaagtggtgtcgctacctttattgtaagatttttaaaattttaactttatattacaaattgtttcaaatataaaaaatataaagagtataaaggcttcatatatattcattatccagctttgacacctaacattttccccaacttgactgtaaagggttttaatgtatctataattgaaactagaattatttaatctatataataaataatatataattagattataaatattatataaaccataaataattggaaactcttgaaagagatcattttgaattatttttagaagacaactatttattgttccttcagaaaggaattgggcttataaacagaattcttattggcagttaactttattttcatggtgcttgatggtaatttttagaaacattttttaaagaggagactgtaagaataaatatcaaagtaacatgcttagcaatagccaaaccaagtggtcaaacttattaagctcagttaaatacatatctctctatcaaactggaagctgagctaatagcatgtgatacaccattgcatgagtcgg

SEQ ID NO: 24978 - DNA, 1880 bp, Bovine  19866880695560
atggtgactgcagccatgaaattaaaaagacgcttactccttggaaggaaagttatgaccaaccgagatagcatattgaaaagcagagacattaatttgcccacaaaggtccatctagtcaaggctatggtttttcctgtggtcatgtatggatgtgagagttggactgcgaaagaaagctgagcgctgaagaattgatgcttttgaactgtggtgttggagaagactcttgagagtccctaggactacaaggaggtccaaccagtccatcctaaaggatatcaatcctgggtcctcattggcaggactgatgctaaagctgaaactccaatactttggccacctcctgcaaagagttaattcattggaaaagaccctgattctaggaaggcttgggggcaggaggagaaggggatggcagaggatgagatggctggatggtatcaccgactcgatggacatgggtttgggtggattcccgcagttggtgatggacagggaggcctggcgtgctgttatttatggtgtcgcagagtcggacacaactgagcaactgaactgaactgaactgatacatacatatatatatatatatatatgtatgtatatatgtatcctctccttccccactccctttgcattcatctcggttgtcaaagaccaccaggatgggcatcctgtgttatataccagcttcccacaaacaaatgtatatatgttaatgctactttctcaatttgtcctaccctctcctttccctactgtgtccagaagtctgttctctacatctgtatctccatcccttccctgaaaataggttcattagtactatttttctagattctatatatatgcattaatatactatagctgtttttctctttttgactcacttcactccatataacaggttctaggttcatctacctcactaaaactgactcaaacttgttccttattatggctgagtaatattgcattttgtatttgtaccacatctttatccattcatctgttgatggacatctgggttgcctctatgtcctggctattgaactcgtgctgcaataaacattggagtacatgtctttttgaattgtgtttttctcaggatatatgccaagtggtgggatttctgggtcatatggtagttttatttctatttttaaaagaaatctccacactgttctctatcatggatgtattgatttacattcccaatagcagtgcaggagggttctcttttctccacatcttcttggaaatctattgtttagattttttgatgatggccattttgattggtgtgaggtgataactcattgtttttaagatttgcatttctctagtagtgagcaatgttgagcatcttttcacgtggtcactggccctcaaaagtactcactttaaagtcatggacttagctttgctgaaggtaagaagtaccacattctcagctgagggatgcagtctaataccaggagttaatcatgacttattggcaatggcaaaaagcttattagatgcagaaagtgtttttaggatagctgtataggaaattgatcattattaatatttaatgattcattttatgcttggcaggatacctactgggtacagacaagttcatccacagaatagttttaagctcttgaaaatatttttattgttttgtgtgtgggtattggaatcatttttaactgaagcatttgaagctctgactttatatacacatagctagtctgaaatatttataacagtatccattcttataacctcaaataaatagacataatgaatttaatatttatgcttcaatttactgcatcatgaatttgaaatgattaggagatatcataaaatccaatactatatataca

SEQ ID NO: 24979 - DNA, 626 bp, Bovine  19866880714263
accaaataaagaagtggaatatgtaacagagagcttctcacaggccttaggtgaaaggcattacatagggatacagggaatgacaagattctgctcggtatccatcacaacagaatgctccaaagacctctcaaactgagcatgtctcattacattatctcttgcatccttccacctttatttgcagtggtgagacactggatagctgcttgttaactttgccattttcgctcagggcaaagcctcacctttcttaaagatctctgctgaaaccaccacaataaatcgctgcctactagaccatcgaatcaagatgtctggtgaaaaagaaatgtgcacagctcttcattcatgttccacacacaatgtgctgtatactcgaccatttttatttttagctctgcccattaaattaaaaataaagaggtaatgatgaagagaaaagattgaaacaataggaaccttatgaaatgaaaggcattttctaatccttggctataaatattaaaaatataaatccaactgttttaagaaaagtacagaaggaaatggggctttaatagcaagaaaatgatgttttaacacttgagttattttctcccattttgctatactaaatgatatca

SEQ ID NO: 24980 - DNA, 1068 bp, Bovine  19866880836191
aaaaaattgtaattatgtgaagtgatacatgtaatgtaagtgatacatgggaatcattttgcaatatatatgtatatgaaatcactaggttgtacaccttagaattaaacaatgttatatttcagttacatcccaataaggctaggaaaagtatttattccacccaattttatgactcaaaataatgagttatgtgtgacaaagcattcattttggctttggagaataaagtaagttttgggaaacctaatcaaatgaactcccaagacagaattaggagacagctcaaaatatgcaatcagtaaattctctaaaagtagattccatttttaatatagtacctagcatccactgtaaaggatgttgggctaaatacatttttaactatctcttttctaatttccttcaaaacatttacatatgaggatccaaatgaaggaaaactacactcaattattgttctaatgttcatgctttgtagtctctcagccttttgaaatcccataatgttttactatctctgggtttacaagtgtctcctcagatttacagtttccagaatattttctgcttctccttctgagttgttatgaaatttttgtcatcagtctgttaattttaaggttaattagagatcacatctttctgagggtctggcagaatgcacaagtgttgccagggcaactagcccacaggtcgttacatgcacatgtagctttctgaggctatgggggagcagagaactcaaccattcagcttccacagctctaagctcactggagtctaatttgatccatagagtaccatacaaagaaacactgagaggaaaattccagtaaattaaaactatgattacagtagtttaactacacaattaagttaaaaaatgttcagcagagccttgcagcagaggttacacaatgcttgcacatcctcggttttgagtgcatatgcacgtgtcccttggggacagagatcatgttgaaccagtttttgtatccccaaatccctaccaaagccaggcgcactgtaagtactcaacacacttgctctaacaagtacacaaag

SEQ ID NO: 24981 - DNA, 1208 bp, Bovine  19866880851332
ttgggttagacatgtctcttggctatttatccaaattcataggaaattaatactctcttcttgtgaggtgatcttttcctaccacccctacccatcatgtcactaaatgtgaactctacccttgttgctgttgtttagtcgctaagttgtgtctaattcattttgtgaccccatggactgtagcccaccaggctcctctgtccatgggttttcccaggcaagagtcctggcatgggttgccttttccttctccagggaaccttcctggaccagggatcaaacctttgtctactgcattggcaagcagatgctttaccactgagtcatctggaaagcctgaaatctgccctgggattagattaaaactagatttccttctaggcataaaatgtagtggtaaattttgcttgccattattccacaaaagcaggataatattcacatcatttgttgagcttcctgtaaattttactcttattttttaggtacagaatatatgcatggtaatctttgtggcaatgctattggatagtgctttttatcacttcagtgtctagtcaaagtttgacaataaaattgtactcaagacttaaaagaggttctttctacggaaagagtaagactgtatggagttatttggcaagaataccaagagaacactaaagaaagcaaaaaataaaagttagttggagcttgaaaactgaactatgatttattgtaaagttctgcagtaaaagagaatgtgtgttgaggcggggagtgagagggggacaaatatctgcagagtgattcttagaaggaatggctctaaaggacaaggctcaaggacatcaagcacttggagttcttacttcccaaagaaggaacagagaaattgctttgtcattctgaccattaattacttggctcaaatattttatggagatttgtagctattaaaatatgatgctttgatttttttttttttcattagaaatttcttttttcccttcctgaacaaatgctattctaaaggttttcatttgttttggtagatttttgcctttttatacacaatcagtcaacaattcagctacctaacagtaacttttcttcacctttccaaagatgatatttactctttatctatttgtatgtacttaaggttttgtgtgtaagagaaggatgcctgtgttcacttttggaatggagattgctccactgatgtg

SEQ ID NO: 24982 - DNA, 1382 bp, Bovine  19866880880711
gagtttattctgcatgtttctttcttttcttgtcttttttctattgtaagaaatagagtggaattattatttaaaagatgacatgcatataaaaccaccaaatttcagttaacttacttgaatccatttttcctcctgtagatgaataggacttcctacagaaaactgagaaattatttttaaattatgaggtacttcaaatgtgtaaaaaattacagactatagcaattatatatctaccattaacaaatgttaatattttgataggctaagttttcagtagaataaagttgaatatagattcagtaagcagcctgtgagctttgtattaccaagagaatattggccaaccagcatattgctgaccttccagctacctaaaatcacatggtggaagctggcagatttcccagacagttaaagtgaaaaaaatgttttctatagaaatggaacctaattcaggaaagtaaaatacttgaaaactttaaataataaatgccctattttttcagttgtgtaactcattttattttaactagttattctcctgtataaacttgcttattaactagagtcatttttcaaatgtaggagatctggaaagccaactttcacagggagcaactggaaaagggtacagccctagctgtgcatggagcgtgggtggaactctgtggaccagcagtgtttgctctaagctactgagtgttcccggacgagctggcactaaagcattttgtggatgtctttttaatattcttttcttcagttgcaaaagaaatagatactgtaaaaagtacacgtgagcatgaagaaaaaagtcacctataatcttactgtaacattttgttctatatacttcttgcccatttttaagcatatacatcgtttttatttttacagaaatgattgatgttttgtaacctgcttttatcacctaatatattgaaaatatatttccatgcaataaatattcttctacatttctcatttcaaagggctgtatatattttcatgggatattcatcaaaaatattcatcctgtaaatacttctgggactctgaaatcccacttctaggaatttttcctaaaagttctggatattgcaaagattagctattaggatgttcttcacaatattgttggtaatacaaaataaaccccacaaaaacaaaacaaacaaaaatccacccaaacccaatgcccaatttttctaggaacaattcctagaagtgggatttcagagtccagaagtatttacaggatgaatatttttaaatgaatattcctgaattatctttcagagagttggactcaggtcctcccaaggtgtatttcttaaaataataaccaacacaattggacaaaattcagattaaaa

SEQ ID NO: 24983 - DNA, 1843 bp, Bovine  19866880978587
aatctctccctctttacaggataatctgacaacttccactgaaagtaaacagagaaccctccctggacccctctggctactgccctagtctctgctgctaagtcacttcagtcgtgcccgactctgtgcgggttcccttcaaactcctgttcagtcttctttgctgactccacttaactgtatttgattcctaaagtcagagttcttcagggctttggactagatcctaatttccttttaaaaataatctctccaaaaatgatctcatctattgccacgattccaaatatcatccatattttgatgatcctaagtttgtactcctagtctagacttcgtggaggtccagttcagtatgttcgatattcttcccaatttttgtaaactatttatctttcagttcagttcagtcgctcagtttcgtccgactctttgcgaccccatgaattgcagcacgccaggcctccctgtccatcaccaactcccggagttcactcagactcatgtgcatcgagtcagtgatgccatccagccatctcatcctctgtcgtccccttctcttcctgcccccaatccctcccagtatcagagtcttttccaatgagtcaactcttcgcatgaggtggccaaagtactggagtttcaatctcagcatcagttcttccaatgaacacccaggactggtctcctcctccaaccaggatggactggttggatctccttgcagtccaagggactcgaaagagtcttctccaacaccacagttcaaaggcagaaattcttcagcgttcagctttcttcacagaccaactctcacatccatacatgactactggaaaaaccatagccttgactagacggacctttgttggcaaagtaatatctctgctttttaatatgctatctaggttggtcataacgtaccttccaaggatctttagggtagactaaacgtaaaaatataagctggaagttggatatcatcataggcttaacctgtagtttaactcaagctttgttttaccattgttttttgccaattttacacatagcattctagtattttaaaatacttaagaccaaacaccaaagatcaagcaattagtgtgtgtatacactgatacatcatctactatttgagtatgtctaggcacaatacatttctaaagcaaaaacaaaaaactcacgaatcctttgtactgcaaaaagaaccaagaagaattaaaaccaatcataaacagaaattattcattacattagagtttttccacagaaagaacctgaagttctttgagtgattttaaaaggaaatttagtttgcagagcagaagcaaacaaacatgtgtaaagtgcattatcaatatctcgcaggctataagatgaattctaatcggatgtgaatggtaaagatcaaggctgtaattaatttctcattgttttctttttgaacttttcagatcagttctgttttaggcatgtcttctgctaactactggagacatcttctgtttcatttaaacttctcttggttactcctttgcaataccaagttgcaatctctgactaagggcctaactccttattcacttactatagatactgggatactgttgctgcatctttccctgttcactttcttaatcattttcagttgtgtaattttcataccttatggtctttgaatatgtagaacacaacttgaagtattgatttagcatgtatcttattgtctatcctttttatgaccatagttaaactacagtgagatcttctactgtccttttcaaagttcttcacccaaagttgattcttctgtctatggtatggtccaactatatgcaat

SEQ ID NO: 24984 - DNA, 1234 bp, Bovine  19866880995031
ttgacttgtctgggttacacttgttacaacagccctttcacctgtatggggtgtgtcatttcagtttggagtactataccagatatttggaaaataagtcttggaaaaatagactgttttgcttcagggagtcctgtatgcttcaagccaaaattcttgtttgccaggtgaggaaagtcaggacagagctgatgcgcttgttcaaggtcgttcagaatagaaacttgaccagggttccagacacccagtcagggctctttttgctagagagtgctctttcactgataaggttctggtgcagctgcgttgtctggcaattaactctgccaggtcaaatctgagcatgttccatagcaagcactgcgtgatacaaaaggagacggaattcgaccagtataggctgaaattaaactgaaaggaatatggcatggctatttaaaagtgtttaattttataaaccccagcagatcaaagtaattatagagcaataaaagatgagtaaaagcctccaatggatgcaaggaagagataaagctagacttttcagaacagccactgttcttcctacaaaacattttctggttttgttgtctattgtctagttcttattaaactggctgggttgcaaacaaagccgtgttaatataatgtggatggaatttattcatgagtacatctgtcctttcacaaggaaaaatgcatctatttaaacaataccgatgttatcctaaaatttgaaagttttatgcttatgtaagtgtgttaaattatccttataacatattgagaagctggacttttaatcaatttatgtttatttataaatttgtaagttttctcccattagaatatacactgctgctgctgctaagttgcttcagtcatgtccgactctgtgcgaccccatagatggcagcccaccaggctcccccgtccctgggattctccaggcaagaacactggagtgggttgccatttccttctccaatgcatgaaagtgaaaagtgaaagtgatggagaactagatttcaaattaatgataggaaagtttattttagcttttattttcttaagtttgctagtagtactacctttgaggagaagactttcttataatgaagaaaatcagaatattgcttattttaaactcttttctggatcatcaccttcctagaaattcttaaaataatcttaaatactttctagcttttggtagtatgagtgtgtgggggaa

SEQ ID NO: 24985 - DNA, 1304 bp, Bovine  19866881034522
cttatatgatttgctacttttgtgaagtaaaagcttttcaaggtaaaatttatgaatatatagcattttcaatagagtcggacatgcctgagcaacttcactttcacttttcactttcatgcattggagaaggaaatggcaacccactccagtgttcttgcctggagagtcccagggacgggggagcctggtgggctgctgtctatggtgttgcacagagtcggacatgactgaagcgacttagcagcagcagcattttcaatataataatatcttaatactttcctttaaaaatatatatttatatagttggtgaaggcacaaagaatagaggggaaaattccttcctcagtgctggtttagtaacagtgctgggtaaggagaagccagtggcataaaatcaagttcaggattctgcaagttactaaagtattgatctctgttaaagggaattttagtcctgagggttattgccaagcacctgcaaggtggagagctatttcttggttcttggccatgtgtgtatggtttcagtatgtaggtggagaaaaacttggtgggaatgattcctctgttgacagcaagcaatgggcagtcattacctttcttggagagaaatgagatagggtgctcaatggaaagcgaattgctctcctggaatatgtgtctcactctgatagttaaaactttgcaaaagagtccactattggaatatacccatgtaatccttccatccattcatgtatccattttgttattcattcactcatgtagatgctagccgattggatgaagctttttttctgttaatccccaaaatgagctgtcatctgagaaaggttgtgttctgtgtttccctttttgcagatgtcaaggacttgatttcctttcattttaacatttaaaatatatttatttaaaattatgaaagaaattaatctttaataccaaagaaatgtagactaatttgaagaagattgagaagaagctaggaaaaggaattcactgtagctccactacacaaataaacattgctaactttctttagtttctcttttctgataggctgaaaagttggaaccgtattaacttcatcatcataagggcacaagtagtaagttagtagtatatcagcttccactttaggctctgtattcttgggatcccatctaaggacacatagctgatttaagcagaaaaataaaattcactgaagatatcagatagctcatggaatatctgggggagacagaatcagacttggaggctacagagttggaaacatcacccgtatcatactatag

SEQ ID NO: 24986 - DNA, 1930 bp, Bovine  19866881231417
ttctgctttgtcagggatcggctttgtccttaatggtactctaatgggtctctggagtaaatggatgctgaggtttggtcataataggaatatttattaagatacggtgggtactttgcaccccagagaatctattcatttggcatggcactctagcttcctggagagcaagaatgaatcttgggtaccactggggcacagtattggacttgaagtaagtgcttgtgtttgctgaactacacttttagtgtaaatggttcttttagaggagggccaaatgcagacttgtttttcttgctggagactagaggaaacttctgtgcatttggcaattcctgatcaaagacagcatttctgtactttctggcgttttcctgtatgtagtacttttatatatatcactagaggtgtgtgtggtgatttaagtggaggcatggaaaaaaataatacatcagtagaaatatattttaatatgtactagtaaacatataactcaaacatcaaccttgtgattccaagcatcttaccacttagaaaaaagctaaattcaacttaaggaaaaatgttaagtaaataataagacacaagagttatgaggataaggtaaaaattgtgaaggttgaaacggaatgacaaatgtttggaaacatagctgagccatatgtcctggattaggcaagggtatgaatacttttcctactttctttgctacttcctttcacatgagaggagatacttactatctgtatgtgcattatttcagattaaaaatattctttgcattcccggttactctcttactgctgttgagcagatctgaaaggatcttttccaatcttctctgagaacatcagttattgtcaacatcttatcaagcaccatttgctgttctctggttttttttttttttagttgttaattatgacattgtaattgcttttgtatttccatcaagaattgtcaagtgttttatgcgaaagctgtgtcgttatagtagttggaaatatttagcaatatatctatagccatagattctaattcaggctctgcataactagctatgagactggagatagggagttctgttattggtaaaatgaaatagattatctctcttgggacttccctggtggctcagtggtaaggaatctgcttgccaacacagaagacttgtgttctgtccctgggtcaggaagatcccctgaagaagggaatggcaacacactcaaatattcttgcctgggaaatcctatggactggcaggctatagtccctggggtcacaagagagtcagacacgacttagcaactaaacaacagaaaaaacaacaacaacaacttgagttcttataactctaaaatcatcttttgttcctgtatttctgacctctgtgtttaaatatattatagagttaaggtcgtcctcctttgtactctatggtctgctgtacggggctacttagagttcccagaagtcaccacgatctgtgcgatttccgttttgctccatctctcctgtttttgaatattaggttgaaatgccatgaaaatagagcatttgtatcagatgtgagaatcgccctgcccattctgtgctatgaaagattcattcttaaactctgattcaaacaaatagtaatcaggatgaaagtttcttaatgtccacactttagagttcgggagcccaaaattctttctatgaaacttggtattattcagtgtgagttttgtttgcagagcctattattcagaagtttaagcttgacttagaaattcataatgtatgtatgcgctgtttgtgtcttactctttgcatcctctggaccagagcctgccaggctcctctgttcatggaatttcccaggcaagaatactggagtgggttgccatttcctactccaaaaaattaacaaaacttagttctttgttag

SEQ ID NO: 24987 - DNA, 1863 bp, Bovine  19866881328384
ggtatacatgtgtcccctccctcctgaatccccttcctctccccgcccaccccactcctctaggttgtcacagagtactgggttgagctccctgtatcacacagcaaatccccactcgctatctgttttacatatgataatgtatatgtttccatactattccctcaattcgtcccactggctcttaaaaataatagatcattggttagagtaatacaatcaaatagcatgaactaataagcttcctacacaatatgctgttacataaaacctggaggaagtaattctagcagcaactctgtatcttagaaatagttttatctagtggtagaagcaaaatctgaattaatttaaataaaaaactgaactaagcaataactgaacaataattttctctccatcatgtaagacttggacaatattccctttaaagaggattatgtaagtgaactatagtttctaaaaggagaattatgttttcacaaagatgttttctaaggaaactaaaattttagtaggcaattatttaaatactttttcttaattttaaatctctttgagtttgtgttgcctgatatttacagtttagctcccagatttgcacattctagactaagtactgtttttctaaaatcaccaatagctttcttgttaaaataagatgtgttgttattaaaattccctgctcatgcttgtaccatcatttccaagcttactccaacagaggattcaagggtagtgacagacagaggtcatggctttctaggaaaagtttatacaaaacttcagaggacttcaaaatccctatgggtcattcatttgccattgaaatgaagaatccgagcaattcataggtcacaatacacacaagttgtttcaaggaccttctctagaattttggttatggtccagattcttatgtgtaatctttacctggatacacagacccccaagagaaccgtgaataaaattcagaggatcagtgaatgcagattataaaatgtaacatttttattgtcactgacctctaaattaaatttatcatttcctgaaattatgaggcaacaaaccacaatggtattaaaatgccaccaatagtaatcatagatatttccatatcacaatatggttgatgtagatattctaaaatacatgcttcatttatgttcatatctcctttaaagtaaggtagttatgtatgctgatatagtagggagtccctaaagaaagagaagcaggaatgactttcttgacataagaaaagtcattttagacctaagccatttcatgatctaagtctggccacaacgcttgcctttgtactggtcttagtaattaacaatcttaagggaacaaaggaatgcaggaacaaaagaaaagcactcaagaaataatagtgcagaggtaaaacagaatcccggtttctcctcgaaggacatatatagcaatctgatacaaatcttcgagttctgcaggagcaaaagcccacaccatgtggaggatggagactacaggctgagactgcagactggtcaggtggaacctaagaaatgattggtgttgaacttttctgacccttgtgacatcaatcaactaaagtttggactccgctacttccgcttcttgactgcactaaagcccttgactgtatagatcacaataaactatggaaaattcttaaagagatgcaaataccaaaccaccttacctgtctcctaagaaaccctgtatgcaggtcaagaagcaacagttaggatcggacatggaacaacagactggctcaaaattggagaaagactgtatattgtcacaaggtacatcatgcaaaatgcagggcctggatgaatcacaagctggaatcaa

SEQ ID NO: 24988 - DNA, 877 bp, Bovine  19866881472011
actgatgacttgtgttacttagaatgagaagagagtctcctttcggtctggtatttcatttatcatcatgtatcttggaagatgtttctttattctgctttgtcagaaacatccacaaatcaaataactattgatatactcttggtgacttatgtctagaaatacattttaaaggttactgaagaaattaaccttggtaacaattgtttttgccatgctaatgggtcttaaggaatgatttaattgtacatgtctttggaaggcttctcaatgtcattgctggtcaaacaggaaaagggacaaggttctaaggtcaaacaccagaaacagcgtgttcctgtcatgctcagagttcaagaatttttggagctcagcttttttcttaactttgattagaatagggattgtgagtttatggaccttcttccacatcccctcccctttgcctgttgtctgctttgcccttgcttatgctgccttactgcttcctgagttctcctcataagccctttagtatgtggcagaggaatgcaagagcatttatagccaggctcataaacttcctgcctgtgtcactgctgcagatttaggtgtgctgattgatcttttccctagagtgcaaggctctgtacctgtccaactagttctgtctgccctcattggcatcttctcagccctcaccctagtgcaaatcaggtgtgcgtgtgccgcctgatgcagtgtcacagtgggcagaccctcatctgccttggaaggtgtaccagccaggtgtggtctcaggcttctgaccttgtttcttagtttagaaagtcgcatggactctatggtgtttattctaaaatttgggacaaagaaaagttcttcttctcatcaggtc

SEQ ID NO: 24989 - DNA, 1127 bp, Bovine  19866881721735
agctacaagaaaaaattactaaagaagtaaagggatgatggcaatgtcccattaaatagagaatatcagtaaagagacagaaattagaaaaaagaaccaatggaatagaaaaatacaataactgacatcaaaagatcactgtaggggctcaaaagtgacttgaactggcagaggaaaataatagtgaacttgaaaatagattggcaatgattatacaagatgaacagagatggggaaaaaaagaatgaagaaaaatgaatggagcctcagagaaatgtgggtaccattaacacactaacacattcactgatggaaatactagcaggagaggagagagaaaagaaaatatattcaaggaaataatgactgaacactttccaaatttactgaaaaataataacccatatatacagggagcaaaatgaactctaagcaagaaaacacaaatacattacagtaaaaatgttgaaagtcaaaaaactaagagaaaaattttaaatcaacaagaaaaaaattttctttgagatgttcaggcaacagactaccacaggggccaatgacacagaacaagttgaagaacctcaggtacagcatctagaataaaacaactggccacaggacacagtggggatggggaggaaatcccaggtttcaacctgcttttatcaaaatgctgcagaagataaagtgtccatagtcaaaaacaaaaggcgggggggtcggttaaacaaaattaagtcaattttattactacaagacttgtcataaattttaaaatgtcaattgtgactctcaagatattgataaaacttacatcatttcccaaattcctttaaccataaaaaaaaattgtggagtacctctcaaggctcaaggtttgaagagcactttcagaaacactgacctggtagttagtaaaagtgaggggtactgataactgctggggtcaattgacatctctgtttcctatgtctatactactaagagaaagatactactttctcttaagggcatccataatagacaactacccatattttcaaggacatcctaggtcaaaagctgtctgagtttcctagtaatgctgcttgctaaggcccccaaatttaagccaccctgaggggtga

SEQ ID NO: 24990 - DNA, 1091 bp, Bovine  19866882021889
tgtataataactgttattgctaatcgtgatgtataaaatgcttggtttagtactggtaactttatttaggatgctgttttcataattttgttttacaaacgtgaaggtatttttttagcttcctcacagatttagctgtgacattgctttctcagctctgtttttctcttatggctttaatttattgactgtaaattacaccacaggaatttttctcaacctgagccctgtggtttgggagaaactattacatgtttcaagaaaaatcgggacaaatttgtataaagggattttaaaagagtaaagctggacattcctaaagcaattttggctgatttccagtaccataaagtaatgcaatttaaaatcaacatgtctaacctaccagtgaactttcaaaatgaaaatttccacctgtttggcaatgagacaatctctcccctcccaaaattcaagcattcttatcttagaagctgagattctctgctaagagcctggagtaacctcctttaagtcctggcatataaatgtgaggatagatacacctttatgtaaccctgggtcccaggactcaccagcccttgaatctaactgatctcatagccaaattaatgaccacattccacagctctgagtcacatctccatctctcttccaatagcattgagggattcctgggggatatggtcctcagatacaagtatgctgacgttttctgctttggtctcctcacccagaagctctgtcacagctgctgttcctaagggtacttctttccatgtggccagcaccatctgtactctcttcccttacatgtgctcaggtttcacttaaacaccacgtacacagagatggcttccctgctccttccctatgactgcgtgaaagctctgtattctccgccctcccctcaaccccaccatagccttctgtatttcttccttgcagacttgcattattgtaatcatttaagagattgctgtctttcttcaattttaagacatgctctgccacaacattgttaaaaattttgatagttcttagaattgaaaaaaaatcatttttttttcccccctgagggatgggatggg

SEQ ID NO: 24991 - DNA, 4588 bp, Bovine  19866880527715
tgttaccgtggtggtggtgggtggtttagtggcacagttggtattggctggtgagtgaccctgctttgttgtgaagtagcaatatcatatccagagaactgctacatgtttgttttctaaaagtgtggtggataattaagatggattattctggcattttgtgctggtcattagaaaaatagtatctgaaagcagataggagagtggaccttaaaaatcaatggatctggtaatttgcatcaattgcttctggtcaaatacagatgaaaagataagtaataacagaattaggaaaagttaatgggaaaaagatgaagaaacttattgcaaatatgtcatcaacttttcttctgtgagcttgtaggcagactggagttaataattgtcagctgctaggacaagctcaatatcttaactgacaaaagggagatcctttacaattcctagctggaccataaataacatggtgcagctgaaagaacagaaaaaagagcagggaggtaccccagggaaaatgttgacatttaaaccactctgttaaagaactacctacatgtacttaacatgtcctgctctggtacatacaccttccgatcaaattttgaagatgacgtaaaagtccctttctccccactgacagtgcttttttcagtgctgttagaacagcagggctcattagcaaactgcataataatggaaaatgaagccttttgaactaccaaaaggacttttagcaatcctttctacaaatttctgacaaactaaagagtttttctaatatcccatttgtgtcaagagagtatttttctcattatgaagctatagatatacagtttcatagcaaatggattggagaacggaccctgaactaagtaataccttattcctcacttgtcacttcatcaaaataaaagtgtttttcttattgcagcagaaataggcattcatcacttgaaattttaaaaatacagataagtgaaaggaagaaaatatttaataaaaatcgctaataattccatcaattagaaaaagatttctattcaaatttcacttttgagttgtaaaagttctaatcatactaatctgaagtaaataccaagatttctcttaaaaaggaaactgctttagtgttttgaggttttagagataccggatgcatattaagatatattgcataagcaaaccacagtcatttcaaaatagcttatgccatttataaaagcacatgcattaatttacatggattttaaaaatacagtttcgcatgcttcttcttgatctttgagtctttaatgcctctatgtgaattctttacctaatctctggtgtgtccctgaagatgattcattattttccttccaaaccctgatgttacataattgtaacctttatttgaaaaggaaaagtaaggccatgaggactgcatggaaagagaccgcgtttgtcttgtaatcccaccaatgaaggcggcctttgtgctccgcgcggggaagtcagaaggcaaatggcaggatggccctctggattttaactgatagacacttgtgactcattgagtacctggcccagcctcattcctctttctgctttccctttctcatactctttctagcttctcagtttggatccagagacatctctcaaagcttttcttctctattctgttccagtttttcacgagccccatttagtaagtatattcctctctggagatgttaactgtttctcacccaaaacaattacattggaaatgtcatcataccttgtcttcagtcagatcctcctggcctctgtagcatgttttgataaataattgtactaaaacaatatttgaatcagtaatctaacacttgtaattgattccaccttcatagcttggttttacttttttctttttctaaattttttttggctgcaccccagctcgcgggatcatagttccccaaccacaggccgttgtactccaacccaggcccttggcagtgagagcatgaagtcttaaccactagaccaccaggaagttccctggttttattttttatttacattttttagaaaccctagaaaaatttgtaaaaattattacattttattgacttgttcattaataaaatttcactgttaaaaacagaaatgtctgagacaaatagttaattttaaggtctatactttctttttacaaatactattttttcctatggctttaagatagaaaacagtggatcctacatgccagtctagcacaggaacattttcttgattctctggttatcaatttgctatctgtggttctgtttttaagttttttctcctacatttgatattttatatttatttaatattgaatggcaatgagtagctctcagagacattcttattaatacccctatattagcctaataatgcttacaggactatttggagtgagatgctgttttatattaagtacactgctggtatcacatctgtctctgattcatgtgatgggatgtgccctctcctttgtttccatagcaccttctacatacatttcttagaagaattctttcaatatgtgttcacttgtcattctcaaaagattgaattccttaagagcagtgcatggcatatataatgctagctgagtaagtgaaagaaggaattaatgaaatgtaaagagtcaactcattagaaaagactctgatgctgggaaagattgaaagcaaaagaagagagcagcagaggatgagatggttagatagcatcactgactcaatggtcatgaatctaagcaaactctgggagatggtgaaggacagagaagcctggtgtgctgcagtccacggtgtcacaaccagttggacacgacttagcgattgaacaacaaagctagctatatgaggtaccaacctgttttagctaagagcatgaactctgaaaccaaaaccatgtggattcaaatctcaactccatcatttagtacagtatgtccatggacagggcttccctggtggcttagctggtaaggaattgcatgcaatgtgggagacctgggttcgatccctgggttgggaagatatgtttatgacatttgtgcatctcagttttgtcatttcaaatatgggataattactgtacctaactcatacatttgtgcttagaacagtatataagtaattgtatctctatacagtatctctatacagtaactgctgtatatgtgtttgctactattgctattatccttttatttaatagccctggcgtggaatagcaggtgccattaggaaattgattctggaattcaggttttctcctgtcatcatgaagaagtattttctttccactttgggttcaggagctttcagtatggaaagaggcacaggcggtctttagtacatcaaaaactgaggacatttgtacctttatcaatcatcaggctgcacagactggccagaactaacaaggaactttttatttcaatcagaattgtatcaacttagcataggaacaggagaaggaaatggcaacccactccattgttcttgcctggagaatcccagggatgggagcctggtgggctgccgtctatggggtcgcacagagtcggacatgactgacgtgacttagtggcagcagctgtgcaattggttgctggagtgaaagtgaaagttgctcagtagtgtcctactttttgtgaccccatggactatacagtccatggcattctcaaggccagaatacgggagtgggtaacccttcccttctccaggggattttcccaacccagagatcgaattcaggtctcccccattgcaggcagattctttaccagctgagccaccagggaagcccaagaatactggagtaggtagcctatcccttctccagctgatcttcccgacccaggaaacaaaccagggtctcctgcattgcaggcagattctttaccaactgagcgatcagggaagccctgaaggttgctcagtcgtgtctgacactttgagaccccatggactatatagtccgtggaattctccagccagaatactggagtgggtagcctttctcttctcccggggatcttcccaacccagggatcaaacccaggtctcccacattgcaggcaggttctttaccagctgagccacagctggtgtgtggcaaaatccactttattgaatctctctgaaattaaaaaaatatattttcaatctgcagttgattgaatctgttggacccccacaaagagaggaccagctgcaaaaaacaatatttatttgtgtattgattggttggtttttaaagagtatgtgtttattcttttttttataattttttttatgactgtgctgggcattcattgctgcagggcttttctctaattgttgcaagcagggactactctttggttgtgatacacaggcttctcatcgtggtggctctcttgttggggagcatgggctctggggcacgcaggcttcattagttgtggcccgtgggctcagtaactgtggctcccaggctctagagcacaggcccagtagtttaggtgcacaggtttagttgctggcggcatgtgggatcttcctggatcagggactgaacc

SEQ ID NO: 24992 - DNA, 1072 bp, Bovine  19866880570280
gaatgggcagggcctgtgatgtgtgcaaagtggctctgaagaaaggagtgtgaggtcgtgtgaagagagaagaacatgtgcatgatagtggggacagagctatagagcaggaggagaacactggtgtgtgcggggtgtgtagaggacaggggtgggaaggcagggagtggagtaaggacttgcaggcttcaatctggcagttgcattggattccaaagacatttaggagccactcaagcaaggcaaatggcaacccactccagtgttcttgcctggagaatcccaggggcaggggagcctggtgggacacgactgaagcgacttagcagcagcagcaagcaaggcctctactaggagggatgatacaaactaaggctctcctattggcatgagacaaatggtgtaaggatactgctcgagtgtgtccactcaggtgcctagccataagagaattacccttgccacaatcctgcaatttctttgaagttttgttttttactttaaaaattcagagatttgtgcattgcataggatcttcgcttcttttaattctcaaaattggtgtttttagtaaagtttatggttccagggagatgtgccatgtttatcctgtggcttctggaagacactcgcactgccctccttggatcaatccaggagcaaggtaattaacaaatagggcatttgaaatgtgaggaccaaggggctttaggagggcttcaccctcagtaggcaggccttcgttactctccttccagaccttgtaggccccaaattcttttcttggggtctttgaaagttcattgaccatgctctagtgcttactgcttccccatctttttttcctcttcccttggcttaaaatatcccacctctttcttactgcttttttcaagcaactttttggagacataatttagatattgtacaattctcccatttacagtgttcaattcagtgtttagtacattcacagagttgtgcaactgttgccaccctctagttttggaaatttttgttactcctaaaccaatctgtgcctattatcagttactcattctcctgcccccac

SEQ ID NO: 24993 - DNA, 1124 bp, Bovine  19866880625615
caagcaaagaccccacaaagagaagcccacgcatcgcaactacagagtagcctctgctcactgcaactagagtaagcctgcacacagcagtgaagaaccagccagccaaaaataaatgaataaacagtcaaaatggatcaaagataaaattttaagtattaaaacagtaactattaaaataaaacatatgtgtaaatctttgtgatacgagattaggtttctttgctataacaccaaagacacaaaatgacaaaagaaaaaaaaggtaagcttcatcaaaactctttggaaaacagcctggaagtcgctcagaagtaacctcaaaaagttaaacacagagttactttacaacccagcaattctactcctaaggcatttaactaagagaaataaaacttacagtcatgtaagagttcacacaacaatgtacatagcagctcattcataaagtcccttgcaaaggaagcagcccaatgttcatcaactgatgaatggacaaacaaaatgtggtataaccttataacggaatattattcagccataaaaaaattaagtactgatttaggctaaacattgatgtatcttgaaaacattgtgctaaattaaagaagttagacacagaggccatatattgtaacatttcattcatatgaaatgtccagaagaggcaagcccaaagagaaagacagtagactgctggttgtcagaaactggagagagtggattggggagtaactactagtagacatggatttttttaggggttgatgaaagtgttctagaattagagtgtggtgatgcttgtacaacctagtgaatatactaaaaactactaaattgtatgctgcaaaagggtgaattttaatgaaatggaaattatatcttaattaaaaatttaattttgagtcaggcatgttaaattttgttatatttaaattctgtgatcagtcaggaatatgaagttcatataatatttgcaagcttatgaaaaatgaatgaaatttttgaaaacaaactagaaaattccctaccttagaagattttctagttctgtaattctttcagttagatcccagttgcctctttcaagactctgaatactggtgtttttcaaagatttaatt

SEQ ID NO: 24994 - DNA, 1114 bp, Bovine  19866880652457
attatcaagaaattaagtgaaaataaaggactttgatgacttattcaaagagagagaaatccaccaactaaagctgtatgcagaagaacataataagttgcgccaggttctccaacaaaaaatggccctgcaatcccaactgaaagaaatggatgaaaaggattttaaggacaaactagaaaattctttacatgttttaaatcagataaaatctcagttacaacagccattgcttataaatttgcaaattgaatatattcaaaatgaaaaagataattgtgaagtgtttcaggaaaaagttcaggcagaaatggatagcattaaagctgtgactgtcattgagaagcaaagtgaggaaaattcttctgaagctagtgatgtggaagcaaaattaaatgacattgaagatctttacatgcagcttaatgcaagcattgattcccgcactgtaagttttttaattaggcagttaatgtatttgttttattttcatgtttttaaaacataaaaaccctattttatgttttactctagttaatatctacatttctcaagaagtaacaggttcttatggctgacccacgttattgtttgatagaaaccaacacaatactgtagagccattatccttcaatgaaaaataaacacatttaaaaaacggaagttacaggttctataagaacattctacacaggagaatagtcattttaaagaacttcaaagggccagtttatagccccaactcattccacatcaaaatgtagtgcctgtagtggaaaaagatgtttgacactgtgagttctatatgccttgtagaatctgttgggctcagaaccaaaaagtttgggttttggtttgtttggggtttttttagagataacagaatgtagtggaataaatatggtgtaaagaacacaaaacaataactccacatttctttagcacttacagtgtctagtaggtatgctgaacactttcatcctcacagcaactctgtgaggtgggtgctaatattagcctcattttaaaacaaggaaattgaagtttagaaactaccattttctcaagatctttcagtagtaacagaaccaggattcatgttgagatctgtctc

SEQ ID NO: 24995 - DNA, 1379 bp, Bovine  19866880661668
ctttcaataacacagctgtttctagatttgtcttttaacattttctgtaggtattatcatattgccatccaagaaatctgaatcaatttatgtgtttccagcaatatatgaatattcattactgttatcttttaaaaacttttgcctgcattacgagtgaaaacactgtcttcttgctgtatacaattagatttctgaaatgatcaatgaggttatttttaatatatgtaagagggatttttttctctcttgaaacttaacatctccatgtgtttgattattttttcctatatgtatatttgttttttaattgtttataatcaagggtgcattttaattgacccagtctctccagaaattttcttgactagctcaattaagctcagttgagttttgattgacatatgttgagcaccagtgtagtgctctgtaagcatggtgggggtggtgaatagatgcctgccttcagtagtccactgaaagaaaaccaaagtgtagccccggatgccaaatggcattgttcagggacttgtgcggtgctcattttaccacaagtaaactgttaccgttaaatgatactttttagatcttgttttggctgaaggttttgtctcagtgctgctaacttatgattccgtacacattaacaatgattatgtcttccttagattgaggagcttgcccggactcttcctggcaattacagtcagccttccctggacagtgtgagtgcagttgactcctctcctacctcaagtcctccagccaagaaatgctccaaagtccaagaaagatggcggatgtctgcaaagaaggctcttctccagtgggctcaggagcagtgtgcctcgtaagtagcttgctgtgaccaggggagacacacagggtagctgtacccaccaacataaccttactgacctccaggtctgaaaatctggccaaataggtgtgacagctacctgaaaacttccctgtcagaagaagaaaatgctcactctctccttctcgcattgaatttttcacatgtagatgtctgcgagctcagccactcttggttttaaagaccagaaggtggtatcacctgagtaacttatctcactcccatgcccatgtataggtggcccgttatggtatacaaataaagtagtcttcaaatatccttttcgttaggcacaattcccttatgcatctggaaggtggatttagattttaaaaagttttaccatgctaggagttctttaaaagtcaagactgttttagttgactgtgtattctcttaattttagccttatatgtgttcacggtatagttggcaataaagttaggaaggacttacggttgaaaatgtcaggggtaggaagaggatttcctttatctga

SEQ ID NO: 24996 - DNA, 1378 bp, Bovine  19866880763228
tgtgtggtttgtcttgctaaggtatcgtggccaaatcatttttgacaagataaagtgttaccattactataagatcattgttgtccatttggcaaatcttaattacattcagtgtcctgagatgcttggtgaatatgacttttgaatgtatggaaatgttttaagtattgacttagagcaaactatttatataatagcaaaagtttgccctaatttcatttttgagtagatatttgtacataaaactttatttaacaaacaaaatatgatcatttaattcctcaaaggcagtttacaggcatatctgcttttggttaattatagatgtctcaaccctatatttgatttcacagataaatgaataagtagaagcaaaacactgcaaacaattgagtataaatgtgcactaagataacaactttaataattaaacttatgccttcaactcttcctgacaagaatgtcttatccatttctcatagttacattgattggtccagtaacctgaaataagtgttctgagattgttagtctgtatttaaaatctttccaattttgtcagagggagtaaccaaatcacacacatacctttttctgtggaataaatatggctattccggcctctgaaaaaatccatgttctatttttgctaataatttccccttctgtgttcacatagcttttatagcagtgttttcataaacaatatattatcatacatctagaattggttatgtatgtttcacagacagttgtgagacttcttgacaccttcagtgttcatcatcactgattgtatcattgtaaatgagtagtagagaatgtagaagcttggaaaaatgttggctttgaaaacgtaaagcaaaagtgttatactagttggcaatgtcaagaggcccaaataatgaatttaagttagagttttataaagtaatataagttctccttttaatgcattttaatataattttctttagcatcccttaacaccctctaagccaatagttctccataattattttaaagtcaatgtcctttctctgtaattttaccatcctccattctcctaataagcacagcttgtaagttgaaatgattttagagcactgtgagcaaaaatctaataccaaaaaaaaaaaccctcttgtcattttgaagagacgggcacactaggtaattgacagagaatgaccaggaccatggacatggaagtaggtcaaacagattgaattaagtattttgaatgcactgtaaatgagatttttgaagtcaatatgccatttttggttgcatccaatatggacttttaaagatagaggcagcatagaaaggatatgtaatactgctttgttcagccttgcgaatacaaatgaaagtg

SEQ ID NO: 24997 - DNA, 4530 bp, Bovine  19866880771148
aattctttaaaaatattttaccttgcagatgatgtctgagttgtatctttatcatgctggcaatactggggccatgttttgttagcattaaattctatgaatttgattaaatctttctgttccattggttttaactccaaaacctataattgaataagattcaaatggtccaattaatcaaggttttcatttagtacacaaggatttcttctgttgagatcatcagatttgaaaccacttcctaaatcattatttactatctcttgttcttgttaatatttatttttcaaaaacttatttaaaatatttagacaatgaccaagcattttttaacataatactacacacaaggaaaatcaccaaaaaaatacaaacacattttgaaacagggaaacaagtgttgcagttgcagaggtatatccctgcttggtttaagatgcatgttaacaaagcagccaagttcaagtatccccagtggtagcagatgaaagcaaagtagatagtgcagcaaatgctcaaaactcaaaactgctgtacacacaggaacgcctacacatcacactttctattcagtcatgtaagaaagcactccagtggcctttgggtatttattacagcttagtgggaaattccatatagaaaactttattcttgtccttataactattgggggctgaaaatacctgttgctgctggaaatctttttgtctactgaattgtggcctttcggtaacaacagattcaaattcagaaaggttatctggttggagaactttctgatgctctgaagatttctttagtgtggtagaatgctgcaaaacattttatgatggcagactatttaaaatggtgatccatttcaattctaataatgtaactacacaatggaaaagttatatatgaagtaaatgactgtattttgttaattacaatgattacatactacaatttaatgtacttatttcataactacttcaaaaaccactacatttaatgaagtggtcattttatcatttcctcaatttaattcatccaatgaattactaaaagccagaaaatctattgcccttttttcttgagaacaaagtgaaataaatatcaaaaacagacatagtattaagcttatgaactcaaatttcccctatgtccaaaacataagtatattttttaagagagagaacatattaggataaaaggggttccatacagcctgtatatctgcagccaatcttacttctgtaaatagaagtcctttaagtagaaaccaccatctcattaagaatggctgtgaattttacatagtaagattctactcataggatgcacatttgcacttatatacacagaatgcttttaaaagtcataagcatactttaactatatgatacttggatcagtatatataaatatttgtaaatggaaaacaaaagtacctgtgaaacagggttttttgtgtttcctgatgttaaattttaagcatgtctataaaggcttcatttttctagtcaaccatgattacacagttcctttcaaatacgaagttcctttaaaatttatgatgaaaggttgcacagatctcattaccagcaagaacaacaaccaacccagtcaaaccaaacctaatcaaagcaacacgatcactaacaacaacctagatgagcaaactacacagcaaaatgaaaccaatgacaaaagccagggtacccaccccttaaagctttaagaggcacaattctttttcacttactgtaattcctctgtagttgtttctttacctgcacccagagctccttcctgatacatatgcctgtatttacatacatgtctacacacagtcatattttacctggtcctcactgtatttctcctgaagcatcatttggactttttccaattgcatttcacagttttcagtttcaaggaaagtgcttcagcctcctgttgagtggctccactgtctcccaggccctgatctttgcaattctctaacagagaggccaccttctgctcaatctctgttagcatagcctagaaagtaaaatcatttcattaatcacagttttggtctcaaacacacattacactctaaaataagttagattcactgtctctacacctaagtgtatttaagaagttccagaaacacaggttgatagggaccttgtcgggggagaaaaaaaacaacttccacataattctgatgtttttcagtaggggttcagccaaaccaactccaaattgggtgtgaataaataaactaaattggttgtatcacaatctaaaacaagtgatgctatattccccttagaacgcagagctgaacacatccagtacagcacagtggttaggaccacagacactagaactagaacttcatagctgggaaaatttgggcactttacgttgcatgggtgtacctctagttatctgtaaaatggggataataacagaacttacctccggggtcactttgagaagctagagttaaatccatatactttggccagtgcttgatatgtagtctgtgcctactattattacttcccaccttattcctaaactttttctgttgcaatccaagtgttgagtagtaatttaaaaaaatacttccacagaacccttgggaaattctttcctttgctcttttcttgtctttctaaagccaaataagctccccaaatatcagaagacgattacaggaagacataacttggaacctaaaacacttagtcattgataccactggtcaacttacacccatgtctaaaaataagtcaggaggatgaagtaagtttcccagtaagtcatcatcattgttttcctcctcaagagatcaagtttgctctctccttgagctatggagccgcaaaagtcatgccaattggctgggcacacgagtgtagcagcagcagaatgtagagtcagacacattctaacactgcaattgcttgcgctaaaatcgtgggtgctaagaacaagttcaatcctttgagagaaacttaaaaaacttaaaacagattttcaataacagttataatttctcatccaagtaaactacttatatcctctgaatacagactcttttaagcttaaacaacgtgtacttataaagtggctgaaaacaaagtgtactataattttgtgctttttgtccacttagctattttatgtatacattttcatgggtctacatatatatgtttcatgatatctattttaatagctgcatattagtactctatgattctcttcatctccttattgttaagcctttaaactgtttctggtgcttcatttttataatcaatgcagccataaatattcttctccttttagggttactttcagaagataaatttaaagtaatgggattaataggtcaaagaagatagacattttatctgctaacagctgacttccacaaatactgaaccaatcaggcaaacattagtggatctatttctccagagttttcccggaaatgtaatttttgtcaagataatgtaggaacaaaacagctgttttgactcatgcatctttaataatcaaggctgaacatttcttctcaatattaagttacggaatacaattttttcttgactgatctgtttgctcctgtccttgcatatttcccctctgggaacttaatgtttttacagagcactgtaaagctttttatgtttcagtgttaaagtctatacgccatggtgttatataaatgagccagagttggcccgtgtatatggatctatatgttgtttatttcttcacagcagaaatattagttcatatttcaccagtgccagactcaaaactggaccccccacatctagtcatggttaagacaaactctggagctctaaagactccagcctctgcttccttcagattctctgacatcatcttgacacaccacccctctggtttctctaacccctaggagttcccttgtctcctccccttctgggtggtggctccacccccactccttgccaaagcctctggaagatctggcatgagacttcccagtccctccagaccccacctaaacgctgcccaagtaatgctcactgcgcgcgactgccaccttgtggtcgtgtcttttccttgagcagcccccacatttttaaattcacaagaggcccaaggaccagattccggtaatgatcaaggacttggctgtggggtctactcagtcagcaggaccatcagtcggcagatggcgcctgaaaggccctaagtggccgggtctcaacatctggaataccgaggttcaggttagaggaacactgctctgcgccacttacactgtcttctccagaccctcctgcacgtcttaccagtcaggccacatggtagtgcctgtatctgaatgaatccaaccctcgggagctgacttttggggtgagaggtgctgagttgcctgaggaaggaagtcagcttgcctggctgggtcctactaggcagactccggatgtagtaagagtgggggtctgaatgaaaggggaggagcgccggcctcgggccaag

SEQ ID NO: 24998 - DNA, 1649 bp, Bovine  19866880785502
atcccatttagattcctctttaattttcttttttaattctgatctttaaaaaggcaactcatatgtgagtttactgtcagacatcaatttctagtcatctgattgcttcctagttttcagatttttcagatattgttatatctcagtggcaaagattttgcaatccccctttttgtcacctgagataaaaatctgttaacagtgattgattgattaattaatctgcaataagagattttccatttgctttccctatttactcaaaaacattatttgagcacctacaactgccacagatgtttaaaaaaaaaaaaacgacaaagttgagtttctttgttttctctgctgctgctaagtcacatcagtcgtgtccaactctgtgtgactccatagatggcagcccaccaggctcccctgtccccgggattctccaggcaagaacactggagtgggttgccatttccttctccaatgcatgaaagtgaaaagtgaaagtgaagtcgctcagtcgtgtctgactcttagcgaccccatggactgcagcctaccaggctcctccgttcatgggattttctgggcaagagtactggaatgagtcgccagtgccttctccactaagtcactgaattaatgaggaaatatggaagctggagtactaatcttggttttatttgctagttatttgaacttggaaagaatccaaaagtaatggaagacaaaaagattatctgtaacagtagaatttcaatagttgaaggtggtctgggaaacgtgccaggaatcagttcacatcttttttatagccaaagaaatccaagtgtgtttaatgtttaatcagtttcacacccctcccatcccaccacattgcttctgagaaactcaggcccagacataaattacttgcccaaggtcacaaagtttcaagattttttaattctgagtctacattttttcccacagtagtctgcctgctgagtatcttcttcaaatgataaccccacattttaaaagcagaaattattttaatcaaagttttataactgtatattttggagggctaaaaaaacatgaccacaaatatgtcttgttagagaattatgtcatctagagtctaaagcataaatataaattaataatacccaatcttttactgggttctagagctaagctactgtgctaagactatctcatattttatgccacaaatccattattcccagtgtacagatgaggaaactgaggcttagagaagttattcaaactgcctatggtcactggattcaatcctagacccaggattcaatctctgatttcattatgccttggggtctacaagtccacatttttgacataattctggcattcaagttagcctctcagtcaatgaatgtggcagtgcttgatttctgtacaacacatcgctgatttgagtaccaagatccagttaaaatgcaaatgagttttctggctgtagcagtatttcatgccaaaataccaaacctttaaatacttttccatcaattctacaaatatctgcacacaccacccccttgtataaaatgcaaaactgcctggctaaagtgcctagcatgctaagtcgcttcagttgtgtctgactctttgcgatcccatggactgtagcccaccag

SEQ ID NO: 24999 - DNA, 766 bp, Bovine  19866880910852
atgccctaaacatatctaccatttgacacgattctgcagtcatgtgattcttcagtcacatttcttctttattgaacttgttaaagtgatatattttatatactgttcagatcacacagtatttgaatcttcaggtggggtaattgagtccccccaaaaagaatggctgcttaaagcatggccatttgtggtatattttattctctttttgaaagcctttagttcatgaactctcaaaaagatgaacagaaggccatggagctccagtatcacacagcggggaaaacacttaactagcaggactcttctatatgcccctgtcaagcaggtgggtctgttcacccctgtgaaggcttagtactttaccaaaggcacaaagtaaatatcagagatgttctggatattcaagataatgagctgataatgaactcctgagggctggaaacaacgtgaacttttatcacaaggctctgcttgcttctgttgtagatgcacatgaaaattgtttctgatgaaaacttctcttgttctagtttgttctatcacaattcaaggattttggggaccggttggaatctttaaaaggtctcattacacatgaagaagagaatttggataaactctaccggcaagaaaaagaaggaaatcctgacttattcctggtattgccaatgtttgttatttctaggggctcaggctcaccataggataaaaaataagtgactcactgtcatatgatagaatccgtgtgcatcctaacccttga

SEQ ID NO: 25000 - DNA, 3259 bp, Bovine  19866880955972
cccacttcttgtttctttttcagttctgtgagcattaatctcagatcctccttactttgcaaatacttctcgccttctagtagaagcttttcctgatggctaaattttacaaaatagtttataaatgaaatgacacagcaaaacaaaacagcattttgcaacatataatacaacatgcattattataaaaagcattaaaataacactactgtacattattcccagagacttctttggcattgtaacattctaaatggccctaagtttaactcagaaatcaagataaaaattagttgtagtatgattttaaaaaactattgtttccattatataatttgatctgaggacaaaagtttaataatttagatttcaaactagtccagtttttattatgtttaaatataattattctgtgtttttctttttcatttaagtaaaacaaataagcatgcagtatattggccagctaactagcttatgcttcctacagcttgattttaattttgatctgactgcttccttataaaaatatgaaatttacatttccactgaacattaaatgtatcatgatttgatttgatgtgaaaggagttaagaattttcaccagaactatgttcacttaattcatacatttataaatgtttctcatagcatatatatttaaaagcataaactatcctacagtaaagtaaacactgaggttgtctcggggcaggaggtttggtacagaaggactttattgaaggtagaaagatagacaatgttaatttgttaccaatggtgggttgatgcaccagtcaaagtaaacaaggagttattacagcatgtttcatatctgatccagagaactagtctctgtttctgcctcaacactgtggttgtccctgacattactttctctccaacagatatattatatctacatccagaaggcagacaaaacatacttgttatggcttctctgtgcaatgaaaaatcatgaaaatggtgaaggcatgccctttaccttagatacgtgttggccaaatgggagccgtgttgtcccactggttcttgatatcagtgagggtctgtggaaccactggagtcttgctgctctcagcctgactcatgatggcctgtattttagcatccccttcaggttttagtaaaatgatttcctaaattaaataaaaatgatcttaaaatcccattcatactacttggggattacatatgatatctttttactcataaacatcattcagagattctaactgcggagtagatttcaaaatttccctttcacttttacatatgccccaagcacaaagatatccttcacattgcatagaactgcttctcagtaaacatctgtcacgttacctactctcctctcgattctcaattgcactcaaagaaattatgtacaaaaaaaactccctggcaaatcctcctcccaacctgcaccattatttataaataaaaagttggggtgacaacctgaacaagacgtctttatacatctaagagtgggtttccggcttcctataggaaaatgcacagtgtcacaggcccactcctgtttctccagcacaacataattaattctcattccctgtactttgattttcctcttttgccctaaacaatcaagttcttctcttcttagaaacactacttcagattcaccttctctggaaaacctttcagatgtgatcccaaacacttctgactacttctgtacgtcaaactaacccttgaaacttgaccattatcttcctccacagttagtatctgataaaccaggaaacactcaacccactcaggatctaataccctttaggatccatacatatccactctgaaaatgagctcctctccagccctgactttgacattgccaatgcctctgatgtactgatatctattcgtttaacatcctagcaaactcctacctgctgcagttctaatttatagtctttatttcatatctgcagtcaatgaagatggataataactgggcactgctctcacaaagagaggatatacctttcctttctatatgcgttaaaataattttagattcatcacaggccttctcttttgtaagctcagtcatctgaatttctcacccaatccacactgatcctattttccattaacaaacaaatatttgcaactttcctctaaatcttattaaaattggagttcatcctgacctctgacatttagtttccatagttatacctttattttatggattctttcctcaagtggcattttgccttcagatgaattcaaaaccataagggattctttaattcctgttatccaatgaattacatcatgtgcaagatcattaaaactctggtcctcggcaggaggtaacttatcctctttgtcagtttcacatatttgtctcaataatgtctggtatctatcaatcagatgtgttgattccgttactatttcttcttcctcagtaatcccatattgcttcacagagttgttcaactgggccattgattcgaattgttctctgtaaattccaaatatcattggaagattataggagccatgacacaccttcagaaaccatatccccaagaaacacattttgtgcaagatcatctatacctctttctagctacagcttggcaaaatagctccgttttctctcgtgttccttccatttctttccatatttcttcttgattagtcaaccacttactcaggtttctgtggtcattatggagtctaaaacaacatcacacatgttaaaatatgaaatcagcaaaaagtgtctatctgaagaaatcgttggcaccaatcttgtaagccaaccaggttttttacattttatttttattctttataaaaaattttgtaacattatttacaaaatgttacaaataacaaatttagaaacaaaattataacattaaaatctgaataataacagcatgtattatagtggaattctaataagccataaatatatatcataagcttcccaggtagctgagtggtaaagaatccgcctgctgatgcaggagacttgcatttgattcctgggtcaggaagatcccctagaggagaaaatggtaacacactctagtattcatgcctggagaattccatggacagaggagcctggagggctacagtccctggggtcacaaagagttgaacaggacttagcgatgagcatgagcatgagatatatcataaaaaataagaaacaaacagaaaatattttggggctctcccctgaac

SEQ ID NO: 25001 - DNA, 1174 bp, Bovine  19866880979370
aacttcctctgtaaaagaagagctaggagatacggctaactccaatggcaaatgatcaaaagatgatttatattagttctagactgtgtgtgcacattggcgtttgcatctgactttccgggaatcacatcaagcaaaatgatgccaccgtgtgggtcagtgggagtcagatcgggaaagccacattctgttcaacttctcctaaatatttgagcctttctggcaaccaatatgtaaaaccaggcagcctattttctacttaactttgtcaaatcagaattttatttcaatgtctgggtttcaaggtttgagtatcaattgctgagacccatggaatgagcaaatttaaagaaaagaaaaaagaactctaaatgaaaaaagcagaagaaaaatgattctgtcgataaagaatggttatcatcaaagcaagaaatatactgagaacatttaatgccatcaataagctggagagcataccttatcacctaaaatacttgataatctaccataaagtgatcaagaattgagggtgccatacacattttaaatgccctattaatgcctcttatctcaggctaccttccactccactcccatcagcagtgtattaaaatatttgagaaaaagtcagatttttttggtaaatattacctttatgtagggaaattactaagtcaaaataactattatcttatctacttatatacagttctgcctccagtattttaattttgataaattttgaatgaaatttatatatgtcttcttacagaaagtttttgtagtttttgttccacacacttctttgtttctgatggttcaaaacactccttaaggttcattttaatgctgccaaaccagtcattaaagttcttgcactgatctgtaggaaaaaacaaaggaagctgtatttattcaaagatgacatcacctaccttgttaaattaagagattctgaaacttgctccccatgccatacatacaagtcactgtgaaatgataataaactaaaacctaattttgagggttaaaagaacctacacagtaattgtggcatattttctataccaaacctcctttccaatcatacaagacccacacagaaacctacaggggcagcccgctcacaggcatgtccccagactctgaccacagtgagcaggtcaaacgctag

SEQ ID NO: 25002 - DNA, 1371 bp, Bovine  19866881029707
aaatatcatttctcaaccatcagactggcaaaaattaaacctcacaccattaagtattgataaggatatgggaccactggaatattaatatgctgctggcttgagtagaaatagataaaatcatttggaattaaaaatttaagatgtgtataacttttgacccggtaatcacaatcctaagtgtacacccaacagaagctcttgaatttgaaaacgttcttcctagaaaaaactgcaacaatccaaatatctaccaatacctgggtgagtgaattttactacagacaaaacacaaatgaacttcagaatcataattgtaagtgtgaaaaaaaaaatgaagtcacagaagagaacacatatgtgaaaataggatacaaatacatagtaaaaatattttttaaagcaaaggcatggtcaataaagacaggataatggttatttctgagaggagagggaaggagtccacgaaggaactaaaaagtcatggtgtttacctttgaacctttcagtacaaaggtgtttatcattattctttataccacatgcagatttctataaacattccattttaagtactggatgttaagaaaaaattaaataaatgcaacagaatatttgctatagttttccttagacagtgatttttattttccatattttccaaattagttctaatgtgtacatgttaattataatctatatttgttcttaaagcgttacctttagaaagaagtacctacctttctacttcagcttcctttactttggctgcctccctcaaggctgagttcttagaaactaagtcctgtaaagtgcactcaagttgtcgtttagcttccaggctggagacggtccccaaattcttggtgaggtcctggatgcctgctattggtggatttcagttcctcttgtttctggcgaggcacctccactgattctttcggattatcaagatctactctatgcgacacaatgatggtttccagatcggagatgatccccatggccctggagactgcttcattatagcgtgtcatattttcataagcatcattcaagacactctggtgaatggaagattaaatgctgtgatgaaattttcaaatttgggggatttttgtcatttttgaatgtctgtgatacattcataatacatctctgggtcatacaagagcaagcatttcacacttttagtttgataatattacactgatattttaaaatgaataggtttttctttgcataaagaaaattatttctagaattatttcatatttcaatttcaaatatttcataaagaaaattagatttctaagaaatccaatctaaatttaaaaatacacatcagaatcacatctaatatatatatta

SEQ ID NO: 25003 - DNA, 1074 bp, Bovine  19866881064814
aattttataatgagaaaaaagttacttaaaatgttatttcaaatgtcttaatccattaaaaaaaataaaccaagtaacatattaaggaataagaatgagaatggcaccatttttcttaataacacactggaaatcagaagacaatggagtaatgccttcaaatctgtgtgaaaataaagtctaaacccaactatcaactgatcctgacggtaaacaataacaaaaaaagaccatgtaatttattcaaagaatttttccctccaagataccatttcttagaaatctattagaagatgtaccccagcaaaataagaaagtacatcaaaagaaaggaagacaaaagattcaggaaacagtgcaacctaaccaagagattggagaagaaaagtcacaggattatagctgtgcccaggcccacagagcaacagtccagactgatgcaagagaattaaggagtctggatgagaaagaatgggagatttttgtagattataagatcatctgacataatattggggaaaaattaataagtgaatgttgaaaattatacatatgaaaatacaagaaaactattaactctaggaaaaataacacacattactacaagaaaggaaatgtcacaagagtataatactgggcattttgtaaacattatttagtgtcatagtgaagtaaatgctgattatgggtctagctaaaaatactgatatagctatactgggacaatagaaggtggagggggaaagagataaaattatatctatcatataataggaagtcaacagataatgtctaaaacaaataactcaggatataccaatataagggcttacctgataactcagctggtaagaatccacctacaaggcaggagatcctggttcaattcctgggttgggaagatcccctggaggagggcatgacaacccactccactattcttgcctggagaatccccatgtattgaggaacctggcaggctacagtccttggggttgcaaagagttggacatgactgagctctgagtaagcacagcacagcacacatagcagtataagcaaatcatttaagaa

SEQ ID NO: 25004 - DNA, 1737 bp, Bovine  19866881116200
ttaaaatattttattatttcctaatcatcccttattagaaaagttgaactaagaccatgctatcacatggtgtttataaattgtctgcttaactgtaccctttggttagcattaagctatcacttttctgtcacattttattttctgaattattataatgcatatttatggtgaaaactatccctatttatataagaattaagtctataatttatcagtctagagcagatctggtatgctagtgtggaataccatcttaaagcatagcttctttgtttcaatactgttgatttctgtaaaggaaaactctcaatctaagatttcccaggtggatgaacatggcaaaacattcgagcagctagagaaagacaacaagcaagaaacattactgaatattcagcagaattttcagactgttacaactcaaagattagaggagaaaattcagaaacttcagaaacagctcagtgacttgaaattgtcaaataaaaatatgaaaactcaactgacaagagtaaatgtccttaaagtaagtaaaggatgtgaggctttcaaaaattcacttaagctttgttctgttactgtttttgctgtatgtttctcattgaacttaaaaaattattttacacccataaaaataatatatataatattaaacatataggataataaagttagatgttgtaaatccaccactcatcttaagaatcagagtatctttggatcttcgctatatcaagcttcagttgtagtatttcaaaagtacattttatgcctgaaaccaaagatgcactagatacttattggtcaactttttttgcccgtttatcaagaatatttaatcttactgtatccagttattctctatttctgtgtttgattaccacagactaagactctcgaggacatggaacatgtgttaaacctctttaaatcccaaatgcctagttaataaaagttctcattaactattggttattgatgaacatagtggagaaatgtcctcttaattcataaattgtggaattttctttttctacattatctagctcgtaaaagaaagaaagagagaggaagaaagtaaaaagcatgagttatcatgcatcatgcctgtctgttacttagaagagatctaatcatagtcttctccctttcccacaacctctaccctcataggacaaaacaattgagaagctcagggaatctctaacaaaagttgaagcaatgaaagggaaggcagttatggaaacagacctgaaaactacagtagactctgatgagcaagaagcaagatgggataaaaagaagatccatcaagtgttagaaactgccactcctgagctcagcacagcaaagagcacacttgaagaagtaccgggaaaacaagaaaaggtttgttttctttgaatactatattaaaattctttaagttgaagtgataaacaccaacctcaatttagactaccctaacttagacaacggagaaggcaatggcaccccactccagtactcttgcctggaaaatcccatggacggaggagcctggtgggctgcagtccacgtggtctcgaagagtcagacacaactgagcgacttcactttcacttttcactttcatgcattggagaaggaaatggcaacccactccactgttcttgcctggagaatcccagggacgagggatcctgatgggctgctgtctatggggtcgcacagagttggacacgactgaagtga

SEQ ID NO: 25005 - DNA, 770 bp, Bovine  19866881147209
aggacccattctaaatttcttaaaatgtggtggtagtttttgaagctggacggacatgagagaccaccaccaactcccttcatttacaaggggagaaatgggcttagaggagcttagccaagtctcacagtagttaagtggaagataagaaatgaggacagtggcttctactttatctggggctattccattacccacaccacccgaaggtgagttacatgctacattgttttattttgtttacacataaagagtcatttttctttcttaattctaacagtctgtaggtagtatctagactttatttaaatgtcagaaatgggttccccaactcctcgattacttgcatctgccactcttttcttaccctaacaggaacagcagctctcagaacagtcccatcagggtttgggaataatgctgacaacagaacatgctatcttaagtcatcagtcatactcgtttgtaaaacctggctatcaacttcattgatatttcattaaaagcaccaccatttctttcattaatcctactgaagcaatttcattttacaataataagaaagaggaacaggtggggacagtgactattcaacaggcaggattggaattagagaatctgaggaccagagacagtgggatataacacatctagccaatagagcaaacaggaactctgagctcctccaatgattataaagtcaaatacctaataatgaaatcctccaagtatagtaatagtattactgactaaacgcttgccatgtgtta

SEQ ID NO: 25006 - DNA, 1055 bp, Bovine  19866881167052
tttttttaaagctgccagttgagtatataatcagtgagttgaaagtaaaattacattcctcattttaaaaacccatctgttgaattagtaaatgttgggtttgaagaaatagctttgataagggttttttagaagtagatggctggtgtgacttttaaaaacaggtggtttgggttgtattttttaagctcaattttttacttttttaatcatctttattatttataaaaccaaataagacttttttctttatttgagaagcccccacttgcttaatacatgtagactacactagcattgtaagttgagttgcaaaatcatgttcaactctttgcgacctcatggactgcagcatgccagccttccctgtccttcactgtctcccagggtttgctcaaattcatattcattgagtcagtgatgctatccaaccatctcatcatttgtcatcctcgtctccttttgccttcagtctttccagcatcagggtctattctagtaagtcagctctttacatcaggtagccaaagtattagaacttcagcttcagcatcagtccttccagtgactattcaggttgattttccttgactggtttgatctccctatagtccaagggactctcaagagtcttctccaacaccacagttcaaaagcgtcagttctttggcactcagcctcctttatggtccaactgtcacatccgtacatgactactggaaaaaccatagctttgactagacagacctttgttggcaaagtgatatctctgctttttaacatgctgtctagatttgtcatcgcttttcttccaagaagcaagtgtcttctaatttcatggttgcagtcaccatctgcagtgattttggagcccaaaaaaataaagtctgtcactgtttccacttttgccccttctatttgccatgaagtgatgggactggatgccatgatcttagttttttgaatggttgaattttaagccagctttttcactctccttcctccagcctggcatttcacatgatgtgctctatatatgagcttcccttgtagtt

SEQ ID NO: 25007 - DNA, 1153 bp, Bovine  19866881199349
agacatttcaataaacttcagaagagccgtgccctgcagttaactgacttactcttaagcagaggtcctcccattgtctgtgcaaatgctctatttgctccttcaaaaccatcacgtcgtccaccagaatgtgctgggttaggtcggtcttcattgtgtgaagttctttcaagttctgagtccagttagctaaagacttctctagttcctgcatttaaacacaagaaagaaagagggggaaaaaagaaagaaaactcttcaactcaagctgctgttgtttccaaacctgtagaggctaatcctttgattggaccctgggggaggggaggccaggaaagggggtgggactttctgaatgagaaacagcccagggccggcctctgcagctgtggttggccaattcctcagcacctattttctcaaagcagaactcttttctacctttattttcacttcctcaggtatttcagacttttctatacttaactctatgttaaagtcaagtaagtctttacctttatttaggggaaagtaaagtatttttggagtctcacaacaatctctctcacctacatacatgtaattctgaaactgtgttacagaatgttgtataaaatatgatttccctacttttaaaaacaccttaagaaatgcattgttgctacgtggcaatcacataatgacagcttctgttaagcgaatcattttggttaactttcaaaaagaataaatataattgaagggaaaaaaaaaaaaattgttccctaatgattgccagagatgggttagcagaaaatgtcctctggctctggaaacaattttttctttttaaatgaagtattggtcaaattaaaacattttttgaattctaggacttaatctagataattactttcacgagagagagggtaaaatgaaacagctcaaacattcaagagacctccagatttttattgtgcttctcgtattctgtattttggcacatttgaagggtctctattcatacctgtctattgaaatctgaaagaagagagtatttcatttacatcagtaacctgcctgaggggtggcaacagtaaaaatgggttaattctgattgattttcagagttctaaaggctacactggcatgaacttgccaacaaggatttacg

SEQ ID NO: 25008 - DNA, 1317 bp, Bovine  19866881222665
atgctagatgtttctgaagaatgttctgtcacccattttcagaaagacaccccaacccagtgaagaatttggtttcaggtcctaatttattgcttatgctctaatttgatattttatcagaagtttggattctgtttggaatggagatgaaattggatgaaacaatatgtttgaagtttatttcaaccaatacaccttctggtttgctctaaaattaaggatatgtgaaaaatcagccactctgaatttctgtttcagccagctatcaccttacctgaactgtcacattatctgtttgatgttggtcagtaaggaaggggcaggtagtggagagagtgttcacagtatgtgatgggtgaccttatggagagccttcagaggaagtattgcatctgactcaggagctgcagaaaaaacaatttatctagtggtgggcataccaattgtaagttctacaaataaacatcttccttggacttccctggtggtccactgattgagaatttgcctgccaatgcagggagcatgggttctgatccttggtctgagaggattccacatgccacagggaaaataagcccaagcgctgcaactactgagtccgtgtgctgtaaatactgaaccctacttgccttagagcccacgctctgcatcaagagaagccgctgcagagagaaacccatgcaatgcaactacagagtaaccccccacttgctgcaactagagaaagcctatgcacagcagtgaagacccagtacaaccaaaaattaattaattaatttttaaaagtctgtttcttatttagaagataatcggcattactgtgcagcacccttgtatgcttggaggtacattagagtgaacccttagagaaggcatatccagtggagaaaaggccatgggtgcttccttcaatgcctctaatattttctagttatcttccttttaagatgccagttcctgagtcacattctaccaaatggctcctttctattttccgtctgaacaagcaaaattcatgtgtgaaaatctctgttgttcaagtgatgaatttagtatgttttcatcacaattaagaaatcgcctttgagaccttattcctatgactgaataataagttgattagaaaaactgtactaaatccttggggaaagtgaagccccaatgatgctgatgaacactcagattttatagcagtgccttcttttttaaaaaatagaaccaagagaaagatttggaatagtatagaattttagtactcttgcctggaaaatcccatggatggaggagcctggtaggctgcagtccatggggtcg

SEQ ID NO: 25009 - DNA, 799 bp, Bovine  19866881234571
tgttggtttgctctccctgattagacggtaagtttgtatttattccctcagtcatcttaatacgctgaataaatagtttgcaagaattacctgattgacttcttggatagggttcttttgattgattgccaagaaaaattctacttgccaagaaaacacatgagctgtttggataaatcagaactttgaagtttataatctatacaatggtgtccaggtcttacatgtagtaaggtaggtaatgtgatagaaataatctatacctgtagttgagttttatttggaagaaaaaattggaaataacttaaactcctgggctttttacccagatttcatttcctagtgatgaacttgtattcaaagcttggactcaggatcctggcatgtgactttggtattgcatgctaaatcagaacttcaaagagtttttctgttttgttttgcttttaaaaacagggcaatgcccttcttagtaaagtagaatctttttgtttgcttgtttgagttgtattggggttctcccaatattttctccttgcattctgcttttaataagggctttcagagccctcatgcagttctcaccggttcattatttaatacctaagaggatagagactatgattgttgtatcatttgcagatactttctccattccgtaggtcatctttttgattggttgatggtttccttcactttgcaaaacctcttaagtttaaaaggttttgcaaagtggtctcatttgtttattttggcctttgtttcctttgccttaggagacagatccaaaaagatatta

SEQ ID NO: 25010 - DNA, 830 bp, Bovine  19866881305032
aattccaatgtagctctcaggaaacctcttacaggaacctcttggcagatcttgggtcttgattttggttcctatgattctactaccattcatggtgccatctttgatttttcagtctgtttgaaagccatgagtctctctgttccagaaacgtgtaattcccaataaggctctccactcaaagtagacacctggtggggttggggaggggtaaaatgtaagtctggacaggtgccccttgatgacccagtggcagcctggggccccctacagcacaacaaaggggaggtccagttcctctaacctgtttcagttcaggcgttggtggtttaactttgtttcctttgttttaggagtttagaatggaaatggactataaacaatggatagttgactttgtaaaccagtcattacttcaggttaagcacctgtgatgtagaaagtaagcgctatgagagaacagagtttgcagagcacctgggagagatgaaccgccaagtggcagcaggtccacggagccctgaacggcaaggtgaactcatggtcacatgtgtgatttggccttcgcaaaattccactttctgaaaaatttacaaagacatttatgagtctttcctagtggtccagtggttatgagtcggtgcttccactgcaaggagtgcagatccagtcccttgtcagggaattaaaatcttgcatgctgcacagagtggccaaaaataaataaataaatggacatttgtgtggttaacttacagtcaaacctaataatcatctcaattctagccccttttaaatccagagcttcattctccatgggcatttaagag

SEQ ID NO: 25011 - DNA, 951 bp, Bovine  19866881375430
aatgcatagatcatccccattaaaagtcaaaccccagtgatccacaatggcaaatgagctatttgctatatccaagtatttttgataatttaactgacactgcactagatagaaaactggtgtaaaacagactaagcttttccctcccttttgacatataaaatacttggatgtaactgaaccttgccttggtgacaaagaaactcatatgaatactaattatttgactactgagaatataatagccttcaaagactaagctaattaataatttgaaatttgtgaatctgaatcagtagaatgtagattccgagcctcagtttcatctgatgtcaaatgggtagatgtgctggaatatgtaaagaaaaaacaatagcactctcattctagaaatgaggaaatcaaggcccagaagtcgcgtgatgtgcccaaattcagcctcaaggggagacagtgggaagctcagcctttagaactcaacaaaacttaagttccacttaagtttctggctagtgtaacccggttttaagatttaacctccttcagtagcagtttcctcatcagcttctcttatggctgctgtgacaattcaataaaataacatactttgtaaatataatactgctaactgctgctgctaagtcgcttcagtcgtgtccgactctgtgcgaccccatagatggcagcccaccaggctcccccgtccctgggattcttcaggcaagaacacttggagtcggttgccatttccttctccaaaatataatactcaccttgcttaaaacagcattaacaaattcagcaaaatttagtaaatgaatggttaatagatcccagaatgatacctggacttaagagccatctgaagctctctttctttctcctttaatttggctcttgccttaactataaaaggcttcttaatgtcactctcaagctcttctaacttca

SEQ ID NO: 25012 - DNA, 1589 bp, Bovine  19866881388784
ctttctagaaaaaggaacagcatgaacattgcctcatgtatctctttgccctccaggcttcataacaaatatattccaagagatctgatcaagcaaaacctttgttactgatatcagatctattaagagtcgccttgtcgggatcgctggtgtctgaaagtggataggtgagtttacacccatccacgtagtgcaaatgaacactggttaccatggagaactagctgtagccatcagggtgtacatctctataatcagtgaccacatcaagtctgggtgggaacagtggggaaaaggggagagcaaaggagaagagaaggggagagggggagagcataaacacatgcctgtcccttgagaaggctctgaagaaagcaggttcaatgcagggtggagagagggccagggcttatcacagaggaagggagaacccacaagggagcacctgcagacaccaagaacacaccgggctagttcctaattttgctacagcatatttcctttggaaaggacatggcagaggtatgattgatttataaatttaatatgctgaggtttactgtaaccaaatattcacagaactctgattagaacttgtcctcagaaataagatatttcttcctttaaaagttgaatgagaagacattatttttaaaaagttatctacatttttcatattctcttttacccatcaaaaacttctttaaaaaagaagaaaaataaaattagtgtgtaatatggctttctcaaagttttatgatacttcaaaagtaataaatttcaatgtcaaatatgctataacttagtgcttgggttgttgtgtaaagttatgccccctcatgcttctccctgtactacctctgccctccgtagccatgattatcattaaaactatctgagttcaatccctggttggggaagtaagaacccacaagccacctagcacaaaatatatacgtgtgtgtatgtataacaaattgaatgcgaataatccatcatgttaccttgcacttaaagtttaagaatgttcaactaaagtccacatttagattcctgtcaatctttataaaatgttatttagttcactgtttaaaaatttgtagcaaagtttatcttttcacctgtctagcatttcatcaagctgtaataccaatggttacttttatcttggacataatttgtcatgaacactaagctgtgatttcagttcaagataggaaggatctaacttgaaattaaaattcctttttgaaactcaaatcacttcatcaagaaggaagtgatttaagttaaatattttccaaagacagtcatgaagtgaattctcccccacaacacagatctaaaagctcaactttttagtaaggactagaatatcagaatagatatcctagaattcagaacatcagatgttttaggtgctctatgtgataatgaagaccttgtataacatatatctttcttctcactaaatcataaagcaatctgaatatcggccataatgtaattcagaatgaagactggatttacctgttcacaggtaaggtgtgttctaatgatctggtttcacgccaaggactcttttgagg

SEQ ID NO: 25013 - DNA, 1412 bp, Bovine  19866881418350
cccctctcgcgccactccctgtctcctgggacccaccgtttaatgaaccgtcagcctgtttgcgtcctccgtgtccaggaactctgtgcctgtgttcatgcagattggctgcttggaaacctggggcgccaggtcacgtgattgttgctatgcctgtggaggtgccttcttcgtttctttttgtttttacttcttctgcccttatatatttgtttttcttttaactgggggaaatgctataagtttgtaggtctttacaagtccaaatctgaatattttggactcctagtttttcactgccggattatcttggattttttcatagggtgccacacctcccatcaaggctgcagctactggcctttcggacgagcaaggagcttttgaggccacggtggagaaagtgaggcccgagcctgcagaagtcctccatgtctgcaagaatcaggtggctgagctggagctgtggctgcaccaagccaacgtggcatttgagccagaaacattagacgcagacatgcaacaggtggtggaacagcagttggtagggtgccaggtaaggctgctgggtctgagttcgtggcctgtctcttcagcagttacgagaagatgaatttctctgaaagcaacagtctgattcttcctgttgctctgacacctatgtttattttggcctcaactttttgttctcaggataattctttgaaataatttatgtaagcagagtatttggggagacagtagtggagaagatctcagaatctagagtttagatctggtcacattaactatgaactggagggagttacctctcacttcattttcctcagataggtcaactcctaagactttgttaggattaaatgagataaagtatctaaatcagtgtctggagtataaagtatatataaagtgctcagcagatactagttttattcataatattcagtttttaaaattttcattcatcagaaatgaaactgaatatcctgattggcagggttacagatacagcagaaaagggctttgctgtcattttactatgaatgctccttctcttgctggcttggtggcgctagcagtgaagaacccacctgccattgcaggagacgcgggagtcgtgggtttgatccctgggttgggaggatcctctgcaggcggaaatggcaacccactccagtattcttgcctggaaaattccatggacagagaagcctggttggctataggacacagtgtcacagagagtcagacaggactgaacacacgcacccttggctagggaggggcaggaatgtaaacttccttgcctggagtcattttgaggaagctttgctggcacagcccaaaggttgggatctctggatccctccagggaggggcgagactgacattgctggagcaaaactgag

SEQ ID NO: 25014 - DNA, 1039 bp, Bovine  19866881422607
caaaggggaatgcataaggggagagaaattaggagcttgggattaacatatacccaatactgtatacgaaacagataaacaacagggacctactgtatggcacaaggaactagactctctaccctgtaataatctataatggaatagaatctgaaaaagaatatatatgtatatagacacacaaatacatatatctatgtatacttaatgactgttgtacacttaaaactaatacagtattgtaaatcaactatacttcaataaaaatatttaaaaattctaaacaaacaaaaaaataaatttagctggattccagataggcaaaagaaaatagatcgataataatgaatattcagtttaaaatgaatattatcattttcttattaagtaatatagtttctccatcccctggaggggtttaaggagatataattcacattgaacattgtattagtttaaggtgtataacataatgatttaatacattactgtaattttagttaacatccatcacctcacatagttctttttttcttgtgatgagaacttttaaaaagctactctcttagcaacattcaaatatacaatacagtataacatagttttgaacctaaattactcagaaggtgcatttctattgataaagttctttgaactcattgtaaaagtagctgaatcaatgatttacatgtgtgcttagtcgttcagtcatgtccaagtctttgtgattccatggattgtagctcaccaggctcctcgatttatgcaattctccaggcaagaatactggagtgggtagccatttccttctccaggggatcttcctgaccccgggattgaacatgggtttcctgcattgcaggcagattctgaacaactgaacaaccagagaagcccgaatcaatgatttaccacaattcactatgataaattatctgctgaaggtagaacgaccaaggccaagactgtgtattgtatttcccttccactttaaggaaagttccattagaagtgacagcaacatttcccctttatagaa

SEQ ID NO: 25015 - DNA, 840 bp, Bovine  19866881604085
gtagactggaagaaaatatatataaaatatagagctataagcctattgagaaataacaagtaactacaatgtatatcctgaatgggattccgtaacagatgaaaaaggacattaggtggaaattaaactttagttaataatgtactattagtcccttatgacaaatgtactatattaatatattaataactggggaaactgggcatgcatacactggaattctctgtatcattattactacctttttaataattttgtaaatctaaaattgttctaaaattaaaagattattttaaaatgtgttttaagaaaccctttaacagtagacattcaattatattactttattctctctctcttcatatactcacacacatatttaatactcaataacatttagcaaaaacaatctctgtggtaggtgctttatataaagccttgcaacaatcctgccaagtcagtgaggtttttcccaattcatcaataaaactcctaggagctaagcaacttgctcaagttcattcattagctgctggatccaggtctgtctgccaccaaagcctacccatattttctatgaaactctacatgtgtatatattaatatcaggatcaatgtcaggatcataagccccagacatacatgcatgttcttacctcccacttggcacaaatgtctctactcttttcttccaaagacagctttacgtcatcagttacattatttttcagttcttcaacagctttcaaatacttggccagacttttagtattagaaattatcagtgcttcctaaaaaaacaaacaaacaaaaaccactaacaagagaataaagccttat

SEQ ID NO: 25016 - DNA, 1096 bp, Bovine  19866881842582
ggagagaagccctagagatattctaagggtttatttttttccctgtttcagaatttttgacatacatttgcaactttccctgtcctgctttggcagctcaaggttgctgcagatacatatgtaatgctcttttgtctagttatatggagagctttcagggctgtgttttctcaactctcacctaggcatgtcatacatatatattcctgctatgattgccaagtggagtaaattagttaaaaccctatagttgatttactatcttagatgcttgattttttttttttttcccttaaggtgccagacatactttctgcagtctaagaaatttgggagactatttgtgcttttcatggtggatcccagattgtgaccaaaaaaaaaaaaagcaataactcttttgaatggatggggggttttgtcatgtcttattcttcatacttggcatcaggtcacagaggtgcaatattgtctggaagaaatttaaaaaacaaagcaaacaaaaagataattttcttagaaaagtcctgtatcgtgtagtagaaaagacgaggagggaaatgccttcagagcttcaactttagtctagtctacattctgaagaagagaccagtagaccattcttaaccatttgcaagagcttttgaatactctaaattatgatcaccatagatataaacttcccctaaagtatgataaagtttaactcagtatttcagttaatccttcctaagcttaatgactctataaaacatgggactaaattaatttctaaagctattaagctgaattccaccaccacaaatgtcaagcttacaccgtgtcattagtacagaaacattaaccattagttcatctgaaactcttaaaaccaaagcaacagtgaagactgatgctgagatctgtgtccttggagagctaaagtaacaaactgtgttccagaacagtctggtttcatctctgttgacacgtgtttcagcctgtagtcctctcagcccttctttagctcaggggaaaacatgacttagactggatcaggttccccgaaggctcagttgtaaagaatccgcctgctaatgctggagacttgggttca

SEQ ID NO: 25017 - DNA, 2441 bp, Bovine  19866880527759
tgcaggataaaggaagcttggggctggtgcactgggatgacccggagggatggtgtggggatggaggtgggaggggggttcaggattgggaacacgtgtacacccgtggcagacgcatgttgatgtatggcaaaaccgatacaatattgtaaagtaaaaaataataataaaaaagaataaaaagaataatctcaaaataatccttattccagagatatgtttggggtggcatatactactaccctaagtaaatgcatagtatttgtaaaggcattcctgaaacatactgtggcttcagttccagaccagtgcaataaactacatatctcaaaagtgagtcacatgaaatgcttagttttctagtgcacataaaagttatatttatgctacactctagtctattaagtgtgcaataacattaagttcagtcagttcagttgttcagttgtgtctgactctttgcaactccatggacttcagcatgccaggctttcctgtccatcataccaagctccatcctggagcttgctcaaactcaggtccatcaagtaggtgatgccataaatttatgtcttaaaaaaaaagtgaatgacaatttaaaaatacaaaaattttataaaagtaacataaatcacagactaccataacaaagataataataaggaaaatgcttgaaatactacaaaaattaccaaaattttggctcttctgtccatggaattttccaggcaagaatactggattgggttaccatttcctcctccagtggatcttcctggcccaagaatcaaacccaggtctcccacatcacgggaagattctttactgtctgagccaccagggaaataactataattgtatgtgtatatttatttaaagtgagggaaagagaatattttaaaataataagtctacggttcaatcacgcacaggcttcactgagaatgttatatagtatactacctgattggtagggtagagtgaggaaagagttaaacctggttgatgaggatgaaaagttgtagaaccaaagatgaataatcagatgtctgatatctggtggaggcagcctctatattgtatctattatgagtgacacagatgcagaaaactgtattcctcataccactacacttacataccgcgtaattttctttccagaaatcctcggctgcatagcctgaaggtattcaataaaacctagagggaacactgaaagtgaatcatacagatttgacatttccagttctgctgtgaccgccaggccaaaatatagtctgcgggcccctttttcattagtgagaaactgccaggttttaaaacagtttatccattgaattaatctctaaaccgcctttcacacagggcagaaacagctctctgcactgctcttcttcttcacaaacactcttatttttatttgtatgcattctgagtaatgaataacgatcctttgtgtttggagaatgccattttctaaaatagctcctagcattttctaaatgttaactcattagatctcatatggtccagagtcatctatcacacagaggtaggtcaaaagcattatatttcacattttacagatggaagagttttagggacttcaaacccaaggtcacctgcagtcagacaccaaacaggggaagacaaggcccagaaatattaccctggagtcagacaaatctcagttggcactctgagagagccaagctggctgctgaggtcacataaagacactgatatttgcattcttctcagagatcaagctttggatggagctgggtcatatgcggctaattacactgctggctcctactcactttatttggcaaagtgtgattaaaatgcttattaaaacatatcctccagttttgtttctcatttgttcagtcatgtacaactctttgcaaccccatggactgtagcccaccaggctcctctgtccatggaattttccatacaacaatactggagtgcgttgtgatttcctactccaggagatattcccaacccagaggtcaaacccagtttcctttgtctcctatattggcaggtggattctttaccagtgagccacctgggaagccagtttcattacatcacagggaactcaattcaggtccatgtaattctgctctgggcactttgctgaggtttcctaaaagtatatagttctatttctcacattacttctctttccgggaagagacagcactcctcagtcatcctccagcctcaggacactgaactctgctttgtgatttctagttcccaccttgaagccctttctttttttccatgaagcaagaagtccaaacagtaacacactgcatggattgctgtgcagttttcctggctccgtgtccctttttcctcattgttaccaccctaggcttgcatcttacaaataaaaagccagttctttaattttgcctcag

SEQ ID NO: 25018 - DNA, 2590 bp, Bovine  19866880791130
tgtcctttggttaaatgtatccctttaggtaatgctaagacctccaatattcactctgccctttttctacctggagagggggattctttgtgtgggaagagcttactgtgagctcctggtggtgggagggagcttgcagttccttggagctcttgcacacttctctttgtgctaactgttccttcctgctttggtcactgaccctatggtgggtatattgctgttgcttgcttggtgaattcaggttgacctcccaggtgcacctgtatgccagagacctagccgtgtctcccatctccccctgacaacccttcacccaggtaagccaaccagcaaccccagtgacctgccttccacatgcctgcacaagatgtaacaaattgtggttgcttacaacacaaagtggtaattctggtgtggccaaggaacaggaaatagaaagcagaaagctttcatgagcacctttgtataagagtgagattggttaaagatcttgaggaccttatatatttttaaaaagtttattgagagaagcagcaaaactcccttggactaaagagattcaaaaaataataaaggcctttttattcagtggggtcaggtaaattttttattctatttggaaataaagcaagtgtgtgaattcccaactccttttaatctgtcactcatatatatcactcatatatatcaaggggctgggacccaaaagtggattatataatgagtgagttggaagactttcttgacagaagtgtgccttaaattacatattgttcatctggtttttaaaatatggagttctatttttttgtggttgtcaaatatgtcttggaaaggctgtaatttctcagtaaggatcagaaaaagttttctgctgaacaaagttgaaggtacgcttttggtgctctgtgtattgctatttgatcagtgaggtttgtttgtgtttcattaatcattattgcttgagggtgaataataatcatcatagcgataacaatattctgtcactctgatcttgttgcataagatgtgccaggaggtagatggacaaactgaaacctgatgtttctggctccattttgcacctggatggaagagatggaatctgcacattgtgatttcagatgctcatggaggcaaggtgtgttcacactacagggataacttgagatctggattgtcttttcatggggacacattgagcaggaaataaaggaaagcagatttcctcatacagggtaacacagagcatcatttattatgtactgactaagaatatcagaacttccctggtagctcagatggtaaagaatctgcttgcaatgcaggagacttgggttcaatccttgggtgaggaagatcccctggagaagggaatggcaatctactctggaattctttcctggagaatcctatggacagaggagcctggcaggctatggtccgtggtatcccaaagtccatgggacacaactgagctattcacacattttacctcctttataccaagtagtatttataactgatttgagaaatcttgaattcttctgaagttagggaatctttacatcaatgttatttagccacattatcgtgataacaccatgaatttgaggtaattaaaacattttttcaaaaaattttttttagctttttacttaaaggtgattgttaaagtaaacagagtcaaactctgaagatagtctttgctaactgatactgtgttcttgggctgtgtgctggggcacttcttctagagaagcattagataagaattgtatattctaacactgaattactagtgaaagcaaaatatatttttttgagagactgaaagagggtgaagatgataattgttgaatgagaattgtcaatgaaaaagtcactgttaataatattaaataaaacaagcagaaaattttttcccttcttttattgaagtatggttgtattaattactgttgttctgttgctcagttgtgtccgactctttgtgacctcatgggacagcaatacgctaagcttctctatcatctccccagagcttgctcaaactcatgtccactaagtcagtgatgctatccaaccatctcatcctttgtcatccccttttcctcctgtcttcaatctttcccagcatcagggtcctttccagtggatcctttcatatcaggtgtccaaagtagtggagcttcagcttcagcatcagtccctccaatgaatattcaggattggtttcctttaggattgactgatttgacctccttgaggtccaagggactctcaagagtcttctacaacaccacagttcaaaagcatcaattcttctgcacatcaacccttcttcagggtccaactctcacatccatacgtgactattggaaaaaccataagtgagtgagtgaaagtgaagtcgctcagtcgtgtccggctctttgcaaccccatggactgtagcctaccaggctcctctgtccatgagatttttccaggcaatagtactggagtggatggattgccatttccttctccaggggaccttcctgatccagggatcgaacccgggtctcccgcattgtagacagatg

SEQ ID NO: 25019 - DNA, 1957 bp, Bovine  19866880848885
tcctattttttaaataatttttaagtatattttggcctgccctgtagcatgtgagactttaaatccttgaccagatccctgaccaggaccctgcagtggaagctcagaatctcaaccactggagcaccagaaaagtccccagaatgtactctctatagcaaccagtgaggtccttatcgcagagaccaacctattgcaaaataggaatttattaacaataattctgcagatatttctttgcaggggattgccgcagtcataccattttggggcatgcttcatgccattagctcttccttgatatttgttgtgtctattagcttattagatatcctgtagtgaggaaatatgttttactttatttaggtctggttttgcacaagagaattgtagctacagaaatgttaatttttcctcttgcaaaatgtagtaaaattctatgaaattagatttccttcaaacacatttttaaggaaatagttacctaaaatattttactaggctcataaccagtttttctgtctctcttctaccttatctgatcattcttttacacaattgtcaagattatcttcctcagagaattatcagatgatgcaggctctatttttttgttggaatatcaaataaaacattttcaaacaaacaacccggcctataattttacaatgaattctaacacattttcagagccttttcatttagttttattttctgtcaaagttgcttccacagctttatgtccttctgttttttgtttgtttgtttgcttttaccatgtgtgtgtgggggggaggggtggtgtgctcagccgtgaatgactttttgtgaaccatagactgtagtttgccaggctcctctatccataggatttcccaggcatgaatcctatggattcatttcccagggaatcccatggatgtcccaggcaagaatactggagtaggttgccatttccttctccaggggatcctttctctcaaagtcaccacagggcacatatccttaatgtctgtgtctagaatatcccttttctcttcctatgcctccatgtttattaaaagttaaagggagaaaaaagggatgcttcggggtaagctggtggcctaatttaatctgaggagacttttggaaacaaatgaaataagatattattttcttaaaagttggctaaatgcagttttaactgggcgatttagtaagacacaggattttgcttgaattgtacgttatactgccaaaaaatagattggaaatgtcagtggcttgtttaaatgtaaattctccatgtgtttggtaaaacatattggcttcaaagtaatagtgtacttttgacttgatatatatcgactcatacctagtagggacttattgattgtttttagtaaatattctgtgaaatgttttctcatttagctaaaaataaagctcagctttcagcaagattttttttttcccctgttcaagtggaaaaatttgttgatcatagtgcctgttcttaaagtagatctgaaactatttgcttaatgggtgcaaaatccagagacctgagtgaaaaaacatttttttttaagataataatgctaatttagaaaataacattttcctaccacgtttatacacataaaatgtagttagtattattccaactatataaaacttgaaaataaaaatgatgtaaaaagattagaatatatacataaaattaatattaatcaggaatattctctaattagtttccaatttataaataaacattttaccaagatcatgttttagtcccaaagatgtgtttgcattgagaactttcatttcactgtttctcctcatgcaatttgaaaacattctttaactttcattcatgttgtatcacttactaaaatgttacattttctacagtgaaataaagcttaatttttttcagatttatgtagcaataattactctgtttctgaca

SEQ ID NO: 25020 - DNA, 716 bp, Bovine  19866880886828
caggtatacctgtgttccccatcatgtaccctcccttccctcctccctccccataccctccctctgggtcgtcccagtgcaccagccccaagcatccagtatcatgcatcgaacctggactggcaactcaagaaactgcattttaaaatgacgtccaggtcatctgagtacatgtttggcaaccctggtctctattcacacagccctgaaaagggccatatttactcagtagggagttggtcctggtatccagggatgaacagattggagaaaggtttcataagcaaaggagaaataatggttaagctagatgactccagaaagattttcttgcccatttcccagacaacgtgcatgttggagtgaggaatagtcttgaggaagagcagaactttatgcttcagtgaagatacatttagaaaaagtgtcaagtgagaactaagtttatcagctttaaggcaagtctgagacagttatggtgtactagggttagtatagagaagataactttaaaaaagaagcctatcttgtctcactcacatataccttatatatgtttacttcactgacagatatgaaaagtgatgatgccttttcactatacttactaaatgtgattcccactagttttggttatcatttgattatattttggttaaaatcttattgaacaaaatcaataacagaagcataaggaaaaaaaatccttaagcaag

SEQ ID NO: 25021 - DNA, 1418 bp, Bovine  19866881088482
ctgcagtgattttggagccccccaaaataaagtctgacactgtttccactgtttcctcatcttaagatatatcaacgaataggacagtacatggtctgcataaacagcctgacaactcttttgattgactcacaatctggatactgcaggaggcataaaaggatccctaaatgaataggtggtcagcagaaaggtatacctggttatgagaaggaggaaaaagttacccaaaccaaaaatacagagaaatgcatttcaaaaagctgcaatgaatatgaaaagggaagaagacaggggcagatgctcatgattgagcctgatgcaaataattcctgatatggaaaatcagactatttccctctctgatgtttagaaatagagatatatatttccttagttaggcaggagaatgctagtcaatcatttgtcattctctagtcatcgacaaagatcagagaaaaataaaacaactcttgtgtaggttattctatgaaaaaacctcccagctcatatcccactagacaaaaagtatttctctaagtatcctcatgctccattgaaagctgttaccaaggacattggaagagaaaaaacttgtaccatttgatgagatccactgggcataggagcacaatcaaatttgaactttgttgtgtagcatttttgaagaatgtgattcctaaagacagccatacacaatttaatgaaccaaatatgtgtccttcaagtacctcatctgaaagctagtattttatcttcttgactctgataagatccccttccttgggtcatgatcaattagtttcaggaaggaaatctttccttgtattgaatagcagcatgaaatgcctgccatcattcaaacattatttttttatgtatcagatcaatacttgtaacaggaaagggcatgttagggtaactgctttgagggaaagagtgagtgaagatctgggaaaaagagatcataaactcttcttttctccttctctgctgcttacctgacaggtgtctgcagggaaaatgctaaatcccacttgccttttggtgactcctggtgagtcacagataatggaccatgctctttaccattcttttattactagacttgttaaacatgtcagagtacttctggacacacagtattttctacacacttctcttattattggagaacatgaggcatagaggattccagcataccaaattctgagcttatattttaaggcaaaaatatgccaaagtttcttaaagacaagatatcttttatttcctggaaaatatgaaacaaaggctgaatccatttgaggagagaagtattgctgtctatgtgtatgcatattttcagtagaggaggagttggaatgtcttcaccttttagtctgacctcagagataaagaaattctacaacatggaa

SEQ ID NO: 25022 - DNA, 3835 bp, Bovine  19866881170352
tttggcattgcttttctttgggattgggatgaaaactgaccttttccagtcctgtggtcactgctgagttctccaaatttgctggcatattgagggcagcactttcacagcatcatctttcaggatttgaaagagctcaactggaattccatcacctatgctagctttgtttgtagtgatgcttgacctcacattccaggatgtctggctctaggtgagtgattacaccatcgtgattatctgggtcatgaagatcttttttgtacagttcttctgtgtattcttgccacctcttctcaatatcttctgcttctgttaggtccataccatttctgtcctttatcgagcccatctttgcatgaaatgttcccttggtatcttatatgttatcaggggaattcaaattaaacaacatgaaactattacttattagtaatatttaatttattatttattatctaataaataacacttagtagaataatctaaatctggcacaatgataacaccaaatatccatgaagatgtggtacaataggaactttcatacattgctgatgggaatgtagactcatacacatagttttgaaaatagtttgacatttcttataagacaaattatcttcctaccatgtaatacagcaattgcatttctttggtgtttaatcaaggagttgaaaatttgtgtttacacaaaactccaagcaaaaatgttgataacagctatatttttaattgccaaaacttggaagcaaccaagatgcctttcagtagttgagtggataaatatatgttgtggtaaaataggaaatgaagcaatcttcagggttaaaacaaaatgagctattaagttgtgaaaagagactgggaaatcttacatatgtattttaaagtgaaataagccaatctgaaaaggctaacatactgttgatttcaagtatatgaatttctggaaaaagcaacacaatggatacagtaaaaaggtcaatgactgacagggagaagggggatgataagtaagcacagctcaggatatttttcagttcagttcagttcagttgctcagtcgtgtctgactctttgtgaccccatgaactgcagcatgccagatctccctgtccatcaccaacccctggattttactcatgtctactgagtcagggataccatccaaccatctcatcctttgtcatcccccttatcctcatgccttcagtctttcccagcatcagggtcttttccaatgagtcagttctttgcatcaggtggacaaagtattgcagtgtcagcttcagcatcagtcctcccaatgaatattcaggactgatttccttcaggatggactggttggatctctttgcagtccaagggactctcaagagtcttctccaacaccacagttcaaaagcatcaattcttatgtgttcagctttctttatggtcctactctcacatccatacatgactactggaaaaaccacagttttgactagacagaccttacacaggatatttttagtgcaggaagtatactctatatgagattatattgatgtatatatgttattatacatttgtccaaacccatagaatgttcaacactaacagtgaatttaatataaagtctggactttggatgatcatgatacatcagtgttgatagaacaattgtaataaatgcacccctctggtgtggaatgttaataacatatcaggggaagctatgcatgtgttggagtaggggatatgtgagaaatctctgtatcttcctctcaattttattttaaacctaaaccttgagttttaaaaaagaaggaagctgactatttcctagatccttcagaatatctgaaatgtttagttgtggcatattttatgtgtgtatctaggtgtttattcatactctttagagggaagaaagtttgttctcattggcattgctgaaagtcttttaggcacacaatgtggaaccctttccttttcctcctccatgctcctgaggcatattttcttctaataaagagtgttgtgaagtatttgttgattttatttttttctcctctcatgactgctgtgggcaaaagcactgacattgatctcatttcaaagatgccttgtcctaaggcttctaatcagcacaaagctgtcagtttaaattccccaagaaactctcctgtgttaggacttgatgtaagaaatggcaccaggaaatggagagcacagaaaaaagagacatactgtattccagactcatcaaggattcattttccaaccaaaatctctcatcaggtggcctgatcatttctcatgggttttgcagtgtccttcactaagtgacctcttatttaggtttcaagttcaatttgcttttccagataaaatgacaaagaaagttgtggtgcaatcagattaagtgtaaatacagtcctgaaggggtaaaatatgactttgtatgtatttttctttcactttgccttaatatttcatttattgcctatctatttacaattaagtagttaaataagtactttttgagagctaactataaacactgggtaaaattcaaacagtttctgcttttattcttttgatgtgtttaagatctactgaggatatattgctataggaaagtcaaagttgtgaaaagtcctcagcactttattcaggataaaaacctctgattaattaagtgaaatgagctcttttaaaatcccatcttccacttcagtaataaaaagtctaggaaacactaatgttaacaccacacatgctttcagtaatgtggctttggggaaatacacactagtataagtaacacgctaggtgtacaaattagcgtgaccattataaagggaaatctggaaagacatgagaatgaaagaaaaattagcttcatttccatgtctctgaagatataccaccaaaattataaatctacatgcacacaagattatttactgcttcacttttcctcataataaaatattggaaattattttcatactcatttaaagagattggctgaataacctggctcacccatctgttataaaataaaattactaagaaaaactaaaaactgcaaattaaaaatgtatgttatttgtgtaagaaaatattggaagtgaaatgcgtggtgaactcattttttgctgaaaagaacactaaaagtaaaacacaagttaatgagattgatgaattataaagggtggatatgaatgggatagaaatattgaggttggagggaaggtatctctttgatttatacatttttgtatagttttaactaaggaaactggttcagttcagttcagttactcagcatgtctgactctttgcgacctcatgaccgcagcatgccaggcctccctgtccatcaccaaatcccagagtccacccaaacccatgtccattgagtcggtcatgccatctaaccatctcatcctctgtcatcccattctcctcctgccctcagtctttcccagcatcaaggtcttttcaaaagagtcagctctttgcatcaggtggccaaagtattggagtttcagcttcaacatcagtcctaccaatgaacacccaggactgatctcctttaggatggactggttggatctccctgcaggactctcaagagtcttctccaacaccacagttcaaaagcatcaattcttatctgttcagctttctttatggtccaactctcacatccatacatgactactggaaaaaccatagccttgactagacagacctttgtggccaagtaatgtctctgctttttaatatgctgtctaggttggtcatagctttccatccgaggagtgtctcctaattt

SEQ ID NO: 25023 - DNA, 1393 bp, Bovine  19866881192390
acatctacaaaggatattgatgtgagatggatgctgctgatgttagcaaagctgctaggggcaagcaaggaaagagaggtcctgaggaaattccacagccagaaagtaaatatgcgctttctccagtggtagaatctgtagcccgtgatgcaaggatatctctcaaaaggggatttctgaatctgaccattagtaaccaataacctcagtactgggcttccctcatggctcagaggtagagataccacctgcaaggatggagatgcaggttcaatccctgggttgggaagatcccttggagaaggaaatggcaacccattctggtattcttgcctggggaaatcccatggaaatcccatggagtctggcagactacagtccatggggttgcaaaaaagcagacatgactcagtgactaaacaacaacaataacaaaccccagtgccagagtatggaatgatggatatggacagcagaacacagacccattctctctccccgaggccagctggcataatcacacatgctagaagtcccccaggtgacctcattcacctggaagcagagagacttaaaccacgtgacccagcagttcaaggagtgtcctcctgggagcagcaggacttttagtattccactgtcagtctggagaaatactataaatacgggggtgtcaacacttctctgtggttagtttaatatgtcactgtcctacagctttagggcacaaacttaaggtccacagtggggaacacactgagagcaatgcagaagaattagggctttcagacaaggaaagccagattagaaccgtaaacatgtttcatgcaagataactctctgaatcattctcatagaggatagagacaaaaacatttaagaatttatacctttttacttgtccccagatctgaattttccatcatagtcccattgccattttatgataaagttctgacaccaagatatgggatcatttatgaggctgcaggaacacaggacaaaatggctaaaaaaaaaaataaaataatcgctcattttgatttagtcttctcctctgcccagtaatgactttggatgccatcctattgaccttccctgcttttgttcccatccaaatcgatacagtatgcaatatcataaatttgcctggctctctttcagctcattgctggaccaaacactccgcctgcaaactgggtgataatgaagctgtgggcgaggtggcctcctgtaatcagcgatcattacagtggggcctgactttaaagtaaatgatgaataggcagtcagatccaatagagctggggagatattgatcaagaagcagccttgtaaagttaaaaacttgacgtggagttctacaggcaatgagctttagctgcaaatagca

SEQ ID NO: 25024 - DNA, 1427 bp, Bovine  19866881231129
ttatgacaaacctagtacagcatcttaaaaagtaaagacatcactttgcctagaaaggtccatatagtcaaagctatggtgcttctagtaatcacgcactaatgtgagagttgtaccattaagaaggctgagtgctgaacaattgatgtttttgaattttggtgttggagaagactcttgagagtcccttggactgcaaggagatcaaaccagtcaatcctaaaggaaatcaactctaaatattcattgaaaggagtttgctaaaactgaagctccaatactttaggccacctaatgcaaagagctaactcattgaaaaagacctaggtgctagaaaagactgaagcaaaaggagaggtatgtggcaaaggatgagataggtacatagcatcccggactcaatggatatgagtttgagcaaactctagaatatagtggagcagaggagcttggactgctgcagtccacaatgtcgcatagaattggacacaacttagctactaaccaaaaattttcttagaacctcaaagcaatgtctgtgtcaaattattcttcatgatataggtacccagtataggtctggcacagaggttgttggtttttgaaatatttatttgaataaacaaatgaatccatgtatgcaagaagataagctaattgatactggaacataattagactttaatctctaaagttgataatataaataatgaaacaatataacacagcatatttctcacctaaatacactcattgactcctcttccactccgtgcaaatataaaatggtaaatctcaaatgaaattccttctcccaaagtgacttggagttatctcaggtttctgactaaagtctgtttaatggtaaagtgtttcacaatacagggaatgaagccagggagacttcttagtaaatggacaatttgttgtgagaggaaaattagaatcagcaaatttttaacctgaaaaattagaaaatattattactattttcatccagtgcacttaataattgccatgcacttgctctaatgtgcacttgagtctattaaatcatgactatgacactattgtctgtatccctattattgcacttatcacacagaactgtaattactacatttattatgcttttattttcatcattaactggaattctttgagagtcatcacaaagtattgaatatctgtatcccccagatgcatagcacataatcagtgttcagtaaatgcttgttgaatacatttcatatgtcatcctattctgtaatgatatgctttcatgtcaactctttcaaactcctcaaagatagtcttttatcttcatgacaatattcccacattgaataattgagttatcaggtcaataaataaatgagggaattaagacggataaatatacttaaaactcttttatatttcacagg

SEQ ID NO: 25025 - DNA, 1069 bp, Bovine  19866882199972
aaatcactatgtgcgtggctcctaatactaatggccacattaatgacacttcctgtgtcctcatataatgtctacggaaagctggtgctggctgagtacattctgacctggcttgtaacgtccttgcccgtttaaccatctgcggctggctaagcggggatcctccggaagcccagcctcatgctagggcttctctcagaggtctcagtgggctctgatcccgagctccgagtgacagcactggatagggtgtctcctccatgctggagggaggcatctgactcgacaggtgctcccggctgtccagacacacggacaccagccaacacctctcgtctttctcagtaaaaaggcactggttaacaagggggaaattttcaggcatggcacagttggtttggaaaatggttaggctcttccattgcaggaaatagaaaaccaaaactccaaacagaaaacctaatcatcctaattttgagggcacctttgttgttgaactgagataaattttctcgttccctcatctacctctcttctgcctttaggaagttgctttcatgttcatctgtccgcttcctcctttgctgccttcaaatcactctttgagactgccgtccagggttttatggtgttaagagggagacagacaagtgtgatatgagctgagacagaagagggcatggcggggtcacctcctctctttccttctgtgactatactttagagacaaactcaacaccattgaaacaactacagaattactaaattattcatttgggcaccttgaagatgcctttctgtgacattctgacccagtttttcaggcaaaaaatagttccacagacaggtggtgaccatgtgagtgaggataaactacatgccccaaatagagcagctgcttagactcaaaggctcacataacataggtgccctagtctcacagaactcgtctttacaagggtctttttcagatttcagaaagcccctaaaatcacaagtttttcattgctgcgggtatgactatgaataactttaaaaaacttttgagggagaaagagagaatcatagc

SEQ ID NO: 25026 - DNA, 1785 bp, Bovine  19866880447504
tgttcaaactacagcgaaattgcactcatctcacacgctagcaaagtaatgcccaaaattctccaagccagactccaacagtacgtgaactgagaacttacagatgttcaagctggatttagaaaaggcagaggaaccagagatcaaattgccaacatccactgtatcatagaaaaagcaagagagttccagaaaaacatctacttctattttatcgattatgctaaagcctttgtgtggatcacaacaaactgtggaacattcataaaaagatgggaacaccagaccacctgacctgcctcctgagaaatctgtatgcaggtcaaggagcaataagttagaaccgggcatggaacagtgggctggttccaaatcgggaaaggattatgtcaaggctgtattattgtcaccttgcttatttaacttatatgcagagtgcatcatgcaaaatgctgggcttgatgaagcacagactggaatcaagattgcagggattaatatcaataacctcagatacacagatgacaccacccttatggcagaaagcaaagaggaactaaagagtttcttgatgaaagtgaaagaggagagtgaaaaagctggcttaaaactcaacattcagaaagactaagatcatggcatctggtcccatcacatcatgggcaaatagatggggaaaccaatggaaacagtgacagactctattttcttgggctccaaaatcactgcaaatggtgactgcagccatgaaatcaaaagactcttgtcttgctgcttggaagaaaagctatgaccaccctagatagcatattaaaaagcagagacattattttgccaacaaagtccgtctagtcaaagctatggtttttccagtagtcatgtatggatatgagagttggactataaaggctgagtgctgaagaattgatgcttttgaactgtggtgttggagaagactcttgagagtcccttggactgcaaggagatcaaacaagtcgatgctgaaggaaatcagtcccgaatatcattggaaggactgatgctgaaattgaaactccaatactttggtgatctaatgcgaagaaccgactcatcggaaaagaccctgatgctgggaaatattgaaagcaggaggagaagggaacgacagaggatgagatggttggatggcatcaccgactcgatggacatgagtttgagcaagctctgggagttggtgatggacagggaggcctggagtgctgcagtccatggggtcacaaagagccggacacgactgagcgactgaactgaactgactgaactaccaagcgaaactattattttagagatgaccaggttctgatcactgatgtctcactggctcttgcgctgtattataaaccagcaggtagcttccgcgccaacgcgtgcgcagacttcaccctccgccctttccttccccacttccttctctaattgcgcaggtgcgctcccgataggaggcggtgctggcgactccgcgaaggggagccttgggcacgctttgggccagcagtgcgcgtgcgcggggctagagccaccgaccgtcaccggcgggagatggccgccgccggggaagcttcgtcggagccggcggcttcggaacaaccaacgggagctgtctgcctcagtgcgggcgagcatcgagcggaagcggcagcgggcgctgatgctgcgccaagcccggctggcggcccggccttacccggcaacggcagctgcaactctggaaggtttgggcccttggcggcgcctgcctcttct

SEQ ID NO: 25027 - DNA, 3453 bp, Bovine  19866880450833
caaagagtcgcacatgactgaagtgactaagcacagcacagcacaaacgaaatgtggcctttctctatcaggggagggcatcctcctggatgaaacaattagctttggggctaagactcatgggacaggaagggaaggatgaggaactctggcctagccagccaggactgctgactccaccactgtagctttaaaaataatttgtgatgaaagcttttgacctcctgtccataaacattacataggccatctcagccaggcagtcaagaaatggaaatcagggagtgttatttgcttgatccaagatatgttgttatcttacctgtgggccctcacaaaattttcagtctgccttctttctcttttaatttcctgtgctgttgctcttggaatttctcataagatctatcaattctaccttctaaatctgtctagaatctgtcctttcctctaacaccctcagtaaatttaccttctctgtcttttctcacccagcccccataatgctctaagaactttagctgaccatgacattctacttcctggaaccccacagtgtcataaaggctcctccttgggcccccagctagcccttgggattcaggtcctttcaatctctgatgtgtagctcacatgtcggctcctctgttactgcacccagaaccaagttgccctctcacatccctctgcctttgtatcctcgcagctcttcctgtctgaaatgctcccctacccccaccacctttaatccccctggagaatgtctacacccttatttagattttaatcttacagcctctgagaagcccaccctgccctcagacagactcaagggatccatcagttgttcccaaacactgtgggggcattggtcataacatagcctgtacatagcactcctgagttggtttctcccactaaactgtgaggtctcaagggcgggcagcatgtctgactcatcttttacccctggcggcaagcacaggacctgactcataacaaacacttactaaatgcctgttagaaagaacacccatctgtgccattatgaggttctgctaggagggtcctctgtgtggttgctgcctcgctcctcagggttcacccacactcacagaggctgagggccaagaggcactggtcagaggatgggtggaaaagcaggaggcctgcagttgctcccactgaaagcctccctgtacgcatgcgacttgttccctcgcagactctgtgacttgcacaaatccaatcattgtctttaacgaaaaagacacagggccccttggagaatgtttgtgaagggacacatctgtgggtaaactctatggggaagaattatgggcaagggggagaaacatcttaatagaatggagagggatgacacattgctactcttgcttagcaaggggaggtcactggcaggggaatgaaggtgttggtagcaaggcttcttatgttttagaaaatacagcctatccagtggttaccaagactttgcacttctatcatcttcttgagcccgttatccaccctgaggggcaggcaagacagaactgggttgttgtttatagataaggaaactaatatccagagaggtgaagtgacttgcccaagggcatgttttgagcaaagaccagcaaaaatgaagcgactttcccagggttggttgtgaagtaataatcagaactataattcatggggttatttgtaaaagtctctgtggagttttctttgagaaaacttttgaaatgagaaacattttctagtaaattgagtctgtacagggttttcaggcatctcttgggaaatttggctagatgacatgaaagatttcttccagctctgaaattctatgaactgtttttcactctgtcccaggttcacataactccatatagtacaattagaagtttgcaagtaatttccaaaacaaatagctctcctgcccgtttaagcatccctgtctgacttaccaaaaagtctcaagcccatttcttacttagtgtatcacctagtcatcaatctattctttccactctaactccctgctctgtggcaactctattacttgaccagttgttcacttcctctgtcagagataactagaatatagagctaaaggtataatttctatgaaagactagaaagcagaactgtcaccatgtgtttttgagatcttaatttccactaaaggggaattgaattgactggattagtgaaggttcatggtactcattggcttccctggtggctcagatggtaaagcatctgcctgcaatgcaggaaacccggattcgacccctgggttgggaagatcccctgaagaaggaaatggcaccccactccagtacccttgtctggaaaatcccatggacagaggagcctggtaggctacagtccatggggtcgccaagagtcggacatgactgagcaacttcactttctttcactttctgtggtactcattcctcctcagagaggtgtctgaatccttgtgcgtgccatatttggtagtgggatacaggattggagttttacatagatcagggtaggagtaggctttttctagaaaggaaagtctgtcttggttggatgaaccaagttatttaaattctgcctgataattctgtccagtctccttgcttgagaacaaagtattgtacacccatctgaactggataaaaacagaagttaatagcagctctgtggaaatagataccctgcttatcttctaatccaagagtccaggctctatctgctgcaccacatactcttcagggtgataattactcccattagttagtgtttcctgagaagtgaagtatggtatccaatttcaataatgaaggctatagcaataataacatgtaacagcctattttattttcatcaagaagaccaagtccatcagatagaagaactatgggtaattctgggtatattgctggatatctctgaagatggttatcctgtggggtttgttttaatttctctcttgactaccaagaacattctgacacttaaaaataagatgttcttgttgctgatggggaggggagagctcatcacaaagcactgggccaggacttccctggtggcacaatggataagaatctgcctgccaacgtaggggagatgggttccattcggaaagattccacatgccttggagcaactaagcccacgcgccacaactactgagctctcgtgccgcaaccactgaagcccgggcacctagagtccatgcttcgtagcaagagaagccacctcagtgaaaggcccttgcaccacagcaaagactagccccctctcaccacaactagagaaagcctgctcacagtaacaaagacccagtgcaaccatatataaaaaataaatatgaaaacttaaaattaataatagtaaaaaaatctttacaaaacactgggccacaacgctgcttttttcttccag

SEQ ID NO: 25028 - DNA, 1769 bp, Bovine  19866880516485
atttgtcctcctggtgtgattttttacaaaccaacacggtcactcctctttcttgggatcattgatccaacatcgtcagactcgcagacgccagccaggagttaggatataaacctgtaaggcctctgggcggctataccacatgacaggcaccttcttcacaatgaagcaactgggctccaatgcccagggtattctcttctaggcagttctaacaagcgtccttattgtgtctggctttttagagtagaagcaaacaaagactcaagaagctggcctactgaccctaggaaaaagcaatatttaacagcctgacaggagaaatgtccaaaagagtacaaaatgacagctgtattcactcagaatcacactctggattgaagtctacacattccagagctcctggtgttggtaatgacacaagacactaagaatcaagttgctttgtgatcagtgctatttaagagtgcaggattttacaataactgttaatggattgtaatcttaaaaattgtataaaaatttaaaagacaaaaaaggggtgctgggatagttgacagaaaaatgtccaacaacactggaaaccaaaacaaaagcacattaaacaataataaagtctgtgatgtttaaatttgcatgtattttatgaaatgaaaacactcaatgctggtgatgatcaggtaaaactggttctacacggaaaacaaaaactgtataaatttctcaaaggaaaggtaaggtgaattttaattaaatatgatattatgcattcacgaatagcaaaaaatttgaaaactatacaggaatgtgaaaattgcttatgatactacttgagaaaccataagacacacacaaaaaaatagcatgcccagaccgaatgtattaataacagcccataactatatgcctaagaaaaagagactggaaggaatatcactgcgcttccttctttccatcccctctttacatataggcagactgaggccaagtggctgccctgtcattgagaacctgtccctacagtttccatgtggcctacagggacagctgaaggggcagagtgaaggagtgctgaccatgcccaggagagtcaggtcatagaaggcctctggagctggggtggagaggactggttcaacatgtggccttggcacatgcttcctcaataccaagccctgaaggacagaggtaaatcagacctggtgcccatcctcagagcaactgggagaaagagaaggcttctgcctgaattaatcagggaagacatcaaaggaggaggtggcgtttggacccagaatcagagtgaggacacctggcatgccagagccagtgcatgccagctcgtgagagcggactgctagattttcagggatatcgagtgttggtgcctaaacatagccattattaaaaataaattatatgaacctgtaatttcataaataagatttgaaacaaaggtaatactcgatactaatcacttccacattattttactttatttcactgtgacctatgtccctgaggttgttctcatctgttgttaaccatatggtctgcatccacacatttgcccccaactccatgctgtagcgacaccatgtctgcggcctgaaactggcagtggtgggagtgtctacaccacggaaatgggcaagtaatccaaatcaggacttggtgtaacgctctgttgctttctagagtttagactctggactttaaaaagtgatggagaaaaaattaataatgcagattaactttaaagacagtca

SEQ ID NO: 25029 - DNA, 1442 bp, Bovine  19866880528046
ctgtcatcctaatcctgtggtacagacattgttgtcctcccattttgcagatgagaaaaccgagaggtgaagtatcttgtccaagaaactgaactgaggcggtggcagaaccatgatgcagtctgagttcactcttagccctgacactaaaaggcttcactggagtcctcaggaagatagtgtgagccatgcctgtgctctggctttatagttggggagggtactgtatgaaagattgtccccttttcctcctagaaacaacctgagatgcagagatccttactcaatcctggctctgctcccagtttaggcaagtgcttttccctctctggatctcagtttcccagtctgcaaaatggacacagttggcctagatgccctctgacaccccctccagctctaagcatctcgattttatgcgcagttcttcacagtcttatgacctgaattcagttaacaggtagtgttgcagggggttatgtttgcagtgatgcaactgttaagcctcagtgtcatgtgacacagtagagtacgcagaattggaaagctgctttgtttgcagcagaagattccaaacttgtgcacagtaaaaaaaaaaaaaaaaagaagtcctcaaaactttcttagtctgcggcctggaaaaactcgagcttatcatgagattgttgcacttggactcccacgggagaggaatgctccatgtgctaaaagtatccgctgttgactgattccccaagaggacctgccctttcttgtctctgtggagttaagtggatgccgctctgaagctgagccagctgctcggctgaaccagacggcggggaaaatgggtaatgtatagccatgtttgaggatgacaggtcacaccgtgactcaagcagggtacagtgtatgagttcttagagcaacgatagatagtcggcatttgctgcgacagagccctgcatggattctcttctttagtcctccacaagttttggttatcagccccattttcctggggactcacacagtaaagaaactgcctgcaatgtaggagacccaggttcaatcccggggtcaggaagatcccctggaggaggaaatggcaactcactccagtattcttgctgggaaattccatggacagaggagcctgacgggctaccgtccatggggtcgcaaagagttggacacaactgaatgactaacacacacacacacccattttaaagatggggaaactgaggcttagagagatgaagtagcttgcccaggagttgggactccagcccagacagtcagacccagtagcctgtgctgttaactaccacctccagtgagggtatgtgggatgagcctggaacggaacttggagaacaaagttcggaattaccagcaaatttttttttctaattcagtgtcttttgaagttggtacattattttcacataaatacaaat

SEQ ID NO: 25030 - DNA, 3283 bp, Bovine  19866880572344
ctcccacttatgcagaaaaagatcacttcatcaaacatcctgagaaaattgttgaaatgaggaagttcacactaacacactgagtattttacccatagttctgctcctccaagaatggatcttgattttgtaaaacaaaaaaccccaagtacattaacattcttcctaatttaatatcattcataagtttgattagtatgatttctacattttcatgcaggttagtatcacattttagatattctgcttattagagtcactcatcattgtagaaaacttagaaaatacaaaagcataagggaaacaattagaaaactgggatatctatgatataaaaacttacaattcaataataaaaagacaaataattcaactttaaaatgggcaaagatcttgaatagacatttctcccaataagatatgcaaatagccaatatgcacatgaaaagatactccacataattaatctttaaggaaatggaaatcagtttcttgagaggagcatcattaatttgttgctgtattcctggtcctcagcataagacctcgcttggagcatggggtcttaaatttgctgattgaatgtatgaacaaatgcaagaatgagtgagtgtatgaacaaaagaattgcagagagggaaatagtccagaggcaagaggaatgcaggaccagcctagaagataggaagacagagcataaagttcagtgaaaattcatggagggtaagtacccccaaaggcagctggaacaggtgatggggattaactgcaggcttggtgtcagatgctgcagtccatggggttgcaaagagtcagacatgactgagcaactgaactgaactggggtcaaatgatttttgagcaaacggttaaagatgtactcttttcttggggaagtgccacactgtgcagcttgtggggtcttagttgcctgaccagggattgaacccaggcccttagcagtgaaagcatatggagtcctaagcactggaccaccagggaattccctaaagctgtactttagaaaaatgaaactgtaagaccaagtataagatgggtcagaaggagagactgggagccagccaggacgctgttcaggcaaaaggcaatgggagctgaactaggcctgcagtcggaccagagaaaggatggaagccagagacactcatccaatttccaaatattataaaaactgtaaaaacaagtgtgtctcgtgacaaatagttcactgttcaatgggaatccaactattagaggaagtacttgccaataaaatttaagtggtttgtggtctgaagttgcaaccacactttttataaaggtaattgaaaggaaaacaaaaactccaattgagggtagtaagaaaacagggaaccataagactatcaccctattatgtggattggagttcatccacacaatgaaggagccctgggtcacattcatcctcctttggccctattttaagactggcaacaataactctcaaaccaggcttcaaacagagacagcccctgtctgtttcaagccatgaagggcattgcagggactatgtattagggtattagccatgtagagtattgcaaggacctgattccagctgtgaatgagtactagtggagaagaggaagaccattctgttaataatgttgagacttagagtttagtggttgagattattgatatcagggctgggctgtgcctggttgaactcagctctgtcactagattatgaccttgaataaattatttaacatctctgtaccttataatctcatctataaactgggattagtgaacacaatcattgagtagctacaaaaattaattaataaattttaaatgcttagaaacacctactatatactaagcaccatagaagtgtttactgttattattattattgcaaaaaataatggccaaaaccaggcaacagtggagtgggctgttctgaagtggagtgtttcctgtttccacaggtgtataaacaccagggctgagttagttgttgggttctgctttggacattgagttttcagtgctggtgaggtgaataaacctctgagtaggtttattcagcattattcattctgtttatttaattccacaaacatttaatgagcagctactctgcagatgctgtgctggcgatactgggatgaaccagagggtcccaattctcaaggacctgataatttagttaaggaggcaggtaggtatcacttcttatgtggagaagccacaataccagcacacatgaggttgacaggagcccaaggaaggagacagggcaagtttcctggaaaaggcagtaagaagcaaggtcccttggcccacattcaggacctggggaatgcagagtgggaaaagatctgcccttgctggtcagtgggtgactagattttggctttcagcactgataatcatctttcctagttcctgtctttagttgaattgtttggacccttctacttcttattgcttctggaaagaatattgttgttagtctttaagatgttttctaaatccctttgcacatacattttattgatcaaggtttcaatatgatggttttgcctcaatcgctttatcttttggttcagggaggttgaaatcttaagtttttccagaagggtgtcagttacagacaaaggagaccgcgtttcctgggttactaaagcaatacagcttaggtctgtaggatcaggctaatttctgtgttcctgtgtgctcatcccagacaagttacccaacttggtgtgctccttaccacggatgttctacgattataaatttatgccagtgatgttcaaagtgaccacattaagaggtaaagcccagcaatcaggggtaaaaatgcaagtaagaaagaaagccacacacatgtactatttactagatgatactgacaaatatgttcacatcctgtcctctcaggcatgaataaccccagtactgctctcagagaggaggtctaccaggaagtgctgccaaggttttcactcccccttgctggcttccattcttacctgcctgctccttatcaagctctgttagggctttcagttcttcctgtgctttgttcataactcctctttcagccaggatcacagttggtctgggaggtgagaggcacaagcaggaatacagatgtagtcatagatttctcctgacactgaatggggtgaggcaagaacatatttactctattctcctgcttgctttccttttgtgcccccaccaagatgactcacgctgttgtgctctgggcaggccctgcagc

SEQ ID NO: 25031 - DNA, 888 bp, Bovine  19866880602601
atagcagctcctgccactgcacagcctcggcctcagctggtggggctgaatggctgtttgttcagcctgagccaggcagaatcagccctgacagtgatggcccagtcggtattatgtaaggagacccagcttacctgcctgtagacagacaaagcagatgatttgacaggcaaaacagagccagcctcttcactcccaggcagccaaggggctattcaaagccagggcctggaagattttcatgaggtgctgacatatgaagccggaatgcagcagggacaaggcagaactgacaccccgtgcagtcaggcatggcaggtgtctccggcatccaaactgggccttcaggagctttgactgggccccacccatgagggagggagagagagtgagctttgggagagaggccccaattttcaggcctgaatctgcagcaaacctcacctttaccactgccctctttattgttcaatcaaggaaaacattccaagcctttgtcatgtgacacaggatgcaggtgtaaagagccgggagtacttgaggccttggttactggtcaagctgcccacaccaggggctagtggaggcagcaaaggaacaggtactgagtgcccaccacatgcccgacactaacggcttcacccccacagacactgatttcaccctcacaggagccctacaagctaagttatctctatgttgcacatgagaaaacaatctcccaaggaggaacttgcccaaaatcactcagctgggaaatggtacacctaggatttgaacccaggtctcctcagcaccaagatgtatgttctttcgacctaaaagctggttcataagacccacaggccccggactcacaccatgtttgcaatcaaagcggctttggca

SEQ ID NO: 25032 - DNA, 1451 bp, Bovine  19866880627240
tggaatattccctaaagagaccttttttgcccttttgggtccatatctctaggccctaaatcacactctccactttctgtgtgaattccctggatcctgggagatggctgtagacccaaagcaccaagaaggcattcttccagcctgctcatcacttttctaataaatcccaactggacgtgagctctgctctcaccatgagctctgtgcctgtggtcacacaacctaactgagcctcagttccctcatctgaagtactcttggaattatttctttggccacttctttaatgaatacttgttgagcaccaaccacaggccaggcataaggtcagcacctacttcacaggctgtgatgaggaccaagtgagtctgaggacaagggctcacacgtgatatgtgtcccaaatggtgctgcccttgtgctatggctgggaacaatgagtaaaccttaactctttaggtctagttacgagttactatttttgagaggggaccacagctggcgcttccctactatagggttggggaggagtccttcctgtcccagaggtgttgataccatagccctcgccctccctggcctcttttaggaaatggaacctctcatcttggaaccaggagcacttcttttaaaaaagctggctgagtctgatgaggatgtgaacaatctcttcaaaaaggtggaaaacgacagcaacctcgaagactacaccatccaagtaggcgtctccctcatggtggggcctgccccgcttgtgtccgctcctgctcctccttccctgtgtcccacccattctgagagtccaacccaaacttctctgcacagaccctgttggagctgagggatcaggtggccgagaagttcctgctgcagaagcaggagatcaaggagctggatgagacactgcactcacttgagttctcccgggtagataaagtgagcttgcctccagatgggctctgggtgactgtcgcttgtgcaatttatggggcatcacctgttttcagtcctctaggagaagagagtcactcactgtggtgccttgtcatttctagctaaaaagcgtgttgaagaaatatgtggaaatcatagagaaaacttcctacctcatgcagcccgacgtgtataggctgatcaataaagaagccatggtgagtggttttcacgtgaacgggatcagcctgcaagagcaggaccacaggatgccctagagcctgggtctcagcaatgatgggcttctcatatgtaacatttccaagtaactcaggttggccacttgagttcagaaccagagtctttgttaagtacttccaatggaaatccctgcagtacattttgtacttccctgccatgttcatcccagtgaacctaatacagtgtcagcagtttgactaacgctgattctgcgagcaccttcggggctgtgtctcagctgccatgtgcagtgc

SEQ ID NO: 25033 - DNA, 3721 bp, Bovine  19866880704353
ttagtataaaatctaggctaggaccaggtattggctttaggtaccaagtctttctaaatttctttattctggagtattttcatagccttatcgtttatgacactggcatttttgaagaagtctttccccttcctctatcttttttacagtagtattttccatgtggggtttttctgatgtttcctgatggtcagattcaggttattcatttcaggttggatagtacacaactgatgtgacttttccagggtatcatgtctggaggcatgtgatatccatctgcccttagtggtgatgtatttattttttattagataggcaaaagtcctgtaagaccatgtaagtgcctgcttctgttcaacactccccttaagtttagcatccatccatgagtggttcttgcctgaacctaggatgatggttgcaaaaactgttttctaacttcagcactcattcattccacatttaacaagttggaagtcagccctgataccatcctctcccctacttattttttactggtatggattcattaattcctgttcttctcagtggcttttggttaatttctgtcctcaattattttggtggtcaaattgcctcagatttgggccaacagaaatatctccagactagctcttgtgtccttttggcatgtcttcatcattctttgagcacatctttctagctcaaaatacacatatatgtatcaggttcagttgagtcactccgttgtgtctgagtctttgcagtgtccatcgagtcagttatgccatccaaccatctcatcctctgtcatccccttttcctcctgccttcaatctttccctcctgccttcaatctttcccagcatcagggtcttctccaatgaatcagctcttcacatcaggtggccaatatatatacattatatatctataatgtatgagttcacacccagttctaatccaaaatttagggtttattctggttttctccctttccttatttgtaactcctttctctgacagtcagaatcctgatttcccttatcctttataatatgtgtagttctttgattggtgctcctgaatgtaactaattccccttcatgtctgcctcctctctaggagaccctccttatttggcttgggctctgcccaccctaccacagatgctcactttacctgttactcctcatggctttaggtctagatttttcaggtggagaaagaagtggcaaaaaaggagacagcaggtttttattaaatttttttattacttcctttctagcacaagtcttttcaggactgtctagtgagtattaaagacaggctttgttcctgtcgttatagaccttgagaggttagttgaagaatgggaagaaaagccataaagtcagagtaaaacattatgttcagttgtgacaattatggacagtaaggtagatttttgttaagtattcttttagtgttaagaaaacaattttcttctctctcaatttcacagaatgctcaaatggggcagaggttagcttagtgattggcatgcagtcacattttgagggattttcttcattgggtagtaaaggaaaagtggctggaataatcagaacgaagttgaaaagtaggtattggaacttgaacagaaacatcttcttgtcattatctgaaaccatgaggcatctgtgcagttctggttagcatactattttaaaaatatcccacttttaaaataaaataaggttcttcagaatatgggaggatacaggaataaagattagagtttagaccatgataaactatcatgaagtgtacgcactgaagcttgaaagcagcctgaagtagagtgcttttcatacccggaagtgtatgaaaaggcagcgcatcttagtggtgaagaacatggactgagctggactgtgcctctgcctgtttgaccttaggcacaacttatgtaacctctctgtgcgctagttttctcatctgtaaaattgggaagatagttgtacttattacaaagtgttgtgaggattgaatgtgtttaaataaagtacttagaacagtgcctgatacacagccttatttgtttgcttatccgtatgatatagtaaaggctaaacataaaaagattcaagtggtattttgatactacttgcagtaaaatggattaaagaaaatgtgtgattacttggtgtactttgatttttaaggttgagattatagaaggtaatgatcatactctcccttaggtagggcagccatcaaagacaatgctggatcattggtcagagtagaaaaaatttgctttttttattcattaaaccagaaactgagatgttattagcttattttctaattaacacaaagcatttggtaacatgcagtgtgaactttagaatgtcctggttgcttttcagagcatccaacccaattcaattctttgtgaaaatgctgttttgtatgatgtagtaggaaaagttctcaacaattgaaatacatgacctgggttcccctgctattcattgttcagttttcctacttgcaaaataaaatgaagtaaaacaactctatagttctttccagctcttagtagccagtgattcttttctttgttgtactttgtaacaattacaatttgtctcctaaaatactgctgtcattccataaaataaagaattcagtagatataaggtcagttgcagaagcagcttttttaagatgaaacatcagcagagtggctgggttcttggctttctagttttcttgcagtttgacttgcctcttagagaagtggctcccgactatgaggaacttaaatccttatcctcagtcgtcccagctgattcccctctcattctttggcatcctgttttccatagtcagctgcttaaactattctttgcctgtcttctgaatctagtttcttgctgttcttctaatccacataactccatttctgaacctcctgtttcaaactaaaaccaacagtgacttgaaagattccacagaccaaactagtgagctaggaaagtaggcttgccaaaactgtatcattagttttgacttgttataaaattaaggcataaaccatattcggttaaacacagctgaaaagcaatggatttttaattcagctgaatagcaccactgaacaattggcttttattttttccttagaattacggcgagcagtaagaagcagtgtatggaaaaaggaaacagctgctcatcaacatgagtatggggctgaagaaaagctagaggatgacatgtaccggaagacttgtactgtgtgtggccatgaactgacatatgagaaaatgtgatgttaagtgatctgttctacagtgtggaaatttagattggtcctgttcaaaattcaccaaaatgtaaagtcttcacaaatgaatgaaacacttgtataaataatgctccaataattatgtatgttatggcttaacagcaagtttcagttaaggtccagcaggtctggtgggcaatacactgagtgtgtgaccattttttctataataaggctgggagctgagcaatagaatgggtttaaaagtgttagcttagagctaaaactgagaaataacgaccaaggcaaaccctcgattgaggttaagaggaagagcttttagcagtaaaggcaaaagctggccgagctggattcatatcccaggaaccagcagggatggtggtagaccactgcaccccagaccctgggccaggtctt

SEQ ID NO: 25034 - DNA, 839 bp, Bovine  19866880777180
gtgtttttttaactgttagttacttttgacatttttaaaaaggcttcttgtggaagtcagaccaaaagcaggaagatactgcagcaagatggatttgggaaaagaccagtctctctcaaagctccatcagacacctgatcatcatcaagaagagacccatgttccaggtaatgaaagaaaccttaagagacagtggctgttgggaaggattgggctatgattattttcctctttgtatgggtctggcaaaaaaggggcatcattgggtgggtacattcatgtattagaaaggaagaataggggctatataactttctgagctgacttctagcactaagattctagtaagcaggagaaacacaaggaaataataaataattatatatatatatgatcatgaaaatacccaatgatggatggtgtggtaaagcaagtacagccatatatgtagcacaaatatagtgtaacttttggaaaggtatctggcaataagtagcaagaactataagagtgtttattctgctgactgactaatcttagtctttggatatatcctaaagcagcattttggctgcttttgcagaaccctaggccttgagacagtgatttaaacattttgtacaccacggatccctttggctttctgatgaaactctagacaccttcttagactaaattttttaaatacataaagttaattacatatgattacaaaggaagcaattatattaagaaaagtatcaaaataaaaaactgatataataatatatgtgcttatttacaggtgcattaaataacaagatccagtgatggatctcattaccactgtatcaaatcaa

SEQ ID NO: 25035 - DNA, 1626 bp, Bovine  19866880851773
cttctttcccacactccccaactcttccctagtaaattaattacacagaaagaggctgcctttctcttgccagaactcacttactcaaagatctttattagaaacagttcatatgaacactcaagtttatctgaaactgcacaacgagcttctgaaatatttaatgcttgaaagttttgctccagaatcaaaacttacaagatatctcctgagaaaggtggggaaatggttggatttattatgttttttctgatcttggtcatcttgtagcttaaaagaaataaatggaaacaaagttaaataccagtttctttctaagcctgcctaactgcccagtttttctttcttttttgcatgaaaagatgccagggatggaagggccagcccacaaaatgaaagccctcaccaagagactcaagagagttttgttatctctttgacttttaactcacccattgggtccagggcttaataaaaagagagtgggcaatggacaaatgtatttctacctgcctcattggaaaaccacatttatgacccagcagtaatagctgccgaatgatcagcacatcatgctgaaattgtgacataattggggcctggagctaatccagagttgcttgccatgagctctgttcccattccctggagtaaggttaggccttgggtggcccatccatgctgccaaatatgcagggcggcagcagccctgatgggcccttaaagatcatatggggcacggttggattctacagctctcttgtatatcacatgggaaccctgcagggtgtgagtgatggaactgggtcacactgtggcaacccagcacagtccggattcagagccaggtttgcagttctcagaggctgggaaaagcaggcctcggtcaagctaaacagagatctttcccattttttaaaaaagttacttcttttgcaaatttgtcctcctcatcttatgtgggaagacgctataggagtcttttattgtaataagacagtcaaaggcacaagaggtcaaactgtgtaaaaagagctttgaaaagtacaggaaagagtgaaatcatgtgattcttcaccattcctctagactctggagtagacgctaccttgtgccccgtttagagctaagggccctccccggttagaatgtccaaggcaagacctttggagctgcgcctctatgagggtctcttgtcccagtccatgggcctaggacgcttctccccacctcccattttcaaagccgcccggtaggcgcccggtgtacgcggtgcaccgggagtctgcgcctgtcacgccggctcggtccctgccacgtggctctcaattcggccctctgtccagtcctgtcctcaggtttcgtcgatacttagttcgtaaggacagtcgaggtatctatgaattttcgcctgtatgctccgctcacatggcggacacgaaccgatccactgcgcctggataggcagccgcgtggcgagcgtggtaggcgcctccactgcccgctccgagctgcccaccaggattgtagcagggccccagagctccgaactggccgggcgatgtgcgcccatagaagtccaccgcagtctcgacgccgccgctgctgccacccgcggggggcgaa

SEQ ID NO: 25036 - DNA, 2031 bp, Bovine  19866880855701
ttttgagtgagttttggcagattttgtctttcaaggatttggaccatttcatctaggctatcagatttacaggtatagacttagttagtcctttattattttgtaatatgtatgagatctatagtgatgctccctctttcatttttgatacttgtaatttttgccttctttcttcttagttagcttggagaaaaccttattgatttaattgatcttttcaaagaatgagcttttggttttatggattttctctatttatttcctgttttcagtttcattgatttctgttctgatttttgtgattatttttggtacacactttggatttaatttgcttttttctaggttcctaaactagaacttagattactgattttaggtctctctctcttcattatcaagggcttcctttgtggcttcccttatcaagtgcttcccatatcaaaggcttcccctgtggctcagctgctgcgggaaacctgggttcgatccctgggttggaaagatcccctggagaagggaagggctacccactccagtattctggcctggagaattccgtggattgtatagtccatgggtttgcaagagtcggacacacctgagcgactttcactttcacttttcttcattatactgcattataatgacattatactgggtttgatccctgggtcaagaagatctcctagagaaggaaatggcaacccactccagtattcttgcctggagaatttaatggacagaggagcctggtgggctccagttcacagagtcacaaagagtcacacacaactgattacacccatagacaggcatcccttgtatcatggctgtcatttattctacctgtatgtaaggacgcataagcctacagagtatatatgggcttctcagattttgctagtggtaaagaatctgcttgccaatgcaggagactcaagagatgcaggtttgatccctgggttgagaagatcccctagaagagggcatgtcaagccactccagtattcttgcctggagaatcccagggacagagaagcctggtgggctagtccatagggtcacaaagagtcagacacgagtgaattaacttctcatgctagcatgcatacaagcatagagtatatatatatactcttattcatgctattatttgaaccaatcgctctttactagatcaataagaagaaaaatgaaactttttgttttactttttctttttcctttcctgatgccttccttctggttgacctgagtttgtgatttatatttgtgatttatattattttccttctctcttaggaacttctcttaagatttcttacaagataaatctactggcagcaagtctttatttctccttcatttatgaacaataatttcacagaatttagtatcctagtttggtgaattttcactctcaacactttaaatatttcactccactgtcttcttgcctgcatggtttctgaggtttttgttcctctgtcttctttcaagattttttatttattttttattttctgaagtttgactatgatatgcttagatataggtttctatgggcttttttcctacttggtgttctgtgaacttcctaaatctatgatttggtgtctgacattaatttgaggaaattctcagtcatcattgcttcaaatggcacttctgttccttttctttctggtattcctattgcatttgcatgtggttctccctcaattcctggatattatatcctatttgtttcagactttttctttctctttgattttcacttgtttctattgtcatatattgatgctcagagattcttccctcatctatgtcttgtctgctcatgaacccatcaaaggcattcttcatttctgatgctgcatttttgatttctaacatttcttgttgattctttattagaatttccacctctttactttcattatccatctgttcttgcctgttgtctacttttcccattaatgcccttcacttattaatctagcttaaaaaattcttcgtatgataatt

SEQ ID NO: 25037 - DNA, 1383 bp, Bovine  19866880879488
tgcagcaaatgtgtcacattccctgttgccactggggctgggacaccccagaacgtagaaccaggtgaccagcccagggccagagaactgggagatggcctggtctggaggataacacctcaagagaaaagtcagcagtaaggactctgcctgcctcccccatggacccccaaaggtgccctccccagagggccctcccctcctgctgtaccagatggtgcacagatggtccagtcgcttttgctgcaggctgctctggttcttcatcatggtctcaagctctttcttcacagccggaggagtctggattctctcactggccatgaactcactgggtgtccagacacattggaccatggacagaagaggaggggcagggtgggtgggagagaagggcatgagactcacggtaagaacattcagcaccctgacaccactcccaaccccttccccacatccaggccccagggatacaggaaaggagggaagagagggagggagggtgagggagggaagaacagaggggtcggcaggcacagctcaggtgtggatcctgactgctgcctccagctctgtgaccttggacaagtcgccccttccctgaaacttggtttcctcttctgtcaaggtaatgacaataccttcctcaagtggtacttgtgaggaccctaccagataatgcgagcaaaaccattagcaccatgcctcactcctgggaaatgcccagtaaatgtcacctcttcccatcactgtccatgatggttactgatgtctgaacctcccagatccaagcccaggcctggaccaggtactttccatagagcatcttgttgatcatcaccgaaaccgtcaccagtccatcatagtatctgcagacaaagcctgcgaatgtttaagcccttgaccaaggtcacaaagaaaatacaggggcagtcagacctcggtacacttctccatccgtcctacagtcagactccggtggtctccatttagaaatgtgggtggacagcgggcctcctgccaccacacctacagcacagacagatactctctggtgactttagacatcttggttccaagtctccctttcttagcaaaagaaagccttctttgctggccaaaacctccatggcctttgtgtcagtattaacaagagtgccacctgatgggggaagcttggagataggccctctcttcaccctccctcccaggagtgaaacttgctcccacagggtgggaagtggcccaagcctgagggatggccattctccttggcccagtaacagtaaagagtggacagtgggcaggtaatcaggctaacattttcaaaccacttgtacagtgggcttcagctagtaaagaatccacctgctgtgcgggaaa

SEQ ID NO: 25038 - DNA, 1410 bp, Bovine  19866880952535
attgacgtggagccaatataagatgattttgcaagaggaacaaaagcccggaggtaagaaaactaagtctcaactgtatttcttcagtcaagtcattttcctttgagcttcagcaggagaagggtttagtcagtgatccctgagaaaagcatcaaaggcccagaagggcagcatccatctaccacactgtgagccagttctcagtggcctgcagcattccaagccactctgttccttctcccagccaaccgagccctgcaagctaggccggacctggggtcttaggcagcagctgccctgacacctgtctgttctcctataactgaggctcctgggactcttcccataaccccaggtgggaaaaagaatcgagcccatctatcaagaatctgtcaagtactccactgtaaattaggtgtttcctatgatcctcctttgcttggcactgaactaagattaactaagaactggttaatcactggacacagtacccaacatgatgcagtctttcttttgtaaagcaaatgttacaagtgacaaatgtgaccagacctgactagaacttaccgtgagcgtggcagcagcctggtgtctcaccagcgctccactccctggaggacaaccttgatgagttacttctggacatatctgcattaactgtacctacatgatcctgaaacatcaacggcaattttacctttttctttgcaaatgagtatttcttctttgcactgacatctaactctgctttgagactgctactgggattcataagacgcgtgtctttcaaatccaggtctgaaaaccttaaaacacaggcctccaggtcatcatctccttggtctggtgaagtggaagaaggcatctggtttggctccagccgtggggtaggttcctttctgctaactatcacctaggaagtaagcaagggaaaaacaacaacgtccaagtctttgattactacttgaagtaaatcagtcatgcaaatgagcatggcccagtagcccaaactatccattcattcacttgttcatctaagaaatatttatttagcaccaactctatgccctgcactgttctaagccctgaagatgtagtagtgaaagaaacagagaaagtttcttctttcttagagcttactttccagtggggagagagaggaggtaaacaaatgaattaaactgctttttttttttttttaaagtcagatggtagaaagggctatgaagacaaataaacaaggtaaggagacaagagtgatggaaggactctttagaactcagagggtagttcaggtctttttgaggcagaagcatttcagcagaaacctgaatcagagggtaagccgtgccaacatttaggggaaaacacaccaaaaaaaagtacgaggtacaaccaaaatcaaccaag

SEQ ID NO: 25039 - DNA, 2225 bp, Bovine  19866880977493
cagattttacatttttaaatggctgggaaaaaaacaaaaccaaaaacaacctaaagaagataatcaatcatgtaataattaggtgaaattcaaacttcagggtccagaaaaaaagttttattgaaacatagccatacccatttatttctgtgttgcctggggctgcttctatgtgataagagcagagtgagaatttgagtcagaaacctgacacccgacagggcttaaaatatttaccacaggaagcatttgctgaatcttgctctagactctaggcatctgggacttgggctaattgctccttgtgatctctagcacccagacttgacaagggcctgggggggcactctgcccgagagtgtttgactggagtctgggggttggcttgggggagccaggggtgagcccggagtgccttggcagtgcaggggaattgctccagaggggctggccatgacaaggcggaggcacttaccagggacaaagttgtaagcccctggactcccactcctctcacagcccagcatccttgggtgaccaccctgctccccagcagcacaggtccccagttacgcacgtccaagacctccagctcctcctccaccttgctctggagacatcccaccatctggaagaaggatgggctcaccaggctctctgcctcctcctcagtgaaggccttccagtccagcagctgcttctggaagggggcgaggcagagcccggcttaggctgatgggggcttcacctcaggactggtcctgccccgagaccaaccctcccacccatctccatgaaccttggcagaaagccccacagtggcccagtcaggccagcttcatctgcccactgtgtccaggtgctgagtaccgcccctggtcactgactctgccagaggtgttctcattagcccctcttggcagataaggaaactaaagcttggggagaagtgaagggacttgctggagtgcacacacctggcaagtggtgggcctgggatctgaactctcctacttccgatcctacaggcataaactgccatcctacacaccctcagcattgctgtaagccagacagggctcccatttcctgtctggagttatgccaactggaaagccagttctctatattaatagacttgatttatgcacaaaatctagaataaatcaacctcccccaattattataaaacatgaaatgtgtctccagttgaacacttccaatgctgctgcccaggaacaccaggcgccatctgtcaggctcaaagtgctcctagggtccgtggtgacctcagcactcacaccctgcatatgcccagcagagggccgtgagcaggggcacaaggaactgacgctagggccacagggctgtggaatcccaggggcaggggtgagtgaggaggtgagtgctggggggcgtggtcttggggaggctctctagagcacaaggcttccctccaggctttactcttaaggtccgatgtccctaaagggctgactaggaggcatgtgatggcccctaaggccccagagcaagcaggcagagccctgtgggctgggacagcccctggatcttttgcaaactggtcttctcatcttcagatggggccagcgacacccactctgtaggaccttggaggatctgatgagagtggtgcaagagagtggcacagcccccagggaccacagcacccgcagtgcactggaaagccctccgctcccctgaactctgttcagagtcctgatggcagagccaaaacttgacagacacacatgtgaggcagcaggagcgtcttggggcctacaggcaagaccgtcatggcctggggactcctacagccacagccagcatgttagaccatattcaaaatgattaggtgtgggggattttcatctgaacagtcttacaaaggaggcggggaaggggccttttgacataatatgtcctcataccccaggaaaccacaccttgtcattgaagggggttgtgggaggtctcactgtctcacactctaacagcggcgggtgggtgaagaacagaggctggcgggtagagagtaaagttggctgtgacagcagtggcagcactgtttataaaagggaactggtggaataacgtccatgacataatctccactgaataaataaagtcaagtgatacagagggtcaagtgaagggtgaggtgatcagagtgctaaattttgtctgtggggtcaaggaaggct

SEQ ID NO: 25040 - DNA, 739 bp, Bovine  19866881107467
cttttgagaggtgaactgaacgctgaaaaagtgcctccatccccactacctgctccaaaacaaataccaccactcaaagggtgtccagcagttatgccaggagactttaaagagaaagttgcagagctgttggtgaaatactcaagtggtctttgggccagtgcactcccgaaaacatttgaggacatgtacaaagtgaaattacccgaggatgccttaaaaaatcttgacttgctttctgacgtatgcaccgtagactacatttctggaaatccccagaaggccattctctatgctaaacttccatcgcccgctgacaaaatcctaaaggatgcagagcaagcacatggcaattatgatatcaagtctacggttgaacaagaatatttgcagatagaagaaaacattgctgaaagtacggacacctttatggagactgtgacaattcctccgttaatcattccaactgagacatcaccatcagtcttggtggttgaactgagcaacacaaatgaagtggttatcaggcaagtttattttctaattctttagaatcctggtaaagatctccaggagaaggaaatagcaactcactccagtattcttgctttggagaattccatggacagaggagcctggcaggctacagttcatggggttgcaaagaggcagacacggctgagcagctaacactttcactgtcactactcttgctacttggcttttcttcacatgggtg

SEQ ID NO: 25041 - DNA, 805 bp, Bovine  19866881130431
aaaaagatttagtgatgagcctaataactttcccattttgaagcaatgatgcacataaaagctattttgaaatattcatagcagctgtaataatgaaaatactgtgattctattgatgacaaagtcacaagtacatccaatacacctgatttgcttcttacattcataattgaagtgctatatttagtgaagggttatgaaaccaaagatgaaattattttccagtccaaattcacaggcccctttagtacaatattaccgactccaggttaagaccctagatttagcctattagttcaactcttagcaggtggacagagtgagtgcggttattcccattttaaaggacttgtctaactagtaaacaatagagtcagatcccaacccagggctcctaatggtcagggttctgtctgccccagcactgcatccccagctctggtgggaaatggtggtcctgtgcagtcctttcccctttatttgtcaagcaatcagtactggcctgccttccagaaggttaatacagaggatgtgcctgctcaggagttgcggttctgagccagtgctgacctacccgacactatgtcattgttgaaggataaggcataacgctcatcgaaaacaaacaacttccctttgtaaaaaccatcaggaaactcctccaggtacttgtggatgccacccttgagctggaacacttccttgcacactccctgtgtatggaaacacaacaggaaatttgaggagactagcagaggccagtaggaagctccacagagaagcgacatgtggtaggaatgccaaa

SEQ ID NO: 25042 - DNA, 2867 bp, Bovine  19866881216932
ttatttcttatagagctgaaattctgatggttctatgagtccttagtaaactacctccctgaactaactctgatactttcacagttgaaatttaattctctggaaatatcagctaagcattaatttttgcatattcttattgattgagttacagagataaggaatcttcattatggtattcaatcataggtctttgtgttttagagagcatagtttttaaggttagaaagttactttttaaaattatgaatatcacaaaatttagaacactgaggtctttctaaatagtagaaatgcatggatagctgtcgaattgagtgctgacttgtgattcccttttaggtgatctttgcagagctgtttcaacttccggcaccgcctcatatcgatgtgatgtacacgacacttctcattgaactgtgcaaacttcagcctggctctctaccccaagttgtatcctttcctttgtttttaaacatactctatttggcctggctttacaagattattaaatatttctgctggtaggtttaaatcacttcatgaaaacagtttggcatttctttaaaagttaaagatcacatataccatatagtcagccactctactctttgactgttggcctaagaatattaatgtttataactttatgtgtaacaaccccaaactggaaaccgtccaaatatccatcaatacatgaatggataagcaaattttgttacaattatacaatggaatactactcaggttaaaaaaaaacaaacagattttcaatgcaggcatcaacatgagtgaattgcaaaatatatgttgaataaaagatgctaaacaaatatgaatttatagtatatgataccatttacacagaatcctagaaaatgcaaataatgtaatgacaacagaccaatatttgcttgggggcataaatgggaagaagggaggatggattataagaagaatgtggcaattttggaggtgatgtaaatgtttattatcttgatttcgtaggtgtataaggtcaggtgttactgtatatcattgatacctcaaagatcagttacttgaaaagaattactagtcatttcatagacttctaggaaatgttactcgttttttctatcacagatttattttcaaagagggtatggtttccttatcctgaaattcacagcttgcacaggcaactgaaatgttatatatgcgtttggacacaatgaatactacatgtgtagacaggtatagtattgccccccccccccccccgccttttttttttagtatttggctgcggagggttttagctgctgcatgtgagatccagttccctgaccaggaatcgaacccacgtcccctaaattgggagcgtggagtctcagccactgtattaccagggaagtccctgccttatttctatagagtgttagcagcttctactccctatactttataaaagtatttgatcagaaaaatatttgcccttttaagaatttccaagttggtttttctttcttgccttctccaaataatcctatatataataaagctcatacttgttgtaatatagcatttcactttctagtcttaattttcaatatgaaatgatacccttgctgaagttttctttaatttcattgcttatttgtttggtgctttggtatggttacactttccctttgtattaggtaggtaagcttttaaaatagactttatgctaattcatatgtagaagcagagtctaatcctgtatatttattatgtttatatattatgtatttgtttatagatagtgtctgtttctaaaataattaacttctctatgactacaacttcaagacttggtttatacaaaagaccatattggatttttacagccgtgttaattggcatgcccactgttgtcttttgggtgagatcttactgcctctgttagctaatatgctctcttactctgtcactttcccaaattagctcagaacagatagtgcatattttccataatctgtcatgtccattgttcaaatgcagtatttgaaaactatcagaaaaggctaccctgagtgttgacctattatcttgagtagttttaatgattgaaattatagggacatagggatatgctttaaggtgtctgctgaggttttatccagtctaattaataaactaccagttgctctgggcattccaactatgccattcattcagcaagtatttactgggctcttacaaatttcccagcattatatagtatactaaagtgatccttatctagttagatcaggggtgtctttaagagaaaaagggcctttgatggtatgttttgttgtttgtggtaaaaagggcatggtatgataatgaaagactgtgctttggctcttgcatttataaaatgtttttaatctttttttgcacctcacagctcggtttcattgtcaattaaatggaataatatatccctcagcagttactgtgagaattaaattatataatataaacatatataaggttcttgatataaaacaggcacttgagtcgtatctgttattctcttgaaaaggatagcactgttaggaggagtgagatggggactgttacttttttgaagtagatgatgagttgcaggatttgcacagagaagggtaggtggcaggagaaagtaacagctataggtagggtgaaaatagggtcttatttgtctgaagaattatgtgaattcctattataaactgcaaccattcatccttttccacctcccccccttctttgtgtaggtttattaattggttttcccatcatctaagtaacttccaattccgttggagctgggaagattggtaagtagtgttatatctgtcttttctctacagttt

SEQ ID NO: 25043 - DNA, 512 bp, Bovine  19866881338935
aatgatgaatggtaaccctctgttctgtcttttgcaactcttacatgaaagcttttccaaaataaaaacttataaaatatatttgttgcacaaagaagttcatagccaccatcaaggatatctcgaagccagtgagaatgtggaatggctttatggttctaacgcatccggttctaacacaacagtactctaacacaatgctgacaaacgtaagccttcgtttctcagatctagtttatattattccatgttgatctttctaacagccaagagagtgaagtcagatggcatagatgaggaaaccgagacacacaaaatagttcccactttctcattgaacagatgaagggactctatcccagaaaaagggaaggatttgtcccagtcacagagcaggttaaaaggccagtccaggagtaagatttctggctccgctttcttaaaaccatcttggctgctgtttcagggcagctgtagacaaagcttaaatgtggactctttgggaaggcaaa

SEQ ID NO: 25044 - DNA, 1054 bp, Bovine  19866881386367
tggtctatttagtggacacatcgttgccgacacagatatctggattcatgattttatgtcagagtatctggtagagctttcaaaggtcaattaatcactgattctgagaccttgacaactaattcagattttttagcaataacaaaaatgtagtaggcttttaaaaaaaaattacctctgctacatggctttgactgctgtgggaagttgaaaagaatatgcttattttttttttttaagcttatgtttgatgaaagatatttaacaagttttgtcttaacagagttgactttcaaagagaattgcacttgaattactactataatattagaattaaaatgtttatcaatacaaaaactgattatcttataatttctcggctttatgatcttaaagacccctttccctttcctgttcatgttttcttccttgttgtgctcagttcttctcaagttagcttgagaatttcatgatttaaccctgccttagtctagtggtgggtcccaaagcaggtggtcaccacaccatgtgaagtctctcccaagtcttcagcacatcagcattactactggtggtgctgctggaggaacagcccaggcaaaccagcacatccctcaccccagatcatcccaaatctcgagtaacttctcattgcccagagagtgtggactgagaaccatctccctgcccaaccgcactgtccactgcttctccctgcaccagtcacactaaaccttcatctggttcccaaaccccatgcgtgctcatccagaactgctgatgttctaaagcaagtcttcctcccctccagaccactcttgctgtcttccctcagcctgcagctcattttgtctccaccagtcttgtctgtcggtatcctccctgacttcccaggcttatctggttccactccccgattcccctcctactgcattgtacttccaactccgcctctcatagtgcccagacctcactgagcttcctaccatatcaatagttgtctgcaccaatcactccaaatagattgtgagcaccttgagggagggagggaggg

SEQ ID NO: 25045 - DNA, 2200 bp, Bovine  19866881543513
atagaggcaagagtaaaaaccaaaagtgtttcttgccatttctgtgagcaaaactttcctggggcgtggaatgtctgtgcctgggaagctgtctgtctgagaggcgcgtcacgggcccttgtgtccctgcagctatcctcggcatgcacacgctcatgagcaaccagcagtactaccaggccttgggcagcagctccatcgtgaacaaggagggactcaacagtgagtaccggccccgctccctgcccactgcgagggcatctcggaagtgaggaatcctccagagtctcgctacctcccgcccactctctgcaatctcattgcagaagatttcaaattctactagctaaaactgctcacctcttctttttactctcctgggatccttgtgacttgattacaaaggccttccccatcccaatattatcagaacatcctcctttattttcttctgtaagttttagagatttacttcttattctccacttcttaatcctcctggggttcatgtttgtgtgtggtgtgaaatgagatcaagctttcattttcttatatcaatattccattgtcccagcaccactcctcgcaaagtccgtcctctcacctctggtttggggctccacccggatcataaatgtccatgtgtccacacgggtctgtctctgggcgcccctcctgctccacaagtctccttgtcctttcctgtgccaacattacattgtctgaatttctccactgtgttgtttcaagctggtaatttggccccaaagagaaatgaaggcacccacagcacaattaccctttcctctggaaggcctacacgtttctttcccacccagtcttcgttttatcctcacaggaacccactgggtagaacgactgttcacaccctactgtgaggacaccgagcttcaggcagtttagtgaattcacctggttcttgcaggttggcagatgcattgtccaagcagggcccagactccaggccccatccatcgccatcctcctccaacccgtcccctcagtaacccccaagaggcccagccttccatgtccctgagctccaccgccacttccttctgatgtccttgtgtcgaggggaaatgacgccccatctctgtgagccatctccctgttgtcggtcactctaggtgtgatcaaacctacacagtacaagcctgtgcctgacgaagaaccaaatgccacagacgtggaagaaacactggagaggataaagaacaatgacccaaaacttgaagaggtcaacctcaacaacatccgggtgaggcccccttcactccacttcccctgttgtgggagtgtgggggaagccgagtccactcagacccagacagcccagaccagactgcacacagacaccagtgtcctgcttggactctgggtccttctggatcaggaatagaggcaaaattttggggtaggaggacagtataaaccaggacagcccatcatcttggtttccttcggggcctgacatcagacccagatgttcaccacagccaacccaggttcgactttggaaacccaccaccttatccacaacactgagagcttctcagagataaatcatgagtcagacacatatggctacacgggatctgaaggctggaaaagcctggtgcccaccacgttcgtggggtaacccaagcctggggaggggcctaaccctgaacctgtgtctcatgcacgtattcagcccattctgcaaccctagatgggaaccattggcccagtgtccaaagccatactctaggctgttggcccacatctctttggacccttcctgtgtgaccaccaggcagagcggagacgggtggacaggctgtgggaggaatgcaggagcaggcccagctgcctgctcacctgctcagcccgggagccagagagattagttctcagggggtgtggatgtaagctaagaagtgggcccctcacttcccagctcgcttttcctttcttctccgctttcttttaagtggctgccagcctcgtggcataatcagattggaaacctgcgcctgcagtgtctcctccacctggcctccctgagctttgctcccatgggggataaagtgacactctgaaatgcgagatccattcgggtgcctctgctatctgccatgtgcgccgtgggagacactggcacaattcagaactgtgcaccctggcaacgtctatg

SEQ ID NO: 25046 - DNA, 869 bp, Bovine  19866880419537
cagagaacttagacattatcgttcacacaactgattgaataacatttagagtgattggctctttagcccttgctttggatttaaataatctttcatttctaatttggctgattttttttaaagcccccttccccctcttttgccatcgaagagccagctcagctgctgggttcgttggcactgaatgactaagggcaaatgcttattttggtaaatgccctcaaagtctaagcttaaggagagtagactctcaaaaactacttccgtttcttgatttcaggtagtgaatgctttggcttatagagctattttattccagtctcatggtgttggcatgactcagtgcagatgattcccacaggaaggtctggtttttttattctttgactaaaaactaaaaatagagccttcaacttgtcctggactctcagctgtcatctgctgtcaaaacctgggctcttggcttgcttacttgcttgcttctttggaagtattactgccttctttgggttaaaataagaaacaaacaaatatacatacatgtatgagcctggaatgttgttttgcttcctattgtctttattcggggtgaattatacagcggaaggtggtttttctttccaatttatttaagtgcaattcttttcaaaggtgactataggaggtatggccaagaaaaaagtattctgactcatcacatcttgttaactataccttctgaataataataaatgctgatgggattgactgtttacagtctccttttgtgtggacaaagcatgttatcatgctcacttcgagaataggacaggttaaggtttaatgagtcctttgcctcacatcacagaaataagagtcaaagaagtaga

SEQ ID NO: 25047 - DNA, 2767 bp, Bovine  19866880458563
tcgttgtgatgggcttcccaggtgacgcagcggtaaagtaatctgcctgccaagcaggagacctgggtttgatccctggatcgggaagatgccttggagaagaaaatggcaaccactccagtattcttgcctggagaattccatggacagaagagcctggcaggctacagtccatgggtctcaaattagagttagcaactaaaattagtcgctaacttagttagcaactaagtctaatttgctaattagacttagcaactaaacaacaaaatacacaaacacagattggtaaggctggcatcagagcctctggagagatttgcctggactggtgagtttttcttgcaacataaatagccacattagatgttctttgaggggcacccaaatgcgggtgacaccccacttctgcaggaaggtgagttaggcatgcatttagggtgggggctggaggaaaaaatgaaaacctttaatttactttaactatgaaacagatatttcataggctatggaggattgagagcaaagattttcaaataagaaacatttaaaactttttcttaaattatttataattagcaaatatttcagatttaggcaaacgatatttgccttaagtagtatttgaagacttaagaagcaaaagttttgtgcctttcttatcttggtttgttccctacggtttccctgatagctcaattggtaaagaatccacctgtgatgcaagagaccctggttacattcctgggtcaggaagatccgctggagaagggataggctacccaccccagtagtcttgggcttccctcgtggctcagctggtaaagagtcggacacaactgagtgactttgactttcaattttgtttcctggacaatttagcctcaactgaatgtaccatcccacccttgccaaaagaagcaatgatgtaaagctcatctactttgatgtatgaagttgatgttttaaagagaagcagtgttaaatgtgttgagtaggattttcccccctttatgtattttcttcctgccccacctcccttctaaaatgttcttctaagattcaagtacatctgggacctttttgaatacaagattctgaatgtcagtctgtcctcatggtcacacacctcagaccctctattggacccactaacatgcatcctaattcctcccttggtgctttgtctacttcagaagacaatctatatggagatttgagaatccctaatgggtagggaatttgagttagcatatttgctaataatcatataaaattactccataacccctttcacagctgatgattggaagctgaatatatttcaataagcctttcttttctactccttgacttagaaagaactcgcatcatctcctggaaagaatctcaggtgaagcaaatataacggaccatttgtctaaacagtgctacgcttgtggacttcaagtgtgaaaacagatccaagacgcaatcatccacctccaacagattcaggacgcaatcagctacctccatactagggagcaggatggtgaggggacaggtattttgggtgatatgacaactaattgtaattaatgtaattaattacatgtaattgtaaatgtaaatttacatttacaatggattgtttgcagggtaggtatacattttcatggtcctgataattgacaagactcaggtgtctgtaaatactgcttattaaaaaatctctatgattcacattgatttttgcttcttgtgtccagtctgttcttggcaaaaaaatataatctggtcacttctttctgggttgtttttctattcagcttctctgtcaacacatctctacaccttattttgttttctatcctacattccaatcccaagtttgacgtccacaattctcaaacacagtcaaatgaaagttctgccctttccctaccttttcctggagggtagatcgagggaggcatcagggttcaggggaaatgaaagtatccgtgcataggggtggtccatagtcacaggtctttcacgatagatggttatttctctggctgagactctgccccaacctcagctctaaggccaggggaaactcagggttacaaggggcacagcacccatcccctaactccctcatcaccttctctgtgagaggccacccaccggagaggcaactgaacagacgctaaggttctcactagctttctcaatgtgtacagtaagtttccctcccatctcttgtccccacaagaatttgaaggggttgactggaagagaaatgttcttctaccataaaatctccccctcttgcttcaggctttattgtctcattcccaaagtgtcaccttacaaagctaaagagtatggaacagcctctacaatatcatgggtgttctttagtttagctgccagttggggtgggggtaggtgtgcacctaatccagacaagcaggaagaagaacactttcccatgttatatcacaatacgaagctgtttgtatgaagttgttaatatatgctgttaaggattaaaagtctgaggtctcacatgagaataaaatattgggttggccaaaaagttcaggaaaacccaagctttttggccaatccaagatattagtaattgagacaatttgtgcagtttataatctaaattccaaaaatcaaattaaaactacagacagtaaagaaaccaggctgacctgggatatatatagtttaaaggtagatttttataaacgtataataaaaagaaaacatagagtcattacaagct

SEQ ID NO: 25048 - DNA, 3558 bp, Bovine  19866880528126
gcaggagctacttttgaatctaatgtaaaccatatgcatgcagtggagtttaaacagcttggcagaagggagtgtataaagggaagagtctttccataacattctgcagaaaatacacgatgtgtgttttgaaaagtgagaatcacagtattaaaatattgctcaattttgagtaaaaccatctgctactttcttagtgtgttttatatcatgggcaaatggcattttcattgcattgagaaatggtgttctctccctatcttttggaaaagttaacagttaggttgattattttttgtgttatatgggaaaaggaaatgtgcttatgttcacttatgaagcacttatcctttgagtttctagccccttctgctgataaatttggtcattacctctaaagtattaaaagatacttagagtgattttctggtacttaagaacttaacatagtccccttagttattatatgagtgaagaattgagttttaggagttatagtatgaaagcacattaatgcaaacattccaaaaaactaacttttatttttggttttttttcccctctaatattagtctaagtagtctaaattagtccacttagtctaatttttaagttttttgataaaaatttatcattttatgatctttttagtctctgctgtaatttgttagtcttttcaaccttagtattgctcatttgtatcttctgttttgttggttttattgatcagtcttaataggggcttatgtattaaaaaaattatctttgaagaactgttgtatttatcattctctaatctgtcttattctttttctgtaatgtctttaatttcaactcttccttttttctacaatctttgcttttattttgtaattacataatttttagcctttcttccattctaagataaaaattttaggctatatgttttcctttgtttactgctttagctgtatccagtaaattttcatgagagatattttcattattattcagttttaagtctatttttaaaaagtcattgcattttttctttggcccttgaactgtttagcagttccttttaaagtatctgatactataggtttttaaaaatttatctagtagttgtcttcttacttaattacatggcagtcatgtacgttcaggcttctctggtggctcggacagtaaagaatctgccagcaatgcaggagacctggattcgatccctgggtcaggaagatcccctggagaagggaatggctacccactatagtattcttacctgaagaattccatgaacagagtagcctcctggactatagtccatagggttgtaaagagtcagacatgactgagcaactaacactttgactttcatgtacacttgggaaggttatttgttgttagatacaagatttcatgtgtacttcaggatatccattcagtacaaacagatgacacagatggagagaatacgatatttgtgaattggaagaatcaatactgtgaaatgactatactccccaaagcgatctatagattcagcgcaattcttatcaaactaccaatggcattttccacagaattaaaacagaaagtttataatttgtatggaaacacaaaagacaccaaatggccacagcaatcttgagaaagaaaaacagagctggaggaatcaggctacttgacttcagactatactacagagctgtagaaatcaagatagtatgctacttgcacaaaactaaaaatatagaacaatggatcaggataaaaaagcccagaaataaacccacacacctgtggtcacctaacctatgacaaaggaggcagaaatatacaatggagaaaagatagtctcttcaataagtggtgctgggaaaactggacagctacgtgtaaaacaatgaaattagaacactccctgacaccacacacaaaaagaagctccaaatggattagagttgtttaaatcttatttattcttaagaacttttctctgtacttgaaccaaaaaaaaaaaaaaacactgacaaactgtgttaaaatctcccactaaaattgtgactttttccctttttctttgtatttctttcagttatttcatgtattctaggcttctgttttgagcttttatattttcttggtgaattaagtctttgattattatgtagtaaccctctttacctctaataaataattttcctttgagtactttgtgcctgatattaatcttgtcacatcactttcttttgttgaatggtacacggtaccattattttatttacagtctatctctgtctatagtttatgtgaatctcttgcaaacagctgtgagctaccagtttctgtcttttcatggtaagtttggtccatttacaattattgtgattattggcatattcatgttccttttcacagggtattttatgctttctggttcttcttttttaaaggcttcctttattctcctttccagagttttttgattgagtttgttaacatcagtttttctcttttaatattttgaaagttatgcatgatatttttagggtctaatgtttaagtgtttgacatggatatcttaaagcctaaatttataattaatattttaactgcctctttatatgaggaacttaagaacattttaaattctagcattctacttttggattattatagttcatttttgtctattattgtgtcttacagtcagtgttagtttagatttacacacatgtgtcactatgtactgttttgggtaatttagaccttccttgtcattatcattgtcatttttcaaagatatcctttagaagttctctttctcaggggccattgttgttaaacttaattttttgaggtgaaaaatatctttaatttgcctttgaccttgaaggatacttttgtttattttagatgggcagttatttcagcattctgaatatattatactattgttttctattgaaatatcagcagtcattctaattgtttccctctatatgtgatatatctttcctatatggttggtgtcaagagcctctcattgtctttggtgttctctggattcattgccatgtatccaactgtgaatttttcaaagaaatgtactgagcttcctgaatttgagtgttcataccttttgcctgtttgggagaactttcagccattatctgttgatttttctccattctctcctccacaaactgattggatgtgtgctagactgaatcagtcaggaaaatagaatcaataccaagtagttcaacagaggaaatttaatatggtgccatggtctgaatatttgtattctccccaaattcgtatgttgaaaccctaactgccagggtggtggtgttgggaggtgaggccttggggcagtgattaggtcaggaggacagagcctcatgaaggagattagcatcttattaaagagaccccaggggggtagcttgtcccttccaccacatggggttacagcagaaacaccgtgccatctataaaggggacccacatctagtgccaagtctaccagcaacacaatcttgggcttcccagccccgggaactg

SEQ ID NO: 25049 - DNA, 3175 bp, Bovine  19866880595661
ctttggcacagtcagtaaagcagaaatagatgtttttctggaactctcttgctttttctatgatccagcagatcatagaaatttggtctctggttcctctgccttttctaaaaccagcttgcacctactgacctggggagttcttctgtcagtatcctatcattttgtcttttcatactgttcatggggttctcaaggcaagaatactgaagtggtttgccattcccttctccagtggactacattctatcagacctctccaccatgacccgcccatcttgggtggccccacgggcatggctcagtttcatgggggagtttggggggagaattcatacatgtatatgtacgagtccctttgctgcccacctgagactgtcataacattgttaatcagctgtagtagtagtagtgttagttacttagttgtgtccgactcttgtcgactgcagcctaacaggttcctctgtccatgggattctccaggcaagaatactggagtggattgccattcagctatattccaatataaaataaaaagtttaattaaaaaaataataattatgtttggaaaacactgtaaactgtttacaagttttgtaaatcccaagcaacctaggatgttggtttgtttagcctgttcaaaaaagtgttggtcccatctgactcttcggcaccccatggatctatgctcctccatgttttggacaccatgctctggacaccatgctcctctgttcatggggttctccaggcaagaatactggagtgagtagccactcccttctctagaggttcttcctgacccaggaattgaacctgggtctcctgcattgtaggcagattctttaccatcggagctaccagggaggaacagtactcttccattctcactccatgaagcatttcctgatgccaggaatcagaatgactttctcttaactctggctttaggaattcacttaagtctgtgactgcactgactcatggtttatttagttgcatactgctctgaatcatctactgaaataagagccccatgagggcaaggaatttttttgtttccctctttgtccctagtttctaacagtgtgctttgctctgagttcaataaatattggccacattgaaatgtttgattcctaatcatcttctaaaatacacttgaagaaaaacagaaacccaggagttgactgaagtcttgctgcagaatttctaaagtgttgaatactaaccagttttccacctcctggcagtgtttaaaaagttcacattatggctgaaccccattaactctctagcattattgttcagtcactaagtcatgtctgactctttgtgcccccttggactgcagcacaccaggcttccccatccttcagtatctgctggagtttgctaaaactcatgtccattgaattgctgatgccatccaaccatctcatcctctgtcagcccttcccctcttgccctcaatctttcccagtatcggggtcttttccaatgagtcacctctttgcatcatgtggctaaagtattggagcttttgcattagcatcagtccttccaatgaatactcagtgttgatttcctttgggattgactagtttgatcaccttacagtccaagggactcttggaattgatttgtcaccataaggagggaaaaacctaaggtttgggacacggcccagtttgttagagctataaaaacacttccatatggcataaaaagtcagaaacatttaatttggctataagaactttgcttttagttatttgaactctttctggaaaataaaacttggtgaggtctatataaaatatccgcataaaaataaatactgctgctaggctttcagatgtttctaagacatgagattgtttgaacaaactggatgttttactgacttgagaatttcttatccatatattttaggttacatagatgtagtcatgatttgcatgcgtataactctaaagtttccatatgtgaacagaaaaatggtggattgactcagatcctctcaagatgagtgtttaagtgttaaaaaaaaacctggttaaggtattaatactttggtagaaatttgtgaccttgtttatccaccttttctgtgaacctcctggtaatcttcctccaaatgaatgggtctggtccattaaaagctgaaaacattgttccctttggccaatgcttgacctttttggagcatcttaagtatcaaagatataaaaataacctgacatttacatttacagaacctctctctgcagctcaaagagctcattgttctgggaattctcagtagcatcttactcattcctcctaaaggcacatccctttctaacacctaatcttatgtattgccccctccctttttttttagtttattatgagagtacttatatgcttatttccagatacacttaacataacacaatcctagtaatcaagttgcttcatttgtatcccaaacataaattcaatagaaataagttattccatatctattaccatttagcagctacaaatttttttttttaattcttcttttaagcttcctctggcggatattttggtttaatcatcttgtttttatttttgttttgtagtacagcagagtgctgggtgaccttttatttgttaccttagaatgttttttatcaaactaacgagtataaagaggttgacttcttgctcctaactgctctgggcaatatgaggaaagaaaaggatgagttcagggattcaaattcccacctgtagcaccacataaatcacccaaaagtttctatgtctatcttaaaagagatgcttacctcctgcagacacagagtaaaccagatacagaatctctgcagttagctgctgagttgcaatgcaaattaaatttccaactttacagcgtgttgaagtcaaggcattaattgggaaggaatggagtcctgaaaattcaaatggggtgtgtggctggatcctgatgaagctggggacattgggtcttcttcaccagtacaaccagcccttacagctccacctggggagagtaaccctgctttgccggataaagttgtaatggcctccactgtaatggcctccgctgaagaaatttacatgccttgaaaacatagctgattctccttaagacatatccccatcactcctctttagt

SEQ ID NO: 25050 - DNA, 2140 bp, Bovine  19866880596549
atcagactcagaaaaaaatgaacaacgtgtatgaggaagaggctaagcaagaactatatccggtgcaggatgcttgggcagaagcaaacaccagtaacaagtatatgaaagacttggaagaaaatagtgagataaggaaaataggaaaggaggacacagtggtccagaatttttatcagaagtacacagaggaaaggaattttgaagacttgaaagcagcatgtctagaacagaaggccctatcagaaaggccaagttacccaggactttggtcagcagacaagaagactccaggtcctaacaagccttcttgcaaaaagacattagacccttgtctcagcgagaggtcggtttgtcaaaatgaaaatagcaaggacaaagaaaagaagacatctgtgatcacccagaacacacctgtatgcagccgtcagaggagccatctgagccacggggcagtccaggagaggcaggtaaaaccagccatgcaagcccaggaagaagacagagccgcggtgttcattcagaggaaataccggggctacaagaggaggcagcagttacggaaggacaggatgtcttcttttagaaatccaaaggtcgttacaacaccgacagaagtagcaagaaatactctcagtttgtattcctaccccacaaaacttgaggactcctgtaacatcgggatgaagagttataaagatgcaaaagcaatttcagaaaaagaagcgtgtgacttggcaattttttcaagacaggtaggtaaaggaacagatgtgtttactagtacagatctctaggaactccacaatagctgagttaaacaaacagttggtaactgtttcatctgtttttatgagactgcaaaccttttcaataaaatgtttcagaggctgtgctattcaaatagccatgtattttaaaacaattttctatgataaaaatagtataatatatgatagaaatctagtatagtaaagagactagtcattgagtgatacagcctactaaaatgctggcatttgacagtgaaaatttccatatttctgagatctcccattatagtgttaaaaaaaagttttcaaaatcttctagagtctatgctttctctaccccatattttaagaagacataattatgcaccagaatcaggtgagtaccattactgaacacaagtgcagtgaagatgaacatctgcatgttctatcataacaacagtgaggaaccataaagaaaaatcacaaaggaaaattccctcttgaagaatatctcatgctgttcgtaggtgtgtttcagctgtttgtaaaaagggcgatagaacttctgagtgtacagtaagtcccccagatacaaaggagttccgttccaagtgtgtgttcataagtccagtttgttcctaagttcaacagagttagcctaagtacccaactaatgcaatcagctatatatattgtaatgtcacaggtttacaatacttttcacacaaataatatataaaacaaaaaaaaaatttttttaatcttacagtacagtaccttgaaaagtagagtagtaccatacgacagctggcctacaggggctggcatcgagtgaacaggcaataaataaagatactgcagtggtgtactctacacagtgctgtacagtaaagtacacaaaagcagagctactggtagaggatgcacgcacgtgacagtgtatgccagacgtgtgaccttgtgtgattggacatgtgaacgcacgtttgcgtctttgaaagttcacaacttgaaggtttatatgtaggggacttactgtacctggaactctgatgaattagtgctacagagagatcacagggacggccttgtccctgcccccttcaggctctctctctttctaggtatttgaccttgagaagatccctttaggtgtctgctgctgctaagtcacatcagtcgtgtccgactctgtgcgaccccatagacagcagcccaccaggctcccccgtccatgggattctccaggcaagaacactggagtgggttgccatttccttctccaatgcatgaaagtgaaaagtggaagtgaagtagctcagtcgtgtccgactcttcacgagcccatggactgcagcccaccaggctcctccgtccatgggatt

SEQ ID NO: 25051 - DNA, 698 bp, Bovine  19866880598928
tatttatcatagagtctgagaattcaagattgtcaggtccccaaatctcatttccagagagggaaaaaccaaagcccagccctcatgagcctcctgttatcgattttactgactttcaaacactagaaaatacagtaacataactctgcactgcagtctaagcatttcaggatattggtttttgtaaaatggaataagatgcatttttctaggattgccttaaaataaaatgagaaaattctgctacatctttaaaaaaaattagctcttgttagtctacatgggttcactgcctagaaaccaagttctaaaagtgaaatccttagacatgcacttatatgaaatacagctgtagaaaaagtgcaaccattaaacttacacagattacttttccgactattttttcatagattaatctttaagctatcatctgttgagaaggtttcactattctcaatgaacacagtaacatatataaggactacaaaaaaatctccaaaatttaatacaaaatggcatatttaaagtatatattcagttctcattaatagtagataaattcataaataagaatttatgtacatcataaataaagaaatcatgttgaaatgataaaaaactatggcaatccaggaattggctgtcactatatgtctacctcttggagaaggcaatggcaccccactcctgtactcttg

SEQ ID NO: 25052 - DNA, 1358 bp, Bovine  19866880634349
tattaaataaacagtttatccctccgtcccccacaaatactgcttacctcaaaggaaaagattagctaagagactccctacatgaattcttgcctcataatatatttgttttgcataaaaatctttcatgtaacaatttatatatccattctaccatcctgcatattaactgatcattttaaaaacaataattaatgatgataaagaattgggcattaactataggatgctggaggtcaagcccttggaaagtggcaggaattctgctgactccatggtttgtttctgattttccctgatcagtacacagcttatgagctacagcagactttcattttgaaaagtcaatatccaagggcatattttaaattaatcaaacctgtttctgagagataagctaaattagttctttaaaaggagaatgtgaaaagcaaacttatgtgttcatcatatttagcttcaagaaacagtcttacataactccaaagtggatttgactgaaccaaaacccagcttcaagtttgaagctgatatgaaacctcaaaagaatgtgttgtaaatttctgaactcacaggttgcactcattatgtttcttattgttccattcatttaaatcacaatttaaattatgggagtcaagtcaataaatatctattaagcttccttatctactgtgaattgaaaataggagtgtaagacagtttgtctacccagaaagtaaagtcttactgaggaagaagacttagacatatggaaacagttacagatgaataaaaaaattgtatagaaatgactcaaaattcatgacttctaaacggtatgatgtgcttctacaatctttctgttacttcttgactctgtcttctcatttaattgtggcccaagctagctctttccagtttaaccacagcctacagaaaccttagacagaggcatgtttttctttatcaaatgggagattataactttatcaaatgggagattacaactactctcaaaacaagggagatgataatcccttgttttgaaagtagttttaataaaagattagcacacaagccttaagcagcgtatagaaaagaagagcttcagaaaaaacaaatgatgtgtctgggaccatttcaactggtagccaacttcattctgcaaatatcttatactctttagatattcattgatttctttcttaaaaagtctttgttgaatttgttacaatattgcttctgttttatatttttggttttttggctgtgaggcatgtggcatctcagctccccaaccaggggatcaaacctgcatcccctgcattagaaggcagagtcttaaccactggaccacaaaggaaagtcccatccat

SEQ ID NO: 25053 - DNA, 1014 bp, Bovine  19866880723579
ctcacatgctgtggagcagctaaccctgtgtgctgcaagtactgagcctgtgctctagagcccagggagctgcagctgctgagcccacaggccacaactaatgggcacccgtgtgccctagagcctgttctctgcaccaagagaagagaccacagtgagaagcctgggcacgacagctaaagggtagccctgctcactgcaactagagaaagcctgcatagcaacaaagacccagcatagccataacttagtaaatacaaattgttttaaaaatcaattaatgcttgcagatatgtagtacactgagtgtttgtttactctcaaattcaaatgttgaaatctaatccccgacacgatggtatctggaggtgatgacttttggaggtgactaggtcatgagggtggagccctcatggataggattggtgttttcataaaagagaccctgacaagctcccttgctccttcttccatgaaaggacatagcaagaaggaggtcctcaccagacaccaaatctttcagtgccttgatctttgactttccagcctccagaattgtgaggaatgaatgtctgttatttaggtcatccattctaagatattttgttaccacagcctaatcagactaagacaagatgcatgtagtttcctaatgcagtaatgggagtctagatatttgcatcttgatcaatacatcaaattcagtacatcaaaagccaatttttctgttgccacatctcagtaaccagtataagttccctcttcatcatcagaacagccctcgaaagtgagtcccaaccaactccactgtgcttgacccagcaacatacgaaaaaaggttgggcaattaccacctgggagcctggacactctgagagtgtgtcattatgggaatcattttcatagaggttgctatggtttctgtgctacattctctatagttggatgattttagttaatcaatggcaagctacagtgtaattattttctcttcagagaacacaaggaagaaga

SEQ ID NO: 25054 - DNA, 920 bp, Bovine  19866880792922
acccctctttgtttacctgttcaggtgacacgggccaaatgtgttcaatatgctccagacctggatgaataactcagaggaggccagccaacaccagggagtctctaggttaaaaaggtgagagtgagtcacaaatggatgtaaaaaattatatttgcaagacaacatttggatgagaaaaatatcccagaggaagagattggtgtattctatgacaccctagtttagaggaaatattacttcagagtagaaactgttcctaaaatacagttccattttaaatcagagaactcataatgagatgttttctcatcatttttcaaatggaagtcatcagggtgctttcaaacagctatgtagcaagaggagctctctccctataaaagggaactcactccctttttaaagagagcccaagggtgcctaggtccatgggggctgatgagcatgcatctttgtttgttctcaaacaaagtccttcctgccagaatcagtctcaactgttagggaattacttcacatcagcaacatcttccccattttcctaaacacagtagtcaaaagaatgagaacaaaacaaaaccagaaagacaattaatgatactatatataaagtagataactaacaagcatgtactatatagcagagggaactctactcaatgctctgtggtgacttaaatgggaaagaaatccaaaaaggaggggatatgtgtgatcatacagctgattcattttgctgtacagcagaaactaacataatatcgtaaaacaactatcctccagtaaaaatttatttaagaaaacaaaactcgaagacagcatagctataatctagggtcttcccagtgagtggcagagaaatgcccctaagtcacaggttggcgtcagttacggcaggagtgctgtatgaggaacca

SEQ ID NO: 25055 - DNA, 1832 bp, Bovine  19866880854643
ttcctatgtgcttattgaagttgtaagcttcctttttctttcattttctactaggtgattgcatgtgaacagcaactggatacaacttacgatgccagatgtgacacgtggtccctggggatcacagccattgagctgggggatggagatcctccactagctgacctgcatcccatgagagcacttttcaaaatacccaggtcagagggctctcacgtgggtccagtacctgccaattttctctcttcctccagccactgaatccttgtcaagctcttcatggaaatatccagatatattccaaaaggttgggagcagagtggcctggaatatcattctgcttctttcaagacactgtttttgtaccgtagttttattttccctggtctaagtacaagagctttcttttggtattgtgtgtgtgttttttttttttttttttctttagcaaggatttgagcttggaaaacagcacttcctatcactcttgattcactcccagattcgtcagtgaggctccctggtccacagtccgtgtaacagtaatgtgctctgttctgctcttatcaatctaacaattttttattacttgctaacacttccctttctttagagctttaaaatgatagtattaataaagttagaagtagaatttttgataaaataataatgattttaaatatgttagtgttttgaatatattaatataaaacattaagcttagaaaaataatctctttggagccaggaaggcactttcctgtgtagacacctccccttttatatgtgttgtcagattttccctcttgcttatcactaattaaacactgtgtatgttttggttagttcctagatatttcagaaaactgacatgaaaagactgcctatttttattatacatgtattatcttttaaagactttcttttcaaaatattatttattttttatttttggttgcattggatcttcattgctgtgcatggactttctctagttgcaaaaaacaggggccagtctctagttgtggtgctcaggtttctcattgtggtggcttccgtttttgaggaacgtggactctagggcacgtgggtttcagtagctgcagcctgaggactcagtagttgtggctcgtgcattagttgctctgcagcatgtggaatcttcctggaccagggatgaaactcatgtcccttgcattggcagctggattcttatccactgtatgaccagggaaatcctaaagactttcttatggattttgcctgctatcttaattttaatgaaatgcacagagagggcctatgggaacatgggtccagggtggagagatgaggtatgctaaaatttgttcctacactctccattaaataaattgtgggatcctaatgcctgtagaacattgaatcatatgtaaaagcctggtcgggggtggttccagtccgaaagaaataatgccaatatgacctattcatttccaaatagatctatttagaatatttgggatggaattaaattagtgtaaaacattcaaatttgtttttaagtttaccttgtaattttctgtcctgcctgtatttactgagttataataccttaaatatatatcatcctttccataacaatttcaatgtatctctaaggtcttactgtttataaaatatattgcttattaataagtggggcttcccaggtagcactagtagtaaagaacctgcctaccaatgcaggagatgtaagagatgcaggttcaatatctgagtcagaagatctctggaggagggcatggcaaccgattccagtattcttactggagaatcccatagacagaggag

SEQ ID NO: 25056 - DNA, 3526 bp, Bovine  19866881019335
taaatgttccctgactggccgctgctgaccgccattctcaactagaggaatgggatctttcctggcatctcgtttcttcccaaggtcctcacaccttgagtgctgggggtggggtgagccccgtctgtcactcagctggaggagggccagtactgctcaaccctgtggaggagccgctgcgtattgtcctgcttctctccttcctcttatgagtctgttggcgccaaggtcacattcccgagtctcctcctcgaggatgcctcggtctctcagagacaggcgcagagactcatgggaagtgagctgctgctctcccgggaactggaggaggaagagggttgagcaacacggtgagtgagaaggagagaagttgaaagaagctgcaaaacttggcagagatgatacttgattggccttaaaagattaagtatcaataggatgtaactaactaaagccataggaggtgacattccaggaagaggaaatagcaccaggagacccaagatcatgagaagagaattttctgagaactaaacagactttggtgtgatgaaaagtggttcaggaaactgacaggactccagcctgggatctagtgtggggacaccatgagccataccccacagtttggaattttggaggcaaaaggaagaggagagatctgtaagcagaactagaaaataactatgatacccggtggaggatgaaatggaaaccaagtatcaggtaagacaatatatccagattaaaataataatagcagtttttattattaaaggactctgaatcaggattgtggtttaggagtttcaaacaacataaccccctgagctgagcatcgctgtgactggtgagagagtatcctgcttaccaagggtgttggaacaaataggctgaaagctgccatgggagccacagtgtatcttccctgcagtccaaaaggatatctgtggatgagagaagagatggaagcaggatatgagctagctattgtaaaagaacacatttgaaacattcagtcatcaatcgagtggaaagaaggaggaactagattgggaaaagaacaaaattcagcagcaaaatgagccattgctctgagctccagggcgctacagttgggtcagaggcgggaacactgaaggcacatgagggaccccctggtgccctgctctgtggtggccaaaggagggaccctggacaggctggtcccagtcatcagagctctcagaccaccatggagctgaagagagataccagccttcacctgctctctttgtagacaaagggaaaggttttagattttggaagggtccccctcttgttttgtaagttagcgtcatgctggcgtctgagaaacagtgccaaaaaacctgagccctcacaaggggtcgtctgagcctgtcatgggtgccaccgtcttcacctgatttgtttcctttagggccaactctgtgacctggaatccacataagatgatgggcgttcctttgcagtgctctgctctcctggttagagaagaggtatgtctttcctcactcgtggccacatctgcagttgggattggatacagtaatgtgtgtagtgacaaaattaagatcattttacagaatggaacagtgagccacatccacagtaggggaaattgtgaatgaggatagctgtaaggccctgctcttatgtccaactataagacggttatatcctgactagacgagacagtcatgttccatgtgtggctgaattattgtgcttgtgaaaaaggcataggacattaggttgtactctgctgcagggtcaacagtgggtcaagagagaaataccattcaaaaattagtcatgggattgaaagaagtggagtttcagggtgagggaggtggcagtcccccactggcctctggttaaatcacacttggagtggtttgctcaggttagcatctaatcgtataggagaccccatcaagcaagacctccaatagtgaggaacattaatcaacatgaacagaggtagttgaaagaactaaagacgtttaatctaatctaaaaagagtttaacttaaagggctgagaggaaagcagccttcacaacataaatgactcaggttggagagatttgctttttatttaaggcttcagggagctgggttagtcacattggatggtacggctttgatgacagaatcacaataaccacgatttgaagtctgacttggggtcaataaaaggaatgcttttctaaaaattaagctgcccaacaggtaatgaatgacttatgtaggaataaattcatcatcaggggagctgactgagtggagattggacaagcgcttgttagaaagaggatggaaagatagaaggggcaggaataggaactgatctggaggtccagggttaggactccacgcttccactgcaaggggcaaggtttcaatttcttggaactagggttccaagaaattgccttgtggcatgaccaaaaaagatgaacagctctaggatccctttgaaatccgagagttcataacatttcttttatagaggtccaaggaataataccatgctatcagatgatattctctgatttgtttaaaaaaaaaaaaaaggagagttcttggtttaaaaaaaaacttggaatatattagcttaaagagttgaaaacaagtttcataatttcagggagtatctgaaccttttattgctgaaatattttataaatatctgaaaaaaatgatatttatgacggtttctgaagtttatttgatcaggggaattttttgacagcagctcttttacagccagaagctattcatgtattttaaatagtttggaatataatggctccgaatcaggatatgatctcaccctttttatctgacttctacttgtccttttgtacaaggagactggtgctgtcttaccttttagaggtcacgtgctctgagttgcttttcctatcccagtagaagctgggctggtctctccatcattccacactccctgggtggtctcccttaggattgaaggcacctagccatgagcttgcatggctgggggaaaaatggtgccaagtgtctgtgaccatgaaacaaaatagattcacctattgcaatttttagtcttattggttttcgagtccaattcaatgtcattctactgctctaatataattacattgtattgaatttctcccactctcaaacaaataacttaatgaattccaccaaatatgatgtccagactacaagactgagcccaaatctgttattaccatctggggacctagtcttggtctttcaggatctagaccaaattttagctgcattttcattttagtttggagaactttcagaaggggctctcacttctaacttcaaccaagtgatcacagtttagtcttttcttctcttgtcatgagtcacaaagggaaaagtcaatgtcaaagcttctgtaaaattacaattacactgtagataaccaaagcgtcaaagactttctgtggttcgtgacaaattgcaatgtggtaaggagg

SEQ ID NO: 25057 - DNA, 866 bp, Bovine  19866881067596
atttctggtttggtcagcactaatagacattagctgatataatattttcttaaacaatgctatctacacagcacatacacccttaatctcttgcaaagggtaaccacactgccacgtatgatcatttatcacaacactccccttaatcattcatgctgctcagcctcatcagacatccttccatcaaagtatgtctccatggtaacataagccagatttggccatttggcctctgtttggaacacaaaggtcacttgagtgtttatgacatttggattttggactgtatttccaaaactacaaattccacatggttttgacatttggatacactcttcattaatagcattgtctcttggtgtacacatatgtttcaatttgaaattatatttgcttattggaaatgaaagcagccaacgtaaccaattttaataagattcatttttgtttcttcattacatttctttccagaaaacaatactctgtgctttaaaagagtgctctgtaggaaaatcattgtaaaatgtaaatcactgagattgctaaaaaaaaaagtctcaaactaacaaaactgaaaaatgtttattgattattttataatgttctctttttctcaaagtataattacatcttgaatttttgttgaaatgagataattattcaagttgtcagcatattgttacctttcatagacagaaggtattgaattttaggatggaaataataaagtgcatggttgtttctggataataagactcaatatcacaggatcaatactttccaagaatatctatttaaaataataatagctaacacttactaaacattttctacatgcctgattctgatctaaatgatttagatat

SEQ ID NO: 25058 - DNA, 1358 bp, Bovine  19866881127657
agactttttgatttggacagtgaatgatcaaaatcatattttagtgttttactcatatgaatatgtgctcatgtcaaaatacacatgtattaaacatcaggttatgaaatactgattttagtctgtgggtcatcagctgatcctgaagatctctttctctctcttctcatcccacaggttgttattttgtactttgagccaagcacatttcgctgtattctcctaagatgggtccgccttctcggttttgctactgtttatggaactgtcactctcaagcttcacaggtatattttattagttctcattcccatgggaggatcaaagtgtttcgcttagcatataattgcaagctcagtcagccactttaatggttaaatttcaggaatttaggtagtaaaataatatgtttttcattttcaaggcaatatctttaagattctctaggaaaacctttaatacaattgaatttgagcaacatgctttagtagaatgtgccattggttgtggaaaggttaattctgaacaaaaaaataagtttacaatgaatgtgaaatagtatttactcactaagaacaggaagaaagacaatacagctgaaataatcaagcccagagctaccaaagaatcctatatagtagaattcagcaatatgcttaccaaacaaaaagctgctgtcctccattcccaagttccatgccccaggggaatcctgcttttattccttgggtgaatttccaaaaaatagtgttcttggtttccttccttatccaatgttctccagtgcttatcagccttataaattggagaacatagtaaattcccttatattttagtttcaaaatcacctacttttaaaaatgtagggacttccctggcagtctagtggttaaaacttggccttccaatgcagaggggatacaggtttgatccctgattgaggagctaagatcccatgtgcattatggccaaaaaaccaagacataaaacagaagcaatattgtaacaaattcaataaagatgttaagaatggtccatatcaaaaaaaaatctttaaaaaaatcttttcagtgtatatgataaatattaggaagaaagaggcaataaaataaattaccagtccacaaagagtaggggtagctggaaatgattatccagggctttcccttgcctccacttcccatatggtagtggtgccaaagaacataggaggtaaaatagaaatttctcctgcaggataatactgtagttcagtagaagaaatcctttatgttgatcaggtttaaagctgctttaataatcacagtaggccattcatatgttcatgctaatttgaccataagtatttctcaataaat

SEQ ID NO: 25059 - DNA, 947 bp, Bovine  19866881155057
tgagtcaagggtgctttttaggatgcatccaattacaccatgttcacagactgtcagaaatgattctgtaaagggaacagacattcaaggtgtagaagagagaggggacagttgcaggacaatgctctggtgaacacagaaggactaggattcagtgcacaaacggaaggtttggtcttagccaggagtacagacacgcgtctggctaatcactggctacctgccacctgcttccatttattaaaattcacaagacactcaactcttcatggctgttgtccctgatacccagacctgctcataccttcctggtgtactaatgctaatatttgggatgtatatgttcaaaatatatataaatagatgtaataaattatcagaataatgtaataatatttacacataaatatgcactgaagtaaagtgaagtcactcagtcatgtctgactctgtgaccctgtggactgtgtccatgggattttccaggcaagagtacaggagtgggttgccatttccttctccaggggaccttccccaccaagggatcgaacccaggtctcctgcattgtaggcagatgctttaccatctgagccaccaggggagtctaaagatatactatatattgctatatattggagaagaaaatggcatcccactccagtactgcctggagaattcaatggacagggtggcctggtgggctgcagtccatgggggtcacaaagatttggacatgactgagcaactaacacacacacatatttctatacagtataaatatataaaagatgtaatatatttgtttataaaataataatttaagatatataagatgtataaaatattccaacagatagtttggcctgaagcttctctaattgtccccaaagatcctttagagctgtttttctgtttttttattttaaagccaagcatcctatcaagg

SEQ ID NO: 25060 - DNA, 1727 bp, Bovine  19866881166605
aatagtttccactcgatttaagccttcagtaggtaatccttcactgcaatgccttctagagacacagagagaaaacagtttgaattatagtctttaaaataaacaaaaggatgaagtgatctagtttaccaaatcccaatcatttgcataccactctcaagattcctgcctgtatctgcgtaccagctaatattttctttaaatttcttctatttaaaatattttaaagaaaattttacattgccactttaaaggaagaactgatagataattcacacatagaatgtaatgatgaaaatgaatacagtgaaataaagagaatagatttcatctaggtcgtattgcaatgggaggctctaagcctgaagtttgatctgctctttgttgtaaaggaaaattagcaactgctgggcaggtgttaaagatctattatttccaaactaatttttctcctggaaataatcagaaggatagaaagagaacctgaatggaaggaattttcttgctttatggttctgtgttatttattggattggcaaaaagttccataatgtcatatggaaaaactagaatgaactttttggccaacccaataatgttgtgtttttgtcccatgatcagcctcttccagaccatggtgtcatatgtttcagacacttgaggacatgcaacaagtcaggggaataggaatgtgttaggtgtggagggaactgtgggaagctgcttccaattctgcagctgacattttcattcattcatttatcaattactaagcattaagcacccaccatgtgtcagtcattgtgctaagagctggggattcaatgtaagaccctcacttcaaggagaagataattagttaaaaataaaaaacataattacataagcaaactgtagcatataaaagaggaccctaagactcacagggagagaggccattctcaagtctcaagaggccatctattcttttgggaattccagaagtcttactgtccacgataggctgtcaatgtcaatagactgtcaatttcctttagtgagcactggttgaaaaacagttaccatataaggagtagagattgaaacggacatgagagcaaagtgagctgtgatatggaaataataaagtcagcatcaggaagaacatcagagacatcttggtggtggtttagtcgctaagtcatgtctgactcttgcacccccgtggactgtagcctgccaggctcctcagtccatgggattctccaggcgagaatactggagtgggttgccacttccttctccaagagactcatctaatcctttcttttgtaggcaatacaggactataatttcctagatgctaaactcagatttaaactggacctcctgaagttactatacgacatacataagaaaggaatcttgagagagttaaggatatctacatttgttccaaaaagataatcgggagtattcctagttgttaaagtaagtacaaaaaataataagagaaatggagcggaatgaattggcagagtggcactgacatgaattcactactagtgagaagctacagtatagcacagggaactcagctcagtgctctgtgatgaccttagaggggtgggatggtggaggggaggtgggagggaggctcaagagtgaggggaggagtagtagtgtagtacctagtagctgattcacgctgatgtacagtagaaactaacacaacatgtaaagcaatt

SEQ ID NO: 25061 - DNA, 1564 bp, Bovine  19866881167714
gggattactgatgtctcggaaacacaagtggaaactgagcggcgtggagaggtacgtacatttttctccttaacaatgtaccatgtgaaagctatatatgaaaagcaaattacacccaatatccaagaagtgttggtgtacaggtgagcccattctctccttgctcgtgtgctttgccttgtgtggtcataaatgcatgagtattttgtgtagacagcagagacatcagatcctatccaagtgacccaagtcatatgtctctcaaacacagagatcatagagattcccaactggcctccatgcttgaccagagtactcaggaatgaccttcctggggtctcagaaccaacaactatcaaaattgttaaaagcttcatgcaggccactgttttctggggggacagaggtcgctctcactagaggataataaccactgctttaaagaaaccaattaataattttgtgatgcaaagaagcaccttgtaatttattagtgttgaaagaggggtttgtggtttaacgtggtccattgacttaaagtgaaacctgcttgtgataacatcgcctgatggcttcatctccataatggttctttctggtgagttctgatggatcctgcagtcacctttacttaggatactaagaaggagaccactgagaaaaagctgcaaagcacaaaggagctgatatttgattagcataaagcctactcagggccaaaggaaaaagacaaagaatcacagaatgcagaattggtctcaggcttcggttcctgcccctatgcagagggagctcagagttcccagttctcccatcacaacgtggcaggtcaaggatagcagggagcctgacatgccaggcaactgagaaagcctggattcatccaggactgccaaatgcccactgtgcccagccaagtagccaggtgttgtcaaggggaagcttcccccggctctccctctggacagctcagcacaatttctgtaccaagatgaggagactgacagggcttgaaaacatctgagcgcaccaatcacacagggcagccgggccagaatgaatggacagggtgtgctgtgtgatatccaggcctacccacacgcagagagcgcatgggtggggaaggagggcgtgggatgactgaagagtctggggcaccctgcctcatgagcagaaggagggctggagaagactcgagacagaccagccaaggaccaggtcccccagtctgctgcccacattctgactgcaggtgcctgttcaggtgtgagtgggtgaggattggcctgtcctcttcccagggggagccagctttaggtctctgcttctggttagttgatcggaattccttcttgtcgtgaagatctgcctggaactagaagctaaagaaggagtgaactaaacaggaaaagagaatgaagaaaagaaaaccatccagaaggtgctagttcagaagatcggaacaaaaattcagatgacatgctatcagaagaattggcctgtgtacagaaccttctcatcgttgagtccccttaaactgaccagcacagaacgtgagaggctg

SEQ ID NO: 25062 - DNA, 2787 bp, Bovine  19866881216011
agatagtagggttttcctgggctgtgtttattctcttgttcactttagcattaataattctgtcctacacatatatcatcagaacaattttgaggatcccttctaccaatcagaggacaaaggccttttccacctgttcttcccacatgattgccatctccatctcttatggcagctgcattttcatgtatatgaatccatcagcaaaggacagagtgtcttcgagcaagggggtggctgtgctaaacacctccatagctcccatgctgaacccctttatctataccctaaggaatcagcaagtcaagcgagccttcatggacacagcaaggaagactgtatttttctcaagtaaatgaaaaataaaagtcctgttttatgaattagacccataagatgaaaagcaattaaatgaaaatctaggaatttcaaaacctcttaatattcacacagcctccctagattcatttttaatcattcatatttttattgccagcagtttatcaaggatatttgcatatgtatattttcttcttgccatttaaacttgaattcttcatatatatatatatatatatacacacatcatatacacaaatatatgcttatagagtatacagtttttttccattcaatttgcaatccttttctcatgtacttttcttcctttagggctggtttttctagtctgtaactatgggagtgattttatttccttctttgaaacatttttttatggtaatagaaaaattagttttttttatataaattaatttcattatttcacactaatttttagaaaattaaagtcagaaagaggcagaacaggtgctcacaagagagaatagtgttttacaatctcaccagaaatcaggttttctagaaattaaatgcatattaaatcatatttaatcttatttttaatttagtacacagagactataaacataatccgacagtcttattagaatcttgcacacaaccttccttttcatactgtggcctactttgtaactatgtgaaaaacagtacaactaaaagaaaaatgtaattacattttcttgagaaatcaaaaaacgtttcccattatggagtttaacattttctgtgctgttgttcagtcactctgtcatgtccaactctttgcgaccccatggactgcagactccccgggtgcagaagactgcacccaggtttccctgttccttactatctcatggaatttgttcaaactcatatccattgagtcgatgatgccattcaaacatcactgtattattcttcaattcaaaaaactattataataaatagttgcttagggaaaattatgatatagaccctgctttggggaaatgccaattttaacatatatataataactattcttttaagaagcctgaagaaactggcaacttaaaaacttgagagctgtgtgttaagtttttaggtgggcaatatgagcagcccaggagacagtgtctcaaataactctgagaaactgttccaaagaggtacgggggaaagatagtgtatatgtgattttgatatacagttaagcacacatttattttagaatttctcctggtcttatgaagcttctgccagtcatgagaaacaatttgtaccatgaagaattttagtacttttctagatatgaggagatacaagaattgggctcataaaattgactcctgaaaatgtctaactatctaaagacctgttctgccagtttttgcctgagcacagagtgcctcacttctgctctccaccctgaacttcttttaggttctattcatgtacagaagcacatgactgattccttgtggaggtagatggcaagtgccaatttgtagctgacagtggtcacccttagcttcaaagaagtctgggatatagtcttccatctaagcagtcgtgtgctcaactgaagaactgggagaaggaaatctgcccattgtgagatctcatctctgccatgcatgtgttttttatcttcttttagttgctgattcatattttctgcattttaatgcatatatattatctttataaaaataagtgaaagcacttttatctctaactctgcctaaccatgacttttgtagagagaactaaggttgctgaggtaccgattatgtaactcatgatacggacttcacctggtgaaaaactgcctgtcactattaattgtaatctttatatagctcttcttcttgtttctttcacttgcctggaaagaaagtaattatgtaagagatgtgattcagacaggggaaaaagtccttatttaatccatgaggctattagataactaaaagagggatttgggcttccctggtggctcaggggtaaagaatccacataccaaggcaggagattcaatcccgaagttaggaagatcccctagagaaggaaatggtaacccactccagtgttcttgcctgggaagtcccatggacagaggagcctggctctactgtccatgggatcacaaaagagttggatacaacttagtgaactaaacaacaaacagggactcacctaagatggattttctaataagacttttctgttgatagctcaattccttttagggtgcactcatttcaatggctcagaaaccttttggaagttattttaagctatagtgtaggcacagtaagtatagtgtgctaaatctgggagggaaaaaactgtagttttactctaagctttgttccctttgcgatgagttatttattattttttttttttagggaagataatgttgccacaaatcgctaattt

SEQ ID NO: 25063 - DNA, 1223 bp, Bovine  19866881374501
tggtgagagttgtatttctcgttaatcttgcagcttagcataaatctcagaactatcttgaatctcaaaagcgacttgaccaccttcttcctgccaagtgggagcagagccagtcatcacaatcccttggcatgtccagtgggctggggtgcctccggtgctgccctcaaaccttctactgggccagcatcctttgttcctcttgagtctcgggctggggacaagggaacagcatcttacagaaagttggagccacctgggagagcttgctttgctttacaaagcagtttcttgcatttcttttcatcagcttggtaacccctagcactacgtatcgaatggccacccctattgggatgaagtccctattgatctgatgagtgactaaaacagaatttttcagatcataaggacacaacagacttgatcccacaagatactggctaatttgtcatctgatacacccctttactcttgttattaaaaacattccctttaagaaaagatgtctaaggatattaggtatatccagcatacgaatgagggcccatggatccttgcacgatgagtgacattgttttgaaaaaaacaaaacaaaactatttcccaatataaatttatagtctatctatagaaatgtaaattgttgcacatgaacaattgtctcatattgggactttgcaccaggagtgaaattatttctatttttgtgagttgcagaaataataaacatttaaatcctggcctcttggaaacctgcggaagagaaacttggcaaaataaaggcacaatgattatatgtcattaaaaggaacgaaaatgtgttctgtaaattctcctaagtaagaggatattttttgagatattcagaagtgtgtttgaatgggacacatttttccttcctagtgatggcatgtgctttataatgatgttatatgataaggttctggtgaaggaattggttttctgtgtcccatttgaacttatttgatcaggcatttataaggaaccaggattataaagcaaggcaataaacacaatcatgtcacatcatgttttcttaatgttttttcattctattgtccctgcttccttaatggagaaattatttactctatgttggtatatatttctttttgctttgtgttccagaagaacatttctaaggtcacacatagggagaaacttactcccataactaaatgaagtgcttttcaaatctg

SEQ ID NO: 25064 - DNA, 1064 bp, Bovine  19866881445638
aattagttatggccatcatttaataaaaattaataaatatgtaaaaaagcaagaaaaggtaacccattgtcagaagaagaatcagtcaaatgaaacagacccagaaataatcaggataatggaattagcagataaagactttaaaatagctattataatagtgttctcgaatgaaacttcaagaagagttaggttaaaatgaaaaaaggaaaggagaaggcaattcagattaaaaccacaatgaaactactagtatacactcactaaaatgactaacatttaaaagactgatacttcccagtgttggtgaggttgtgaagcaaactgaacttttttagattatttaggcagtgtgaaatggtgcagtcactctgcaggcaacacagctaatatcttattacatctgtggttaccttatgatccaaaagtgtcacttgtaggcatttgctaaaaattggtttctataaaaagaatcaaacacttttataaaatgagcagagtaaaacctagatgagtgtcagaaaatgagtttcagcttttgtggtctcacatgggatgtggtcagactaagtgagggtcttagagcattcaatataaacaaaaagcaatgaaaaacagcagaagtcagaaatgccaactgcagaaatcagtagtccttttccagaaatttgagtaaaaatctcatatcctgtccttacatagtaaagacagaatgcaccgtgaaagcttataaaagctgtctttggaagtgagttgtaacgatctgtttagagatttagtttttttttctttaatgtttgactacagcctgagtagagaattcacttttagggctgctctgttctttcattagtgtagctctggtttaagaaaattatacttcaattttgtttgatgagagaacatgaaggccctattatagcactgtgttatgaagcgacacttaggggtttttcggtctcctgctacaaatctctttttagtctgtcttggtgatttaagaattgcatagggttaatatgacccaattcatttccccggatgcagttcttttttagtggaaa

SEQ ID NO: 25065 - DNA, 1175 bp, Bovine  19866881518809
gggatttcaaggaatgggtttgaatggacagagatgagtttggttttggacatgctgagattaagtcattcgtgaactctggttatagaggagccaggtctggtcctcagaagagaggtcaaaactagagatagatttgcattgtcatgatggggttgtcactgatgctgtgagaatgaacaggaatcccagagaaagggtgagaagaacaggggcaggcttattgtgtatcactgaagaagagttttcgataagaaagccctggttctgtctttatccacaacttgaatcacctgaaagatttatattttaagattcaggaaggcaatgtaatcaaattatttttatgtccatttgctctgatttatttattctgctggtatcaagagaactaatgtttgagatgccttaaaataatttctatttacagctctctgtgagcctggaagtcacaaaatctttgtaaattttgcaagtctttgagaaaagccttcatgagatgcactttcagaccacaggcatatggtgagagtgcctgccttccaaagcagagactaagaaatagaaaggtttggttatagttcagatagtttttgaactggtttggcaataatgggtcaattctgttttaatgactacattttattttcttgatggcatactttgtctatggatttccatatatatctattatagagcttttaatattttatctggcatatggtcttctcatattaatgatgagtgtgaggtttaaaaatattcacaacctataagttgagagttatgttttattcagcaagaaattttaggacttcaagccccaagaggcagcatctcaagtagccctgagagaactgctgcaaggaggcggaggcgaggagggagctaggttaaataggagttttgcagcaaagggcaggtagtttgaacatcaaaagattattgtaaattaaggaaagccagatatcccaagttaagggattgagcgcttttcttgtcagtgagaagatacaagagtctgggctcactgaagtcattcctttgatatgtacctcagctgtttgaggccagtatcctgtgttttcacatcctgagtttcctcaggactcactggccccacgctggcgggcctgcagtcgctgacgactgtgacatccttatttactgatacg

SEQ ID NO: 25066 - DNA, 673 bp, Bovine  19866881679960
tttttaaaaaggcagctgagggacttttggtggtcctgtggttaaaactctgtacttctactgcagtgggtgcaggttcgatccctggctggggagccaagatcctacatgtggggcgttaagatcccacctgccttgtggccaaaaaatcaaaacataaaaatggaagcaatattaaatataacaaattcaataaaaactttataagtgggccacatcaaaaaaaatctttaaaaacattttttaaaagttatctgaattagtttccatttggcaagagtgttcttaaatcaaaaccattagtcctaacaggtataattggctccagatgattacccacaggtctgaggccacatttggctaatcacacattcctacaggtaggtaaggtggggatacgtgtgcataagtgtaccaaagcccaagatatacaaaattcctcctaaagtcagtgaggtgaaatacattcgacttttgatagatgaacacacaaatcatcccaaattgctttcatataaatatgttttattgcagagaagttataagtatttacatgctgtaacacatcacaacataaatttaccaaatattttatgatgagatgctgcaggtttcagataatagtttcagaagaaccacagattaagtgaagagactgacagttttattgact

SEQ ID NO: 25067 - DNA, 1144 bp, Bovine  19866881818998
ttaaatattggacacatgcagatctgcatctgtacaggtgggggcagcctggtctcgtccctgcctctgtccttagtcactgaccccccagcctggcccctgagaggatcaatcctaacaactcatgtttattcacttcccctttattttatatcatgtctgcatttatcatttcctcctgaaaacatgacatggtgatattatcaactaactttcataaagaaatatcaggatgcttgccctttgtttacatatctgaagagctaaatggtgatgtcattttgtcatgaactcgctgatttggcatctaagttcttcgttcctctctcttcaatctcctatcaagccaacctggaataccgttgcttcttggtcctcaaaccaccatgaccctgtctaaacagggacatcagccttcgtttcattaattccgaagcgctgggacacagagacacagggacctgcagtcacctcttgcctgggtatcaggtttgcagttttatttgcagtgactgagtctggtcagcagatggcaacgaacatcttgcaaggaaaagacattatttaggttgtgttaaaaataaagagaagggagagaaagaaaaccggacatgcgcggaagcagacagcacaaagttgcgcctgtcttgcaggacagggaagcacactcatcgcaggacctgggcggggttccagtcccacccaccttgattcctgagcccctgcccctctttctagcccatgcttcttattcattgttcaggagaagttgtttaccggagatgttagattcacagcacatgcagactgggggtttctgagaaagggagatggaggctggggtggtaaggaagagtgcccccgattctcagtgccacgaagggctgggctccgccggctgagtagcccctctggccaacctgcatctgtggcctgcctttctggtccttccctgctgctctgtatgcatccagcatctcagtctggctcccggctgcaggaacagccctccgccttcccgccccagccccgagccgctccgggtgacaggagacagctaatttaacctgtgtgtcatctcccttctttcttgggcgggtgccatggcaacccccaaggctcctcaggctttctcattgactga

SEQ ID NO: 25068 - DNA, 1879 bp, Bovine  19866880297755
catgaaagtgaaaagtaaagtgaagtactcagtcgtgtccgactcccagcgaccccatggactgcagcccaccaggctcctccatccatgggattttccagtcaagagtgctggagtggggtgccactgccttctccaagttaaataagcagggtgacaatgtacagctttaacatactccttttcctatttggaaccagagtgttgttccatgtccagttctaactgttgcttcctgacctacatataggtttctcaagaggcaggtcaggtggtctggtattcccatctcttgaagaattttccccagtttattgtgatccacacagtcaaagtctttgacatagtcaataaaacagaaatagatgtttttctggaactctcttgctttttccatgatccagcagatgttggcaatagtgtatgctaaatgcctgccatggtaccagacagcaaccaaacttccaaaaacaacacctgttgttcgtatcctttgtggtcactctgctggcaaagatgcccccagagatgccctaaaatagttcagttcaaacggggaataaggaagaggctcaaggtgataagaagaactaagttatcatgatggtgattagcatgccctcacccctacttgtttcctagggagatctaaagcattattttctagctggaggtcagtcccacaaaacaaaaagaaatggagctacactaaggagcaagaaggaggaagtctgagttgctgaagctcagctgtctaaataacaagctagacagctggtgggagaggaagtcagggaaagtcaaagaataatacatactgcaaaaatccgatgtgtgtatagagccacagtctggagaagtttccaaccttcactgtgctcattctaatcacctggtttgacagagaaaacctttgccctggtggattctataaaaagattcagggaatgaatgttctacagaggctgtgtaatgatttttagtctggaagcaatggttgggaaacaaagtctaccctagaatcaagtctatttccagggataaaattgggtgcactccaaaagcctccaagtgcttttcagggggcaggggggaaatagagttggaggtattgttcatcagcacaggtaaagacagatacgcacagtgttgcatttagcccctatttgtggaagtaacgctgtgtgcttcatcattaagcccgtggagaccaatgtgaacagcatttttccacttccatataaaacaataattggtaacatttactgagtgcttatggtgctccaggcacaaaactctttaaggaaacaggatagaatttgcttttgagtgagcagagtcaagacatatgaagctccttccagagactctgcagtaactgttttctcctatcacatgtccatacacgtgaatgttgttcaggttctcacgagaccagaaaggaaggattccaccatcacaacagcttccagttatttagattctttcagattagtctttcctgaatgaagagtttgttccctgataccaagcctgcaaacatcctcctgctgctgctaagtcacttcagtcatgtccaactgtgtgcgaccccagagacagcagcccaccaggctcccccatccccaggattctccaggcaagaacattggagtgggttgccatttccttctccaatgcatgaaagtgaaaagtgacagtgaagtcactcagtcgtgtccgactcttcgagaccccatggactgcagccaaccaggctcctccatccacgggattttccaggcatgagtactggagtggggtgccattaccttctccagacatcctcctattgctttgcaattattaccttgattttccactctttggttagctgaag

SEQ ID NO: 25069 - DNA, 1024 bp, Bovine  19866880376505
ctcatgtctccagcattggcaggcaggttctttatcactaacgccacttggcaagtccagagtagtttactcatttacaaagtaactgtaactgttacagtgaataattccttatattattatttttttctgttcaaatatctgcttgctctctgtctcctgattcaaccctagctgagaatggtttcaggagatagatatgcaaagttgagattctgggttgcttcggttgtgtctttgaacttgagggcagcgctgtatttttttgctgatagaaaatgaggtgctagcaattcatgggatgcaatggtgttgccattagtccagctgtcgcctgtggttgaatgtgttaaagtgccaattgaagatgtggcctatgtggcagtaaggatgacaatggggacagtggtgtgggatgactcctcagagtgcgctcgagcaattatagaaagaaagtgacaagctctagtcctataactgtcagctcaagtcacagattgaggagcaaagagcttacaaggtggttctaaaatatgttcttatttcttatggctgcagggctgatattgtgaaaaaatcaccaaaaaatgtattatgcaagttgctaaattacagttgaactcagagtcttgccaagtttcttatgtgagagtgaagacactcattcagaaagattaggagactaaaactagggttcagaacatctggttggccccggatgcaactgacaatcttgagctgccaagtcactctgggtttcccttggcactgaaattacctaattctcctgtacacagaagtcagacttacattcctgtacctgaaaatcttattatttaatcttacctgaggtaggtgcttttatagtggacgatctctctttttaaaatcttccacaatcaccttctgttgccaacaaacccatagttagtgctaagttgcttccgtcgtgtccaactctttacagccctatagactgtagtcctccaagctcctctgtccatggaattctccaggcaagaat

SEQ ID NO: 25070 - DNA, 2043 bp, Bovine  19866880494013
agcttggcctatgacctactttttttttttttttttatggcccaagagctaagaatgatttttgcatttccaaaaggctgtgaagaaaagaaagaatatgcaccagctccaaggtggccctcaaaacctaggatatttcctattcgaccctttacagaaaaagtctgcagaacttgggactaaagtgaccctgctgttccctttctgagctctatgggaagaacaggcacttcttctctttatttttaattttttttattggtgtatagttgccttataatcctctgttagattctactgtacaacaaagtgaatgagacacacacacacatatatcccctttttcggatgaattagaagaacaaattctgttcatagtggtttggaagaaagagccaggttgaccgaacttctttgcttcttctcctgggtcctctgcctgctggcaggaagtctatattctgagaacagagtgcatgttgggaatctctgctctgaggatggcctgctgtggtccagctgatacagtgatgaggtaagtcaaggctgaagtgagtctgctttccagccaatcaaaggcaaattttcccaacagctttatcagtaatcaaggtgatagtctggcctctgctacattcttccatctgtatcttagaggttctgagatgaagggcggagggtgctttttgaaaccccaaagccaatcctctactgtttcctccatgaagggcggagggtgctttttgaaaccccaaagccgatcctctactgtttcctccatgcatttcctctgtctctgtctcctcgttgaactcagggcaggcaccgtgcctgcagccagggctggcatttcgcacctgactgatggactcacgtgaggcccagggtcaacaccctggtgctgccaaatgactctgtgtcagcccatgtcaccgactgattgccacatcagagggctcattacaagtccaagccaagctctgggctcctgtggagagcagccatcagccactttgcagcaatggcccgaatcacaggaaagcgggcctgatttgacaaaagcagcagccatatattttttgctcttggaggtgtaaccatggtaatgagagcagacaaaaaccgttccttaacactggcgatgctcaaatgcacacagcactttggggtagtggaagtggggtttaattttagaatctgagcatcacttcagggaacaaagggcattagaaccgggcctgtcaaagacctgcaacagcttcctctccttccaggagcgcatatcctgttgcaggcagagtttgcacccatccattggggtgtttgctttgttcatgacattcttctacctggtgcagctgctgtgacggggatgtgcctttagaaagtctctctgttgtgactgtttccaggagtaataaaagaactgagctcaagaagatgcagttgcagtaatcattctgcattcaacctagctgtcaatatcctccctacaatctttataggataggtgtcaatgttattcccattttacagatgaggagactgaggtgcagaggtgatgtgacctttgataagtgacctggcagagagcctgcactcttccgtgatgtcgtgggagacaaaggtttcctgggagatctgtgagagacatttggaatatttaagttggtgctggaaaggcccgtctctgctccctggaaatgcaagtctgttgttactattttgagtgcagatgtgtgtcctcccagagtcccagggctgaaggagaggagatgaaagggaaactttaacctgtgacagaggtaggaagtgcatgtaaaaccagtctcatttctctgaaagtgattttccaatatgtattgagagccttcacatgtccacatgtgtcaatccactacttcggttgttacaaatcagcctaagagaataaccaaagtttaagaagatttttctaacaatatagaaaccacagattctccatattttcaaattatacaggaaattttcaaaataacctacacaatcaaggatggggactca

SEQ ID NO: 25071 - DNA, 2062 bp, Bovine  19866880511435
aggagtatggagactatattataccaccagctgccctcaagagaactgcttgttatgtatttttatttttgtttattctcccttcaccacatctttcttacagtggcatttctgttcttgttgttaattcctacagcaacataaacactatcaggagccatgtgcatagaaaattacagccctgagctccattatccctcacaagctcaggtgtctgagtcacgaattagaggaatgccttcagcacccagcatgagatcgcagctccatcagctcagttcagttgctcagtcgtgtccaactctttgcgaccccatgaatcgcagcatgccaggcctccctgtccatcaccaactcccggagttcacccagactcatgtccattgagtcagtgatgccattcagccatctcatcctctgtcctccccttctcgtcctgccctcaatccctcccagcatcagagtcttttccaatgagtcaactcttcccatgaggtggccaaagtactggagtttcagctttagcatcattccttccaaagaacacccagggctgatctccttcagaatggactggttggatctccttgcagtccaagggactctcaagagtcttctccaacaccacacttcaaaagcatcaattcttcggtgctcagctttcttcgcagctccatagatatatgtaaaatgaatgaaggcattcattcattcacatagaatggcctcctgaagaagaagttttaatgactagagctgagagcaatagacacgttgctatttatttaaatcagttcagttcagtcgctaggttgtgtctgactgtgaccccatagactgcagcatgccaggctttcctgtccttcaccatctcccagagtttgctcaaactcatgtccactgagtcaatgatgccatccaaccctctcatcctctgtcatcaataatgactacatttccctattctttcagcttggggttgcagatatgtcacagatttgtatttctctgtagggtggattcaccgttgccaatgcctcaggctgcagtttcattgagaataactttttggatgttataccttttcatttttacactcatgaagtactaatctcataactattgaaatgtcaaatcgcaggaacctctgacttacctgggaaacaggacctcttgtacaggctaaaagggattcctgggagtgtaaatctgttttctaaactcttttccttgggaactttgagaaatttacctttctggataggtaatttaataatgccctcactattctgcttccattgacatagtatgttcgcacaccaatgggacagaaatcaagcaaggattaaatattaactgtaaggattctggggattagtgaaagggaaaggggaaaaaaaaaattctagaatacacctgaactctgcctcctatgaccattacccaattctttgaacaataactcattgctaagttatcacttgtcacctagcataaaaatactttctattaggtcttctgatgtagttataggggttcaatggtatttatgcaaatcattcaaaaatatctaagcttttaaaaagtatgttttttatactgctaatggtgtttggttttgtgttccctctcctaggcttgctgggatgggaaacctgctcaaagtccttaccagggaaattgaaaactacccacattttttcctggattttgaaagtaagttccaaaaattaaaagattatgatgaaaaagcttcactttctttatagtttgttgataggggagttataaagattgttatgtaattcttaaaccacatccaaatgtctctctacatttctctgagtcttcaaagaccatttcctcctttcttttcatatattattttttttaaaaacaaaaagtatctttttaatatgtttatgcttttctttgattttagaagcagttattgtaagcctaacatcaatcatcatcatgtattttcctaataattttcatgaattattatgtcataatccaaagaaaaatagtatacatagtaatttacacagattaatat

SEQ ID NO: 25072 - DNA, 1060 bp, Bovine  19866880528575
gaatctaggcatttggtccggcagtgctgggaagagaatgggtaatgatttttaacagagcctgctgcaaacacccactcgttctttcacgagcaactaatcttaggtcttagcaatgcaatatcccagagagtaaaggatgaaactgactacaaggtgaaatgctgccaataaaagaagccaaaaagaaactcactcttcaaggatagctcattggtgtcagctcaggtcagaatggtgttgcagcaccctcatcattgatgactgatactctgacctctttagctcggagatgggatgggagctgatgctgttagcttttaatataatgcctgggcaatttactggtaagtagaaaaggaagttggtgaggatgagctcacatttgccaatgaacagtaatgtgcagaaaatgtttaatcagactgtgaaagtttaacttcaattcatcaatcaagcatttccaagatactgactctatgattggcactaagtaaaaggcctgaggggaatgaacacagtccctgacattaaacagcgtaccttttaccaaggagacagaacaggctaaagaaaatgatcaatggatgaaaagacccccaaacagaaaaatatgatcagttctgacaagcagaagagtttaatggcctggcaggcaagttgtagagccaagtaggttcaaatttcagctctattacttaataaccaaataactccagcctaagctttttacttaaccattgtgcaatagtttcacttaaaatacggggataatatggttatttcaaagtggtacacgtgaagtacttagaacagtgactacaattggtaagaaattgatattagctattattaagaacaattgagatttagagggacctttagtttgtttgattacttttctcatcaaatattcctgctgtttcataatgttcctattaggatgtgtgtaaatatgatctcttttggcacactgagaactctggtctggaatctggcactcacgattcaccactacctcgggggtctccctgtggtttccagaaggatgaaggactgt

SEQ ID NO: 25073 - DNA, 1194 bp, Bovine  19866880576229
ctgaaagtgaaaagtgaaagtgaagtccatgaaggtgagaacatgttaattctcaaaatttgttctgaaatttcaaaagattaatgattggcatttaaaaggagggagtgtcattttctacttttatacaaaaataaaatagactttaaaataaagaataaaaaatttgtagaatgtagcacattgaagtcattatcaaagatctttgggaagactggaacagagctggatactgagggcataataattccaggcttcagtagcaaaccataccaggaatttctgaaaggggtggcatttcttagtcatctttacatcttcagcatcagtcacagtacctaaaacaagttcttgaaacatacatttattttaatgaacagaatatatggtcgttttatttgtaccatttggcaatatgggttttcattcaattagaatgaaaagtaagtctccatgccaataaacaggaaataaatctaataacagtcagtcatttgcataaatgcctaattaattccatatttgaaattggctgatggaatgtagtcaaacagtcatcatcagacaaagcaaacgaccgaatggcaatagcacatgccacggtgccaccaagacaccaagcgatgccaggtgtgttctcagatttgtagtttcctttggtttctgtctaatcatgaggcttccttgctgaaatttgcaagaacaaatattagctgagactttggtgaggatattcatttaagctatggctggctaaaagacaaaaatcattgattttcaaaggcagtttaaaaaaaaataaataaaaaaaaattaaaaaaaaaaaaaaaacaaaggcattttaaaccatgactgaagtatggtcagagttcgcaatggtcagagtttgcaatgattagcagtacgtcaaagagggcaattttttattttttaataactgtgcagataatgatagcccacgttgccattcagcagtcaaatttttactaacttagaaattttaatttaatatagtcccccctcttcctactaacaggatttatagatgtaatcacacttatttcacttttatattctcattccccgctcaagaattcctgatagatttctctgacttaccatgttgttttgatctcagttatattttcccaaaattcatatgttgaagccataacttccagatgtgcctcaaaa

SEQ ID NO: 25074 - DNA, 1353 bp, Bovine  19866880606745
ccccccccccccatcaatcatgaatattttatagcaggtctctctggctgtcctagattatagagaataatggcttcattatggagaaaacgaatcaagctcatttctatagagcagctactgcgtcgccagtcagggtaacttcctttgttaagatacaggctgcagattgaattagattggcaaagatacctaaaagagattacacaccattcattgggttgagagtatttgtggagcttgaattctgttcccttaccttgacaggggcattgatgattcagataattcaggccaattctagaggctttcttaacatcaacttcattctgacttggctccacaatgatgattattatttccatcttggaataaatattaacttaaatataaattaaatatctggaaggaatgccctcttacatttgaacagagcatcacattttagaaggcactcttgatgccttggcactcccaaactttctgccttgtagatggcattatggggatctcatcaggtgaggaaaccaaggtcagaccacttgtcagtgggcacagaaggggctacaaaataagtagaataaggggaaacctgacactggagtgaagatttcctcattactatactgcctcacctcaacaactcaagcatttttaaaatccagcaactaatttaagtacaaagaaactgccacatgcctgagagagagattttcattatcatttttataatagtcttaccagttctactcttggttttaaatattctctcaaatcttttctccagcatacttatatcgtctctcaaatcttttctccaatatacttataacaatacccagtcatttaactcaatccaccatttgatctgcatacaacttctcctgcatctttgattcaagttttgattctgccatctaacaagccacgcgatctttgggaagatgtcagttaaccaatttcagccttgtcttccttagctttaagatggggataactacacctatcgccagagttctttatgaaattaattcagttaatatataaggaaatgtttgacgtgctaacccaaacgttagaagcggtcatcaccaccatcatcactgttagagatacgtgaattcttgacatggatacacctctgatttaacttacggagtttccagcatgactttacaaacacttgtcatcgtactgaggcagtctgtggtgttctctattggcaggggttttgttctaaatgggagacacaaatgtgttagcctgttagcagctttgatgggcaactgggcggaaggcactttgttgctcaacatcacttacttcggagacaaagtgcatgggtggcggttg

SEQ ID NO: 25075 - DNA, 1591 bp, Bovine  19866880690054
aagaaactgctgagggaagagagatccttgaaggaagaatggtgaagaccaaggccctgggactggccagttcttcgaaagggcagggcattgaagagggtagtcaagcagagttaagagatgagttgagaggaagatcaaagtcagatcatgcaggtcctggtaggtctggaagcgtttagatttttttctaagtgcagtgttagcggaagcatcaagtcagagcacattaaaaaaaataatctagcttctgtctggagtatggactgcaaagaagtaagagtagaagtcaaaagataagctgggaggcaaatcaaaccagattagcgagagaagatggggacctgagccaggaaggtggcattggtgaagaagataaatgcatgcacgtgtcatatattttgggtagaggatggacaagggcttggtggaagattaatctgggtacatgctgtgctgtgctaagtcgcttcagctgtgtccaactctgtgtgaccccatggactgtagcccaccaggcccctctgtccatgggattctccagacaaaaatactggagtgggttgccatgcccttctccagggaatcttcccaacccagggatcaaacccgcgtgtcttaagtctcctgcattggcaggcaggttctttaccactagcgccacctgggaagccaatcagggtaataggaaagaggtaattctgagatgacccctgagttcctgtttattggataacctggtcatttatggaggagaagaaaacctgagaaggaaagaatcatgagtcacaaataagataacgcatactttgtatgaagagcacttaaaactgttcctgacatacaacgtgctttcaacaggtgcgactgaaagaaaatgcctctattatctgataattcaggcccattagtttcccttgacaacccattacaatttaagatcttcccaaagtattttccgtttcatgtttctgtgctcttattgttcccttttcaataacttaatgtttaaggtcgatatattccttattttcagatccaatggggtaatgaaggcaaaagtcgctcttcctctattcatttaaaacaaacactgcaagccaaaatgattactctggtttgttcttcccaacaattcttacctttctgagattgacagaaagcctctttggccatctgcaacaaaggcactgcctgagccgaccatggaaagacagttcttctagttcaacgcccacaagtgggaggcacagaagtagagcaataaaagttgttaacatatgcagggaggttgctgcaggctggacacgatgcctcaagcactttacagcaagggctgctgctgctgctgctaagttgcttcagttgtgggcaagttgctcattgtcctacagattttgatagttattatggcaattttccagcagagggcagtaaaggtttcctaaagatggggaaacttgcgttaacattgctgttgagctaggaccatgtccctacacccagtcctacagggcaaagtgttagaggctgtgttcttccagtgccaaacagatgatcaaaactagataccacttagaattgaaagagt

SEQ ID NO: 25076 - DNA, 3769 bp, Bovine  19866880700115
tgatgtggatattgtgatgtggggccctggacatgcaagggctccgtgaagcctgggtcaggagaaaacagggtcagggaccaccctcttcctcccgctccatccctgcaactctctcacccccaccatcctctccctccccaaggaccacctttttcctccccccccaccctctccataatgagactatgaaaaccaaaatgcaccttctctcaagttgaataactattcaacaaaccctctgccaacactctgagacttaaatccctttctaacagatttaagttgtaatgagagaaatgaaaactatttaggtctatgatgctgggaaagattgaaggcaggaggagaaggggacaacagaggatgagatggttggatggcatcaccaactcaatggacatgggtttgagtaaactccgggagttggggatggacagggaggcctggcgtgctgcagtccatggggtcacaaagagtcggaaacaactgagcgactgaactgaactaaactgaaaagggcgattagaataaattcatcaagccctccctcccatggattccacgcagggaaactgaaacccacagaggagacatgaccacttcagtcatgaaaaaaatttagtgtaactgaagctcttcattttaactgaaggatccattaccccaacctttgcaggggccacttttagggttagttttctggaacaaatgggataaaaaaaaattagaggaaggaagggaagaaagaagagggaggcagagggatcaggtaggtctaaggaaaattgccaagtgtaaggaagttttagaaggctttcagcaagggagctcctggaaggtagatgagtctgcagagctgtgtcctctggcccttattgctctgatttcatctcctgtaggcaccccatccaccctctactccagggaccccagcctctgagatctcaagcctgatgatctagatggagctgatgtaataataataaaaataaagtgcacaataaatgtaatgcacttgaatcatcccgaaatcatccccctcacccctgtctttggaaaactgtcttctgtgaaatcgatccctggtgctaaaaaggttgggcaccattctactccattgacagaccctaggacagaccttgtctcctggccattgcacatgctgacccctcgcagtgtttacctgggtgatgatcaacgagccttctcttagctcagacatctcggcctccctgtgtgccccccaggactcactctggcttataggcttggcacttgccatcctgaagcacaatggcccatttacttgactgtttcactactagactgtgagcccctgaagggggcttatcatctcgatttccccaatgcaatggcatccaaaaaaaaaaaaatttgcttactcaaattagtgagtctgtgtcagcttgaagatatttatttctgcagtgttcttactaaagccgtgtagataccttcataaatccttcatgcataatgcagtgcttattacatgatgaagtcctgtccccagagtgtctctctacccaggttattccattaataaacagtatttataagtgatgagtaaacagtatttatgcatgaaagagattgttattatagacctgcaacagggcctattgggaaataagtttggcagcggtaacttcatcagaggactcagccaggccacacagcgactctatggagatctctccctctccactgcctcagtctccctcttcttcccttcctttcctctccctgttctctcctctggtggctcagtggttaaaaaaaaaaaaaaaaatctgcctgccaatgctggaggcacaggttcaatccctgggtagggaagattccctgcagcaggaaatggcaagccactccagtattacttgcctggaaaagcccatggacagaggagcctagtgggctagagtccatggagttgcaaagagtcagacataactgagagactcaacaactgtcctctccccaccccagtctctctccttcccatctcaccccctgcaggccaagacttcagcaggagctggagccccaggaaggaacttcaccatgagaagctctggttccactggggtttgctgaactctgctatgaaccctcaaaggtttatgctcagcctgcctgctggctcttcctaaagacacgttcatgattgagctgtgctcttaactttagggctcaggaaaagacaggccaagcaggaaggatctaccccacagcccagaagaggtgtggactcacactcgcaccctccagtgtccatgaggaaatctgacatggatgaaatgctatgaggacgtattgtccaccgccaaccaaacacaacaagcgtgattatttttccatcatgctgtggatgcctttccaggtaggggctccagtttattcatcttcaggtcatcgggactaggcacagcatctggctcagagtaaatcctcaaaacatgcactgagtgaatgaatgaatcagtgagagcatgaacaattgacaaggagcatgaatcaaaagtaatcggtgtgacataagggcagcctgaaccctcagcctggcattcaaggctttttagggctaagaacttcatgggtatgagccaggctggttaagctagcctgagattttttttgtttgttttaatttatgacaaaaatatttgataatcctcatggtgggctgcagtctactgggtcgcaaagagtggacatgactgaagcgacatagcatgcacgcaggcacacatggtagttaaatgaagcaaaaatcaaaattcaccaaaagagtactttgcactcttttatcctgaaatatgggttttctaatgcagggtgtcccagattttagccctaaccttctctggcctgcggtggccacacacggctggttttgacaggtttgccgggatagctgggtgcagcccactggcttgtgctgtcttgctggagtgagctcagggatctattccagaaaagacaaaaacagaagaggcatggatctaacttcctgagctgggtggacaggggtctatgtttagccactctggagccaagatcacagataaagtaagaaactccctccagcttcgtaggagctgatagcgtccttgttcagggccgggtgcacatgtcagaggaacatgtccatgtcacacaacctggaagttgctgaacaagagggcaaaggactgccttggtcagacatttccaggtccaggagaatcaggaacaaatcctgcagccggaatctcctgccaacagcatagactatctcgcccctttgagcagcagggcaccaattacaggttcttcgcaagcctccttaggccacattgtgtctccgcaggcacttacatttcatttgatgacagtgacattgatgaataatagtttctgcccccgcaaatggttacagggtctatagctgatataatagagtttcctgtgaaagttaacactttacaggagaatattctctcccttatgtgcagtgtttgcatcggtgatcttatacctcatttttccttttcctttattaagatattgactttcaggagaaaactctaagggattttgctaaaaactccatttgctctctttcagtctggaatagagattggaagcaatgcctgaggttcactgaatgatgactacctgccaagtaacccacacttagtaaatcatctgatcctagtggctcagctggtaaagaatccgcctgcaatgcaggagacccagg

SEQ ID NO: 25077 - DNA, 1031 bp, Bovine  19866880723697
ttattgcatctagagcggagactcagaaatattcagtgaatggagtgaggctggagctttacctgtgtgcccatttggctatgctcactcacagagaagatgaggagacttcaggggaaaaagtcttgaacctgactagtgtggacacatatcaggtgtgtccaacagacagaggccaatgttgccagaacaaatttgcagaggaaattagaaaacctctgaaagaaaattcaccagaagaaaaaaatgaatatgtcacagtaaacccagctcataaacaatgaataaggatcagaaggaagagggagaccaaggcagagcatcttaactgttatccaggccagtggttttagagacaggctgggaacgtgcttcctggagagtaacagaactgtagacgttcaatgaaagagctgaagaatttgggaaccaggcaatcctgcttgggaattctactcactccaccaccccaactaggcagtaaaaaaataatacagaaggaaggagcactcccttattttgcaaaaagcatgggaaagggacagggagttgggaatgagcacagaacgggtaggagcagaagtgaagttttcacaagcccagccccaacacattctcagggaactgcaactggcaggactggcagaaccacctctctctctgggcaacaaggatgtactagaggcagaattcccactagagtggcatcaggcagtaaaggttgggaaaacattcattcatttactcaacaaatatttattgaggagttactgcttgccagacattgtgcaagatccttctgttgactggcaatgagacaaacagaagtgtttgaggctataacagataatgaaaacaagagctgtctcactaaattcagtaatactttgactccaaaagcccttttggaaaatctcactttaccaagcttccttctttgcaaatgttctaatcatagccttcattaatttatttaacaagttgtccttttcttattgaattattgcatgtgctcagtgcccaagtcgggc

SEQ ID NO: 25078 - DNA, 2302 bp, Bovine  19866880898435
gccagagatgtggtcgttcctggagctggacatgccagtgatggggaggaaatgagtgaggagacgagcgggggcctgacatggagaagactctggaagaggacagagcagaagctgggaacagctcaaaaccaatgttcctgagtttgccaagctgatggcaccatctcaacccagctggcacatgacgttggggaggtcagacaggctccagcgtggacctggtgttgaccatggattgtttcctagttccattttatggaagctggcttgggaagacaaactgtatttgtaaaatggctcacctctcctggagtctaatggagcttttcggggtggatgacatctgcaatggggcttacctgatgagttgggagttccataaacaggtctcttctgtcttgctatgtgcttggaggggaaggggcagcacccataattggtagggtctctcagggattgagtcatagccagagtcttcatcactgaatagatcagtaagcaggaccttccaggacaagactagtcagataaactctagcaattcccctccctgggtatatatctggaaaaaatgaaaacactaattcaaaaagatccatgcaccccaatgttcatagcagcactatttacaatagccaagacatggaagcaactcaaatgtcggtcagtaaatgaatggataaagagtatatggtatgtatatacagtagaatatttgttgttgcttttcagtcactaagtcatgtctagctatttgcaaccacatggactgcagcacaccaggcctccctgtgcctcaccatctcctgaagtttgcccaagttcatgtccattgaagaagtgatgctataaatggaatggaatattatgcagtcataaaaagaatgaaataaagtaatttgaagcaatgtggatggacttagagaatattatgcttagtgaaaaatatcaaagacaaatactgtatgatattacttatacatggaattgaaaaaataatccacatgaatgcatacacaaaacagaaacagactcacaaatgtagaaaacaattaccaaaagggagagggatggtgagagggacaaattaggggtgtcgggttaatagatacaaactgctgctcctgctgctgctaagtcacttcagtcgtgtccgaccctatgcgaccccataggcggcagcccaccaggctcccccgtccctgggattctccaggcaagaacactggagtgggttgccatttccttctccaatgcatgaaagtgaagtcacttagtcgtgtccaactctcagagtccccatggactgcagcttagtaggctcctctgtctatggcattttccaggcaagagtactggagtggggtgccattgccttctatagatacaaactattgtacataaaatagataagcaacagagatttactgtatagtggggaattttactcaatatcttgtaataatctacaaaggaatattatctgagaaaaattccaaatcactatgctgtacacttgaaactaacacaatatttgaaaccaactatacttcaatcacaaaaagaaagtgaaaaagaagaggaggactatacgaagacaaacatgaagatgtcatgctcttcgaacataaggggcaattttgttttataaagttcttcctttttatgtctgcagtcagaaatctcataaggagggacacagggaggatgtggccttcaaggttatgattcctcgacagaaacacttacttttgtttctctaagaaaactgagagcaggctggagcctgcaggagagcactctagacagagccagggcctgtgcacgcttcccaggggtttcctgggctccccacgtgtctttgggcaaatgccttgccctctctgggtcaccctttgcaaaatcataaactgaaaagtgcctttcaattctgaccctctatggatctatttttaacaaaaccagactccctcccacactctaagcttgccatggcgacatgtgtagctacacaagcttctcagaattagaaagaaatagcatctgtgaagtgtcagctcatcagaaatgactggcagctggggggttccaagcccctccctgaaacttgctcctgatgcaaacacagcccacctcccctccctgggctgctgccactcctgtccttgctgactatgccgtgtgttctcaggaacagaaatagaagccgtctgccactaagcaagtgtgctcctaagaagatagtgttcgtgcgtaatttttttcttggttctttttttttcagctaatactctgtcaa

SEQ ID NO: 25079 - DNA, 1077 bp, Bovine  19866880943896
ctaatggatgaagacagtcttaatagctaaaaatccgaaggttgtattttaaactctgaaataataattaaattaaatcttaataataatgatttaaattaattacataaataaggttgaagagaagaagaataatattaaactaattttttcattttttatgtagggagccaatgtttaaacaaaatgtataactacaaaaatggatctctgagtatatagtttagaattgcaagaactaccaactttattaaaacaaaccaacagttaaaagagaatttaaatgaagagtgaaactgtgagtgtaaggaaggaggtgaaatatttaaaatgctctttaacccttcagtatagacattttaaccttgtgaacatactgattttattatgctgctgctaagttgcttcagtcgtgtccgactctgtgcgaccccatagaccgcagcccaccagggtccctcgtccctgggattctccagtcaagaacactggagtgtgttgccatttccttctctaatgcatgaaactgaaaagtgaaagtgaagtcgctcagtcgtgtccgactcttagcgaccccatggactgcagcctaccaggctcctctgtccacaggattttccaggcaagagtatttattatgctaaaatatataaaaacattttccaagatacatcctcatcatatcattttttatctcagttttgccagttttttcattttggttataataaatttttcttaaaaataattttgaacatctgcaagttaatctctgcaaacacaaagcccctaccagatgtttctgtctggctctgggcccagaaatattaatggaattataatggagaaggtcttgagcaaatatatttgtcaatctgcttgtgctctcagtcttaaattgtactaaaatggatgataggatggcattaaataaaactgctgtggggtctcagcagtttatctgaacatgtgattgattctatttgcctctgttttctacttcaaaagccaagtttatccttatatcattttttataacttgagattgagattggttttgcagagaatttaaaaact

SEQ ID NO: 25080 - DNA, 1388 bp, Bovine  19866880969428
cgagattgcttgtttctccttctgtaattatttgattaggtagaagatctatttgtttaataaccaaaatataaacttctttggaaggaaggatcgaatattaaatctgagactaagttggacactgaagtgtggctctttgtgtaaagaatggatgccaagtttgatttctaaatatcagctgtgcctctcaagccaaagatgagctgacaactctggtcaaagctttctcagagcatactgtttgcacactgtttgcacactgactgccgtcattttctctccatccaggttcactacaaagcacttgaatgatgaatcgacttccaaacagattcgagcgatgcttcagtaaagccttgctcaatgaagaggatctttgaactgacctcagaagatgtatatgtttacataatttaatacagattgatgttaatacttgtgtatttacataaccgtttccttcttgtcactgaaatatatggaccttcatttgtatcctgactgactcaacccagagatcataaattgactggagagccttaccttcgatgtctaaaacaaaaaccccttctccaaaaggcagaatttgggagacgttgatctttgctactggagttccttacgcctgtaacaatcagaacttcccaacagtttgtggtcatgttttaattctagattaaattgatctctctgggaagtatagttagagaaacacaaagagtttgatttcctgggtcagcccagctacaagaaacacaactgttatcctgacagagagacagggggaaccccagaaaagaaaaattccagtggagatataagccccagtgtctggaattcagcacacccccctctctttcctcagaaggcacagcacccatcaacttttctgtttgcacctattttatttctcagcattctctcttcctattttgatttataccctgtaacattccctttccatttttcaagaggaaaaaatcagcatgtttgcatcagtttgtggaggagaaaggagaatagaaagatgcactcttgtggctgggctggtgactgtcgtggaagtggggacaggtggggaagaagggcatccaagcaacagtggcagtcatctctctgcttcaaccctctgtctccaggaccagggaagtggagctctggctaaaattgtgggtgaggttgctaatgttccagttgtctgtggagtgctgggcacacaactcctcctaataggagccatggcctctggggaccattcatgtggcagcaaagatctagctagaacttaactagttatcagaaagcttggggactttagagaggagatttttattttctgattacctgatatttaaaagacagctcctccaggacctaactgccag

SEQ ID NO: 25081 - DNA, 655 bp, Bovine  19866881045809
acactatgagaacttctgacggcaggtgacacctgaattaagttagctatcccctcctcccacctctttccctccacatttcccctgacaactccccagcattgtcaagagggctgagcaaagatcatggtcctagtgggtgaggcaagaagggggaactttcttagcatggttgcagaagggaggtgtttgggtttgcaagttgagatctgtgcataattaaactggagaaaaggtctaagtgggctgtcaaaacaaggagggcccgaggcttatgggaggagtcagataacagagtcagagtgtgggagagacagtgaaaatgagcaaaagtcacagtaggagggaacccatggaggaggctctctgggtgactgtcaaagcatgaccgagctcttcccggtgccctgtaatgggctgtttcgtggcttagagccgttcaaagggcttaagatgaagtccatccactatcttcttccctcagctccttttttttttaagatttttttgatgtggcccattttaaaagtctatattgaatttgttatgatattacttctgatttatgttttttggctgtgaggcatgtgggaatcttagttccctgaccagggattgaacccccaccccctgcactggaagccagagtcttcat

SEQ ID NO: 25082 - DNA, 1682 bp, Bovine  19866881096309
tatttaccagtatcctgacatagaagttttcaaaatatgcatattatgtatgcatgcatgtatgtttcatgtatttttatttccaataaatataacttccaatgaaatgaggactttgtgagtttgttcactgtcatacacccagcatctagtgggtgcaaagaaatctttttgaaagcataattaaataacacctttgaaattattcaatgcagttgaagaggggactcaactgagagttcaaatggcacaacaccacccctcaaccactggaaactcaattcagaacctcatcttacaaaagatttgttcatttctttgcctctggtctccattttcctagttcaactcaaatctttgctgagagccatacactcaactagcgttttttaaactaagtagtgaatacaagcactgacttaaaaggcagatttttgtcgtagaataagctcagggaacctagaagcctggtccttgctcaatcaacagctgtattagtttagacacatttcttatgcaatgctgctgctgctactaaattgcttcagtcgtgtctgactctgtgtgaccccatagacggcagcccaccaggctcccccgtccctgggattctccaggcaagaacactggagtgggttgccatttgcttctccaatgcatgaaagtgaaaagtgaaagtgaagtcactcagtcgtgtccgaacctcagcaactccatggactgcagcctactaggcccctccgtccatgggattttccaggcaagagtactggagtgagttgccattgccttcttatgcaatagccatattcaattaatcaccaaataatcaataaaaaggataaaaacagatttgttctaagagaccttccaactttgacatcttagaatatcataaaatattctcttaggttattttcttcttgcaactggctggtgtaattgattttagtagtaccatcacatttgcaggccttcaggaaatttgttctttaccacagcgatggccgaggtcctttcaaggagccaacatgccaagccacaatgaggccccatttatccacaggtccatttcccagcaatctgactcattcaggcccttttgatcctgaactcatcaaaagagtcccctgggtgcccacatgagctggcagaaagcctcagcattaaagattatgtacattgcttctcatcccctctatcaaagcattacagggtctagattcctgttttccatcaatgactcaagggtgctatttcctctcctggaaattgtcttcccagtccatacttgctgatgaacccctatgtgttttttaggctaatctcaaattctcactgttctaagacactactacggcctcctgctgcccacagaatggaatgctgtaccttccacactctcaatctgacttgtgtatcccttcttaacagcctggccattctgtgtcatcgtcatgcttgctgagcatttagacttgttgaggtcactatcgtgttttatttgccccgttccctaggatggagtctggcacagagtaggtgtgcaaatactgttttctagagacttccagtgatgccatgccctggaccttagtgaaagaaacccagtaatccaaaagggaatgcttggagaaggcatttgggagagacaaatacatgattcttaagcagaataatag

SEQ ID NO: 25083 - DNA, 2771 bp, Bovine  19866881105071
taaagaggaagaaaagaagattctcttgctgatgaagaccactccagcaaaggccctagggtgggtctggcaagaagaagtgaaatcgagagggtcagcagagtagcaattaggacaatgtcttgcatggtgtggcaggttatggggaccattgacagctggccagaagaccttggattcagaaacaaagtgccaaagcgtgagtagggaaattaactagcctagttgctactacatggtcacaaatagcttgatggtattggtatgggtgcaggtgtcctcataaacctactaaacttttattaatgctgaagatggtatgtaggtggtaatagaaaaacctagaggaatagatgcaacccacttcagtattgcctggaaaattccatggacagaggagtttggtgggttaaagaacatggtgtcacaaagagttggacacgactgagcacacacacacacacacacacacacacacacacaagagggacggaaggaaatggagaggagagaataaaaatatatatcatttatttcacccaaaaattatatttaatttgtatatttagctgatcaggtgtttactgaatggagcatttaaacatcatcaagatgctgtgtgagacacagaccttgaccttaagctagaagataggaagacaaactcgataagatagatgttaacctggcttgctacactgaaggcagggacattaagcaggagatgtctgtagtagttcaggtgagaaattgtatggaaataaacacaggatggtcacggcaggggttgcaaaggagaaaacacaaggcacattgagaaggaaaatacgatagaaggggtttggtgatacgtttttgttacttaatcatttcattcctttagttccttttgctgagctcttactgccaggctctgcagcatttcctagaaatataaggatatgggcatcaggataagctgcatttgctttgtcctcccaggaggcagacacagtattaagaagtctacatacatcatggcatgtgatgttcagaaggttcctgtaaacagatattgtcactctcactctgtagtcacagaaatcagagctcagagacagtaaacaacttgctcaagccacacagctaagctgagctgggattaaaatgcaggtgtgtggattctaagcctggctctctcatctctgctacagagatgacaaggaagatgtggtttgtgttactgccagggtcagagtcttgtgagggggaggtggaggacaggcaggatggaagattgcaatgggggcacgcccagagcctccagaaatggaacacgagttggaggagaaggaaaatgccaagatatttaagctgctgactctgaaggtgtttgcttgcctccaactatgtgagaagattcagaggccatttgggaagtgctctcggttgtgccttcaaggattggggtgagggtaggggtcctggttccaccacgatattgagcaactgaccttccctcttctggtctgggttttcccatcatccagaagtttcagactaagtgttctccaaagttcctttcatctctacactggtggtggagaaactgaattccagtgggctgatgaacaatgaaaagtcaacaggggagggagggctcagttggccttttcttggtattttttgctcctccatgagatatttcctccactgctttccagttcatctcctagagtgtgagacacagaatgagtaggggtcttggtgtttcaccctgaggaatctcaggggaaacaaggtaggaaccctagactaagtctttttctctggagctcataaactcattcccatttccctggagtttagaggctagaatcatgcattcactttatctgaagagaggcagagctgtagaagatagaatgcccatagcctggccccctgctctcagcactaggttgggaaatgaaggagcctggagatggggctagagtggagatggatatggagaaagtacacccttctcccaactgactctgtgcttccagccatcaccccatgtgggtgactgagaaagttgaataccctgccatagccagaggctcagctattatacgagtctgggcaaaggcaaaattgggacagagaatggacttctgttcaggcaggactttcaaagggtttggtgcccacacggatagtttctgttggcacaaacgatgtctgttcagttgaaactgaacttctcggtaaactcggtttcctcctacccactttccctgtttctcttttcttatactttacagaataacatccccacaagtacgttttaaaatccaacttctgatggaaatatgttagattcttctcagtggcatgttcaagtcagctcataagctgatggttcaattttttaaaaatttgtgagttgattattaaacatagccattataaaaaattaaattatagaacttattaaataaattatagtgaaaacaacagtaataaatactcaaaattaacactaattattttactacattttatatttatttatcctcttgaggttctttactttccatcaagtctatgccctgaaaatattatacaatggtgtacacatatttttgcaattcagtgttcaataagtttatcatggtagctagaaaatggtcatggggtggacttattcacaccatgggaaatctgcaagcatcagagatcaaggcttgatttattgggtttggtgattgccttgacataagagagtgatggataaaatgttaata

SEQ ID NO: 25084 - DNA, 938 bp, Bovine  19866881129014
caaatatcaattaacttttaaatatcttttatccagtcattttgtatatcaggcatgggcttggtgagaggattcccagtagaaaaagacttattaaaccctttaccttcatgtctctctcctaaccttccaaatctttattcaattgctgtacatatgctaacctttcatcttttaatatcaattcagggaagttaaattactagaataaaagtttaccttaaagtgtggttgatatctttatcattaaagaaagaatttcttgaagtctgtaaaataactgaaatgtttggttctaagggacttgagtgtttgcctggtgtctcagtgatgcaatgacttcattagttaaatggcagtggcttcttcctgaaggccaggaactggtccaaaccatggttggcaggttcttggtgttctgaagactatgatgctgggacatctggcctgggtacccagctagcctaatgttacccgagcctgtgctgtataaactcttactcctctgagtccatttctgtgtggagactcccaagacgcaaaacaattgcatgagccactgctggttagcttaattggcacattcaagttagtcatataaaccagattctttttatattttgccaatcttcatagtgtaacaggactgttcccatgttaagaatttcaagtaagtgtttcctggagtgattagcatctgactagactgtgctcagcaattacccacaaacacgttgatgcctgtgcctgatggtggatagagagttctgaaggcatctccatgttatccttcagtacttccttggaggaagagagggaccagctgtgctaagcagaggctccaagaaacacttctgggaagagatttgagggctctcaatctatggcctcagtgactgcaatagattttaactcattcccctcaaatacacctgcat

SEQ ID NO: 25085 - DNA, 795 bp, Bovine  19866881156627
ctttcttaagaaaattaatagcgtaaacaagtttgcacagagaatatgttaatgtgccttggattatgaagagtatttgaaagcatataactgtttcttttagatagagaaaaagtaatatatcattttaactttctgctcaggtagtttaaattggttcacttctaaagttttattaaaaaaatgtataaactttgtgtaacctttcctgtctttgagttatacaacatcaatttatttggggaaagtttttctagtcgatctgttggagcattagagaatcacaaagatctgacctgcatgttgacttttttctttcatttctctcttaaaaaaaaatagctgtaagacaagggtgtctgccacccactcgttctagagatacctttgctttgggcttcaaaaagtcaggttgaaagaaattgcagttatattggtctcctatgtgtaccacagaaaaatgcaagacaagaatgagtgttttatttttttgtaatttgatgaatttcttcttccccagtgagagactgtcaatgaccctccaatgattagagtctaaatatactttccccatttatttttaaatgatgagaaatgttacacatatatacaaaaggataaagaatagtttaacgaatgtccatgtacccaacgcccacctttcataactattgacatagtcaacattgttcatctatgctcatatctctttttttctcatagccactctttagattatcttaaagcaaattccagactaactgaatttcatctgtaatacactctcatatatgt

SEQ ID NO: 25086 - DNA, 1527 bp, Bovine  19866881195456
tgggagacctgagtttgataccttgagttgggaagatcccctggaagaagggaaatgctacccactccagtattctgactgagagaattccacgaaatgtatagtccatggggttgcaaagagtcagacatgactgagcgactttcactttcatggtaaatttatatagttgtatgccatgcagcatttaaataatactatagaataatgacataaaaagctatcagtgaaaaaagaagtgatggcattaaccccaaactcatcatttgtgcttgtgtgactgggtttgtagaaaccttcatttattttgatttttcaggaagcatcaactctctacccataaacaagagataggggaactcgaagacatattctgaacttgcatgactccagcttcagtgacaggtgtttacactcagtactgtttcttgcaatgtacaggactgtggttaagatggaaagttgtccaccaaatacttctgccccttcctggatgttgtagaactgggtgcctgtcagttttacagctctgcaaaccgactgccacctccttgtgcagacaagtaactggcaaataggagcaaaaataatatgccatttccagacttgacccctaaatactcttgctccttcgtggtttttccccacttctggctgtccccagtggatgaggtgatcttgaaaaccacatgtcccagataataaggtttctgacagcctaggtctttgaaggagtgcctggagaggagccattcctccgacctttacactagtctaagaccggaagaggatctattgtgcttgacgtggtatttactttagggattagctgttatagcagtctgcctaccataactaatacactggaatttgatagtttacctttttggtattttccaagccctgagcacaatgttatattttatttcctgctatgaaagaaagaaaaaaaaaaaccaatccaatctcatactattactgagacaattttctagctatatttggttatctctgactcttactggctgctcccacagaggctactcaagcaattttctggacttgttttcattttataagatcttctaatcaaagttcttaaatatatatttaaagtgctttcatgatagataccaatataaatcttttctaagtaattttccatctctctcattaaaaaaattatatcaggatgtgggaaagagagcacataatcaaaaggataaagtaagaaatgaccttgaatacaaagtttatgtctttcatcaaccttctccctgagctttagtgagatatttaattttacaaggaactgttctgtgcactaaagtgaaatgcataatttaagttccctaagaaattctttcagcatttttgttttgttttgttttagttcttggcagacagccaaaacttgaagtaagaattatagattctgaagagtattaaggggggaatttaggaatgtgctatattcttacattttagatttcaattttttaaaatgaagtaaggaaagtgagaata

SEQ ID NO: 25087 - DNA, 1987 bp, Bovine  19866881197237
tgatatggacacttttaaatattcaacctggcctgtataattgcttgcctgtttctgatggaagcagagagttatccagggaatgataaatgccagaagttgggtttgttatatcagggtttgatgacattgtcccaaggaatgagctgtcacaccattactttctggattttggtagccagggtggcagtcccttgagtcctctaagaataggagagacatatttaggttttatttttaacaaatccattcagtggcagaacggatttccctggtctatatctaaatgtcagtcagtcaacaaagagaggaaaagcccttttccttggagcttttcaaggctgaacaagtacagctggttggatgagggttctgtcatcataacagaaatgcactaaatggctttcaaagacctttccaaacctagggattctaaaaccctagaggaagccagaagttgggataacactggggtgaacaaattcattagatactcagcttcttttacttggaagccacatgttgtctttgggcaacaactgtcaagactagaaaatgtagaagtactcaatatttattgtcatagggtctattttcctcccatatcagagaaaggacttgcagagtaaatggttgagcacatttataatttttaattcaactttctcacaagtgggaccaaacatatggggtgaggagctgccggcctgccccaatttagccaggccaccttgtttcaaagccaagattcaccagaacatggattctcaaaagcccagggcctgaactattgcctccggttagcagcaggacaggttaactgaatgtctgtgatcactaacaggtggtgggccgtgggtccactccagagctatagtgggagacagattcttttaacaggctgtccttcaggtgtccttgaacaatcacatttttgtatgctgcatgcatgtgtgtccaggacccatgagctgttcaggggaaagtgctagccacggtatccatgtcaatgttagctatatttcatatttgaggtctcataattttcaaataaaagtgtaccccattattcagatatttatttttgggcaagtgacaaggtgaaaatgacatttcttagatgcactgctactttggcattataattttgttctcggaaacgttttatgtgccactagacattagtttaaaaagaaagtgaccatgttttaaattgtggtgacccattggagctggagttttaattaagaaccagaaagaaactcctggatactatcctttaactattagttaataccatgcttcatgggtgtttgctcctagtcaccaccattgtatcaagatattaatggtaaactgaggtttttaatacattatcacatttaagtaacaataatttcatgcttcttcaaaagaaaaatgaagcttactcagtcttgggatctaactgtgcagtagacatcagagacttttcattcaatcttgtatcccagacagctacaaatttttgtagatgttaataataaacattggaattttgtcttaaagaaacaaaaactttggaacccaattttccctctacatctataaaggctgttgcatacacaaagctgtttaaaaattgtcatatgttgtttgctgaagtcattgtaatttttttgcctgctttgcctctttttgtacagaagttttgagtgtgaaatgaaaattaaagtttggtacatatatttaaaaatacacttcttttatatgatgttcaaggttgagtgggtaataagcatacagtcatgaatacttgctgtgctaagtgttagtcgctcagtgtggccgactcttcgcaacccatggactatagaccaccaggctcctctgtccatggaattctccaggcaagaatactggagtgggtagcattcccttctccaggggcaaacccaggtgtcctgcattgcaggtagattctttaccatatgagacaccagggaag

SEQ ID NO: 25088 - DNA, 1466 bp, Bovine  19866881208387
tgggctgacacgagaaagaaagagactatgaaattgcagaaatgaatattagttttctatcacatctaaaacctttccaagttggctaattaaattactaccttccaactgagaatgcaaacacaatttcaggttctaatctctcagtaatcaagcgttctattattaatgtccttttcctttttctgggcttaattgctcattgtactacatgtggcattgattagcagtaggaagactgtattctctttggttggcttgtgaggaaactggctataaaaagacattgaattggaaagcaaagcaggctctatccagctgtgatgtggtgagtcgggggtctgtgtctgaggaagcaaagccagccagcttgtttagtttgaaataacagcataaagttccgtatctgccttgatcaaactattcttgaccaaacatgaccgtaaatcgacagagaactttaacgacaatgatctggcagagctttacagtttataacatgctgttttacaggtatcattttagttaattgggaccataaatctgtgagttaaatattcttatccagactttgcagatgagaagtctgatgcttagcaacgttaagtcactttggtcaaatcaaatagtgtggtgaagatagaatttaaacacggacattgcaagttcaaatcttgtggtcttataggacactgtctctcaataatagtgagtcaactcaatgtactttaacgaacattgggcaaatactaaatccataaaacaatcgatgcacactgagaggaaaaaaaaattggtagaggcacacagctctaacaagacatgtgtttgatgagttgtattacagatacaagtaatctgtgcagctaatgtaatacaagaatcaagggggggaaatgtactcaggaaggaaatatctttaaagaggaagagatatttcagttgatctttgaaagataagacatattttgacaaccagaaaaggggaagagaatagagaaaacattgagtggagagatatggtaagaaagatcttatgttatgaaaaatataattaccacaatttataaaattgtaaattacctgagagactgattgaaatgcaaattgagctcatgtgaaggaaattgacttcattgtgtaaacaacacaaaatttggaatatttctccagaaatatcactgacacaaagggtttccaaattgacttttttaccatatgtaatcagagtgccattaaacacaagtgtgccactccaagtgtcccactgcactacaagtgtgtaactagtggtgtgacagtgtgcttggacataacccctctaacaggaatgcgcgtttttacacatcgagcctcagcagcaaatgcacattccctttgccactagtatctggggcctgcagtttcctattctgggtttgtggttcagttgctaagttgtgtctgcctctttgtgacctcatgga

SEQ ID NO: 25089 - DNA, 1272 bp, Bovine  19866881288303
acatatatcctctgaaaggaatacaccacatctctgagcagatccttgaggaaggctctcctgggggcagctggaccacctgtaggtgcactggaaactctagtctgaagttggcttactcttgactctcaaattatgccacctatttagctaagagtcagccctggtggctcagcggtaaagaacccgcttgccaatgcaggagatggaggttcgatccctaggtcaggaatatcactggagaaggaaatggcaaagcactccagtattcttgcttgggaaatcccagggatagaggagcccaatgggttattgtccatagggtcgcaaagagtcagacatagcttaacaattaaacaacaacttccttgttgatgctacagccaagacttccatgcagttttcttttggcttcagaattcactgaagaccatgtctgactctccaggatgcattcaacaaatgcctgctctgtctggtaccctatttgattccaaggacatacctcctcctgctgtgtgtgtttagcccctgtgaagccctggctgtccccacaggaggacgcgatgcctcccctttgagctgcagccacagctgtcccagatgtttatgcctttagaacacatgtcgtatttttttctcaatctgggtcagtccctggacttaatgacgttagttacaatatatgatgtagctaaagatatctgaagataaagaagactttttctgtccccaaattcataaacttctaaaggaaaagttatcactctagtgtgatgtctgatgtcttcaactaaaaaaatgtatcttttagttcacatttaaaaaatttgtctaaagaaaattatctattccctgaggctgcagaggaatgaaaataccaccatgtgagtttattagtctccaatatgatttttatcctccttttatttctcaataaggaaagattctccaaatgacgtatttcagaggctgaggagaaggaattatgattagtttcgttatggctatgatcaactgtaagagaaactgctgcgagtttgcaactttcaaagaagtggagagattactttgttaatgtctattcagttcatttctatttggggaacagaaaatttgagtgtggtttcagggaactgagcgcagaaagcttaaattgcaatattaggggcgttgcttcaactatagccctcctttgaagttgcttatagtacatgtgggaatgtgactaagaactgtagccttgttctcaatttgcccacttatcctaaa

SEQ ID NO: 25090 - DNA, 1255 bp, Bovine  19866881377891
caaacatctggatggaatatgcaaaagccagaccgcatatctgggtgttcttcacatgccgacagaacacagatcatctggagactattgcagtttcactctttacccttgggttaaggttcagttactttaaattcaacaaacacttgtttactcaagctttttgcctttttttttttttttaatcttttcaatagagagatgaatgagtcccaccatgaaggaactggcaggctagctaaggtcacaggtaattctacccaaagctcaaagtgctctgtgaagatgcttgatctggatccagtggctgcttcatggagggacccccaacagacaaatcagaggccatcaccactgataaactggatgttccaactggaatgttggaagttgcagtctgtcaatgcaatgaaactcagcccaaagctcagttgtttcctctgtagagtgaggggaacactttgagttgtccaaggctgggatggacaataaagaaaaggatttgagatcatggcatagggggagtaccatccttatcagcaaataggggatgtgtatgtaatttaaaaattctctgtctttaaaagtacaatttagcccatgggctaatcagatataggagctttacctcttttgaaagtagatccttcccctgctctccctacaggggaaacatttactcatcacttaagatgcagcataactgcccccaccttcctgggagaagtcttctcgactgtgagtacactggccgcttttgtctgtctgcagccagctctcaccagactaagctctgccactctgtctacttcaccgtgttccttgcttatgaaggggtcctgacccagaccagacagaagggaatgcatgtcccctccctggacacttcgggatggagcatctttcacactccagtatggtgctttctccagaccctcgccagggagctggacctgaagggaagatggggaagggccagaaggaccccagagagctgggacgaaggatgtgggaacaggcacaaggtgccaagcccttgggctttctctcagcaggggccacagggcacagaggatatttggggacatgcatcagtctgccatgggtagaaccaggacactttgagtactccatccttccttcgttttccaggtcttccatgatacctgcaccattttgttttaactttttattttacatcagagtgtagttgatgaacaatgtgctgtttatcagttaagtctctcacttgtgt

SEQ ID NO: 25091 - DNA, 685 bp, Bovine  19866881391421
ggcaagacatacaagtttcaggtttgtgatctctaaagcaggattaataataaacataagtgagtagtgaggctcgaatgagataagagggtgacttacaaactctgttctatggagactcgggtggagagaggtcaaacgaaaggagccacagcccccttccactgcttggctccagagaaaatcaacttttaacttttcagatctcagcttcaggacttcagctctgcaattcagtcattagtcgaccacatcagtggttgtttccaatatgaacgtgtcctcaccgttatccagtgctgtcgagttcacagagcacgtccacatatgttatctcttgtataatccttaccatgacacaagataattctctctcacttggatgctgaaagactgaggggctaaagcattaagtgacttgtcctagttcccaagacgaggcagcagtaactcccgaccagagagaggcgtgttctttctgcagctctgggcagccttcacattcctgttttctccaatacacaagatactatctttaatttgaaaactgtttgcctttttggataacctatgtccttacaacaaacaaggcacattctcatttttcttcaaagaatgaacttctggtttatcttaagaaagaagttaaaagcattgattcaaaatctgataggacttagagcag

SEQ ID NO: 25092 - DNA, 645 bp, Bovine  19866881459225
ttgcagttttctattactggagatgatcagaaaagaccgtgaggcaggatattacagacagaaagtacacgtcagtcggtaagctgaacaagccatcttcaaaaagcccttcccactctaagatcttctccctcattagcataatctttccttaatctgaattttctattattcaaagcagatcagaacatcgtcaatgccattttaatcactatgtgcccttgccaataaggtagggctagcagagtctgatgacaaatttgcgcagccaaagaaatggatttgaagttatgtacactggtatagagagacccatcacccatagggagagaagtgtgtgtgtgtgtgtgtgtgtgtgcgtgcgcgcgtgcatgtgtgcatgcatactaagtcgcttcaatcatgtccaattctttgcaactctgtggactatagactgccagtctcctttgtccatgggagtctccaggcaagaaagaatactgcagtggattgccatgccctcctccaggagatcttcccaacccagagattgaacccacatcttttacgtttcctgccttggcaggcaggttctttaacactttatgtatgtgggttctttgttttctaggtcttatttttgctgttgttgttaaatgatag

SEQ ID NO: 25093 - DNA, 2559 bp, Bovine  19866880344939
ggggaagtctagtctgtctcattttgtgctttaatattgataaattcaggtattttaattttgatagaagagaagaaaataaaatgttggaaggttgtagaaataacttttccccaaatttaaaattttgcatgtgtgtgcacatgctcggatttgtgtgtgatatgatatatgcatgtttaagttccctctttattgcccttatcttttaaagcaaaacttaaaaaaaaagtcctcaagaaacaaaaaaaaacaaaatacaaataccaaaatgcatttccttatggtaggataaacattcagctgtgtcatttgcaagaactcaataacataaacaaaaataaaccaagcaattttcctagctagtttttgtgtttagtatatggaatatttctggattgtcatcaagccagcatttatgaccactttagagaaataaaaattttagtaacagaaaattataacatcgtccggctcttgataggggcaagggaggagaggagactacaaatgatcttaaaaaatagagatacagtttctgaggctcacaaggatggaatagtgagaagggactgctgcccttatgggggtctgaacccaacatcaatataggattccttggtgtctggtccagcttcaaaggggactgaccctctgtggctaatgaagtggctcgctgatttcatcttagaacatatcctgcccaaatgcaaaatgggaattctcttattgttcatgtccctggggctaaggactaaatcaaatcagcccaagtgtttatcatcttagaaataaagtccataaaatttatatcaggtctcataagacatataattgcaaaatatccttatagttaaaaagaaaagaataggaaaaaacactgaaacctattcagtttaactctgggaaaacgttaggacatgactaaaagcatacttttcctgataccctgaataggagggcagttccttttcctttcacttttggggttcctctgcccacttcccttctatatatgtttctttttttttttttttttagattgaagtataattggagaaggaaatggcaacccactccagtgttcttgcctggagaatcccagggacgggggtgcctggtgggctgccgtctatggggtcacacagagttggacacgactgaagtgacttagcagcataattgatttacaatattgtgttagttccaggtgtatagcatagtgatttgtggggttacaggttatcacaagatattgggtataactctctgtgctatatggtaagctcttgttgcttctctattttatgtttagatgtttggatctcttaatcccaccctcctaatttatccctcctcccatcctcttctgaatatcccaccccgagtcagcatttccctcatgccagctctgattctacccattatcactcactctgattctctccagatcatctaaacagcttaaggacctcttactcccacaacttctcagaagtctgggcggcatagtctctttagcatgaaaccttcctgtttgtctcctgtttccttcagggcattcagattcatcattcgctcccttccaggtggcagttttcaaagtgtggtctgagagttgttcttttctaatgctcatgtttccaacatgataaggtctgtaattttgattctggcaggaattaataatctccttgttatattcctaattagtttttcatcaaaatcactgttagggtctattcgttcctttattctgttgaggctttccttcccctcaggtgacaagccagagttggtggcagaggtattccaaggaggttttagctctattaaaggctccatggacgtgtcttttcctccatccaattaagaatttcccctaaaactatcccagcaggaactaggtgttttgtcagagctctctgaataactcaacttttcaagaccactataatgtccttctcacttggattcacttcctgggttctagattttggaaaacatccacttatcacgcagatggattccaaaactgtcttaggaagtttctttatctacttgcaaaagtaataactactgtgtaacctcaacatggttaaaatagtgatagaaaaagcgttttggcttcaaccaagagaattttgactcaagattggcttgtttcttctctctgggtgggtagtaaaattagttgcttttggtccagtcaaatttgtagtgacatatccttgttgaaatagggttgactcgtgttatttctggtcttgtcaattccacattcttcttcaagaaccattccttctatccagactctcattgtttttattaactcctgcaaagcttgggagtaggaacttgtaaaggaatcccaaggaaaggcctcagttggatggagaagcttacttttgtggcccttactgttttttcttctactctgtctgggccattgtgaatatggaggttacctacactggtcaagcctagtcagggtgagaatctgaaggacttgatattcttaatgcttggaactagagctcgggaatttctgatagtctg

SEQ ID NO: 25094 - DNA, 1911 bp, Bovine  19866880381474
aggaactgggtgttcccattgatggaaaggtattgggtcatcagcattgttaattttattctctggttttactagttttacttcattatatggcagagttttggttacccaaaagaatcttctctttcaataatccaataaaaggtttcctcagcttttacagttcttaaattgaggttaaaattgagattaaagtctttctttttttaaatttctttgtaatcaagacacttatgagtataacaggtgcagtgtaccctaattgaccttaaaaggttagaaatgaattcgtgcctttaagtatatttatagtttaattagacagatttactgatataaagctatacataaataactatgaacaagtgtggagtaaactctagactatttaattttggttgtctgtggctagtcttgttttcgaatatgtagacagaacctgttcaactatagggagcatgggcttaacctatcctgccttgtggtatctcaaatccctttaattttaagcagactgcctttgaaaccagtacacttcccatcccctctattccagggtagacccttgcttcagcctttgaaatggattgaattttagggaagagctcagtagatttccagacgtggaaacaggacatattcccagctcatcttaaattagattttaatagtatggcctcattgcttcatcattttgcttgaaggaaattccctgggtatcagacacacccctattcaaataaaatcacaaaaccatctttcaaagctaaacaattaaaaaattttcctcattctgacattatatagctgtttccctctgttagtaagaataaactctgtcctttaaactgaatactgaaagaatagagaataaaaccacttcacagatagtatgaagaggaaatgaggtgatgaaagtactttggaaattagagaagtcattgatgcaaaatatttttacctcagatttcagtttgaagcacagataattttacatgttgaatcagtgagaacagaaaatagaaaacaaaagatgcagtaatgttctaataggttcagcatgaatgaagttttcttaagtaaaaggaatatgttgtaattttaattttattttgttgatttgagtaaaacagaaaaaaattagtccttcactattgtgattaagagctgctaataggcctgctgacgatccaatgcaatcgataaatataaaattcaataaaaaggaagaattattatatgatatttatatctttttttcagtgtgaaattttgtataatctccatggaggtcaatgtatatagagtatgaaattgtgtttctttgtgtgtacaaggatatttattttagcattttaaaaaatgttttttaaaatttatttttaattgaaggataattgctctacaatgttgtattggtttgccatatagcaacactgtaccattttttaaaaatggtaaaacttaactacaacttaaatgtccagcagtccttagagttgaaaagatgttcatgatgtaatatcaactgaattaagcagttttctaaatgtctatttaatataccaagaagtacatatgtttatatgcataaaaatggctagaagggaacatgtcaaactgttactagttctatctcagtggagtgagattgaaaacccactattttataatattattatgtattatatttttaatgaaacaaaaaattaagatctttcttttaaaagtcacatctattaaaaacttggagaacttaatattaagaaaacctcatacagagttaggcatgtgcgtaaataatagttgctaattctagtcatagtactgacaggagtatatcttcgtttggttcagttacccctttccaattccctgagttcttattcatctttgtatctaatttatata

SEQ ID NO: 25095 - DNA, 2735 bp, Bovine  19866880425406
catagccaaaaaaaagaatacacagtgaggagggaagaagcacattggcttgaaatgagtaatgccagggagagtaggagagaatgcccgaagtacaagggccgaagaagcactaagatgtataggagactagatcctgggagaagatcggaagcccaccacggacgccctctcctcactgtattttcttttatcaactttattgaggggtgaggttgctcagtcgtgtccgactctttgcgaccccatggactgtagcctaccaggctctgaggagcctctcagtccatggaattttccaggcaagagttctggagtgggttgccatttccttctccaggggatcttcccaacccagcgattgaaactgggtctcccacactgcaggcagattctttaccgtctgagccaccagggaagccttattgaggggtaattttacataaataaactttcatcaattttcagtgtacaattcagtgagttctgacaaatgcatgaagtcacatgggagaagatcctgggaaggtgggagaagggagactcttaggatggccctgcagactgggtcaggctggcacaggaggggaagaaggacagaaccccggggaatgccagcttctaaagggcaagggggggaggtggttccagccactgtggttttggtcagccctttacagtaagctgtggggaagtgtggaggtactcgagtgtggtggtacttttggacttgagccccacacgtgggtcactttcatcagaacaggaaaacgaaacagcctcccctgaatgatttatgggagggcttgtatttttggggatgtgatactgcaatttgtgccatgggatcaggacatctgtttccaggggaggtgtgttctcttaccccgaatctttcccaccggggacctcttatcccctcagatagttacacgcttttgtctgggttgcttgttagcataccggggactctggtaaaagtggcctcaatggtgcgtgagcatgagtggtgtgggggccaactgggagatgagcaggaactgcctgggtcccaccctgtccctcagatggtgtccagcagtgcagtaagctgtaggattagggagtgtgccatctgtcagatggcataggcagcctcccatttaacaattgagttttagccatttatttgattaaattccagttgtgctgtctccctgcggattcatgtcccttgctggggaactctactgccagcagatcttggcctacaaccctttctctccaagaggcacattccccagggcaggtctgaagtaagatggcatggaatcatctaatattctgactagagggacttgggcaagctttgtgttcagctctgcatgtcactggtggtcacagggagccagttgggaagggacttgctcagtgtcacacagcctgtcacgtgttgagcaggacctggtgcctcccgcttggaggttctttctaggtcatgcggactcattcctcttggtttataaggagcgtgggctggccgggcatgcatgcgtgtaaacagaaacatgctgtatgcttatggtggacaggtactccctcttttagctcttctcagaagggggatgggggaagttttgccggtgtccacctttccctgtcagcctagttcagcaaaagagctttccaggataaattcaacttggaagggaggctcagtacacatcttttcttttatttcttttttttttcttttttaggtctaccccttctgcttttaaaaggaaatatgaattctcaattctttttaaaacttattttgtattggagtatagccaattaacaatgttgtgatattttcaggtgggcagcaaagggactcagccatacatatacacgtatccattctcccccagattctcctcccatccaggctgctacataacatttagcagagttccctgtgctatatagtaggaacttgttggttatccattttaaatatagcagtgtgtacatgttgatcccaaactccttaactctctctctcttcccctcattcttcccccatggcaaccataagttctttctctgtgagtttgtttccctttcataaaagttcatacagatcattaattcttagtgaagaagatcttgtctccttttatctcagggattttgttttgtccaaagagtgtttgtgattctggaagccctaccggacccaggttttccccactaatcctttcttacctgaggctttgtccacacggtgctcatggtctcatagcatgtctgggtgaatcctcccagcgcccatcctgaaaacctcctataacccatgaactccaggagcatattatgcatgaatgtaagtgtgcaagggcctccccctaccctgtgtgtgggatcgaatattcattgtataagtcaaattaaaatctattaactttccttccagatgccccctgatagcaagtttaattactctggacataattaaatgaatttaggagattagaaatataagggggtagtgaagagcataaatttgtggagaaaaaaggaaaatttaattctggagtcttttgtcacttggtgggtagaatgctggggacccagaaggatggaggaagtgctggggtagaggcagagggaggattttgggatgttgaaccagtttggatgtattaggatgtatcagtctcatgtcacaaatgtagaaatgcatttttcctcctaatcagggcagtctt

SEQ ID NO: 25096 - DNA, 2526 bp, Bovine  19866880488289
aaatgtagaattaagaaactctttctcaggcaacttgaattcaaacctgtattttaaaaaccacctaaaacgctgactccaaatttctttctggcgctcacattctagttttatctttagaagatctttaaatatctctccattatccagcattcccactcgcatgctggcagcaagatgcctgctggcatctcatcagcaggtatcttctgaaatgcaggacaattagccatctttacatggggtggacatgttgagactttccactgagcaaaactcaaagctaacaagagccttccacatcaagcaaggaggtgaaggcactgatgacctagactcatcgtcaaggtcatccatgacttgttcccccggcacgatctcaggcacttagaccagcactgctaacccagtgagtccctggtaccgaggtatgagatagatgggctccagcctgagcagctggagcttgtcaggactgagctgggctccgtcttctgctgacatatcaaggtaaatgcattggcaggagcagggctctgcttgagtcataaaaagataagacaatcacgtttctcattcctaaggtctaggagatagccccaactacataggcacagaaagcctcctcagggggataaaaagggaggggacactagcctataacacagtctctcgactgcccagagacccttgtgttagaatccatctcagcaaaaagatgaaagtgcacaactggaggggccctgagtcaggtcagaaaagggaatgaagtaagatgattatccagagaaaacaaccacctgccccagtgtaagtgacccaaactgccccttgagcgctcctcactagtgaggacatccacgttcccctcttttgagtgtgttttgcttctgtcctgaataagctgtgctgagacttccctggtggtccagtggctaagactcagcatgccccgtgcagggggcccaggttccatccctggttggggaactgggtcccacatgccacagctaagagcaaagatcctgtgtgccacagctaagatccagtgcagtcaagtaaatataaacaaaagccaacaaaactgctcttcgtgtgctctcccatacgtactgtgcctctaataaacatgtaagtgcctgcttactctctcggtctctttgcaaaattcttttttttttttttcagagaaagcaagagccagggctctgcttctagcccctagccactgggggtctatccgttaggattcctggttttcactcaggtggcccacatttggttcctgggcagggaactgggtttgcttcaagtcacttttgacacccccaggtcagcacaaggtctctacatcaaagaaatgccaatcccaaggacatttctggggaataggtttcttccggtaaaaagatggactgtttggcccaagatgatagggaatcaatattaggaatttatagaaatcactgggcaggaagtgaactttttccgaccatgcaatccagggtagggaccaagctgtactggttcttccaagagcagagaagctgcccatgtcatctggattaagtgtgaaatagagcattttagaaaatgttttcaaaagaagataacttcgaaaccaaatttgttatttctgagtgctttgcgaataaccatggactttgtaataaagagggaaataaaatgcaatgaacacagactctcacatacacacaaaaattgatggaaaatatacttcaaaataagagaaaatattatgataattataattcaaattagtatcagattgattttattttttgtgttatatttttcctctctgtttctacaagttgagtctgtgaaaataaggactgccttcctttgatatctgtaccaaattggcatacgggatagtacaaaggttaacaagtagctctgctgtgaagaaaatacatttacgttattgtcgaaatccatgcatcatcttccagctgccttcatctcccatgaacccaaacagctcaggaaatcttcctggggtgtcactgactgtggatctccagtaagttgagcctgcccccaaaaggggaccagcaagtcataccctgtgggcttccttggaagctggaaaacaatctgcctgcaatgtaggagaccctggttcaattcctgtgtcaggaagatccactggagaagggatagctatccactgcagtattcttgggcttccttggtggctcagctggtaaagaaatcacctgcaatgcgggagacctgggttcgaaacctgggttgggaagatcccctggagaagggaagagctacccactccagttctaataaaattagtactgatactaataaaattgcagcgtctagtttctcaaaacccttaaaagaaggaccctttttggacttagccaaattctattctggaaaagtgttagggattcctcccaatagtttaggtcttccctgcctgtagtactctagggagtatgttggaggcagagggtaagggaggggtaatatttaacaaat

SEQ ID NO: 25097 - DNA, 5250 bp, Bovine  19866880501729
acaggagatgcccagaatggaggcattagtctcagaggatctgtctcagtggggagaagaaattaggcaagatgggaaagaaacatacctacagggtaaataataaggaaacctttataactgcctgaattacaatagacactgaatgaaattatgattttcatcagatacctactaggtgccaggtactgttctaagggggctggaaagaaagcaacatgaagtttgctttcatttatagtgaatgaatgaatgaattactgaggatattttttgctcagcaaggaaggtctttgtttcttgttagatcaggtatcaagaccatcaagaagagtggaccgaggatgtgcagttagaaatcagagcaggtgctctggttggagtggggtgtgtgcagtggaagaaggccagccattacacagctggaggaggggaaggggtttgcttaactgagtgattcttggcccaagctgcacaatgatcatctgggatgctttaatcaaatacccagaccaaccctcagagatgctgattcagttagtcgggtatctaagtagtgtagcctccccaggtgattctaatgtgcagccagggctaagaaccacttatttgtactggttcttatttcttaactttgttattatttcaaacaaaaataatttgttcttatttcttaacttctctttgtgttgattgctgtatgatttggagtcagtggcatggcatcccactccagtactcttgcctagagaatcccatggacagaggagcctggtcggctgcaatccaaagggttgcacagactcagacatgactgaagggacttagcatgcacacgtgttgtcaacagaacaggctcaatgagtgcctttaagctgtgtgatctagtgcatattatgtaacttctctgggtctccatttactcatctataaactgaggatagcagtatttataaatctctgtaaggattaaagaagaaaatatttgcaaagggccgactatgatgcttggtacatcgtgaatagtcatatgtgatccttaaaatttttcactaagttagggattattgtgcccattttatagttttgggaattgaggattagacacatccagttcacttgttcagagccacattattagcaaatttagcccagacctccttttatgacctaattctacccattgttttaacagtgatgcattaaagcccagccaccccactcttttccctttgacctctgtggctatgaatgagctggccactgctgctgctggtctgttaagaccctggtttcccctcaacacctcggaatttagggtgggagagaagcctatgtcaccatccctcttggctgcatctcttactctgagatagagtagacataagaatgctgtaggctaaataacaaccctctaaagatatcaggtcctaattcttggaacctgccattatcttatatggtaatgtctttgcagatgtggttaaggattttgagattaggaagttcttctgaatactgcagggggtacgggaggggggcggctaagtactatcacaagtgtcctaataaggcagagagaaggctcaagaggaaggggatgtatatgtatatctgtgtgtgtatagttttgactgatttgcattgtatgacataaactgacacaacattgtaaagcaattttgtgaaccaattagaaaccattgtaaaccaattaaaaaataaaattaaagaaggcagaaagagttttgacacacatacagaggagaacaagatgcgactctggaggcagagattggagtattgtggtcacaagccaaggaacgcctgcagctgccaaaatctggaagaatggattctctcctctttctgaagggagttttggccccatgttactaattttttacttatggccttagaactgtgaaagaataagtttctgttgctttaaaccaccctggtatgtggtaatttgttacaatagccataggaaagtaacaccagaggttctctgtggacaccccagttctctctctgtgtggggggtactttcaagtcacagtaaacccagtgggggtctgcttggatctcttttgggtgcctggctgctgactcctactgctgtgccagcaggaagctggtgctcttgtagcgctgcgcagcaagcagagttcacctcatcctcacacccctgtcctttcctaccagccaagcctctggccagcagccgatgtgagttgtttattgactcatctgctggaggagacagacagcctctgtaagtggtggggtagggtgcagagccacaggggctgatggctcccattctctgcctgctttttggcattgagggtccccagttcagtttacccctgtcttcccagcgttgttgctcaagggcagggactttctggaacaattttactcagtgcaccaggaacaaaggagaaaccaaatgccttgcttaggaaggacccatatggaggaggcaaggctaggcccagtgacaggataattgcttaaatatctgctctaagtataaaggcagactctacctccagctggagttcaagttcccacaggtcatgaaaacaaagaggggaatgggagaattaaagaggaatagaaatggaaatgattaggaaagattgccactacttactgtgggggaggtggggaaatgggaattaacccttttgggattgtgcaagtagggtgtggcctcccagctcttggggaagctggaggcctgagcctggggctgaaacgctgtgctcctggacagctctcctaggacccagagaagaggctggtggggcttgttcaggcgctgggctgtgggcagtgcgacttggtagttggctttgagtggcaggactgagtctgtgggcagcacactcaggtttcagcttctcacaatccctcccttttcgctgtcctctcctggtggcgatggcccctcatgcttcatgcttctgctggcccagctttctgacacccctttggtggggtgggcatgctctgcactcactcccacagcatcctcagtatgttggcaattgttaaattaattgtagtgatcttatctcctcaattataagaagcagaaattttcaccttttcacagttctgaagtaggtcctgtgtcacaatcagtcagcaaatttaagggatgtattagacatggttccccagagaaatagaaccgataggatatatatcgatatatcctgttacatattgtatcctatctatacagttatatcctatgtctgtctctgtgtatatatagagagatttttttttggctcatgtgattatggaagctggcaagtctaaaattcgtgggatacaacagcaggctagaaactccagcaggatatttgtgttgtagtcttcaggcaccgttttttttaaatttgggaaatctttacccttaatgccttcatctgattgggtcttcctatattatagagataacttgctttacttagagtcaactgatggtaaatattgatcatacctaacaattaccttcacagtgatatctagactagtgtttgaccaaacaactagataccgtagcctagccaagttgacacatggaattaaccactacagtgggggtagtcatttgtttgttttttttggtttattcattccctcctccaaaatatctactataaaagtgtgtacagtcttcgtgaatgtcttaagaattgggctatagaggcatttgttttcagtctgcccttcagtacgctgtaggcctgagaaagccagaggtctacctattttggtcacacaacatcctcaatattggttaattccctcgactggccgtgtggctgaacagtaaaagatttagatttgggtgctgctttgacttgtaatctcctccctttaggagtgtctcaggacctttctccacttcctttccccttttgtgcgggcttcatacacctctttcttctcttcacccccccctgtctttctggctccttgtttcccatcccttttatttggctaatgctctgtgcctaatcatgttagccagcattggcattatagagatgtttgcaatccaacccaggtctgattatgagcttcagcagccccaggctactttaagaatgtgttgattggtgggggttgggaagcccccagagggggccagcatttttggctgatggagccgcccacatgtgtgtctgggcaccgcaagagagcctgggctggttgggttttggttctctccttgatcaggctcctggtggggtatttatcctggctgggtgtctaagcccttcctgattgtattaagcctcatgaaagtgaggccccaaacaatccagctagtgtggctagtgctgtaaccacagcaaagtgtgccctgtatttcttgtcattctctgtttgagctcatttcaactttctcccagcactgggagtataaagaaactgccacgtgtttctctggtttgcaagcattacctcatttcccttgtctcggatattaattcagaaatatttattaagtgatttcaggatttggggcaattctgaaagcattcagttcagattccaagaaggatgccatgagtttaaaggaaattagctacctctctctttctattttctcaaaagcaccctatatttttccttagtgcattttgctttcttgtcattgttcctttaattatttacaatcattccctgaatgtctgtcttctctatcagtcttttacaatttccatctggacaggttcatgagtggtgtcttcatcactgtattcccagggggaggcacagtaagttcttggccagctattgcctacattttgattgacagagatattgcatcctacctggaaggtataattatatctttgaaagtttgtacatagcacagaggaatatgtagttgtacatagttaaggatccatggttgtattcttggaatcaacttaagagcccatgctgtatcactcaaagagccttaaagtgtttcttccttgcatttcttaaaatatctgagacaagactacctgagtcaccattcctagaggggctggtgtgaaatgaaattactttgggttgtacagttgtgaagacacatattcccacgtgtgtgtatattgtagtggactgtactttgctaaaattgggggctctgtgaatcccacttcctggactcatatcctgctcctaccagtttctagatgttccacataacatctagaaggccat

SEQ ID NO: 25098 - DNA, 1334 bp, Bovine  19866880504118
atgattaattgcttatacagaaattgatctaaccactattttatggaaaatgcaggatttccatatctttaaaggaacttctccaagaaatttgaattagagaacaaagtaattgaattcttccatctttcctagcattttcatctactgattaatatagagtcctgagtgttgaaaagaattctggaaatcaataataatattaacccttatgaaaaggtttgctgtgagaaagaattgtaaccgagagtcttcaatggaaaatagccaaaggtaagagttcatggatgccagtgctattggcagagggcagcatgggggacaaacttccatgctactgtgatctttaatgtttccccaggatccaagctctctcctggtccaagggatagtaatctagtaatctggtcctataacatgttgagatcaggagagagaggcaataagcagcattggtgaccacagccaggcaacaatatcgggtccaaacagcgccctccttcatcaccctcccagccaggcagactaccccccagctctgtcctattaaaatcacccctgtctctcaggctgtagttggccatgagggattaacccctcccaccccccaccccggcattgcccctccttccaacagtcctttgggcagacatgactgacaagagtaccacaggcgatgatgtcacaaagagagggggcagtgtgccctgttagaccatctttcactccagtggactcgccttcacagacaaattgatttgcaaaggttcaggctgccagcctggcctgctttgcatacagaacgctccctggtgacacaataaaaagtggccaggctaacagaggagcacagcggggtctggccggttcaaagtccaaactccacaccccccccctcacctcagtctggtttgaaaggtcactgtgtgtctgggaaaatagttgcaggatacaatcctttattaaaggtcactatttttcaacagcacttaacacacacttacacacaaattgagactggagagggggggaaaaaaaaaaaacgggggctgcatcgtattgtatattgtgcttgcaagatttatgtcttgtggtcaccagcaataaatacacactgcttcagtattaaagttcgcattaatccaccgattcgccctcccctggaaatcagcctcttctttgccaggcagacaggggcaaccaagacttttgtttgtctcttttgttcctttcccatctcttccttcccctgttgcaagatttttattttatttttttttcaattattgtggatgttcctattatcactgatgtgcacccacagaactttgctc

SEQ ID NO: 25099 - DNA, 1660 bp, Bovine  19866880514001
ccgtaagttgttatgggaacaatgtgcctgtgactcaggtcatatctgttagagacacatggttgcttcccagcacagtggagaactgcgtttctaacgcagtctacctttgataatagacggtcctatacagttcacagtcttcccaggtggctcagtggtaaagaatctgcctgcaatgcaggagacgtgggttcaatccctgggtcgggaagatcccctagagaagcaaatggcaacccactccagtgttcttgcctggggaatcccatagacagaggagcctggcgggctatagtccatgaggtcacagagagttgaacatgacttagcgactaaacaacaacaataatatatggtttagtgttttgggtttgagtgttatctccctaaaagtattgtaggaccatggtgttaggactgaaaggcatattaaagtcatctggttcaatgtctttattcagtgtatgaggaaagtgttgtcctgagaggtagataactcactcaaggtcacacagtgagttatgggctagcagtggaatctgacctctcagcccttagtctagtgctcgttcccctttctgatgccacctgtgtctttgtggcatgctggctgtgtatcctattcataaaaggaccaagaatgcatatgccaaacctcacctggatgccatgtacataaaagcaagaatgaattaaaaatagtcaggaagtctccttgggagttttaccacattgcccattcttttcttaatatggctgagatttctactcagccttttttatatttgagaatacttagaagcaactcaacagtccaaaaacgagattggtaaatgatggtacatgcccataatgcattgtcttgcagttatttaaaatgatgctgtagaataatagctatcaacacagagaagtacagtagaatgttatgtgtaaagcagcagaattcttaagtatataggagtataaccttagttcagaaaaaaataaatccagtatacacaaaaaaagggatatcaaaatgttaacagctgttataatatctggatattggattatgggagtgatctttattcttttctgtatttccattttttcaatgaagatttattacttttatatcagggagaaacaaaaggtgttatttttttaagaagaagtcggcactagaaagatttatacacagtcctccaaaaaagtcagttgggaatgcatgctctcctacaatacaaattcagatctcaatgtggctcctgacagcagttctgataaaaggataggaaaggtgaatttggaatttgagttttctttcctttattggttctgggccagatcatttgatctccctgttttcagtcttctggtgtctcttatgggtgtaatccttctaccttctctggggaaggagagggcaatatatgtaggaaggagccatacacactcagaagtccttgggaagtcttaaatccttggccataaagaggtcaaagtgaatgggtggtaatgaccgaagggagctgcggaaactcagctcaggcttccggaatgtgaaataaagataggactggaccctgctgctcaggattctcctgctgtgttggaagtgaggcgtggaaatcccctcagctggtgtttggcaaatttgcatggaatactc

SEQ ID NO: 25100 - DNA, 1183 bp, Bovine  19866880528877
attgaacctgggtctccccacgttgcgggcagacactttatcatctgagccactagggaagcccagctatctttgagtgcagttaatctttcactcccaactatactgatgccacacctctctcttcccagaccttcttctctgtccttgttcaccctgaacttagttctcccttcctgtcccaagtttcctggctacctctctgcatcaccaggtgacggagagttacgatcctgcctctgaaggtgcctcctccctcttggcttctctcctagtgacaagttcatggaggctgagaaacacagtgagtggcctttctcgcctcacttactgcctgggagagggctgttcataactttccgctgacatctggagaacgtaggttttggaggagcagagcccagactcccgcaagccagcggagccaagtctttttttgagtttccagcacaacccatgttataataggagttggtcattgtgtttaacagtgaagcaaagcccaagtgcatgtcacaagcacatctcttctttgtgccggggtgagcagaggtgaccctccctgagtgtgtaggatgatacgaagagcattacagacatgggaaagcatttcagagcacccaaatgtggcatgagtaatcacaggcatagagcccacaagactgccttttcagcccctgcctcccctttttgtactccagttcagtcagttaagacagaaattaagtggtaagaagaggggccgcccgctcttcagactccaaggtgtttgtagcccaggacccctgcgtgggcatgggcccagcagagcctagagaacatcccctgctgggatctttctcagactgacttgctaacttcccgttcagcccagcccagaggtggctcggtaatccccacggggtaacctcacagtgggctaagtggcctgggaacttatgtgtccagactcaagtcaggagcataaatggggcagctgggaagttgggtgatcagggagtcagttggaaagccctgtgtccatgccagacccctctgtgcactgccacagtctccctgcctgaaagcactcggcgacatttcacggcagaagaatgtagcctacccgctacatctatgcactgaaggctggcttctggattgccttcccttgggctgcatctctgaggccctttctgcaggt

SEQ ID NO: 25101 - DNA, 679 bp, Bovine  19866880567258
tttcctatgatttttttaaaaagaaaatcataaaatgttgccagttatttattggaaataaccacagatagcggccctgatagggtgccggttttagagagcacacaattgtgtaatgaattgtaattcagaagactgttaaatgtgaaccacagaacctttcagaggtaataaagtcattactttttacactacagccaaccctgaaaagctttatacacaccattatatataaatcatacatatatatttccgcaacacacattcgctcatttatataccttctctatatatggacttttatggatggatgggaaaaatatttaaatttgaaaagctcggttccggaaagaatcggactcactattgttacctgaagggaattttatttatttattttttatttttcaaaggcctcccagttgtacttttttcttccctctcctcaccttccctccaaccattctcctccacgaccggctccccccaccctctcccctgcaatgatattcttttggtcggtctaaggctagttgaacaagatttaaaaaaaaaaaaaaaaagacagtagtggaaaagagatgctgacctgctctgaagaactcgtgaaaagggggaaatggtataacgcacacgctacagagctttactgcaagtgaatcttcctgcttcttaaaca

SEQ ID NO: 25102 - DNA, 1274 bp, Bovine  19866880605307
attttcaacgtcctgggcaatgagatattgatgtctattccatgtctgtttttctgatttgggaggacgttaaggtttttcagtttttatccctcaatttattcaggcaaaaggaaactgggttttagatactacagattcagcagcaaagaggttcctttccatttgtgtttataagaccatgtctacagctccatgccagtgaggaggagcccctggaagtcctagagggtcaactcagaagacctcagtggactctgttctaaccagagtaggaattgcacgcatataaagacccaaggcctccaggacattggaattttgtctcttgggctctgacttatggacagtgagttggcaaaggcagggggtagcatagccccttggtaaatgcccactagaaaagaaatcggactggtctatgagtgatgtgggggttttaaatgatctccatagactcagtcatttcaaactgaccttcccatctcaagaggtgctgtttcctaaaaacagcaaatacagttggaactgcttatgcttcaattttgagtttaccatccagagttcatctgaaatgttctaaggtttctagaaattcctctgaagaggcacagtacaaaaggaaggtacaaactggtttacaaagaggtggaaatggctcttcgtaccacaactttaatatctaaatatacagaccatgagacagcccagcacaccaggaaggctgcaacgcctttgaagacttggacttctgctgatgggatattactttatatgtggtgacacttcatagtttttacagtattttcatatacattccctttttcaattagtcatgctttcatctctcttctcattgatttttggcttgtttgctctttaatatttttgttgtgttgcttctaactgataagaatggggtagtgtaaacatcacacaggcatgtttgcacaatgctgccttgtaataattaagtgtatttttcaaaggtctctaagcaggtcataaaaatctgctcagagctaagcgtggaatgttcgggtcttatcctaccagcaaattcttttaaacaccataataacctgaattttggtcatttagaaatgtacataagggcttccctgggagctcagtggtaaagaatcccctggccaatgcaggagacacgattcaatccctaatccgggaggataccacacgcctgggagcaactaagcccatgagccacaactactgagcctgtgctctagagcccaggaactgcaactaccgag

SEQ ID NO: 25103 - DNA, 760 bp, Bovine  19866880633449
ggagagtgggatccctgaaaaggtctgggcactggtcagagaatttcaaattacaaggaggaaaaataatttgaatgaagagttcagcacgagatctccaccgatctaaacagtaaagacatcaaaacatgaaaatctacctgccagtcttgctctcattcacttgaggcaactacatgcatgtgcttagatgcagaaaataaaatggccctgcagtcccttgaaaatctttcctcaatcttgatgttactttaaagccaccataaatcacacaacctgccaatcttgccatgttttataaactgtggggagaggtagagtatttctggcccaacgatctcccagtaacaaatgccagttctaatgctgtggtatttcctcaataccactcgacctcttaaacaagcctctacaaatatattaactgtcatattctcaatttcttttttacaatgggaagtgatatcctcttatgactagctcgatggagccaagggcagcagccatctgggaactgaaaaaaacacccgattgtggtgggcaaggctttcctgctcaccacttactgcccctaacattcttatgggttccctgttccctgcaaaatcccccagggtcacaccccactggttcatcagattccagcctgcccctgcaactcatggccatccaaatgagtgccaaaaccaacccccatggggccacactctgcctggccttcaggataagtcaaaaaggctgaacccaggcaagcccaggg

SEQ ID NO: 25104 - DNA, 951 bp, Bovine  19866880698931
atactaaatttctcttttcaagttttctttatatatctcagatgaaactttatcagtatttagaaaaagctttatgattggatttataaatgtcttcatgttaacttcaactcatttaacagggtcaaaccaacaaatttcaacgtaggaatgatcagagtagaatagcgtagaataatcattagaaatggtaaaaagcagaattaatcattaaagatccttaaaaaataataattaaagattctaatcctttgatttggtagccttaaatttcttattcctccatgtttgtggttcagactgaacagaccaataaatagaactttagtgtaaaaaaaattttttaataaataaaattatgtgagtgcataaataactacctattaaaccttccaaagcttggaatttaagtcatgataatagtgatgaatatagtgcaagcaatagaaaaaagccagtctcaaaaatggtaactatttccttaggattttttaaaagaattgtacaaggtcagagccttcccagatttcatatttttttctggagttttagtatttgaagttagctgaacataagattatcatcaggcttgctctaattttttaatgtattgctgcatttttagcaaggacccaagtaattaccttaaaaagtacttaggatatatttgaggtaaatggtgctacatcacttcacagtattaatgtaaaatgaatgcagctgctgctcctttctagttagctgtttgtgtaattcatattaattttcctgctttcttatttggattgtcttaatttcttagttgtacacacaagcctcattatctgtctggaataagtaatataataaacttgctttgataaataggtattggtgattgactgatattatttgggagtaacttaaaagtaccagacgtctttacttatatttcagactgacagccagtta

SEQ ID NO: 25105 - DNA, 1369 bp, Bovine  19866880705867
ttgaaaagaccctgatgctgggaaagattgaaggagggaggagaaggggatgacagaggatgagatggttggatggcatcactgactcaatgatcatgagtttgagtaaactccaggagttggtgatggacagagaagcctggcatgctgcagtccatggggttgcaaaaagtcagacatgactgagtgattgaactgagtatgcaatctgaactgaactgagagtcaaaagcgaaagtgaaattaaaagtgaaaggtgctcagtcgtgtccccttctccaggggatcttcctaatccaggtctcccacgttgcaggcagattctttactggctgagccaccagggaagctgaagaatactggagtgggtagccaaacccttctctttgtgaccccatggacaatacagtcaatggaattctccaggccagaatatttgagtgggtagcctttcccttctccagggaatcttcccaacccagggatcgaaccctggtctcccacattgcaggcagattctttaccagctgagccaccaaggaagcccaatacaggagtgtgtagcctaatccttctccagtggatcttccccacccaggaattgaactagggtctcctacattccagacagattctttaccagctgagctactagagatttgtccagaaaaaaacacaatcacactgtatttgaatactgctgcattagtgcaatgtgaaagcttcactccccttgcccccaactttctgcttcctatagataagtggttttgtgtctggaaaggaaaagatatacatcttacaaggttgaatctatattaatccgtcaacttaagtgacacaggaaaaatattttaaggcacaatgcttagctttgaagaagaaatgatgcgacgacagcaggaaggattcaagggaaccttccctgatgcgagaaagcaagagatacggatgggtcagatggcgatgggaggtgctatgggcataaacaacagaggcgctatgtcccctgttcctgtgccagctggtaccccaggtcctccaggaccagccactatgatgccagatgggaccttgggattgaccccaccaacaactgaatgctttggccaagctgctacaatggaaagaattggggcaattggtggaacccctcctgcattcaaccgtgcagctcctggagctgaatttgctccaaacaaatgtcgccaatactaataaaattgcagtgtctagtttcccaaagcccttaaaagaaggaccctttttggacttaatcgaattctactctggaaaagtgttagggattcctcccaatagtttaggtcttccctgcctgtagtactctagggactatgttggaggcaga

SEQ ID NO: 25106 - DNA, 1431 bp, Bovine  19866880709146
acattcctataaggaaggacattccaggggcctagagatcaccccccagaagctgaggacaaaggccaggactgtctttaggaaaggttaattcttcattatttagctacacataccataccaaagtacccagccaaagatagagctagaaaaaaaaatgagagagagatatgtatgagagagataatctataatttcaattttagagtcaaaataaacttcaaaagagcacatgacctagcctttcagttcaggtaagtaactgcacctattttactgctgaggtctagagaggtttacaccctcattcaagctgtggacagaaacaatctcacatcctctaatttctactaaaaacactcattccccactgatgccatggactcccctccctatcccattggcactacctgatctttcccacagtaacctggcatcagggagtgtccacgtctctcagtagacaacgtgctcaaaatgcccttccttcccacatgccactttgaagcagaaggaacacacagtgatctgctcccatccagactcctagctgatggggcccatgggcttctgtcaagagttctgggggtccccatccacccagagcatctgacagatactttgccccagaaggccaggtatagtcacaggagggtattttcaactaagacccaccccaaccctgccggcagaacgggtgcagggccatgaccacactaaagacaaaaagaatcaagactcttctctgccttgacaagcttcttcaggtctctgggcctccctttcacccttcataagacttagcaagctactccaagtacagtccagtaaccagccccagggcattaccaagggagttgtttaggcagacattccaaccctaggccaggactgcagcattcaattctgcactttaacaagatctctaggtgattcaaatgaatagtaaagtttgagatatactagctgagaccctatctaggtccttcccaagatctaaattctgagattctaaaaaggcatctcacggctcaatttccagacctcagcgttgagatgcctgttggaactgggggaatccaagcttctaatcaggagtggtcagaagcagagtcacagaaggcgtctgtgaaacccaagcccttggacaggcaatgtgggactgaggagcaggcggaggagccccttcattttttccataggcacgctgtgtgtgccagatgaggtctttaatgtaaaccctcttgtgccccgacctaaacaatgagcataattatgggctcgcttacccccttcagatgcagggctcagggtcggccctccacagggtcctgcaggaggtcctgtttctgagtcagggagggcctcggttaaccagaacagacccaactctgaggggcaaagttgacataccagcgtaattacacatag

SEQ ID NO: 25107 - DNA, 1856 bp, Bovine  19866880739937
agtactggagtggggtgccactgccttctccgtggggaaactgaggccttgagaaatgaagtgactggctcatagctagacggatggttaatcacaaagtgaagatcagaatcagtctcctgactgtccatccagtgctcttttctgggatatccatctctctccttccctcttgtggttcccaccatgttctgcactgcccaagaagtaccagtgaggagggatctctttctcttgaaccactgggaggaataaccgctcttggaggagaatgcagcccagaggtgttgagtgggcctttcaaacagtctgaatgaactgacttggtttcaaaattagaaaacaacacctgatctgcttcctgcgcctcctggctcacctccactgttgtcatcctctacctctgcttcccctctgagagtcagcagaagagaaacaaaaccattcctatgagccaaacaagctcctgacactgtctctgtgagtgagactcatacttgcatttctcttcccccacgaaccaaaggcaatgggcagccccagctgattctgcagcctctcccaccaaacatatctctaaacacattctccttggtaagcagaatcaacatccccacaggaactggaaatgctaaactgttaatagcctccctagggcttaactttttgctatgatgctttcaattatttcatcacggtttagacagagtcgagtctcacaattaatgcttctaagcatcaccttcaaccagcagctctgcccaccccccaggctgcccctgactgagggcctcttctcctcccacccacattttcattctccccagggggaggtggactcggctggctggcagggaagtaggcagttgacctatgctccctttatttctttggtagtcctctcagggcagtggttctcaaagtgcagacccaagcccaacatcagcatcacctgggagcttgtttggaaatgcgaagtccccccaccccaccccaaaaaaaggaaatgcaaagtcccaggcccttccttagacttactaaatcaaaaactgggttgatggggaggggcggagtggagtacaaaaacctctgtctagcaagcactcccagggatttgtatgcacaatccagtttcataagcactgtcttagggtaagaggaggcatggaagctggaagctttgatgttctcctggcagagatccactggctatgaggttgtctggaactcacctcctttaggaccagagcaagcttgggaaattcctaaggataccttccatgtgggagtccaaggttccacccttcctcattaaccaggaacagccccagactcaaacagggaacgctctttgcataacttcccaaccagcttttgccaggcagatgatgtcctcactgcttccacaaaagtggaagtgtttgtgaatgcagctgtgccacgctgcatggtgtaatgtagccagtactggactcctgtttccctttctggacttgcaaatatgtggccctcttctgaatcaatcttttcatatgccttgtactcctctggtgaaaagcactttaacctgttctgttgcataaaagtctctccagacccagcatttccatttagggcctcagaaatgccttatgcatttgttgttgttgtttacttactaagtcatatctgactcattgggactccatggaatggagcctgctgggctcctctctccgtgggatttcccaggcaagaatactggagtgggttgatgtttccttccccagggaccttatgcattattaggttacaatggttccttatggctgaataataaataatgaattttatttttctcaagtctcattaaaaat

SEQ ID NO: 25108 - DNA, 703 bp, Bovine  19866880752632
ccctttttttaaagaaaattccaaataaactagaaagcagagaaagaaggggaacaccacagcacctgtgttctttctgaaagcacctctgcaggtttcacaataattccattcttcattttaatgggaatttttaaaccaatggactcacctctatctaaaactgagatcaaattgtaggtgtaattgttcatcactcatgctaacaacagcaaagacacaaacagaaactcattgtgagtgaccacaggtccccaggtatccccttcatcaacaggcctgctccaggtccccactgggaattccctggcgggccaattcaattctgagtaacatgctgccaaccctatctggaaaagtggaaaagggtgtgcacagcgtcttctcgcctcttttacaggaagtttaaacctgatcatctcaactttagtggctataatttgttgtctagagttccaagaacttggtcttttatctatctaaagagatcaaaaagaaaaaaggaaggcagagagtgagcaagctgtggcctggcctagcccctagcgaggctctagctcagagcagtaacctgtgcaggtaagccttccagcggcattgcatcagaccggctcacatcagtctccagggtgaatgggagaggtgaaacacttctggtgccctgtctgcaaactcctcattctccagttcttggcagcttatt

SEQ ID NO: 25109 - DNA, 1772 bp, Bovine  19866880777531
ttgtaacctgtgcggccttagtgagtttccttccctttcttaagctctctgggcctcagtctcctggtccgcaggatgaaggtggtaatgctggcccctccctcatcgttatgagggtgagactagtgaacatgtgtcaggagctcagaatagagcttggcacagtttcctctacgagcagtggcctgaggatgactcgcagtcctacgaatggctgcactgttacttatgataacagatgcctgtcctcaagctgcatccacactagggaggagaccaccttctaatttcttattcaactgcaagactgacaggcaagtgttattttaataattttcccaactcctctctagatttcaggcaggggtattgctgcccccttggggctgtcatttcttgatcgactcctttttccctcccctcttgtctcccactcaacagccaggctccagaagaggaggtggagataaccactgtccgtggggtgggggcggggtacgtagctaagaggaaattatgatggagcctgatgactcacgacttgccgtggatttggcccactggggtgaggtcacggtgcagacagggactcaagccgaggtctgctggtctaagaaataaagctgctcacgtaaacatgagggctgctcccagctgaggtggtggtcatgggccctgtgcaccacgtcctcttcctttccacgctcatcacgtggaatgatgagcctggctggtgtaaatgcaggttggatgggttcatctggttgttggcatagctttcagaggcccagcttctttgttttgtgtccagtttccaaaagatcctttgacttttctggaaggttattcaatgatttattctgagtatcacaggctgagctccccaggaagcaggctctgcaacagaggtttgcctgcacaaagtttcctggggagtgaaccccaggaagcgggggagaggcgaaggagcaggatggatggaaggaaaagttgaactttgatgctgtcccaacagaggcttcagctgatgtcatgaggagctctggagcaaggatggaacccagggcaggctttatacccctgcactgaccactggatacagacttctctgggaaggcgcagagaggccatgggggaggcagctcgctgtagaccagggccagctctaaggatcctaccaacgcttcccgaagctgggttaaagaacccctcaacccggggcgagacctgggcaatgcccctcagtgtccagcacactaagcatgggtggttgacctttctacctcttgtgtgtgtgtgagttgctcagttgtgtccaactctttgtgatcccatagactatgcagtccatggaattctccaggccagaaaaacggaatgggttgacatttctatccccagggattgaacccgggtctcctgcattgcaggcaggttctttaccgtctggaccaccagggaagcctgcttcttgccgctgtccaaatccttctcattttctaagacctacagagtacaacgactgaaggtataggcttccagtggactcaagttcaagtcctgtttctactgttcatttggtgatatttatagtgaatactgtgcggtagtttgagcattctttggcattgcctttctttgggattggaatgaaaactgactggaaaaatgaaaatgtttccagtcctgtggccactgctgagttttccaaatttgctggcatattgagtgcagcactttcacagcatcatctttcaggattcgaaatagct

SEQ ID NO: 25110 - DNA, 1706 bp, Bovine  19866880811535
agtatagtatgtgaacattcttgaaaacaccagggccaagggacaatggaggaacaaatcataatgaagaacacacggattacaaaacattcataggaaatcatggagcaggggagtggtttaaaaaatgaaaattctgaatttcctccctcactctctgagagtaaagtgtttgaagcaggacaaggtggggcctgaggcttctcaactccttttcaggaaggcctgacatatcccagtaccttttaacaaacttttagtgtctgtgaacaaaccatctcatttccttatttccccaaatgaaatgatatctaacccccaccaccacttcctttcaagttctcacttccagcattatgaatatatacaggatgaacttattgcatatacagaaatggtatttaaataaacatttctatcacagaatgccctgggaaaaaactcggctacttcacacttcctgccagtgctggtacaaatgaagaaccaatcttacttcttagcaacctttaaaatacgtccatctcactctttctgtaagtcctaaacagagagaggactgtatgtggtttgcggataaaggtactacatgtaaggcagagtgtctcggttaaaatctgtgagacatagttatttactgtactcctgtttattgttttcaaaatgaagataaaagagaacattttaagcaccaggcattcaagtatgtagagaacattgcattcaacacatcaggggtgtcacataaatgtaacttgagaatcctgaaatgtgttcatccttattatttctttgttttaaaaaactttaccatgaattcatctactgttggaaatgttttttattatttaaattaagctttttaattttagtgttccggatgcaagatgtcatttataagctatcttcttgttgcctaggttttcaggcttctattattcacacagcttcaggaataatattttataggagggtttcaataactcaggagattgagaaccctgaagaacctgtctcccaataaatttatttaactttgggattatgtaaatcaaacataatttgtgatttatcaccaaatgtttgcacccctccccagtccccgtttgatttaaggaatttgagcatacaagcatagagtatccaccattaattctgtctgtcaggatgcaaaacctcattacactaagagcatcatatacggagaaattaaaatgaatactgtatataaaaccttcgcagctgtactcacagctcctaataaagcagtgataggaacacacagcacttttatggacatttaatatggtgaagcagaagtcaccatatctgaagctggcatggcactgaagactatttctctatgtcttgaacagcattctggttgcgttggtgaagtaaacttgtctaaaacacatatatctcccctcacttcactgccaactatcaccttctgcaagtaccccctcatgccaccccagctcctctactatactctcccaaatcatctcttaccagattcttctctgcctctctgctttccacccaatctgacttttaaaagagtacacctactttctctgtattttagaaggataaaactattcttgcctcagacaaaaggcattccgtgaaaaggccacctcacaaggcaccagggcataagaactgagcaacagaaatgctaccacaagacaacagaatgg

SEQ ID NO: 25111 - DNA, 1753 bp, Bovine  19866880834071
ttgaaaaaataccgtatagactcatggcattctttttttgacagataattttgtttatttatttttggttgtgctgggtcttcgtggcggacaggctttctctgtttgtagagagcaggggctactctctagttgcaatgtgtgggcatctcttgttgtggggcacagattatagggtgccctggcttcagtagttgcagctccctgggctctgggtcatgggctcagtagttgtggcacacaggcttagttgctccatggcatgtgagatcttcccaggtgagagatctaacctgtgtctcctgcattgacaggcagattttgagccaccagggaagtcaagactcatggattcttagagtcaatgcattataattggatgctagtctattactagcattattattctgattttcacgttgtcacaaatttgaccaatccaagccccttcagtggagaaggaaatggcatcccactccagtattcttgcctagagaattccatggacagaggaacctggcaggctatagtccatggggttgcaaaaaatcaaacaggactgagcgactaacacacacacacaagtcccttcaaactgtttacgcctgctctaggctgtgagctccatgagaggagggattgtatattcccattactcatcacagtccttgggacacagtaggaactccagaacttgttgaatgactgtgaatgaatgaataattgattcagataatctctgtgatcttggtttccttatgtcaaaatttgtgtgaatagcactcaaataggattattcagatgaaactatcaagtaatgtgtaaatatcttagagtcctttaaaatgtcaaagaaaaagtgagaaccaacctaagaatctttcaaagaagtggaatacttttgaagagaaatatggttttagggttcaagaaaggattacaagttcaaaatttattttttaattattggaggcagaagaaggaagtgttaaagatattttaggtgttaaaaatcacaaggatggtaaatatgaaaagcatgaacagtaaaacaacagagcatagagggggcaaacacggcaagtgaccccctgttgccaagggccatgtgaagtttgagcaaatagtaatgttattataaccaagttttgcttccttattcacacccacccaattttaatgatgtcatggtttttccatgtgggaacaagtatgactcgtggtggtaggggagttccccccaccatcctctgtactactcctatgcaaattagtaatatttgtagctgttgagaaattttccataaatgacattttgaaactgtttaaatattattgttagttttaaatatctgtctaatgaaaaaatacgtagtttgatgctttcttatgataaacggttattataacttcatgtgataaggcataaaacatattccactgctgctagtagtgaagtcatttgtagtcagaaaccagatgtctgtggagtggagaggctgaggtatgagaggactagcaggcattgcagccaactggagaaccctgtgtcaatggggccgcaaacttagctccaggcaggtgtttctgtgccagtctactgttgcttttaaaatattcaagagaaagcaggaatgtttatatgcagtttcctgatttttaaatgttggtagtctgcacacattttaaaaacatgtagtcagcatttttataactcagcaaaactatacatgtaggtgtcagccttgggcag

SEQ ID NO: 25112 - DNA, 633 bp, Bovine  19866880838066
cttttcaaagagaaaactttaaaacctttactgtctctctttagtctaattttttaaatatggattatgcttgaattaaaatgaaaatgtatagattacacagccaggaatgctggtatatattaccttcctcagcttgcactcaccatttagcgggtctagtagggaaaacaaaatggtacgtttgaatagtgcagggagaagcccttggttgtatagtttataggacacacgggatgccatttagccattggagtcatagttcatttcttcttgcaagccctttaccattgagctgaaatgacttgaattctgattgtcagagagcagtatccttcttctcccctcctgttcctgacccctacctacatctctgaaatggaaattctagtgtttacttctaagttttcctttgtgaaagttaaagaatagcaaggagaaaacaatggttgttcccttatttattttgtacataggaaaagacgagaatgaaatcccatgaccaaatggtagcttccttgcaaagctgtttttttagctgacccttgtcctttattcaggtattttgagctttgttttataaatattctgtttgagcaaaagtacatgattatgaaaggactgaataactgt

SEQ ID NO: 25113 - DNA, 3667 bp, Bovine  19866880838159
ggtttggtcccagctgggggagggcagagcagggcagatgagtcccgggtgggggtgggcaggcgggctggtgtgcccctggcctcgcccctggctcccttcctgtcgctgctggtgcgggaagattctgcctccccagcccacccagtgggatctgcgcgctggacagcgcccctgccgactccagggctttgcgggccactggctcttcccaccctggaggcagtccttctcgaccccgagggatgtgcctgccagccgtccctcctccaggactcccttccttggtgctgcccctccccgctcacgggtgtcagacccacagggagaggggctccctcctggcccaccctgggatcccagcctccccgcagcctctccaagtcagggggctggcgtagggacagattggggggagggggcacccacatgaggagtcaggggacgagggggtggctccgctgcccctccacacgccccagcccagctggcagtgggcgggtctgccctgcccctcgagtgcccccgtgtctggaggccacggcagaagcagggatggggctgatgtcgagggcggggcagggcaggggcctctcctctagctgagcagcacggggctctctctgccgtggtggacgctgtgctcctgttgcctttccggcagagggggcctgcggggccgtgtgaaggacagtgacgagagggacgtgccgcagggtgtgagggagctgggcgccaggagagcccgcactgaccagcgtcagcgtgtgggacagtgcggggtggaaggaggtgggctcgggctcacgtccaggctggactctcgagggccccctccccaggtcaaaccacagcgccctcacacacaaaccctccttttatttcacgggggcaggtgcctggataggctgcggggaaaggggcgactgcctcgggctgtgggcaggcctagtggcctccgtagttctgcatgagctccgagactgcctgaacgatcatcagggagccggtggacacgaggacgatgaggacgacagtcagaaggatgcccaggaccagggagcagatgttcaggcatttggcggtggaggcgtagctctgggccccagtgatgtcgccgaccatcttccggtccctagactggaggaggagaggtggtgagggtccaggtgaccgccgggcctgtggctcaggccctcccccgctggtccccactgccccgttcttcccagcggggacccacgcccgcctgtcccctggagtctgagcgcgacagtggccggtgagcgctcctcccctcctggggtctccatctgctttcccgcagacagtcagcctctccaggaggcccagggctctcccatcctttctctggccgcctcactggcccctcacccaccaggggacaaaaggctgaccctggtcatccccatgcaccccctgcagcctcatcatgacctgcacgtgtacacacacacacacacacacacacagacacacacacacaccatgcagcagaacaacacacacgggggctcccaaccccacgtgccgtctgggcagggcctctccaggctcacacacacttccgtggagacgccccgggtgcccacccaccttcacagagtaggcgaatgccacgaagcccaggcagcaccagttcatgaagatggtgttgaacagggaccacacgatgtggtcgggcacggcggtgtcgctgcggatgttgatcaccgtggtcgtcaggggcgcctggctctggggcgcccccagcacggccacctcgtgctcctccttaagcacctcataggctgggggcaccgccccgtgggccccagtgaacaagggctgggatgtgcggttcatggtggggacagaggaactgcggtctagatgccagaacacactccgggtcccctttttttactcaggagtttcgatttctctgaatttccgtttcctggcttttggagtattggggatgggctggtcctaggaggcgtgaggaaccagtgagtgtcaggttacaccgggtgggtgggaaggaaggctagggcctagagggatttcctgtcccagaggctggaaggggccgatttccctctcccctcccccttcttttgtaataaagagctttaatagaagaaatacaaataacagtttaagaacttgtaacctcctgtgtatgggagaggcccaggaattgtgagtaaacagttttctgtaaatgagaaaatgtggagaagtttctcccggagatgctgaatccacccgttaaatgccactgtgagttagagacaaaaggcactggggtggacgagaggactcttttgggagatgaccccgaaatgcataaaaataaagctgattcctgcagaggccaatccttgcctcctccatccctgagagttttctaggaatgtggccccacccccacccccgcccacccccatcctggtacaagagaaaacaccctttcagggcagtttctcttgttgactgaaattaaaaaaaagtacaacttaatagatgagaatcgtctttcattcgccataaacctgagcacctaagtccaagacccagcacgctcgttcactggggagggaggcccggctggaggccccgcgtcttccatagttgcgtttatagctctcaaatcttgtaacaatctccattttcctgattttttcttaataacaaaaatgggagtattccaggggctattagaaggctctatatggccggctgccagttgttccataactaaatcctcagctgcctgtaacttttcagctgttaaaggccattgttccaccaataccagatcatccgatttccaggtaataggggtggcagcgagagcaacagcctctaggataaatttgaatatcccagaccttctctgttcttgttgggaaccacctctaatggcgaaacaattccctgctgatctttaccaagccccttatcaggattgtaaccttttcaactgggctatataaaagcattcccatctgagataatatgtctctcccccataaagaaaaaggtagtgaaggaaccacatatgggcaaaaagtgccttgcgcccccttctcatctgaccgtgtcaaaatctgtgagctgttagcaaccgagggcactgaccctactcctacccggccggtactggtcaagcgggctggccaggatgagggccaatcttttccagcaatgcaagagacgtctgctccagtatctaacagccctgacattttatttccttgaatgaaaagatcttttaaaggcctagaagctgtaatttcctgcagccaaaaagctagatcactagatccaaatcctctggggcccctagcttgagaagttaaggtttttcctgtctgataataaggtaaaagcaaaagctgtgctaatctttgacctttatttgcacagttttggtaggcagcgagatcaaaactttaatttccccagtataatcagaatctactacaccaggcaccaccaaaattccttgaagggaaagcgagctgcgccccagcacaggtcctacaatgccctcaggtaggggccagccactccctttggaatcagagtaaccctggaactgaggtccagtcctgcgctgcctggggtgatggcaggcttgttgtccctgcgggcagga

SEQ ID NO: 25114 - DNA, 1067 bp, Bovine  19866880892361
gatgagacgttttttgcctcttaacttatctattttccaagttttcatggtctgtttgtaatagtgtttttggttctttgcactactttaaattaagtttctcctgtgggtcttattatacctgaatgctgctcagttatttgatgacatagctgtaaatcctcaataaaaagatctttaataatcagttggcatttatttaatataccacccatcttattaaatctaaggagttagtttattgtatctttgcattggaatagtgatggtctagttatgcttgagaaagcactttcattataaactcctgtttttaggcacttataattttctcaagtagcacatttatttcaatgtgcaatcattttctgttctcgtctccctccctctctccatttgtaccatttctttcatttttttaaaagtctaataaggaagtatatcgcaaactttagggagaaaagctgtgtcattggctgagaatagctgagcaaatctgtcaggctcttgaaatccagattcttgtttggtaccttcagtcaatttcatgcaaatgttggtgaaggaggctgctggtcccaggattatgctcctataatgtgggcaatgttctcctaagtgcttcaagtgcatttgttccttttcaggggtttatacattcttcagctttttctagtggcaggaaaccgggaattgagcaggcaagaagcagagcagaatggactaagatggagacagaccttccaactcctcacctgctgctttctgtctccaacccactcgtatataaaccacagtgggctgcgctccactgtctggctctttgctcactctttgcctggtggtggtggtttagtcattcttgcgatcccatggactatagccctccaggcttctctgtccttgggctttccaggcaagaatactggagtgggttgccatttccttctccaggggatcttcccaacccaggaatcgaacccaggtctcctgcattgcaggcacattctttaccgactgagctacaagtaaagccatatcacttcgtctttgagatcccggcacaa

SEQ ID NO: 25115 - DNA, 1007 bp, Bovine  19866880904900
gtgaagagttgactcttggaaaagactctgacactgggaggggttgggggcaggaggagaaggggacgacagaggatgagatggctggatggcatcactgactcgatggacgtgagtctcagtgaactccgggagttggtgttggacagggaggcctgatgtgctgcgattcatggggttgcaaagagttggacacgactgagagattgatctgatctgatcaagtggggaaggagataaagtcacaggaataaaatctaacacaccaagaggtaattaaccaggactgaggatgaacaatgcaccttcagatgtccaccaatgacacagtcaagaaggctttcctaccatctctcgggtgagttaggaaatgggggctgagcaggaagagaaggatggaaggtgggtaaacctctgggaggcaaaagcaaccaaatgctattccagaggccccgaccctaaggcagaggaccatcataaagccgctaaagagtgttgggatgggccctagggacacttccctgcctgtgtcccctccctgccagcacccgccacagaagggatcatgaaatattaattctatctgatctggggccacccaggcaggatcatgttacatgatactttaatgaccacaattcaggcaacacagtctggctgtgaaggaagaattcctgtcccagcccaaaggtgctcatgtaacaggagggaacaggaagtaggactcagaaatctagcatgagacccctgaatgctccagggttccctgagagcctgctgtgcctttgcaggatagacaggcatctactgcctctcagccattcctcatcaccactaacgtgagctgttcttctgtgtatggtgtcactccagaactaataaaatggggaaagtctaattgtattagcaatttcccatcatattctattaatatgtatcatattggtatccattttcactaatgtgacatgaaaggcagtaatgtgattacttttttagtgaaaaca

SEQ ID NO: 25116 - DNA, 735 bp, Bovine  19866880930635
gagcacactgcccatgtcccgtgagctgtctctgaggccttgcccagcctgcagtgtccaggagagccctgctgtttatcactgtgggcattatctccactcaccacctctgtgcccagggctgtggtgtccccttgaagaaccccacacccatctcccagaggcccttcttgcttagagtctgacccaatccagctccccccaccccgacaccttccagggactttgaactcaccccagccttgcttgaagcaatgtccttccccagaggaccagatctgcctctctaggggctgccctggggatccctgccatctcagcagtgcttgaaccttgtgggttcttgtggtggcccttggctgatgtggtttcatttagaaccaagcacagcaccctttggagcatttctctactagagcgttatcttctcactggcaaagagagaaatgggacaaaagaggttgcagagccctctgggggaaatgtgtgctgaagataaggtggtaacacagagaaagggggagtatgagactggtctagaagaccttccaagaaaggacaggttgttaaattgctctgtcagctgtatagtgctcttcagtggcagctattgttattattaccatcatggccattatcatcaccatgagaggatatggtcatgaggtaggtgctaactgtaagtgctgattgaattttcaactgatttcctgattttagaggccacagatgtgt

SEQ ID NO: 25117 - DNA, 993 bp, Bovine  19866880998972
tggtaagtaaagaagaggatagtgtcttgtagttttaaagtaactgcaaaacacatcgaacataactataggagctcagagacgtggccataaggttaacattatcttcataaaacagcctcaactcattatttgatgacttttttatggatatccaagtaactttcaatggaatcagttggaaaaaatgagattggatataaagcgaattttgctaaacagcaacaattttgtaaaggaaaagatactgatatcatcaattactcatgaagtacagaggcaggacaaggacagtataaaattatacaaaggctattatgcaaaagcacaatttcaccacacacagaaaccgccaaccccacaaaattcagtaataaaaatagttaaggccatttagactcataaacagttgactccttttttaaagagagatttattattattattatttattttgactgcagtgggtcttcattgcagcacatgggcagcatgtaggatcttagttccctgaccagggatcaaacctgagtcccatgcactggaaggcagattcttaaccactggagcaccagggaagtccttgactccatttttttaaaggggcttcatcaacctttactaacacacacagtctacacagacaaaccattttaaatgaaaacaccttttcagagaacggcatctttggttacttacctctggctaatttgaaatacagtcaaaatgtggagaacaatttttggaaataaacggagagacccagatatgcttccaccctgactccatgcccagtctgtcttgtgaattagtttgaatgttggcaatcaagcgagtagaaaggagtaaagggaagggaactctgacttctgtgaataagaagtcatgattaaatgccagtagattataaagagctgaatgctacagccctgtggattcaacagaaaccaaaccagagactaagccttttcacgttaaagagagcttcatttt

SEQ ID NO: 25118 - DNA, 1013 bp, Bovine  19866881003709
attgcctaccgatttatatcgctagcgggttcccaataaatgccactgacagactgtcgagctgaggcagctacacccggggtaacaatttgctgagaggtccggcaggcgccatcatgtcacacggagcctcagcagctcacctggggtgtgatccagcttccagggctcctggtcccacatctcccaagactccaccaggataaaccaagtcataaccattcagtgccctagacactggcgtgaggagactgggctggacaatgaggcttaggtttttctgcttctcatagctgctgttacaaatagtcccaactctaacttcccaggctcttaatgagagtcttatatttgcaagagtaggggtaagaggtggaacccccagaagagtctccctggggttcttcattccctggattattctacattctatgaatgtaaaataattaaatgaattgtgaaatgaatgtttaagaaaataaggtttaaaaagtaactatattaaatgatatcttgaaacagccatattatgaaaaacactacctcacaatgtcattataaactagaatttgaacactcaacattattaaatttaagtagtatattttgataataaaggggtttgtttcttaatatctttcactttttaaaaaactttttatttgtatggcatttatttttggaaatgtctttttttctgtattaaagttttaaagcttgcctaaaaaaaaaaaaaaaagaaagaaagaagcttcctattgatgattggcagtggccaatattgtcccctgagagtaaggcatcagcttgtggccccgttacaagggagatacctggtggccagattcccagagtccctgacgttgttctcagactcagggcttgtgcctgcctggagttatgtctcgaccatgcctagagagccagcttgcaccccaaggcccacagcacccccaactgaatagcatttattatttttgcccagatcccattatatacaaatttccccacca

SEQ ID NO: 25119 - DNA, 1258 bp, Bovine  19866881106093
cgctaatccaaaataatacacagcagtcctcttacacttatgctctctccctccggtgaagggtacccagcgcatcatggaagtgacacggaaattacaccttttaaaaattataaaatacctacttaattacaattaaaaacaaagaaataactttttctttaaaatagtccccgaggtcttttgagctggagtctggctttttgaaaaagagaagccagtcacttaatcacagagttgagtgtggaggcagctcacgttggctggtgtttggcgacccccctcccccagccctgctctgatctatctcaggggccccatggctccctttcccaccagcccttgctgcagcctgctttgaagtgtcccctttacgctcttgcctcttgctacactcggggtctgctagatgtatccccgttgaatttcgctgtcacagaacggggacgggtctttgaggtcatctgtctaattcgctcatcttcctattgaggaaactcaggccaagagatgcgaatgtgcctgagatctgacaattggcctgaggcccccacgtttgtttgtttgttttttaaattatgtgagaattatatggttgtctgaataactgtggctcatacttccattgtgtttattgctaccttgttccagccactgttgtaagagctctgcacaattaagtcagttgatccttgtaatgatcctgagaggtcaatatcattatctccccattttatagataaagaaaccgaggcactgcagtgttgagtagctcacctgaggtcacatccctaagtggcagaactagatttaactccgggaagactggctctaggtccacgctcttaaccactccattaacctactcttttgtagactaattagaaaatacagagagaaataaagtagaaaatgagaataaatgtcacgtgtaataatgcttttcagaaaaatataaccattattagaattttggccatatcctaacataatttgtcctccttcttacatgttaaaaaatagaattaaacatatccacgtgctttcctatgattcacttgattttgcttttttttcttaacagtgtacctgtgaacagctttccagtgcctataaacacacgtgtgcagcattatcttcagtggctgcaatgcatcccactgaatggatgtgccacagctgagttaacctatgcactgtggttgacatttaggttgcttctttctctctcatagcgtgccgcagacatctttatttt

SEQ ID NO: 25120 - DNA, 819 bp, Bovine  19866881200705
tgaaaattgtttatagcaccaagacttcttagattttcaatcttgcaaaattgatgatgtaaaaaaattaaagccgtgttttttcttctcaagattgaaagttcaccaagagatttgacatatttaatttacatgatgactttgcactccttcattaatgcaatttgcatatgaagctgttgttaatcacttttgatcatgttttgtgtattagctgcctcagtggctctcctcctcagatgccccagtagaaaggagcaaaatgatgcatcttcttgccaagtttcctttagtgaattgaggaattagaagtttaaccttgagtaattacgtatgtttttatccattttcttttaacgttaagtacagtttgtggaagtgttggcctggaagttgttctcatttggggagaagaataaaatttaagtgtatgatggaggcatatccagatatgcacagaaatatgtatggcttgtccctcttcccccctgaaggttgttgggcagtttcactgttcacagtttgatggcggagagactttttcagtgtattaagacatcaggtgcctttagaagagagacgcctactaacgacagacctttgggtctgtaacaatgctttgggtctctgctttgaaaaggtgacttgcccctccatgtcttgggtctgagtttgactaacttatcttttagctcaagtaagttttgctggggccttctgctctcagctgttctgcctgtgtcctcccctagtcactaaagtaaatcgtggtctctgggctaccagatgcctctctcaaggtacataagtgctctggtt

SEQ ID NO: 25121 - DNA, 3524 bp, Bovine  19866881212605
tttggtaagttttttggcacagaaaatttctttctgttaaatgtggaaatctagcttctgaggccttataaaggtatttttgaaatgtgaaagataaatgtcagaatttcacttaatgggcctctaaatattcaaaatcatttcatattctctttcaggagaaaatggagggatggaggaaacattaaggatgattgagaaatctacataaatttctaagccatattatgatataactcacactaatggtctataaaattttcagaaaaaaatgtagtagtatatttaattacgtattatatgactgctgtacatattaaaccaagaagcactgatttaagaacattaaaagaaaaaaaaagacttctaattaaccctggataacaatctaaaccagaaattggcaactttttttccataaaaagccagatagtaaatattttaggtttcgtgcaccatgcggcctctattggaacttcttaactctgcagctctaatagtacaagaaaagagccataaacaatatgcaatcaaatgagctgtgttctagtaaaactttacaaataaatataggtaattgagcaggtctaaaccatttctttcatgacatactgtaattagtacaattaccaccataggaatgaaatgtaatttctcaaacaataaatcccaaaacataattcacagttgctaacaggactttcagaagctgagatcaattcattcaatattcatagcatgaaaaaaatatgtaggaatggaataaatcaaagactcagttttcattattaagaacagaattcgagtatattgtgcaaaacactggtctctctgatcacaaggaatactctattgggcataaaataccttttttgatgaatcttccttctccagttggtcctaggggactaggtctaggtctttcaggaaaattaactcctgtgataaattttttccattattaaatgtaatttgaaaaacaacagtatatcagttaaaatttgaaaaactgaaaaaaaaaaacaaaaaacccaaaaccaaatttacttaaataccaatcaaaccaaaatattcttaccacaatcctgccacagtttgtggaaaagcagagttgttttttgtttctttgctttatttccatatgtgtctggttagaaagaaataaggaaaatgtgtgaatcatcaatgagtatggttcctctcctttaacacatatatagatgttttattcctacatagaaaatgctttaaataaatgtacataacatggatttctaggggtcacaaagtatgtcccaagtcagtaataaagggcatttttctcttagtaaaaaatagtttataatattcatcttgttttattacaatacctacaggttaacccatggtcaattaatgggccaagggcagattaggaccaagattggagaccactttctgagtggcaagtttgccatctatcaagaaggcacaataaggaccaaaacagaatctcaaatataaaacaaattctaataaacagttgagatatgttgaaattattctagattcctttcctaagaaaaagattcaaagagcacaaagatgagtcaaaaatcaacaaaaactttaaggaaaagaaaattgtgaataaataatatgactgtattctaatatatcctacaagacaatattcttagcaggactaagaaccatataaaacattaacacaaaaggtcatacccttttcatctggcaggtatctaaaatccatagattcactaacttcctgatcggaaggtcgccgcaactgcatctttactgttaccggttctattatagctttgcagtatggtggagtcttgaaaacaatggctacttgacggtgtacatcagcttgtgaaaagacaccttttgcttcccagtcattcaacacaaaccgaacttctatgtcgtctagtgattacaaagacaaataattcgaacacaaagtaaaacgtaccaatcaatttaaaatatattctgaattcaatgaaacaaacaaacaaacaaaacccaaaaaatacctttctgaactttgtcacagagtagaaatatttcatctcctcctttgacacttccacagttcttgtttacacgacaaatccttaattctgcagtattaggagcacctaaatacaaaggatttctttttaatgggttgctaccttagtgagttagacaaggctgtggtccatttgatcagactggttagttttctgtgactgtggttttcagtctgtctgccctctgatggagaaggataacaggcttatggaagctttctgatgggaaagactgactgagggagaaactgggtctgttctgattgatgggcaggaccatgctcagtaaatctccaatccaattttctgttgatgggtggggctgtgttccctttctgttattcacttggggccaaactatggtggaggcaatgaagataatggcgacctccttcaacaggtctgatgaacgcactgctacactcagtgccccaaccctgcagcatgccatcgccgacccacacttcgccagagacttctggacactcaggggcaagtctgggtcaatctcttgtggggtcactgctccctttctcctgggtcctggtgtgcacaaggttctgtttgtgccctcaagattctgtttccccagtcctgtgtaagttctggcggctccatggtggggttttgatggtgagctcctccaagagggtttatgccatacccaggtgcgctgcatccacagccttgtctaactcaatcaaactatgagacacaccgtatagggccacccaagacggacgggtcatgggggagagttctgacaaaacgtggtccactggagaagggaatagcaaaccacttcagtattcttgcctggagaaccccatgaacaatatgaaaaggcgaaaagacaggacactgaaagatgaactctccaggtcggcaggtgcccggtatgctactggagatcagtagagaaataactccagaaagaatgaagagacagagtcacagcaaaaacaacacccagctgtggatgtgactggtgatggaagtaaagtccgatgctgtaaagagcaatacaccataggaacctggaatgttaggtccatgaatcaaggcaaattggaagttgtgaaacaggagatggcaagagtgaacatcaacattttaggaatcagcaaactaaaatggactagaatgggtgagtttaactcagatgaccattatatctaatactatgggcaagaagaaatggaggagccatcacagtcaacaaaagagcgtgaaatgcagtacttggatgcaatctcaaaaatgacagaatgatctgtttgtttccaaggcaattcattcaatatcgcagtaatctaagtctatgccctaaccagtaatgctggagaagctgaagttgcgtggttctatgaagacctacaagaccttctacaactaacatacaaaaaagatgtccttttcattatagaggactagaatgca

SEQ ID NO: 25122 - DNA, 1122 bp, Bovine  19866881251804
atgtaatgtttataaatatttaatcatattaacttcaaaaatgtttttctaggtatggaagtttcttaggcttcctgggagttcttgctattgcttttgataacctttacattgggctgatttttaacccttaaaaaattcattctgccaatcttgtgaaattagtaagggcagttatctttatttcacaggtgagacctattaagattctgtactttctccaaaattactatatacctgtcagtggcagaagtggatcagaactcagaaataaagtcttttatacccataccctatactagacaagagtgagttgtctctcccatgctattactaaagtgggagttattgagacatgctctaccataataacaatgttcaatcagtactaatggaatgtattttatatgtttactggtgggtaaagtgtgttccctagcctcaaagaaggtatgttcttatgagggtcagttatataaacagatgtggaaagtgctatgataaaggtattttcaggacttcctcttccaatcgggagggaataacagggactgggtttactctcccacccaagcaactgtaaaactggacaaaatatatgaaataatggctttcaaatcattagttataaggcaacaaaggacagtatccctgaaatatgggaaacaaatgagatgaatcctatgaccactccagcttatgtctaaaaggaatctccacaggtacagggaagaagaactcagtggatcccataagtttttctgagttttgaatagaaaacttggaaatttatggagtcagagtctggagttcacagggcaaagtagcaggatggagagttcttcatagagaaaaagctccagagatctgtagagggtcccatcatgttgtcaattgagtgttactgattatgcatgtgaggaagctgtacaaggctgcagaaagggtcactgaaaaggattagaggaagcatatctttgaagatcatacaggggcaggaatagtttctgttttcatcatctggagcagagaactagagaaatcacaggacactgaggagaatattggaagagttttgagtcagtagggaaaaaaataggcaaaaattaaatatggtcccac

SEQ ID NO: 25123 - DNA, 1334 bp, Bovine  19866881269337
cagatgcactaatgaaagatagagggaaaaaatagctatagccccactgtaccttgtatacacttctccatgaatcttggctgaatcatgtgcttctgccttccatatggacttcctccacaaaactgcccctcctgtgaacatgagacaatgcccagattatagtacacatgatgactcactacaacctacctttaagtagtattataccacttcaggtatagtgcaaaacttgacagtggtgtacttctatttctctcctcctgacacttgtgctactgttgttataaattttatttttgtgtaaggtatagatctaacaaagcacttaataattgtcaattatcttttaaagtaatttaaataatatgtttaaaagtatatttttacccatttagttaatacttctagtactcttcatttctttgtgtagcttcagatttatatctactatcattttccttctgtttgaagtcattcttttaatatttttataatgcaaatctactcatagtgaattattttaccttttgaatatctgaaaaaaatattcattttcactaggtaaagaattatatgttgacagttttttaccattcactccattgtgttctagtttgcatcacttccaaaggaaaatctgtttcaattttttatctttgttcctctgtatgtaatgtgtttcccccaccctggctgcttttaagatttcctctttatcattgaatttaagaaatttgatgtgacttggtgtggttttcctcatgtttcttgtgcttggagttctttgagcttcttggttatgtggtttataattttcatcaaacttggatatttttcagccaatattctttttaagtattattttatgtccttctcccttccagagacttaaataacatgaatattcagcctcttataatcttatgtctctctccctttcagagatttaactaacatgaatattcatactgtctcccagttcacaggttcttttttttttttttttccattttggaaggtttctattgctatattttcaagtttaccaatgctctcttttgcaatgtctaacctgttcttaatctaatctggtatgtattttatctcagtttttatgtttagagtttagatttgagcctcgtctatacctctcatgtctcaattaacaagctaaattattcctttaccttcttgaacatatggaatatagtttcaacaattcttttaatgtctttgtctatgaattatattggcagtatcaattctgagtcaattttaatttattcttcttctaaactttggttatatttttctgcttccttgcatgcctg

SEQ ID NO: 25124 - DNA, 1659 bp, Bovine  19866881324195
aatgctaatcgccaatgtgccttccaaccagtaggatcagcaaatatgttgtaaattaataatgcacccttttagtagcaatagcctttcgaagaagtctggaggagggttatttatccactctcctttccatcccacctcccttaagagaaggagctagaacagggtaggtcccttggagttttgtttcagaatgacccctcccccccacccttactttattaaccatgtaacattttcaggttgttttttcctccctgtctcctccagcaagtctctattgatcactgtttacagttataatccctttcaaatttatcatccatgactaacaccccgtgtattgattagtggtgacggatgtccctctgcagtatagaaccaccatgatcccagcctgtgatataggaggggtggaggagacagaaatactcatttccccttcttcattttctttgggtaattttctgctccctgttttgttcatagcctaggtgacttctttcctatctttgtgaagaattgctttgtgtattttagggataattcctgtgcttttatttaagtctttttggagggaaaggaagtagccttgttgcccctgggtggttcctggggggtggggtcaccgacaggtcctgaaggagatcagatatatgagggacatccacgtgtcttaacctaaagcctcaggtaccaaagatataaaggctggttgtttagggataaattacatgtcacttgtgactaagaacaaggtgtctaaaatatagactctaaatggagtcgtttgtcaatagtgccatattggggctcttttttctatactgtccataacatccccttggcctcttgtggacaaaaggtgagtggcagctgggttgggaagctgtgtcctcatccgccctgcctgagcatgtggttgcctgagcacgtggtcaggtttcctgtcttggagagttctgctcgtgcatgtgaggtacccaccccactcgccaaccaggctggcacagaattgtggagcggtccggccacccatgattgagcctgcatgcaagtcctgagctcagctgccttctctgtgcaatggagccaacagtactttccttgcccacctaacaaggagtacatgataccaaccatgagagtgcttcaaaaaatcccaaagggccgtgtgaaccaagagggtgtaatgattactctggcaactttctccttgctccttctgagcctcagtctctctctccctaccacaagaagctttggttacttcgcaaggtatttgcttctactccagggaactttaccaaagggcccaaggactggtcttgagaatagaaggaaggatagaattcaccaggaatttggtggtcttctagctcagttcagttcagtcgctcagttgtgtccgactctttgcgaccccatgaaccgcagcgcgtcaagccttgcgctccatcaccaactccccaagtccatcccaacccatatccatcgagtcagtgatgccatccgaccatttcatcctctgttgtccccttctcctcctgccctcaatctttcttctagctcagctctttcatttgacttgtgaggaaactggtgaagcctaaattttggagtaccttattcaatgtgtgaaacgtaagcctagaaaga

SEQ ID NO: 25125 - DNA, 780 bp, Bovine  19866881325142
aactgcccagctatgcactaaattcagatggaaactaaagacaggcaggaaagtaacacatagaatcaaacataaaacgtttttgtcaaccagaaaacaacattcattactgtgatttccaaaagtcgcccattcagcctgtatgatgactgagaacagtgtcagcccggccagaaaggcattagtaaccaactgagtcattccagcccattaccccaatccaccaggtgatgctggtcggggaggagtcatcagagcacaaaagagaggcaggagcactaagaaaccaccttggatacttctccattaataagcactttcacaggctcaaaaagggttttaggagtggggatttagaaagtaagcaacgatgaccactaagaaatgatagcaaagcaaaaagacaggtttttcttctagaaaacttaagacattgtcttcttactaccaggattcccttttattctcattatttatttcctttgctctcttttcaatgtattatctgaaaaaatcaaatttacaaatgacatatattaacttataaagtccaatgtaatgaacacttgtgaattcccatccaatccaaaatttagaacattttaagaataacctgcaccaacttgcatatctcttttctcctttcttcaccctcctatcctcctccagatataatcacagtcccagtttttatcacttttcttctaaagctggttttaccacaaatgtgtgtaagcttaagcttgttgtactcactcttgagaactaaaaaaaaaaaaa

SEQ ID NO: 25126 - DNA, 1008 bp, Bovine  19866881341465
catgtgggagagagaaagaggtagggagtggagaatctagaaaaatgacttaaaaaaacatcacatttcattgaaatggagaaaagatattgtctctgctgccatcacctccctgtcatcttcatcttgcctgggtttccctgccaggccttgcagcttggggtgattgggatcaggctgaccacgctgccctaccaggggaggtagaacttgctttgagcctggaaagcaggttatatgcttgtggtgggtgggtgaggtggatatgtgaagaccacaaagcaagggtgccaagggccgagtttagctcttaggagatgtagagggggcctgggggtctgaatggttttgcttttcctgggatccctgcctcatttttgttctcagggtgtacgtgtttctctcttgttctccggcacatcccataggcaggggctgggcttgggcctggggctcgggctgggcagggacatgccagtcatttggctgggaagccctggtcccgctgagcactccagggctttgcaccctcttccctgccctccacagggtggtgccaggatcgaggacagtcgggggatgaggcgtgggctgctgcaggcagcctcctgcatatgaggcggggaggcagatgaggtcatccacacagccttccacgcaccttccagagctagccttatttacccttttagtggagcaaaaccatgtgatctaaagaggattccttgaactgaaggactttgcactgttccctttctcagggcagaaagatggggctgtaggtaggggatgagaatagaggaaagtgtaggagattactgaaaaaaaaaaaaaaaatgagatgatgaaggagaggaaaggcagccggactaggtaattgggaccaattcatcagaaggcttaaggaaatttgacatctattgtaactcttctaactgtataattacgcagcgttggaaagtgaattattaactgatgtctataagaccatgagtaaatatacagtca

SEQ ID NO: 25127 - DNA, 715 bp, Bovine  19866881381410
ttcttgcaaagggcaaggcctggaattgaacataaacaaacacagcccacgagtttaaaatagaccattgagcggctcacagaataggccccttgtttttaaaagagcagtggacgctctcaagaaataataagaaataataagtctggaagctgggtagaaacctctgatgctttctggctgcatttgtccttcgaactttatttgtgtttggcacgcctatgatggagctgctgccagcctcggccagggtctgcaggcaacggaaagtttatctgggctgctggagggaagtggaaatctctttgaaaaaagggttgttctctggtggttgtgctcatttctaagacacagactccctttcgcagaggcagtttggtgttcatccaaagaggagcatgagatttgaggatggacgtacgtgtgacctagggacatgttcttaacatcacgtagcccaggttttctcatctgtaatattagggcattaatacctacctcacagcgttgacttggaattaaatgatgtgattgtagattctgtgagttgacagcttgctctgatgggttcacatctctccacccagagcctcacactgtgtctgaggggtggtgggcagtgctaaccctcttctacagagaagcagccgaggatagcttgggttcctttgtcagcaatatgaagacataaatagtgttctattccctttcttcc

SEQ ID NO: 25128 - DNA, 1035 bp, Bovine  19866881389666
gccctcaaatactgtttcccatcttttcctctgttttcccctcttgggactccttttaaacatatggtgggggcttttgagctgttattcagatttcttaacttttttttcatgtttcccatttgactgggtctttattccacatttgggggcatttcctcagctcagatttccagtgtcataattcttttttttttcttcttcttctttttttttttttttttttgctgtgtgcaatatgctatttggtctattgtgtagggtttaaaatacactggcaaatcctttgacagctttttctccaagaggtggagtctaactcctctctgcttgagttagggctagttttaatgactctcatctagtgaatagaatatggtgtaactgacaatgtataacttctaagacttggtcataaaaagcattgttgcttccttcctctgtgttctcgcttacttgctctaggggaaaccagctgccacatcatgaggacaatcaaagcgaactacaagaggcccacatggggaggaactgaggtcatctgctaacaggcccaagaaggatccatcttatctccagcctcaggcctttacatgatggcagatcttgctgacatcttcactataacctcatgagagaccttaaaccaaaaccagctagctaacccattcctgaattcctgacacaaagcaactgtgagataacaaatgtttgttttaagctactaagttttgcttaaactttgcatgatttttaactaatccacccatagactcaattgtttagctctagcaactatttcttcattcttaaagtttctaatttttccaaaaccacctgttcttgtttcattgccttctgtttttatttcatcgtttctatgttctcccttatcttcaaaaacatttaaattattcatttttaaacttttttattgttatatagcctcctttctttgaatattgatacctccaattgctcagtttgttatcattcatggtggttggacttcctgggcactatgtaatttttatt

SEQ ID NO: 25129 - DNA, 1738 bp, Bovine  19866881425084
tagcaagaaatatttccaaatcgtttgagatacagccagcatatctgtcctaacactgaattccccagctttaatacttgcagaaaacaattggttctcttttcactgagcttatattcactccttgtaatttgaatcatcctcttaattcctggaccctaccctttcttctcaaacaagagagtctgctttggttttgaccaagcccatatcttcccgaatttctcagctaaatctcttctaatacttctctttttccaacataaatagtctttgttcactcattgtcccaccctgcctcacctctgactccaattagagcaatatttgtttttcctttttaagaatctttctagcttctactactcagatatgaggcaacccagctcgtgttaaaagcccttcattatggtcacagaaaatctgctctgacaagatccacctcgacaagactgtgttcctggatttccttcctcattttatctgtcatctcactttctaggtcacatcatttcctggcatctaacgtgttgtccgtttatatatatattttaaagaaatggaggcgtggcatgtggaatgagcaccttgtggggttgggatatagaaaaggctcttctaatgtaggggcacctgcaattttctggagaaggaagaggaacaaacacacacaaccgtttctccaaagagcctgtcaattttgatggggattttagttctttgagacagccaatggctgtccaaagcccaaatgtggactccaatcaagccttcaaggaagtgagtaagaatgttttttggattattccagaaacatagaccacaccagcatggaggcgttgaggttggggggcttgggaatatgaggactccgggataggatgaccttgcaagaccaccctcttaggaaatagccagtcaatgcagtaggtcaacttgcatcaggctggtccaatacctttatgctgatatcctggtcctctgaccagtctgtgacctgctttatgataatacagacgtacctcagagatattgtggcattggttccagaccactgcaataaagcaaatatcataataaagcaagtcccatgaattttttggtttcccagtgcagacaaaatttatgtttatactacactgtagtctataagttttcagtagcattgcatcttaaaaaaatacatatactttaatttttaaaatactttgttgctgaaaagactgtcatctgacaatgagagttgccacacacaaaaaattcaatatctgctgctgctgctgctaagtcgcttcagtcgtgtccgactctgtgcgatcccatagacagcagcccaccagtctccccagtccctgggattctccaggcaagaaactggagtgggttgccatttccttctccaatgcatgaaagtgaaaagaagacggacccaatgaatattaagtgcccttttttatctccttgacttgcaaaggtaaccagcttaaacatactgttgagatttacattcagagtgacactctgatgagaatttattgtattttaaaatgcaaaagtattatagtactgttccacaaaacaaaagagtgggtgaatagcagggccgccctctgacttatgaaagctaattctatccacaatcccttccagaagaaaaacatagtattagagatatacccggagaaggcaatggcaccccactccagtactcttgcatggaaaatcccgtggatggagg

SEQ ID NO: 25130 - DNA, 1184 bp, Bovine  19866881526263
attagccaatatataatttgcctgtttttattatccaaaaacttgtaactgtcaatgagagtgctgacatctacctattaccacactgaattgattttattccatagtaaggccaagaaagttgacagttcagttggcctctgcagccttattgaaggtaattttgattttttttttaactaggctttttgaattttgaaaaaatagctcaaaaaccaaaaatactatcatcacatttatcgtctctttggaactcttaggaacctaagaatgccaaagagatgtgccttgtgtcaacagatgtgatagcattagcacgtgtataatatgcttttactctagcaccaacataaaggtactgcctatatgtttaattactttttaaaatactgtttgtttttggtgggggttttttgtttgttttcatctaaagcatgttatcttttattataggctggttgttcttggtaaactcaacaatctagtaaaagaatggatttctgaggtcagtgagagtaaggtaagactctaaattgaattcatagtttcattgtgtcctggtaacaaaatgcagagttgagaatgatcaaaaatagataaacatttttagtatacttagaaatgaattgttctagacagttgaaatgaagagaaagtcacttagtcatgtccagctctttttcaccccatggactgtatagtccatggaattctccaggccagaatactggagtgggtagccattcctttctccaggggatcttccaaaccagggattgaacccaggtctcctgcattgcaggtggactctttaccggctgagccatcagggaagccctctagacagttgagtcctaaataaatgaggatttaccccagaggtagccagtgtctgactacatttccacataaatgtcttccttgactcacatgtagtaaaccaaactttaaatactgaaattttaaaagccagatttcagaattcttgtgaaataccagatatggcagcactgggcctttcttggggcaaggccagaagaggcttgaatggaattgggctactcccctctggtgcctcatggtccccattactccctgctctctcagacatagcaattgtcgattatcagtttctgtgtttcttacgtgtatactttcctcatttgcttacctgcctggcctag

SEQ ID NO: 25131 - DNA, 889 bp, Bovine  19866881689950
cttgattgaaggcacagtacatttgccacaaattattttttgttggatagcaactatgactccatctatgcctcattttgtacctaaaatgccttctgtatgcccggctctgttctaggtactcagagattataaaacatggtccttaccttttaggacctacccattcactagtaaaaataaaatttggcacacaaaaccattagagaacaatatacaatagcaggtggttgagcacctgtggggtccatcaggtagcattaaagctaaaaggagctcaacacttgggattaggatactagtaatcataatatgtttaattttatcacattgcttcatcaatcaagcaattacacatattctacctaatttcatcctctggctaactgctgctgctaagtcgcttcagtcgtgtccgactctgtgagaccccatagacggcagcccaccaggctcccccgtccctgggattctccaggcaagaacactggagtgggttgccatttccttctccaatgcatgaaagtgaaaagtgaaagtgaagtcactcagtcgtgtccgactcttcgcgaccccatggactacagcctaccaggctcctccgtccatgggattttctaggcaaaagtactgaagtggggtgccattgccttctcctctggctaactagttaaagcaaatgctatcatcctttcatttgttgttgttattgcttggttgctaagtctcactcatttgcgaacccgtggactgtagcccaccagtctcctctatccatagaattttccaggtaagaatactggagcgggttgccatttccttctccagggatcaaatccagggatctcctgcttggtaggcagattctttaccactgagccaccatgga

SEQ ID NO: 25132 - DNA, 734 bp, Bovine  19866881890799
attaagtgactacgaaaacctactgcctgaaagggtgataatctgaaagttagttctagtcaagtgatgtcgcaatcttaccatttcctaatgttctcacatctacatcttctcttccagaggaagaaaaattaaagcctttggaaagcagataaagaaaaaaaaaaaaatcagcgatgcaatagtcctagacttacattcccaccctgggtagaaacccaatttgtcttaatctacaggagaatcccaaggaatagtcatcatcacaactctagtcctaatgtctactgaaaataacaatgataataataaatactatttattgagtacttattacatgttagacactgagctaaaattctgcatacattatttcatttattccttactgtaaccttatgaggtaattattaaatgaaagaacaccaaggttctgaaaggttaagtactttccccaaggtaatacaattaaagggcagaggtaaaagccagatctttcttatcatcccatgccaccaatcccatgggaaagccaaaggcagagcactgtttggagaaaagccctgctaccaaactggctacaaacttatggtgaaaaatctgtcttctttttcttaaaacaaaagaaaacaaaataaaaacagtatttgagaattaaattccatgaaaggaagggaaaagaaaaagtttgactctaaaagcaaattcattatataagcaaacttaagctaggg

SEQ ID NO: 25133 - DNA, 1371 bp, Bovine  19866881890880
ataatcctgcttggaggatcgtagagatagattccaaatggcattcaaacttgatcagatagcaccccaagattaattaataatgtctgttacggatgaggaggtgtagaaggggcattgctacgatccagtccttttattttccagtcttgtctgcccccggagaaggcaatggcaccccactccagtactcttgcctggaaaatcccatggatggaggagcctggtaggctgcagtccatgggattcctaagagtcggacataattgagagacttcaatttcacttttcactttcatgcattggagaaggaaatggcaacccactccagtgttcttgcctggagaatcccagggacgggggagccttggtgggctgccgtctatggggtcacacagagttggacacaactgaagcgacttagcagcagcagcagcttgtctaccccaaaacacactttagcgacagagaactgaaatccaggcttgctcattcctagtctagtgctttatttaaaacaatttccattgtccatagtcaggcttatcagaaatgctggtttctagaaagcttctagctggtgtatggcagaaaaagccaacatttactttacttgaaagattaaggcaaatctaccctaattgttcctactcattaatgcctcagccactaaggcaggtagagtattttattccattattagctataaaattttaaatactgagatcccttgagaattaatcaagaaaaatcatgtgtttaaaaaaaagcctagtacagtttctgacttgggtttaaatttatactaaagaatgtaagatcttttcttgcaagtaggttttgatgaaaatacagagcataatgcataactggatgcctaaaggatagagttcatcactgagagagggaaaatatacaagagagggcatctagggtatcaaggaaactgtccacttcacaactgtccctagaacagcctggtcagaaactatacccctaacttcctcagctggggccttaggcaagttacttagtgttaatttccccttcggtaaaatatgggtaataaatcctgcctctcagggttgttttgagaatttactgagaaaaaccttatgttccagaaagggctcagcacatttcgtggcatatagttactcaataatgtttatcaatctatgtgtttgatttgcacaaagaaattcccatgaactgatcccatgaacatcaaaactgaggtctgttcaactcagggttctatttaaactatgagatctataggtcatctaagactaaaagccaaagacagaggttattgagaggcaacattcactgtgcaataggcttaagatgtctaagctggtcactgag

SEQ ID NO: 25134 - DNA, 907 bp, Bovine  19866880351424
gttgcaaagagtcagacacaacctgagtgactaacttttgtcacttttcactttcataacttaatagtagataaaagtttagatcccaggagagttccaaaaaccagataaggtaagcaaaaatgtagagagcatggcaatcagtttaaagaatgagatgaattttagaaacctagaaaccattttaaaaaatatttattaataattcagaagcaatacaagtaaacggtacatatttgtcaaacatgtttggaggattatgagaaactcttgaaggacttaattaagcttgataatggagtaaacacaatagcagatgatgctcaatggagagaagatggaagtaatatacaatgaacggtttagagtcatgcattgaatgagttatgaattagccatgcctctcaggaagagaaattaatacacaggtcaaggacagtaagcaaaaaacctaggtcagtgaattacaacattcacaaaaagtggatggaatttatcaattcaaagagcattgctttaagctatttttaaactggcttgtgggtaaaattgcattataatgagttttctctggtactttagtaactaaaacctcctccttattgttgtttagtcgctaagttgtatttgactcttttgcaagtcgtgtctgactcttttgcaattccatggactgtaggctgccagactcctgtgtccatggaatttcccaggcaagaatagtggagtgggttgccatttccttctccagggtgtcttcctgacctagagattgaacctacatctcctgcttggtaaggtggactctttatcattgtgccacctgggaaaaccccctagttcaaccctaatgtggtggtggtggtgttttagtctctaaatagtatcggatctaatgtaattccag

SEQ ID NO: 25135 - DNA, 1333 bp, Bovine  19866880357426
tcagtcactcagtcgtgtctgactcttcgagacccatggcctgcagcatgcaagaattccttgtccttcattaccttccagggtttccttaaactcgtgtccactgagtcaatgatgctacccaaccagctcatcttctgtcacctccttctcctcgtgtcctcagtctttctcagcatcagggtcttttcaaatgagtcagctcctcgcatcaggttgccaaagtattggagctagcttcagcttcagcatcagtcctttcaatgactattcagggttaatttcctttagggttgactggtttgatctccttgcagtgcaagggactctcaagagtcttctctagcaccacagttcaaaggcatcaattcttcagtgctcagccttctttatggtccaactctcacatccatacatgacactggaaaccccatagctttgactatatgggcatttgttggcaaagtgatgtctctacttttgcatacactatttaagtttgtcatagcttttcttccaaggagcaagtgtcttttaatttcaatggctgcagtcaccatcggccagtgattttgttgcccaagaaaataaactctgttactgtttctattttttccccacctatttgccatgggtcagatgccatgattttagttttttgaatgggatcaaacctgcatcccctgcattggaaggtagattcttaatcactggaccaccggggaagtccctcgttcatttcttgcttgcactcatcctcactcgttcttttcctcttcccttatctcaactaatctatttactattcccttttctctatttctcagtcttctgtctttcctttccacacaccgccttcttgtttccatgtcttcttttctctcctcctcctgctactgccctttctctcacctagccctctatctctttatcactgatacagccacaaatgtatttttcccaacatcttctcttattccgtttttttctttctcatcactacagaaggatgtttgcccacttccataatacattcaggagcttgttgctcactggcactatctatagaagtactattttctacttattgtatttttagagaaagaaatgtcacagcctttttggtaatgaagctgcttccatttgacatcattaggctcagaaagcattctgcaggctgccttggtgacatttgtaaatattataataatggtagaatcggagaacttccactgtgtttctttgtgtttttctcaaagcagttcagaacccaacctaggtgatttttttgtgttttcagggaaaggaatttgttctttaccctagcggagag

SEQ ID NO: 25136 - DNA, 904 bp, Bovine  19866880379889
taatggaaaaggtttgaccattaatactcgaagtttctgtcttaagatgatttttaaagtagtcagcttccaaatctactctagttggctcagatatttttctagcctacgtactgtttacctttggctttctgaaactcttaacaattctcaacttctgccctgtatatgtgtaacgatgtagattggatagtagctccttgaagagaaatgaaccatgttgacaccttgagaatgaggttagttgtagcatgacctcagacttttcaatttatcacccaaagcaggaaatttttctacagctggcatctaactttcaaagtgtgtaaaaataatggcactagaaaaaataatagtgggtatatatagctagtttgaacaaaagcaattgctaaattatagcaattcatataggcttcatatttggttatgcaatttaacatcctataattatatacaagatagatgttgagaaagacagcattattaacagtaactatacttatcaactacatagtataaccataatagcctttttctctcattcttaaatttgacattagtgatttgaattataaacttgatgctttcaaaatgataagagtgaaggtaaaaaaatgatactttatcattacttggtcattaaactatagtttatgtaaatattggtctatataaaaatagacatgaagtcatcactgatttctggaatgatctttgcttttactatttgtgttttaatatcttatttgctttattggctgcacacttctccataattttgcacaaatgaagtcattacatgcttattttctaaaggtagttttttctgttttgcttgcctctcatctttttctccttgcttgatcctgctcttcctttcatgtaaactaatgaatgttaa

SEQ ID NO: 25137 - DNA, 3198 bp, Bovine  19866880401276
tgtgacctgtctagcatttcagaacccttcctgaataggggagctataacatgatgtgacagttggaccctaaagaaggctgagtgccgaagaattgatgcttttgaactgtggtgttggagaagactcttgagagtcccttggactgcaaggagatccaaccagtccatcctaaaggaaatcagtcctggatattcattggaaagactgatgttgaagctgaagctccaatactttggccacctgatgtaaagaactgactcatttgaaaagatcctgatgctgggaaagattgaaggtgggaggagaaggggatgccagaggatgagatggttggatggcatcaccgacttaatgaacatgagtttgagcaagctctgagagatggcggaggacagcgaagcctggtgtgctcccgtccatggggtcataaagagcaggacacgactgagaagctgaacaacaaccacaatgtgacttacatatgcagtgtatcatctattgagtatagaaagtgaaagtgaaagtgaagtcacccagtcgtgtctgattctttgcaacccaatggtctgtaacctcccaggctcctcagtccgtgggattttccagacaagaatactggagtgggttgccatttccttctccaggggatcttcccaacccaggggtcgaacctggctcttccgcattgcaggcaagttgttgtttttgtttttgttttttaacttatattttctgcaaatctgaccaaggagagaaaaataagctgtcataatacagtagatagtctaacatggcccctaattatcctcaccccctgttttcctgttcttaagtgatcaattcccttaactgagtgtaggcaggaaccatttcttgtgaaggtgattacttacacacagttgtaatgtttgtcttgttgggagcctctctccctcgtggctttgatgaagtaagagaccatgttaagggggccgcttggctggaaattgtgggcagcctctggccaacaattgacaaggcactgagatggtctgcagctgacagccagcaagaagctgagaccctcagtctgacaacttgcaaggaactgagtgctgccaataaacatccaagtttgaaaacagactcttccccagttgagtatgctgataataatccagccctgaccagcaccttggttgcattcttgtttgattacattttccctcaagtaatccttccccaaatatgtacctctagtcatcatttgctgtaatgtataactaacaagcctgtttaccctggctttcaagatgagttttctccctctctctcttcttaaggtgttaatccttggttgacttttgtccatactcatgccactgtagtaagtcatcaagggttgtgctccatatccatctatatttcatcagccaccgatggactaatctcagtttaataatagctaacgtataaaatattgcatataatttcatatttcatgaagcaaccatatttggacctccttacagcaaccctagggttattgccccaagatgcagaaatcaagtcaagaaataaacacagtgtgttcaattatggtagctagctaaattttctgtctgatctaaattcgttcccttttctgatttctgaggtcctcttgctgctgttccaggttgtctctgtgaggttgttgatgactgtgactttgctccatcccagcagttaaggtgggcacatgacccaggatggccaggtttctcatgacctctttgattagcttagaggttgacagatgactccaataaaatgagtcaatcatccttgaattaatatttaaattttgggagagagagtttcttttcctgggattgctaaaccaaatggaagtgagtcagtctagggctcacaactgccgtcttgtttacaacataggaagagctcacatacttaataaagtcaagcagagaccagcagaactgaaaaagtgggggaggggacaaaaaaaaaaaagaactgaaaaagtggcatcacaaaccatgtcctaagaacattttgtaatcacaggtacagcaagcctgaaggacctctctgatagcttggaggacagactacagggaggtaaagtggaagtcagaaagtagcacagcagaataaaggtggtagctgtggagacagtatgacatggtcagattctagatgtattactttgaaggcatagctgataggacttactgccagattagtgagaaatgtgtaagaaaaaaagtcaagaatgaatccaaggtttttgacctgtgcaactgaattaatagaattattatttattgaagaaggtggaaactggagaggcaaaggcatgtttaggagggaatattaagagctggatttaaggcacattaagttcaggatgcttattagacatctagaggaaatgttgatgaactgattgacatacctggagttcaggaaaaggtccatcctgaaaaactaaagcatgaaaatcattggcatagagatgggcattcaagccataagtctgaatggggttattcagggagatgagtgtgtctaaagcagagaaaccatctaaagagagcatcctggggcactgcagtatttttgaagtagagaaagaacatccataaataatgtgtaacgcgcaaactgagaagagaagtgtttctaaaaaggagggagtggctgaccttgtccaggcagctgctggaaggattaaaataagaactgaaaactgaccactggatttgacatactcatgagtgaccttgataagagacatttctgtggaattatagaaggaaaaaaaaaacagaaataagtttaataaaaaaataggagttaaggtgaagatgaaatatataattaactttttcaagagaataaggggaaaggagggctttctccagtagctcagtggtaaagaatccgcctgcaatacagaagacaagggttcaatccctgagtcaggaaaatcccccggaggaggaaaatcccatggacagaggagcctggcaggctacagtctatagagattcagcaacaaccacaaaggggaaaggaagcagagaactattaataggtggtggttggaggggaatttccagttatgtcagaaaagggatcttatgagtgaagatctcctaatgagtgaaggaaagggtcaaatttgtcatgggcagtgtcctctgcctg

SEQ ID NO: 25138 - DNA, 1215 bp, Bovine  19866880412319
ctttttttgtattgtagtaactctgtcattgttcctggtgatacagttcaaagcaccctgaaatgtatgcttggaattcttagtggatgctggatcctaaaatttgaatgtaagtattggatttgggagaattacaaagggaattaaatagactaatttcatttttttattgcagtattgccagtaattatttaaggaccttatgctaatgttttttacctctgtttagtccctacattttgaaaaagcttttcatattaatggtatcacttaggtgttcttggtaaatatatacaagtatgttctcatttcaaagtcttcctgtcataccaactattttaatccagagtaaatggatcctgtaatagacctgtaagcttaagcaatctgtgttaccattattgttgttgttgttttgttgctcagtcatatcagactctttgtggccatggactgtagccagacaggctcctctgtcaatgggattttccaggcaagagtactggagtggattgccatttccttctccagggcatcgtcctgatccaggaatcaaacccacgtctcctgcttggcagatgaattctctaccactgagtcatctgggaagcccatattaccattgtatgatacatttaactcaataaatgcttgttttaaatatatgactattaaattagtttattgcttttccttgtgatgtctaaaaacttatctgcataactctctttagctctctcagctaatatcatttgttttaggaaggtctttgaaaattgagactgccttgtaccacctgctgctgctgctaagtcgcttcagtcgtgtctgactctgtgcgaccccatacacggcagcccaccaggctcctccatccctgggatcctccaggcaattgtaccacctgattgggggcaattacactagctattctctaaacctctgatgaaaatgtgttcctgttactcctttctagatggtagtcaaccaccttctcctttgatgctgcctttcaccttcccagctctcacctgtttgttttacctaggacttaacaaaataaaaagaaagcttgtacaaggttattttctactcctcaattactaaagtgtcttctgcttttgatatgacagctaaaataggacaaatgaaatgacctttttgctaactgattgtttataaaaagaataatggtctgttaaagagggacctggt

SEQ ID NO: 25139 - DNA, 1631 bp, Bovine  19866880415051
tgtgcctttttacatccctttgatgtgaattccaaaaagacttaatggagagacagtggacagccgacccataattaaaacaataatggctatgaaattcaacctctaaagtaattttagtgtgaacttccttctgtgaaaaccatcaaaaatcacaaataacacagtttgattttgatcagctgggagtgttctaatcagctcaaattccattacctctgagcaaagtccaaagctgcccttcactgtgaaatcactgaaggcctctttagcagacctgttcacttgaggatgtaacctttaaatgaatgccacttttgtagatgccacttaagaggatccttctaaaagccacagtgagatgccacactggccttcttgttggattttcccaaggctgatttccttagaggaaaggagagagtgctgtctggcaccaaaaccaaagagattcctggggttttaaccccaaactctatgtctgaccgcattcaacctgtaaatttcctctgtgcaaaatttcacaactcagaatagtgtctttacttatgtgtgcctcgcagagtataaagtccctctgtgacaggattacaccttaggatatgtgaaggaaagggattcttaaacaactttgagcatcatgactgattggccagtcccatccccaaagaaggatattaacaatattatgttttaaatccaatgtacgtgttataggcataactcctatcctggattattttgttctgatttcagtatctggatgttacttgattcaaagaaggaatcttattatcatcttactttactcttgatttattaacacatctgacctgctttttgcaaggtgaaacaaaatttagccttccttagagaaagcaggacataagaatgctgagatataaaggcaatagtcactgttgttatgctgtttgtgatggaaactcagatgctttaggggaggtgagaaaaattctcagacactgaaagcctttacagcatccctgcactagttagattatgagaacgcagcagaaatttcttgctaaccaacccctgctgagatgactggctggctaaccaaacagaatcaaggaatgtcttccatttgccctgtatgcagccattcaagaaaaaaaaaaacttacagaagactccaataatgtctaacttaaaggaaatttttctacttagaatgtgaaacatattcatttttcaaaatactgtacattatttaaacaattttctctgaaaatacagaatcctaactcagctcagaaagatgcttaagacagaattctcagctgtggtttcaggttccatctttattccctgaacttgttttataacctggtagaagaccacctactgtgtgaaatatacaagatatggggaagagacccacaaaccctattcctaaaacaaaatccaattttttcattaataagtagtagttattaattaaatatatctttatttggaatttaccatgcactatagctctacttgacattcaaatatagatttgaatcaaacaaatgcaatcacagctatcatggagcacagggtttaatgcgagatgacatacaataatgattaacacttgatgcagtatctgtgataatgggaaa

SEQ ID NO: 25140 - DNA, 1280 bp, Bovine  19866880529040
ttattatcttccaggttcctatgggtcagaaatttggttactacttaactgtgcagttttagctttgagtctgtcatgagactgcagttaaaatttggctagggttgccttcacatgacaccttgactagggctggaatgtctgttttccaggtagattgcttacctgactaatgggttggtaccaactgttgatgaggagcctcagcttctgtctgtaagttgtttcagtgtcctcttgacatggcagccactccgccagaccaagcaatgcaagagacagtcaggtgaaagctgtcctttttgtcacctatcctgggaagcctcagagcatattatctaccatgttctattcattagaaacaagtcactaagtctgacacatattcaggggcaaaggaattaggttctgccttttgaaggaaagagtgtcaaatattctgtgaacacatttaaaaaccatcacatggaatagcaagagccagtggtacaataataacattcactagacattcttgaaatatccagccccatcatggcagagagcttgtctgcttgaagcgatactgcattccttgcacctggcacagatgttcacacatggaagcttcattaaatattttttggactgttgatgttttgtagatgaagatattcattttcagatatttcagtgacagatctcactaagtaagtgttgaagccaagatgtaatttgatcttactacccagtttctctttctgctcaccttgctatctgtcaaacagaatcactcatctctattaaaatactcactttgctcttggcaaagctaacagaatcactctgtggaatattgcagggcatttagtagttacccaacaaatatttgttgaacgaatgaacaaatttggtgcaacaatacatgaagacttgagatatgaagaaatccattcagatttatttacaagtcaaagaaagactggggagtacaggccaaaatgcttgtttcttgtgcaggttattatttcatcatatttgttgaaaggacatcttgtataaaggatagaagttattatagatataaaaattataggagatatggaactccaggattctgtgtagaatgaactttgtatcattgtgccaatattttggatacagtcttttaagagtgaaagtagattagaggggagaaataagtgtggttcaactggaatttctctcctatgaatagtattatgctttgatatttaacccacagacaaagggaaacaaataaatctcagaacaacacggca

SEQ ID NO: 25141 - DNA, 1417 bp, Bovine  19866880575345
cttcatgaatgtaagaatgggtttattataggattagcagataaaatagttctattgcaatacaatccaaaattcacacagtgctgtttcataaatcctaaaaagaagtaagatattttggatttggggataatgatgaagaacatgctccagaagagatcatggtttacatcccaagtcatgtctttcattgtcatattattaacataatcagtagcataacatgaaattcttagtctctataaatcacaattcagtgagagaaaactgaaggaaaccaatggcaccccactccagtactcttgcctggagaatcccatggacggaggagcctggtgggctgcagtccatggggtcgctgagtcggacacgactgagcgacttcactttcacttctcactttcatgcattggagaaggaaatggcaacccactccagtgttcttgcctggaaaatcccagggacgggggagcctgctgggctgccatctatggggttgcacagagtcggacacaactgacgcgacttagcagcagcagcagcaagtatactagaatgaaaatttgctttttgggagctgaaaaaagacatatatctttgtccatgtccatgtctatatctatacctatatctatatctgtatttatgtctatatatcttcattggacttaattactatgccaacagttttcctgcgttagtagttatttttattattagcatttaaacttcttctgttaatgcctaagtcttacaggtaacttcttgggcaaaaattactgtcagaattgtaaactgtattcagattttattcagattttggttttcagataaacttataagacaagttctatgcaattttttgagaagacaaaatagtgccgtaccagctgtcttaatgattcataaaatatttttccatctaattcaccagatataggtcaggctttctgagtttgctcaggtattatgaaaatcatagtcattaattatatatccaagtagaacttatttgtaattagagattctcaacatacctcatgaagccggaggtctttctcataaacaagcttttttacaaatgcagctataaatacaacccaggcaaccatgagcacgattggaagagagtaagagacactggtaaggaagctgtaaggaaaaacaaaaacaaaaattcagtgaccaaaatgaatgccacatttgctgattgtaatatacaaagaacacactgcctcttacactgaaattattaatatgactattttatttatgaagtgtgaagctgacttaacagtaggtacatgattttcttgccataatgctactaaagtaaaacagttctagattgttagataaaattgccaaattgtttaaagggtgtttaagtatgtcctgttcaggaaaatagttaatt

SEQ ID NO: 25142 - DNA, 1362 bp, Bovine  19866880704698
aatacatgttgcttctgaggtgctgtttttgcaaaggctctttttgacagtaaccacactttatgttcctgtcttttacaatattctataatttctaataaaacataaaataaatttacactcctcttttagagtcagcagttgtaggttctgctatcaatccctcaagttaaagtatattgtgtcatcaggaacaacatgatacagtagcgagtgcattagacaaggtgttagatattctggactgagttcccattgggccatttactaactgtcgatttggacaaggcttttcacggcctccttttcttgacctatatcacaagaataatcatctttgcctatcccatggggttgctttgcacatgaagtaataatgtaaatgtaaattgttagttcctttatagatataaaagaattctaagtggtttttaacactacactagcctttctaaattcagggtttattctatcaagggaagaaattcactgatagatatagaaaacaaagttactggctgtagaagaaatgggaagagtttttgacatcaaataggtatgatgttttagaaatggataatgtctccagaagctctctagtctcaagacatagaattgcaataattgtaaaattattatcagaatattagccacctgtctaaatttgatatatgttatagatttcaggtaataaaaactaaataaaaatcaatggtagttttaaatgaatgctatatactatcaaaattataggtacatatattgttaccaagatacaactattatgcagttctgataatcagatttatggtcgtgagttatttcctgaaaaaggttatttacattcttaggtaaggagaaatgcttaggcaaaagtgttttattcctattccttacatttttttttaaccttatagaatagaaagaatatcttcttgaactgttcttcataattgcatactcttactggtattgaataatcttaaattgcaaccaaggttaatctttacattggattctcagtcatacatagattcaccttcaagaattaaaaagggggagtttgatggcattgactattgaattcacaaagtaatcacatgagaatcatctaaaaaatgcatgtattcttgttcatttcagtgtagtaaaataggtgaatttgaaatttggatctgaacttaaaaacttgcaagactctaatggtacaggaaatatgctctcaaaagtagtcagccatcagaggtcaactcaatatgactactgctactgctgctgctaagtcgcttcagtcgtgtccgactctgtgtgaccccacagacagcagcccactaggctcctctgtccctgggattctccagg

SEQ ID NO: 25143 - DNA, 969 bp, Bovine  19866880741561
acttgcagcctccaagcccatgagaaaataagttgctattttttaagccaaccagtctatgatattttgttatggaagcccaagcagactaagagagtgtgtcatgctattgacccaaaatgctttttaagattctgaattggtcattgtcctggatatcttctacatgctcctgtagattcactctccaccattctccctcctccagttatgctaatttggatattccatctgttttctattagcaaaactgatgatatgattatcaatatttaagaattgagagattttgcatgaaaataaatctggattttcagattctcatgagaaattagaagatctggcaacagtgttggcaataatacactggcaattcccttttccactgggcgttagctctcaagttggccatgcttcactcaattactttaccaggctggtctctgcggccatctgagaatactacccctatttctcatgagatgatgtgatgagctaaaaggtccagatgcttggaaatctcttttactggctgctgtaggtgttgctggtaacagctcacgattgcaacctcttctggagtagtgttctatccttgggacaatacttgaagccacttggcttgggagtgcctaggaatttgcctccttcccaagacaagaccagcaataaattctaagatggacacctccatcctgcaaggagcaatcatttaccctgatcaggatcgatatgtcttccagagatggacttgcttttactatctacggtgcctcggccagcatcagtctagttcattaagtaatcctgcgtaacattacttggaatcaagggatgtactttacagtcaaagaggtgcaatggtgaacacattggtgaacacatagacatggggtctacagatcatgccatacactgcaccatccagaagctacaggtaggagaagaagtagaatgactttttaaaga

SEQ ID NO: 25144 - DNA, 2007 bp, Bovine  19866880753796
tcgaaaaacaattaaaccagattgcatttcaacatttgcagacagaaacaaaaggttattcaaggagaaaatagctacagtattgaaaattattcttataacataaaagacaagatgctgctgtgtcatttaattgcttgtttgtctgttcatgcacaaaatcccaacaaagtattcttgaaccatacaggattctaaagcctaaaaggtcttaaagtaaggagtgaagttcacatcagttttttttgttgttattgttaaggtctgaaaataagtagttagaaacagcagtttccaataaaaggatacctctttttttttgtttttaaaggaaaaaaattaaatattggaaattgttttcattaaaaatcaagcccagataaaagatccactttcaggaataattattaattatttgataaatatttatcttttgctaaacaaatgttaattttttttttaaatggcagcttgccctaattagagattgcattctatcctctaagtagcccacaggcactgctccagggggtagctcaaaattaatatccaaactaactggcactgtcttcccagtttttatgttactaataagatgggcagtgtacaccaggaatgaaaaatcagcaaatttactggttcatgcttgagttcattcagtatttccaaaaaatcaattaccgacttaaaaaatgcctcttttttttatctcctattgtcattagtacatttaaaaaatgttagtattgtacaagtatgtttgaatttcataaacactgtgaggcaatatatataaatatatatatatatgagtggtaacttagaacaaaaggctttgttaaggatttgctcttgtgaaattaaatgtagtacatattagctaatagctcttccatatgtatcttagtcaactgaaaggtcacatcagcaacagcatgtgcatatactttctacaatattttttgaatttttaatatttaaattaagatcattttaattttagctcctagccatgaataactattacatttagagcgccaattttttgtatgtcctctaatttctagtaggtatgtgtatggatatataaacatctacttatttataggcttccttggtgactcagtggtaaagaatctgcttgcaatgcaggagctgcagaaagacaagggttcaacccctgggtcaggaagattccctggagggggacatggcaacccactccagtattcttgcctggggaatcccatggacagaggagcctggcggctacagtccactgggtctcaaagagttggagacgactgaagcaacttagcatgcatatttatttataattttatttgcttctctaataattccaaaaagtcaattcattagtcttgttatggaacaataaagttcaaaagttaaataacttacacaaggttatccaaataaataaagctggttgtgtctaatttcgaagtttctgctctttctcctctacattttgactctggtgctttgccccaacatggcagagaagaggaggacagaccatttctgcactgagccacagccattgttagcttgtttttccagctgtgtgtttggccatggtgggatggctgaatttttctcgtctgtgctttgtatacataacagctgatatacctcaggcatttttatatttgccccaagaatctcctggttctcagactttgaattgtttctgaatcctggtgagtatggagaccaggtaaacattctaagactggagatttctgccagccttcgcccagcttggtctgtgcttgactcagctgatcttttgtctcaaagtaacaccttcaaagactgaacatttggcaagctcattgtcagcattattgttattaatatagctaataaaaatgtcagtagacataattcattttttctatcaaaatgtgaccccaaaaatgacacctgacccccatcctctatgagatcctttaaactattgatgaagataattttacttca

SEQ ID NO: 25145 - DNA, 1362 bp, Bovine  19866880766218
atagtttacttactcatctgaatatcctgaatttgtttcagctacttcctattccccatgtttcctcttaaattacctgagccatagcttcagacaaaaaatatttttgagggcatattattatggcaacaaattacctggtataaatttccttaatgagacagtatatgtgaagtgctttacacaagaaccagcacatagtgatacccaacccaggaatcaagtggaggtctcctgcattgtaggcagattctttaccagctgagctaccaggaaagcccctaatgagacctcagtaaatgcttattgcaataatgataataaaatgttatacacaattggatatgtgattctaattgggcagtagcctttttcacaatgattctcttaccagcaacagaatggaaggtttccctatcaaggccagtgcagtagacaattttctttttgtgccgtaactacacatagaggtaactttgtccctgtagggcatcaggtgaagtctcccaaggagtttttgaacagtctgcgggtggaaaaaaggacttgttaattttccctcgccaaaacccttaaagcattaaatggaaaaagagctacttgtgaaaggagttttataatgaagaaatacacattttagttttatttttaaaggtacacttaaagatgaaccattcatttaaagataaacgcaattccgtggaggcccattcataaatacgatttcttgtccccctaatacatgtgcgtgtaagtgtgtatgtgtttacaatggttctttctgctgtattgacacaggatttacttttaagcttcaaagggctaaaacagaattcatccctttacaaggcaggtttcttattgattgtcatcactgtttcatcttttttcttactgtgggatgagctgtcacaaaggctttaggtctatttaaaaatgacccagtatcaaaactgtagtgtattaacttaggaatcttgggttcttgtggctatttcagtagttaaatagctctggcaaatagtggaatcctaggaggatttaagaattccccgagggttgcaaaaatagagaaaactgtccaaaagattagtctttccattaaaaaggtaaataattgtagtgaggtataaaagcacatctcaaaagccaaattggaatctattctattttccttgggcattttgtacatgcccagtcaactactcagttgtgtccaactctctgacaccctatggacccaccaggctcctctgtccatgagattctccaggaaagaatatgggactcagttgccattccattctccaggggatcttcccaacccagggatctaacccacatctccaggcaaattcttta

SEQ ID NO: 25146 - DNA, 2154 bp, Bovine  19866880801685
ctgtgacttttctttctcatgtcctcaggatctggctccttcactgatgtccgaacggccatctaccagccccagcctcatcctcagccgcctccgtatggtcactgtgtcacagacagcggtgtggtttactctgtggggatgcagtggctgaagacacaagggaataagcaaatgctttgcacttgcctgggcaacggagtcagctgccaagagacaggtctgtgttatcttttttaaaaaggggaccaatgactttcttattatttagactttgaaaggcaatacattcatttaccaaaaaatgtaaaacaataaaacaagaaaagtttataaccttaccagcctatgataacaaccatggttggcatttgatatctattttttcagtctttttaatctatgtgttttctttcctgtagtaagtattaagctactgtgtattttttatctgtctaaaatgttacaagtggttactttctgagtaaactaatccgtccctatttagtactctaaatcccaaagttctgaacctttgtgatgtaaacttctttcaacaacctggtgcaactcttccgggctataaaagtggtagaaattgtagcaataataattggtgcacttgacttttcccctagtacagcttcttgtattaattcttacagcatcaacagagccatatataccccctgcaggatcacttgagcagcatccttaattaacctgtagtaatattttgggttggccatagttcattcgagtttttcagtaacaccttagagaaaaacccgcatgaactttttggccaactcaatagctttgcaaatggggaactgaggcatggctgctgaggtggtaacaatggatgtcagaagaagaactcgggtgttgttctacccacaaaaaaaatgtggctttctgagtaaggtattttgataacactatgatctggttaatacttatagctagtcatattcatagtactttttcccccctttgaggacacaaggtcagcctcagttaagtggaaaataaggaacaatagtgggagacaagtgcaactctgtttcctgagacccttttggttatgcttgtagctgtaacccagacttatggtggcaattccaacggagagccgtgcgtcctcccgttcacctacaacggtaagactttctactcctgcacgaccgaagggcggcaggacggacacctctggtgcagcacaacttccaattatgagcaagaccagaaatattctttctgtacagaccatactggtgagtatcccaggggaaaacacaacagtgagaaaaccccatttctcatgctctgtttttattggccagcaagctgggcgttcctttcaaggctacacttgagaagtaccacctttgtgttatctggacccaagggacatggatggaactaactttacagttaaagatcctcccaagtttcccagtcgtcttgggaaatgacaccaaggggaaagccctccagtgcgtttatttttgacacattgggatcattatgtgattaaagatgcttgtatgggaaaatcagtaggcactcccccaggctgaagactacatagaaggcaggcctgagtgctcttgcttttgttttggctaaaaccatgattttttcaaagcgactatttaatctttttctttttggctggaaaaatgagagcaaaattggatttaaatctgcttgaaaggtgaaggtgaatacactaaggaggcttagaactgtattattagacatcttttattctgagacacactctgagttagttgcagaaacttggctagtctagtcgcagtaattccccactgtacattgggaagctcagttgcaatctttttcttctgacatgtgtgttgtgttggacagttttggttcagactcgaggtggaaattccaatggtgccttgtgccactttcctttcctgtacaacaaccacaactacacggactgtacttctgagggcaggagggacaacatgaaatggtgtgggaccacgcagaactatgacgctgaccagaagtttggattctgccccatggctggtaagacgaagcccttgtaggcagtcgtttgtggtgtaagaccgaaaaataatgtttggcttacttctgtttcacgcatta

SEQ ID NO: 25147 - DNA, 667 bp, Bovine  19866880805493
cttgaactatcccttatctccagacagcatctccctatttttgtattcctcttgtatgtaagatagaaatatgcgtctgcaatgagctcagtgtctagatataaccacttttactaaacttctgttacctttagtgtaaatccttaaagtttgttttacttttctccttttcttcctttttaaaacatttttaggggactcattgcctcaatgctttgacttttctgactcaaggttgtttttattgaattatttcctgtaatctgtaccctccatgctgtttctgattctctctgcaggatttccctcttattcctgacatttgccctcaggctttgccttttatgttttctcctttggttgatacaatgaaaagagatatttatatgcttgttggttcacagacttcctcaggatcttcctgagtataatctaagatcacccccatacttggagggcagggagagactgaagaaagaggcagacccctgcaggttggtggtggcaggattgataagcaagggaacttgcctaccaggcttgtcttgggtggttgcaggatgagtagattgccagaccctcccaccaaatcttaaaatttttatagagaggccttaactgggttctgttgcatgtaacatttagatggtctcaacaacacactgct

SEQ ID NO: 25148 - DNA, 1497 bp, Bovine  19866880809153
tgacgaacaagggaggcctggagtgctgtgattcatggggtcgcagagagtaggaaaggactgagtgactgaacctgaacctgagactgttaaagactaaccctgctttctctccacttaccctgcctgcctttttaggatattatttgtcattcactctaaagcatcattttggccaacgatgttctattttgagagacagaaaatgccattttggaggctttgaaaagctttttttgactatgcaattatttttaaatgcacattaattgagaatagccagaaataaatagctagctaaaaaggaaatttccagtggtgctatgtagccctcaggtaaatttgctaagactctactgctaggagtgcagatatgtatgagtacaaattctcttctctgtacccagcatcatcccttctaataaggggaataagcataggatgtttattcctatgacattctctttcaatgtcataggaataaactgttcacaaaatatttttcttttccattctccacccagataatccatagtgtatcttctatctagatccatataacactggagaaaagattgttatataaagtgaagagtaggctctctatttggaaaggatttctaaagaatgtggtggtggtctgtgctgtttctaactggcagtgtcagggcagtggttgtggtgcagaggagtagcgtttggtcatatgagatcttcagtccattaaggaaagcataattgagttgtgtcgctgataacaacacaaattatgcaaactaacttacatattaaataatcagtgctatgagaagttgtaattatttttttctacctcactttgccaaactgacttttgaaaattcaccagaaatgaatttgctgtattttcaggggagccaatttgtatgcttgcattgactggtttgaattgtaattcatcttatgcacacatccaattactccttatagaaagggttcagaaaagttcccaacccaccagagcaaagccttgacttgagaaaagatgaatactttggtgtgtttcaacttttttcttaataaaggaaaagaaaaagtaaataccagccattctgtaacaaagtatcatttttcttcaagctgaaatgacattagaaatttttgaactttttaaagaatttgtccataattaatatagtttctctctaatttttaaatattgtctcaaactttaagaagaaattcaataatactctaataactgggataattctcctagaaagacatggagtaaccctaaaagtgaaccagagtctaggccaggttagatttctgggatccagtaaagatttagtgtgaaccagtcagaagttatgtcagggaagctgtgagaaatgaattgcaatttattggtaactgagaagatgggatttaagtcacagtaatatactatgggattggttcagaggttggcactctatttagttctgaatgactacagtaaagcaagctagaaaa

SEQ ID NO: 25149 - DNA, 1544 bp, Bovine  19866880827826
accctacctgcatgtgtgctaagttgcttccttgcatccgactctttgtgaccccatgggctgtaatccacaaggccttacggaattctccaggcaagaatgcgggaatgggttgccatgccctcctccaagggatcgtcctgacccagagatccaacccatgtctcttatgtatcctacactagcagacaagttctttaccactagcaccatgtgggaaaccctctccaacactaccccaaagtaaaagaagtgggaaaaatgagaactatgccacttgaatacagtagtcaccacttatagtttatatgacattttgtcattatttttgtaaaataaagttaccagaaattaagtgtaattttatttaaacttttttcttttggcaaataaatctgtattaatacattgcagatatgtttcataagagattcacagagcaattctaattaaacctcttgaattcctttcaagtaaattttagaagtcccctttaaatgtacttggaaagagaaaaggaactttattgtgatgtactattccaagaaataaaaagaaaaacaataggatgtgatgaattgagaaaccaaatcacactctttcaatggaatgtagcaaagatcaattgactagtaaaaaattaggaaaaaaagagcttgaacatacacaaggcataatggaaaccaatcagattaattagacatcagtcttattattacattccacagcaaatgtagaactaaaaacaataagacacctgttttgttcaaaccaaagctggattttacagacatggtttgagaggcagagggcaacatcaaatcatctctcttcatttggcttgactcactggagaagcatctagatattctgaaggtgggacaattccactcaggaaaaaagagacaactgaaaagagttcaacaatgaaaactaaacagcaaaacagagatgtctccttcttctgaacgcttctattccataatattttgaaagcatatttctcttttcgtaattttccagttttactcaaagtgaatataaaacaagctttaatgcaacatattattcaagaacactgtgtaagcaaggatttatgagtcctcaaaatgacttcctttattgtttccctcttttatatgaaaaaaaaaaaagaattctgagagttgcaaaggttgtttgaaatgacttgtttgttaagtcccttactataggaccagagtctaaacccacctatatatttatgaaagacaaaggcaagcttcaaagtttcctctaagcaccaacacgaatgcaattctggctgcatttaattggggattaatagagaatgcagaaattacagcacattattaaggaaccactccaccctctgaaagataaggtgcttttctgatgaaaataagcataggacattgaaattttctttaaaaacaaagctcatcctaatgaaaatagagaaataccatttaattaatccattaatttttcaagaatcaaggcctttttattcattattctaaaagtcaaaatctccatttcaa

SEQ ID NO: 25150 - DNA, 1401 bp, Bovine  19866880842977
ggaagatacaaaagaaaaagaccacacacaggaaataggctggatctagctgtgggcctcggagaaggcgatggcaccccactccagtactcttgcctggaaaatcccatggacggaggagcctggtaggccgcaggccatggggtcactaagagttggacacgactgagcgacttctttcacttttcactttcatgcattggagaaggaaatggcaacctactccagtgttcttgcctggagaatcccagggatgggggagcctggtgggctgccgtctatggggtcacacagagtcggacacgactgaagcgacttagcagcagcagcagcagcaggtgtgggctgcagtgggccagtgtatgactcatgtatccttattttttgcttcttcctttttccttttttttttttgtttcttctcctctgtatttcctaatcattctctctctctctttttggccttccttcatttcactgttattctatgtcctcccttcttccttatctctcttttctttctttaaagatcatagccattctattagtttagctaaatgcttaggtggaacgatttcttgaaacacggattcaatcctggggtgggaaaaatatatatatatatacatatatatgagattaaaacaatatttgaaacatggagtcctaatgttattattttatggcctgcttcctattccttcatggacaaagttcaactgtaaaagagtaaaaatgacttataggttggtattgacagaagtcccattactaatatgtgcaagtatgtgggtgggtaatggttattccagtcgggctatttattttgcattaatttgtaataattgagcccctcagttgtttattctttcactccttcctgcaaattcagacacctacttgcaaaaattatcttgactcactaacaattttggctatgctgaataatttttttttctaatttccaaccactccaattcatagctgctaattttaaagatggctttattcaagtcttcttattttcacaacactctcataaacaatttgcctcagatctaccaggtttgagcaatagtctttaaaattcagttaccaggggaatttttgaaagtacagacactacaaagacaaaagtacagacactacaaaaacaaagtaacctcgacaaaaaacctcctttgggtcttgtcaacaaatgttcagagcatgttttctttaaaacaagcagcattttcccccaatgcagcaaattagagaaatttctactttttctttctttctttacaaaattaccaatttaaagaatatgatagaattttactattgtcagaagttgtatagaattatacccataaatcgaaaatgttgttgctttctttctttttttttttttttttt

SEQ ID NO: 25151 - DNA, 811 bp, Bovine  19866880860093
aaaaagaggcctaactatgcaataaaatcacccagttataaatcatcacattatttcagggattaaataatatagaatatcaaatcatttaaactgcccagatagagtaatgcataagccctctctgtataataccggaagcatataatgcattatgtttctgccaattgacactcataatggaattctattgtataagtgtcccttaaatttaagaaaacaatcccttaggcacccctatgagataatagatgtaaagtactttaaaatgttaaaaagctctatgcaaatgttacgcattaatgagctgaattgaaatcaggccacgagagaaagatactatatattttttttaatatatacttactatatatgccattgtcttcaaaaataggaacagtgacaatataatctttactgtttccccaaactaatacttatttctttctttaaattccaatttaaccccttgctataaaaataagcctctgctgatcctatctgcatactttccatttcagacgtatatttttaatttttacttaatcttgacctacagtttgattttttaatcatctgtcaggatctattattgcttgtttagttctccattgctacatttctaattttatgcctgaataatttttcaaaatgtcatttactttaaaatgtaatttatatctttctatttggcattttctgcaaatcttacttttatttccccaaggagtattaaatttcaattaataacataaaactgaaaatgcacttcaataatattaacaaaaaaaatgcattctagcagcagcag

SEQ ID NO: 25152 - DNA, 2174 bp, Bovine  19866880862257
ccctgtctggcctaggattctattgaatatttagagtgggaaacacccatttcagggtacatttttttttatccctgtcatctcaaagtagaacaacaaccttagggaagagataagagtgtgcgtctggccggtcgaaaatgctgtcttccatgctgctgaaagatttacagagtatagtagaggtcttcagatcctgaatccatacaattcatcttctgcttttaatttatgctttgaagatttacacaaaatggaaagaccaaataactcactttccagttaaagcactcacatttccatctggcatattgctctgaatagcatgtctgcattacataatagtacatttttcataccaaggctcgtttgtgatcaatttataatcacaaatgtcacacgatgtattgaaaagaattcagaattacacatggctgctatatttacctccttatatttcttaccagaagtgttttccttctgttagttacctctgcaaattatgaggaattgttccaaaaatatccacttgaagagccagaaacttcacaaaactgtaaaaagactttgtttaaccatcacaatagtagagcatcttttaaacttttccttatctttatgggtgtattttttctttctccctctctttctttccttccttccatctttttcttctttcttttttccaaggaagttttctctcatcacatttatttattttacatttcagcttcatgatggcatagttgacaatattttaagatatttaaagtgtgcattgtggtgatttgatatctgtatacattgtgaaaggatccccccatctggttattcaacccatttggggatatattttcaaatctaaatgcaaagttgatgacagataaccaagaatttttataaccaagtctctcttaatgcttgaaatttttgacagaccagcaggaagagatatgagcatgtgggaattgttaaaatgggttaggctgatacatcatgctaccacaaactctatctttgattgtggcagtcatgtatgttttctgcaaatagagttctaatcaccctacagaatttcagtcttaaaaagtcagagatgtgcccaaagctttctcagatgtcttctaatcaacacaggagagaggtgggaaagccgaaatctcattcctgatcttccagagtgtgttgggctaacgagcatgatattgattttcttgctttaagtgcttcactttttaaaatatttccaaataagaaaagattttaattataaaacagttttaaaagagcccatacataagacagtgagtgcttttatttttatttacctaaattttatttacataagacagtagttgctcttatttttatttacctaagattgctaacaatcattcagccacaaaaattttattgactgtccattcaataaattattcaaataaattgctgctagggatctagtagtgaaccagactgggtctctgctccactagacatcaagtgggagagtcagacattgatgaaagtaattttaagtgccacaaatatttcaaaaggcagagtagaaagctctttggcactgaatgttagggtgtcctaaccaaatgtgggcattcagggaaggcctagaagaactgatgtaaaagttaaatctcaaaggctgagctaagtgaagagttggtgcattgtattccaggcagtggaaacatcactaataaaagccctgaaggggaggagaagctaatgcatttgtgggattggaaggggatcagcatagctggagtagagcaatgcttcctggtatttttcacatcactggacatgacagtcagtggaccagcctgtgcctctgagacctcgatatcttggtatatgtgccatcagtttgtggaagtgctttgagtcttggctaaccagttgggaatctcaagcatggcattcaagagagaacttggcatgaaaggatgctgatgaagtagacaaggaccagattagaggggattgggtggtgagtgagaggtaggaaaggcggagttagaacaggccacacacttaagattggctaaggtgacggaggcctctctgagtgtacttgattatacgaaggacaatggagagttacagaaggagagaagttcatctagaaaggggagggagtgatcctaaaatgt

SEQ ID NO: 25153 - DNA, 1140 bp, Bovine  19866880901919
tccaaagaacatttcatattttcagactgtggtcagcaggttttacgggggactatttgtagcttcttaactaaaagttaaatagatcctttattaaaaatgaattcctggattatccttgcaggaaacaagatggtcataagccacaaagtcagttttgaagtaaaatgctatagaaattgaggttgtttcttacaccttctgataaggaatgctgcaaattataagaacagactatttactgaaatgagcataaaaatagccagacaggtattcctttgcttttatagacttcaagactccaaaccacttttagaagtcaaaaataaaactgtaacatttctgtcaaatcttaatattcaagtaatgatcacagcaacacagaatatagaatttgataatgaggaagaagatacaatatttctaagggagtgaagtttaaatgcagaatgcatatctgaaataaagttattattttgatagattcagtactttactgttgactgaaatcagtaggccggccgcgattagcagacatttggtaccgtccaaaaccttcataagacatttggtccttgccaaaatgtccttgaaatttggttctttccaaaacttccatgagcatgtttggtctatgccaaattgttttggacaggatcaaataccaagtaccttttgacataaaccaaaggttttatggacattttggacaggaccaaattgttctgaaaataccaaggaccctttggcataaaccaagtgtcttatggaccagacgttttgtgggcactttattcaagaccaaatatcaaagaccttttggtgaggaccaaatgttttatgggtattttggatagaactaaatggttctgcaaatattaaggacctttcagcataagccaaatgtcttatggaccaaatgtctgatggatcttttgtacaggaccaaatgtcctgcaagggatatttgccatatgcagaggatatatgataggaaaagaaatcccacttgactctagaagagcctttctgtattataaaatacttacaaagccagagtgattctcaagaatccatatgtacctaaggaaaatcctaaatgaaaaattatgggggacatattcccaaatgagcagcaag

SEQ ID NO: 25154 - DNA, 1290 bp, Bovine  19866880939127
tatccttgttaagctttattttttaagtgacattaactgaatcttccctcttatttgaaaccagctgtccctcctcccactgatttgcgatttaccaatgttggtcctgacacaatgcgtgtcacctgggctccaccctcatccattgaactgaccaacctcctggtacgctactcgcctgtgaaaaatgaggaggatgttgccgagctgtccatttctccttcagacaacgcagtggtcttaacaagtaagcattcaagtgtatttgttcaataaatactaggctagcgcataaggaaaagaattttgtgttctcgggtaggagcaacagagattaagacagataaaacagaactacaaactagattccaaatctaatgcacagctctgtaattctgaaagatgttacatttgttgttattttaatatatctttgatatctacaactttttaaaaatcagtggagaaataccaactgtgaagttcaaagacttcaaacaagttctgcttccaaataagcacattaaaaacaaatgtgtgccaagagacgttacatgactaaatctcagtgtttagtgagagaaaaaaatgaggattgaagctagtgtcatggcatctgttttattctcatttaagtgtcagcaggtaatctgtttggtatttgaaacttagaaacagtgactggtcactcagggtagatcaggattttattttgaagaaggagccagaagtttaatttgtacttcaaaaagaatctgttagcaggatttctctgaaggcggaggacttttgaaaataactgacactaaaataaacagccacagtttatggaaattgtttctttctagttcctacccttttgaaattgatattttttattaaagaaaataaaaggagactgctacatgttgcttttcacataaatattgcttctcattatttttgctataatagtaaaatacacatataagaacagcaaacatttttacataagggaacactagctcacacttaggtacactacctaatgatgggctgaagacatcctccatctttcagacgtatttttagagaatgaaatacaaagaaaaagcaactcagcatgaccatagtcctggtttctcattttgtggctgagggtgagaaatccttatgtctgcctttcagtggggctatgattctgttctggagcattctggaatcagtagttacagcatcacccatacacaaggctctgcttcaggagcactgtctgtcccacattagccacagacctgtcacgtgttcaaa

SEQ ID NO: 25155 - DNA, 916 bp, Bovine  19866880987553
ccaggggatttgagaatctaaatttagctgagacagagctggtatttgtgtgatatacccactccccagacatacatatgttcaagtcatctctgtaaaatatcaaataatttctatgtcaccctctaagatgttcatacacacaagtggattctttttaagaactggccatgtgctgagattttcattagaaggagtaagaaacaaatgcagatattgctctggtgaacctatacagggacagatttagggtgcatttcattctggttacgcatataaaattgtgggagatataagagatgctggctcaatccctgggttgggaagatttccctggagaagaaaatggcaaccctctctagtattcttgcctggaaaatcccatgaacagaggaggctggcaggctatagtccatggggttgcagagtcagacacgactgagtgtctgagcatgcacatgtgcacatacataaaatacatgattttaagttgtgatcaacaagatggaactgaaaaaacaacagccatatattagactaatcttaatctatttcttctcctctttccttaacactttagttatataaaaagcttaacccatctgtgccaagtttctccttctgttatcagagtctaacataattataacatttgcttccctccttccttcagtgatcacactgctcttcatcctctcagtgcctcggcagctcttttccacctttccctgtctcctttgtctgggtgtcctcccacctcccagtaattgaaggctgatgtcatctggagggaacatgcaatctctattttcagagctctgtcatcattgcatccatttggcatcctgtcatcacccatctcttgtcagttaatacaggaacacaaaccttcagagacattatgcaaatgtatcac

SEQ ID NO: 25156 - DNA, 1951 bp, Bovine  19866881031395
ggagatggcagagaaaagtcccctaatgcttaactgcttccagctgctatcttagcatccagccaataaagatttataaacagtacattctttgtttcatgctgaggtccctcggtacgcaaaaaaaaaaaaaagataaaattcgacatggttgctttcagcctaagacaaactaataatctatggaagacaaagaatgagaaagtaccactcagaaagaattagtatcagaattaaatggagtaatctcttacagccatcctgatgctaatcagccataattttgttgttgttcagtccgactctttgtgaccctgtgcctgcagcacgccagccaggctttcctgtccttctccatctcccagagtgtgcttaaactcatgtccattgagttggtgatgccatccaaccatctcatcctctgtcgtccccttctcctcctgccttcaatctttcccagcatcagggtcttttccagagagtcggctcttcacatcaggtggccaaagtactggagcttcagcctcagtgtcagtccctccgataaatattcagaattgatttcctttaggattgattgggactgattggtttgatctccttgcagtccaaggaactctcaagagtcttctccaacaccagtttgctaacaaatacttctgctaaagcatttaatctgtacaaatataatcaacaaaagtatacttttttttttctaaagttgcaaatgtatagatttgccaaaatttgctaaagctctcctaaataaaatcagtgctccttctctttttaagaattgggagcaaacaacctttcagacatgattaactgtgagagccagattttatagatgtgaatactaggcataggcatatcataggtgtatacagttccattgtgattaagtaaaatcagcaaaatttgtttcacatgttgaagattaagcttcattataattgggttaaatgatagctagacataaatagctactttttaactttaattaccactgttggtattttactattgttctacataaagtctgttgtctaattttggcacttgttccttcatttactcactcaatagtgtttaacactttccaagtgccatgcactgtgttagacaatgagagtacaaacaatagtgtagtcaagatccctgacttctgcatttcagttggggagacaaacagaaagacaaacacactattaactaagactgctgactttcaaacagagtttcaggatgaaaaggagtcagcactgtgatgaactaaggaaagaacctttcaggcaaccagatatgacaaaggctcttgtgactagacttaggtaaaggagggaggtgggaggaacgctgtaagatatgggcaagtttcgattttactgcaatacaataggcagtcactgaaaggtttctatccaaagagtatctggagataacctctgtttaaccatgattgtttagcagctatgtggagaatgggtttgagagacactttatttcaaaaaagtaatgatacagattcgatgaatattttagtgattcaggtggggaatgttgaaaaagataaattttgcagataggaacacagtatttcttcaggatggcccccagatttctgactttagtaattagatagaaaatgatcctaccaggtcccgaggttgtgactatcaggtcaagataaggcagatgagagtggagatatctagaatgccattttggatgagttattcaacttgagataacagtaggcagttggttgttcaagtctgaggctcagaatcaaagtccagactagagatataaatgtagaaattgtcagtatatagataatatttaaatttatgtgactagcagagatgagctagggtgaaaacacaacaaagaggaaagagggaacagaaaggagtccaaatattaataaatgtcagtattttttagg

SEQ ID NO: 25157 - DNA, 698 bp, Bovine  19866881064763
ctggaatcccacttcatcatccaaatggagttatcaggtaggcaagagatactctttcctactccatcctcctgctggatgtgccccatggaggagacctatgtttctacatagaaacaaaatccagaccctaaccatagctgcctcccacagtccccagcgcacccaagtcacaaggtaaattactttcatatgtgcttaaacttcatatcacagtttgctcatgccagataatcacagtcgtaacttgaaataattaaaaggttgattcaaaggaggctatattaaccctgtctcacagacaattaaaccaagacattcactcctttaattgatttcctcttgaataagaaataagatgagatgaaaatctctaacctctcagccagggctttagtggatataatttcatagcaactgttatggcttgaattgtgtccccccacataaagatgcttaagtcttaaaccccaggacctgtgatcttatctggaaacaaggtcttcgtaaatgatctagggtagatgagatcattagggtgagcactctaatccaatataaccagtattcttagtcttataaaaagtggacatttagacacaaataggctactctggccacctgatgtggacagcccactcatggaaaagactctgatgctgggaaaaatgaaggggaaggagaagagggcgacagaa

SEQ ID NO: 25158 - DNA, 1913 bp, Bovine  19866881066013
ttcttttataggctttatccacaaaaggaaactatgtaaaatatgtttcatgttaaaaagtaaaaaagataacagtggtcagtaaaagactactaaactctctgttctaatgcaatgaatgtcatctataagaagcaggtatttataagaaatacaaagatactgatctcatgttaatagattttagagtcttagtaacatataacataaaatagcaaaattcaaaggtcagcttatagataaaaagtacgttttacttgtttatgactagtagttacttaggaaaaagcatttactgccaagctttatacatgcaatttaaatagaaatacatttttagtaaattatgaattcctacaaagaaaattttatagacactttctttgtgtgaaataaattccacagtaatttataaactaaacttatattcactttttgaatgctttttaacatctatttttcaagttagagtaagatttgtggaaagcttttaggaaatcgcaagctagttcacagttgcaatactactgctgaaaaagtgttaagttaggtccttctgtaattcaaaatgagctaaaaacagcaattaatgcttatctagaaattatgggtctcactatttctttgtaatgtaaatgagatgcattaatagaaatcaattcatgaatacgaatttaatagaaatcaactcatgaatacaatcctctattgtgatatagacatgaaagagatttaaggtcacttcctgtaaagtgttgagcaaaagacagacatgaccaaaaattactgtcaatatttttccttctgcggaattgagagtgatttaagaaaagttaaaaaaaaaaaagctatcctgttctgcagaagtactttaatctgctgttgtcaacactcattacttccttagctttcttgtcctgttggtttctattcaactggtagatgtttttcttccacatttaatgctgtcgttcgatgctcaaagtatcgggatgtagacacaatggctgatttttttcttgccttaactagtatttagtaaattcatttaattcagtagcattcaattttcgaataacttgggtgtcttaaaccatgctactcaaagtactggtctaggaggaaataaggatcttggtaacatatatcatataacccactgcttccttcatcaagaaaactttgcttcaaaaaagtattaactgaacagtgtgctccttgatccattctggcataagctcattagtccatgtaacaaacaactcacagagcagcagtggatccatggatcacactttgagtaggaccactttaaatatctctttcaaattaaaaataattatttaaaacttgtacaaaatttttaagttaactttgttcttttttggccacactgcacagcttgtgggatcttagttccctgaccagggaactaggcagggacagcagagagtcttaaccactggaccgccatgaaattccctaagttaacttcttaaaaaatggatgaaggagagagaatgtaaatacagatgagacatcaccaagaaaagacatttaaatgttgacttacgagtggtgaagactccggtgactctggggctctgctgattgcccttcacggctacgaggcttacagcatactcagagccaggctgcaggttcctcagtgggtactgcgaggctgcgggccccacgttgtactgcttgggctggcctcccgggtcaggcccacggtcagtcggtacccaactatccgggcgcgaggtggagtccaggtcactataacccgtggtatcagtttcattgataaactggaggttggtgggagcatccaattctagaaaaagagatgaaacatgtcaagaaatagctgcacttcagaattatcatactgaaatcctaaagcttga

SEQ ID NO: 25159 - DNA, 1123 bp, Bovine  19866881066289
tctttagaccctgagaggttcaactttactgttttggggattttcaaaaaagaaacaaaccaaaaatccctaaaagaatattgtaacctgttttattctcccagggaagcaaactattcatggtgcttaaaaagtcttttcagataatttggaacagattgcatattaccatcattgctttaacactattttaccactagtaacctgatgtacactgctttattttttcctcttttttgcctctgttttccttttgccctcctttgctttgtaactcaatagaggtgccccaactcactgacctaagctttgttgatataactgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagcccggcattgactatgacatcagcgttatcactctcattaatggcggagagagtgcccctactacactgacacaacaaacgggtgaattttgaaaacttctgtgtttaagacatggatggtgttgcatgctgtccccagtcactctggttaaatttggatgtttcaggggaaaacccagcaatttcccaaagattaagagagggtagatcagggggtaaggagtggaaggcatatgcttcactgattggatgaagacatatgccgtagtcttaagtacattttcactgaagccatgaatatgaatttgtataaagctagagaaatatagatacctaatctatcaaattgcagacctggaatttttttaaaaaatctaacatttataccaaattgtatcaagagcaccagttaataagaagaaatgtacttccaaaatgtaccattagactcttccttctactctttcataaactctaccatcttgtttgtgagtgtctaaaaactaattgaaatttaggttagagtggaaggagggtttttttgtggtaggagaaaaagagactttggtacattctaggttttaatgccatgataaggtgaagaaactcctctttaaccacagactggggaccagcatgcaacattataa

SEQ ID NO: 25160 - DNA, 1505 bp, Bovine  19866881118393
cctcgctatcagacttctagcctccataactgtgagacaataaatttctgttgttctcaaagtcacccggtttttggcaccctgttatggcagccttcagaaactaatacagtaaatgataagaacttaggtttcacagtttgcagaggcctagattcaaaactaactggaagagtaagagaggcatatttgaattatatagtaattaattttctccccaaacttagtaaagctattttctaagctttgtacctgtcaataagttatcctctttgaccttttagcttctgatttgtaaattaagacagataaaaggatcaaaaggagataatgtacagtaagtcattttgcagtccatgagaattatacaacagaaagtaataccagtatcaacatggccacgtgactattaccttagtaaaaaatacacttacattaaatgtgtgtgtctatctatcataagccatcattacttacctacagaagatgtgctcacatccgcctaagcacacaggctccctcagaatattagtgctgtttgaagaaagaaaaataatcaagacttaggtcactgttaaacattttttacccaacatttcacaagtccaagacccaacactactgtacttgtttctcaaaacataagatattaaggtcatattcatttgaaaggctgtaactccctgattaaatattgtatcatcacacatctgctgaattcaaatagcaactaccaaactcaggacaaactgtaacactttttataatgcatatgctgtgaaatcatagaaagaagcaactttgctcagtatctctttcaagtaaaaccaaccactggccacttctttcaattcatgattcaaagtgtagaccataaatctcaaaatgagactcacaaatagaatgactatacagtgaactgtccaaatgaaaatacttctgagagtaaagggtagtgataactggatagaatagcaggtggaaaccaagactgtcatagaaaaatagggcatctggtccccttgaccataaaaatttatggtttcccattaaaaaaaaaaaaaattgctttccagttgttgtcaagtagacatctatttttattctttctatttacaggaaattgttttattctttaaagcaactgggaataggaatcatcaggttggcagtctgcagaaaattaagtatccccagcattgtccatcaaaaaacacctgctaagtttgataatcctaagaaggtaaagctacttaactaataaacacagatcaagtcattaaaatcagagggcgtaatgtggcaagaaaaaacaggagaagtaaagctttttaaaaatgaactttttttggtttattacactaaccctaggacctttaggtatttacatcattattatccaattatctctgcacacatctcacatatcaataaaaatagttttctacgtttcttgaaagatcagatgcatcacactgcacattttaatagatatgaacattaaa

SEQ ID NO: 25161 - DNA, 791 bp, Bovine  19866881200399
gacatcacacaatctataaaccagctggaaggagtcatccagactttgccctgcctaaccctttctgggtgatgattagacaagtcctcatagatgatacactgtgtgcagaagtgctgatcagaatcaggtttggcatggtacgcgactgtattgatggtttgagtcacatcactgtctggcttgggctttctaataaggatctggcccccaccggcagcgacaagcttaataaggttgtcctttggatggttaccaaagatagatataaataaacaaaaagcacctaaccaagccaggagcttccctggtggctcagagtgtaaaacatctgcttgcaatgagggagacctgggttccattcctgggtcgggaagatcccctggataaggaaatggcaacccactccagtactcttgcctggaaaatcccactgacagagaagcctggtaggctacagtccatggggttgcaaagagtcagacacgactgaacgacttcacttcacttaaccaagccaaatgtcaagatataattgatagccactttaaggcaactattgagagcactataaattgcctaagagccaactaatgacttatactggaaaaatctgacttttacagactttttcagtatttttaatactgacaggaaagttgaagggctgtagcctttaaaagcaagatttcagtcattgagtggcatgctgaaaacctgcccatttttgtttctaacttaatgatatatcaagtcaaaatcatggatgatttttcctttggtgatcatta

SEQ ID NO: 25162 - DNA, 1057 bp, Bovine  19866881226464
acctcatcctaaactgttacaatgattctgcaaggcagtgtaattattcactgccttaaatattcagaatattctcttattctaagaataagaagctgatgctcagaaaatttaatagtttgcctaaggtcacacagctagcttcaatgtcaatagaggtttgactgattcagagtatttctgttgtgcctcatgaccttcccagaataaacaaggaaatgggtgatacaaggactacccttcttacccaagcagttttccccctttctgtcatcaaagtcctttataaaaacccgtcttctaaatatggaggattaaaaatgaaagaaaatgaaagggaataatatttaatgaacgcctacttacataaagctcagtgctaacaatttaaaaatttttctctacctattttaaaaatagtttatttatttaatgcatttataagtctacctcttttacatactgttgtttattacatacaaacagcagttattttgtattattcaaccagatttggaaatttgctctgccgtattttgaaaatcttcttggcacttttacatctgtgaagttaattgcagaaaaacgtgttcaaaaggtccagtgtgtctccagtgagtaatgccacagtcagttcagaaaatgaaaatagaagtgatagcatcatattctgttaccaccactgcttgaaagccagattttaatgagcccagctccataatctgcctgagcgtttatagaccttgggaggggaactctagagctttaggctaaagcagcagcagagaatgtctctcactagtgtaagaacagtgctgggtatggctgttctgagggcaggctcatcaactgtggcaacttgcagggggcaccactcggggtgggaatagagctggacattatttgccactagacattaagagatatgtaaaatccatcaactttttccaatttcattgtgggaaaatggaaaaaaaatacaatagccagttactacactgccagcatagaaaagcagcattacaaatacctattaacattttttgtgtgggaaatc

SEQ ID NO: 25163 - DNA, 1358 bp, Bovine  19866881255857
tgattgcctactgtagcaaaagagctagacatgacttagtgactaaaaactgttgaaagattgctaacctgtagtaacaaaaatctggaagattgtggctgctggtctaataagttccagtaagaccatgctttactgctgatatctagaagttctagaaacttctgtaatattaatagccatgcctcaaatgtcactgaagagtaaaacatgaatagtatttataaaacatgttaccctaccttttaaaactatttatacgtcgtttggcctgatttttccccccacataaaattgatagatttgaggggactatgcacaaaaaatccattgagaaacatgttgttggagaagtattcattttaatgcccatgttcttcaggttattggcatcggagcaggacagcagtctcgtatacactgcacacgccttgcaggtgataaggcaaactgttggtggcttagacatcacccccaagtgctttccatgaagtttaaaactggcgtgaagagagcggaaatctccaatgccatcgatcagtatgttactggaactatcggcgaggtaaaagggctgttattgagtggggtttaccctttcctgtgtaactgtcgtcatcactccaaagagaaaaggtatcaggttggccaaaaagtttgtttgggtttttctgtaagatcttatggaaacatttgaatgaactttttggccatcgtatttttcttgaagctttagattgtctaaaattactaatgtaaacaacctctgtctcatttacctctctttggcattctttacccctttctgacaccacagatcatgtcttcttagattatagccactgctttagttttgtgtacttgtacccccgctggttctaagttttgatggcagggactgttgttcacccatcttggatatctgtcacagtgccaggcatgttgcttgctgtgtgatggatgtgtattcaacattgcatacaggttacttgatagcaggtagcaaatgcccctgacattctccagaaactccattaacaactcagtgtacttgtgttatgtttcatgtgctttaatgttttctaccttaaagaaggtatgagggagcattaaaattgcaggtattaggtagcctgctaaaaaagtaggacttagcccagtttctggaaatacaagtgcttaatgggtaatggttacaaaataaaaattaagttctggtcttctgagggggtgagtcaactccactaggttgtccagccagggataggaatccacaatacaatcaacaagtgttgttggagaacatgccttgtaaccaggaggtgtttcaaacagtcttttttaaaaagacgttaata

SEQ ID NO: 25164 - DNA, 5841 bp, Bovine  19866881275880
actggtgtgagatggtacctcattgtggttttgatttacatttctctaaagtgatgttgagcatcttttcatgtgccagttggtcatctgtgtttcttctttggaaaaatgtctatttagatcttttgcccatttttctattgggttatttgtgttttttgttaattagttgtatgcactatttgtatattttggaaattaagcccttgtcagttgcatcatttgcaaaaaaaaataaaataaaataaaaagcagagatattactttgccaacaaaggtccatttagacaaggctatggtttttccagtggtcatgtatggatgtgagagttggactataaagaaagctgagcactgaagaattgatgcttttgaactgtgatattggagaagactcttgagagtcccttggactgcaaggagatcaaaccagtccatcctaaacaagatcagtcctaggtgttcgttggaaggactgatgttgaagctgaaactccaatactttggccacctgatgtgaagagctgactcatttgaaaagaccctgatgctgggaaagattgagggcaggaagaggaagggacgacagaggatgagatggttggatggcatcaccgactcaatggacatgggtttgtgtagactccggcagttggtgatagacagggaggcctggcgtgctacagttcatggggtcgcaaagagtcggacacgactgcacgactgaactgaactgaagcaactgaacgcacacacacacattacgaaatgatcaccatagtagatttagttaccacctatcatctcatgtacatacaataaaaataaaggaaaaaacaattttctctttgtgatgaaaactcttaggatctattctagcaacgttcctatgtgtggtacagcagtattaattaatagtcatcatgttgtagattgcatccctggtatcttataattcaaagtttgtatcttttgaccaccttcatccagttccccatctacccactccctacatctgataatcacaaatgttcattccaagtggccttttttagtgagtttcagataataagggctacataaacaatgccttattgacacatgtatttcctcagggagaaattgctcttttctcctgaaactttttttcagtgaacagataaaaatcccacacatactatttcattaaggaaagttttgctggctaaagaagtgaattaacaagggacatgatctatgcaaaatagttccaaagtacagtaatttggtaagaagaaaattctgtgaccatgttcataaatggatcatcattcaattctgtgaccatgttcataaaagtatcaccatctaatgggagtatctttattctgttctagaccaaaataagttattattcttaattattgaggaaaatttattcctgaaaatgtgtatagaatttgatatttcaagattttagtacatgacctggctttgccattgtgaaatcataggcaaatgacttaaaatactttttacagtttatgaaactctaaaatgggtctgttgataactgcttcacagacttgtgaagattacattgtgtggaagcatttgaaaataatattctatatcatagacaggactgattgtaacaggaacagtaagagaatggaaataatttgatggatcatctttgacttggaactaacatagtgctttgtttattagtaatgctctgattcagatttcctacaatgagaaaattcctagtaaataattagattttaaagaacttgggttatcattgtatatagttgtgtgatagccatctgtcttcatgctgccaactatacttaggttccttaggagctatatgtttagcaaattatattatatatgctatattaatacatattattcttaatcatttacttccatgataacaaaatgagatattggtaagaaggacagaataataagtggtactgaactatcctctaaaaagaaaacaacttaagcccagctcacataaaaacgaagtcatgaattcatacataagatgaataaacatttctttaatcaagttgaagtctctctcttcgactttccctttggcccttattaattgtacattcttaaggaatttatatagcttcttgagtcctagccttgtcatctattaacttgggatagtaatagtacttatgtctaggtattagggaaaactaagtgagaaaatcaaggtatattctgttagacagtacccagcacatagtaagaactcaataagtattacctagtagataacatcagcagtagaagttatgtctcctaatttgggagatagctataagagtctttatattttaaacacttttaaaaaaaaatttcagttttgccatcagtatggagtaattttaagttttatgatcagtttattttttctgtgttcacctagctgcacttattatagaataaaacaataccataataatttacgtttgactaatctggttagattctactttacagaaaaataacctgaagctggaaaaggctgagtgcttgctgaaagcctcacagctaggaagtagcaggactagaatataaatcagttgtgatatcacattccacatagacaccaccgtttttaaagcctcttttgtttgtttcaactgaacaaagtccaattgtgaacggttaaaattctataacgtatgttaaaaacaattgatacagtagctatgggggaaaagcgttttcagttaaacatggcttccctatgtggttaattatggttatatctggctacttctacatggtgacaaatttgtgtctatagaggagcaaaaactcagaattagcagtcacaaaccttctctttctttctcgaagatttgtatgggaccctttacaagatggtggactgagaatgcccagtagtgatacctcatttcattgtggtgttattaaagagacagtgattaaacatgttctttgaaactgactccctattattgtttgttagaatactctaaggaatccctttgtgcaagtttttgtaaaattctccgtgggacttgatgctgttgaacttttgaaacagatagatgaactcggtgagtccagattcaaaaaaacctttatttacctgtcatgtcagaaatgtgaaaagcattgtcccatataagatcttaaaatcctgagtatatctatccatctttctcctagtaaattgcacagttaaacgtaatgattatttggatacccagttcgtgtggttgttctcaataactataatgcaatgtattccgtgtaaatgcagcttgtccttcaatcacaggtagatttctaccagaggacactttttgggggtaacttggtgaaaagcaagtctttaaaagcagaagatgaaatggtttatttctgctacatttataattttatctccactggccttagtactgctttgactaactcagaatgtaaccagaagaggttacagagtgagaaaaacaaaagcaatgtggagactcaaaagaaaataaacctaagtcactgtacaaggtcaggtcctcctctcatgatcatttaaaagggacagaagaggatcaaagaaagctgtctgaacttatgcattccctctaccacattcctaccctcaacctaaggcatgcaagatatctaattcagtctgtgtctgattcctggttgctatgcaaccatgggtaagaggaagggattgaaaacatcagaatttgccagcagtagagctaatgcccctctttctcctctccagcactactgggacttaagtgtttaaattgtaaaccagtggggaggaattatgcctatttatattatatataattgtatgtattttatgatatcaaccttgtttgattaaataaagatattagtgatttattctctaaaagtatcatttgggtaaggaaacatttgatcaaaatatcagggataaactacaaagttcttatatactttttttcattcctaactttagatataggagatgagtctcagagtttaaaataagattaaaataaccatataagtgagacttgctatctgtataactgtatatttaatttaatatcaaagattttatactgtttgaatttggaggccactgactctttatagctttttgattccatctaccagcatttctgaagaatcctttgcaggtgtgttgattttcagtagccactggaggccactattcaaccacagttttacccctccccccacaaacatctatatcaagcaaaacattttaagttataatgagagatgtccttcaagaagctgccctctgtgagaaatttaatcttctattggatgatgatagagacatgtatgggttctgtaaagaggaatttatgacattcacagccttctcagtattcatgatcaagtcagcgaaaatttaattggccaagtgatttatgaacttacaattttatatttaccctttgtctcagttgatttcctcataaagatttatgaaattgaagagcaattaaattctttttcttccagagtaattacctgaaataaaatcttgatcatctagattaatacagatataagtagagataactcacagaagactttaaatcaaacaatatcagaaagttgtaactatgtgtcatagattgtcacagtctgctaagaagtgcttctgtattacaacttattaaatgatattttttatttgctccacacactctgcatagacgttcgttgcttaaattcttacatcaacactccccaaacaaagcaagcatttctgtttattcaaacttttcacctctagtttttagttttcttcctaaataattcaggtagaataattttaaaattattcacctttagtcttaggttaattaaattgtagcagagtagaattagcttttgaattagcttgtactgagcacacatgcatacattcttcgtatgtgagtttactgtatctataactaattcaaaattcttctcaataagcgtttgtacaactggctacatcttcccagatatagagtatttgacatttttagagtaaattctgcaagtttatattatttataatctagtttaatgtttaatacttaccaaaaaaatcagtatttttgtcccattactactagaaacaacattataatgtgctttgtgtcttttttttcttctttagatattctaaggctgaaattagagaacagcattgacctcattgatcaacttagcatactatcttccctgacagtgaatatttcctcctgtgtattatatgaccgtattcaggcagcagaaagtgtagataaaatggaaagagaggctaaaagactctacaaaagcaatgaactctttggaagtaagtgttattctactagaatttgagcttttctttgtactaaaattggccaaattcttcccgtcacttctttcatccagacctaaaaaaaagtagtcagggctggggcgagggcactgtcccctttgatgtccttggaaataagaacctttcatgtcgtcaaccaactatcttggttgagacgccttcaatatgtgtaattttgttgatatggttaaaattaaagctgaaaagaattacatattacagggtaaagttgagtccatccttataatcagtcaatatgtgtgtttaatttcagtaagtggcttagagtgaaatatttaatgtggccacttagtttgtgattatattctcaaactcctgcattgaatctttgagattgtcactttcaattaacaatcttttctgtaaattaaaagtctgaacttactgtcacattactaactcaattgcctgtttgg

SEQ ID NO: 25165 - DNA, 928 bp, Bovine  19866881388236
agtggctaataaataaactcaggtaaatacaatgaaaacagtgtttgacatccatgacaaaactcaattcaaaatgttcagagaagggtcaatagtctaagcttttccattagtgaaatgggaatgttttgctcaaaaaactttaaaagttgtcacacaattcacaatctctttcattcagtaaatatttctcaagcctttctatgcttctgcaagtattgtaaaatgaggtagtaaaatttgtaactaacaagcccagttgtttgtctaaaagagatcaaaattcagtggtagagagaaaatatgtacagaaacagaagatacagtctttgagttgtgtttagaaggatagaaagtagaagtgggaaaagaaaattgagtatgtagatactagcaatgtattcagaaaaagaagatggagtaaaatgatgacagaatcataaataaacatcattgacccaacaattctatttctaggaattttccctacagatatgctaacaaatacgcagaactatgtatatataaatttattcatcatagtaaccattcctaatagcaaaagaatggaaataacctaaatgtactgcatttgggactagttaaataaattatgttcataatttataagtgaaacactatgcagccattagaaagaatgatgcagttcactgtatcatatttgggattacttctaatatttgttaagtgagaaatgcgaggttcagagctacatatgaagtatattaccatttaggttttaaaaaggaaatatatttttatgcatatatatgcataaactatttctaattatgaatgcttctgctaaaaaactgtatgtatttgaaggagacttttccctaaatattctttagtaccattttaattttaataaatgaagtgcatgtattacttatggaaattaaga

SEQ ID NO: 25166 - DNA, 1181 bp, Bovine  19866881404973
catccaagatccaaaaagaaatcatgaactgaggttgggccctgtgccagttttataacttgggtaattattaaatgtaactaaccaatattaattggaaaacaattttcttttaaactaaatgttttgatacaaatgcaccgttcaaatattagcccagaagagagatgagatttttataatgctctggatttcatcattcagttggttaaattccagtctatggcttctcccatgatacaaaagtaaaggatgatctagcttgagatggctgcctgtttgtgttgcacacaacatggtgatatttatgagttatctgtgacaaatgataagtgatttaaaattttataaagattaaaatatattctggcttctacatattatagttttccagataaacagtataggctcaacttcttactcttttaattcaaaagactgaataaaagacatattaagtatttatacaaatattgatatttccaattggaaaaattactcaaaaaatgaattttagaataaagcactaaagtggtagcaaaataaattttaaccagaatccaaaagttagagaaataaacaaatgtcatttacttacaagttggctttggttttggaggaaatttggtccgggtaatagccaaaattatgaaaatcataactggccataaaatcaagacaagtgtccaaagctgcaaagtaacgacagaaaaaatgttaattatattgctaaaccaaaacatctgacaagaagaacattattctacaaaattccaatacaaactagatatttgcctataaatgttattaataagaaaagaatgagatttttaaaaatgtaagagaccttgaaataaatgcaataaggaattttccaggtttaaaacctttaaatgatcttctgaagcctgctttccagtgacctttcttaactaccccaagaatgatgatcttaaaagtcaagtatgatcaggaaattcctaacttgaaaatcttagagcttcctgggtgtttgttgaataaggcttaacatgataaacagggcatacaaaacccaacctaatttcaaccaagacatatcttaccacttccagtattagcatgctaagcccaggtataaagattagtttgtgacattggataataactcaataaacattattgaacaagtgaatgaatga

SEQ ID NO: 25167 - DNA, 1336 bp, Bovine  19866881496030
ctcgcaatgcgggagacctggggttcaatccctgggttgtgaaggtcccctggtgaagggaaaggctacccagaattccatggactatcccatggggttgcaaagagtcgggcacgactgagcgactttcacttacttactctcacattatttctttatatggttattatacattaaagtttgtccaggtggccaggtcgtactagcagctgcaacaggaatagtaatgtaataataggattagatattacttcatatatcaaaccactgaaacagatggatatggaaacaaagattttaaaagtttcttctgctttaaagcaaacataagactttattttagaacaaaatcaaaaaccatgagtagcattttgactcttaagaaagaagagcattaccttttgatcccctggctaaattgccagtgacatttctcacgcatgccaaataaggaatataaggactatctgctgatatatttaagagggcattttcaaactgttccagtattaggagcctatagaattagaaaagaagacgcaaattaagtcctatagaaataaagtaaagctattttgttgcgatcctgtgagtccctagttgtctggcactggttgacttgagcactgaaaccctggcaagcagcacgtcttcccccatccagcccaactgcacaatggcagcactagtctggattctctgagtatttaaccttttccatgggcattaccttgatatttaatcactttaatatccaatcataagtgatcttacgatcatttctaggcacgtttacttgaaacaaaaatcactgggctagcgttgccagataaaagacagggatcccagttaaaactgaatttcagcaaaataacaaataatttttcagtgcaagtacatcccacaagtcttgcgtgtttctttcctttcctttctcctctaaatctggcaaccctctctctgaacttcagcttcctcttttgtcaaatgagagatgggggctgggtgatctgctgggtcccttccacttataacattctctaaataatttaaattcatgtagttgtgattacaaagaaatggtagaatccaactgaataatgtcagttcctttttcttctttaagcaaccaactcagagttccccaattaaccactttttgtatccctttcaaattgactgcatgtgaggacatagtctaatatttttgaggcaaacctatgtgggtaaatgtatggcatgttacacacgcccagtcacttcaactgtgaggctgcatctctattttgtaatttcttcccttagtgtctattattgaatttgaggtatagcagag

SEQ ID NO: 25168 - DNA, 1327 bp, Bovine  19866881522598
aataaacatattgttttttctctctgtttaagtaatccaaagatctttgttgctctacttcatgatgtcccacatttgggatccctggaggtaggaagtgcagctcataaatccatttcttccctgcttgagttctaaatagatgactgataggggcaaagctgaaggaagtgattcagcatgagagtaaggtaagcctgctaactgtgccctgaattagggagtctcatctgtctattataggtcccattggactggaatgacccacgcagggcatgtgacagcctgagaaaggccaactgcacggaggaacagagaagaaacaaaaatttccatggccaagctccatccctaggggagagaaaagagtgcaggcttgtctggttattcttacatatttacaaattcagtaagtcatcttacttctccagaggagagacaaaatcagaaaaagctcagagagttaccaggactgtgcttatggaaacttatcaggtactgagtaaagatgtcccctttttatttatttattttcgtgtatgtgggatatagttccccagccagggattgaactcaggcctcctgcattgggatctcagagtcttggccactggatcaccagggaagtccccaagatgtcccctttcttaaactattatcataatcattaatagctatgttctctagaaataaacctttgaaaaaaattttttaaatcttaaagaatgccaagatatggcatgtaaaataatttgatacaacttttcaagcagatttgtgtataatgaaatgtttcatggttctacctttgcagatgctctttgcaaagaaatgcatgcatgtttaacatttacctttgatattaactgtgtgagtattactattgcttcctttgacatttgagctttaacatttctatttagaggaattaaaaaaaacacaacctcaaaggagctttaattcattgtcatagtatgagttcatgtgagtgttttagaagacacttcagaaatggctttgagtgaatttcagtaatgaagtgcccattgagacaaagtttaagatcatgccatttgaaattaaaatcctacttgtggaaattgcttcaatggaaatacatattgaggtacaatgtagtttgatagaatgagtatgttagcagaattttcattgtgatcagataaagacctgtaattaaataataactagcaagataagaacaaaacagctacaatcttaagtacaatttgacttttatggcaatagagagaaattatagaggtagattttatttcaacataaagacaaacttcctaatagagctatc

SEQ ID NO: 25169 - DNA, 723 bp, Bovine  19866881535842
tacattttggatcgttagttggctgaactgagggtaccagataaaaaacatttatctgcattctctgtgattccgaggtttgaacacatgcttttttgattccatttcacagtgcagcctctgggctctatcccacattacaacacagaggtgactgagaccaccattgtgattacatggacacctgccccaaggattggctttaaggtaaattgcagatgttcctaatctctagtgatatagccctgaggtgccctcgtgtttctggatgtggttaaaacaggatgtttcaagaatcgggtgacttgggttttatcctgtttctgttcatacctctctggccacattgtcagggcatcacaatacttctgcctccctgaattgctggaaagatgaattgaggctgtaaaagtgctttgcaaagaagaaaacattagtatgaagctgttatttgttgttatcttattttctctatcccttcccccagggaattacatttaaagatatatatagggaaaccacatttgttgtgttgttctaaataggtatcaagttcacaaaaaccaatttagggagaccaattaaactcagaatagctcaaaaatcacatttttattcaatcagtttcatctcaacttgttcagagccccttgggtgaatctcttaatagaagttaagattaagctcttccctatagatctggatacttgtttttttaaacta

SEQ ID NO: 25170 - DNA, 1337 bp, Bovine  19866881650429
taagactgatgtagttactgatgctaccaaatgtcctattttccagcagcagaaactaatactgagttcctcaatatggcatcatccctcaaagagagcagtcagctatttggtagcaagttaattacattacatcatctttactctgaaagaagcagctgacttttttgacagagagagagagagagagattgcaggcattgacttacctttcttgcccataaggcctcagctttatatagtgtttgctccattcatgtggcatcttatatatattgtgttagacaaggaacccatttgatgacacagtgttggggtgagggcatgaccaatggatccactgggcatgccatactctacaccagcaagaaagctgacatcaagctgaatgacagcccggaggcaaagctttgcaatgatggaatatatcctcaagtttttgccttacagtatgtatcagtgcttttcagccagaggcaaatttgtcccctgggagacatttggcaaattctaaaagatgttcttggttgtcacagctggggattactgctggcttctaatggatggaagccaaagatgccactacacatcttatattacacaggatagccccacaatgaaatatccatctccaaaggacaacagtaccaaagttgagtaatctgactttaaattgatggactcacggtgcaatttccctggagttgtaatacaacttactcacggattccagatcaatactcatctgggatccatgaataagaaacagaagtggcccatttaccatcacttccacctattctctatagcacttgcaatctcacaaacagtccctaataaatcccatgcatataacctctattgcagtctttttcatgcggaaccccatctgtgacagattataaattgagccaaggcagtagcaataacaataaagcctgcatagccattttagaatattttagggaaaaatagagttcattatcaattggatataaaaggaagggaaaatggaagacttaattataacttctaggtttacttggacaactgggttggcaatggctcattcatcaagataaggaatatagaaataggagaatttgagggagaaaatgaccgattttttgtgtacattttcatcatgtatatagaggaaaatgcaacaacatgtataaagttattaggccaaatcatatgaacttgccatttttataggtcagaaaactgtcaaatgttgccaatttcaagtggatcaacctagtaattacatattagctgctacatgggaaaatttactatttttattgcaacttatgtaggccatataagatttt

SEQ ID NO: 25171 - DNA, 673 bp, Bovine  19866881662312
tcttccgcacaacgtgcagtatctgttctgatatcttttccgtaaacaaagtatggtacctgccgaggccccaaacagtccagtcaacatggagctggaaatgaagaaaccataagttaggtgtgaaccaaaactttgatctaggtttttggactaaatatatctcagctgttagcaaaaaatgttacggtgtgtcttcccagggcaggtcaagctatgaagtaaaatcggattaattgggagtaaaaattaaaattgcttttaagctcccaatactttagtgttacagaagcacatgtgatgatgatggtggtcgtggtggcaataatgacagaaagggttgggctttctaattgcaaatgcactcccgtcttcagcaagctcccacacatccctggcatcaggtagttcccataggccattaagcctcaaatttctatttcccacgtgaactttggtcatcttcagtcccccactctaccctgtgacttgaatattctcacctacagaactcctcatcgtacttcagatggtcagtaaactgggcagttatttaatatccatcttctccactaaaatgtaagccccatgaagtcaaggaaaggacattttttttttttttttgtaccactcttaccatctaactagtgtcttacacataacagatcttaaa

SEQ ID NO: 25172 - DNA, 723 bp, Bovine  19866882077813
atttgcttcactatatcatgttaaggatttaagtcaaagccttaatgtatattaaaaataaaaaaattcagttataaatattgccacagagtattaattttacaatctgtaagggaatttaaagattcttttcagttttagttataacaagagatatatggtggtggtggtttagtcgctaagtcatgtccaactcttgtgaccccatggactgtagcctgccaggctcctctgtccatgagattctccaggcaagaatactggagtggattgatatttccttctccaagagatatgtaataattggcattttcacattagaaaaaggatctagatacgtttattagttcactgaaaggttgaacattttgtcatatcatttgacacttaattgttcataagatggtcatccagatgaggtagaataaacttactttagcttttcagagtatcataaacatgaaaaacccaaaatattaaatcttcaaaaggaattcatgggcccatgaaaatatgtcacagattccagaatagtctacccttctactcaaactgccttggctataggaaacagaaaattacagatctcatatattctgctttatgattgaatgttactatgaatttgaaataattgctatggaattagtctcattatattccatgattttcattgttctggaggttccaagtgatcaagcattattttagccagtaataata

SEQ ID NO: 25173 - DNA, 958 bp, Bovine  19866880395118
catcacagatgtctcccagcttccaaaggcaacttcatttttttatcttttccttcccccttttaagcatccttttccaactcaggctcctaccaggtttcttctggaagccccatccttccctcctgaggatttgctccccaaactcccagcgtagctagaaaaatgaagcatgctgcctccggcctgcccactttgcctacaaagttcagcctcctcgtatctatatgggcttttggcaggataaacagataaaaggcagacggctttgtcatctcagaaaatgaaaacaaaggaagcaaggaaggaaaggaaagcagataaaactggaggtggttagagaaagattctcctgaaagccatggtccagagagctggaaccttccctctcccgccctcaggaagagttcttgtgcacagttatccagaggctgcaaccccgggactaattagagctcacaccctaaatagtaggcaccaatgacgcaggatcttatttgacctgtgcccagtgcctggcagagcacccaagaacaccaaaggtactcaataaatatttgtgttttgagaaaccagattcaaccaggaagaagcctgtggacagatgcaccttgtcgtcagcatgaagaaagtgtccactgtggcaaggcagggcttccatgcctgttttctcatttaatcttcatcattctgttgtgaaggatcagagaggtttgttcacttgccagaggtcacacagctagcaggaagcaggtgcaggcctggagagagatcctttcgtttattcattagttctttcgttcttctagtcctcactgagcacctactatgtgtaaggctctattttggctcagagaacgaaacacagagccaaaagagcgtttcccagtgatctgaataaggggtgggtgtttgaggaattggaaacatgtgggatgagttattaaaattcagtagg

SEQ ID NO: 25174 - DNA, 2434 bp, Bovine  19866880509941
tgaaattcaccagggcttttttttttttttttggaatagaatgactagaggagaggctagagttgaatatttctctccctacaagtaggtgaggctctgaagaaaccccatttacaagttaagccctggcaaaatggtgtctcttgaggacaagccttgttaagaacagaaggttgtggtgtatttcaaaagggttcctttgctccatcccttagcaaaagcatgagcggacttctctctgatattcattgtaagagctagattggacttctggaggtaaaaactcacaaaagtgtgccttccctaagaccccatgccaggtcacgcctgggtcagtttggagttttcatctctcagatttgtccacattgagcctccagtgattcttcacatacagttcagacttctctaccccaacactggtttccatggaggttgctgcacctgggtttctgctcagtaagctgtgattctctgtatctgctgtctatctctacagttttggggggcagtaacttttccccatggcctcatttctctgaagaatttaggaagagttgttgatttctcagcttgttcagctttttatttgttattaggattgactggcaatatctaaattccttaccttcccaactagaaacccaaagtccatattgcttaaaaaaaaaataaaaagaatagaattagggattggaggctaattacaataattacagtattgtattggttttgccatacattgacatgaatctgccacagaggctaaagtatttaacctctaattaaaataaataaatttatataaaaaattaagtgattctagttttacatctcctgcattggcaggcaggctctttaccactagtaccacctaggaagcccggttaataacatcctatctttagaggagccagaaggcttctctcgaatacttctccagggactcggacaataaaaccctttatttctagctagttagagttgaatagcaagctgagttgatgcttatctaggtgggacataagtttttcagttctctatgatctgttctcagcatggcttatcctgttatttttcttgctttagcccttggagtcatttgaagttgtgattctttctttagattttgctcttctcccagctctcccctccctgaccccgcctgggttttttattttgtgtttggtctcagaatcgactctgagttctaaaccacatcatgactgttgtagcatgctttctctctctagaccagctctggtgtctttgatcccccttgctgaactaaaaacagatcagactgtgtttctccaggctcatctcaattgggctgcatgactgggcacatcagaaggttctcacattagggcatctgtatatttctggcccctttacctctccctgcctctctcctgggcacggtcctgaggtgatgggtggaacactggcagtacacagagcgccactgtgaccataatgatctgctggctccctgcccctgcaaacgtctaacctgcacagctgcagccacttagcccccagcagcagcctctgccccacggtgattcagagctcaatgcggaccacgctcagagaagtattaggagctcttggcaaaaagctctggcctcacgtggacaatcccagcaggactgcatcccagcacagagactgcggggttactctgaaatcagtgtctcctcttggatgtactttggaggaacaattgtagcatcttgctggaggctgacgagaacaaaagcaaataaaatcagggagtgataaatcaggtggaaggctcatcttctctgactggaggaaaggagcttgagaccccagtgtcctcagacagaaagagattaaaagagccagtagcctcttccctcctttcccatcccgtgaggcagaaatgacagatgctgattgaatcatggtggctaaacagggtaatcctgtaagagggctgagaagggatttaatcattgcctgctagtgccagtgtttgagtgaaaaagaacagtcactaatcaccacttcctccactccatttcactgcttttaccatccatcctacccaagtggcagaaactctagcccatactggaaagaggatggtcagggaatttattactgaagtccagaatatggtctggcttcaggtatggtttgattcagatgctcatataatgtcataaattctctcctttcttaatttttctgggttggatcccatttcggaatctctacctaggggatggcaacttggcttgatcctcatatccttccaaattcaagtccagtgagcaagaaaagagtatctgcaaaaccagtttggcgtgtggagtgttaatcacagaaggcccctatttcaatacagcagagggcctcttagtgctgtatctcttactgcatttttataagagcaatatat

SEQ ID NO: 25175 - DNA, 3362 bp, Bovine  19866880529739
tccctacaccaaaagatctctgtcagttctgtaaccacatccacctccttcaccccagcaatcaattccccccagcttcatggagacataattgtcatataacattgtataggtttaaggtgtacaaggtattgatttgataattcatatattacaaaattctaatcatcatagcattagcatccatcccatcacataatcatcattgtttttctttttggtggtaagaacattatcagcaatctatttttagcaatagattcattgctaaaatatggaactgattcattggaaaagaccctgattctgggaaagattgaaggcaggaggaaaaggggacaacagaggatgaaatggttggatggcatcactgactggatggacatgagtttgaacaaattccgggagttggtgatggacatggaagcctggggtgctgcagtccatgggatcgcaaagagtcggacacaactgagcgactaacactttacactttcaattaataacagataaagtcataatttgaatccagagccatctgattccagggaaccaggctcttacccatttctggtccctgtggataaagcataaatgagtctatctgggagccctttttcaagtgggtggtttttgcagctgagacctacccagagtctgccatctcagggtctctctgccccacagcaatgccatgttttgagcgtttcctcattattcctaaacaaatttaatctcaagaaaataagatgtttcagtcctccttggaaatggccagctacgtagaagggactcaacaaaaccttaagttctagggtactagagtttaaataccatttaagaaattcttccagttaagcagccccttttagaaatgggaagaggcagatcagggaggttcacatcccctcccctgggtagaatattggagcattgggctggttaaacggcctgaagctcagaagagcggcctcagaccagtgagggagcccatgaacgcagcggacctggttttcagtgagatgactctggccttggaagcccattggtctgtcctgtcccttggggtctccagttagagtgtcttgaattaattctgggctgcaatcaggtactgctgctaagtcacttcagtcgtgtccgactttgtgtaacccatagacggcagcccaccagcctcccccatccctgggattctccaggcaagaacaccagagtgggttgccatttccttctccagtgcatgaaagtgaaaagtgaaagtgaagtcgctcagtcaggtactagaattgaattgctgaggttattctggacatggacagcaaatcttgggtagcttaagcctttaaacccccctccccctccacttaattgtgtgtgtgtgtatgtgtgtgtgtgtgtatgtgagctctgtattttgttctattgggaaggggcgtaagtactgacaacaaggacagggaaggtaagttttattgcaggatagaagagatttcacacgtggggcatccactctttcactgactgagtaccttgcacgccattggaccaagcaattgagacacttccacatgaccattgtaacaaccacccatcacagaagtccttatcaattccagctcacattttggggacctgacaatagagaccaaagtgcttgagccaaatccccattttctaggcatgctagaaactatgccatgtgaccctgaaggagttagtggaaagctgaagaatgttcttcagctcatcttagaagtcaaattaccaagtttccaggtctcctgaatggggtcatatcctgcaaataaaccctgttagcacattttttaaagtttatttttaattggaggataattgttttacagtgttctgttggtgtctgccattcaacaaggtgaagcagccatgagcgtacatatgtcccgtctcttttgaccctccctcccgcctcccacccaatcctgcccctctagggtgtcacaagcactggatttgagctccctgtctcacagagaaaatttcactggctatctaattttacatgaggtagggtatatgtatcaaatctcctctcaattcatcccaccctctctttcccgtcctgtgtccaccagtcagtcctctgtgttagcacatttgacagatacttgggatttactggcgtcatctcatcttcccacccagccttgccccttctctaagccaatgtcttttacaaatattgtgctgtgacactcgtctctgctcccattaatagaaaagccagctggagtccagagagtacaagtgatgtgcccgagctcacacagcagtgagcatcgcagccagaatttcaacctggatgggtaaaactcaggagcacagcgctcttccgatactaagctgctcttctccttattagaaacacaatgtaattaagtgctcggggcttgccataattcaaaatacacttgacaccacaatctacccgagacaccatccataatggaacaatgacagggaactgccctcttggcaggtgagattctattggtctggctccatcaccaccattactcgttctgtatctcgattatctcccccataagacatatttacagcaatattaaaagggagatgaagggatatattatcttccttatgtacaacatatattacacgcccatgcccgtcacagcccagatgatgcctgacaagtcagcctgcggtgataggagcaaagtctttctatcacttttgaacaggccgaataccaccttgtgtgatgggaggaaaattaccatcactgtcatcagccccatctcacagggaagaccaccaaggttcagaggagtgaagtgattttctgtaggtgtcccccacctctaggactagtgaaagcaggacttgtccccagaccttccagcatatcctttgagatccttgtattacaagatgtctttggggatgtatttattcacttattcattgattgatttgtttaatatatattgagtgagcacctgcttcaggccaagtgtgaggtgctaggaggaatttgtgaaggaggccatctagactccctgctctcatagcgaccagagttgggggcttctccagcttgattctccccaggcaacattgcacaaagtctggtgacactttggttgtcacagttagaaggatgctactgggtatctagtgagtggatgctacatatgcttccaaacctcctacaatacacaggatggccctccaacaaagagctatccatcctcaaatgtcaataatgcagattattgagatacctcggcctagagcatattgaagaggacaggattaatcaaatgtttcattcaggaggataggttacagtaaac

SEQ ID NO: 25176 - DNA, 2473 bp, Bovine  19866880620039
ctcctctgttcatgggattctccaggcaagaatactggagtgggttaccattcccttctccaggggatcttcccaacccagggatcaaacccaggtatcgcacattgcaggcagattctttaccatctgagccaccagggtagcccaaggtccccatgaaagttaagaaaggttagccccaggtgttctacgatggtggaaagccctaaaaatattgagtttagttctggcagcttcctccaatctttatctccaaaccaccagatggttggctggtagggagaccagataataagggctctggggtacatgactcctgaggagagtttggacattatcccatctaatcctggcagcaaccccaggtagcagaagttttgtccccattgtgcagatggagagactgaggctcacagaccataatccttgcttggaatcacacagcttctaaataggaaggcaggcattggtcagtccaggtcagttgatggcaaaatccaggctgcttccatcacacagacaccctcttctgagagtttgccactccaagccctgtgacctctccccaccacctccttggcatccagccccactcctcctgcccctaattggccaactcagtgttcaccccagtgagaccatccccctttatttaaaagctcttcagtagatggaaggcaacttggcagtaacctctgcacagagctttaagtacacacactggccaatctttacagatttaattgtctataaaattactctgtgcgcaattcccatatggatcctcagtgtcccgcatgcttcttggctggacctatctcccaggctagggtacagttggttcaacacaaaacaagtctaccagacagatgtgtgacttgagcaactgataggccacccagggcctcagtttcctcatctgtcaatggggacaaccccagaaacttgccacaaggtttggcaaattcaatggaatgatgaagagaaagctttcagtcctgtgcctggcacacacataatgtggtagctaatatttctgagatttcaacccatgttctccccctccttgatttcctggaagcctttctccccccattccccactgcctcccatatttggtcatacacttatcatctcagggtacaggtgatttacaggatgatatgagatgcaagaaaagaggctttaaagcttcagaacactgagcctggatgaattcaagatttcacagtttccatcataagaaatattctggagaaggaatagagggagaaccagcacatgagcttggagccatcctcctgcaagtaacagaccacccaacacaaactggctaagaaataagtcaacgagaggactgacagggccagagggagggcaactccacgggtagttgaccaggaactcaacaacgtcactcaagttagcccaactgtcctccctgccttcaatggaagctgctcccaaccaaggctggatcccctggtagagacaagatggctgccaggtgcttccggggcttcctcacacaagggtgggtgggggatgggacagcgtgtctccagatagctccgcccaggaaaccccaaccaagatcacctctcacctcattggccccaaatgggccacgttcctgcctctgaaccaaccactgcaggaatgagttgtgccgattgggtaaatccttcccccgtggggttacaggtctctcccctccaaaccctgagtagctattggagtaagagggatattctttagtgagggtttcaaggcataaagcttatgccacaatgaacagactggacagagaatagatgaagagcttactaaaaaccatcttctctatactagattactcattgtctgaacaatatttgtggagtatacttcaacatttatttattgggaagtttctgtgggactttctcagccaagatagttgtcattatgtctttgacagtgtgacacccagaggtgacaccgtcctccagggaggtctgaccagcacagagcaccagaggactgtcagtgccagtggtgataataataataaatagctcacatttgtgaagaagttactatcttctgagaactgggctgagcatataactataaatataattcttttaatccttctgaaatgataaaaaaaaaatccttgtatgaaagtaggtcctcttattatccctgctttacagatgatgaatcagaggcacagggagtagaattaacctgcccaagatcacacagtcagtaaaacactgggatttgaatccaaacagggttactcaagcttggatgttaaaatgcctttccttctatggtggcgcagaagttcacacgagaattttgacaggagtcactcattcacttggcaaacgtttattggctgtgatatgccaacctataaggcatttaaaattcattcatttcttcaactagattttttggaatgcttattttctaggaatca

SEQ ID NO: 25177 - DNA, 751 bp, Bovine  19866880673934
agagaaaatcccctggatgttcttaaaaatccacaataatagaaacaaacaaacaaacaaacaaaaaagtgtgaagttgaagtggtttctggagtgtgtctgactctgcaccttcattgtatggatgagggaactgggtcttcagggagatgtaatttctcaacatggagttggatggatgaagactggaatctggccacctcattttggtctgagaggtacccccccccccccactataccatgctgcccagaatcatattttaagctcacacacttttttgttgttgttgttgctgttaccaaaccacaagcagtgtaatatgattataaatctcagaggcatggactggcattagtttggagctttgttatttcatctaactggttttagcaggcccactgtattttaatatgtatttcacctttatttgatttcacggacaattgattttttcgcaaagcaaaacaaaataaaaaagttttcccctgttcttcccagcttgcacattttccagggaaaggaagtccattagactttgtggaaggcttatctggagagcccatcttcccacttctgatgatattaacatggcatacaccaggggtcttaccagatgctctcagggacacaataccaacagtgaacactaaaaatttgggcaccgtgggagtgaccagtggtcagtgccacctggcttctgcggggcaaaagaaaccaacctctagggctgataagattgttcctgata

SEQ ID NO: 25178 - DNA, 989 bp, Bovine  19866880751268
tatatgacagagcaaccccagccttgatggactccaacgtaagaccagggacaggcttcagtgatgactttaccaacaatcaatccagaataagacaaatttaaaaaaattccccccattgtccttaacacctcatcaagcaaaaacttacaaatggaatataattaaaatcacatcttctttgacccaattcaaagaaatcttcttaaaggcatgctggaattgtgatacattgagcaaggttctctgggtgccaggagctgctactggaaatatagaatgaactggagggtatccagacagttgcaggaacccccaaacattaattttagtcacagttggctgcaccatatcaacctataaacacctctccactttcaattaacattgctctgtctcctgtctcgctgaatattatatttaactaatttaagaggattggtaaagagagttttcacacttcacaggaaaacataatgaaataattatacctctacctacaaaaggcatgagaatattacataagcagccttcaaggcttttcaactaaaacctctttcctgtatcttctgtctgagggttcctgcctgaactttcacttaaatgcactttgtttttacatctttatgttgcaaaatgttagattacttcttggaatttcagtacttgtatcttttttggccacagaaggtactggctgagttgtacacatcaggtgtgaataggtgcaggacaagctgggacactgggcacttgtgtggtggagagaaatggaattgagattggggctgggaaaagtaatccgtaatgctattcttaatatagacagggcctgtgaaacaaagcttaatgttagtatcgtagtccacttatcagtcagctaatgacacaatagtgccttttctcatgtttatggtttctggagaccagtgatatctcaaatgactctatcaggttgcagattgaccggccttgcttccaggctatag

SEQ ID NO: 25179 - DNA, 830 bp, Bovine  19866880761292
atttcattctgcgcatttatagaggaagacacagtagtgcagaaagacagcatgatgtgatggcagtagtgcagaaagacagcatgatgtgatgcaggtcttcaagaggggtggcatgacacaagcaaagccatggagctccatgtgggcacctgaggctccggcatgaaggcaggggtagaggccacctggggtcccagtggccaaacatcgctgggagtcaggttctgaggtgttcgcgcttgtgggcaatggggagccctcgaggcatctttggctgtatttctgctgtgtcttaattcttttagtaaggctaatttcaactccatcaacacagtaactccttgcttgattaactctggtttctctatatttgattaaccagcctcctcactctacaatgatacgagagtttactaagttacttttggaaattcaaatgctgttctctacacagcttggaaggatccacagggagataggtttacataacgttgtcactaaaccacttggttatcttaattttctcacttccttccttgactgaattcaaaaagaaggtaagagcctggaagctgggaaacagcaggaaggtgtattaaccatgattacaaagataacttctattttctgagtgctaagtatgtattgggctactgctttgcctgcatggctgtttccatcatcacagtggccctgggggagttgttatttacatttcacagaagaagctagctgacagaggtgaagcaattaatcaaagatcacagggttagtaggcagcaaagatggaatgtaaacacagcaatctgagtcctgggctcttaatt

SEQ ID NO: 25180 - DNA, 1067 bp, Bovine  19866880792856
gcctttgttttctatgctataaagaaaatgcaaaaggaaatccttactgccagaaaataacccccccaagggtataccaatgaactctttgcctaaaaataaactcaatttggcaagagccacctgctgtttcttgtaaagtagcaggggaagcaaatttgaaagcctcagggattcgtcctctttcacgtttctttccaatctccctatattctcttcattttaaaatcagcatcactgagatacaattaacatacaacaaaatgcatgtattttaagtatacagttctatgaatttggcaaatatgtagacctatgtcaccaacatcccaataaagatacagagttcttctttcccttctgattgcttgcttatgagcctttgcaggaaatctcctctaacttcacattccaggcagtcactggtttgacttttttcactatagttttgccaagactttgaattaatggaaccatgttttgttttttttttaaatctgacatcatgtactgagcataatattttggagtttcattcatgttagtctgtgtatcagtaatttgttcttttacattggttaaaaatacgtcatgtacaaacacatcacgtattttaatgcattcacctagacatttagttgtttctagttcttggttattatgagaaatgtttccataaaatattgatgtggaaggtttttagggaacatagaatttgatttctcttgtgaattgctaggtcagatgagaaatacatgtttaactttataagaaacctccacatctttttccaaagtggttgcaaaggttgagggttgtaatttcaccacatctttttgtcactgtcttctcccaatatgtcctcaggcaaccactggtttgctttctgtccctagagcttacgctggccatagcattctgtacgctataaataaaggcaaaaggagaagagggtggcagagaatgagacggttagatagcatcacccactcaatggacatgaatctgagcaaactccgggagatagtgaaggataggtgtgctgcaacccacggactcccaaaaag

SEQ ID NO: 25181 - DNA, 921 bp, Bovine  19866880815649
atggcagtgtgacacactcgtcttgcctggggccttttgacaaggtttttttttttttaaagtgctagtgtcagaacttgaagaatgagtgtctacttgagataaaatctcagagactgtggtggaacactcttttaagaaatgttatatctcctaagctcttgatgtctcagaagatgatattgtatgaaaaacaaacatcaatgactctgagttgaaaagagactcacaaaagtcaaattccgaaggcaaagatgttgtgggatgacttgaccaatttattttgctgatgtttaccattttatatatgcacaatagtgacatatgataaaaatctacttttaaataagtctaagagagccctttcaatacacataaaataaaaattctaagtgataataaagcattgtgtcttggtttagttggcagtgttctttctttctcagtggtacataaagatgcatcggacaatcagtgacatctaagatttgttgaaatatggtccttgttgatcccaggaggcagaatttggtaccaccattagctgcttgggttggggttggtggtgcctggaccccttgcagagcctgctactagagttggagggcctggcaccattctgggggatctgttctcagaggccccttctgtgcctgaggaactgggctttgactttcttctctgcagattctctttctgacagctcctggtttatggctgctcagtggagctgatagagtttaggataaacgcaggctccacagaggggatgaggcatcctcagaatgtaataaagagaaagagagagagctccccaggtcccttccagggaaatcaagtgaaatttctggaatgaagataaagacagctggctgtgctcagagggtctgtggggccagactcctacggaaggtggggagg

SEQ ID NO: 25182 - DNA, 1318 bp, Bovine  19866880832086
atttgtaaatcacgagagggctaagaaaacaagtctgtgtcattttgggcccacctgctgccttgtcataacctctggccaggaggctggaatccgagattagttccactagctttgattaagtcctgctgtttttgccttatagaattcttccagcactgccttaaaaccaatcaatgggtgatgatatttctccagattctagtggatccagcccattgcaaacctggaacctaaaagttcctgttaaaagtcctaacccagcactgggaggagcaagaaatagctattatttccaacgccttcatgtcacgatcagaacattctctctctagtctcctggctaatgatgctcatttctggatctctgatctctaaatctcacctctcctattcatcttccacatagcatcagtgggatcttcaggaaatgcagatctgatcatatcattcgtctgccctctgaagagtatccattgccttcctaaaaagatcagcctccttagaatcacagttaagatcttatgtaatctgaccagtgcttagctctcctgcctcatctcccctgacctttagcctcgcataccttcatagctagggatctttggaagcggcaggaagcgggtcccactaaccatggcagagatggaacaataacgactgctgtcacctgactgtaagctgccactgtcacatgcctgcatctctgtttctccacatgcccgattcaggctgttctcttcttgttcttcttttctttttctggctgcattgctcagcttgtgggattttagttcctcgaccagggactgaaatccggggccacagctgtgaacgcatcgagtcctgaccacgggaccgccagggaagtcgcaaggttgttcttaatataatagccaaagtgatctttttaagcttgaatcagtcagtgcctcacccttgtttaaaatcctccaaggactctttcatttcattgagaataaaaatgaaacctccatcatgatttgcaacagtagctgacatttatggagtgcttatgtaccagacctttttctaagcaattgacatgtattaacatgccacaacaacctcggggggggtaagttctattattaacccccgtttagcagatgaagtgaagtgaaagtcactcagtcatgtccgactctttgccacacaatggactatacagtccatggaaatctccaggccagaatactagaatactggactgggtagcctttcccttctccagggaaccttcccaacccagggatcaaacccaggtctcctgaattgcaggtggattctttaccaa

SEQ ID NO: 25183 - DNA, 1624 bp, Bovine  19866880832127
tgccaaaggggaagggggttggggagggatggatcgggagtttggagttagttgttttgttgctgttaagtctctaagttgtgcctgactctgtgaccccatggactgtagccctccagactcctctgtccatggaattacccaggcaagaacactggagtgggttgccatttccttctccacaggatcttcctgacccgaggattgaactcgcatctcctgcattggcaggcagattctttatcactgagtacccccttccaggaagcagccatcacagaaactggggttaatagatgcaaactcttgcatatagaatgaatggacaagaaggtcttactgtatagcacagggaactatattcatatatcctgggataaaccataaaggaaaaacaataaaaaagaatgtatgtatgtaaattgagtcactttgctgtacagcagaaattaacacaaaattgtaaatcaactatacttcagtttttttttttttttaaaagaaaaaacccaaagcaaaaaacagtgcatcactgagttgatagattcctgctgtgggtaagtggggctcagtcctgctggggaccctctgaaagaacatcagctgtgtccccttgtgggataagcaagctaggatactccacgcagctctgttcctctggtcgggggttggtcagggacactgacacccaggcacattccggctgccccaggtgtgggctgagcattctgacttgagctcagaccaccctcagaaggagagacactgtctgcaggtgacctccaggtgggctcagtggatgaaaagagcacgtgcttcctgcagcgaaactgacttcagagttttaactgaactcccctgggtcggattctgcctgtcgggtgcattacttagcatgctcagtgtttctaagacacggaatttgaaagcaaaacctctaattcccacactccctctactccatattttctgagaaacatctggcctgcttcatctatttcgccttcctaccggggccctaaaggcataaacctgtaggacgctgaatgagatcgactgtgacaaactcccttccaccccgtctgcaccagagtgcctgcgaggtcaggaatgtgctggcagccccagtgacctctgggacagagcagggcagccttgcgcccccagcatcattagaatttccatgtcactgctgctgcttctggctttggagccagctccttccaagtagtgaattaatgcatgccagtctctcagtcatgtccgagtctttgtgacctatggactgtagcccaccaggctcctctgtccatggggttttccaggcaagaataccagagtgggtggccctgccttcctcgaggggatcttcctgacccagggatcgaacctgtgtctctttttgtctcttgaattggcaggtgggttctttactactagcactccctgggatgggagctccttccaaagcacatcgataataataatacttgtgtagcactcatagattgtacagaactttacaggtgctgagcagcagtggggctttttatatctccatgtgaaccagtcgagaaagtaattcaaacccattttgcagatgaaccaacagaggcttggagag

SEQ ID NO: 25184 - DNA, 2703 bp, Bovine  19866880846144
aggagggcatggcagcccactccagtgttcttgctggagtgttctctcatggaccgaggagcctggcaggctacggtccaaagggtcacaaggagttggacacaactgaagtgacttatcacgcagcacatacatttccacaaacccctaagattatggatggagataagcaatgcggtcatatcttgattctcatttgcctttgtttcttgtgggaaacctcacagggaggagtggctctggtttgtgataaaatgcggtttggatatccctacattcatacaaatggaataatataagattaaaaaccaagctatgaactattgccaagggggttctaatcacggcaggcaccgtgtagtgaaaagaacatgaattttgcatccaaaagcctggttctgtcatgtcataggtgtatgacccttaggccaatcacttgacctctctgaatcccagctttcttttctgcaaattgggaaaaattaattcttatttttcaggatcattggaagaattaaatgccataacatacaaaagtgtgagacacataataggggcttaacgagcatttgttctcattcacctgagtcttcttgagtcacgggtattttggacatcgataattcacattctattttggatactgtccttcctgctttttaaaaattcaatttttttctgactataaaataatatttactcattgtagaagacctaaaagattatagacgcatataaaaataaaatagaaatctcccataaaaccacccattaaagatttcaactctatatattgtggttcacttccattctgtctttctttctgtctgtctcactttatcttgtatgtatgtgcaagtaatcagattcatcttatatacagaattttctgatttttttcatatagtattaaagttcttctctctgtgggttcccccctcaccatgtttaagagtaagaacataccaatccttagagtgagaccagcgtggatatgagaattcactgtgtgatcatatcttgggtatttgacccttggggaatcccaaatcttctttcacagggttagtgtgggatttaaatatcaggtccatggacatcttagcagagtctctgaaacttagtaactgcttataaatagtgctggctaatactatattgattagacttctgtgtcagtctaggttacactacaatgacaaacaggcagcatctcagtgactctgcacaacaaaactctgtttcttaccgtagactgaagccacgtgccgtcctgggcagctgtcttcacgaggtggtgtggagctcccgggtacttccatcttagagcatttccatcacgcacatgtttccatgaccgccaaagcaaggaagaaaaattggaagatttcacactggcaattaaatgctttgatccagaagatatatgcatccattctgcttacaaccaattggccagaactaattgcatgaccccaccttgcagcaggaggtgtgtgtgaagaaatgtgatcctctcgggtacccagaagaggaagagtctcccaaatcattgagcacggagagtccctgccgtggaattatctctagcataagattatttgcttttgtgggaactggtgcaatttaattcaaggtcagtcttactgtatttatgcagaatgagtcctcaaccctgacctggcaaggagaagaaaaagcagctgatctcagatgcacaaatgtctctgggtatgtctaaagctgaggttcccaccagtgtaccgatgccagttccctctctgggtctgagttactgccctgatgctcagcgctgtgaacggtgcagttaagcgaaagggtcgggttgaccacagtgcagcattgcatcagtgccccgtcatcaccctgatatacagcttgtcccgagggccatcattcctggaggagaatgcatcaggtcaagctctggcatttaataccacatccatcacagtgcagagaacactaaggaggtctgagccctggtaagctagaggctgggaaagggctcagcggctcctggagaatcatcacatctcccgaaggacctgcaaaaagtttcgcttcttggttttcattcgtttttccttctgaccatagtgaactccccgtgactaaaggtatgcaagttgaagcagactatttggttgtcatgagtatcgaacagactacttgtggagcagtgaataagtgctgtcttagttggagttccctttgaagtaaatcctaaggtgggaatttgggtgcacgtagttcattatctcaagatgccaagacccacaatgggggtaggtcgtgagacggaaggaagaaaaccaatagacagtgcagggcaagacaaacactatttgatgccacataaatgcggaatctgaaatgcgacacagatgaacttacctgtgaatcagacagactcacagacgcggaaagcagactcacagacgcggaaaacagtctcacagacgcggaaagcagactcacagacgcggaaaacagactcacagacgcggaaagcagactcacagacgcggaaagcagactcacagacgcggaaagcagactcacagacgcggaaagcagactcacagacgcggaaagcagactcacagacgcggataacagactcacagacgcggataacagactcacagacgcggataacagactcacagacgggaaaac

SEQ ID NO: 25185 - DNA, 1085 bp, Bovine  19866880870044
cccctctgctgcagccacggcaaactcccttctatttgtcaaatgaaccagtcccttttcataccactgtgtctctgcgtgggaggctttccctggtttttaaaaaacgttatgtacttagctgcagtgggtcttagttgcagcatgtgggctctctagctgcgtcacatgggcattggctcatttcctctgcagcagcatttgggatcttagttccctgcccaggattcgagcctgcatcccttgccttggaaggtggattcttaaccactggaacaccggggaagtctcacaccttccctgtcttatccttcagaaactgacatagtcatccttcagggctgacttagggtttactctttctaactgagctcctccagccttccagcccccttgctcctaaggcaggttagtcatgaattcctctaaaacttaaagctcttggcacgagttctctagttagaacattgtactgtagttatcagtggtaaagaatccgcctgccaatgcaggagatgcgggttcaatccctgggccaggaagattccctggagaaggaaatggcaacccattccagtattcttgcctgggaaattccatggacagaggagcctggtgggctacggaccatagggtcgcaaagagttggacatgacttagcaactaaacaagaacaacaatagttatctgcttgcatatctgtttctctcactagacaatgagcttggaggagaagagtattagtaatcaagtagtgtatttacatatacaaaatatatgtaaatgaatacatgtgtaaatagcaggtacttaacacacacaaatcaactcaatcaatagaggggaggagggtgtctgtctgtaagtccaaatgcagttcagccaaagtattggccccgtgccggtgatgagatcagttattcccacaatccccaatctgggaagacaatggatgtggtctgaaagaggaagaaaatttattctgagtggtcccagaggtcagaactaagaccagtagctggaatgatctggggcctaatatcagttctgttacagatacaatttcctttcttcactaaagacat

SEQ ID NO: 25186 - DNA, 1745 bp, Bovine  19866880870785
tgggttgagctccctatgttatacagcagcttcccattaggtgtctatatcacatatggttatatatatatatttcaatggcattctctcattcattccatcctctccttcgctcactgggtccacaagttcattctctctgtgtctctattcctgccctgcacatagtttcagcagtaccatttacctagattccatataaatgcattaacatatgacatttgtttttctctttctgacttacttcactctgtataataggctcttggatcatccacttcattagaactgactcaatttcattgcttttaatggccgaatttctcaagccttggaaaatcttccttatgtagatgtgagcaggcacagtccttgtggccgactcttttcctgtgtaaggaagaccttctctacttcctctgacgttccggttcactatccctctgacattctcctgcttctttcatgtggatcctgctagaatttcaaaacaaaaagctgtctctcaaattggccccatccttcctctcccacatgcagggctaaagctgcttcctggagcctcttaggattcgcctcatctgctttcccttttatttctctttcctactgtttcttttctaactaaaagatagaattttttttttttaaacacctccattcattagagtactttttttttttcaaagtccaagccatagttttctgtctgcctaccagcactgcatctcccctgctaactgcgttcttttccaggttcctgggcaaacctgccttctagagtcagaatgatacaagaacttaccattttagttttgtttcatcccttgggtttgcgataactctgctgaaattttaacagcaatcgcaaccacaatatgagggtgccatctgttgcttctcatgagccaagtactgagtgttaagcactttgtggtgggcagtatttgtttttctttacaaatgtggaccctggggtcaatccaattaaaaaaaaagatattctgtctacaataatatccctattcctatttatccatttgttgataaacacttccaacctgtgtgcttgaatataccttctcgatgacccatccccaccatcctgaataaggcttagtagtgtgttacctcctcacatgtgaataaaagcaaaaaaaaaaaaaaaaaaatcagaaagaaagtacatggtagagatttccatgtggtaccccccaaatccctagctctaattcataatcctggctggattaaagtgaacttgacctggctggattagaaagggatatggatgatcacaggcttccctgatagctcagttggtaaagatttcacctgcagtgtaggagaccccggttcaattcctgggtcaggaagatccaatggagaagggatagactacctcctctagtgttcttgggcttccttggtggctcagatggcaaataatcacctgcaatgtggaagacctgggttcaatccctgggttgggaagatcccctggagaagggaaagactacccactccagtattctggtctggagaattccatggactgtatagttgatggggttgcaaagagtcggatatgactgagtgactttaactcactcactaatgaatgatcacactataggctctgaacaaggtctcccaactgggatctgggctctgtcttcaagggactttgtctaggacacagctgtgagatgaaatttaaccctccttttgctgaactccctttg

SEQ ID NO: 25187 - DNA, 3059 bp, Bovine  19866880959188
attgaggcaatctggagaatgcaagccgattttctggcttttcagaaaaatccagaaattcaaattttcatataaaaatcccaattaaaaaaataagcaactaatttaaaatgatttgaaacactatataggccattaaaaaagtgaaagtcattccatcatgtccaactctttgccaccccacagactgtagcctgccaggctcctctgtccatgaaattctccagacaagaatactgcagtaggtagccattcccttttccaggggaatcttcccaatccagatgttgaacccaggtctcctacattgcaggctgattcataaccacctgacccaccacggaagccccaacatggacagtacaaattcataattctagtatccatgactttgagatctctgccataagacaattaacaaaatgaaaagacagcctacaatttgggagaaaatgcttgcaaaccacatatctgataaggggttagtatccaaaatatatactcaataaatcaatagcaaacagatcatcagatttttaaatgggcaggggacctgaatggacatttttgcaaagaagacatacaaatgaccaacagggacaggaagaggtgctcaacaccattaatcatcatagaaatgcaaatcaaaaccacagagagctatcacctcacacacctgttagaatggctaccaccaagaagagaagtgacaacaggtgttgacaaggatgtggcgatagggaaagcttgtgcactgttggtggggatggaaacttgtacagccattatggaaagcagcgtgaagtttcctcgaaaagctaaaaatagacctatcccctgatccagcaatctctcttctgggtttatactcaaaggaaatgaagtcagtatctcaaagcaatgcctgtactctcatatttattgcaccattattcacaataaccaggattcaggaacaacctacgtgtccatcaacaagtgaatggataaagaacatatacagtaggatattattccactttaaagaagaaggaaatcctaccatttgcaacaggtatgaacctggagattgtgctaaataaattgtcagatgcaaaaggaaaaacaaactgcatgatcacgcttagctgtggaatctaaaagtcccatacatggaagcagaaagcagaacagtggttatcaggagagcgagaaggaaagggcatatgttgatcaaagggtgcgaagttgtagttacataggatgagtaagcgcaggtagggtctactgtataggatgaagtgaagtgaaagtcgctcagtcatgtccagctctttgcgaccccatggactatacagttcatggaattctccaggccagaatactggagtgggttggcctttcacttctccatgggatcttcccaacccgggtattaaacccaggtctcctgcactgcaggtggattctttaccagctgagccatgatgtgcgtgctacattgcttcagtcatatccaactctttgcaattccatgaactgtagcctaccaggctcctctgtccatgggagtctccaggcaagaatactggagtgggttgccatttcctcctgcaagggatcttctgactcagggatggaacccatgtcgcttaagtctcctgcattggcaggcggattctttacaactagggccacctggaaaacttgcagcatgacgactaaagttaataatattgcatttaatactgaaaatttgctagatctcagatgctgtcatggcaaaaatgctaactatatgtggagatgatactgtaattagtttgactatattaatcatttcactagatatgcgtacttagttgttcagccgtgtccaactctttctgaccccatggactatagccctccaaggcacctctgtccatgggaattctccaagcaagaatgctggaatgagttgccatgccctcctccaggggatcttcccaacccagatatcaaacccaggtctcccacattgcatgtggagtctttatcgtctgagctacaggtatatcaaattcaccatgctgcatacctcaaatataagcaattttcattttaaaaattacattataaaataggagccaggaagttaggattgggacccaggggttgggtttggtttctgcagggtccccggagtttttccctgatattttcgaagtcagagttattcttatggtgtctgtaataagcagcccctctttccaggcttttgagagctgtggccatggctgacacccataaccttcgcagaatagattcttcacttcactgtttatcctgtctggactggcttctgtggtccagtgatttttaaacctgcatgcgcttcagagtcacctggaaggcttgttgaatcataaatttctagactcactcatgaagtcactatttcagaaggtggggtggggtctgggaatttgcgtttctaacaagttgccaggtgatgctgttgctgctggtacagaaacctcactgctttaaccaaagtggcagtgtcttagagatgaggagagatgcttgacttggggaaagcactggaactcattaaagggagagactttttattacagccctaggaagagggcaaagggtcctttggcatggcaaacagctggctctggccacacagaggtgagaaagggagaggctcagacagaaccgtgtccagccagcagaggccagatagaactgagcttagcaaagctctcagccacttggattggaattctgatgatcagatcataaagaaacatgaacattttatgtgttcttgcatcttccttgtttacttcccaatcccctcacacattttcagtgatgctctttgtggaaatgtcagcctgtctcagctctgctcaagggaacaagaaacagtggcggctcgacttggactaagtgttgaagggggagcagctccccctaggggccagcaggatggagtgcacaggggaagtgttgagctgggaaggggggtgcttcttccttcagtggccacttactgggcacctgatgtatgagtccaggcaagg

SEQ ID NO: 25188 - DNA, 915 bp, Bovine  19866881028190
acttggcaaagactccatgctgccagtgcaggaggcctgggttagatccctggttgggggactagatcccacatgcagcaactaagacccatcacagccaaataaattaattaattaaaataagataaagtaataagaggaaaaaaccttgacttatatgaaatctgagaggaaaccacaaatattaggaaaacagcataaataagctcaaggtcaggacatagcagggaatgaagaactatttgtacagggtgctggtttggggcatgaatctgtaatctcttgcttgtagataaagtgctagtctggccatgtctcatttcctgtgtcattcttgtcagaatctaggtttggaactttaataacagcaaagtttttactgtgagattgatgcatatgaaataatccaaatgaaaactgaaaaaaaattgggagccatttgtactgtacagaaaattgatccaagagttaaatgggtttgaagagttagtctcagaaataatttctccttgaaaatataggaactatattagaatcttgattagaatagttaaatcatctctctgtcttaatacttacaatggtttcaatcactcttagaatgagttctgagctcttatctaaatagtacatggtctggttcttgccaacctatttgatgatgtggtttatatccgctttctgcctaaataacctcaagtcacaacagcctctttttgttccttaagagtcaatcttgttcctattcctttgtacatgctcttccctctgcctggagtgctgttcctcatccttatcgtgttcccggtgcaagcatcccctgctcagagaagccttctcggaaaaacccacctaagataactcctacattcactccctgttccccggatagtgtttttcattatctgaaatcct

SEQ ID NO: 25189 - DNA, 1130 bp, Bovine  19866881068651
atgttattactttgtctatcagcagtttctgacttacatctattttggctgattatttaaaattgttactgctttattttggttagtaattgtctttatccattcttactttttcaatctatgtgtgtccttagatgtaaaatgagtcacttgtacacaggatatagttggatcttgtttggtttattttttaattcattttgctattctgtgacttttgattgaagagtacagttcattaacatttaaagcattagctaatataaagaatttgctattgtcatttttgttaattgtttttcccatgctttgtaacatttttgtttctaattttcttctctaatgatttcttttttgcttagttgacatttttatggtgactttaaaaaaaatttctcatttccttgtgtgtagtctgtagatattttctttgtggttactatggtgattacattaaacatcttatagctgcaacaatctattttaaactcttaacaatggacttcagccacatacaaaacccctaatccttttcagccttacctcctatttctggtattgctgtcataaattgcttattaaatatggtttacctattaacttagatgtatagttctttttacactttttttaatctataaaataattaaaagtggagttacagaccaaaataaaaagatacttatttatatttgtccatgtgtttacctgtaccagagaagtttattttttcatatggctttgagttacagtctttggttcttcttttttttttctatttgaagaaattcctttggcatttaagtctgtggaaaagtctggtagtaatgaacttcctctacttttgtttgtttgaaaatgtcttaattttttactttgtttctgaagggtagtttaccggacacagtattctctgttgacagatattttttttttatcagcactttaaataggtcatcccactgccttatggcatatatttcttggtttaagctgaaaaattcactcataatcttattgagaatctcttttatgtgaagagtcaacttcgttgctttcaaaattctctttgtcttcacccactgtttatttgtaatgtatatggtgttgatcttttggatttaccaaaa

SEQ ID NO: 25190 - DNA, 1375 bp, Bovine  19866881089388
ccttgaaacctcttggtaagatggagagtgtctttccggatgttccagcaaagcctcactgcatcctgctgactctggttggaccatgagaagtcacttctgggaccagagggaatcttttgagatgattggataaagcatggccacaggctgcaccccgagcttcgggcaaggagaccttaaccgaatcgtatgaagtgacaagaggaaggagagggtccccaatatttggaaggagaatgactggatgttgggggatccattacaaccagacaagataagagcgagggcaatagagagaaaggggatcttggccatacagagagggacagagaaagaccaaggggaggaaaaagagagaaatcctgatagcacctcctttcgtagtctcctatcctttcccagaaatgccatgtggaagcacctttgtgttgtcacagtgaactccctttcttctctagatagatttctgtttcttatcatcaccagccccaaattcagacagagaaacggtcatttaccctggccacctggacagatggctggattgacgcaacagggaggggagcctcgtgtctacatgcactttagcagatgaatcatgagttcccaccatttcagcattaatttcatgaacggtgattgtctccccagtaactaagcactgttagtcctaattaaccagtttgcaggcaatttttcaacctatcaaggagtgaaataaaataatgagctcagctgagaagaactggaaaagcagtgagttcactggggaaatggtgttttattaccaattccactcagggttaagctacagagttccccccccgacccccactttccttctaatagtacctttgagtcaggagaatcgtgtcaggatattaagatgaaagatgcttctatatttcccttataaacgagcttgatttaattcatgattacagtcagttaatttggatgccttaatgatccctttctcagggaaaggaatccaatgaatgagtcatgcccgcctcgtcccatggcatttctaaggaatttctctattaaaaaacaaaatattaaaaaattatgttctgtttccagatgtgtttttagactttgacatcctctcattttgatgatgggaatcaacagaaagttccaggagaaggagattgagggcaggaggagaagggggtgacagaggatgagatggttagatgacatcaccaaattttttttttttgagcaatctctgggatagagggtgcttcccaggtggtgctagtggtaaagaacccgcctgccaatgcaggagacataagagatcctagttcgatccctgggtcgggaagatcccctggaggagagcatggcaacccattccagt

SEQ ID NO: 25191 - DNA, 658 bp, Bovine  19866881113154
ccctttaagggtcgcgggctagtcttgaatccaccagccacgggcaccccgacacctcgactctattcctccgtgggaccctttctaactaatcaagttctctcccgagactttccaaggtctaggagtggccgctgggctgcagcaaagagcttccttcaatgcttcaaacgtgattcttaaaaaaaaataaaaaacaaggagaaacctttcctggattgttgcctgcggcagacacagtttaaattaacttaaaccatttccttctcccacccccacctcgttatcctttttcacggaggcgagaagagaaaaccttttcaggaaaaagctactggagacgcttctctttctcttccctccagcggatgccaggcccggagatgctaaagtttgcagcccgcgcgctgcagtcgccgagagggaggtagcttttagggccggttgctagagaacgagggcggctcgggtcccgggggaaggtggccggtgccaagtccagccgccgccccgcgctgcagtgccgcgctcggccgctagggtgcagcagggccctgcggatggcgcggctccccgctcggcttcttgcatgcagaccacgtccccggcagcggcggcgggatgcaaaagccggcggcggggcggcgacccgagctgg

SEQ ID NO: 25192 - DNA, 2459 bp, Bovine  19866881115796
aaaatgtcatgggtttctgcccaggatcacagatgcagaaagtggcagagccaaacctatatctgtctgaccccagagcctttccactgtcttaagctttgcctggggcttacctggtggctctgatggtaaagaatctgacttcaatgctggagatctgggtttgattcctgggttgggaagatcccctggagaagggataggccacccactccagtattcctgcctggagaattccatggacagaggagactgacagactacagtccatggggttgcaaagagtcaggcatgactgagctgctaagcatgtgtgcatgcaagctttttctacagccccctctttgatccacttcttgaagattctctctctctctctcagcaacatctcctcttttttcctcttcttgtgctttcagtctctgcaaagacaccccctctttgggaagctttccctgacttcctcaggctcagtcacacgtaccacttttatgcttatctccatcctggccaaatcagtcaggatagggtgagctgtgctgccgtaacaaacaacccaagatcttgggagcctaaacaatgatgtttaatctgtctcacagactacttgaacatctaaggttgccagcctcactccagtgccccagtgaaccaagcagcctctatctagaacattcccaggcatcgtggcaagagtaacaagggtcactgtgtggggattggcatgaaaacactcataagactgaacttaagtaagaagctcacagtttagcatctaaagcaatagattagacttcgaggaggcaggaagcctagccctcatgtacaaccatcctattggtaaaccacatggagtccaccatcagaactcccatcacattataacatgggaatctgctgtcttctccactgtgagcttcttcaggctttggttttatatgcacgcttttgcctcgcacagcttctataccaaatagagacccaccatctgcatgttgaatagacgcatagagagatgcctgaatgcagtccagacaagagccctttctccatcctgactcctcttaccacctttaccacctactaccacacagaggaagctcatttgcataatgattccttgtccacaaacatgccaggctcattctcaagtgcagggcctttgcacacgctgtccgttcttcctgggacacgctccctgaaatccctgtacactggagatgccttcctggaccccctcacttaaaagagttcttcagctgcagccctccgtagcctcacattttgtttcattttctgcacaggcattcttgctgtattacattgtgcgcatgtatgtgctaagttgcttcagtcatgtccaactctttgcaacactatggactgtagcccaccaggttcttctgtccatggaattctccaggcaagaatactgaagtgggttgtcttgctctcctctaggggatcttctcaacccagggatcaaacccatgtcttttatgtctcctgcattagcagacaggtttttttgtttttttttttaccactagtgctgcctgcgaagccattacattgttgatttgcttccttagtgcttgtcttcctgatgaaaatatggctgcctgagcctggacccttgcccatgaggtttatggctctattcctaaaactggtataacatttgaaatgagtcaacagacactaaatatacatttgttgaattgatgaatatgtgaatgaataaataaatatgtaaatacacagctgattgccacagtatggagagcaaactatcaaaaaataatctctgcccttctacagaaaataatgtctagagaaatataaggcatgagctctagtttccctgaattttttttaagatcctcaacccttcagaattagccctatgccctaaaatgtaagatgacaagcaaaatgattgcaaattaaatgtttaattaatgtttattattgctaccatattagtttgcagtcaaatttatgacccgatagatttgccgtctttatgaatgacagggttgatgtcttggcaccgaggcctttggcataagcagggagttcagtgcatttctgccatcatccagtctatctcctcatgagggaggcaactcttcaaactgagagacatacgacccctcactcattcatcctgtaaagcctgattaacctatcacactccaaattattccaggctctgcaatgagcagacagggaatgagtgaatacacacatgaatttattcatttatcaaacattagtttttgtctccagcatgtaggaagtgttggctaggtggtgaataaaacagaaataaaaatacaaggtgtaggtctggttcagactctagttgttcagtcactgagtcatgtccagctctttgcgacctcatggacttcagcgcgccagtcttctttctctgttcttcactatctcccaga

SEQ ID NO: 25193 - DNA, 1043 bp, Bovine  19866881177790
agggggtttctccatggccagcaagacccactgcagggctgctcttccccagggacccgtcctgacaggtcctgctcagagtctgaacagggctcagcttccaggtaattctagtgatccctgctgatgtggagaggaaccaagatacacgttcatctatctgatagatgaacaaaggtaagtggtgtaaatgcctgtatttgccccctcagataagggtaacaataaaacaaaggattagattagatgcttcagaaatcaccagattctacccagcttacccgcccccgcaagcccaaataaattgtgcacaaaagaggtctccacgccccctccatctctgtatgatttaactcttggggaagtgcattccacagaccccagactctttatctacaatgaagacagtcagtgctaaaactgttcaggcagcacctgctggcaacgtgcagagtgcagacgcctggaccctgcgcccaatgaatattacccagaatgtattagctgataacacaggcatcccaaatcaatgaggaaatcatctcctgcacacaatcagcacaaaagaaggatatttgcagagtccctccaacacagtctggctattgtcaactcaggcgcggcaaagtgattaatgcacgtgtgagtaggagcccagatttcaattcttaggatgatgtgcacacaccgttccccgtcccccaccctttatggatgctcaacacttaacctactcaatggtttttatttgcattgatcctattttatggtatgattaaatttgtatggaagagaaccaattagttttgttttacacttattgaatgcactttatagtcagacgaattaactctcaacagtaggttgatttatccagtggagggaggcttgatgggctgtgcagggtcatgaggataggggcactggagggctggaatctccaaaaaaaaaacgagcttaaagtgctgatgatgatggcccagctcatcaccgcgggggtccgggtgagagtacaaggctgtcacgcaatgtaatttcgagaa

SEQ ID NO: 25194 - DNA, 987 bp, Bovine  19866881190992
cttttgatgcatattgttaagctgttttcctgaagagtccctcagttctgcctgtgacatgagtagtctcactgcatcccgccaggatcggcattatggcctaagagttgttctccccagtctaatagatggacatggctcctgtctcttccagttggagctgattattgactcagacactggctttgcgtcttccacaaatattttgaacctggttgatcagcttaaaggcaagaagatgaggaagaaggaagctgagcatgtgctgcagaagttcgtacaaaacaagtggctgattgaggtatttctcgctgtgggttttccagcttggctcactttttaccatgaatcacactgtttcctccaagattgtatcgtatttaatgggtgtctgttgagctgaggccgttcaggtccctttatctcagcaatcccagacctctttggcaccagggactgattttgtgaaagtcagcttttccacagactgaggaggggggatggttttgggatgattcaagcgcattgcattgcattacattcccttctccaggggatcgtccgcacccagggatcgatccctggtctctggcactgcaggtggattttttaccgtctgggccctggggaagcccactgtgcatttttacgtcagctccacattcagatggtcaggctttagatcctggaggtcaggaacccctgctgtctgcatgaagcccacagtgaccctgcaaggaggaccctgtttactcaagtgacctgggtgggaaggtccaactggaagtggcagagccagggtctcaggcagctgtgcaggccctggactctgagccccaagcaggcggtgtagtgcggtcggcaggagcacggtgctgctgccagattccgccgcaggtgccccgtgtgcctcggctgtgagaggggaggaatagctccacctccaggtgagtgaggagcgggatgagggcgtggagtcacgccccg

SEQ ID NO: 25195 - DNA, 1032 bp, Bovine  19866881219290
agaagttggaggacttcatcaacacaattaacagtgtcctggagtccttgtacatagagataaagaaaggtgtcactgaagatgacgggagacctatttacgcgctggtgagagcagacagagccccctggtggatgtttagggaactgcagtggagacagcctctgccctccttcctggggtgcagatgaaggtgcacccgcctcaccaggggcgtggagggcgaaagacactgggcctggccacctccctgacccagtctcgtctctccatgctcgctgccggccccctggtctgtagtgtcctctgcagccatcacggttgggggtaatagaacctgggcctggctctcaacgcagcgctggctttattgccccacctggaatgccccctctaccctgagactgggcagcatgccttagcttttattttggttgttgccaggcatctgcaagtcaccctagatgaatggaatattaggggtaaagggataaaaatgccttttcgtttagaacaagacatagaaactttggaaagaaagaaacgtgaggtcactaaggattgagacctcgttggggcctcctgctgtgttcacattttttttttttccctcctggctagggaaaaggatgtgagatacaagcccccatctttgggtagggaactcctttaggccttcagagtaccacgcttctaccagccaggcccacacagaacagggctttagcccagggtttcccaaaccctattctgtggaagaaagggctgtggaaatgttgggttaagtcggtgaatcagtattgtttactgccagagttctcagtgccttctgcatttgaagccccactagcatgcagacaggcttcccgaattcatctgagtttggagctgtcacacaaccttgggaattctgaaatctctgaaaattagacatattgattgagctaaagatttaagcttgtaagactggttccaaatttatccccgtggcccacagtgcctggacacaaagtgctccaggactggtgaggt

SEQ ID NO: 25196 - DNA, 2030 bp, Bovine  19866881304107
acaaaggaacttgctgtggtttggggttgagggaagctctgtgggggaaagcgacacatgatgtgagattcaaggaacttagaacatggaggggaagagggaagagcatctcagtcagaaggaacagcacgtgcaaagccatatggcaagagccacaattgggaaagcgactgaaagtgactgtgatgggagagcagagggtggaggtggaaatgaagctggagggtctggcagggtcacacactgggttttcgaaccagtgaggggtagggtggagggtgtgttctgatcagagcagtgggagggtctgacctgggctttgaaggtgccctctagctgctatgtgcatagagggggcttgagcagaggaaaggacacgagaggaggacactgcagggctaagagatggggccgacattactggaatgcagagaagtggacagatgtgaaaactatttaggaggcaaaactgtcagatgtggtgatggatggggcattggggcagggtgatgggtaatgcattgcttgtcctctgcgtgcctgactgtttcctgaattaacccaaaggctgttgccggaccagcactggagactgctgggaagggctgctggcctctcccacccctccttgaacctggaggcccctgtccctgctcacagtcccagctgcaaaacctaggagcatcatgatgctgccttgctctgctgacagctttctgtttgtgctctcagatgcctctaactcacagataattaatgtcagccggctgtcaccacaccctggctaatcacagtgcgtgggggtaggcgcactggtcgatgagcagcccaaggacctgtcagccccaggaaagggcgtgtcactcgcccagtcattggagaatgtgccgtgaattttagcgcacgcctttctgcttgggaggcactggcggtctgcatcccatgggaagcagatgctcaaggtcatgtcggcacgtccggggacccaggccggacagcaggagagggaatagggaggtgggggtttgctcttgatgggtgtggacgcagcccctccccttcctcatgtgtgagccacaactgcatctatttcagactcaatactgtgctcaaaattcagttaattaagtgcgtttgcacaacgccaaagggctttctgcagttacacggagacacttgtagctcccccgacagttcagcctttgctgtatttctttgccttctgctggttgcagcttcctgatccctcctgttcccacccccacccgcacatgagccatgaagttcaactctttgtttagcttcattccatcctttcctttattcattcgtttgcttgttcattccttcaccagatcagcactgtgttcctgctgagcacagctctgcgtgcaggaaaacggtaatcaacgacgtggacacagtccatcctgggggcatggtctgcagggcgaggcggcggccgttaagaaagatgcaaagtgttgttaattacagtatcagcagttctcctttccatggtgcggtgcatttttgtctctgtttccatttctaggactctggttctgtgggaatctctctcaggtcgggaactatctgatttatgtctaattttttagtgcccagtggggcttcccaggtgatgctagtagtaaagaacttgcccaggagacttaagaaacacaggttcgatctctggatcaggaagatcgctggaggtgtgaccacatgctccagtattctttcccggagaacccccatggacagagaagactggcgggctagtccatggggttgcaaacagtcagacatgactcaggtgacagcacccacccgcagtatattcacagtggatatttagcgaaagacagagtgagtggagtagatgagagttggctttacgcacccagaatgatgaatacttctttatccagagagctgcctgccgtcccagccaccccaaggtacattgtgaagacatcagcacagtcgtgtgaaggaatagtcatgtccagcagacacagcctggg

SEQ ID NO: 25197 - DNA, 1880 bp, Bovine  19866881523173
cgctgcgcctcggttccttcggtgcaaatgaatttctaagaatagagcttatctgctagggttgatgcaagattaaatgagtcaaagcaatgttcaatgctcagaatggtgcccagcacttaacgccagtcagcgttgccgtttagtctctatgtcctgtccaactctttgcaaccccatggactgtagcctgccaggctcctccatccttgggattctccaggcaagaatactggcctgggttgccatgccctcctccaggggcaatccagggattgaacctgtgtctcctgcattggcaggcaggttctttaccactgagccacttgggaagttactcttattaataaatggaaggttaacatcatatatatttggaacagtaatgctgcttatgatttgctgtggacatatctcagaattggaaaggaaagaaaggcatattcttcatccctccaaacaaaagagagattgggccaaaagagtctggcatgaaccagggtttctgacagcttcacgcggccaggtggcaaagccaggctgatttcccaaacacaatatgcctgaaattatgctactttacccacctatccaagaggcattgtttattttcctccctctgcaaaaaggagattctcattgtctggagaaaataataataataataaaaactcatgtgctaggcatattgacagaacattctttggaaaacaacacccccctccaacttcttatcaagggctcttcatcctgtttctaaacattcgaaagaaggccaggctgacatgttacacatgactgacccagagagctagctatgcttgcctctgggtgtgtttgcatgtgtatgagcgtgtgtgtgtgtgtgtgtgtttacctgatattgtaactcagcctcaagaaagattcaaactaatttatgtgtaaataatgagttggtggcacagaagcccacctcctgggctctgtttgcagacgctgatttgcatgtgtcaaaagaagatgggaagacaggaaggagaggacagtcaggtccagtgattggttctggggtagaaacatggtggccacaggacagtgcatcctccttcttggtcccctgattagttgcttctcaacctgcattattgcatttttagtctcccctactagcatacaggaccaccacccccccgcccccaacctgccaaggcagagacagtgtctgtcttggtggccgctgtgtccccaaggctgaaaattcttcctgccataaagcagtttctcatcagtatttgttgaatgagtgagaagggatgaatgaggtgtatgacattgaccccatctaagtgaacctcagttttcttatctctgcagtgggtagagctgtgatatgccactcagacagtggtcaaaattaattaaatgggatcctctatgaaacacacaagtgctcagagggtacatcagtgtccacttccttcctgtctgcccgccaacctgattctctgggacgacagccaggtgagcctttcgagtgtacatgctaaatcacttcagtcgtgtctgactctttgagagtctatggaatgtcgcctgtgaggctcctctgtccatgaaaatcctcaaggcaagaatactggagtgggttgccatgccctcctccaggggatcttccggacctagggatcaaacctgcatttcttacatctcctgcactggcaggtgggttctttaccactagcttcaacttaggaaggctcaggtgagccttacttggaaatgaattataaactcagagctatcctttagctctgaggctgatgggagcctgtcagccttaagctgccacacttccgaccacacgcactaaaaattaatgtcccggaaggcaggtctct

SEQ ID NO: 25198 - DNA, 1226 bp, Bovine  19866881968601
tgaggcgtggttgacaggtaaaaaaattgtgcatatctgcaactcagtaattttgagaaaaagtatacacccgtgaaatcatcagcccctaaagtaccatattgcacacttaaaccttgctaagagagtagattttatgttaggtgttcttgctgctgctgctgctgctgctaagtcgcttcagtcgtgtccaactctgtgcgaccccaatagacggcagctcaccaggctcccccccgtccgtgggattctccaggcaagaacactggagtgggttgccatttccttctccaatgcatgaaagtgaaaagtgaaagtgaagtcactcagtcgtgtccgactcccagagaccccatggactgcagcccaccaggctcctccatccatgggattttccaggcaagagtacttggagtggggtgccattgccttctccattaggtgttcttaccacaaaataataacaataataataaagatgatgggagaaaatttggggaggcgatggaggtgtcatgctcttcttgttacaattatttctgctccctgttttttcaaacttctggtctactcctttctctcagtgcaaactaagggatttcccatgcttgaaacccctttaaccattattgaaagaaatttcaggaagaagaaggaaatgtttcttcaattcccccaaagagctgtggaataaaacagacagtgttcttgcatcatcataaactacttcaaaagtgagatggtgagaatattaacaaattcatcagtcttattctcttgttgagtgtggagaatagtgcgtaaataaataatcctgttctgtttcctgtgactataaagctgtaccagagaatagtcacacaaaggaatctattaagtcacctagtcatcagatagcactgccaggcctgtgaaatataacctataaccctcagatgtctccaactctaagcaaatgttcctgcttaataatttgttgccctagtagtaaaatttaaattgacacctttgtttactgaaaggtgcaaatcttgggaagtttccatgtgattctacagaaaggctttggaaatttcttcttcatgcagaggagcaaagaagaataataaatagtgaatactgctgatttcctaattcaacctaaagatttaagactctttttctcattaaagtaacagtacttatttgtcaagttaaggacgtttcttctcttctcactttccaga

SEQ ID NO: 25199 - DNA, 1567 bp, Bovine  19866880415063
tggtgaattttgacttgagggagaataatgatgtcaattaacaaaggttattgtttatttcatttaaaaagcttaagctttattctatatgcaatagaaatccatacttcaacaaaccagttcacaatcatattttactttatatgactgactttaacaataatttaaaatatggattgagcatggggtaataatggcaaataagtgcataaccatgaaaaaaaaatactgtgtttgtctaaagatgaaataattagtcccttagtagaactgggatacaatactcataagaaggaattttgcttcataatttgatctaagagacaaaaggtaatttagacccagagtatgaaagattttcacatagtaactgatccaattcaagctaaatagaaaaaaattttttttcaatgatcgtccttgaatatctgtcatgtttccagaatgatcctggtgccattgcatgtggacataggtcattatgtgtgctactattcttctgagatactctcatttgagataatttacaagtccatcaatgcattgttgtgctctaaataaaatatattcttcaagcattaagtcatatcctatctttataaatgatgctacaagaaaaagctaactgcatgatgcatcttcacagtcttaagacaatttattatggtggatttgatttttaaatggaaccataaattacacaccgcactaaaaattataagatttagtgatgagctttactgtaactctcctctgagacaaatgttgccataaaaatctaaatcagcatttaatgaattgacagaagctagagaacctgagagcagtgctcgatgagaaagacttaaaaacgttgggtctttaagaagaagaaacttgggtcagaaaataaaattctgtaccttcgccattcaactgaactgagctctgagagactgtcaagttacatccccaagatacgtaaaagatctgcagctgaggggacagcctctatctgtgcaggaaccagcatctcatttgttaatgctccaaatgcaacaaagaattaagctgaagcatctattcctacacattcagaacaaagaacaaatcctgtatttagtgtagtcacacacaaaggagtgatctggaaatgtaaatcaccaaaaggatttttccctggggcgttaataacaggtcagtaattactctgaaaagcaagagacagatagaactctctggaagatccaacccaccctgctagacaccctcagtgctttctttggagcaagtagtttaaattcagttggaaaatatattttttgtctgcaatatctattaaatgtttaattaaaggaaagactccttttcaaaaaacaattcaatgctagaacactaggatttttttttaaccctctttcagctgttactcttaaaaacaacagatcattattgtcctcagtgttaggcaaattccaagtgaaattatattaagtgggtgttgttttccaaagcagagttatatgcaagacgggaaatgaccaaagagccatgatcctttataacaacatattatgaggacataaag

SEQ ID NO: 25200 - DNA, 1755 bp, Bovine  19866880461393
aattttcctcctgctttaccaagtcagtctttttgttgttgttgataatccccagcatttgtacaatacttcctgaggaagatctctgataccaatgcgtaacaggcttcttaaaataattctgatggacacatttagtgctattttttccccccacaaactcagttcttgtcttaaccatgaaattgctttgctatgcattttattaggcttgaagtcttaatactctttttccggctatgaactgaagaggatataggtccccggataaacttatctgctgggaaaggaacatagtaatgtaatctcctaactggcctcatatcttttggctgtgctctgcacaaatgcatctgaagacatttatctgactcaaaagctgagatcttcatgaaagcaggttagctctcctagattcaaataactgggtttatatcctgtgacctaagggtgacttgtgagtattaagccaacctgtgggtgaaaagagaagtggccttaaaatagtttagatttactgtgaaaggcaaagaggtgagcagtgcagaggaagagaaatggctgtacaacacttcctgctgtaaaagaggctaccttgaacttgctgattgagaagaaataatgcagtgccttgcaaataaaccatgctgatggatgtcttctgctagaacggagctcactgtatttactctctttctgtttgatgtcagcatcttagcactcagcgtgaactctgctacagctaactgtcgaaataagttatttctagtcgataatgaatgcttccctaacatgttattattgaaaataacaggttccaaatgtgtgaccgtatggtatacaattcattttcttcctctgaaagaattggattttcttgtcattagaattgaattgtgtgtcgacacagtactaagtcagaacatcctgaatccagaccaaaggcaaaaagttacgatgaaagattataataacaattgcaattgaacagtggtttacaatctgcaaagagcttttgaaagtactgctttggaatgtttggtcactaaggaagatagcatatgtatttttattcccatttaagtaaaaggtggatttaagcataggggatttaagttacttatccaacatcatcacaaaactgataattgagagcggtgaggctcaaaccctgagtatctgcttccgaatctaatgttctgtctttccttcctctaaaagtaaatacaattacctgaatttgcttggctatttttaacaatagaaagagagaagcataaaggcccttgttgtgagagtgactgcaaacagctgagagaatgtcagctactacatgctggttgttgggtcacacagatagttagagtggcatgctgctgctgctgctgctaagtcacttcagtcgtgtccgactctgtgcgaccccatagacggcagccaccaggctcccctgtccctgggattctccaggcaagaacactggagtgggttgccatttccttctccagagtggcatagacagggtttaaacacatttctgacatgttcaaaatcacacttcaaggtatatacatttaagaatcaaattttgaagacatggttttcatcttttcttgttttctttgccctctaatatgttaaatgattactagaactaagtatgcttcgtagaacctagggcacactcagaaattttcttgttttaggaacttaggtccatgtaaagaaatgtatagttcttcccgctctccttct

SEQ ID NO: 25201 - DNA, 960 bp, Bovine  19866880495231
aaaatttatgttcctggagagggtctgggatggattacaggaagcaaaagagaggtaaaagatttgagcaaggaagatagtagcttgattaaacatctctggagaagataaaacaaatttttctctcctaaaaattagaatgagaacataaactgtaacaggtttttataggcaggttggtattagaaaaaagagacatttgaactcatttgaaaaatgaattggcttgttctgaaagataatcagtacttggctccttaccaaaatttctctgacatcaagcaaatgcacagttcatgtttatccagataaaagaagaatctgtatctataggtttaatattacctggcagtgaaggttctctcaaaatagatgcttattttagaaagcataaattcttattgggtcttctactctcctgtgtagccctaccacttagcacaatggtgcctggacctctgcatccatctccgttgtagaaatgcatgaagatgttgggccagagtctttgatgttttacatctgctcaaggtacttgctcttttaaaagaattctattatcaatgattttgcaaagaaaaatgaaactgttgggtcaggaactgtttatctaatttatctttcatgattatctggatattttaaaggaaagtgggcctgaaggaagaagtaatgagtattttgctctgagcacaaggcatatttcattcaaaatatacttggtttttagccaggctttccagacttacatttatctttacttaaattcaagtgtgtgactgaagctaaaggtcactttatttaccaaaaccaaaatgtcaacaaataagcattctctctcctgcttttctcaaatcagcatgcaggggacaggacacaatgctctaagaccttctccacagagatattaaagaaagaattaatccatacaaaatatgttaatttcggtctacttaccca

SEQ ID NO: 25202 - DNA, 2667 bp, Bovine  19866880507227
atgaagaacagcacaactaactccaaaattatcttgaaattggtcatgtggtgatctgatcagcatcatcttcattgttttaagtatagtcgatctttacttgctgggtcattttattcccatttcttgaggccagttcttggaattatgtaaaatggaatagcttatgttatggctatagtcttgtcataatgtagttaatttcttccaaaaggtgggggtttcagtatttgcaaaacagctcaaaggatatggctcagaaaactatgtatagcccttgaggaggaactaaaggtccatgaagttgcttaatggctaaatttattattttgtcttgcttgactgttttctttgcttccgcattttctcacttcctggattaaatctattctatggctaaagctttttttgtttgtttgtttgtttttcacaaagaagagtcaagtggagaatatgatgggtgcagggggaggctacctgtctcatgaaggcttcacagggctctgctcagttatgaaaatacaaagaaccataagggactaaggaaaacaatgctgctgatgaggccttgggaaagatttttcctgaacttcctttctaagttttccttgcaggtagactccctcagacacttgagtggggatttaaccagacagaacaatgtgaagaagtagtagctagggaatccatgctttggagtggcagcagtgtcagtgaggaagtgagtggtgtgactttcaatgtctgtgcccaacagatactatagtgggtcctccccggactgccccacagtgtaattagcttatccttaaagagtagcctccaagcctgactccacctcttctggatcttctgtgagcttcccaatacaatttattcaactgctcttctacttaaatgaagtagagaacatcctatttcctacagctggtatttaagtcacaagattaaagtggcagtatactctaataattagaagcatggactttggaatttcaacttgtgtttgaactctttcttttccattcctttagtatatatttatgggtaatatcttttacttctctaagacttagtcactaatttaatatttggaaaaatattaatagcaaatttatagcactgatatacatttaaatgagttgatgcacaaagggctcatgtgtatcccagtaactgctcaataaaaaattattgttattatatgagttataatcccagctaaattaatgtgttcctatctcccaaacacatactctttgactattatatactattcctcctgatatttcactttcctaatctgcccttaggcttcccaggtggcatagtggtaaagaacgtgcctgccaatgcaggagacacaggttcagtccctgggtggggaagatctgctggagtaggaaacagcaacccactcaagtattcttgcctggaaaattccaagaacagaggagcctggtgggctacagtccatggggtcataaagagtcggacatgactgagcaactaagcaacaacaacagcaacaatctgccctttggagtttggaatacattttcaagaagttctccttactgagaatagtaaggagaaatcatttatttcacactcatgcaactacagtttgttgccttcaaaaataaaagcatgtaatatatattgtcatatttcggactattttttcttcaatgctaggattatcatcagtataaagttccttactaataaaaaagtgtactaatttcaattaaactcaaattgaaaaaaaaggagaaaaacatacaactactatgcttaagattgccctttgctaactgaatgcaacaatatcctgcagaggaggtgagatgtacctggcctcaggcagaggctttgagatgagctccttgttagagttactgattatcactgaaaaatagtgtaacagagacattaaaagattcatggtgcttcaaagaaatgcttctcattttgacactcattaaggtttgattcctaaattttcaaagcaaaaccacagtagacactttgcagtgaacttttttaacatacaaaaaaaaaaaaaaaatcaccaagaatatctcattttgaattaaatgaattttatattatggtgtagaacatcttataaaaaataaaacatcaagtttactgagacatgtgcagcttccttgacattatctccattcatcttgaacattccttcttttaaagctatttaaaatatttctgatcaggacacaatttatttatgtcttagtactcctttctattgctttctgtctctccctgctctgatcccttccccatatttccatctcattagaactgcatttactcagccagagacagggcagaacaagtgaagaagagaacatatttaggtggagaagattgatttatctacacagtaaaaagctaagagtaaaggagatgggaaatctgaactgaggaagaggtgttaaaaagatttctgaattagttactgggaaaatttaaaagacttgataaagaaggtgccctggaacaattttatgccatgagaaaattaaggaggaagggaaaggggatttgaagggtgacactatgtacagctgacccttgaataatgggttttgaactacacatgtccacttatatgcagattttttcaatagtaaacat

SEQ ID NO: 25203 - DNA, 4872 bp, Bovine  19866880530244
ttatacctactttgagaacaattttctatttgtacatattcatgagaaaggaagtgaataacattagacaacaaatatgtatgtgcatatgaaagtatatatatgtatatgctcatgaatttttaatataatatcatgctatagaatttgttctgcaattttttaaacttatcaacatgacaaggaagtctctttgtatctatttgcatgaagttaccttatactttttaatttcaaaataaatatttttctcttatattcatatacagagagttgcggtattgttaccaggaagagttaattttgaatttctgctgttctgtgactttaaccctcatcctgccactttttgttgttgtaggcatacataatggcctgcctcaaggagataacctgagctacccacctgtgaaggactgtaaggaagtaaaactaatacattcccctgcctgaggcttgccattctaggggacatttgcaaggattgaatagtctttttacttcattcctcacctcccctccatctcttatccatgaaagaactgggcaaccaggcacctacaagtttgttattttgaggtgctagtctgccatcttcttggtcaggtagctcccaaacaaagtcccttcctagtcccaacacctcatctcattgtctcattgacttatcctgaggctagcagagccagcttggactcagtaacagtatgggaatacataattgttgattctagaagtagtatttttctattctaattcagactcagtcacttactattaatattaatgtaaacactttaaagctctttgtgactatacttccttatctgcaaaatggcaaaataataacatatcttaataacaaaataataatttattcaacttattcaacaaatattcactaagctccttctagatgccagagagatcaaggcacctttcattcttcactgaataaagctgacaaggattatttttttaatccctcatgaagcttaaattctagaaaaggactacaaaagtttacaaataataataaaataaatccatgaattacatagcattttataatgagctaaactgaactgaactgatgcataatagaaaaagtagaacaaggagggcagttggccagaacacagtgagtgaatgataaaactgaagattaggctgtagaattaaggagggcaaggaagaagggtaaagcaagtatttgctgaactttgagagaatttgggaaccactgtcgggggaggattcagactggaggtgtgaggtcctcagatttacaagattcctttgactgctttctgcataatagcatgtaggtgtggaacaagcatagaaacataaagccaattaggaagctactgcaataaaattgagattagaattgatggtgactcaagcaggatattgccagtggaagtagttgaaagtcactgaatttggacataacttaaaggtcaagaaaacaggatgtgctgatgaattgaatttgagatactggagaaagcaaacattcagtgatgacttcaattatttagcagttacctggaaggatgaaattatcatcaaatggaaatggggaaactccggaagaagtaagcttagcagagaaaaccaggagttaaatttaggtcacattacatttgcaatctcgtaatatccaaatggagatactgagaagtcagttgttaaataacataattcacatctagaaatagctctcagagatactctgatgtaagctaaatttgctggattataacaacaggttactaaagaagatgattatgatctttcattcatagtgaataccaggttggtggatgtaaaatttgataccagggttttagctttgttaggtagttagaataggaaataggagtccaaattagcagcagctaaaagacaaagaaagcaaaaagcctgtgaaaatggaacaaaggaaggtctgaggaccagagtgagaacctcaggtgaaaaaagagtcctcctggctagcccaatttacatacagcaggctgggaaaaggggggcagaaaaaaacgtataaaaggaggagccaaaattgatctctcttctttagggtcaaggcctcaggcctcaaggatatattttcctttgcttgccaaataaaactgagctgtaaccaagctgtaacactggtggcaaatttttgctgcagtgagacagaaccaaggaattacacattccccccaacagcttcaagctccatgtgcatgacttaaacactgataaacaggtgactgagtgttggcagttgtaatatgtatccacacaaatgccatatgctgctttattaaatgcagtcatatccgttagattcctaacatgtccaagtgctaggtctagctcaccagaaaaataaaacatagaaggaatcatgccctccactccctcagattctgatagaccttctatgttttgatggaatccacactgatcaagaaaaagaatcaggttgagccagtaatagcaaagacctctctctgagtttagtgaccttgatgggacaaaattataatcctgcagtgtctgtaaaaaggtattctagaaaagaaaagcaattcttatattgacccttccccttttgaagagactttcaatctcactactccttgtaaggtgaccagagattttgtgttgtttaataagatggtcataacttattttacacatttcttgacttgacagcattatttggcacagttgatttttttatgcttgaactatttttctcatttggcatctggaacctcattctctcttggttgctgttcctttgtaatatccagccatacctccatcacggccaaattgctctgtcctcaatttctcccaaagtgacggcaaccttcgaaaattctccacccaaagcgctcggcacttatttctcccttatatgatttaatcaattcataaacatatacttttatttaaatacattcagaatcagatccctttgcaatacttccactcaactagcagcttttgcttaggttttagaatttctaaagatttttattctagtgtctttactctgcttcctaacagttgatccttaacatagcaccagagttcattttccaaagatttctttcctttgctcaaaatctgtcagcagtttttcatttaattaatgaaaggtcctacataaactgacattatctcctattgctttaagacttgttattcagctttatccacactggtttattattatttctgaaataccctaaagcgtcatcacatcttaactgcctcagaacatttgaccctgctgttttctctaccaggaatgctcttcctgacagttctgtgactcactttcccttcctccaattatcttggttgtctagtctcttctcagtgattccttctttaagacccaacaaaagatggcaatccctattttcctcagtaccaattttctccatgagaaatatcatgtatgcaaaatcttgtagcttgtcatgttcctccaactagaatgtaacctctatggatgctataattttgttcccccaaaataattgttaagccaactagtaaattcttatatgaaatggtgcctgtgtttaattattgaacagggaattttctctcctaattttctctttagaaaaacattcctagggctatttttattagatcaactctccagatgccaggtaagctatcttacctgatttttttgtctcctctgcctacctgcattatactcaatgcagtgtcacatttgagacttcttggagactctatattttcttcttgattagtgaaaagttgaaaattatatatagtatgaaaaatgtctggtactgttttgaattattaaaacccagcagacacctgaacataaaggttatataaaatatctgtcatttcatcactctcatctctatcattatcgttttcatggttatagatatcatttactaagaatttactatataacagaaactattctcaatctctatgtatactgatttgcttaatcctctgaacaactgtatatcgtaggtatcacctattttatggattgtgttctgtattttacagatgacataactgagacaaagtaatttggctcatacttttgtaacatatatatccaacttgaaagtggctggtggttaaaagaaatacaaataatgagcaataacctactccacatctacagatattaaaagagaagaggtgggttctggaacaagatggtgaaacaagaagattctaaactcatctcctttaagaacacaccaaatctaaagctatttatgggacaatatcttctaaaaaaagacctaaaaactagtagaaccatttttgtacatcagacaaaggagaagtaggaaaggctgagatacaatctcaccataaactctacttcccaaccttctgccccacatggtgacccataattgtgaaggaattcaaaacttgtctcttctccctgtggagtgaagagttcatatcccacatggggcaccatagcttttaagacgtatacctgagagatgagtttcctcaattatcctaactttgaaaaccaactaggcttatgtctgtgagaccagtggggctatggtgaattgagaaacaactcttaaagggctcacaaacaaactcactcaccccagggcccagtgcagaaacagcctttaaaaggtgttccagcatcatatgaaaaagcttatttggtaattttaaaacagagttagatgtggggttatattgggatattctcaaccaacagagtctggtgggcaccatattttttactttaagtttttaaaattatttatttatttatttaactctagacacatttccctggcaagc

SEQ ID NO: 25204 - DNA, 1763 bp, Bovine  19866880533437
atggattttatacagttttgtgatacgggaccatgtgtgtgtttatatgtttaaacaatactatattgactcttttagttcattttctttttttctaaaatcatgatagcagaagaaatggaggataaattcatatatatgtataatatatatatgtataatataggcagaaatggaggataaattcatatatatatatatgtataatatatatatatgtatgtataatataggcagaaacagtccactgatataactggagggaaagaatggcatagttgttatagacagtcactgttctttgattttagcattttcacttaagtatagcgtatgtggaagagcagaaacagagaagataaaacaagataaagcaaaatgagtgaatatggggctgtttggcttaccatcttttctcccacttaaactacccctctgaattgactgggccacatcacaaaatcaggaggtgaactgacttttcttttaaaacttgcaaactctcattttctctagaatagagataattaggtggactttcttgtgctgcttctcttagattggactaaacttaaaacctattatgttagcagagtatttaattgaaagaagtattttccaatctagtaataatgaggaaacaagatctaaaggacaaaaggaaagttttgtggcaggtgtgacaggtggaagaagagtagatagaaatgagataatgaagagaatggtctataaagtctgatgtgcagccagactagaagttcaaataagaatatggagaagttgagaaatgggagaagagagaggaaaagtaaacaataatggaaatagaagtgtaaatatacacctaattttcaaataggcaaaatgcttttgcttatatatttttaaaagacaaattgcaaaaggaaacattatgacaatacaggtaaaacagtgtatgtcatttttttctcatgaccaatagttctgtgaggccagagcatgtcatattttggaattatttttttttaagttgtctatgacttagtgacctagaattgacatctctttctttaaaatcatcaggtttcataaacacagagatttttgacaagctttcgctcttagaggggcaaatggaaagccctactttaattttaatcttatgaaggattactgaaagaagacataaagacagtcatagagtattctcttctcttcattcatcacatatcattcaccatgcaattcctattgacatgcctccaaacatgtcctgatttcactcattttttctgtgtctcattaccatcctagagcattcctgtatcatccccttcatgaagagttatagctttctaactagacctcttagattccctctaaattctgtgcaagctaatcttcacatggccaccactagatccttaagattgtacaatagattgaatcatttctttatttaaaacagttcaatgattttcaatctcactaaaaagaaagtcaaaactcttaaacctaactcacaaaactttatgatttggaacatggtttacagtcatctgctttcttccctgtaaaaacatgatacccctatccttctcatgtgtcctcatggaggggagaaaatacttactcataccctcaccataaaaatccagattccattgggcaagggaagtcatagactctacacaggcatctaagtacaagagccatgcaagaacaaagcatttcatctatccctatcttttcatctggtctagcccctatgcatttca

SEQ ID NO: 25205 - DNA, 1843 bp, Bovine  19866880568445
acattaaaatttgggaggtctaccctgtagagttggagaaggtgatggcacccaactccagtactcttgcctggaatatactatggatggaggagcctggtaggctgcagtccatggggtcacaaagagttggacactactgagcgacttcactttcacttttcactttcatgcattggagaaggaaatggcaacccactccagtgttcttgcctggagaatcccagggacaggagagcctggtgggctgccatctatggggtcacacagagtcggacacgactgaagcgacttagcagcagcagcaccctgtagagtgcaccacaggatagtagtttactatgtttaatttaatagcaaaagttaggggctttgacctacagaggtcttcagtacattgctggtcacagtgaaaacataggtgatattggtgaagtgtatgtgcatgtgctcactcgctcagtcatgtctgattcttggcaacctcatgcattgtagcccaccaagctctgcggtccatggaatttccccggcaagaatactggagcggtgggcttccctaatagctcagttggtaaagaatcaacctgcaatgcaggagaccctggtttgattgctgggtagggaagatctgttggagaagggatagattacccactccagtatacttgggcttcccttgtggctcagctagtaaagaatctgccagaatgccggagacctgggttggatccctgggttgggaacatcccctggagaagagaaaggctacccattccagtattctggcctagagaattccatggactgaatagtccatagggttgcaaagagtcggacacgactgagagactttcactttcaccgtttcctgctccaggggatcttcctgacccaaggatcgattctacatcacctgcactggcaggagtgttctttaccactgcaccacctgggaaaccccaggtgaagggtcaggcttcgtttcaggggatagaggaaaggagcacgtttagagatgaaacagggcatatctgtgagctttagctgtctaggcttctcactcatttagggttgctgaaagaggaaaggaagaaaaggtcaaaaagagcatggcatctgacatcagagtttgagacagaaaacccccacatgaacacaaagaaatgtatgagcattaattaattattaataattattgaaaagactaaatcacagaagaattcatttttatttaatgtaagatttgggagtaaattatctgcccatgtgatgaataatactatagttagacctgctttactacttactgtgattcttactaaaaccaacttaacctaaaccaagtaggaacaggtgtttactaaacttcagcagcaaactaattttattttgcatttgtgcagttggtaatggtgatactagagtttactttactcgccacttaaagtgaatgggcttctgtgattatccaacacaatagtctggagtttcagggactcttaagtaaatctgaataagaattttcataagtgcttgtgaattgaagctgcaaatggtttaatctaaatcacagcatgagtaattacgtaaatccttctcacataaccaacaattcactagaggccagatctgtgacaatcttattctctagcctggaattgtgaatggaacttctaaaagagacactttgctttcataagctcatagcggctttcaatttctggttaggttatctccaaattaaaaatattgattcacataaaatagaagtaattttattttataataaagataataataatagattaatagtaaacatttaaaatgctttaagcatagt

SEQ ID NO: 25206 - DNA, 710 bp, Bovine  19866880605843
aaaagaattgaatcctcttggttttatttctcgtagagaactggagcagaaacaaagcaaaacactttatctccccccaggatctagttataccttttactaagacaaacacatcacattcaattctcctctctcactgctgacgagggagaagaaatacattcagagaaccaaccagaacagccagattattctcacccaaaaataaaccgtggctttgtttacagatccctttcctgtctttacccactgtcctgtgctcacagaagcaagcaagttaatatctagcaagaaaagaaggtctctttttttgtggctgagatttaaaatatcaaacgggctgaaatgtctgaatgcttggcctctagcaattagtgtcttggtggctaatatcctcctagctctattagttccagatcttttgcattatatccttggattttgcttttatgctaggcaataatgcagtgaaattgctattataaaggttaaggggaaaaatccttgcacctctagttgactctgtattgatctagtacaaaatccaaccattcctgagacagatgggggagctctgagactctcaatcccaaaattgcatctgctggttgctgttgctgctgcacatgttgacaatagctatagtctgaaaagcagggtttacatgcctgaaataaattgttttgattagaacctttaggagagaaagt

SEQ ID NO: 25207 - DNA, 1710 bp, Bovine  19866880625437
ctatttacataatgaagaggactagcatattgtttctatctataatctgacaccaatatttgctctgatctctgtgttgaatagaacaactcttcctagccatacttaaaataccatcttaagtatcattgtctcaaacaacttttttttacctctttatacatttttactatctggaatttttgttttgatttttggtatcaacttctcctgttagactttgaactccatggtgctatgtattatcttaactttgctcaccaacacagccccggtgccaagccttgagagaggagagtacagggacacactagcttacactccctggcttgactgctgcctaggcgccttagccgcccacatttttctaaggtggaggtctgtgtcccaagtacatattctctgctccttcctgtggcgcatttaggtagtatctgttttgttttgcatggtggcctattgttttgatgtaggtaaatttgattaacaaaggatagaattttaaagtgctacaatgagcacacacacagaagtctgtcctccaatcttgctctttcaataaacctgccatcttaatattcatccgtaaatgtatgtgtctactttttcaaatttgtgtggagcataggatgaaggaaagacctatttgttatatattaggacccttacatatcaatatattggcacactggccaggaatcttgaaagagccagcaatgggttggtgttatgtaaaacacagtaccacatgggtaaatccacgtgggccggggtccttgaccttccaggactgcagctcttgtgcagcttgtggcagcacatgtcgatggcatttagcagctgttttataagtaacctgaaaatgaaagggtcagtcgctcagttgtgtccaactctttgcaaccccacgcactgtagcccaccaggcttctctgtctctgagattctctaggcaagaatactggggtgggtttccattcccttctccaggggatcttcctgacccagggatcaaacctgggtctcccacattgcaggcagattctttactgtctgagccacagggaagccatcataagtaacctagggcttagtaaatatatcttacactgacttttgtatctgaccttgactgatgtaggtgtagctttgacccaagcaggcatgaatgagatagggattagattattgagggtgaaggagtctcttagttccagtaagggtcacttgatacaggctcaccaggcattgaggggtgaaatgacttgttgcttgaagtgtttctcattgtcagctggctgagccatcgatctgcaaaaatagttaatatccatgtgggctatgactgggtgaggtttttgtctttgtacaataggcgtgtgacattaatagagactattaatttaactatttcaaactcttttctcttccctcacttgaaagggcatccaattccaaaaagaggcaagatgagacatgccaagtaactagtctcttagactctgaaacacagtcacagtctgtgagtcacagtctctaagagtcacctccttccgtgtagttccagactgacctgatttggtcactggatagcctgtgagcagggcataagagctccaaggtcgagacggcattgacctacaaaggggtggtggtttttattgaacatcaaataatgaagaacaagggagagagacatgttatgttgca

SEQ ID NO: 25208 - DNA, 1132 bp, Bovine  19866880708650
ctgtgcctgaatataatttgggaataattgaaaaaggcaaggaaatcctccctgattaaatttgtaaatggttgtctggagaaccattataatttacaaggatttgttgctcagagagtaaataataccagtgacagcatttcctcagagaacagaagatcaaatctgttgcaaggtaagtgccaatatttcctctcaaaaacacagtggaagagacagaggtaataaatgatgttgcatttatctcaatgcttatgaccctcctggctgcttaagagcaaagggacagcatttaactcttcccagagtggtagaactacttacttctgttgcctacagcagcctcaaattctcagagcataactgaatgaggtaagagtctacctaagtgaaccccatacaatcacatctggcatttttggcatatagagaaatgtttaccactttcatgtaataagctttttatctgccttgtagtaataatgatgataacaatgttcatggtataagttatagcaatactgtgtttatgtcatttagaataatgagaggtacttttcaattagcatttgcgagcgtctgctaatgcagcttgcttgttgaaaattataatttgcggtcctttattgcagagttaaacaccccccctcatacaaggtgcagattctagctgatttaattccacctttagctctcctacagcatataaattgaaagctatgcagcttgtcattcaaatgagttattaaaaattgagaccctcgatctcaccactttaaaatctggtagtgtcagcacatattaagaataatttatgaaataagaacagccattggtcaaatgttagtctcatatactggtgctgccattttaattaatccatgtccttttttaaatgggcatttgttatatccagtaaattattcttctattcatttagcaatatctggcccttcttggtatcttattacatagccttaataatcacttgacatttagcatttcctagctaacaatgaaatgcaatgattcatatctctcaaatggattataaactcctagagggaagtcattatgttctacattcattttattagttgattaattaatctgatgcaaagttaggatgtag

SEQ ID NO: 25209 - DNA, 1387 bp, Bovine  19866880758554
ctaaaactggaaaataggagtatattctgtgacatactcagtaactgttgtttcacagcaagtttattcattttctgcattgcagagttgcagcatgtgaattagggcaattaagaaaggtggtgacaagagtcagagcaagtaaactccatactgaaagcaatcagctggagggagacaagaatgtgaggagggaggtaaccagatgcagacatctggataatgttgattggcagtttaatggctcttgccttccccaaattaggcatccagtggctgtttctattctttcttaagtatgggtatacacagtgtggcaattctgaggaggaaaaatctagtgaaaagactgtggaggacactaaatactgggatttagaaataattggaagaatttagcttggaagctgttccaatcaatgtcccagcaaggaacaaaaggcctactcaaatgagataatcagaggagagttttacaaaggaactttgggaaaaggtatggacataatagcagaaaactataggcattatgcagatgactgctcttagcattagaactgttacttactacccctacacccaaaaggactcagcttagaagaagtacatgtcagaatttggaaagagagaatcatgcagaacagaattggtagtaggcttgccagagaaaatatatatatttgggacagtttatgttaaacaatttattcatcacttttctgaaattcaaaattaattgatacactgtatttttagttgctaaatctggcaaccttatctgtgggggaagaaccaaatttttgtgtttgtttgtttggtttactttctaatcctttgccaaatgatatttttgtaaaacacagtaaaaataaattactagaaaagtgaagaaaaaagacaaaatggaagctccaccttttgaaattaataaccagtatatataaagtgtccttataatacaagttttcaggtgtgatacatgtttcagatcattatcactattattattattattttaatatcttggggaattctaagggttggaataaattaataaatttattataaattaactatagaaaattttatagttttaaaatatccaaacttggaatcactcttatatactaaataatgctacagtctttagattcctggctaaattgaggtcatagaaagagtagaaggacacattattgaaaagtatctgagcaatcaatgacctacagcaactgagcattttatatgtttctatcaattcactgattatgattatataaaaaatgctgttgaaaattaagttaaaacgtcatgttgagtcttatttatttcacagaaaataaggagaagaactgactaagagtttcaaaataggactagaagttta

SEQ ID NO: 25210 - DNA, 2722 bp, Bovine  19866880768530
ctagagaaagcccatgccccacaacaaagacccagtgcagccaaccccccccccaaagcaaaaacaaacaaacaaaaaacagattaaaaaactgttttggggggcttcagagggaaattagagaaatttgtgatgaggtacacacaagaaacataggaggtactcaaatctttgctgagttttgaaaacattctcgaaccaaactggccaaatggattctgtacggtgctgaaagcctttccctcaagagtgaaaactttttcttattcaaactttttgtcagtgactggcatagcactgtatccaactaaagttagtgattctcaaagcgcggtctggggacctgggggacaggaggcctggaaggttaaaactcttttcaaaataatactaagatgacatttccccttttcagtattatcctgccacaaaatataagttcattgatttcagattccacattgaaagtaaatcttaaaaataatcactgttgagttttgatataaaatcaaagtagagtctacacagttatctgaaaaggctataaaatataaaaagtattcctcccttttccaaatacttatctgtgtgaggccaggttttcttcatatgcttaaaccaaaacagtatattgcaacagactggatgcagaaatagacaggagaatcctactactttctattaagagatttgcaaacttgtcaaccaatgccattcttctcaccaaatttttttttgtttgttttggaaaagaaagggtctttttaaaataaaaatatgttttcataggttaacattggtaatgtgcttactattgccattttaatataaactgtttttaaagtatctcagtttttcgttcctaatgtggtagatatagacagatataacccacataaaccaacactctagggtcttcagtggtctttacaagtgtaaatttgaggaccactgaacaaaaatcttattattttttatgataaggagatgaaaaatatattttatcttagtgtaagtaagactttctttgaaccatatcctaatactaatcatttcatccagagcccaggaactgatgtcacttgacacccaactgaatgctgtttctgtattttagggtacaacatctgatagacagctcaagtccacatgggccatttaatattacaaggtcatggggccaaccctgatccaaccagtgaatgcatgttgatgtgggttacttggatgaatacaacatggatgaacagaaatatgttttcattttaattggggctataaagaaatctgaaagttgtaagcatactttattcctgatccccaaagatctggattttctgggaactgctgtctggaagatcttggcagtacatgtgtttcaaaaatctagtgtggccgaatcataactaaactgaggattccatccttcttgccaaaatacactttgaaggctgcaaagatttgactgaaagtcctgatttcccagccctgaggtgaaagcagaagaaatgtatcgagtctttgagttgtcagcttgaagtgggaaagtagaaaagggtcaatgtgctcagaggcacagtaaaaatgtgatttgagatatactcctctgggctctggtcccaaacctgataacaaatgaaagtgagcacagttcttaccttctggtgaaacaggagctcggttaggaaggaactgtctcatgagcatttgggatatagcagttgtgcataaaagttagaacctctatctttcaggctattgtgacaatacagagcaacagaaaaacattttcatgagccttgaagtaacaggatccataattttatggactggagtatcttggagaccaggaattctgttagcctcaaggataatttgctgaaataatgcacagatgggaaaaaatgaggctgaactatatgcattcctttttgccattaaataggcaatgaaataaaagaccacatggagaaaaggggaaatcccacctcaatacattattccctatttgtattttagaggaggaagagaagtgacagaggacggtcatcactgggagtttaactggctggcagcagcctcatatacctgttcatggtatcagaaccccacattcggcacatctcatttaatgttaacatattttaaaatgccagggagcttaagagtagcagcaagtgacgcactgtaataaagaagcacaggggttaaattaaaagtggaggaagtaacctggccaaagaaactggaagcagagttcgtttgtaggttttatttagacctctgatttttctagaggaattaggattctttgttgcagttcttacttagcttgactgatagattttacttaaaatagaccctagtattctattcctgctatgaaccatagtagattattctgttataattatatttcattaataaaaatgataaaaatgtgcaatatccaattaagagatgagcctatataacctggaaaggattactttcttttcatcatcttataaaattacaaagccagtctgtttctttggacaattaatcaacaacatcctacctctcctgttggttaaaaatagctaaaactttctgttacatctgggagtacttcccaaaatatataacagcaagtcatgtctcataactcctttcaaagaggcaatggctctgcaatgtataattgtcttcatgctcatcaagccatagatttttaaataca

SEQ ID NO: 25211 - DNA, 1958 bp, Bovine  19866880780384
ctaaagacaaaagaagttgagagtaatggtttgggacttcaaaggggaggaaggcaattcaaatgaagatggaaaagcaaatgtttcatagataaatgttttctgggccaagcactgacaataggacccagagtggaacctgattgataatgagttttttccaccacacctcaccaatattctttgcagacatctctggtgacagctcgattctaatgacaaggcctctgtctactaaatttgtataggcagttacagggaaggtcaatgtttcttcctgacgttttggtccttgacttttcagttccaaatgtctgcattccaaagagacatttcaggtggcaaattttactctcctacagtccccaataactagtgtgcattaaaatttttatacctggatcacatatagcccatttgaatattcattattgagtatgtaaaatttggactgggaaacagcaaaaactggggatcactggaactgagttatatttatggaagctgcctgaagaggtcaacaggcatcttcaaaattgttcagttctttcttcacttcttggagttactccatctccttctatggattaaatctgttagtggaccttaacaaatataggaataccaaatagtcataaagtaagatttggtatagtgcggaaaatgatataaatataagcctttctttttctcattagtagtagatcaagtaaggttctcaacatattcagcaaagtattagctgatttaatttccttgtaatatttttgagatatctcttctttcagtgtagttgaatatgcactagggattctaaataaacagagcttctaaagaaaatgtatttaattaccagtgtgtacagagccatagcagttccatggacataataaatttggtaaccatgagagaaaatcagcattaatgaagagtaatattgaaaatcttatcagctggagcatttaaaacaaaactattaagaggctttcatttcattaggcaaccacaattgctcttaatatcattttagagctttaaagaaaggagttttctctttaacctcaatttaaatgaaaagctataaatgatctgacagtgttaatagttttaaactataatttcactcaggggagtctatgctaagaaattgaactcaactggggaaaaaagatttatccttaataatattaatcacagcatgatttattgactgaaaaaaggggtaaatctctaatgttaaaggtagaatgatgtaataatgcaataggtaaattatgataaccacaatctgccatgaaatgacctgccatgaaagctttaaaattatagtgtcatgatatggagaaacactagtgaaaaaaatattgaacaaaaaaagcttttataaatgtttataaatagttctacaagtttctagcagtttaaaatttaattagcatagaaaaattaagagatttcctaccaaattcaggaccttgtttgatcaacgaattactgctattgatactgacagaactgcctaaagtttcagttcttttgttccatcctgtgagttaactagtctccttcaaaaaactgttgaaaatcttaaatttaaaagatcaaattgcaggaaaaaaaaaaaaaacaaaacaaggcttaatccaatgagtaaaaattctaaatctatgtatataaagtataggcaagataacaaatatagtaagaaatggaaaaattcacagcaagccacatcctactaatttggagaaggagaatacagaaaggagctgggattttccaagttttactttatacacatttttacaacttgagtattttgtaatacaactaaagaaaatacaaataacaacaaaaaataaaataggaaatcatagcaaaatttatgtctattttcaaaagcatataactattttttttccaactacaattttattttatttttaaactttacaaaa

SEQ ID NO: 25212 - DNA, 3329 bp, Bovine  19866880788443
gaataagtacataaaaatatattgcatttggatttcccccaactctctttttcccgtggatttgagctcattatattcagctagatctattgattctatttctacagattctaagtgatttctttcagtttatccattgttccccttttaataaacagtggctagtaatatgacagtcggcagtatttattccatactattaattctatacctgcacaaggacatagttttatgctaaacaaacatacaagctaagctgcatcccctacaaggttaagttctgtggggtgcactgtggggtgattaccccaggggaaaatgcccctgtgggttctgcttatctctgaactaagggagactacatggacctcaaaccctgcatctgtaaaataaaaatctctagggtccctttcagcacctatgcatcagatttctgtggatactttctaacaatcagcaatcttctgttgtgttctccagtgcactctagaaagagccagctctgcgttctttgagatacgtaggaaaatccactttccatatggaaggtgccctgaaatgttgtcctcagttttcccaatgcctcttgggagtagaggagtgataagtttgctcacaaacccagtcctgtccctaatcttcctttttttttttttttgctttttggatagcaagtgtctcaggccaccaggtggcagaatggctttgggtaatccccaaagggatgtgcacacatcaattctcattttcttggttccattttagagctttgagttctagaatcattcctctgtgttttcacaaagtcgttggcactacaacttctagtcctcctcctatttatgtgtctccagactcacatatcccattgcagagctttctttatgcgaagggagacaaacatgtgggggcattctacaggtagttttagtcctggatggaaataaaaagagtcagtaaaagagtgacttatattgacttgaggagcaaaggaaaaatggttcttgattccatgtagttaagaatgcaaactttaatgtgaaagatgttaaacagtctcacactgtctgaatgttggttttcatttagagctgtaaccaagagagaataagtaaataataatagcaataatggcaataatcatttcaaatccctttcagatttctcaggcttaatgcctagtacttctgtctttcaaactgtagcaatgagtgctccatcagacctaattaggttctgttgacagtggctaagatcaagaaaccttctgtcttacagctgcttcttgaaaaacaggaagcattctctctccttgtcccaacacacattaccttttctgatgtgagaaccataaaagagtatttccacttataagtattcatgaaaaaatgcagataattatacttttcttccagtattgttatgggtaaaaaaaaaaaaaaaaaaggagaaacataaatgcttagcctggcatgtggcaagcactcacagaatggcagctgttatttttttttttgtaaaaagaactaaaatgattattacagttgcttccaagcaaagatttgtatgacttttgagattttttttctaagctagctcctctagcctaaaagagaaaagtggaaagaatggcagattgatccctttccagttggagagcaatactatgatgtaagggatcatactgctggattttcagaaaatagttacaagacaaaagacagaattaacacagaaatcattaagggtagacacgctaaaggcaaggtttttcttttaaaggtagaacataaagatactttccttattgtcctttgggttagaagtgagatgcattctctttctgtcaagcatgaaggatttatttaaattctaaaataaaaataccatgtcctatactttactttggtcttccctggtgggtcagcagtaaagactcctcttgcaaagcaggagacctccttcaatgcaggagatgcgggtttgatccctgggtcaggaagatctcttggagaaggaaatggcaacccactccacgattcttgccagaaaaatcctatggacagaggagcatggtgagctaaagtccatgtggttgcaagattcaggcatgactcagtgattaaattattaccataatttcctatgtgtagcctatcatatatactataactgattagagttgcgtgttttttttgcatttttatttatttatttatttattttaatttatatattttaattggaggctaattactttacaatattgtattgattttgccaaaaattccataacctgaatctggtaagtgaaaaataatcaagtaataaaatattaataaagatcaatttactagaagacatttacccttacataggcaaacatttcaatgacttattaatactagaatctgatatgcatttaataatatcaattttgtaaaagaaaaataattttatttgtcaatatcattagtgaactacagtaacatattttataagggagtatattttccatctaagcatcatatctgcagtgatgtttttcaattcttagaagcagattaataatgaagctaaaagaatttagctttagggttgtcatttcctgtaccctgaaaatactggaagttgttggtagttgtagggaactggagatgagaaaaattcaggtttaattagaagtatttctatggaaacatcatttataaattgctgaaaacaaaaaaatcagagaaaaaggatttggatatcaaaataggttctgatatgatttttttctcattctaaatactcattttatactgttataggcagaatagtatctttcaaaagagacccacactctaatacctggactctgtgaatatgttgcaagggaagaggtacttcaggttgcaaatggaatttacattgctaatcaaatgaccttaaaatagattatctgtgtgggtccagtgtaatcccaaagtccttagtgaaaatggaagtcagaagagttggtgtcagactggtgagatgttagaaggattcaaccagccattgttggctttgagaatgggaaaacaggcttcaaagccaaggaatgtgccaaccatctagaagctggagaaggcaagaaaatggagtctcctcaaagtctccagaaaggataacagctttgctcacatcttaattttatccctgtgagacacatttaggactctgaccttcagaatgaaaataataaacatgttgttttaagccattaagttggtggtaatgtgttacagtagccacaggacactgataaaaatacctacttttgaatttgcagtttcgttactttg

SEQ ID NO: 25213 - DNA, 1209 bp, Bovine  19866880893211
tccttgtagataataatccatcagagctcagatttgttgctttatgaaggatgggctcatctgatctttgtcttttgttggtgcctcatttctaaaaagactgcatcagtttcttatcacacatagagaagtgcaaatttaactctttccccacataccctcacacttctgaaaataatgagctttgttgtcatgccaataatccctgtacaaatataaagaagtatagaaaccaaggtgctgccacactgttgggcaaagaatgttctgtctcagaagtacctactgatgaaatcagatacatttgttaagtggcacgaatgagcagatgtaggtctgaggccactcaagatgtagaacttgaatttttatgctccaaatgggactctttcagatgcaaaagcccagtgacaaagtctctgagtctccactttgcttagtttcaagggctgctatgaaatatcatatgataattagttccagaacagtaataagcttttatttttaaatggcctacatgtttaatttactcgataaactgaaatatatctgatcttttaccagcctgtgccacaataacagctgttttttaaagtctcaactgggacagtagttaaaagtccttgcaaagtaaatggtgcacattcaattaagcaaaaaaaaaagctaaaacaggtattatttagtgggtttttaattagatgacttctattaaattggtgctctaaaagggatttcacaacctcccaagattatgctagttagaaatgaaaccatataaatcccatttaactctgtcttgtgagagttctcttacgggtaaggtatttctctgtcatcagcatccatatgcccagagttgcacccttcactccctaaatgatactcaagaggtaaaacaaggtagctgaatctcagctggtaaatcaaagagacagactttctggtcatgaggcaccacaaatatctaaccttgcatgcctgcaattttccaacatcagagacacagtgacgtgagtccatgagtaagacttttcttgttggaaaatgttatgaagcagagagaaagaaaatttagtcctttctccactgggaatattcataccctcagtggatcttaacttgtatttcagtaaatggcctttcaagttctatcccctgctagtcttgcaaggttttagtcctttttaccattgctgccaaatttta

SEQ ID NO: 25214 - DNA, 1683 bp, Bovine  19866880911265
gagttataaagaagtctaacgctgacttgaatattttaaaacaaagagtaggagtttaaaaaagcagcagaaatttcaacagatgactttaacatgggagaaagtaaataataaagaaaaatacagcaagctacacaggacttagatcatttaaatgctgaaagataaaagctagttcaaaatagctctaactcagaacagtgacacatctctgcaaaaaggaatatcaaacaattgcatatcattaagtctaaggtatcaaaatgtaaaagagtaaaggtaattttgtgtacattattaaatgtgagtgattgataataataaataataagccttttaaaaagccgaacattaaaagaaagagcaactgtaattaagaaaggcatacagagtctaaagagtcatttaacattgataatctcaattataggaaaaaatatgaagaaactgggagaaaagaatgtcagaagtgctactactaataaaatcataaatggtttccattaggtatactttattttaaaaagtaagataaaatgtctattttccaaaatttggggacctttctagaaattatgatctaagttctttagcctcagaccaattgagaagatgaatatagcaggaaagccctggctctcctatattttgaaactagattcatatatttgttcatctttcactagtgtgggctgtcaaaaagtaggtgctggcagttaataaattggaggctgttccacagtcttgtacctcagatcctccctaggataatcccctaagtgacgtcaagagagtgcggggaacagaccctaccagaactgataggcacttgctcaagctgcccaacagtctattttcttattcatgttgcttttgatagtaatttaatcttatttcatttataaatgagcaggcatgttttactgtatacatgaatgtatgtttgggggaactgaaataaaaattgaaaataggtgcattttccttgagaactttcacatctacttattatgtgcaggttggaggttaatcatttatcccattcttaaatcagagataactgatttaaactccagagctttgaacgaattgacaaattagtcattaagagcagatagatagaggtcagtgtatggatttcattaagaataaaactaattaaagactgtggcttggaccagtggtcaaatgtgcttctgaatcaccactctccctagccttcaccctcactatctttggcagaactgcttactgcaaagtcattggaaaactcagagaccgagcaacgtgagttctttcctttgcccaaccagacaaatgaagacaagttgtgggttataaatggatagaagtgttctcctgggtaatgaaatagaagttccttctcatctatgagataagttcctccccttgcttccccaaatttaggactagcccatctcaggacctcaagacagcacagaaatggccttgtcatttgagtggatctgattctacttctttgacattcttccttcctttttgacattttagtcattttactttaacttttctgtgattcttataaagaacatttctttttaatcatgcctgacagatttttcacttaattataatagtccatttgatttctgtgtaatcactgaaacactgggttttgatctaccatctttcttttcattt

SEQ ID NO: 25215 - DNA, 1720 bp, Bovine  19866880969126
caagccaagaagagggtcttcataagaaaataaacctgctaattcctccatcttgtgcttccagcctccagaattgtgagaaaatacatttctgcggtttaaaccagtcaactagtattttgttatggcatcactagaaaacaaatacaaatatgcatctattagaatggttaacatttttggcaaaataacaaagccaagttttcctgaggatgtagggtaactgggattcacgcacactgctggtgggaaagaaaatggtacaactaacttggaaaccagtttgtcagtttcttataacattaggtgtatattttttgattcagaaatcccatttctaggcattttttcagtggaaattaaaagatatggctatacacaggcctatacctgaatctttgttgcagctttatttgtcagtggtccaaaatcatacataattttgatgtctgttgactggtgaacagaaaaatggtggtgcatctacataatggagtatggttgagcaataaaaatgtgtgaactgttgatacatgcagaaggacgaatcttaaaagtattatttcaatgaagagaagcctgacaagatagactgaatactgcataattctgcttgtatgacattcttgcagtgcaacactagaaggtagaaatagatgttttcagttgcttgagttggattgagaacatggattacaaaggggtacaagggatatcttgcctgtgtggtggtgattaagactgtacatactctctaacactcctaaaactttacatctaataaagagcaacttttgctatatttaagttatacttgaataaacctggtatttaaaaagaaagaaagtctagagaataaaatgagctaaaggccaaccatgaacactgacacactgaagaaaacaatagcttaacaagaactaatgtaatgataacattaaagaaaggttttatacttaataaaattcaagtagtatgcattacataaataatttgacctgagatttccattaataacctcagactatagaggaatgtaaattaattagagcccttggcttgtaaccatctattgagggaagcattcatcatacaaatagtttcaccaacagatgccatgtttgaattgttctctaagtgctataaatcactaacaatagaatagttagttctgatcgaaggtactggggagggcttcagtgaggaggtgacatttaaattaagttctgcagttttctgttgtttaccaatgtcttgagagctgtaaatatatatttgcatgatgcaaaatcccaaaataccaccatctgattttatgcatatgtgaggtgtttggagatgttaagtacatttgcaatttgcagtgtatttgtgggtaccattaaaccctttcttttccaaaggtcatattgtttctatagtaacaaatgcatttcaaaatgaacatcaacactgagatcactgaactactgctgtaaagactctgagttgaccccttagcagcaatagattctgctaagaaagatataatctgaatttcttttcaaagtcttatctgtctattcttttgtgtaagaacatattcaagagaagttgcctcacttacattgctatatagattaatgagcaataaaacatgcttgtttcttcatgtattatgcaggcgcaatggttgttcatctatgtcatctgcactccattatttcatttatcaattaat

SEQ ID NO: 25216 - DNA, 1513 bp, Bovine  19866880971703
aatactgaagtgggctgccattttcttccccaggggctcttcctgacccaaggatggaacccacgactcctgcattggcaggtggattctttactactgagccaccagggaggccccagtatgtggagtctagaaatactgagtttatttgtgaggaaaattttgaaagcctcagaacgtctgataagctggtggacttccatgaagaaagttatctgtaaaaacaacaaaaaagaaataaacacattgttatttaaccactgttttttttttttttttttttaagcaaagaactgcttcaaattcaagatggaattattcccattgtttagattctgtggtgtgataaaacaagctgtcgactattttggccccagagtagtcccaagttatttgtaacaaaagtaactgaaagagagatgagcgctcagctttggacagctaaagacttaaagcaaatgcctgtttggctctaagaaagagcagacacgagctcggatacgttttaagtgaggctgccattctgcctggtgacagtagatggcggtggtgtgccaggagagagcctggcgggttgtaactaaggcttgcaggaggtagtttatgcaggtgcaggctaaaaaagacactattttgtctgaggaactgtaaattgtattcatgattcacatatcattattaattcattttgtattcattatcatacagcaggcttcatttggcatttaggcagatgtcagagtgtaggcacttccgggagctatctgtgcaggttcagaccgggctggctgtgcacaggttttcatggatgcataaatggagggaagaaatgcttaaaaaaaaacaacaaaaaaaccgcacaatttggctgtagactggaccatggatttcccagctaatgactttgagcctctaattctgtgactactgtgtgtcattacttccctctgcatattttttggcagattaagtctggcagatgagaatctcccaggttggagagctctgaatgagataaaaatttaataatcttattgctgacccagccaccaagggcagaacagataatcctttaataatgcacttcagaagcctggtttgcgtagccagagactagagacagcctggcagagtggaaagagagcctttgagacaaaaaaaaaagatgggctctggtgttgacttgccactaactagctctgggactttgggaaaatcaattaaccttcccaggtctcaggctcataatctataaaattaagggattgcatgagatcatcccaaaactcccctcacattgctaaaaatagcaaaattttctgataaaaaaaaaagcacgtactagatagagttttgaaactcttaacatttctttgtgacctacttcaaatccgatgagttgtaaaactcaccatgaattgtaaaatgtatatcatctgtgagtaaatgcacttcaagctgttacaagtggatttattgccaggggccagtgcagtatcgcatagaaggacag

SEQ ID NO: 25217 - DNA, 1704 bp, Bovine  19866881183930
cagactgggacattctggttgcaaccttggctctgaaatctacatgcaaaactatacccactttgtagcacttaatgctctagttagtggccaggtgagtatgatcattcaagtagattttagagccacagtgacaaagaagcctctgctgcctcaaagccccatcctcttcatttacatcataaagtcaatttctaggctccaggagtcagccatcttctcagcttacaaaggagagaaactataacccttctcaatgatgttagtcatcactgagcaatacaatttgccttgatgaagagagaataagttggtttaatttgcaaagtttactcaagtagtcctatttctgtacatcatctggttccttccatactatattgaagacggtttgtcatcacaactttatttagtatgaaatgaaattaatcctagttagttttaaccaaaagtaatttttttttttttatttttttttaggtggctcacagagtctcaagatggcatataaacaactctgaggctaagttgtcagaaatgcccaagcaatgcaattgccagatttagcaaaaaaaaatacaggacatcagataaaactgcatttcaaataagcaatagacctatctcccttaaagaatctggtggattttacaatctatttgttaaaagatttattcgctcatacttgttgctcacttaaatttggtttgttaatttatctgatagtaaaacctaagtcacatgtgttaatccaagtttgataggagccaaggccgtgtgagcttcctattttctgtcttatgctctgtgctcagtcatgtctgactctttgcaaccaaggctcctctgtccatggaattttccagcaagaatactggagtgggttgccatttcctcctgcaggggatcttccctacccaggcattgagacaagtcttttacatctcctgcactggtggccggattctttaccaactacaccacctgggaagccccattttctgtctcgggaagacacaactcacaaactaggcaattaatgaaaatagggaggatattcaaaggtaatgggtagctaaacaaatgaacgtccatgaaactctgcagctgggtcttcgaaatgtgagtgtacctccactagtccattagatgttattagatttaatcacagtgaaatactttaactcaaatattttaaagtgaaacaataagtaatttatattcaagtaataattaaaatatctcttcgttaattctcccacattggaaaattattcagcattgtggacagccagttctctccattttagaatactcaatgaaaaaatattagctccctgaaaataatgtcctaataaagaaccaattaagtccttaaatgtgttatttcttccaaatgttcaaactctttttctaaccatttttatttttagataaagagaataaattatataattataggaaactcttgggcttttctacattttatctttctacagtatgtgaatgatagtatatatggagcttttcaaagcaagcctagagggctttggcattcagagatttgagtcatgagctatcagctcactgcagcattccactggaatgttatacattattcagacaattcatttttatggtattttgtactcagaatgcttcagaaagaaactaaaatgccatccaattattcccaaatcaaat

SEQ ID NO: 25218 - DNA, 2480 bp, Bovine  19866881189174
tcctctgctccctccttctcttcctgccttcatctttcccgcatcagggtcttttctaatgagttggctcttcacatcaagtggctaaagtattggagcttcagcttcagtaccagtacttgcaatgaatattcctttagtattgagtggtttgatctccttgcagtcaaagggactctcaagagttttctccagaaccacatttcaaaagcatcaatactttgatgctcagctttctttatggtccaactctcacattcatacataactatggaaagaccatagtttgactatactgacctttgttggcaaagtgatgtctctgctttttaatacactgtcttctcctgcagcacacccatccttaaaaggaaagtaatactgtgctcagctccacagggagagacttgatgtttcatagctggaattttcctggactatgcttgtatgcagtttcttcccttggtgaatataaatttgtgtctgttaggagtaataaactataaccatgggtataacagctttcagtgagttctatgaatcattctagcagattaatgagtctcagggtggtcgtggaaaccccctaacttgcagttgatatcagataaaaatccttacatttcttaatccactttctaagcttcctcaaacatgtatcctctattttgaccaaagcctccaaaatgatcctgacattttctctgctgtggtgtattactgccataatgtcccatgttgttcatacttctttttgtccacatcttggtagtcccttcctatggtgactcagggtgcaccatattatttgatttggctaatgggcaagagacaatatgatacagagacttagaaagtatttgcatttcaggatttgccctgtgcttccatgtaaacaagccttgactaacctgctggataacaagaggctgtggtgacccaattgttcctgtgacctcaagtgacagtctgccagcatacctgtaaatgtgtcacactagattgtacaataatcagctaaacacagatacataagcaagcccagctgacatcattacttgaatttcaagaaggcaatggaatgaatgggtactgatacatgaacaagtgacttataatggaaaataagtgtaatggagatggtccacatctgggtcatgttaatgccaaggaggttatgcaagaaataggaaaggaataggctgacatcattcccattgaatgaacaggaattctgttgactggaagacatatggctccttgaataaaaggagtactgaataaatgagttacttatacattacagtgccccatacattgtaattagatttgtaatttgtagagtccaccatagtgcaacattatcttaagcagacatatataaaagtaggttatttaaagaggttcagtcattttccaattatattcaccatctaatctatagacttttatcatggctcctctaaatagggatcatggttgcaaccctttaaaggacaatagaagagcaatggtttcttgttaatagattattgcatcagtgaatacattataaatagtaaggtaggtatattaacagcacattaatgtgtagacgagttgtgtctagtgcaatctgtaatgtgtttttaagtttgtgctttaaattataatgcaaatgtttctaaaactttaatattcaagattacctcatgagatccaagcttcactgttatggaacaaactatgcctgtctccaatatttgtaagttgaacctataaccccaatatgatctttgatgatagtgcctttagataggtaactaagggtaaataaagtcataaggatggaaccctaattgaattgaactagactgagtgacttcactttcacttttcactttcatgcattggagaaggcaatggcaacccactccagtgttcttgcctggagaatcccagggaaggggagcctagtgggcttctgtctatggggtcgcacagagtcagacacgactgaagtgacttagcagcagcagtatccttaaaaggaggaagagacaccagacatctctttctctccacacaagcacagaggaaggccatatgaaatcacagcaagaaggcagtcatctacaatccaaggacaggggtctcactggacaccaattctgcaaggaccatgattttggatttccagcctccagaaaaaaatagtttctcttgccgaagccactaagtcttttgtactttgttacagcagcctgagtatagtaatatcctccttcttagttaaaatgaatcgttatagcttccttaacatgcactccggctttttacccattccactctactttgttgttgctaagaacagcatgatggttgtcttcctggaacctaattagagtctgtagatcatttaaattagacatgttaatgaaatattgagtaatggaaaattcattatggctaaacaccataaaaagacaattaggagttta

SEQ ID NO: 25219 - DNA, 1976 bp, Bovine  19866881329482
gagtgttaattgtcctagcaaaatttattgagactttctgttctcttgtataatgctacttcttttttattttattttagtttttaactttacaatattgtattggttttgccatatatcaacatgaatccgccacaggtatacacatgttcccctctctatgtaagctttgggcttttgtggcctctccattatgttctacttatcctttattttcttgccactgtgccaatacccacccaacccatcaccaccctattgttcttgcctattttgagccatttaaatttatataaaagtagagaattaatttactaagttcttcaaacagtcctgatgtcattttgactgaatatgaaatacattgaatatgaaaatattgatagttccaattgcttattagcttctacaaacatatgtttgttatttgtttcctgattaatatttaaaaatttttgtatgtgtatgtctgtatttcatgtgtgctttgttttgtttttaggtagctaagttgtatctcactctttgccaccccatggactgcaatacaccaggcttctctgcccttcactatctcccagagtttgttaaaactcatgtccattgagttggtgaggctatctaactatctcatgctctgttatcccctttcttatcctgcccttcagtctttcccagcttaaaggtcttttccaatgagctgtcttgtcacatcaggtggccaaagtattggagcttcagcttcatcatcattccttgcaatgaatattcaggattgatttcctttaggatagactgatttgatctccttgcagtctcagggactctcaagagtcttctccagcatgacaatttgaaagcatcaattcttcagtgctcagcctttatggtttaactctcacatccatacacgactactggaaaaaccataggtttgactatatggacctttgtcagcaaagtgatgtctctgctttttaatacattatctaggtttgccctaccttttctttcaaggagcaagcatctttttggagtcaaagaaaaaaatctgtttctacttttctcatatctatttgccatgaatgatgggaccagatgccattatcttagttttttgaatgttgagtttcaagccaggttattcactatcctttttcacccttatcaagaggttctttaattcctctttgctttctgccatgagagtggtatcatctgcatatctgaggttgttgatacttctcccagcaatcttgattccagcttatgattcttccaacctggcatgtgtgcttaaaataaattacatacaaaatactttatttattattcatttcactaattccaacttttttttaaaaattacaattcatcgcttattccaagaagtgtttttggtcatcaattttattattttcatatcctttacttaatgttcctgacagaagaaatttacctgtgtgctttcatattcactctttatttctccatacttctcacctgtattttagagaacaacatttcaaaggataaatttacagttgacttccaagaagttccagccaatgagaagagagagaagcagtatacatttgaatctcttcttctgtctcagctggtatttctgatgtaggctctttcttacttctgttatctttctccacaatttcaaatcacatcaaatcactctttctctctcctcacatgtggtctaggtcttccttgttggacctggtttatctcccttgattatccttccagccctcttatgattgtggccttgtgatgtttttaatagcaaggctatctcactaaaactcttggcttatcagtggagtggccaactgactgtagtaaaatctctctttttgaaagacaagatttctgtctttcaaacacaaggtatacccaaagtgatctcttaatgcactttgggtttacctctcacatcttttactctaataaatggctca

SEQ ID NO: 25220 - DNA, 2022 bp, Bovine  19866881403508
ctccagtttcatccacctcattagaactgattccaaatgtattctttttaatggctgagtaatactccattgtgtatatgtaccatcgctttcttatccattcatctgctgatggatatctaggttgcttccatgtcctggctattataaacagtgctgcgatgaacattggggcacatgtatctctttcccttctggtttcctcagtgtgtatgcccagcagtgggattgctggatcatatataattttccttttatttctgtatatggctgtgtgtgtgtttaaagatacaacatattttgtttcctataggaactgtcaacttttatgttatttttactctcaaaaggccaaaggatgcttgaaaatgcatttgaattgctgcaaagtgctgagtattatagttgaattttaggtttaatttatgtcttaataacactcaccagagttatctgttgagcatcaaaatatcactgaaaaactcttcaataaactactgcagcatgtagctttctagccttttgactggcctgcaattctcagcaacttcatctgtgtttttcgtaagatatatgcacaagctgagatttgaagtattctactttgtttattcaggccctgggaagtaatcccaactggaattttatcaaagatatctgcatggcaataatgataatccttcagaatctagattagttcactattttattccactaatgaatactctggagaaatatgtgtaattttacagaacaaattaaccctagagcagaactacttacaatgttcattttactggacacctacaaagcagaataaatttaaatacagtttaatcgatccttccaggcctggttgagatcaaatagctaggacataaatataaaggaaattaacataaattgatgctaagatttttttttttttacataagtacttcaaatgtcacaattggtattctaatttcaagccaatagagacactacaagactgagacaatagcattatactatgtatcacttgagtcacagtggttcagaggtggcttttgctggcaaggaaatctgatttttaattactgtgttgtttccagcatataatggccatgacttgtttaacacgaataccgctgtatgagctgcagtttgtttcccatctgccttcatttcattgcacaattgaaaaaatgtaactatctatcctactaatagggcagcatgaaaactaattggtattctccgttttcaaatatttgtatcctcaagcctctcagcctaaaaaagcctgacagagtctcttcattatctcattatgctataattattgcgtactcaattgccagggcctgagagtaattcgtttatgctctgcatcaatataaacttgtgcctctagaactagatttaaccaacttaaaaaaattataatttagattcacaaaattatgtctcctggtgattcaagacatgaatcatcttatcttcccattaaaagaagaaaagtctaaatcaatatgctaactattctagctttcaaagccttgttgataatggcccttttcttataccatactcaaaaaggacaagaagcacgttttgatgattttatgcattcctgatcaccactggctggcattatgttctcattgacaaactcttctgaaatttacacatctttcctcctgtttgtggtataatgatgatcatattatagtggtatagtgatgatcatgattaggtatttcttattctccaattgtactcaaattcaatgcactcaattaaaaaaataataatcttctatttcataatcccaagcagaatgatttgtaaaaggtacatattaaatatatatttacagaattggttttttcaatgagtaaagaatctgttccccttttcatctatgagtagctttatattcctttcattttcaattccatcacttatttttccagtacacataggtaatcaatgggaacagttttatcatctttcaaatagataaaactattttaaaaa

SEQ ID NO: 25221 - DNA, 1590 bp, Bovine  19866881649038
cagcaaaaaagtttgaagagacaaagcaaacatcaaaagcatacctaaatatggcaaaaaatgttagaattatcagaatcagacatctaccaacccttccagatgattctgatgcacacttaagtttgacaaccactggtctacaggactgatttggatactaaatttcctatatgtgatttctctattttttttttttttttttggtcaattcactcacaattcttctcaatataagcttcaagtaatttccatttgctctgttcctgttatccttatctatacaaagatgccataaatcccttgagtgatatatcatgtatgtcttttatatccttcatgacctaatagggtgctgctaaagaaatattcactaagtgtttagtgaaagaaaagttaatgacttgacatatgtactatctaaggctggttttgcagacaacttttctgcagtctgacctggatagagctctgctctctggatgatgctgaatgtcaatgtgaagacctctaagttccatgaaccagagaagactcccatttatccagagacatcatgtcccatttaagattatctaagccaggaacccctattctctctcttgttattatacggcaagtatacaaaagagaggagacaaaataaatttgatgtattggaatgtagcagtttagtataagctctgataaaaggtttgatggaggatgagctgtaagtgtttgataaaaactaaaggtcctgactaagcaattggtcagagttaatcattaatcagattttctctttcattaattagagttattcctcttgcccactggagttgactgaatgtaattaccctaggaaaaataacaatatttcaggtccatccttttcttattctgaagcacccaaaatgaacaggtgcttggattttacccagaacttgttcatttctctaattcagttttgcccatttgaaatcctgaatcttgtaagaaccaaagaatgtaggtttccagtagacagtccatctataattatacacactttgcaaataaaaattaaaacctgtgttcagattatgctttcttcttgcttatcaaaaatgaaaacagactcaatttgaatatccagattcatcagatgcaaattgcaacttgttaagacattgctatgttcacttgtcttagcaatctccatgtagttaatttgtatgatgaactagtgagagatattttgttactgattaatggaaaacaggccaagagaggttaattaaatttaacaggttacatacacagctaggtacagaacattttaaaaagttaaatgtatatatattgtgacagagagcttgatttcttagcgatatcttggaccaatgtgagcatttatttcttcaaaaattttagaggatatagcttcaggtgccttcaagaaatttttcaacttaaagattattttttggtggaaaccttgggtttttggcttcccagtagcaattttatttagtgttcctttattgatcaagtctcctgtgacttttctatttacttctctgatggagggagagagggatgtttgctagcctggttgtacactccatg

SEQ ID NO: 25222 - DNA, 820 bp, Bovine  19866881651501
ggttgacagtcaggcttaaccctggctggggatattgtttattctctaacttttctatttccagattccatgtgatcttagtttctgactttggtcccctcttgatttgattattgaggtctgagaatctgtttttaaagtaacttaagaggctgaaagactttcagtctcaattgcatctatctgaggcacgcagacatgtcctagcagctttatcctcaggcccttatttcttcccacgagcaagcactactcaaaagtatgagagcagcttgcattagctctaacatgcaagccctttcattgccttggagacactcgggcaatttatgatcatttgttgcaaagaggttctgccattactctcagccagaaggaaaatagcattgcctctacaattgcgtctcaaggactcagctaatgcagccctggtgctcttctctggatagaaatatctacaaaagcgttgagagctcagatcaagtgttttcactgtcagccaccaaaggcgttctgccccctgcctaccacaattacaggactttctagccagcagaaataggcaatacaaaatttcttctaatgctcctgtcaatattgaaccatggattgcctgaaaaagagtcattcttttccctcagtggctcgagtacactgtgaaaggtctttaacagtctgtgccagtctcggggtgaggccgaaaggctctgcatactttatcactaacactccaaagaactattgatgcactactggatacattaagggggtacttctccccatatgtggacctcttccaaatgatgagaagacaccagaa

SEQ ID NO: 25223 - DNA, 1132 bp, Bovine  19866881898771
ctaaacagtttgtaaacatcatttacacttgagcctacgagttactattatttccactttaccagttaaggaaactgagggccacaagagtttgagactatcacaagctggttccactaggatatttgccctatttcacactatgctgccggtttggtaatatctttcagtgcagggctgaaaatgaaagcacaaatttagtgcctgtggaagaaaacattctctcttctgctcttgaaaatatgcaatgtctattctaacttagatatgaaggggaaacggagtagcaaacaggatttataaaccactggtataaatttaatttttttgtctttgaatatttgcattgaaatctgaataataaaaaaactcataattgtgttctatattcattttatacttctatagggtaattgcttctttataataaaatatgaaagggttgtttcagaaattctgatcactattctttttccaactagtcatgcccaacagatgtttttaaaatgataaaactggtttaatcaacctcattaacattaatatttgagaaattacttgcctttaatgcatctaagactagagcacagctaattgtattatgcaaaattgtgaggcactactaaaatcttaccagctttagaataagtgagcagtacacccagaacactgtcccagcatttttaaggcaaaatttgctcgtttctttttgtaatatttaatatgaagcacataaattttcccctcaaataatgaaataacttctttctcaagttcttgctttctctttctctctcacatactcatacacattttaatctagaagttgctccattgtttcagagtaaatgcatgcaatgatttatgttttatctatctctacacctaaattctaagagttacaaaataccacttagcaaacttagtgtgtctggttgaaattagagccctgcaatctgtcttaatgaatgataatattaattctgataagagcagagtctcttattaagcatagacatgttaaaagttttatttctcttttaatcaagacaactgtataggcaaggtactgctatctgccaagcaaagtactgtctctcatggacagggtgcgaattaacaatatcatatg

SEQ ID NO: 25224 - DNA, 1596 bp, Bovine  19866880406506
tttcaaaaataactaattttactggtagaattaaatgattgtaagagaatttcttctcattgtcagaatggaagttcactgtatgtctcaaatatttatttttataaacattatggcctgggcacattaaggccattttcttgtacataaaaagccactttacctcagctttgccttgttcctgtaaaaacagaagattgttttatggtctgtctaactgtatctttgcctgacaaatagacatcaaataaagaaccaattgttgtaccttactcagagacttttgctagatctccttacctgaacagacctcagtagtaacaaagaggacccagctgataaatgactggttttgttttcatgaaagttaggagaagtatcacctgccaggagggtttatcttggactctgggggcaaaaacctttactggctccagaatgatgacagtcactaatgtttaagtgatattctaacctttccaaaatcatttatatgatcccattttatccttacagtgtttttagaaaataaaagcacataatatacgtagcatatactgtttcagtttggtttttgctcacatgaatttaaagacacacacaatatccagtaatatttactatcaattttttgagtgagtgagtgagtgaaagttgctcagtcatgtctgactctttgcaacccccatggactatacagtccatcgattttttactactttgatatactcttatttttttcattttatatttctctcttttttgttattctccggacattttttcttcccaccctttgcagaacattctgattatttgtttagaccctccattaaggaaatatccattttggctatttaagtgacatatatggatgcaaaaacatccggcacagtgtctgacaagtaacagatgctcagtgttgactttttgttcctctgcctcctctccctctttttgtttttggtttggtcttcaggttggtagtgtggcatcagcccacacttgatagttgaatacatagacatatagatagataatctctatccatccatttttccatttatgtatctttggtccttggttccctctctatataggtttctttcctttaatccttgatattcagtttctctaattttcttatgcatgtggttgttcagtcactaagttgtgtctgactctgcagtcccagggactccagcatgccaggcttccctatctttcagcctctcccagagtttgctcatattcatgtccattgagtcagtgatgctatgtaactgtattttgtacttattgaatacacatgtacagaaagcaagtgttctagtgatcatgtttaatcgtgggagatacaaaccagagtaagataaaatcatgagtctggcgtaggagatacacaaataaatatgtcaaaccatgtgtgatatgctctcatagagaatatagaggggacctgtaatagggttgagagctagagcctgactctgggattttggggatcagaagtgaatgataaatattattactctctgttgagatttcttttgatagtatgttttgaggaattaacataattaattctttgcattc

SEQ ID NO: 25225 - DNA, 1033 bp, Bovine  19866880482739
aaaatcagtagttcaaatatgaccgtctatcctggaacttagcttgagtgttttatttgcacatgactgagtgactgcacacctgcttttccatgacagtatgagcttattcctattgtcctggtgcaattattaatattgcccctctttcctctccaaaatgtctagtttggattttaactattcaccttaagctcaagtcatacagtgcagttgttttcataaaacctttaatcaaggattgaggggatgacctgatattgaagtcataaatgcatatctgcattcagatcactgctctgctaattacatgacctaggatattttcctctctggttcttcattccttaaaataaaatatgataataatagtaactatttcagggtcattctgagaattaagtaagaaaatatcctatactatatgctattatatagtataatatactattagcatagtagctagagtttaagaaggtttctataaatgctagctatgaatattacaacaaccacctcagagccctaagttttttcttgaatataataatagcaaaattcttagtaacatggactattgcattaaaaataaacacatggaaagtgcctagcagagtgccaagtatacaatacctagtcaataaatgtgtatttcttagatctaaaagattttttcaaatctaaaagctgcattactagtgatccaccaccactttgtattttattttataaatagagattctacacctggaaaaataaagcacaaaaaagaacagtagcaaaatatactttatgtctagaaaatacaacctaaaatgaaaacaataggaactgagattgtctcagaggagcaaaattgcaaggagattcaatattccagaatgtttggaaggtccttgcactttggagacatatgttgctgaatctttccttttttttccattctttatagctttcccccagcattccatcccatcccaccctagtgtactcagccagaagtagactcatttgcctccaaggacatatgtca

SEQ ID NO: 25226 - DNA, 2024 bp, Bovine  19866880530316
gcagcctagaagagtcataccacaaaaatacctaccagagagaaacagtttcatacccacctctgcctaaactatttaaagctcaacttggttgtaaactgtacttactggttatctgaataacatggtgctcacttcttatttttattagagcttcccggtggggtgccactagtgggttaccagtatgctgaaatgctgcgtccccctaatttgcatccagctatgagcagcttcctctgttttcccgagcatgctatagagaaatcattctctctctgtgtgttccatacaggaaaaaaacaagcaaacaaaaaaaacactgatcattatttctcaaagccgggaccacctacatcataatattctgaagggattattgtgtatgaagattttctgtcccacgtgtacaggatcctcaaagatcatattctctggagggtagatggattggatagtggcttaggtatctacattttgacaagctccaaagttgaatggtggcacactaaagtttaacaattattactgttgaccttacgtggaagtttagtgagagcagttttgagcatgttctgtttgaaatagaagcgtctggttggcagaactgaagtagagatttgggagtgagcagaatgtatgtatttgaagtgaatgagcagaatgattgtatttgaagccctgggaagggtaaaaatgcagagataagatggaacaagagggacggaaccttaggaccatgacttggagaaaatgaacaatcagggaggagctttgggaaaggtagtcaataatagattctgcctgggcagtcagagaggcaggagagccagctgggctggcacctggaaggcgagatttagtgacataaagactgatacgtttccccattgttttgcagctagtggttcattagtgtccttggtaagggtggatgaatgggcatcaagttcagtcaagttcagtcgctcagtcgtgtccgactcttcgcgaccccatgaatcacagcacgccaagcctccctgtccatcaccaactcccagagttcactcagactcagcgtccattgagtcagtgatgccatccagccatctcatcctctgtcgtccccttctcctcctgcccccaatccctcccagcatcagagtcttttctaatgagtcaactcttcgcatgaggtagccaaagtactggagtttccgtatataggaagcctaaataacctgaggagctagatagagcaaattttaaaatttccagaggaaagggagttttagaataaagtgatgacagtgttgaaaactgatatgtattactcagataatgttctaagtgcttttacatgtattaattcatcctcacaaccaacctttggaagtgggtaatgtcattatccccagtttgtagatgaaaaaattgatcatgattccctcatctgcccagtttttttatgactggttagtggtagaaccacagtttgaacccaggcagtgaggcccatagtttatatatggtgttattctttactgcctttcagtatttaaactcaaatagtggtaaagagttgtcagttgatttgccagccgtagccatatgctggtttctgcccaacagtcttctaggacaggtttgccgtcttctgtttcaccatcgtctcttttataagatgcctatacttagaggagagtagaccctcatcattagatagtttttctcttctttccatactttcatggtttttgttttaatttaaagggctgtgttcaaaaacaaaaataaaactttaatacttttagttcagggcccagggagagccttcccaaagtgctgcctttggttaattctttgtttccacttggggcttccctggaaaagctagttttaaactatcttgactgctgtggcttagcctaaattactgtagcaatctaatacttagagtcacatttggggggtcggtatataaatactgctttctgtttgaccaaaatagatatacattttgctcagtggcaactattatt

SEQ ID NO: 25227 - DNA, 1810 bp, Bovine  19866880576808
agtttgagcaagttcttggagatggtaaagggcagggaagcctggtgtgctgcagtccatagggtcagaaagagttggacatgactgagtgactgaacagcaaacagcaacaatctaaaatattataatttcatcataagcaaataaaaattattaatgatatttaatattttttcacagtaagtctttaaaacatggttattttacccttgcagcacatttcaagtgctgaatatccacatgtggctaatgactaccttagtgaaaattgcagttctagctacagataattgtcaactcagttttatattgtttcttataatgtctcttttcttgatttttttcttcctttagtccctctaaattcttgttcttgataagactattgttgaccattgattttcactcacacgatgtgaatattaggtagtgggaaacactaagactaccaggaactgccaggacactttgtttacataaaccatgacttcaggtattgtttttaaaaaaaaaagtgtcaaattttgtgtcagtagatttgggtcccagttccagctctctctgactctttgactttgggtgtgtcacaacctctctaagccttcgcttcttcactttcatctttggacttccttaggacctttttgagcagcatccagcatggggcttatcttctagtaaaattctcaataaatatttattgtgccgtataatgattaggacaagggacttcgaatctttacgtttctatcagtacagactttcagaagcaaacgggacctttttgggtcatctagtgccaacccttagactgggatgtggttgttagccagtcgtttggtggatgctaatgctagtgatttaagctgcagggctttgtgagactgaattagttttcaaaaaaatacgtaagtgcaaagtattattataaattagagctacgcttccctggatttaggtatataatgctaattgacattaatggggattgtacataaaccaaggggagaacagacctattagcgtataaaaaacattctgcttctagtatcagtctggtatgctttacttccctggggcatatgcattttttaaaaataaattgaatgcatacttctttatcttcatgttattcaatcagtattggagttttctgcctgctagtgttggtttaaacatctccctagattataaattcagtattagggttttattttggcaaacttaccagattcagaaatgtgatattcatctgcatttcaaactaaaagttatcaggggtactctctcgtgctgaaatttcattctatttgtggtttgatcttttgaaaaaaaaattagtcctttgacatacacttagaaacaagatgtttctaatattacaataaaacaattaatggctccattataaggaaatgaaaatcttatctttttgtgtcagtgatgagagaaaaatatataagtgccctccaattatctgtaattgtatgaggttttctttcatttatgttctctctcttcctgtttaatcccatttagcacaattattccttttgtattagttttctctaaatggagttctgaatggtttgaattgtgaattgacaatgatcacaatctttacaacccctcctcctctccaccttcttctcttccttgcctttctctttaaataaaggaaaacaaatacagtttcctggagagattattttatgcacttagcaaaaggaagatcatgtatggcctttgtaagaatgtctatgaacaactgaataattaaatcattctgaataattaaatcatttttaat

SEQ ID NO: 25228 - DNA, 918 bp, Bovine  19866880674225
ttttttttttaaatgtaatgattctataaaatgtgagtcctgttaggtacatccagggaatttaaaagattgaagatagatctctgaatttgcttagaagaggtaagaacagatctgtctctcaggggggtacaaaataaacatttaaaaatattacctctaacatccataataactatgtatagtcatttattaatatgtgaacatggtgatccatggtgtgtatgtttgtaaactatatccctcccttttattagttaaagaatatgctcatttatccataaaaatgtgtaaatcttcctgagaacattttaaccagatgtggcaaagactgaagcattctttattgatcactttgtgcagaacatcagagaatgttccagcagagtgcagcaaaagccagttgttgcaaaatatactcttgtctttccttagtcagtctggaatgtggagacatagaggaatttaaaattcaaaaaatgatgaaaagaaattgtagagatcctagaatagtgttcctgtcccccatcctttggagtaggcctcaagcaagtaaaattttctttaatttactcagcagtgctgatctttcttgaggaagggacatggtgatagcccaggataacacaaaagttagtgtggtctattttttactttcttgtcttttaaatataacttttaaaaaagccacaagtactacatacgagagttctttgtcagaaaatatagataactaaaaagaaggaaataaaaataaaaattaccctaatcccattgcccagaaagaaaaaaatattttaaatttaatttagtacatatccttccagatttgtgaatgctttctattgtgaataaacataaagaaaaagatagaaatattttaagatgggatcataaggtacatactgtttggaaagt

SEQ ID NO: 25229 - DNA, 1470 bp, Bovine  19866880678329
atttgattatctgaataaaaaaacttttctttattctagatgaaatactcacaaaggaagagggacaactttagtgtatttttaagtcttattttgagtttgtacttggttttgggtcaggggtatttgagggcagtgagaacagagaattaaaattgtgaatgaaaggtaagttaggctttattttttaaactattttaaatatgtaagtagtttagatgcttggaaaattggaattagtgtgtccttcaaaataaacaggaataaacttttttgaattaaaattatttgcctttaggattttgacttgtaatttaaacataaaaagattattttctccacatcagagtttcttacccttggcactgttgacattttggtctggataatccttcattgtagaaactgcttgtgctattgtaggatgtttagcaataatccccttaggtgccagtagcacaatccccttccccagtgtgacaggcagttgcaagacaaaataacccctgctgctctcattatagtattaatattaacaaagattaaggactgtattttaggtataacttatccaactctttttttttctcctattataactattaggtctgaatcagaatttaatatgttcctttaatatatgttccataaattcataaattagcctacgttatttttggagggaattaccaatgacaagctttctgatttatacttcatactcaaatattttaattattgctttaaaattactcctgttttaaattataaaggccatatataattccacaaaacttggaaaaatacagaaaattattatgaagaaaatttaaattacctttaatcttaaaatttatatataagcagaaatacatgagcttctaaatcaagtattgatgaaaatgtagcatgattttggtgaacatttggagacactagattaaaatagaatcctctctttttgggttaaaaatgtcaaacaatgactgtaagcaattcttggtttttttaaagaaataagggtgcgagagctcaccaatatgttcacttggcttaattttgactgttgtacaaataactgtggtagcatgtatgatgctgtctgtgagattacagaaggtttatttatgaacaaattatccatttgagagattaacagtaattttctcatatgtgtgtaaagtaccttcttatagaacactataaacctttcaactgttcggatataatatattgcctaggtgtatatgtttataaatgtgtgtatatatctctatatatttgtatctgtttctaatttcataaacaataaaatttaggtttgaacagaagccatagtcttcgctatataattgaaaaaacgtgtgtttccatataggcacacctacagaaaatagtaactctcaaacaattcatctgtttagaaaatgctttcagaactttacatgttaaattcataattctattaca

SEQ ID NO: 25230 - DNA, 860 bp, Bovine  19866880760517
cagcgttacaaattaatttatttactgggcttttttgtgtttactgtatctggtctacaactgatcattggtgttttcctttgctcccaagctctagactctatcccatgtggtaacttgacttttgtctgagtccttctacctgagcccctatgttgggagcctgcttgaaaggcccctccttaatggactgggctgccttgctcctgccaaatccctcccaaggaacgaaacctatggctgtagccctgctgcttgactgcagtgccaagttgcctgctgcacgcatcccccagactgagaggctgctcactcagccttctgcttttgtgttccacctgcctgtgtggaggctcccgtatgccatgctggcccgacatgcctctcggtaccagtgggatgtctcatgtctatggtctctgctatcctcttcctgactgaagacaactgagctctgatttttatgatccagagaccagacagccatggctgagtttctgacgtctctgcactacctgtcctgctagtctccactggtcatggtgcctaaataccagtgtaagcaagtggcttttcagaaagaataagaagcagaaagtttgaccaagtttgtaaagtgtatttcccagggtatcaacagaagtaagcaaaaaagagaaaaacctaaaagattttctcatgccacctacaaattaaaacaattaagttgaagataactgctcctcagcttctgggttttgacttaactcattcacctcaactgcctcttcactttgataaatcacttaatctctgtaggctgtgtgtgtgtgtgtgtgtgtgtgtatacgcatgcgcatgtgctcaatcactccatcggg

SEQ ID NO: 25231 - DNA, 1138 bp, Bovine  19866880806926
tatttatttaataactataaaatgtatttttttcaattttcagatttcagttttgctttgttttgtattcatgtttggaaatccaatgtatttatcttcttactattcttcatctctgataataacattggtgagtgtttgttaagctcataaagattttttttttaccttcaaatagcaattttaaccatttaatgtaggtgagaaagaataaatgggtttctcaagtggcactagtgatgaagaatctgcctgccgatgcaggagatgcaaaagatgtggggtcaatccctgggtcaggaagatcccctggagtaggaaatggcaacctactccagtattcttgcctgaaaaattccatggacagaggaagcctaatgggttatagtccatgaagtcaccaagagtcggacaagactgagcacaacaacagttaacaagaacaaatagggccctttctggattattactcacatgagaagtttttccaagatagtgcttttctctatctcatcctttaaaaataatataaggaaggtttacctttttaagccgataacccagtaactattttttaaataataaagtaatgacttactttttaaaatatgccatattttatgataaaaattatttatttccttctaagtcacttcagtaggctaaatacttattgcagtgacactgccattgcccaaagcatttttggaattcctctgaattgccttcacagactgtggcacattcttttgaatatcttcaatggtggcaaatctgcgtctttcaagggtggatttgatttttggaaacgaccaaagtcttgtgactaaggtgggtgactggactgggtaatacagatcttgatcaaaatatggtgtgacaataaagtaataagaccgattttcttgcacccacaaggaaataaactctgaattataaagtttataaagaggagttccaaactgttttgagcaatggcaacctaattagaataagtgtatagtctcctcatgtaacttactttcatggaataactctcatttgaagttgtatttggaatggtggttcagtaaatcagttttattaccttatagtcacacttttgatgttcatatgccagtaccggaatgttctcctt

SEQ ID NO: 25232 - DNA, 1404 bp, Bovine  19866880836117
ctatatttaaaaattttaattaagcttcaggagtagaattgaaatattcagcttcacctagtatgcaaaaaaataatatgttgccacttagatcttacttatacacaaagcttcacatttcaaagactgttccattttattgacctgatctgttcagactgtattgcagataagcagtcctgcttttacatgtggaaaaagagaagcaaatgaggttttatgttgtcccataagagttagtctccattatttctgcattagagttacatgacatgggcagtgtaaaacatgactgcagatggagcacagtacgtagccagacataacaggaagggatcaaggaagttctggctaccagactttgctactgcttcgggccccttgttttcaatacgaaatgactctagcaggcccctggaaagagttctaaaggcattatatagatgtgtaatatatagttattctactctggtatataagttctttttcctttttttttaaagcacattttggcttccctcttgacagtgatactggtctcttgggtgtgccaggggtaattagaattctctttctggaaaaactgttctgtcaggagtgattttgatgtgaattttgtctgtaagtgttaaataattttgtgattaatcgcaccatagtaattgtgactgtccatttcctctagtaagctagcaggggaagtgtttgaaggagaggtgattatatttgttaaaaaactgtagaacaaagtcagtctgatgactgagtaggccaatatttgcgtattacaaatgaccaaattttcttctctctcagcattatactcagagagttgaataagccaaatagcctattttgccaacaaaatattgctgatggtagacaattagggcaagttaggctctttcagtactttggccacctcatgcgaagagttgactcattggaaaagactctgatgctgggagggattgggggcaggaggagaaggggacgacagagaatgagatggctggatggcatcactgacttgatggacgtgagtctgagtgaactccgggagttggtgatggacagggaagcctggcgtgctgcgattcatggggtcgcaaagagtcagacacgactgagcgactgaactgaactgaggctctttcaactaagctgaaagctaccctactagcaactttggaaagtcttcaaatacatataatttttttctttccttattatagatacacatatgcataccctcacacatacctctacacatctctggcttcaggtttaggtacaattatagcctgaagattaattggtaggctattttacatttcaagtttcttaagaaaatgtaaacctcagtagaaatgtgcctctgataaacccaatgtttaaatgcta

SEQ ID NO: 25233 - DNA, 1966 bp, Bovine  19866880869784
catgctgcttagcagacatgctgggaacttttttctccgcctctaattttggttcccctctttcctgagtcatatatcttcttatttcttaattttctccattttttttttttttttactggacagcatcatagagtacattcctaagaatgggtgcattgtatttttttattttgagtttgtacaggcatactttttagttggaaaaagtctttattctacttcacaattgttttctactttggttttgtatgcaaacctaagatgaaagttattttccttccaaattttgatggcattgctgtccagaactgtgaagggtcaagttttacactccttgcaaggtagcagctggctgtcagtttcaccaggacagcacattactcacagcagtgggagaagccagaatatcagctggttttgcacctactctcctaaccccagttctcatagcgggcacaaagaggaccgaaagacccctgctcacacaggcaacggttgtgctacaagagaggaaccctgagcttagggaagccaaatcttttataatgggtgtcctgccttttgctctggacagaaacactatatctcccaaagctcttcactcttcagatatgcttggaaaggtagtgcatccaaaacagagggcagctggggcctctctcatcagacactcggaaaggcgagagacacgtggcaaagtgtctccttgcctccagctccccacactgctcctgagcatccactgacatccatgcagccattgtctgtagtttatttcacccttggaagcccttggatcatcttctaaaatttcaaacatcagcttggagactgttatatcctatgtttctagagatttctctatactatccctttgattattagatggtctccttctcttttgtaccctcgcatggaattatctatttttctttggatttatttgccttgtcattcaggttgcaggattttcatcaagtttccagtggtctatagatgtaacagtatatttaagaatgagagactaaaacagctggtaattctgtatctgtggccagggcatgccacctgctgggctgaaccacagggtaatcaagggtgatttggccttttcattggggggcggggctcccagttgtcaaaatcagtaggtgtttgctcttgactcttaatattttctctagaaaatagtctattggtttcctacctgggagatttatgccaggcttggctttctggaagtaaggcaaggtaatagagctgccacatttcagagagcatgtttacgaagaagaaataaataggtttggttacctgttacaccttcaccctgttgtcctcccgggggtcctgccctcatccccagtctctgaggggccaggccttagcttagagcctgagcctcctcttctcacaaggaggaaattataatgcttggaaatggatccaaccaacaggatatacgcttcagtacttcctgattcatactgtgctctcatacaaacactgtcattctttatgggtctgtttgaagggggatgtctgatgtactgtcctgtagagagaacctgggatcccagtggtggtatttcttcatagagctttcttcaggaaatgactgttttcctttttctctttatgtaattttaccctggtttcttggaacccttcttttttaaaaattttcttcactaagtatttgtgggctcgtcatgctcactttctgagcatctggtccacatgcccttgaagtcctcctgcctcttggtaaaccttcatcaagcgtttgagtttcaaggtcattgctgtgaggagggcttatttagtcatcactgggtaagctcacgcactcacagagcaggagggcccatcgtctcttctgacagtgtgtctgatttactccatcagaatctccccagctctggagcctgaaaatttgtattttgagaaaacctccaaagtg

SEQ ID NO: 25234 - DNA, 1004 bp, Bovine  19866880972278
tgtatataatagaatatacaaaggtcaatagttacaattagtcatcaaatttaataataacccactgtataattgtattttcttcatttaattttttaatgtataaacaattaaatagcagtagagtaatatagaaaaatattcctttaagctgtttcattactcacaaaaaagagctatatacccaaagttcaagaataaataattgttcatacagtttctagtcacacaaagtacagcgaaaagtaaaagaaactgtttatataaaatgagaaaatagccaagtatttccaataaagttggttaggaatctgaattacccaggtaaccacctccacttttctatttcacttcctgtatatacacacacagtctgagttactttgtatatatatgccaacgcacaaatatttccatcttcagttatgtgtataactttaaaagtccaatcaattgtgtaaaggacaaaaaagttgccagtgaaaccaagaacttgatttaatatcattccaacagaagcggctgcattttaatgcacctttataaaatccataaaataagcattataatgaaagaatgccacaaaattaactgttaaaatgatgacttttaacctttttaatggcacagtggcaatcaacagcttttttaaatcctcaggcccaaatgcactccaaggtttataagagaaaactccacttccaagttcaaaatactcattgcttaaaagtaataataaatcctctagtgaaacactgggttctggctttaattagaagtaaatgtgctaagattgccacctcctgctgaataaaaagtcaagtccttcatgaccaacctcaagtggattttcaaaagacctcaaatctgaatccttcttaaagaaagaagaaaggagaataggaaaaaatatatattctcacgcagaagagtttaagtggggccacttgaactatccactgctgccaaatgcaaaactctctttcccaaaaaagtcaaacata

SEQ ID NO: 25235 - DNA, 2801 bp, Bovine  19866880999486
atttgctggcatattgagtgcagcactttcatagcatcatcttttacgatttgaaatagctcactggaattccattacctccactagcttcgttcttagtgatgcttcctaaggcccacttgactttgcattccaggatgtctggctctaggtgactgatcacaccatcgtgattatctgggtcatgaagatctttttttgtatacttcttttgtgtattcttgccacctcttcttagtatcttctgcttctgttaggtccataccatttctgtcctttattgagcccatctttgcatgaaaagttcccttggtatctctaattatcttgaagagagctctagtctttcccattctatggctttcctctatttctttgcaatgatcactgaggaaggctttcttatctctccttgctattctttggaactgtgcaatcatatgggggtatatctttccttttctcctttaccttttgcttctcttcttttcacagctgtttgtaaggcctcctcagacaacgattttgccatatttgtctgtacatatatcttaaataaaattaatgataataaccattagcagctttctatatgcatgtaaacatcctaataaattatttgtgtgtattatctcatttacccattaaaacattggaaacaggtactatctatcactatatcccattttacataagagaaagatgtggcttagagaagctagataatttgaccacgggcaactctgattataagtggaagaacaccatttaacttctgtctgtcagagtccagagcccatgctcttaattagctgtggttaagaatcaaaataactgcaaatgaaaaagttccccattttacattttaaaaatagaggttcagagaaactcaaaaacacgtctaagaccatcgagccagtatatacaagtgagcagaaaagaatgaccaagaatgaccaagaaggtctcacgagagcttagttttaaaaatgaaaatgaaaaatccttaaagtagtaataagccacttttaaagcagcagacattctgactctgctaggcataacaatgcatacttagacaacaatcatacaatttacattgttacaagtgtttgcatttagtttagatggaagatggatggtgataactcttatacacagatttattgaatcccaacaatggactaggcactttcaaatatgaatcaagatgatgtgtgacaaaaataaccacagtaacaaagaagagttgtgtttgagccaaaataaaaaaagttaaagacttggctagatcataaacctcacattttaagagaaaaataattatagaatattaaggggaaaatatgaaacatgaatatgaacgttttccatgctattttccatgtctaacaaaataaaatatgatccttaggaaatataataccaaatttttatcctagatatataaacatgactccaaaggccaggtattaacaaccactctgccttggttgcctggaacagatggtcacgcatcatgcacacatactcaaggtagccacatcttcattcacttggaacggatggaaaaattttctcaattaacaggatttattatgacggaaacttgtatggttatatattttggctgctgttgtaatttaaggctataaggagagatttataacagaaatttgtataggaactgtcaggcagaaacaggaagtcacggtgtccagccgtgaaagtcaagctgattttgtgtaactctagagtatcgcattctttcttattcttttatcatggcagtaaggaagagagtgtaacttagtcattctcaaatgcagttaaattcccataatgaaggagaaatttccagtagtgtcacaccatcatttgaaggtagctgttatacaggaaagcctaagaactgcatgggagggaaagatgtatttatttatagcaattatagtaggtggggggaaaattaccatgagcaatgttatctggtttaggtacaagatttctttttgaaatttacaacatgctcctgaattattatatgtatgtgtcagaataatatcagtagatagatataaaagggatttccctacacaaaagtctacagatcattcctggaacactgcgggattgttgttttttatcttaaatgtttgatttcttgccaccaaagcttttccagactcagaagtattaatgagatagagcctttgattggatagggggaagggagactgggaaaagaccacccttgtttccagtggcaagaatccaaaaaaattagcttaggaaacagttataagattgggctcccttcagcttctaccaaagatccccacacttgggccacccgctgggtccagtgtaagcgaacacaattggtaaagcctggtgccctgtcaagctcctccaaggacagcaacccataatctaagaaaatataaagtcccgtccaagttttgacttagcgagtcgccaagatccacaactttccctggctccaacgtctgggcagtgataaatattttcagcttaataatgtgctgactgattaccacactgtaatctaaatgccttaagagggttctacatttgagtcctagttctaaaattctacaatggcaggactaaaaatcttaaccaaaaccacatcgttcacattgtattttgggggcactatcaatttgtcactactctgtggcttcttcgtttagtattttcctactataaatacatccatttaaagctaatattaggcagagagaggactgggaattctttgcaaacacacacataga

SEQ ID NO: 25236 - DNA, 2113 bp, Bovine  19866881050270
ctcagtcagtacaagggaaaaattggctcatggtttttctatatgtgaaatgtcaaaaaattgcaaaggatgtattatttattatttatagcattctattttttaggagatgcagcagaagattaaatagttttcattgtgaagtgtgtcagtgggcaacttctagcctttgggccagaatcaaccattcggttaatgtaattcagcctgtggggaccaataaaaggtgtcctcggctctgtgtaagcctaaagatggaaaaccacagctcttccgatcatctttaacagcttcattgaagaaaggttagacaagaagtgtattacttctttaaagagtgtttctgacttatgtgttttttttgtttttttttttttgatattcgattcccatggacatttttcccatgaagtgcgtgtgtccattagctcatctctgtttttctttccttttttgtgagtcatgtcccatttgtagtgtcctatctgcctttctttaactcactttctttctctcttgtttccttgttcatcagccttaatcagtcttccccttcctctgtgccccccagttcttccattcacatttgaatctctccctttatttcctgtgatattttaaaactgaagcattgtttgatttgtaaaggttactttaaatatacgtgaatgcaatgatttctctttcatgtttctcctccattgttttccttttatttatggctgccgctgttgctctatgccatgaggaagtgactaccaatgtaaattcaaaagactccctatctgtgtttggggaatttaaggtgacttttgttgctacaattacatattatactgggagtttttatgttcagaagtaaatttgtaagatattttcctagaaattgttatcagtatcttaagcctattaacaaaataacttgaccaaataattttatttttttatttagatcactttaatacagaactctataagcaatacgttatataaatattttaaaactatctaatttattactatttgcattttactagctgcaaaaaggaaagaagttactaattaaacttcaaaacattaaagcatagttagcttacaatacttgttagtttcaggtatatagcatagtgatttgggagttttgcggattaattccattttaggttcttacaagatattgggtatatattcccctgtgctataaatccttgttgcttatctattttatgtttaatagtttatatctgttaattccatattcctcatttgttccccttcccctttggtaaccataagtttgtcttctatgcctgtgagtatgtttctgctttatatatagatacatttgtattatttttttagattccacatgtaaatgatattagtatttgtcttcctctgacgtatttcactgagcattatattctaagatgtccatccttaattaaccttttaaacattatcaaatttaaaatataagttctaaaatgataaaaataatttaattattgacttaaaagtatcttttattaaagaatttcctgaatttaagttatgtgtgtgtgtgtgtgtgtgtgtatatctatctatctatcttttacccctgattttagcctcatgatttaaaacacacataaaatgtttctgctcgcagaaaaataatggagccacaaattgtgttttcttttagagtggcttttagaaaatcaagacccaaataattcttaactattcccattattttgataccagtacttcagtcattaataacaattgtccattatgtatttcttatgtgtgtgtgtgtgtgtgtgtataatctaggaatagctaaaaaagctggaagaaggaagatgataataggtttcttagcccaatgctttcattattacccaatatatgaggataagtactaataaattgggcttcccagatggtgctagtggtaaagaacccactgccaatgcaggagacgtaagagacacaggttcgttcgatccctgggttgggaaaatcccctggaggaggtcatggcaacgtactgcggtattcttgcctggtgaatcatatggacagaggagactggcgggctgcagtccataggactgcaaag

SEQ ID NO: 25237 - DNA, 4434 bp, Bovine  19866881050917
ctatacccaggtgtggctaatctcataatagttaatgaatgaatctcataaggatttccagagttacagcaagtttggaccctgctccttcattaagtaatgggactgtaaaaatgtcttcttttataaaaggaagcagtcaaatcatttgtaatgtgataaggagattgaagtaagtctggttatcttgttactaccaagaataatcccacatgatacctagaccagtttggagaacagccagttgttctacatttcagggtcaggaaagagatataacctatacagaaattcatccagtgccaagagcctaccatatgcaaactctatgctaacaaataggggtaccaagggcacaatacacatcctctacactcaaggagcccacagcagggttgcattgctatgctatgctatgctaagtcacttcagtcgtgtccaactctgtgcgaccccatagacagcagcccaccaggctcccccgtccctgcgattctccaggcaagagcactggagtgggttgccatttccttctccaatgcatgaaagtgaaaagtgaaagtgaagccgctcagttgtgtccaacacttagcgaccccatggactgcagcctaacaggctcctccgttcatgggattttccaagcaagagtactggagtggggtgccattgccttctccgtggttgcattagggtataccaatctctataatacaatgcaatcccatatagggtgcaatggtcaaacggggatagaactatgactcagggagagagggtattcggagtgggggaaaggcaggaatggtctcagacaatatccgaaccgtaaaagttcacatgagtcagccagctggaatatacaagatgggaatcctaggcagaggacttgtgtgcctgaggacaagggaaaaatatgcttccttctaggagtctgtggatagctcagaatggtagctgcctaattggcaagtacaagcaaaagggctggagacacagaagccagatcacagtgggactcaggagtcatggcagataaccggcagtttactgtgaaggcaatcaggacttcaactcaggagggacatcatcacatcatatgcatctgcatgggttgaacaagatatgtaaattcaactagcagcatattgggctgagatttttcaggacctagataacggttggtcaggtgagcattcaactgccaggctggttaatcgcctatgtccaagacacagtattatttttattgggtaagctgccatctaaagtatcagtcaggcaagcctgctggttcatccttcctctatgcccaacagctaaatgatgatgtcgtaacactatgggcaattcttggcatttacttcttaaaaaaaaaaaacaaaaactaaaaacgcatagttggctaactccattcttaaagagcagcttatatcacttgtactctcctgacaccagaaattcaaaaagaaaatgtcaagagttacggagttctattttatcatcatcaaatatcctgcggctttagagcaattatcactgcgctttacccatcagctacgcaatgtttattcctggttttctacggacacaaacatgtttaggaaatcaactacaaagataagtgtggccattggggacaattctcgtgctaacgatcattttcaccaaaagcagggagcagggttatgaatcatctgtgaccacttatgcttaagctgaatacattaaaatttaatggtttcgacacaagaagccagtcataagtctgcacatcaaggcactaatgtgtcgggcctaattgtacttagatgaagtgagtcaggaatgcatggcagccaaccatattttgctgtaaaatgaaaattatgaatctctaatcacaagtgaggattccttttataattcattattcatgggtttaattcactttaaattattcattttctcaaatgttattgctatggccttttaaacttttctactcctccactttcaagtgataaatgcctgagaactgagtggtctcaggcctttgaatataataaagtactgcttcaacatgctgctggctgtgctcaaaaccactccagaccgtgaatgcacattgactattcaagtttaggactgccacctttcatctggtctaagagataacaggttcataaaaaatgtcctatttcaagatttgtcatttctagtaaaccctaagctttgaaacaaggcctcctctatgatctggcccctactcagtttaccaaccccgtccactgtcatcctccccagtcaccttggccttctttcctacttgctttgcatttcctattccctctctctgggacatcgactgcttctcccactctcactcccaagcccaccaaaggcatcttcatacagatggctccttcccatctcactgcagataacctctctttaggaagggctccccaaatccctcctccccctgctggttactctttaccacactacttgccttcatattattcgttatagcttgtaattatctttttatgtgtttgtgtattgccttccttccccactgggatggatggtttattagggcagagccttcatctattttgctcacctctgtacacctagacttctgtatgataataagcacataataagtactcaataatggtttatataataaacacaattttaattccaagagatgatgattaaagtatattttaacctgaaaccacctcttcaattaaagaggtacaatttatccccaattctcttcatatccttctatgagctgaccatgaggcatcaaaggctctgcccaagcaatcagcagagtcacaggaagtagaacttgggacagtttctggtgaagcattgtatcacagacacacagagaaggatactgagatcctaacagttagaggtcaagaaaaagaaactgaggttcagagaggttgagagaaaaaccatctgtctgtatttcagcatcctgtattccgtggagaattccaagcatccgagtcaataggaagatcttcaaaaagaaaaaagcctggaagcaacttggagcactatcaacttggatcaactccttagaaatgctacaaaaccatgtgtagcttagtttcagactgaaaccttctcatggatagagaaagaagacagacactctttgcccaggatcacccctcatcagctgtcatggtccaccataacaccgctttccttgttaagagtctcctctggaaaaaataacaaccattaaccagatcattttatgcacaggagttaaatacaaaaggaaaggaactaaataggtcaggttaatcaacagtaagtctgtgagttactgaaatatattttcacaataaaaatcaaagtctgactggcacctttgtgcattttatgctttctcaaattaagtgatgtttctggctagcacacaatgtgttactacaataaggaaaccttagattcagacattaaatatgaattcatgatgatggccttttaagtaattcaaaaacctattcaaatggaaactgagtgtataattattaatactagacattcttggcaaagacaagtagaaaaagtaaaagatcttcagataagcagtccacttaagaatcttgggattattgagagatgactttacaagcattgaagacaaggttatcaaggtttttccttagtaataataagttttttcatgacacttttttgaaatatttttactggcatttgtaggagacctgaagccaggaagaagaaaggtaaccggtcttgttatgaaatccatgcctaaaatgataaaggctcagaaaaggggattaagtaaatatttgctaaataactgatgagccaaataaatagagaaatattaaagattaactttcaactcccagtcgcacatataaccctttagattaggctgattttctttcagacagtcttgtacttctcatggcttgcccttctcattacttattaaaacaagattttgaaatgtctactgaagtcattcaaaaattgctcttttggaccttaggtggctaatgtagcaatataatttacagaggatacattatgctggaccttacactgattctgggatgttcccagatgcccaccaagaactccagcaaactgacacctctaaagtcactttcctggcatcctgagacaagcttagtgccaggtcttccaatatgagtagctcatatgtcatcccattatgccacctagccccagacagcacacctttaaaatagatttatttaggctataaacttaccggacagtgcctctgtcttcaaatatattacactgaaacagctgggaaaataaaatcccaactttccaatgctgaaatcactgaggccaatttgaagtatgaaggggctatcaaattctataacagatgcaaatttagat

SEQ ID NO: 25238 - DNA, 2655 bp, Bovine  19866881085665
ctttagtgtgggcttccctggtggctcaaatggtaaagaatttgcctgcaattcaggggaccctggtttcatccctgggttgggaagatcccctggagaagggaacgactatccactccagtattcttgcctgggcttccccggtggctcagatggtaaagaatctacctgcagtgtgggagacttgggtttgatccttgggttgggaaggttccctggagaagggaaccttctggagaaggttcccggttcctgcctggagaattccatggacagaggagcctggcaggctacagtccatggggtcacaaagagttggacatgactgactgactgactaagactttcactgctttttttcacaaccctttagtgagtctttactaagaactccagtcttcatttattaagcccatcaacatcattcctaggaaacactttgaagtttaccactgaattcagtactgtgtgatttatttcctttaatttaatagatgctaatttgatctcagcgtaagctttttgctgagtgtcaccttcagattttctaagagaagaaccttctttttgcggcaaagtgtcagacacatagtaaatgatcaatattactggcattaatattaagatggaggaaaaaactctgaaataagacttgttggactgagacttaaatatttgctaagggttgatttaactgaattgagactatttttattgcctggcacaaatcacttaaatttagtgagaagttattgttaatcagttgaatcagcccagttagtactcagaaaaatatatagaggagtaagttacatcaaattagatttctcagcaagtctcaaagagtttgcattgagatatataaaaaatattctttcattgctatacatggatcacagagttgatttatttctaaataatagaaagttgggatcacaaccatttaaaagattcttaatgtcttaaagaaacataggacacctttttcttgtttgttgattgcttatttagttttgttactggttgatttttcaatagcagtttgactttcctaatactgagatctgagaggaatttttctccttagtctttataaagtggatatgatgcaatataggggagagcaaccttgatacgagggggaagatttagtcaaagtagttgaatacattcctatccaaaattaaatagttgatcaggtctgaaccttaagaaggccattgactcattttacccaaactgttgagttttgccagttctttgctgcagtggagatagccattggaaaaaagatggattcattcattgactgaatccagtgcctgatgactcatgtaattcttatgaccacacaacggtgggttgaagcctggtttcctaactttagaaattaatcttttttatgctcttttggggaggggtatgggtatggcaggggaacaaccaaagtgatctctgtcttttccaagatttagggacataatttaaccttgcagttcaagactctctgccaaagttgagtctgggacagaatatttttttctctcagtctaaatcatctaggctaaatcattttttagcttacaatcaggagcaaccttaaaggtactgtcacagctcctcaaattcataatgttcaagtgggctataaatgatctcctcttggatagatgtgtcggggcagcctcagagagggcccctgggaaaggaagtgctgaattgagagagccgccatcagaaaatctcccagtcagctgcgtcatgaggtgctcctgagaaaaacctgtgaagaaatgaaacttgtttaagtcagattctgtttttagtgcacttagagagttgctgaacataaaaagggattctgttaagaatcatttctttaaagtgaataaactcctccaatgttgcgtgatttcatgtttttatatatttaaggatccttgcctaacttttgaatgagtagattttaaggcataggtttgttccagaattatgaagtttgtgaaacaaagattccattcttccctcacccaatttagaaaccaatttcttcttattgttattgttgtttggatagatactgaaaaatattctagttttttccccccagtaatttccctcattgtacagcaagctcattgcctcttcagaggtagctgtggtagccatttatgcaaaaaggaattctcaggaaaagccttttttttctctctacttttctccagcttcttgaggttggggctgatactcacagggactctcaccaaccaaggaaacatgattcattatcttagccagtaatgtcttttttgaatacaaattgagtttgtgatttgttgggtagtttcttagcctgtgtttccatcatttgaatgtcccaaatgaatgactatattttattttagatattaaaatttaataccagtgttatagaaagaaaatataccttttatacaattttttggtattgaaaatcctttgatcctcaccttgtgactactgaatgtcttctctactcctgtataatctggcaaatctttactcttaaataatattctttaaggccagatgccaaggattcactgtaattcattggtatctgcatttcttaaacagtaatctgttccagatgctattttttccgcagataagcta

SEQ ID NO: 25239 - DNA, 2139 bp, Bovine  19866881107437
agaatgtgatacataagatttgtagattatgtatatttaaaaatttaattatattgagatcatgtgcttttaaaataatttacacattttaactataaagtcacttacagttattccatatcttttaaacagataccaagtacttgcttttgcaacggatgcagataaaagacaagagactgaacaacaaaaacatgggtctggaaaaagactagttgtaaggccttttaaaatatataaaaattttagaaatgttatatctgatcacagatgtttgttcagaataataattcctgggaagaaaaattaaaaaaatatatttcagccattttctgtgttaaggttatgtcagtgatcagagaatttagttggctgttattgagcaatggagacacatgcctagtcatggtcacaatgtaccagattatagaattgtgccactaggattataaatgtccagatggggtcactttgaactgaactgattaaaaactaacaaaataaaaattaaaaaattcctttaatagacaaaaaagttgctactcgtatagatgcatgatgaaatatgagtaaaagatgaaaatttttcacagcctgcaaagattaagtttgtgcacaagtaaaatttggtaactttgaaaagtagtttgaagaaaaaatgtttgagttttatggtttttggacttatatttagatatttaatccattctgagtttatttttgtgtaaggtgtgatgaaatgttgtaatctcattctttcacatatagctgcccagtattcccagaactgcttattgaagagactgatgtgctgctgcctgtgcatatgcaccaataatgactgtcccctccctgcttagacgttgctttgggtcttagctgcctttgtgtctcatggctgggttctttccttggtcatgttggctctcactccagtgtggagctgcagtatgacgtaagtggggctggaacattcagtttgttcatgggcagttgagaaaagccagtcagctactcacaaagttctgatctgcactttctgccctgtttcaggagtgaacaagcatgtgcacactccttcgggaacagaaggctttccccagccttcctgttagtcctaccagccctccaaccagccaagaggctcgtcttctttgtggaggaccccaggactggggtgcctaatatgtagctccaactgctcactccccagggaggatctgtgcctgtgaaatctctcttctcctctgagtcctctcccttgggtacaggtgatggtttctcttcccttgctgcctcattacatgtggatctctctctcagccttgcttgtacaggagtctctctgccagtgtccagttattttttgctgagaattgttccacatatggaagtatgtctgttgtgtttgatgcagcaagtgggttctacatcttccaactctgccatcttgacttcctcctctaggagcagagatctcctccatcttctagcttgcattgttcccataagaaatctttcatcttatcttggttccttggtacacaatatctttttcctccatgtgtttttcagattttttttcgtatcacttcttttgagcagttagattataatgtgttttgtatagttttctttcattcctttttttgatgcttatagatttgtgaacttagtgtacttgtaaatttatagttttcatgaaatttagaaaaattgttagctattcttcaaagatatttttctgttctccatcttttctcctcctcactcagttacacatacatttaggctacttgaagttaccctacaggtcacagatttgctctttgtgttaaaaaattctcttttctatttcattttggataacctctactactgtgttttcaaggtcactaatattttttctgtaatgtctaatctggtattaattcctgtctagtatagtttctatctctacaagttcaatttaggtgttttaaaaaatatcttccttgtatacttttaaaattaaatagatacaatttatttaacataagtattataaactgtatattattataaactgtatgtaatacagtttatttatctctacattatggatcacattttcctgtttctttacatgcttgataatta

SEQ ID NO: 25240 - DNA, 1689 bp, Bovine  19866881124084
attacagggggattctttaccaattgagccatcagggaagttccaatccacatttaaatagggataaatagcatgcttttatccaaaggaaatgaataaatgccatttccattccagaacaatctagaaacgaaatggtaaagtgtgtatggcccaaacaacaagagggtcttaacctctgaaagccacagaagcactaatgctttaaatcccaacatttctgccaaagtctatagaatctggaaagatacaggtttaataccatgtaatttcaactgaactggaaatagtgtggtttctagcatagtttcagtagacaaatttaagactgactaagtcttaaattgaaagaaacattttctaaaattagtaattagaggagggaaaagaccagtataattagaagctctaaaacttacaggctaaacataatattatttccaggatatccctttttgtctcaattatacaattatatttgctattttgagtcatccttcatggcatctcatctatgttatcagttacactttaaaaataggccaccatggctttgggaaacagagcccctttttatctggatttttaaaaaaaagaagaaagctacaacccaaagaccagtcataatggggtacataagcatcactaatagactttttctaccatccaaggcaacacggaagtcaacagacaggaagaagaacccccatccccaccccaccggccactcagtaagtattggaagtttctctgtttccctaactcttaatttttcaggacaaatgatacatgttcattctctacaagaaaatatgagaattgagaagacatttgttttttcaagaatgctgaattctgtgatagaaaaatcacagcctactgccagcctctgcttactccaaccttttcacctgatccaattcactattagctactactccagatgctgcttcacatatttacataataattcaaggtattgatattaataagtcaaaattccaatgaacagtgtcccaacctgcagggtacatatccctcccaactttgctattaacaatgccaacaggctcaaaacctcaacatcatatttaactcacatctcctccttgatctactttattaagacccccaagtactttaaattttcccttcaaaacatctccccatatttattttctccttctattccaatcatcaatatcctcctcaaatcacctctagattactgaaacagacctccactagattgaaaagggggggtggttcactcagattatgctaccttgagagagccattactaatattttgagaaatatctttttagacaattctttctgagactagctacacatgtatagatatgtacacaagtttacaagaatgggttaatattttagatgtttgcttaattaaatcaacattatataacaaatatcatactatataatttaatttttaaatatcaatttctgtacttgtatttgctaactgatctattcctacctcattttatagaaaaagtaatacatgttgaaattataagtcttgccctggctatggagtaatttaatattaacaatattcaaattcttcccaatcttgccagtgtttatcttacttaaccccagctttgttactctcctatattagcctctccatcacaaataatttggcccatttatcat

SEQ ID NO: 25241 - DNA, 843 bp, Bovine  19866881139985
ttatgtaaacacttccctgtggatttgggattttcggaaataaaagggaaaatattagctaaccttgtataagagagaatgatgatattgggcacgtggtataaactctccccagatttcccaaactgtgatccaaagaatattcctttgggagatattaataggtgttttgtgaaaaatgggttttaaaacactgcattctgtatcctcctgttgggagttcactaagccacactgggttattaaaggctctgagaagttctgctctaaagaaactttaaaaaaaaagtgttgaatattttcctaatttaggtaagcacagaacagtgtgtgtgggagaagggggacgcattccacgagggcctgcttggtgtcggagacagttctgtatgctgcattgtacttgtgcacgtcttatggtgcactggggcattggctgtctttgctctgcactgcctttttaagaatatatttttacatctttacagggaatagtcttggaagatagagataatatctccatctagagtgaagcacaggtgtgtgtgcttgtgtgtgttttgtctagtgtagtaaagatcgtcatctcttccaggcaaaattgctgcccattataaaatatttggtttccctaagcgcttggttctttttctgtaacccaacccacaacttatgtagatgttgccttcgttctttttgcatgatgggaattagggctccgggaactaggacaaatgctgaattctggctcttgtgattgctataagtaataaaattctttgctttttgaatcttctgcaagcatccataaaactatgactgattaacttgttagctgcaagt

SEQ ID NO: 25242 - DNA, 914 bp, Bovine  19866881168987
tgttgctgttttttggtctctgtatgatttcgccgcaggatgatagtgagaggatatcttctggggacagactttataatgcagagacctagatcctatttgataccgcaggtttttccacagaattcttgtatagtaaatgtatcgagtttaataaacatctcattgtcagacaatatcttggattttatttataatcagagggttacatagttgatatctttatttaacgggaagaagttgaatggacctaaaaatgttgctgggcttcccaggtggctcagtggtaaagaatccacctgccaatgcaggagacacaggacatgtgggttcaatccctgggtggggaagatcctctggaggaggaaatggcaacccactctagtattcttgcctggaaaatcccatggacagaggagactggtgggctacagtcagtggggtcacaaagagtcagacacaactgagtgactgaccatgcacgcaaaaaaaagttactactccacagtaagacttgaatatggttgttttataaatgaaaggaactacaactaggctaaaagtaggaagagatgtgttttatagtattgtatgaaaatgtttaaaatattttcaaggaaaagtgttagtcactcagttgtgtccaactcttcgcaaccccatgggctgtagcccacaaggctcctcaaggaagctagtacattaacatcgtcttttcattacccaaatgggtaataccttttaaaaaatccaggttataaaaggattcacactctattataattaaaatgtaaggttttcatatgcaagaaataaaagagtttgtcaatctcaagttaaaattacagttgcaagactaatttatttaaacaaataaatgtctgtgccagttttggaatacctcagtcagtaca

SEQ ID NO: 25243 - DNA, 1194 bp, Bovine  19866881178780
tttgccatgtccaaaggaggctataagaatatgtacacacaaaaaatttaactccaatttctagtaactcctacaatctagtttaccatacacctatctcagaaacatttttcagttctttaaattcctctctcaaaccctcctcatcccccaaaccgaagttatgtatctctaataaaacaggaccctatcttcatgactaatataatggctcttagttttcaatatctaacatcacctttatagaaatccttgatgtggcaatgatctgtaatgtagtgttcttaatagaagtttttaaaagcaataatatcatggctttacttacgagaggttttggaagcaagaagcgtaacttgggaccctcctaagaagcgaaaacccattacattcacctgatcatcttctgactgcttggcaaagcctacaaagaaaagaaaaaacatcaccttacagagacacaaggcaaacacttaatatttaaaataggaagcttagtttatgatgagtactttttacggcactagtggagtctgaagtccgtgtgtggactatattaacttccacagttgcttccaattgttaaaatttctgcctcataagaacatgctaaaatcatttcatttcctttcttctactagttcattctaggtctgaggcaggaaatgcacaagatgaacctagaatatctgtcacaccagaaaaaagctatcagggactagagagctatatgaaaaggacgtaagagccatcttaaagagactaccactggccagagatgaaaatatttgagtatcaaaaaagataataattgcaatggagtaaaacacatcaaatatatttaaaagcatgtgttgatatttacactaaaaacaaaagagaaaagccaaatgctcactactgaagaattctagagaatcaactgagcattttaaaaatcactaacaaaggcaaggaatcaagtacttaccctaatgaccctactgaactgtaccacataagcaatggtaaataaggcaaacattctttgtacgtaaatacaccagctaaaaaattgaagaaagcctgaaagccatcatttttcaacttccaatgaatgaatggatctgagtattgactatcagtagctattacaatcacacaaaaaagagacaaacatattatttacccactgcgaaagtatataccaccatt

SEQ ID NO: 25244 - DNA, 2238 bp, Bovine  19866881241182
ctcagtttagcacacaaagcactttctgctccacctcctgctccatcttattctctccttgtccacctgcacccacactctcaccttggcctctccaaaagcttgatcctcctgttgcaatgcctaatcaccattctttcttgccaactcctacttacaactcagctcaggcactgccatctaaacatcacatgtgtgggccctctctgggactctgagaccagactcacccagttcatcaccctgggagcactcctcaccctatgccgtggccactgtcagcattctggtttctccagtgcctggagatgtccgcacccctagcactatgcttggtcaagaaatgtgtctgctggacagagacagagagagatagtgagagatggtgaactaggatcgcagatttgggaggactctggagatctttagtccagtctcatgggatgcttcctgctgaataaaacagaaaccatgtgcctaggtatggctgtccccaagatacaaaattatcactttttgagacagtttactcctttaagggacacgtgaaaccagcagaaagttattgctaaagctgagctaaaatctgccccattggcccttattctaccctccagagccatgcaggataaatctaacctctcttctacatgacaaccctttatatctaagaagacagcaattcagtaccctctcttccagaacaaacatccccagttcctccagctcttccttatataaacatggtttcaagttttctctccatcctgaccacttgtctttgaatgagctccaattttaaacacttaaacatttatacagctaactagggaaccccaaactgaccctaagacagcaggcaggggatggggattcagggttggtagagtcacgccccaccccactgtttactgggaattctccctgccaaccaggcctccggttgcctctgctttcttggcagccacaccacactcttgattcacacaaacaaacacaattaagccccaggcctttctcacactcaccacatatcttccttttaggcttaagcagttcgttctttagaccaaagtgcagaatctctatatatccactaaagaacttcccactgattgccaacataaggatttttcactctattgatccattatagatgccaccaggcaaataaggaaacacattaattatttttaaatgagatgtcaaaggctataacaaaaacttcctactccaaaccactaaagaataataaaacaccagttgctacaaagaaatctctatacaactatcaaaatctaaatcagatcaatatttaaaattgaatttgtatttcaataataatggggatgaaaattaagacaaaatagtaacccaaatgtcattgtagaggacacatttccaagttgtttttgataccatcaatgatgacctctggagtataagaaggaaagatcctttgtatataatttggcatttatgtactctgtggtcatttcagcattaaaacagttcctactattttatagactattcatctaagctaactattattttcataagtaggttatagtagcatattagataatttaagtagatatggcatttagttaatacagaagtactacagaatttccttttctactgccaacttgcagatcaagtcaaaaaccatgtcatggttaggtatttggcatggatatttctttaatataatgaggcatgatgccaaaacttcaaaaagattgctactgaaatacagggttattatttggagagctcaaattgctacataaactcaaatataataaaaaaaagaaatgtttatgagacaaaagaagagctttaaaaatgcaatgtgataatatactgatcaaacacatagcctacttacctgataaaacgtgaaacaaaaccatgtggaaatctagaatctcaaggacaaaaagtttaaaggtaagctgttctaaccacctttttggtgtttgagtccatcacctttatttagatcctttaaattgataagtccaatattcagttttaatgtctaaacacacacacaaacatacacacacacaacccatatgcacacacctgatctttatcctctaacgttgagcatcagttgcactaataactgaacaccaattgatgttcaccaattgctctctcctaattgtgagagtgaaggaaaatcttaattttagtgcttaaaatagcactaaaaatgtctggaag

SEQ ID NO: 25245 - DNA, 811 bp, Bovine  19866881254588
atgcagctgacccttttagctgctggatacccgagctttaagtggcaactttaatgtgataccttagagttatgtccttactaaataaatcacatttagaagcttttatgttatcttagtcatgcttgtattttaagaagtctgaacatgataaacattaaaaatgaatttatattcatgaagcaaaatgtgattttcgaggtaattaccaattcatctagaagttcaaatggttgcttttagtgttcatccatgtaaatgacacaataaaaaaggaaagctattctgtgataccctgtgattcatttaaaatgatttttctgatgatacatttatttcatctaagactttttcaaatagatgctcctttcctaagtagagcttggtggagttagaaataatttaatatgtctattgttagaatgaggccaatataaccttttacttagtcttttatttagtagattaaaaaatttttataacctcctgagtgagcatattgaatttttgaaatatgattgtagattaaaggatatatagagatgttatataatctatttttaaagcaagtagtgttgggatttgtacttaggtgatgttggatataaaatgaaatcaaagaggcagaaattcagagaggtttttccctaattaataaaactagagaaagagagagagaggtgaattgccattgatttttaacagttgttattcatacgaactttttgttaattttaggtttgaaaggaaaatgatcaaaaagcatttctatagtagtaacttaaagattacaggctatatagttaaattt

SEQ ID NO: 25246 - DNA, 878 bp, Bovine  19866881285581
gcttccctactaaatagcttaggtcagtgttcaacgtacttccctttctggggctctagtttcatcacttttaaaatggaggggtgggaaatatgatctctcacacccatcatagctgtgtaagatgcaaaaacttttaaattacttttggataatttattttgaactatccatgcttctgccccatttatcgattcacttctgcccctctatttgtacacattctgagcttctcattgaatagttattgatttgcagcttttatctataaaattgagtaggaaatggcaacccactccaggattcttgactggaaaactatatggacagaggagcctggccatgggattgcaaaagttggacatgactgagcaaagtacacacacatctataaaatatcagcaagaatatttttcttcgactaattcataggattatgagaattaaatgacagaagtaaaaagatgagcaatactgagcattggcaaggatgtggagaaacaggaaccctcatatcttactagtggcaatatgatacagtcaccttggaaagcaatcggcagttcctcaaaaattaaacactgagttactctatgacctagcaatgccacttctaggtttatgcccaagagagctgaaaatatatgtccactaaaaaaacttgttcacaaatatttgtagaagcattatttataagagcccaaagaaagaaacaaaccaaatgtccatcaaatggataagtaaataaattaaatgtggcataccagtataatggactattattcaggcataaaaagaaaaggagtatgtacacatgctactatatggataggaaatggcaacccactccagtactcttgcctggaaaatcccatgga

SEQ ID NO: 25247 - DNA, 1116 bp, Bovine  19866881299332
attaaggtgctgtttttttccattatgatttttgtcatgtttccatgaatattaaatttataatggaagaatgttttctaaaaaatttctctttaagttaaaagctaccaaacaggaaaggttactttggtcttaagtcctctaagtctcactcccagagaaacatgctgacactgtggccggggtgctggaggagggactctgcaccaggcggggcgggactggacggattcacatgtccttagactccactgttctctgaactgatgacattcaagaaagcagcaatggagcgtcagagaaggaacatggggcagcagagctttgagaagatgcagtcgcaagggagacagacagaaggggagcgagcgctgaggacacccagggggcctgcagtggtgtcttagggacatgttcttaatgtctctaagaacagacataaaaaatctgttttaggcagattaaacttctgcaaagcacggactatgacaaagcccaaagtgcacgaactgactgccatctgcagagaagagacaggactaccataaaggagcttcaaaccttaagcagctgtttttcataacaagtgactgagtctgagttctggtcaaatctgtctcagagaaaaacccaaaatacaaactttacactgaccttgataaacccaggaggaggtttttcataactagaaggaaaaaaaacaaaaaacaaaaaactggtcatcaaccattgttcataggaacataacacatttcaatcaccaaaaagcaactacaggccaaaataaaaaaggttatttttagtaaaaactaaaactacagtataacttttaaaaacagttaataaaataggcccagcagtcagagatgttatgttaatatgaataaactgatgctgtatcacatcctgctgggatgcagcacttaaattgaccaaataataactaacttggtgtctaaggacaatgattttatatttagaggaagggaaatcaagagactgcaaggaaaatgtgagggaagaagagacttgagctaattatggttccaatctgtcattgcacttgtgggtatttacctaccataacttccaacttctgtaacactgtgaggctca

SEQ ID NO: 25248 - DNA, 1036 bp, Bovine  19866881427081
aattctgtttatggcatttggcacttaattaaaataaaatgccttattaactcaaaaggaatgcttgaaacaatgtcatgtgcctagttttagatacagatcacatgggagctactttacattgcaaaaaaaaaaaaattagtataaaagctagaaaatactgatttatgatctccctaaaatgggcaaactagctgtgattgttctgcttctgagctaagacgtgaaattgtaaagaaggcaaggtggtgttgaggtttgtagtgacaaacactttacagttgttgcaccacagtagctgcaaggagtcagcctcttctgacatcagcagcctcctcttcctaatggctgcagtcttctttaaggatttttaaggagactacaactttgaggagggaaggaacagcaaacaagtacaagtatttgagaataaatgttcaacgtgttctttttccagttaagataaaacaccaaaaagattggtttggaaactctagaaacttcaatccagcctgccatcccacagtcttttaaatgttataaagtaatgctgtaagtattaactaagtagcagattgctacttgtctgacccaaataggcttttgctagaccttggaaaatctaagtcttcacagctatagttggctgaattacagttctagaaagtgagatgtatgtgaaagtctgctgagttggggtatggagtattatcctgggaaagcttttactttcttgggaaaaaaagaaaaagatggctgaagccattcctttccctatattcgtgcctctgacaactaactatgtaaaggctaaaactgttgcagccatcttgcaattgtgagagaaatgttaaaagaatcatagacatttggctctacttttctagagctgttgaatcaaggataaccaactaccttcaggtttatgtgactaaacagacccttctttaagccactgcagaatttttttattcgcagccatatgcattcctaactgtacagctattaaaatcataccttttagaactctcttacc

SEQ ID NO: 25249 - DNA, 1205 bp, Bovine  19866881552300
caaagtactggaggttcagctttagcatcattccttccaaagaaatcccagggctgatctcagctcactaaattaagatttttagttaccttaatgggccttgtcctctttcacatagttttttctgcctcaaacacttctcatttgactggttagatttaaggtgattatacatcctagtttatgcttgttttcactttgaaaattgtccctgtttggatagtaaatgatatggtaaccgtggttgaattcaatttaccattcaggtaacttcctccaagggactttttttttttccttcagccgtgccatgggacatgtggaatcttagttcttggaccagggataaaacccatgccccttgcattgcgtagtcttaacccctggagctccagggacatgtcccctccaagcagctttaaaaaaaattataacatggttccctttgtataaatcttaaattttactctctattgcctaacacttattaaactatcttactgtcttcaccacagttgagagggtaagggctgtctaccctatttatttctgtatcctcagtgcataataatgcctggtacatagtaggcacacagtaaaatctatataaaggcatgcgtaggtcacacggggagtctgtgggagtagataattcagaccaccatttcagaattgtagtaattagtaatggactatctctgacactatggaaaaaggatttgtcaataaattaacatcaaatgaaccaacattaaaaacacaaactttgcaaaaacaacaaaccacaaactttccaacaattttgatttgaccaagtgggatttatcttaagaatgaatggttggttaaacatctgaaaatcatacatgtgaacaggataaaggagaaaaatcatataatcatttcaatagaaaagttattcgagaaaatctaaggaccatttgtgataaattttttaaaaagctactagaacaatttagcaagtttacaggatacaggaacaatatatataattcagctttgttttagtgtattatcaaccatcaaaattcaaagtaagacatggcaaaatatgaaaaaggtttataagtgctagtatctctaatatctttaaagagtttttaaaaataaaaagaccaagtaccctgtaagaaattgagctttgagatgaacaataaacttaatatatgctgattttattcata

SEQ ID NO: 25250 - DNA, 595 bp, Bovine  19866881714577
taataagggccaaaatgctgaaaccagactacaattaactttcatacttgtacccacaggaccatgtcagggaatgaaacctgcgaggtctggttaaatgaagacaaccaaaaaccaagaaattggaactataaagaaaaaatacttgaggttcaccaaagaaacgcactttaagccaccatgactcagcatttaatgaattctgttgttgctattgaacatttcttaagactcaagtgccctaagtacccagaatgggcctctcttaatcataggcaatcctggacacaattcctcagatagaggagatttcaaggaaccctctacagtgatagaaatttaagtatgcatggaaatattagaccaagaaaacgtaatagtctttgcaacggaaagagtaagtgaacaataggaaaacgctaaccaagataagaaaacttttaaccaagtcaatataactattcttacataatattaagaagtccatattttagtaaaaagtctacatttaaaaaaaaaatgtttcttacctgagacagagtagacacacagttttctcgaatgcaacacagccaaatgaagcatctcagtacct

SEQ ID NO: 25251 - DNA, 913 bp, Bovine  19866881749990
gaagagtccatatatatatgtgtgtgtgtgtgtcgtgtgtgtatgaaacatgaaatttgcagagttcattaaatttaatgtaacttttcactccaagttttatgtcttgagattgtggcatttctataaacaatgtgctaatgacattttgattaacacttgattatgtaaaacatttctgagaaaagtcccttctagcttagttactttttggtggccaaaatgatgcccttgagtactccagtcttttcacccagggataggctattttacttgtcattaccctcattcttctttgtatattgaaataactgctaattaagctagggatgaacccacagacttgagtgcaaagtttgttatttacataacctcaaagttaatatttgaagttctctgccccttctttgccaccatcatttgattttattcataaaaatgaaatagagactctttaaaaaaaaaaaaaaggagagacttttaacatagtttatttctagaatatggaaagaatttactgttttttgcacttataaaattgtggtatatttgttcattaaaatacctataattatataaaagcaccaaatcatttcactatagcagattatgagaagttaaaactctgaactttttgatgacctcattatagtagagtgactttaacttgcaaaaaaaatgttcttttcagtcttgtgggttatgttcagcacttaaagttgtttttttttttcttcaaagcaagaattgcagcaaaatataaagccaatttaaagaataccttttgttgtacacatggtgtatattatctaccataataaaagtgtttttgaagctgattttatgtgtgtaagttatatgaggagtgtatgttataagcatgaaataatatcaatagtaataatttctgtat

SEQ ID NO: 25252 - DNA, 717 bp, Bovine  19866881862043
aaaagatactcccagggtggaaggaacacagcatcactgagcccagacttgataaaggtaatgtctctatgaaagttaggaaaggctccctttctctagggatatttattccaggccagcgcacatggccagatgagcaggatcaggtctgcattccagtctccactagccccttatgccctggtttaaaaacaatttacacaacctgcacagtggccctgggggtgggtgaggtggggacaggggtctacagcttcatcctgcctctaccaaatagagcagggacatccatcaatgaagaaatcaaccccttcttccactgagagaggcaggcacacagttcaccacagaaaagctcaacttcagtcaactcatgtataaaagacaaaatttaaagaaaaggcagtttcagaaatatttctgtagaccacataaaagtgcaggccatatgaaaatcatatatatccaacgcttagagttttctttttttattactttgcccaagtattttaatacaaaggtttcaataaaatatgtttaactctgagattcaaaccacataatcctccatttttatatggccaaatattctggtccttacaacagcacgctcatgattaaatacaaattacctttcacaccaccaaatgatccataagtcatattgcaggctgttctctgaagattatgttcatacatcaatttgatctgatactg

SEQ ID NO: 25253 - DNA, 1404 bp, Bovine  19866880350976
acttgccaagccacagtcattcaaggaagttgcctgctatcaactaaaaagcagctttaacaataaaaagcccctcagcgaagatcagtgctcactagcgtcgtgtgagcgccccgctgccaggacgggacgcttgctggtacagtggaggggacatgagtttcacagactggaaagtatttgcgagttggaaaaagagtcctgcaaagcaagctggccagctagacaccaaatgtgctttgcagttgcccctggagtttggtttttttccgtaaaggctgttttgaactccagattctttggatgaaaagggagatctctttcctgcagatttatgagaaggtggatactgaaaatatactccagtgctaagaaatggaatttcttttgttacttctagcggctgggatcaccagctcacagattcagaccatctgaaaacacagatgcccatcattttgcctttttttttttttttaaagccagttcagaagaacatacaggaagcttgaaaatggacagaatcaccatgtcctggaatggaacaactccacattgcagatttatcaaactctttccaaattaccttatagattgaattaaactttaaaatcagagttctgaaagaattttgttggtgagaggaatttagcaaaatgattctaggtttatcttagagaaaaaaaaaaaaacaagtattaagagctaaaacattttggaaaaagaataatgaatacttatatctccaaatattaaaatgtactgtgaggcaaattaataaaacacaggatggctttttaaaaaatggttcttgaacaaatggttggtccataggaaaagaagaagtttagatttactctttaccccccccaccaccaccaagataaattccaagagaattaaagattttaatgttaaacatttaattgaaaaatgaagtattgaaagaattagaagaaaacttaatgagtattactgtaatcttaactttggagctttaaaaacagtagcaacaataaagaaaactgcaaaaagatttaaatatattaaaatctgacatgtctataagcgaaaaaaatgccacaaataaaagataacaagttacaaaaacttttgcaacataaattcgcctctatagagtaaccttaaaatgtaataagcagtttttaaaagatcatctcagtagaaaacaggcttactatatgaataaatcacaaaaaattatgaaaggtaataaacaaaaaagttcaagtttcctagcaaagaaatgggaaaatcaaacaagatgtaatatttattacgttggcaaagatttttaaagaattgtaatattcagcattggctaacttgtgggaatgaggggccgttgtcatatcttataaggaaaatatacatttgggtttg

SEQ ID NO: 25254 - DNA, 2179 bp, Bovine  19866880430138
caggtgtcagactgtcgcagcgacccgcagtgccattgctggactccagagacccatccccacaggccaaagggtttcccaggctcacggcctagaggcgttgagcccctggccactgttttgactgctggcggtacaaaaccagtccacccccacaccactgccgccgggctcactgcgggccatcaaaaagttcaagccaaaatgttaacattgtgcatcaagacggcaggcataaggtgagaatgcaacatttacaatctcaaccatacatcaatcagaagcccctgtgcagtttccaagatgttgttttgataaactctttgatgaaatggggaactgcaaatacatgatggctttgaagaggattagcagggtttgtccttaaaacggattcttcatgtaaaccctagtcctttagaatgacagtggagaaggagaaacttctatactgtatgaataaggtaatatttgaatagtaggctatcacaggcaggaaaattctttaactggtttataagtctgtccgtacttgggtcattccttgtaaaaggtcgcagacatatgattgtgatcaggaaactgcacaaaattatttttttcaaccctcatattattgtcctcccaaagtttttttttttaataaaaaccaactttttgttgtatatattcatattccatgtgttagatggaagcatttcctatccagtgtgaataaaaggaacagttgtagtaaattattataaggccaatgaaatttcatggcaggttattctaccaagctgtgcttgttggtttttcccatgactgtattgcttttataaatgtacaaatagttactgaaatgacgagacccttatttgcacagcattaagaagaaccttgagtggttacctctgttaacgaccaattcacaaacagtgtctggcctgtagcttggcacatactccagtgagacacaaggtctcttttaccagagtcaagaacagagctggtggacatattaattaatagtcttggatatctggctgtgggtaactttactgtaaatatatctagaatgggcagagactatgtggaagtctcatacacactaaagttcaaacaccaggtcagaagagggaaattcatccaagaactagaaaaaaaaaaaaacatgaaatattgcaccacagttttcagcccagcgccaactcaaaaagaaattaatgctgtgtaaaagtgggttgaattaatttgcaaactataataaagatatatgcagtaaaaagcctgttaatgcacatcagatgggaatgggatgttctagtcgtgttttctagttatctgaactctactatattattgtacttggataaccaatttaaaagaattagaatatgatgttttaaatacacttaacattaaactcttcttctaattctttcttctatctgtgataattcagaagacattatggatcttcagtgcctctgagtcattgttataaagatcagttattgctgtacctgctatagaagactgggctaactgtgtacaatgacaaaccttggaagttgctttttttaaaaaaaaataataaattccgaaaatcaactcttttactggttgtctctttgctatgaaaatgaagtacagattgctcaagtgcttaacactgtgatcataaaaatggctatcattctgcagattatatttcccaaattattttgtgccttctactatcttgattactctttcttctttagctgtccaacattcaacttatattttttgtaggtaaaacagtgtttcttactagttcctgaatctgtttctttataagtcctcattaagccttagttcatcttaattagaataaaaccatctgaaaacaaaatcattccacaatttcttcccaaggcttcattagtattcaactttaatagcattttgggcacatggactttttcaaattacattcatcattaaatcattttgagataattgactagcaatttggaaggaaaaagaagttggagccctacctcactccttataccaaaataaattctagctgtatttaagtgtaacagatgaaaccaggaaagtccaaaagtaggaaaaatgtttactgtacggaatgaagaatttttaaatctcatatattgcttgcattgccaaccaactttcttatata

SEQ ID NO: 25255 - DNA, 1534 bp, Bovine  19866880435848
tggttgcagcatcccagttcactctgtaagggatttcaacgattagttgcaccaataaatgttctggctttttaaaaaaaaagaagaagggtaatgagaaaacagcaaactaacaggcaggaactggccatagcgtatctggagggccaaagtgattttccttccttatcatttctacaggagaaggcaaggaagggataggagatcagggctagagggccccttgtttgcagattttttaaaaaattattttcttataactctgtaatgaaaatgtgtattatggtatagaggttacagaaccgcatctgctactgggtcacggctacaggtctatgagctgatccaccagcagtaaagacctggctaggttgggaagactggactcggagctcctactgctgtttctagagtgcccaccttgcggggctttggttatccatgcaggaatagggtcaaactcatcttctgccaccttgtccaagccctcagggacatcaaaagctgagatgagattactatcttctgcagctttatgggccggagcatatgcttgagaaatgtgtgcctataacctttgtgtgcctataacctaagaagtttgtgacttctctaggcctcagattcctcatttgtagaatgatgataacaacaatgtatttgtcttgttgtctgatgttgtgataatcaagtcataggtggttgattgagagatggttgagagatggctatgggccaaactcttctagaaggtctgtagaggggttagaaagcagagagtgatcaatcagggaatcttccccagcgagagaatctgtgcggttcaaggtcacagattttgtctaagaagggaggcactgaggcaccaggggctccaggcccagtatcagactctcaagagcaatgtcagctttttcaattacagcatcaaaagtgctcccaaagggatcttctttatccacatcttctttatccatatccatctctctgttgacagatatttatgttgcttccttaagaagcatttttaaaccacctatgtcttgattctcacatcagacaacaagacaaatatattgttgtcattatcattctacaaatgaggaatctgaggcctagagaagtcacatacctcttagattataggcacacaaaagcaaactcaggtctgcagccctgatgcccagtcctttctttcttttatacattttctcaagcacatgagttctatgctaggacaagcagatattccagaacagcagttccatcatgactggcaaggccagtttgacatggaaagagattaggaaaaagcatcttaatgagcctcgccagctgttgcttcaggtgtaaagaatagttgaatggacaagagcctaaaacagaaaaatgaccgctgtagcacagaaattgttcaagtggttgtcataactgcattgtcacactaactctcccacagctctatttgatgaacaaagaaactaaagctcataggaaggaatcagtggtgctctgtcaccagtaagtgacagag

SEQ ID NO: 25256 - DNA, 3237 bp, Bovine  19866880531031
cagggagaacatctcccacccagggcaaaactttcagaaagttctagaaagagtcctggttccccagtgaaggtggtcagaatcacacacctttgaactgattgcatttgactcagtttctcaagcattccaggaaatagatttgaggaccagagaagcaggggagcacattgcctcagcacaccccaagggagctcactaggagaaggagtccacaacgggctgctccctgccatcgcctaggctaatttaaggcactgaccacgctgaccacactttaccctttcctcattccaggctcatgatcaggaaattttccgatatttggcctgaatttttctttgcttggttttcaccccctggatttacagcaatcccgtgcttctcattaaattgggactgaccgcttcaggcgagttaagtaatgcccagatgtatggccaccagaaagatgaaaaccaggtctgttttcaagtttgctggaaggcttgcagacttcagagaaatgattttcctccttttccagtagctcctccctttgactggcaatgacagaaatgacagccgaaggacaaaagccagaccctggctggccctgcagaccgctgtgttctgcagaagagcctgaccagcctgtgctgctcacagcaccgggaagccggtggtcttctgttcattttctttcaggcaaacctgtcatccctgcttaagcaccttgaccttgtaatcaagcagcattcagtgctgaaactgcactgaacgaagctgtatgccatccagtaagacacactgaagccttaaatgttgtcagatgtgctgttgatgttgaacagacatttttttgtcccttcctggctacaattcagaatggttccaaacatgttttaaacaaagaccaaaagaagagagaaaaaaaattaccgtgtatgagtgtgtctatgtgtgggtatatgagggggaagtttctaacttatgcattcatttgtttcatttaaggagaagcatgagtcacaatatttattatatattttaaggtataaaaaattagtattagtctctcacacccctctaagttgaactaccctcaaaattcccagcttctgactaacttccaattagctgaggcagacaaaccaggagagaagatacagctgcttgcctgcccacccctcctcccacccccaaaaaaggaaagaaaggcagccacaaagcccatgcactgaaatgctttgagcgatggacctcacaaacctcctggcgtggtcttcttgtttaggaagaaacaagcgagcattgatgtaaaattcccggtttgccagcctttgtggattggaagatattgattatcaggctagggtagagttggggaacctggaattggtacacttctcatgggatagtcaaagtgtgtccatttcatatgaaagaaagatatataaatgtcaggtaatacactgtggtggagggttcccagagtggcggagaatctttaagcttcgcagaagcattcctcctgggaagtgagaacctgtgtcttgaaacgcaccttgtagagagggccatgcaggcaggactctcagatctgagagaaatagtggtgtcaactcagaggctccccccaggctgtgaggaaaacccaccaaccacttggaagaatctcctgaggctcttctggccccaaagggatgttattaataagcccagtagcaactgtcttgaaatgacaaaacttctgcctcctctcagaaaatcaagcaaaggaacccttgttatgtactttgacttttaagagttatttttcatcctcttgattctaaacacacttattctatagcttacttcagctcttgcataaaatgctacctgatgtattgaaagaagtacaacaaggtataggatgtatagattaccccagctgttttctatgccacacagaatggggactttggattcatctgtggaactttgagaattcagaacactgagggctacaatcagaactagctggtcttacctcggccagaacagctgttgatagcagctcagctggatgaagggcatacctgggtgacacatgtaccacaagtcaggcatagtcccgagggtcttgcttgcactcacttcttcatttctcaccaacgccctcaaaattagaaactgctactactccttctgttttacaaatgggaaaatcaaggcacagaggggtaacttgcctaaattcacactgctaatacgtttcttgatttattttattactgacaaagcatccattccagctagccatgatatctgttattaatcaagtagtagaaaggactgggagcctggaggtaaaagaccaatcaggaaactattcacaggataagtgacaggtgatccaggccaaggcagtagccaaggagacaatggggcagggctggacaggaagaggcaagagggaagatgggacagaacatccaccggacacggtcgaagttggatgtgaaggggtggcagagagagaggaggtgagaatggcctgtctggtcattgcctgtctccatgtcagtggtgctccatggcatactcaaggcagggtgccaaagcgggagcaggttggaggaaaattattcaatatgtgatgtttgggggctttttatacctgtgatatgtttactttacaactaagatttggtaattggattggaagtttatatgagccatgggcagacaggtggaaatttgacccatgagactaggtgagagtatgcggggtgagcattctgcctgggggtgagtctggtagaggggggacaccgaggggaccccctttgcatcaagtgtaggcagaggggaggggaagaagaagctgaaaaggatatgagagagttaagaaggagcaggcagagccaaggtttagccaagccttagcgaagcagctgtggtggagtgttgggggtccccagacaccgtcatagaagccagggggaaaggcggaaatgtggttgcaggacagagtggaaggcgggcgctccatgcttgtaaagtacaaattgttggattcttactcgtcatcttacattcatttccatctttctacagggcattccaaattattattttaatgactacctaaggattaatacattgataacattgaatgaatgctttctgtgagacaagtatcttacttcaagggcttcccaggggctctaaggtaaagaacctgcctgccaatgcaggagacataagagg

SEQ ID NO: 25257 - DNA, 3233 bp, Bovine  19866880570058
acaaatcagcacaatcctccaaaacatatttgaaaagattcttatgtatacaagggttatcaaaatagagatgccgccaaactatttttatttcagttcataaacaacatctgacatctgagtttggcattctgatattcctgtggtctttcagcctttctaatgacagtacaagaaaccatagctcatcttgttaaaataatagtaataaatactaggatattgtaaaaaaaaaaaaaaaaaaaaaccttgaattatatatgtctctcctaaggccagctaataaatagatgagactgatttgtgactaatgtattaattgtttgtaaatgagatggtgtgtttgaagttatttgaaaacaaatttttcttgggaggagctttaagctcactttagtctgaaatatagtctcacttgtatcaggcgaaggttggctagtttgaaccacactaagagaaacttatctccagtgtcaccaacaaaaggctttcctttattttcaaaatataaaagccaagctcatttgttacaccatttaggactgataatatttgccttactctttcactagatcacttttagttctagaatttcactttcaacattggaagaagtctgaaagtttttctagtccagttgcctatctgatgcatgaatggcctttacataattctgccaatttatcaagttgcctggacttgaatataaccacaacagggagttgactcccaccggtacggagcacccaatcagaaagaccttttacaaaactgagccacaaactatccatcagcctattctactccactctttgtaaactcatggactgtagcctgccaggctcctctgtccatggcattttccaggcaagaatactggagtgggttgccataccctcctctaggggatcctctcaactcaagaattgaacctgggtctcccacaatgtaggcagattctttatcatctgaaccaccagggaagccccattctactccttagatatacacaataaaagcagttgtacctcaggagagcccagcccttgaaatattgaaaatgtctatcaaatctttatatcttcggtctcaattctatagattattctaaatgatttatcatacttggtaatcttttttcacatgttcagtttttttgaggttctccttgtagtgtccttactatttaatatgatacttgaaagatgttccttcagcaagttgaaaggttctatcaacttccttaggctcagataccattctcctgttaattcaatcagaagtcagagactgtcactgcactgattcttagagaacctataacatcagcctaaggaaactaacattgggtatctattctgtactaggaccactgccagctgtttaaggcctgggattttagccacactgatctgatcccaaagtccatgatggttcctacttttcttcctcaactaagtctttccttcgtactttgctaagccacatctttcacaggacatatcacctataattacagcaataagaaagtaacagccatcctttttcaggggctgattatgagacactaatgaatcacttgtagccctagggttgtggattggtcattcttggaacaaagtttctttcacctaaataatggaacactaaactggagcctgttcctttccaaatgaccaaattataaatcagggacatccagacaaataatattttgctaaaagacttggaataaacaaatgctgaattaatcttccaaaaatattgccttgttctttctttgaatggtttcccatcacccagactccatcttttgtcattcaaacactctgcaatgtcagtctcctatttcccctccaaccctgacaccccttattcttccaggataggaattcttcaccctctgtgaagacatgggggctaaatggataaggagaaagatgggagaaaggtgcacacgggagtgagctgtacaggcagtggaatgatgtcagggtgaagaatctataagcaaaactggagtgtggggcttggtcctgcccttctccactggttgtttggaagggacttgtcttctccatgagttttttcctgtaattgagaaatacaattggggagaaataaaaactggggagggtcttgttgggaaaaagatactctgagctcagtacatcgtgagccgtctacatgttattcttgaatttctagaatttgtccagctcccttttgcaggaagtcatgaatgccttcttaagtaattgagaattagggttacagttagaacctggtaacccgctaggaccattaaatggactctccccaaagtgtgcagtgcttgtgtcaacttacttatccacaggcctgggtggaggctcacaagtctttagaatagacaaagaatttctggatatcctgtggtatttgtcttttgcacccccaaatataatatttaccttttataccaccaaatacagcatctacctcttggagtatgtattctgccttgataactagtttgtatgttctggagggcaaagacaggctacgcgcttctctgagaccctaacacttggaccatagtactatttcatacatgccagtcccagtctttggctctgttcaccatcagcaactgcttctctaaactactttacttaatgaagaggcccacatgcttatagctgctggtatgaattagctacttcaaagatagctacctattttgattaatggactgttttgtttaccttggaaaagaaatagaagaaaaatgacttctctgatttctactttttctgaagagtgagcattagttttttattaagttggaaggcgagattgccactcagcacaaggttctggattcattccctaccaggctggtgaaattcaagaaattttggcaagggcagtcacgccaactgtctgtttacctagatagttatacaactacaaagctgggctggatttttattttcctaagttatttcaaagcaattagtaacagaattgaactcacttacaaaatgaacccaggaagttgctaagaatagaactctgcagacaaggttggaagatgccccctgacctccatctgaagcctcgctttgctgcagccactggagcattcttctatggctccagcacactgtcttctgagctagccctaaccaaggctgcctgtgcaaccccagccttcactggcagcatccaggttatttaagttaccatcg

SEQ ID NO: 25258 - DNA, 1518 bp, Bovine  19866880628210
tttctactgcagaacagttttaaaaggctaacaggatcatttctatattcattctgaaaactagtatagtaagaaaggtaatttaagatttcttaaaaagttctcattagccattatttatcatatattccataacattgatatcaagttattagagactcacaagttaatatggcataacttgacagttttgctagttaactatgatttttattttaactgcagatactatcagttcaaagctagtactatccatcctattggttatcatcacggatctaaagatagttaaattcgtcaagctagagaaacactgtcatattaacactctttaaatactccaggaaaaaatgatttaattgttacaatttttaactttaggctctaacacaagaaaccaaactaatctgaaatacattttcacaggtaaaacactacctggtattccgatataaaaaatctattaaatatgtggatataacacttttttaatctacctttaccattcccttcaatttctttggccttcataaattcaatgtgagctgtgatttctttttaaataaacactttcaatgacattgttctctttagaaaaatcacttaagctgtagcatataataattaacctcagtctttcccttttactgctgtagtatatagcctaattagaaagagagagagagagacaaaggaaactgaacccaaaggacttcttaaaatatgtttgctgaagtcaacatttcacatagttttccctctttcaagagttactagaaatatgtcaaaggaatataaccaaggagctaaaggggttcctttcctctcatcctcataattaactcaggtcaagagatctgtattcaaaaggttaagacagtatcatctcagaaacatctttctaagaaccttaaagaaaatctttattagctctctaatcaacagtctcacctacgtgtcacctgtgtcagttcccttttagttgtgttgcttgttttcaccttgtatctaacaactgctgttccttacagtactacagacacatggatttatagcctgtggtaacagttaactctgcaaaatgcacttcacctcttaggaacatgatatacaccaaaacctgaaccatcatttcaatgaacaaattcactcccaacatttaaaagctcaactccatttttccactctctcaccctgtaccttccaatgatcctagtctccaggagcggtaagtactcaaggagacaagtggactttaaacaggatgtatttttcagtttctggcacagtgactttcacataatacactgttgacagagttataacaagccaaagacagttaacattaactttccttcaactatttattcctatggcataggtgatttaaacagacagaagagctgactgatgtcaaagtaacaatcatttactgtgccacgtgtcagatgctaacatgatccttggcctaaaaaggattcatggcctgggtaaagagtactaagttatacaaaagtg

SEQ ID NO: 25259 - DNA, 1258 bp, Bovine  19866880670207
aaataccactttggtattcttgcctggaaaatcccatggacagaggagcctggtgggtgacagtccattgggtcacaagagttggacacaacttagcaactaaaccaccttaagagtctctagctctcccttaagcaagtcccattagctttcaaagtcagacattctgggaggtcatcttcctggtgcaggacccctgggggctagaacccaaagtgggacttggaacccttgttcctctggggagaacctttgcaattataattatcctcctgtttatggatcacctacccatgggtgtgggtcttgactatactgcatctttgctcccaccaccaatgttactatggggacttccctgtagtccagtggttaagcatccacctcacaatgcagggcacgtgggtttgatccctggtcagagaattaaggtcccacaggctgcagccaactaagccagggcgccacaactactgagcccatgtgctgcaaaaaagaccaatgtcactatggttccttctttacatctttggttgtggaaaatcttttctgctagtattcaggtcattctcattgatagttgctctgtaaatagttgtaattttggtgtgcccaatgggagaaggtgagctcaaggttttcctaaccttggcaacatctccaaaatgctggtattttaaaataatgtgaatataggaggttgtaaatcttccatgactaatcttgggggtacaaatttttgttgtcaatgatgagtggttgacatgtctcttatgacttctccttcagaagaaaatgaagcgttttctgcactcttagcaccaatgtttcttgtacttttaaaatgctttgcaagaatgcaagccacttcactaaaaagaagtatgtcttttatgaattgcatccattttaatgtttacaaggatctctcaactaaagatgctggctaaaaagtactgaatgtgcacaactaattgaacatcttttaacagagctttgctctgcactctccagtgactcaggcattatgttaactggctgctgttgctttataaggacattgtgaaatgacatttgaaactaaacagaggaaatgttgcacagttttaactccaaactttaaaactgtcccaagtagagaaggaagggtttatataactaaatgaccattttaacatttagcaaaaaggaaggaaccaaagcttatgcccagaggaattaaaaggcttctaatctgtttaggtatgataactttagg

SEQ ID NO: 25260 - DNA, 1341 bp, Bovine  19866880691033
tgtgtgagatgctgtgaatctaaaggacacatacccatttagggtgccagccactcattagcaagagtatagtagtcacaaaagcaaaatgttctttaaattttaattaatatcctctccacttgggaaaagtactttgatatctacaggcattggaaaagaactcgccctaaagatggaattcctcacattgtgcaaaagaagaaaacagaccttcatccaggatcttgtatgtgtggagcaggatgggactggagctatgcaccagatgaataagtaatttcgtaatttgacatttcacatccaagctaaataatgcttttggcaaggcaatctcagtttatcttctggcccctattttttaaggcaaatatctcaacataaataaaataataaatagactatattaatgatagttctaagtagtcagagtcatttaactgggattatggacaaggacaggaaaaatatcctcaagattgttaactggaagagacagaaagggagagaaggaagtctctgaataaaattagttcatcttgggtcagactttcactcactcagcatgaccatgccacagtgttttcttaaattttagaaaagtgcatgaaagcaacattattactgagacccatccaaaatgtcaattaaaaccaggctttttggaaaaataattgctgcactgcttagcaggacccaacattgaacttgataccaccaatgaagagaaaatggtcaataccaagggctggtttttagaaaagcgaagcttagaaacaatatttagggcatgcttagaaacaatatttagggcatgctacctcaggtctgaccgctcagcaccattcatttcctcttcaatcagcaaatgttttcaattaattccacttctaagtgcgtgacccttggaatctctgcatacatctttgtcttgctaccctgaatgctctgaatttttagagtccctttggccactgatcacgtttcctggatctcctttctctggtcctattccttcttttgttgttgtttttaagatgtgtccaaactagacaggtgcagacataatacgtcaaggttttatataatgatgagacataaataggggatttaagcatcaaatgggaaactcatttgtaaagcagttccttatgtcactgtgtatgtttttgtctttgttgaccgcaatggcatattgatcttcctcagaagccataaaagtgagtccttctctacatggactcactaatacattcatttgcatgacaagtaattcattgcaactttaggcatagtttagacatgggcacttagcagactttcatgaaccttaggacagaa

SEQ ID NO: 25261 - DNA, 2474 bp, Bovine  19866880711869
ttcattattgtttaaaaggaaatgccatgtttgcaaagaacagaaattgcatgttgactacctacacttccgtaatcccagagggagttccaggagtcccatccattgttattgtcaacattggccacgccatgttcattgttgacactcactgactgctgcccacttccaccactgttgttgttatcattaacactgatatcctgaaatttacaagaaattgataatgatttaataccatttttttttttttttgcaaatgcattttggtaacacactttaaaaaatgaaacttacatagtcagcaagagtaggagtcaggaagatgccaagaagtccagcaaagacaatctgaaatcacaaataacattggtctactgttaaatggcaaaacaatgtcctcatcgtctttttctagctaaacttataaaagtgcttactaaatttattactgttgagtgatctgtcttttcttcttctttgatcttcaatttttttaaactgtagaaaatttaatgataatgttgaattgtaggttaattataaataattatgttgttttagaatttttaatgtaggtcttacgaaaaactgatgaagtgtaagtatattgaaaaatagcattgacaccgaatagcatacttggcatgaaaattgttttaatttctgagaagcagacctgagaatgaattaagataactttcctaatgtggtctagaaaccaaataggactaatttccagatcaaattattgacctgaatgctttcttctcttcctagaccccctaatctcaaaagcagtctttattaaaaacattttttattgtggtaaaattcacacaatataaaacatattcttttaaccctatttaactatatggttcagtgacactaagtacattcatattgttgttcctatttccccttcccatcctacccccagcccctggcatctatcaatgtactttttgactatgaatttaactattccagatatctcgtgtaagtggaatcaaatagtatttgtctgcatctactgtgtgtgtatatatatatatatatatatatatatatattcaaagcaatggattagtaaccaggttggatatgaatgatgagaagccaaagatggagtatctggctatcgagtatgcttagtagaagggaagtcaatgtcccaggatacctgggtaatcatagttgtcattgagtacatgatactggttctcagaacacggagctttatgcaggatgcacaattttgggtccctatcttcattttctttgcctggaacaaaacgggttgagacctgcactagtgattcaagataattaaaaaaaaaaaaaaagtttgatgtatcccctgatagtttaaaaaggaggatgaaaaaaatcagaggtgaaagaaattttaaagatctattagtacaacataattcttcacagatgagaaaatggagcttcagaagttgagtgacttggccaagggtctaccttttgttcataccacaactggaagagaaatcagatctaacctgtctgaagctcttttttttcccttaaccttcctatcattagcacttatttccagaaaattatttcacacttgccactccattatgaagcagaatctactgtcatatattttaatgtttagtatgtcaaaatacgaatgtttattcaccctactctagcccttttgcatcctgttatgagacacacagcatcaccggttgctttggcagaattttgctgtccatttgctactctctcagccttttacatgaaacaagtgagatgatgaactagcttcatgcttctagtgttttcatgaatataagactatagacagggttcaaggcaaaactttgttacttagagatccatttcacaggagggaatgtgacagtaagtctctcactaatttattttgataataagctttttatcttgcctgaacctgttcagtagtatttttttgtcaaaaaaggaattcaagaatgtaatgaaaaatcagacatttcatatagttagcagctgtttgctctgtgcctagatctgaatcaacagatgcagaaagcaatttttttaaaagatagcatagtataagatgctcaggcagctgactaatcccagtataattatccttttctatggagatgtgtataaatgccataattccataaaaagggattattcttatttttacaaatttttccatgacagtgatattataataagaagcatacccccacttagctgagtatattagcagtttccaattataaggtaataaattcaaaaggaacaatctactcactgtgaacttcatcttgacttcaccaaagcaatgaagctgagatgacaggtatgcattcagataaaaagtgttctcatatttgtacttggccagctttactcaagctaggtgtgaacaggtggggcctaagacttatcttttctccattttccat

SEQ ID NO: 25262 - DNA, 846 bp, Bovine  19866880721579
aactatattgtctcctatcttaattcttttttaacctggttgagtttattctcatatttcccagacttctaattgtttctattccaagttggcatagtggacacttttatcaaggtaattatggactcgacaaaatgaaggttagcaaatctctatttaaggaactgtagttaaggaattctactaagagtgaactttgaaattgggttaaaagcaatgacaaaactagggaagatttcgattttgcctaaaatttaataacaaatcatctagatatgatcaaactctgggctgggaacagaatgttaacatacatagcatgagttcccatggacatgacagatactgttgagagaaagactgctcagtaccctggaggagttaagggtatccttacagcacagttctttcattaagaaactagagggaacctgaaccagtgaaaaaattcttaagactgaaaccaaagaaagctcaggaatcactctatagagaacacggcctcaaaaagtgctccactctttaccaaggaaacacatccctcaacatctagaagctggagctataatgatgcagagcatcattgtgggaggagctaaccaggctgagaaataaataagcccaggaccactggctgcaggcggaacgtctgactcagcgctgctggcactgaccagtccctgcagctgtagagactcctgactgacctgtgcggttcgaggtcacagattccgtctgagatggaaggcgctgaggcaccgggggctccagtcctggtatcagactctcaacagcaacatcagctttttcttttggacagagcattaagagaggagaggaaagggt

SEQ ID NO: 25263 - DNA, 763 bp, Bovine  19866880781000
tatgaagtactatagcagagatctgctcaaagagatgctaatgagatgcttgtgggatgagaaaggactgaagcgaccacagagatttagacaaagcattgaaacacaaggatatttggagaactcccatgcagaaaggacttattggtcttattatatgtagctttaggagaccaccaccgagcggttggggaggaattcaaggaggcagattttggcttaacacatgcaacttttacaatgaaagctttccaacagtggagtagatggtttgaactttccacccctagaattatgtgagcaacagctgaatgaccatctgtaaacatatgctgtccagagaactcctcctttgggtttcctttataacttgaagtttctaaagacttaattcaacgtccgctaagatattaatggctgattattgtttaattgcgaaagagaccagtacacttggaactattttgcattttaacaaaaagtcttaatgggaagaagatgtaaggatctgccctgatcaaaaagaatttcattcaatgaaatgagtgaaactatttggagagagagacgtcccccaaagcctccagttccagaggttataaactggcagccaacaagccctctctggtctgcacatatgttctttttgattcacaccgcaattaaaaaaaaacaaaacaaatttattactaacacttaaaagtctgatttcacctaaaaattcagattttcatctcatattgaaaaatcagatctagcaaca

SEQ ID NO: 25264 - DNA, 1066 bp, Bovine  19866880786824
attcaactaaatgtaagtctcttggctaagaccagggactctgttttaaaaattgtttctcagatgattctaaggcacaaattagtttaagaaccattgacacatagcatgtctttgctggagaaagcctcattttattgttgagctgtagaaacaatgccaggatcaaggataggccttgacagtctagtgggggacatgaaggatgttgttggctccacatcaacaaggaccagaggtaaactccccaaaactggggtggggggcaaggaagcacctgacctaactcctggttcattttgatcaagaaaaacagctgggagtcagagaatgagcctcaagaggaacatgaatatgtttgctggattcagcagaaaaaccaccgtcccagtcaaggggaatgtgattctctcagtgtcctaaccaagcccaaggagagacagggaaaagaagtggcttatgagccaaattaggctcagagatatgtattatttgtatttcccagaatgtagacattttctgaaatcagttggaaaaaaaatttttaattacaatttcaaatttctagtttatcttaaaattggaaaatctgaccctcacaggccttaaactacttcagcaacaatcgtctgcttcctcacagctgctgctgcccatacttggagcctgagtcttccagtgatccgcagtctccaggccgcctcacttgtttatgtcacttacctggcctctggggttgccatcccagttctagatagctcaaagagaatggtgggatcctttggtggtctgataagaaggcagggagaagggctgtaccagaatatcagacagccatacaggctcaaacatggcagttggtctaatttgcccggacacaagggttagagacaaatagtttgatctttctaccactgattataagttactgtgctagtaatagcactagtaatagaactacagggctcaaattagctgtaggtagttgatgaactccatcttttttgtgagtattagagctcagaataacaagtattctctgctcagtgtcttttgacatcacttg

SEQ ID NO: 25265 - DNA, 1389 bp, Bovine  19866880790315
attttgtggccgacccaagactgattaactgcatctcctccacaatttcaatttcctgtagcttcacctaaagggcaggttactgtgcctagcttacaaagtaattcccaaagtctaacctaaattcatctataatggctgctgctgctgctaagtcacttcagtcgtgtccgactctgtgtgactccagagacggcagcccaccaggctcccatgtccctgggattctccaggcaagaacactggagtggcttgccatttccttctccaatgcatgaaagtgaaaagtgaaagtgaagtcgctcaggttgtctacttgaaagttacacagtcgtgtccgactcctagtgaccgcatggactgcagtctaccaggcttctccatccatgggattttccagcaagagtactggagtggggtgtcattgccttctccgctataatggctcaggaaacaaattctccaaccgcaatgcccggttctatgaaccaaaagaacaaaaataaaaacttctctttccaccactcacaaatgcttggagttctttttgtttccatccctatgttaatctccacacttttggggaagaaagttccaaagatccaacgtacttatgtttcctttcctgatactgtctatgaactgctgtctctgaattcctatagaaaaataagaaggtgaaagtgaaagtcactcagtcctgtctgcctctgtgaccccatggactatagcctgccaggctcctctgtccatggaattctccaggcaagaatactggagtgggtagctgttcccttctccagggcatcttcccaactgaggaataaacccaggtctccctcattgcaggcagattctttaccatcagagccaccagggaaaccccatcaaaaacaagagagacgtgtaatttgctatttgggtcatctgagaaaagttacccctatggggtagaaagttgttcttgttcagttgctaagttgtgtctgactcatcgcaaccccatggactgcagcaagccaggcttccctgtccttcactatctcctggagtttgctcaaattcatgtccattgagttggtgatgctgtctaaccatctcatcctctgctgcccccttctccttttgccttcaatctttcccagcatcagggtcttttccaatgagttggctctttgcattatgttaatagaaagataactgtcgaattttctggcatggcacactaaggcagtttttctcaattcagcctgctgtcttgtaatcaatagaaattttgtccacattctaggacttagttctttatcagttttcagcattgtgatccttttttttttttttttggtctttcagtgggaagttacatgatactacattgggagctactag

SEQ ID NO: 25266 - DNA, 805 bp, Bovine  19866880815137
ccagagcccgtcgttccctggagccagtacgatgggttcctgctctgtgggcagctcatgaattcagatgaggcaaaggtttgtatgtcattagagtgagttgtcctactttagaagaaggtaatggttactgtacactagtctgttaggcaggcaacagtgggtcaagggtggaccttttggtgagatactttgttaaactagaactttctcaacagcaaaaagttcagtgaagccaatcatggtaacagtctttatgggatgtcgcatgccaacaaagaactggactatcatcaaataccctcaagtcactttaaagctagtaagagaaggaggatgcttctgagaaggtttcaagcaatatggccttgctgaaacctgctggaacagaaagacagactgaccaacctggagggcagatgcagggtcctagtgttctagctttgtgataccatgcatggcaggtgtgggtatatgaggaacatatgccagggagaggaaggacaggaactttccttggctcatttcagccacagctgcctgcagggcctacagttcctgtctgcaacatcacaaagctcttcaccagcaggagttttgatcctcaggtaaattgtttccttaaagggcttagaatcaacagttaaccacattagaatcatgttaaagaaactaaccaaccagcaaaagaaaccagtaaaaccctactgacaacgataaaaccttcatggtttttaatcaagatttgcaaaactaaatggtccatgaatgtgtttgtattacacagctattaaaggggtctact

SEQ ID NO: 25267 - DNA, 784 bp, Bovine  19866880838513
ttcttttctgggtttgttcccctataattattagcaatccaaattccataattctcacttgggaagaggcaagtccggtatccaatgacattaaacaaactgacaatctctttcagaggtattataaaacccgtatttttcaattttctaagccatactaaagacaggcaaaatcacacaagttcctttattcagaatattaaagaaattaagactgattgttgtcacagtccattataaggtcttctctgggaattttcagtggattattcttctgactatcttccattgtaaccactcttcagtgtaggggagtggttttgcttttttggaaacatcaaatgttacttagaaccaagactggtgaaaaaagggtaagagcataggttcagatgctgaaagagacactaattagataataatacaactgattttcttatacttttaacataaatggtggcagcatcattaaaataagtattattttcccaagtaaaactagatgcctttgaagggaacactcaattagatgtcacaattttgatatgtctgctaaagaaatcactaactataatcatattcacaagtgtccatttaaaccttatctcctctgaggcctgtgttttcactgggacttgaatttggtgatctagttatctgaatgctgtaaaggggaaaagaaaaatccaatttgtgatattttctggtttagttactattttgcacagttggaatatatgcttacagtacttgcccattttaaaatagcagatccttcattaca

SEQ ID NO: 25268 - DNA, 1741 bp, Bovine  19866880851806
gagcgtgattgacagtgcccacaggaccacattgggcctcactgagaagacagcatttaagctcaagacccaaaatgtcgactgacaagaaggaaaacctttcccaggcagagtaccagaaagtgcaaaggccctggggtgggaatcaggtcagcttactgaaggaagaaatgaggggatgaatgctctgagctcagggcagaggggcagccaagggccagaatcatcagggccttgtgggtgtggtaagaagcctggattttttgctcagtgatttgagaattcaaaggagtaacatgtatgatttatgctttcatcatctggcttgtgccaagaggccacccttccagcttctgcagttcatgggctatctgggtaagaacaaggcatgaacctgaaggggcatctgcttgaaactggcctgtctaggccctgccaggcatacctgaaagatgcaacagagaaaaggacctccatttgacacctttcttttcatttctttaactaccctccctgagtcattccttaattattttaagtatttttgacctacctccaggtccagccaatacacaatactacctgattaaggcaaatttctgcttcttcttagaagggtcaacaaactatctaaagaaataaaaactgtcttggtacccctagctgtgggtctgttttgtaagtagaggatttccacatcacaatcccttccaattatgaagcaatcaatcaaataaatccctctgacattttgagagagaagaaaaaaccaagcagattcttttagttcaagaaatcgacaggagtaagaatgaggaaaaagaaaaactatcaacagcaaaatgacctccagttatttctaaggggctggatctatttgctttttgaaaggaactgatcaagaaggaaagggcaacttctgtccctcacatcatgcgcctcttcccctaagagaatgaggaggggagcaaagggaaatctttggcatcatgaaccccaactggaaagcatccaagcattgttttgaaagctgtttcaatcagaccacgctaaccgtttcttacttttgcagactgcttacttaaaaatcagtacacggcagattgtatgggagatgagaactacttatcttgatgatgaaaagtcaagctcagacagtggaaagtagtggaacctaggtctcctgactcattccctatcaaattttattatgtatttttatcttataaaaatcaaagcacattagaacaaaacaggaacaggaagtcactcataatccaatcagtatactatactattaggattttattccttccatcatgtgcttgtaggttcccctgcacatacactgttaacatcacactggactaaaagttgtttgcaatacacaggccctttacatcaccattaacacagtcgaggacatgaaacttaacattggtatgatgtggaatacaatttggtataatttgagctgaatttactgtctttgctaaggataagtgccttccaagtgaattttggcccttttattgagacacagtaaaaatatacaacagtacctattattaggtcttggactgcaggttgttctcacagtgtttaaaacagaactctcaagaggccctgtgatgtaacttaacttcagttttatttacctacctggtgcatcaggtacttgaagaggaagaaaggatcagatacacttagaagaggaaggctagaatccatagtctgccca

SEQ ID NO: 25269 - DNA, 1611 bp, Bovine  19866880910517
tttaaattgaagcatagttgatttacaatgttatgttaatttctactatagagcaatgtggctcagttacacacggtatctacattcttgtggctcagctggtaaagaatccacctgcaacgcaggagacctgggttcaatccctgggttgtgaagatccccggagaagggaaaggctacgcactccattgttctgacctggagaattccatggaccattccatgtggtcacaaagagtcggacacgactgagcaactttcactttcacttcaccttctttttaaatattcttttccattatggtctatcacaggattttgaatatagtttcctgtgcaaagctcatatcctttctatgataccaactgcagcttcttccttgtgcagatcttctggtcggagcactttcacttagatcctctagaacagggtttctaaactgggggttgcaactcttcaacccctcatgaaataattttgtgtattaggatctgaattaataggaaagaaaatatttgagttaatggcacatggtgaggataagtatgatttgtgaaaaatgtgtatcagttaaacatgcatgggtgtgagtattagtgtatgaagtgaatgcacacataaggatttactgggccaacatgtattcctgttggggttttgcgagcatgtttgaaaacactgatctgtaagtggtctttgaaggataatgctaaaggctagaagagtctagaaacttcaagttccttgccacaaagcgttcatagtagcagcatcaatttaagaatgccacttgaagagttggtgttctgaagttattttctggtgggttttattcagatacgaaaaatgtgctctgcaacctttatcaatggtcgcttgagttcttgtgggttcaactctgtcttgctaagcataatgtttctcatctctcttggccaagtatttacaaaaacctctaaaaatattctggactgacttcagaatgctgggaaggactgctgctgtgttcagcatggttttctgcattaaaccgtttcaatcattggttaaatgttttcctttaaagttctttgggataagtatttatgtgtcaggatataaccaggtggacttcctggacgaacgcctcttttcttttccattttttaggggggactcctggtaactgacttggtaaatcatccccctctcagtattctgtgccctgatcactcaactccttgacaaatgaggtgcaatgagatggggctaaaagaaaaagtggctgttgaggaagtgttataattaactcagcagaaatacaaagttccaggcagggaaaaggggcaaaaaccacctagatgtgcaacaccaggagaatgggtggcaacagatcatagagcaatatttaagcacaaaatgactggctttagactgtattttggggctgcccctcaccagctctgctgtggccttgaacaaactgtttcatgtccttaagtcttacctttctcatctttagaaaaaagagagataataatattgtctgctctatggatttcttaaaaggcttacaattagatattgaagtaagatgcgtgcatggtaaagtcgcttcagtcatgtctgga

SEQ ID NO: 25270 - DNA, 2429 bp, Bovine  19866880913673
caggttcagcgtaaaaacaaataactgctagtatcttgttaaaaccatgctctcaaagtttaaaaatgattatttccccaaatgaactagtcactttgtaaggcattcaagatgctgccttaaatttgtttgtttttaaatttgcagtataatttacactgaataagaatacaagttaccaattttaagagtacaatttgatgaattttgacaaatgtacacacaagcaccactgaaataatgaagcagaaggtttccatcaccccaaaaaggacctgtgtgcccctctctggtcaatgccttcctctgagccccaggccctggcaacaactgatctgcattccgtccttgtagctttgcttcttttctgatgtccttcatttagcatgatgcaattgagattcctccatgttgtggtacatatcagctgtttgttttactgctgagtgtcactgtatgaatgcacttcattttgttgattcattcatcagctgatggactttcggttatttccagcttttagttattaaaaataaagctgccatagggatccctatagctcaaacagtaaagaatctgccttcagtgcaggagactcggatttgatccctgggtcaggaagatcccctggagaagggaatggcaatccactccagtattcttgcctggagaatcccatggacagaggagcctggcgggctacagtctgtggggtcataaagagtcagacacgactgagcgactaacaactattactactaaagctgccataaacatacacatatgagtttttgtgtgtttgtatctctttctgagcttagttttgaatctctcccctttttttgaacttgcacttagaaatggtttatagctcaccaagagaagcaatgaaaccacacctaggtttaacttcaacaatcatttactgtccgccaacttacagcttgtgacactcccagtactcattattaaactgtcaaatcttataaaattcacttaagcctgcaggtggattacttctgatgtcttttggctaaagaacaaaaggacattagaagccaccagatttgtcacacctgataacttaatgtgtgataacatgcacactgtttccttccaagacaagtctttatagacaactctttcaacaactctctaccttttaaaagtagagcattaacttgacacaaaataatgaatcacagactcttagagaaagaaaggaattaagagctcatacttcctttaacttacagagactgagtgagaccacacaaattctattacttgcctaagtaaaggcctgtcaacaatgtcttttctacctcagaaataaagtgccattaaaataaaactaagacatctaagaaaaagcagtgacaactgtgtgtatataatatcttaatctgtattcttctaggctattaggaatagagataagcaaagatgaaacagatattcactgagggacagaagccagattttaggtgacctgtaattgagatgatctgtaactgcacaggtgaaacaaaataatggattttagtgtctaggcaagataacttgctttggtacaattaacactgcagaaaaagccatttttataggtgaaaccaatttaccatttttggaaagtataatatgcggatatattggaattaaataccagtaagcgacatttctcattgatacctaatttatattgaaggaaggaaggaaagaagaaagcagcctctgagcagcagagaacgaaactcagggttctaaccaagtacacgaacataataacatcagcattactcgaactgcagatgacatggtgagaaaagatgtttaaagtttcttgggcaattttctgcatactggcaaaagtaagatggttttccccccaaatctaatttttcattattctgagcactggctttggttttattcccccctaacaaggacctttcacgttaaaaaaaaaaaaaagtgatgatctgcttttttcacttctagcactcagacatttgcaatcttatgaagtcctggacaaaagggaaagagcccacatgtcttgcttgtctttcaccggaggcctgtttgtcttggcctgtccagtgagtgggcgtgactctggggctgttcctgaaacggatctccttacctgtaaaatgcagacagctaccccccaaccttttcgtattagtcactcagacatcatctctaagcctttccccacactctctgtcacagtagcaactttctggaacactctgctttcacttctcttacagcccttgaaggcagggaaggtagattcttaatttctgatccccagttcccggttccctctcgtcctctgtcacatctctgccttttggcttcattggagaggtggggagaacagaggatcgaggcagaaaggcaggtccttcaacaagaat

SEQ ID NO: 25271 - DNA, 779 bp, Bovine  19866880926343
cagtggagtcatagatgatattcgacctcatctgcagcaaagcctcttccccaggtccgttggaataaccgtccaaatccagggttgtccatctctgggaattgctcgtgggcgatcatttcatccagttcctctttccgctccttctcactgctttggtcatcagaaaacacgacaagcaaaggatcgtgcttattccgggcactagtgtctatttccagctgtcccctgccaagtgtgtcctccgtttcgtgtttgctctcaatgtggacctccagctggtgggtggatgagcctgacttttgccaatgcctgatggcatcagtgacatcaaacgtctcccactcactgttggttccgtagatctcccctgacaccaagaccagcatgtttctttccccttcatggtcctctttgctctcaagtacttcaaaaatggtgatttttcggtccactccttcatatataagggcggtctctttgcaccagggtgtacaacctgagctcagccatgatgatgtcttcatggtgagggatggatacgttgaagaggagagggtattttcggagtccattaaaactggctggttgggaaaacagatctggaaaaaacaaaaaagaaatcagatttgcagcatgtagcagaggaaaacagatgcttatttatgcaataagagtgcctgtccattctctccacacagaaagaatgaaggaaaatcagtgaaaacaaacacagtgttggcattctctaagaggaagtaccgaaggtcaagcattga

SEQ ID NO: 25272 - DNA, 1465 bp, Bovine  19866881093501
gaagaaaagaggaggggggacaaaaaaacaaaactaagtacattactgtgaacttctttcatccagtgccttaacttttcctttcttcttaatgagctggattttgcaggcattggcttcccaatctttatcattgcctccgtcaattcccacacctgaatcatccagaggtagaaaagcaagatttagaaattggctactacttagaaactatgactgaaaggcagaacttgtaagtgaaaaataaatttttttcatctaattaattcatttacttatcaattcaaaatttactgaaaacatactatatgtcaagaaccatgatagccactagagataaaaatgaagaaaattcaattcctgttctcaaatttctcaacagtctattgagaagacagacaaggaaaaaataattaccatacagtgtggttttaatataataaaagtcatgtgactagaataaaagtgctacaggttgcgactgcagcacaatggagatacagagaagactggcaccacctcagaagcagggtaaggaagggatgccaggacacacagctctcaagattctactaaagttcctacagaatttgaaaaagttactctagaggtactggaaaaccactgagttgtttcaagcagagaaatgacacggcaaagaagtttagaaaactctttgaaaacagtgcaaaagctggaggagagaaacagggaagaagaaacctgctgtcagaagttacagttacagcaaagcaaaaatgaggaaggcctgagctacacaatggtcatgaagtgatgggtgtactgaaaagcagaactgactgaaggtaacgagagaaagcaactcccaggctcaaaggacttgctgaatgacctggctgttggcaaaaggaagagagaaaggatagagtgagacacggatgagaactggaatgtattcagttcaattctgagcatgcaaggtttacaatatcgtggtttgtccagggaaaaatttctaagaagtagccggaaaaacaggtgtgcaacatgggaaatacatatggattgtaagtcaccaacatacaggaggctgatgaagtcagagctcacgcacaaagatacaaaataaggaaagaggactcaggaaaacactgagtaagtcaaaaagttcattcgggtttttccacaggatgttatggaaaaattcaaatgaactttttggccaacccaatatcttgaggaacattaaaataagtaataggtgaaagaaaagcagcctccaaagcagacaaaaaagaaataatcagcaagttaggaagagaatgagaagatatgttgtcagaggtgaaggagagagagaatttgaagaacaaagagttgaggaattgactttccattagctgaggaagagtcaaggaagataaacgcccattacatagggcaatgttgagtgtaaagagttaatatggtaggcccaagaccg

SEQ ID NO: 25273 - DNA, 1546 bp, Bovine  19866881103170
aatgatgacaaaaaccattaaagactccaccatgcttcctaggaaggcctggggcctcacgaggggcctctaccaggttggcttaatatagaaggaaaagtcaactctcagctgggaaagccctagcttttctctagtgcctcgggatcatttaaagaaaaaatcatatgcattttcatgaaacaggaaaaatattattatatgactgttactatctaaactcacagttcacttcagttcagtcgctcagtcgtgtctgactctttgcgaccccatgaatcacagcacgccaggcctccctgtccatcaccaactcccggagttcacttgatggacatgactctaaacacacaaacagcgtctaaaaaaagttgtatcatcgtgggcctgacctatgcaatcgcggcccctgaaatgcaagtggaattagaacacagcccatgtcctgctcaccgtgtgcctcgagagggatgtctctgcccccaggaaggggagtcatttactctcataaaggtgttgcatggattaccaacagccctgctgctgctttttttttctttatttgaatataattttctaacgagttttgctttcataaatacagtttattgcttggtttgtctttgcctaacactaattttgagtttccagccctggaagagtgtgcctcatggtgggggtggcagaatggggtcccggcttcagcaggtgccgctcttcaaaacacagttcccctcccccaaggcagagaactcaaaagctgaatattatttttggcccctgtgtctcagagacatcccagtcagacatctgaccaagcaagttgttccacaacagaaacacagctaacacttcagtccagcctatgtcgggggcagcctgttgcctgtggcctgcatcagtctccactggacacagccatccagttatggaaggtgccgtttcactccgctgaaaccaccgtggaataatgcaatcctttcaaatacagccccatgggctcagagctgtccacacaagtccccgctcactcttctcctcttgcaaactccaccgatctatttattgggaaatgtgatgtttttccctccaaatgtcgtctccctcttagggagtgatgttgcttcctggctatttgttagcagcaagaaaggcagcagtgctgggtctctgcaggcggtctctgtggttcctgggatcctcaagcgtcggtcttgggttcctttatcgatttgacaaactccttgacctcctcttccaagaccctgttcctcttctccacatcctcccggcagcgttccacgttgcggaggctgatttccaaggctgctgacttcttcttctcattctccagttcttcattgagccttaccaccttagcccacacgtcataattttccttctcgaggctatgaagaagggaagaaaagaatgggatgacaaggcatgacctctagactctccctccggccttgcccactgccaccctgtccgtttcaccttccatatcacaagacccatctccagcctgtgcctcctagtgtgt

SEQ ID NO: 25274 - DNA, 1699 bp, Bovine  19866881146859
ctcagaagggaacttgaaaagtatctgagggctactcaggcagccaccagaacaccttttcatcttttctgcaaatattagtgatgagaaaggaacacacttccctttaaggagcacctaatgcgtttttagaggacctgccttgattatactcatttcatcaagtaggttaggtccttatgcatacaggtcacttcaggagagacaaaggtaagcagaaagctgttaggattcttccttatatgaaatttaattctctttcagtgaccctcacagctttccagttcccagcgcttggggctggacatgtacatctgatccaccttcctgacagcctctctggcttgcagaccactctcctgtccttctggatccactgttttccttgttctgcaataggaaaggaaaatgttaggtgctcagtcgtgtccgactctttgtgaccccatggactgtagcctgccaggttcctctgtccatcgaattttccaaccgagaatactggagtgggttgccctttccttctccaggggatattcttaagccagtgatcaaaccagggtcccctgcatcgcaggcggattctttactatctgagccaccagggaacaatagtctatgttgaaacacatgctcagaaacagctccttcagccagaggcaaacagaaggaaggcctgtacctggtctagaccatggccctgatggggtaataggtctggtggacagacagatggtgctgcttgtcctgggaggaagtttactcttatggcagaacatgggatctgaaggacatagaaacagtcccaggtgggttaaaattccttttatcaatcatcctgcacctcttttggaggtcatatctggcaagtgcatcagcagggagcaccaccctagttcctcagcatcagaagtgatgaaggcaggatgagagttccagacacagagaaaagagaaccagcaatgcgcatagaccaggactggactgacaaaacctgaaaagccattcttatacttaattttgaattttttagcaacatattcattcctttctgtaaataagtccattactgagtgtttctcccagtgtggagcctgggttcattctccaccttggtctgacctgagcatggcagcccaggactagctatcatggctctagaagtttctcatctacagtagagcctggtagtacattgggcagacagggctgtaagtgatttggggaggggggtagtttgtctacaaagtaagagaaaaaatgattttcaaagctcagattatacattaatactatttataggttgtattactgctcttaaggtgaatgggtctttgtggtgttgagggaaaatagtgccatgagaggggctccatgtgactctagtcacgtggtcaagagcccgcttttgtgcagaagtgactatttgtaaataaggggcctgcttggagagggtgagagcttgttaacttgggtggttataaatggattatgtgattatcttcaactcactcccccaaactgtcagtttacaagaaccagctcctgccttctcttaacgttcatcagacagttcagacagatccacaggagctcagctcatcccaaggagaaagtcagaaactacacagacacccagtccattttcactcttacgtgagattctagactctgtaaagctttaggactctcagttcaa

SEQ ID NO: 25275 - DNA, 2765 bp, Bovine  19866881163262
ttagcaatttctactcctttttcccccctccccttttgtgccccaactcccttctttgctactgatgaagtaaccgtgacctgaattcgatatctcatcattcatgtgacagcaattaacacttagtttcaatttacctcctgcacatatggtggatggttcagctgctagaatttcgatgcaggatttcttcaatatctaggaggagaggaaatcaaaaagtcaaagtcaaagtatagctattttgttagaaaagtgggtttgattttagctaccaggatcagaaggctcaaggatactatgctgtagtgggtggataagtagagtgttacattttcactgatattattaatgtcaagcatttaatgagcagtactgtgctagatgttctgggtgtcacaaaagctatgtgcctgtgtgctaagtcgcttcagtcccgtccgactctgcgaccctatggactgcagcctgccaggctcctctgtccatgggattctccaggcaagaatactggattgggctgccttgccccactccaggggatcttcctgacccagggattgaagctgcatcccttaggtctcctgcattgcaggtgggttctttaccactagcaacaccctggaagccccacaaaagccataagaattatttattcatttgttctggcagatatgcattgaatctatgaaaggccagtcctagttatagagacgtttacatccagtagatgaaatgggagctacacttgaaaagataaataaccatggaccattctatgtgatagatgccagggtaaaagggcagacagtacaagctagagttcatgggggagatcactgagggctgtaattgagaagggcttcctggaagaagtggctgctgagggtgggatgtagtcaagtgggcaggaataagttaggggaaggttaaggtcccagcagggagtggcatttgcaaaggtgagaaactagaaatgcatagacctctttagctggaacaaaagaagcttaaaaagtagaaaaacaagtgattaatagataagaccagagagataggatggaaatggccaactctctagaagagatgcacgctcagattactcagtcgccttctagttaaagaagtggaaacatgttgcaggcaaaggatgtctttgaagcctgcttattgtgcctcacactttaagaggaccttacgtaaatggaaataaaatagtttttcccccaagtgagtctttcagggttcagtggagagtctggagaactccaagactgcacagggaattaaaggcttctggcgaaatcggggtatctgacttttaagcttttctctagcatttatgaatcccactgcttactgcataaggattctaaaattttggccaagcattttaaacaatgtataggacactgagtgatataccgcaggatctttatttgggtgggccttacttaatttggaaattgaaatgggtcagagggctgaagaagatcattttgctctatttatgaagggggcatttgttaaaagaattaatagtgaaataaaatgtaaagtctgtaaaagaaaaaaaggatttttagcattgggaaacacacattaacttgcatggatgtttttagcaaatatgcttctttgttccagcttaagtgatacatatgccacaaggatacagtaaaacaaaatatataataaattacaaaaggggaggaaatggattaaagggaaaatcaggggaagatgaagtaaggagtgagaatagcatagacaaaatacattgggaagagcttatttccttgttaggagtggctcctgaatttaattctaagctttctagtagcaaatgaggacagacaatatttatgagattctcagtctgaagaatgaaaacaaaccagtttctcagaagagataatatttacccattccagagagaaatctgggcatcctcatagagaagcattgtgaaaggaaatgaacaacatgcttcagaaaattgttctctgatatacagacgacaaaacattcagacgtattcactgaaagaggctccctcgcaaccaggtatttgaggtaattctctatacctgagagtcataagcagcagcatggtcctccctcagtacctgcaggaggactggtccaggatctccatggacaccgaaatcagaggatgcacaagtcccttatataaaatggtggagtatctgtacacattcttccatatactttaagtcaggggtccccaacctccagactatggaaatggtacacatccatggcctgttaggaattgggccgcacagcaagaggtgagtggcaggcaagccagtgaagcttcatctgccactcccccacactcgcattaccactgaaccattcccccgcccccacccctggtccatggaaaaattttctcccacaacatcagtccctggtgccaaaaaggttggggactgctgctttaaatcatctctagattgcttataattcataatacaatggaaatgctatgtaaatagtccccagcatgctgcaaactcaagttttactttttggaactttctggattttttttttttacaaatatttttgatccccagctggttgaatctgcaaatgtgaaacccaggttatagagggctgactgtatttctttttcttgacaattctaagatttagacttccagctatttttcctgaacattctttctgcctctttcacaatttaaaggcattttagtatctgttttcagcttcta

SEQ ID NO: 25276 - DNA, 2044 bp, Bovine  19866881168167
gcattgggggctggaggagaaggggacgacagaggatgaaatggctggatggcatcactgactcgatggacgtgagtctgagtgaactctgggaattggtgatggacagggaggcctggcatgctgggattcatggggtcgcaaagagtcggacatgactgagcgactgaactgaactgaatcatcctctttagccccccagcctctcaagttctctttgttttcctgctggaagttctcgttatgaagaagccttgttcactgggttagtttatactcagatgtagttgacagacaacagtgtaatgggaagtggttattgactctttctggagcaccagggagattctattcttatctggtaacttcccaagctggtagacactgatcccactgtatccccatcagggatgccagccactaagacatttctttcccaaagtgtagtctgtaactgtcagagtcttgctttacagcatctgggccgcctgataaagaggaggactgagattctccagagccatgggcctccatgggggattccaggcactgtgctgttggggtggggggaagggaggggaggctgaaactttgggtcagctgagagtatccaccagctgtcagttttcagtggcaaaatgactgtcctcaaccatttggtaaagctaacttcactctgcttcctgttctcagtaatcggaagtcatctctaccaccagagggaaatacatctcaggccccattatttttatacccaattgcaaagaaatggaatagacctgaaaagtgtcattagaatttgtcaaggacctaaaaaccattccacacctcttgcctcacctgtggtcttgagtttctaggtaagtgattcatgtaccttctttttgctgttgggcaaaataagtggggaccgctcggcacatgtccttgatgggtgctccgaactgggctaaattcttgacccggctgggtaaaacagtgtaggtcaggccgtgagtagatggataatgctttggagcctggaagatgtgacatttcaaaagggtgagacagcaagtagaggtggcccagcaaggaggaagcgtgagaaacctattccagtgcatgggggcactggatgtccaaaaatagccttgaacctgcactagcccttgagttccctctctaatagcaatattctatctgaccacaaggtggcaaaattattccagaaaagtctgtgtgcctctgtgactcaatctgtactcctttcgcccttgaattctcagcgcttccagactcctgtgctattctctttctaataatgatatacaatacattttaagttatggtcttcatttatattatgctttttacttgttataaatcagatgaggggaatacttattacctctctttttaaaaagtgacaaattattttatttttatgtgatccaaaggcattttcttccccaggaatcagcagccctgctgccatggacatcagggacacagcccaaatgtgctgggttggttatttaagcaaaatgatgccagatttcaatgacttcccaagggcttcctgctgatttttaatttatctgacaacccttggcatttaagagacaggaagagagtttcaggagtcctaaactcattttcaactaaagatattatgtgtgtatgagcttaaagggtctgcaggggaggagaggaggtatgagaatgaaaatactctagtatttcactttaataattcatattcaccaacgtgtagttcacacccttttggaatacatcaaaattatgtcattgcatggaatgcaaaggttcattttcattaatgtgctgtgacttaaataggccacggattggacttggagtcctttgcacgatgatggaattccatgggcgttaagatcaagtatgaaatgaattccccagcatgtacagcatcatcttaggaggtcagaacgtagagttcaaaaacaccaaactaggaggggactccaatgagctgatctcacttacctggtggtccagggcccttaacaatgtcatccaa

SEQ ID NO: 25277 - DNA, 1208 bp, Bovine  19866881240062
gtggccctggcgtcctgcttgtcccactggccgtgtggccaaggagcagcagccctctctccggaagctgcctgagcatccttgctttattcactcactgtacatggaaacccagcagctcaagtcctaggaagctaatctaacctgtttcggtcaaaatccttttcagaaaagcaagtcgaaactcaaggtcttgtagaacccaaaatttgaaaactagtatctgatttgtcacaacatgaaatgatagctggattcattatctggagttattccagctcaacagtcagaggcagagagagaaaaagaaaaagaacgcgtgtatgcgacactgttaatgaatcctaccgtgtctcctggctgtggacgcatcacggacacacgatcgtagcctttccttagtaggacccacaaggcatcaagttttccctgaaataaaacaaatgcaccaagattacatctgaaaccagactgagggcccgcactgacatgaactttccatgcttcttcagtcatatgaaccacacttcaccagcaatgcagttgtcacaggatgtgactctctagttcaaaatgtggatttcagcaatagaggagaagagacgcatcccagagaaccctgatgctcacgcaggagacacctgcaactgtagcacagcctcaggtgtgcagacacacaggagtcatccagcctgttgccctcattgcatttctgggcatcttctcacactgcaggcttttcaacttgcactcaagttttttcttcccacttagtgtcccgagtttacaaatgaaacaatgaggacaaattcaggaaaatgactgaacagaagcgtggatggggctagaccaatgaaagggtcctggggcacagatccacggatgtccccacaagaggctccagaatcctggacttgagggacaaatgaccaaggatcatggatcaccacaaatcacagccccctttggagttgtaggtgattggctgaatctgagaagactgaatctgtgagggctaaagttttcatagtgtgtgacaaagggagtctaatgttctagttccttagacatgctgagtggagctggcttctgccactgcaaacactaaaaacacaggaaaaaaaggaccctggctggtgacgccaccaacaggcagaagtcacctttactttgtctgatttcccttcaccaccaggaaatccgctcgc

SEQ ID NO: 25278 - DNA, 943 bp, Bovine  19866881387331
cctatgtgataatactattaggtcccttttcacagatgatgaaacctatttcacaaagagaataagtaactcattcaagggcacactatgtgagtggtagggttgggataaggaccctatagtccatgctcttattccaaacacctacctctcctccagtctttccagtgtttaagcctgtactcctaacacctgtgcaacactgcctccccatggagggaggaagcatacgattacaattcgtagtgttaggctgctaagttagcagagaagtactgcagaagttccacacatttttatgagaatttgggaatagggatgccagggcaaggttaaaattggtgtacttgagtggaatcagaagtgccaaactgattgcccattttaatggaataaggtgtatcagaggattcacctgttcggccttcaatcctcttgtgttcctttgatagtgtcttttatgacagtcaataatcaggatgaccatataatttaaaatccaaactgaaacactttcaagagtaaactaggaagccactaataattatactgggacaagcacaggcgaggaatgaactagaatgtaccatccatttacttatggttagattatggctgtccaatggcattttgtacttcctttgaccttatattgcttattattgtgactggagtgtagttgagttaggatatttcttttttttaaattttctatatagtttccataaacttgatatttgcattatcttttatggtggctcagatggtaaagaatctgcctgcaatgtgtgagacccaggttcaaatccctgggccgggaagatcccctggagaagggcatggcaacccactccagtattcttgcctggagaatttcatagacagaggagtctggtgggctacagtcccaggagtcgcaaagaataggacaaaactagtttcc

SEQ ID NO: 25279 - DNA, 868 bp, Bovine  19866881583767
ttctggaagtactttagccgttatctaattcactgcccatcccgccctgcattttattggaattctgttgccctggcatctgtggtggctctcttcagcttcctacctctcatctcagattactccttgcccacctcctcatgggcttttccttgtatgcagtcccttaaatatcagcaggcggcatggatctttttttttttaaagcaaggtatatactttttaaaaattaatttttattggagtatagttgctttacaattttgtgttagtttctgctgtagagcaaagtgaatccgcgatacacatacatatatcccctctttttttgaatttccttcccatttagatcaccacagagcagtgagtagagtcccctaagctatacctgaagtgcctacttttttctcattttaaaaagcatggtaaaatacatatacacacagcatatgccacttaaaccatttgtaagtgtccaattcggtggcattcagtttgcttaccatgttgtacaacccatggatgcattcttggtcccttgctgtttttctttctgtaaaactggccacgggctgtctcccttcctttcacagtttaaactcttatctagatactgatgacttaactctttatctctagcctagatctctcctcatgcttcagggtcatggtcagggtcattccactgtctgctaggttctactggcactgcactgcaaactcaacaattcaaactgagctcactgtttcctttttcaaaccagctcattctcttctcattcaatgataagtactaagtacttcccaggtggtgtagcgatatagaacccgcctggcaatgcaggagacagagagacctgggtttgat

SEQ ID NO: 25280 - DNA, 1885 bp, Bovine  19866881752957
tacatagtcacaaaaatactataacattaagtttgatgggagaactagtatccagttcttcaaaacaagaccagacctatttgatctctgagcataaatctgctctataggattggaaaagtacatttaaaggattctcctgaaaaggcccaatctgttaacctttccattctttttagaggaggtgcagtatgaccaaggctcagagcaactgccctttgcaactctccaagcccggcattctggagaccagagacaagcggtgggtatagggtgcgcagacatccacatccccgcagggaattttggtagtggcagcccaagaaacaaagcagtcaagagaaggaggaattctaaataactgtaaacagaagacagacattaaatcttgttggcggttagagggtttccatttttttttccccttaatatgaatgtattactgtaggaagggaaaacatatgttttcagggtgaatagtccttatatgtgaagatagccttgtactgttggaaaaacatgttggaagccgtctgcctgtgagcgatgaaagatttacactaacttaacctcagtgtcttggcccatttccttttcgaaccaatggctatgcatagcagacatcctgtgatcataaaactcagaaagctagccagttgttcttggggtgtggggtgatggggcggggtggctggcgctaaaccccaggacctgacctcacagagtcagggtctcccttatcaagcataaggatcttccttatcatgaagtttaaggtgaggaaattttgttctaattctctcaaattaagtcatgtctctctctctcttttttggtttagcacattaaattaagcaagaagtcaaaacacacttctttttcttgctttgatgtagggactatgtgagaggtaaggtcaagcacactgttccaacgcttccactagggataactccattttagtctattttgaggctccaaactacatcaatttcagtaaagagcttatatgctttgaaggaaagacatactcacaagtatctgatgattttgcaaagactctcaccaatccccccttaatttcccaagcaactcaaagtgctgaatgacttagaataggttacccctggaaattttatctgatggacacagtgaaggccaatgttcccttaaaaaagaaaaatcgaaatctgaagactgaaatttcaggctggatcttcctgagtgccatatatcataggtgaccagaatttcactttctcccatactataaagtgaaataacaattagaagaagcatcagagacatacttcttgccccaaactggaaattaagacttgggagtattggaaaaccttctcagttaattagcaaatagaaagcaaaatacatcccttcccaagaacttcagaaatgcagcaccaaatgaaatccacactctttcagagttgaatcagggaatcaggagatgtgcttcaaatgcataatttccatgaccttttgcttagacaataagatcaagcatttggttctaccatatgctgtgtcgttgcactaaaacccatgcctgggagctaacactggctagcgatgctgtgtctctcaagccaatggggcaattaaatgagagagatttctccttgggcataaaactgctgttgccaagacaaaatgtttaattaaattggcctgggtacatcaatgattaaattcaaggagggcagctgcaaatgtgtgctccctttaacaactccacgtctgggtcgtatcaaatgcaggctcacagggggttttcatctccatgaccacaggtgaagccagggtaggcaggactcattaaaacgtcctcggcacgtctctcaaatgtgtttgcacagcactcgtg

SEQ ID NO: 25281 - DNA, 943 bp, Bovine  19866882028837
tgagaattggccctaaggagatagttaaaaggaggaaaaaccaatgttcatccaatccaaatgttaattaagcaattaattagaaattatacattgaactagatacattcctggacctctgctaggctagtgaccatggtcactgtggcagtgttagcaacagtagaacatagtaaacaacataaattatttaaaatgctgcgatggtttaatacagtatgagacatccatatgatagactattatgctttaatgctaaatgacacaagcagaattcaaaagcttctcttgcatttactgcctgggtgtgaattctgacttgtactgtgtcctggcacctgacattggcaagttcattagcgcctctaaggctccgtatctttaatagtaacacaggtataacaatactatctcatggagttggctgtcaaggttaagtgaggaaacgtgttcaaatttagcacaattcctagcacaaaacaagcagtcattgaaagtgagttgttcttttgaatactataaatgtagatggacagacttaccgacagcctcaaatggacagcccctactttagagccccaggaaatatgacgtgtggtttgtcttgtatattttgttcagtatcattgcagaaaatcctatcactttgactgctcagttctgccaagggaaattggagtgactggcaggctctgctttctctcttcccagccgtgtttggccagcgcttggatgagaccgtggcttatgagcagaagtttggcccccacctggtgcccatcctggtggagaagtgtgccgagttcatcctggagcatggtctgaacgaagagggcatcttccgactgcctgggcaggacaacctggtgaagcagctgagagatgcttttgacgcgggggagcggccctcctttgacaggtatgctgtgctcacctcgtcgcc

SEQ ID NO: 25282 - DNA, 719 bp, Bovine  19866880373672
ccccctaccccgaagcggctctcccaccacccctggcggcggcggtggcccacttgccccactaccccttgcccatggtgccgcctccgcggccggcgtcgacgaggactcagccccggagccccctctactgcccagaggccgccgccgcccgcccagcactcagcccgcctgcccagccagcaccaggctcccgggaacgtcagcacgccgccgtctccggacctgctccctgcctaccccattggtcggaaggagaaggctggcccttcccattggaccggccctcatattgaactgaccaatgggaactgaggtttcaggtcgccatagagaccgatgctgttaagcgctagagggcctggaaaaggtggggagtgaggatgaaggtgtctctggctttgggtgcgggagggggtagaggaaagagctaccgagggattcgtgagtgctgattgaaattgggacagctttcgctttgtctccctgtcaaacccagttgtgcatgaaagggttagtccgtcgcgtcaaaggcagggacagctgagcccctaaaggaatccttgagaacctgggagtgggcatttcactttttctgcgattagggagtccctcggcctctgccctttggcctttgacacgtgtgcaccttctgcttctccaggtgagtttgcaccccatcccttaaatcattgcttcttcctgacgtcactgatcca

SEQ ID NO: 25283 - DNA, 1933 bp, Bovine  19866880409946
tgagtttgagtaactccgggagctggtgatgggcagggaggtctggtgtgctacagtccatggggtcacaaagagtcggacacaactgagcaattgaactgaactgaactgagacagttaagataccttgatgttaattacctctagttattaatcactgttttcccttaattcaaatacctaattcaaatggctaaatgcattagggcatgtactttattatattatattaaatattcctatcagtaaaatattttttattgtatggcatgaagaaaatttttttttcctcctactcttctaagttctctgttggggctctgtaacaaaagacagattaacaagagaaaagcattcaaatttattcagtataagttttatgtgacacaagagtcttcacaaggaaatgaagacccccaggaaacagttaaacctgagtgtttttatactagctttgatgaagaatgcaaagtcacagagaaacgtgatgggacaaaagggtgagagcggagagtgcgaaatcgagggcaacctagcaaggaggcctgtttgttcagattcctttcagtgtccccccttttctctggagagagggagaccacttctcagaggatggtcttttgaccttcttccagggagaagggaagatcagagagtccttcccacacctgccatttctcaaattccttcagcttaaaatattcagtgtgctaaggcgccatatttggggggtagcatgttcttaactgtcaaaaattaaatgtactaactctttgtgaaatactgctgctaagaatttttatgtagaatcagacgattctgtaattttattttactctttttacatacagtttctattaccttctcttaataatcatcaaagggaacagccctagattaatactttaaaagttaatgaattatccagacatattcttttgagatatttatatatatcctctcacataatttcctttttctaatcaggatagaagtattaatatccaatctgtgtatcttggcttgaatttctttaaattatctttgtataagcaatgctcttaaaataaacatgtagttctatagaaaacactctagaggaatatttagcgaaaaactaacattgcatagctgggaagtggaattggggaggattttctaaaatgttttacagccttttgtattatttttataatcagaatatatttgtgcatgtgtatgtgtgtatgcgtatatgtaagataatatgagaggttttacctagcagttttggcctctattgcaattctttattgttttcaccttcatcataaagggattttactggcacaaacctaaaggatattctgttgaacttcacatgacattctaggatttggtttagctgctttgagcaaatgactgtaaactgaggtgaggcgaacaaagacaaatgccctgctttaaactgttagatccaaactggattcaacatgttagtggtacagccaggaatgcctaagctaggctaatgggcagtcacttgtcagtccacaatcagtcaacagaaaatacatgtgcatgggaaatgaactttatagatttaaaaaaccaatatgaataaattataatgattatatattaattaatagaatacatttccattttcccctcctttccttgttaggccattttatgttgaccaaaaaatacaagtaacagaatttcaactttctgctgttgtccttctacagtgggaagcattttctttcaaattagcccttcctgcttgagaagaccttgactggatcgattctttcttttttaatttctaggataaacaacaaaaggattcttggtctcccgttctccagtttctatattattattccagtccttagcatgcacttagagactctgcaggtaatttatggtagaattaggaatagaacta

SEQ ID NO: 25284 - DNA, 1312 bp, Bovine  19866880466344
cctcttaatgaaagtgaaagaggagagtgaaaaagttggcgtaaagctcaacattcagaaaacgaagatcatggcatccggtcctatcacttcatggcaaatagatggggaaataatggaaacagtgacagactttattttttgggctgcaaaatcactgcagatggtgaccgcagccatgaaattaaaagacgcctgctcctttgaagaaaagctatgatcaacctagacagcatattaaaaagcagagatattactttgccaacaaaggtccatctagtcaaacctatggttttcccagcagtcatttatggatgtgagagttggaccataaagaagaccgagtgccaaaaaattgatgcttttgaactgtggtgttgaagaagactcttgagagtcccttgaactgcaaggagatcaaaccagtcaatcctaaaggaaatcagtcctgaatattcattggaaggactgatgctgaagctgaagctccaaaacttgggccacctgatgcaaagaactgattcatttgaaaagaccttgatgctgggaaagattgaaggcaggaggagaaggggacgacagaggatgagatgattggatggcatcaccgactagatagaacttgagtttgagcaagctccaggagttggtgaaggacagggaggcctggcttgctgcagtccatggtgtcgcagagtcagacatgactgagcgactgaactgactgaataatcataaggttccttcatttcccctaacacaacaacaaaaagcaaaacaatttttggttcagggttttagtgatataccagacacttccaattagatgaagcttgtcttcagcaattggccttcttaatcttccttccttcttccttctctcccttatcctgcagaaaatctgcgccctcctgctgccctctgtgcaattagtgagagacaaatatatgtaccatgaaagacactaaaaatatctttattttcttttaatattttgcctaccgtgacctacttttggttcagtgtcaaaagcaaaggggtgaggtgtgccctaaataaacatgtcagtgaattcggtcccaccatattgactgcatgacttttgtactgtaaattaaagtggttttctacagattgcaagagttaaaaagatgttctatgtcagtacattgatgtttaagttctgaaattccatttgcttcatcaaaaatctatttctttgaaagccatttcccactgataatcctggaattaaggagatctagttagtgcctgagtcacatgaagaatcacttccaacccacccacatag

SEQ ID NO: 25285 - DNA, 1191 bp, Bovine  19866880531927
ggccatctggtgggacttcctccagatgaccacaagagggcacatgattgccagctcataaggccctctgcacagccaacagccaattcctggggctttgctatagaaaggacagtttctgtttgtttgtttgttttccctcagaaacaggaggaaagcagttgaaattcccaggatgcagctaaggcattttctacggcattcatctgtgaaatgttggctgcgagaagcagacattctggcgggcaaaggaaagaccgcattctctgtttctctcgcgtagtcccagcccagggagaagaaaagggctgcagaaagttggacagatgatttttgttgttcctgagattactagtagaatatgctggtgggctacatgtgtctagcaggcttcatggtataatataaataaagtgtggaattaggtctatatgggattcatttccctttcccaagcttcctgtcaagagggctgctggcaaccctggagaaactccaacagtaacctgatgcgaggtcgagaggtgttaggattgtcccttggattggggccctcgggccctgatttcagatgaaggggtgatgagacactattctggaggggaacatggagatagtgatgggatgggaaagttaagtggggtgagtaagcatgagtgtaggtcaaaagtcagaagtggccttttagaggtcaaaattagattgcttaacttctaaagtagcagacaaaaattcaactataagtgaaaatgaaggaagaaaaaaaaggaattagaaacaaaaaaaacctgtactatcaatgagaactctcagctcagatgttgaactaagtcctcataagacagtctggaaatgttgcccagctccagcacctaccaactctgtgaccttgggctgggtacacagtttctctgaaactctttcctcatctctaatatggggaaaactatcatggctaccagctggctatgaagagtaaatagcataaggtgcgtgagagtgctctcctacgtggctctttgtagacagtgaatattctagttctctcctctcttctccctctttagcaagtctagcttattaacacttactcattcaagaatatttcctgagtacctgtatcagttaggttgctttcaattgcaagtgacagaaaacctcacctaaatggcagtaaacaataaggaaaag

SEQ ID NO: 25286 - DNA, 1273 bp, Bovine  19866880589395
tggaatttctccctgtcccctggccgcttctctgtgacacattctggaaactaagccgttttctgtttcatattctctaggactggcttgcaggcattcatacattcactgtctgggaagaaggctaggtttaccttcaatcaaccttggcgttctcaattttagctctgtttatggctgggtcagacttccctggtggctcacatggtaaagcgtctgtctacaatgagggagacccgggttcgatccctgggttgggaaaatcccctggaaaaggaaacggcaatatactccaagactattgcctggaaaatcccatagacagaggaccctggtaggctacagtccatggggtcacaaagagttggacacgactgagagacttcactttctgtctttagtttagattttgtgcacttaatactatattttccagaagacacacacatttccatacttaacatctccaaacagctttttgaagaaaggacaagaaaaaaattacaaagcttctagcattttatcacagatggagcatgcagtgaactagactgaatttcctattcactgttctgcatctcccaatcatacactctagattcagtgagaccagggactcttttcatctaaatcaccacggtattctcagcaccaataaaatgcctgaaacatagtaggtgctcaatagagtttgttgagtgaaagaaggaaacaatgagatgaagactgaggggaagaacgacaatgtatcttcacttttatcaaagaaatatttatgtgccaagcagtgttaagcttcagaatcatcaagatgctgaaggagctcacattctaacaggagagaaaggaataaaaatagtgtgataaatgcaacagaaaagataataaaatatgccacaacaggagggacatccaggaacatgagagtttctacaaagacaaagagacataaaacatcacaatgtgctgtgttcagagaatgccaacagattaaaattagggtggagaggaggagaagaaaaggagagagaaaactctggatatgaaaagatgaaggaactgttgttgttgtttttagctgctcagttatgtctgagtctctgcgaccccatgaactgtagtctgccaggctcctctgtccatggaattttacaggcaagaacactggagtgggttgccattcccttctccaggagacctcccggacctacagatcaaacacgagtctcttgcatatcctgcacggcagggggatgttttactactagcgcca

SEQ ID NO: 25287 - DNA, 1026 bp, Bovine  19866880643982
accaagcattctggctgacacgaactttgcagaaactggcatccctagggaaggtcccttgtgaggtctttaagtagcttagatgagtaaaacattcagactaccactataatgaacagctctcagtggctcataaattctttcattcccagcaatcaagaagcagctgttaaaatcctggaatcttcctagtagcagatcttaaatacctccaagttggccagggaaggttcccaactgctttcttctctcctcccccagcctctccccaggagtgccaagctggcaagaataagggaagggaaaaaagacccaggaaaggaaaaaagagagtgagtgagtagcggctctggcgaaagcagagaggcagactcccttcatttccactacagagaaataccaactccgcaccaactaaccaggtgtctcctttcttctcccattcccaccccctccaaacacattaacttctacagtctgatggcctggcatttggagttaatgacctcagcagtcctaagcccattcctcaaagattctaaaccaagctcttcctttccttgccagagttcgaggcccatccccagggaagattcagcttcctttttccttgtatctcgcccagacggcgatgctcctggggtcaagttcaagatgaaggtaccctcctaacctccaggagccgactccactgcagggaacagagctacctagacgagtcccatccttcgaggaacggggatctggggctgtcagaagtgggccggagggggctgggaggggaagaccgtcgccgagcccgttgtcctctgaaaccctggccgcggcgccgggattctacctgaccaccgccgcatttcctcccggagccttacacaataagtaaactaagttttgaaaacgccggttcagagccgtttctgtctgcaaacacggcgcataatgccttggggcttccttccttgccagccgttccggaaagctgccgcgccaaagccgggagcccctcacacccccaaagcagcg

SEQ ID NO: 25288 - DNA, 4783 bp, Bovine  19866880651803
gcaagttatgtaatgacaagacacagaagagcaccccctgtatgaacaacaacaaatggatatgaacttcacatttctagaaatagaaataatgcaatcattgtaacagtgccttcatgaaaagtcactactgtcctataatgctttaattgtttcattaaacactaggaaaagtgataatctgcatgggtgatcttaccgtgtatataaaattcccaagaaacaaatagtctgtagtgtaaccactttgcaagaccatatctgaaaagtgaaaaagtcattttttaatctttgtagagtctgaaacatagatttttaaaatttatttttactaaaggtacccatactggacaccaacaatatttatcaatgaatggtcacatttctcaagtgttctgtcagtgacaacaatgcttactttgcctaccacaattgtgatattttttcattttcttacttcctccaaagatagatttgctgctgctgctgctcctaagttgtgtcagtcgtgtccgactctgcgagaccccatagatggcagcccaccaggctctgccgtccctgggattctccaggcaagaacactggagtgggttgccatttccttctccaatgcatgaaagtgaaaagtgaaagtgaagtcgctcagtcgtgtccgaccctcagcgaccccatggactgcagcctaccaggctcctccgtccatgggcttttccaggcaagagtactggagtggggtgccattgccttctccgacctcttcagttatgctatttcaaaaacataattttttttataattatagaaatgatatactctcataaccattcaggcagagttgaaaataacagtaatcccctccacaaacccacaatgatactactcctcaaaagtaagtactgttaaattactgttaaatatttgaaagaaatcctgatttgcacacatacacacagacagacatacacatcctcatatatacctaaacatatacatatacacaaaattttattatatttttccaaaactatgattgtttatttttgtgtcatttgcatttttctacttaacaatgcttatgaatgcatttatgtgtcagtacatgtaaatctgcttctaatggctgtatagcattctgctatttgagtatgccatgtttactcaaactttttccaaaattccaaaagtagtgtatgcctactaaaaataatccaaattatactgaagtgtaaaaaatgaaagattctttcctttctatacttcccctgtcccattctccaagagctaactattagtaacaacttgctgggaacctttatgaatttttaaaagttagatttactggagcataattcacatacagtaaaattcaccttttgtagcatacaaatgcatatggttgtggaactatcactgtagttgagatatggcatattttcattcctactcacacacacaaaaaacccctcatgcccctctataatgaccttctcaacacccaccatggcaaccattgacctattttctgttcctatggttttgctttttccagagggtcatataaatagaatagacagtgtgcagtcttttgaatgtggcttcattcatttagcataatgcatctgcaattcatccatattgatgtattatcaagtccttattttgtcaagtacatggaaatgtttttgtttccaaaagtgagattatgctatacctggaatttagctatcttttttgcttgtttacttattataaacctacttctgtatcatttattacatctagatctaattctttcttctgaatcgctgcccagtattccttacggagtgtatttaactgcttttcgtgtattagacattcaggtcatgtccagactttcacaattttggcaaataacaaagtatgaaccaataaaacacatacttgttcaaaatttcatgtgcatatgtacagtatttctataagatagatttttagaagtgaaattgttaagagtcaggtatatgaagcattttaataaatactaccaaacttctctataaaaactataaaacttgtatatatttaaattccattcaccctgtttgagaatgtctttttcttcataaacttaccaataacagatatcaatatttctaatttttgttgatcttataaacaaaatgttggtatcttattgtatatctctcatctctaatgacattgattactaaaaatatatatttataagctatttgatttttttcttctctgaaatgctagtttacagcttctggtcattttcctgttaggttgtcatttaaaaatgcagttgaaagaattctttaaatactaggtagactagaaatgttttctttcaagtctttatgtgtttatggggtctataggaacctgtatgttttattatcaattctgtaatatcttcctttatgatgtttataaatcatatcatacacagggaaacctttatactctaggattttaaagctattctcaacttcagaggttaactaatcctttgctgatagacaacacagttgcttccagtttttcctgttagaagcaatgttgccctgaacactcttgtacaccttctgccttttaagagtcttgtacattttcccctcttatgtgagtattttcacaagatttttttttgtaagataaatccctagaagctggatcaaaggataaagtgaaatgaagtcgctcagtcatgtccgactctttgcgaccccgtggactgtagcctgccaggctcgtctgtccatgggattctccaggcaagaatactggagtgggttgccagttccttcttcaggggatcttcccaacccagggatcgaacccgggtctcctgcattgcaggcagatgttttatcctctgagctaccataggcctatttcaaattttgtttatctgtgctcctggagttcatattcattaccctattttgagacttcattctatcagggattccctctcctgcacaaacatttagcctctcccatccatgggctctttctgttcggcccagaagcatgctctagactcacatcttttaagaaacaaagcaaaataaaatagcttccattgagtctgcattgctttctagtcgctactagttttttcttttctttctggacaacttgtcaaaaggagtccactcttcctcattgcccattactgctatcctctgccgtgggttttctatccctgtactccatggatggagaagatccccaggaacctccagagggtttacccagtttcacctgcagctcttacccgctccctatttcctgacaccagctctttcctgttctccccttcctggccagactctcttctccatcttctttgggttccttcttccagtgctcactcccttaacgtttttgactttgatctaatgctcttctctccacacacatccaccctgctgactgtacgtactctcgtgaacttcatgccaacaacacctatagtaggctaaataatggcctccaaatatatccaggttctaaattttagaacctgtgactgctaccttctttggcaaaagggatcttatgatgcaaagattatcgtgggtcatctgtgtgggcccaatgtaaccacaagtgtccttataaaaggaagcatggggacagagaagaaagcaatgtgatcacagaaacaagatgctacactggtggctttgaagatgaaggaagggccaccagccaagaaatgtcagtggcccctgcaggtaaaggcaaggaaaagattctcccctagagcctccaggagggacctccctgctgacatcttggctttagctcagttagactgatattagacctctaactgctaaaactagaagagactatatttttattaagtcactgctgctgctgctgctaagtcgcttcagtcgtgtctgactctgtgtgaccccacagatggcagcccaccaggctcccctgtccctgggattctccaggcaagaacactggagtgggttgccatttccttctccaatgcaggaaagtgaaaagtgaaagtgaagttgctcagttgtgtccgactcttagcgaccccatggactgcagcccaccaggctccccaagttttgtgataatacaatgctcaaatctatatgtctactatcagaactctcctctgaccaccagtcatagcaatccgcctcctatcttcaatttagcatgacccaaacagaattcatcactacctccctccaccttctgtgtttccctgattcatttaatggaaccaccattccttgaatcacacagatcagaacccatgggtctttctggcctcctcccacccacaaccaataaccataagaccctgcataatttgctgtccaaatctttttcaagtacgcctcctcttctctatccctatatctctctgcctgtggattgatccccttcctccaaaacccaccctccacaccaaagccaagaggaagatgaaccttctacaaggcgaacatgccagagctccttcttttaacaatcgcccagagtcaagtctcggctccttgacagacgatataagaatctcccaatttccagccacattttctgttattccctgccttgaactctagtgacactgagctgtttgccatttccccacctgtactaggtactcatgtgtcttcatggtcacaatccagcagcttggtctttctgcgaaggctgcctgttagctaactataatagctgtggccggagggtcaggcttctaattaacagcatctagggg

SEQ ID NO: 25289 - DNA, 3156 bp, Bovine  19866880689070
aaatggtggcgatggtagaactgctgtatatttactaaaaataattgcactgtacacttataatggatgtatctttacggagtatcaattagatactaataaagctgttattacaaataaaaactttaaaaaatagcatgagcacattgtcttaaaactctcatttatgaacacttagtaaatttgcagacaatttttaacatgattgaaaatcttccaaatgcatttcagtggatttagacccaatatgttaaacattaaattaaaaaaaaaaaaaacaactttgctaggaaaactgattgatatcagcaaagtcagaaaattactagactagaaaaatactaagctacaacctttgtataattaatggatgaactgaaatttgagtatcataattgagtacatgaaactgattttgcacttcttccatatctctttgtgccatctaatttaagtacaatagtccttatatctaagtatggaaataaactgaccttagactttgaaccctctatgatcaggtattaagccaagattttcaaggtaatacagcattttctatcacataactctcactaaaatttagtacaattatcagcactatatacatttaaattttttttgtatttatggattctctgtatttatgttttacaatttatgtaatgttactacaacattatacttaaagaattcataacagtagtttttaagtatgtgctaaaaaatgcttattaatagaggtatgtgtcagagaatgtttagaaaccttagtttcctgttttggtttgttttggtttggttttttagttttcctttcctgtctaccccacgtagtagaaataagttgttggaagatgacagtcaaatctaaattttcgatgttttgtcttgaagatcacttggatcatttgtctgcaattaatcacatttaagtctataacgtcatcagagatgttgatcattattgtgatccaaatcaagagaggttagtgaagtcttgagtgatattaggactagtattattcttctgacacatgcaaatggtgtgaaagtgaaacatagaaagaaagtaaaggaaattgctttacagaatttgaaatatgaaaaacaattccaccctcgcagaattaatacatttttatgatcaatagaaaatctgatttcaagtatcccaggctttcaatgatctactgtttgaccttggaaatgtcaaatatttttctactgcctctgcctcacaactagaaaatgaggtttaatatacttttgcattctcacaaatgttaattattaactttcaaaattaaaaaaagtaaaatatgtaaacttctgaacttttagtactgaatgtgctactgtactctactagttgaccttaaatacaaggttctttgacactttgagggtttactctcagaaaaggcctcttcctttttactttttaatcaatttttctttttgcatccttcctgttattttttaatattaggtaaaaatatcaatttaaaatgtttatagggaaagaatattaggggaaatttttgcatttatatgaagaattttctttcttgcatttataaattatctgtgctactctcctgcaatattatttgactattgagaaataactttagggacttttgcatttaatctacaatatgtatatgctgtaattattttttatattcttgaaattgagtaaaaacctcttgaccaccatttctgtgttttgaaagttgacggattgtgtttgatacagttggtggaagggtgctgagctcaaagtcaggagatctggttgggggtctagctttcatatgctccctgcttctttacgtcttggataaagcatttaatctccctggctctgtgtttaccgatctgtaaaatctatcagtcagactaaaatcttttccaggcttatgttaattcatgtataaaaagacatactgcatgatctcattctaaattgtggccttgttttctttgaaagaaatttaccaaaaatttttctcactttgctgtagcccttaaatttatttccacaaccctgtttgttttcatttttccataaactgttttaaatagactcctttcttttcccctattcgagatccatctcttcccttggctcccacttctatcttgccttcctttctttccctctaggaccttactcttatcttatcaagggagcagctgtttactaaaaaagacaaaacaaaataaaacatgacaaaggtcccctgctctgtactgaggagttctattccctgagggggaatagaattgagcagttaggtccatgggctctagagccagactgcctgggggtgcatctagtctctgccatgcagcagctatatgatctttgaccttaggtgcctactctgcaacataggaacaaccgtgttaccaaacattattgtgatgactggatatccctggtggttcagacagtaaagaatatgcctgcaatgtgggagaccaggttcgatccctgggtcgggaagatcccttggagaaggaaatgactacccactccagtattcttgctttgagaattccatggacagaggagcctggagggctactccacggggttgcaaacagtcggacacaactgagtgactaacacacacattgtgaggattaaatgaatcaaaatagatgaagcacctaggatagagcctggttaggagaaattgctccttaaatgttgccaattattgcacccaaccctcataaagcgataatcacttcagcacagggtggaagagggatgggtaatactgaggcagggtgagtagaatggtgtgtcctaatagttcttttacaactctttgttccctacttccatccttccaggatgtaaatgttaggcaaaagcgtgatgaagaggaagactgccatgatttgtgggtgacgtacctttcatttaattagcaggaatggctacctgtggcaacattttcttcaagtaaattatctgtttgaaatgtgatttttttgttttctgccataattcagaactggcatgccataattattatactctaagacatcaaagaaaaaagcccaggaattgtcctttgggcaggcctatttatataatactgtatttgagaaaaagcactggaaaaaaaaaaaaaa

SEQ ID NO: 25290 - DNA, 980 bp, Bovine  19866880702276
tctcccgtgttagtttaacttcctgcaaactgatttcctcttctgtctttgacccttttaggcttatgtataaaaaccacctggggacttaacaggccccggtttggttgaattaaagcctaatgttctatgagagcacaagggattgggcactggtggaaaggaacaggtggagagcttggatcttccctctctggctgtaggtttgtaacgaccagtccacactgaagaggtgatttcctactcatggaaaccttcctccctagaggttccagcttctagactcagtctccccaagatgcctacacattatctgacttggtgcccaggcaaaccagcttctgcacagaagacagaaatgcagtttctctcgccctcctcaggtgtggggttggcagtgttatcagtaatctcttttgtctgtcaccaagctgaggagcacttttttttaaaatttttattttattttttaactttacaatattgtattggttttgccatatgtcgaaatgtacgaggagcacttttaaaaaaggatacaggcctggcagaggctgactggaaaaggtagctatcgaagtattttacaaaggatccacagttcttttttttttttaagtatgctatttatatcaattctctggaatatggaaattatttttattgtacttaaccatatgttcatatagattggctgaggcactcaggcctatttttagccaggttgatgttctttctactgtctttctctttttttccttgagaatgatctcacgagctcaactgctttgttcttgcctttctccaaataaccaaatttatttgttggtatcattctttggctcttctaagccaaggttgtttcagtcatctttgctgcagaggacaatggcaggtatacccttcacaaagcatcaaaagctgacacaaggctcagtggctttctggtgggcagcccagccaaaaaagagtcagaattt

SEQ ID NO: 25291 - DNA, 2956 bp, Bovine  19866880710328
ttgctattgggatccctgcaaaatgaaacaagatactgatcctggatcccacctccagagattctggtttaattggctggcagcgtggcttgagccctgtagatgttaatgctcccagctgattctaatgtcagtgaggctggtggaccactcacgtaattagtgagaagtaagagggttcacttcagagtagcattttgatttattaggaaagaataagaatctccaggataaggaccatgaggcaggctcaaaggtgagcagtgagatggcatggctgtgctgggcctgggccagtcacataggatgcttttaaatgatagaagtgaagtgagcttaaagcaatctaattttaaagaatgtggtggtggcgaggggaactgagaaactgcaagaattgggggcatctacatggacagaaattccgtagttttggatacttcagtgcagtcaagaataggcagggaggctggtcccacgttaaaggcaaagggctcgggcagcctaaggggttgttcagtgcagcaactcagctgaaggcctgcaagtccagggaggacagcgtatggatttttcaccagccggagcggttgcagcgttgcaaagcgcgcggcggagctgcacgtggagacgccaactcggcagggctgcagggacaccttttttgaattctggtcccaccgctgaagatccccacttctgtttgggtgagttattttatttctctggcttcactctcttcacttgtgaaaagaggataataatacctgtttgacaggtttctatgtattaaagacaataattgtgaaagcagctaacaggttttttaaatgttttatgttggtgagtgtttaaagtaggaaaaggagatacgatagttgttagaggcagtctggacccatgtctttctgcctcatttccctctctcacctgatattctctccattcttatttaactttctaaattctaaagtatgatggctagagctgacgacctgtttttcttagtaggagattaaaaccatggagttggaggacctaaaaagtgtaaaacttaaaaagcagaattaacaaactcaaaactttattttctgtgcaaaaaagtatcaatgttatgaagcatcagagtgaagcaatgattgctgaaatttaaactctgagagaaagcaatttggtaaagtgtgtgggactttcagttatatttcatgaaatctgagatgcctttggttgtaggatacatcatgttatgtattatgaaggaaaagtgttccttattaaactgtgacaaaatgctttctttgctcatataattttttttcttttttgaaagagccccttaaggttaaacatgtattgttaccatgtgttactcttaggcttgtctaaggagaacagtggaaaagtttgttaacatgttttgcaaatcttgttcatgttcacctaactcttctgaatcacattttagtcactgatgtgtgttttttcccaaacatctatgtcctctgggctttcaagtgaactgatgatatggtctctcataacatcccatatcttcttctaagtcactgccatctctttgcaagctttcttgcctagcatgtgataggtaatctttctgtgtgtatctcagtaactaaacataactcagctttatctacctatagatatcttccttaagtcctataatgctctgcttctcaaactttcatattcatacaagtcacctgggaatcttgtcaaaagccagtgtgaagtaggtctgagataggcctgaggttctgcagttttctcgtggtcccagttgaggccaacacaattggtaccagttgatttgagaagtgaagctataaagcagttgtttcaatgggttgcttctttgcaagaaaatgaggaagtgtgattgttcctccagtaaatacttgtttcgttaatgtcaaatgcatgccctgctgctctgttttcatggccttctgtgtatacaacaatttctcatttcaacaccaaatgatagtctaatctccttgaaattatttaaacagcagtgaaactcaacatgtgtagtgtggtgtagtgccagcaatgcacataattccttggcatgatggtggagtgaagagtgaggaccaagttagtgtgtggacaggcagcgctggacaccaaagaggactgtaagctgtactctgacgtcaaaggtgcaaaaatgtgctgcttcagctcacggaaatatagagaatctgttgtaaatctctgtgctattttaacctctactcttcgcagttattttcacttaagaaaatgctgaagtcagccttaagaagtatgagagataacagtaataaccctagtgcattttctcagcatctttgttttttaacctttccagttccagttcagtcgctcagtcatgtccaactctttgcaagcccatgaatcgcagcacgccagggcctccccgtccatcaccaactccagttcaaccaaactcatgtgcatcaagtaggtgatgccatccagccatctcatcctctgtcatccccttctcctcctgcccctattccttctcagcatcagggtcttttccaatgagtcaactcttcacatgaagtggccaaagtattggagtttcagctttagcatcagtccttccaatgaacacccagaactgatcaccttcagaatggactggttggatctccttgcagtccaagggactctcaagagtcttctccaacaccacagttcaaaagcatcagttctttggcgctcagccttcttcacagtccaactctcactttaggtttcccctaagtgaatggtacacaaggatgaaagttgttgagtgtgtgagcattggtgatttgtgtgttttattttagtatttatgtattatttggctgcatgaggtctgagttatggcatgtgggatcttcaatatttgttgcagtcatgtgagatc

SEQ ID NO: 25292 - DNA, 1055 bp, Bovine  19866880734364
tagacttgcaaatgacaagaagggtaaactgggagattaactggggtacctgaattttattggtctggttattctcttgctatacttacctttggaaacagaaatcttgtccagttgtaggtatttgcttatatttggcttcataaatcatacaacagtacatgtgcaaagtcattcaatgataatttccacaaattagtcttaagtcaaaagtgagtaaaatagtttcaaaacacaaacttttttctattgaaatttataggaatagtcccaggattcaaaaaggctgaatgtgtactaattttctttacattagttcactgcttctcaggtctcattgcctgagaaccttgagactacagtgttttattatacaaatctctttggacatacattatattttgtgtttttttaaataaaaattttaatacagaaaaatatacacatatatctaaaagtctgtcattattcaacttcagcaattatcaacttactagtcaaatttttttcatctatacccttatctagtctctcatgcctatgcaaatacccatatatcatatcatttcatctatattttagtatttatctctaaaattaaaaagaataaatcatttataaagcctttataaaagcataaccatactatgatcatacctaaaaacttgaacagtgtttccataatagcatctacttactaatcaatattgaaatatatctgttttttttttatatattaggtgtattcaaatcagaaactaaaatggctgtttgtttcctctttgatgttaagattactcactgttttcagctactgtcagcctgatccatccattactataacatttcctatcagctcagatcaatttcagtagcaaatgattatcatgaatgagaacccattatttcgttactcattgcaatagggtatattctaatgctatcatttcttttttatttatttggttccatttaaaaatgttatttgggtaatttaaataggtattgcttgagcatctatcatggtgctagcactctgctagatagtataagga

SEQ ID NO: 25293 - DNA, 783 bp, Bovine  19866880748677
cattaacttatatgtctattacagcatctaaggcttttttgaaaataagtaaaattaataaacttaataacctttttggttctttttaatgtatatgtcatacagtgtatgatatatatgttgttttatatgtagttttcatataaattattccacataaagtagcatgctgctgatgctgctaagttgcttcagtcgtgtccgacactgtgcgacccatggactgcagcctgccaggctcctccatccatgggattttccaggcaagagtgctggagtgggttgccatccaccttgtccgataaagcagcatgtgccctcatataagtactatgaaggtcacagttagctgtgctattatatttgtcttattcaaggagaatcatatgtcttttaataatttgccttaagttctaagaaatacaaatttgtcccagattggcatagggggttaaatactctctaaaaattaatttagaacagtcactttaaatattgtttgaggttttaatatacttttatataattaaatgtgaaaattaaatgtttatgttcaaaacagatccacagttaaagtttacaacaaaggaagtaaatgttccattttttttccttctttttctctagctcaactgagaagtcatttccttggagatcaacaggtatgagttttttaatcatataaaaaaatctttcttacgttttgcccaagcaaagtgtgctctctaaatttactgtctcttgatgagatcagtcaagccaaaactttaatagtgacaatat

SEQ ID NO: 25294 - DNA, 684 bp, Bovine  19866880760137
atcattttctgactaaaatttttccgcaggaatatagtcttctgtcttcagagcatggggagatttgtcgtggcagatgttcattttaagaaaacccaattcacactcagcagtacgaaaccttcactgaaaaacatcagggagagatgattcttgcataaatggatcgtttgcaggaatcttaaacgaactaaagttctctgggcaaagacgcgatttacaaaaactcaactgtcatcttgcctggaacatagtcattccataaacagggctgtttatgacattttatgccaggtctgtctctctctctcacacacacagggatgtgtggcttaacaggcctaggggtttcaacgacgactgtcgccccgacacgcttctgtccttagaagggtgacaggtcggagcacacacaggcagttccctgcttctggacactgaccttctcttacctcatacactgatgacccaggccgccctgccaggcccgagctgagcacaggagccagctgcagccacagaagcacttcctgccggctgagacggccccaaagggacggaggggggccagggggctcagcttggcttctgtgcttgtgcttaccggtgcactttatttcctaacatactgggttttcccatctctcagaaaaatggatggaaaatgaactgcggtaagcagca

SEQ ID NO: 25295 - DNA, 1246 bp, Bovine  19866880780836
tgtctaaatgtttaatggctttaacaggaatcatatctgcctaagtagaaaatagggcatgatgtaattatctctgggcttcattagaggagtcactccttacctagagaatttgctttaaaaaccagctacttagtaaagattgatttgactacctagtgagttgttcctaaagccctgttatctttcagtgaattcaaagctcttctagcttttacagttaatctagttcctctcagtcttcaagattttctgtgcctttgaaaagaccacctgaagggaaagagattactgatacaattacaatagaaacaggttaaaacaagacatcagaagcccaaaataagacagcgatcactgggggttaaaagtagatgatgtcctcttaggctcttcatcctctttctaattctccatgccctcaccctacccccaggagccaaccagaatgctagaggcctaaatcttgttgacaaagaattagtaccgaaaatttaaaaaaaaaaaaaaaaactgtcctaatatttatctgggaagctatatttagcgtcccaaaatcaggtgacatgcagagaaactggatcactcatacatcactggtggaaacataaaatgatacagccactctgggaaacgttccctcgtgttcccgtggttaagaattggcttgccgatgcaggggatacgggtctgatccctggttgaggaagatcccacatgccacagagtaattaagaccatgcaccacaattactgcagctagtgaactccaggcctgtgctccgcaacaagagaagcctccagaatgagaagcctgtgcgccgcaatgaagagagcccctctcactacaacgagagaaagcctgcatgcagcaacaaagacccagggcagccaaaaacaaagaaacaaatacgtacatacataaaaaaatttttaattaaaaaaataaaaactaagtatgtaactgccacatgacccagaaattgcactcctggatatttatcccagagaaatgaagacttgcatttcacatgaaaacctatacacaaatgttcatagaagttttatttgcaataacaaagcgtagaaacaacccagacatcctgcagagatagatcatcaaactggtctctccatgccctggaatactaacacagcagttaaatggaataaactattgcacacaacttggatgagtctccaggggattatgctgaagaaaaaaaagctattctaaaaggttaca

SEQ ID NO: 25296 - DNA, 2094 bp, Bovine  19866880788332
ataacttctactaacccacccacacatacacaaaataggccaagagcagagttccttcaagaaattacactggaagctcgtccctcgttgaaactctgctacaaaataacttggcctgagaaaagaagtcagacacagaagagtacctgctatgtggtgcattttactatgtacaaacaaagtcaaaactaatatatggggcagtaaggcagggtagtgattatccttaggggcagccagtttgactagtgctacaggtctgtctgtaaatattcaccaacctatatgttgataatatgtgcacttttctgcatgtatactctactttgaagaaaaaatttttaaatattaataaatattattataattaaaattataataacttggcctgcaaagcttgtagttcatggtcacacagagcagggttttgtgggtttttttaatcttccagaagtagccaagcagcatgaaagcttaaagaccaagtagaaaaccatctatacagatcatttagcgtctttagtgggaaagttgctgtttctatatgaggtttcttttcatcttcacagtgccactgcaaatgttgccaaaatacagacgatggatgccctgaatgacacgctggagaaggtgagccatgggtgaggcagatcacatgatactcctagccagttttcacctagctgatcatgctacatgggtgaatgagctgatgactggaatttttttccatctcagaggtttgatgtccctgtgaaagaatctgctttcagttcaaggaacacagagccgttttgatgggaagagctgatgctcccgaattcctagcatctatttaagaaatcatttcaaaaataagataggaaattaatcagaaatcatgatgccaaattggcagaactttacgttgccatccatttatttcctggagaccttggcatgttgctcaaataaggcaaactgtgtgctaggaattcagccctttttgaccttcctccccaccactgctttcccatatggaaatgtttgatctgaggccaggatgggtggagggttgcccaatttaagactggaggaaggctgggcactggctggctttatctaatagagtctatttataaaggtggtcgaccattactatttttatttctgtgtcttgaattctttcttagtagctcaggaaactcagaaagttcttcctgaatagacagtggtttaattttgggttcaatagtttgtttttaaatgttgtaagtgatccgagtgaggatctttattctactcctagggagggggcagatacactgaattcaggcattgaagaaccaccacttctgttaccccaacatatattgaaggtacaggactgggtgtcctttgtagaaggaagacttgctgttattgccaacatcaggggtctgaaatattaatagattagaatggaaattgtgcagctaaacttctgggacctctctttggtactggcttctcctcttactgtctttaaagccttgagcaagttattgatcttgcacctctgatttgccatttgtaagatgaggataaggaagaaatggttgttgtgtggaatcaatgagattcacacacaggaatctcttagaacagtgcctgacacatggaaacctgtctgcactctctgctctgattagtagcatccattttatgacagtgcaatggaaagttatgtctgaagcccctgaggcaggcagtagtaccagatgagatcttgacaatagaccatagctacagagccttctcacatggtggggtgtggttctcccatcaggtagatcagcgggcaggtcataaatgactgtttgccttcctgactttagaagaagggaaggggtggatggtgatctgcctcttgcattctctggctcctgctgtccaaacacctcatcctcaggggcaaaagatatccacagtaagtggaactgagtggaatagatacattcctctaaaatatgttaacccaaaataaagtgtttaaaaagagtggtcagtaaaggtcaattatgctgtactttaggtatgatgctggagtcttcactgttttttaatagacacatg

SEQ ID NO: 25297 - DNA, 1443 bp, Bovine  19866880845013
caatatggaaaatttttgctctgctgttttcagttaaaccagtatttgttgcacacacaaaataaaattcatttttacatgcttgaactcacagtcacagaaatttagaaaatatttgtctaaaatactgagttcagcttttcatatcctttgtagtttttttttttttttttacagacaatcttgaactacacttttatgttgaacctgttttgaaaatttggaaaatctctcagttaaatttagtattcttcaaaagaaaacaaatatattttcagaggtattgaaaagtccttaaactattggtaaaattttggcaggtgttgaaatttaagttatatgtatataaggctatttcaagtattacatgtggtgagatatgaagttattgaaagtcattgagtcaactctaaaaatagtaaaattctttttcaattgtttttcttttaaacctaggaaatgcttatagctgagcaaaaagtgttttctggaggctatagaattacttggagaatgcagtattaaaaactttaaaatgctttttgggaaggaacatttaccttgtccccactaggccaccagtgcaaaggaacactgagtttctcttgaccttgagtcaggcccatgggagcaaaaatcaatattaaaccgtaaggtggagagggccagatgaggacatctattttttctttccctgctcttatgttagaaccttgatctaaaacaagcaaatgaggtgttatctttattttgaagctctctagagataggtctgcagcctgttgcctcacgtctaagtgacctttgctatcagaaatctatcatgtcactatcattaatgtttcttaatttaagaataattactgaactcttaatatttaagagtattggtatcaaacctggacctaatagtttagagagattataagagcagaattccgtagtggctcagatgataaagagtctgcccacaacagaggaggcccaggttcaatccctgggtcgggaagatccccgggagaaggaaatggtaacccactccagtgttcttgcctggaaaattccatggacagaggagcctagtgggctacagtccatgggatcacaggagtcgggagatcacaagagactgagtgactacactttcactttttctttcaagaccaggataggaaattaatatcttttctgtacagcagaactgacaatgaataggaaaagaggcccattttataatagaaacaggaactttaaatatcaacctaagaggaaatgtacaggttttatattgaagaaaatactaaagctttgttgggggacttaaaagaagatctgaataaatggcaagaaatactgtattccctaatgggtagatttcttactattactgatattgctactactgctattatttggctgcactgcatggcatgtgggatctta

SEQ ID NO: 25298 - DNA, 3761 bp, Bovine  19866880900800
tatttttaatatttgaaaatgatataaaccatttggagtcatgattggtagttaagttgaatttggactaaaacactaagttttagtagtagtattctgtatacagcattcttggtgacatgtaaattagctctcaactgattcccaaactgcttttatcaatgacagcactcctggaacaagccttccaaggtcctctaaggacagtatttaatttggatacttaaggtatggttggctatggcttttattatagtcattactttagagctatacattgtatatatgaatagctaaagttgtattcagacttgtaaatataactatttcaagtaatctggaagtcatgtatttgcatgtgctttttaagcttcacccatgctgtttattgcactgagcgatatatagggcatgttaacagtatccaagtaacggcactttatctcatttatatgaacacctctgaggtgctacaagtccaaactgatgtattattcatttgtaaagataaggtacaggaatgatccttgagttaaaggtatttttatatgaaaatgatatgctattggaggatgttaaaatgctagttttcagagaggtgggagtgctttgttttatatgttgggatgtgaaattattttctagaattggagagaaggaagttctatatttacagaatgttttaaaaatgaagagttgtaatgaagtcctgtaagcaccattgtggtcttgtacgaacaggaatcttctggcgtcattcttcagcattggttcctgtgtgcagtgtactctgtatagtttcattgtgtttttttaagaggctcttcatgaggttctgctatacctactatggcttatttattgttttctttaatgttgtggaagtcttactcttgcattatgtagttttgtttctgcacaactactgtacttgtccgtctggaataaagacaatagtttgttttgcattaaatgaaacagtggctcagtagagaagatcttgatgtcagctatctgtctcactttaatcctgggtgatcgtgtccctaaaaaaaggcgaatagcctgattttcagtaatactacaaatgcatgtttacttttatttcattttagaacaaggataatggcatctagaaatcccaatatttcaaggtcaaaattagtctttttgcctgaaatgagcatgcatgaggagccttctaaacatctgttccagaaatcctggcgtctgtttttattggcaacacggtatcttcagtttttagctctcactttggcgatacactgaacaccgtgctaatgtgaaattttgttcttcacatgtgtactgatctctgagttaaacgtgtttatacccacatatttcagtttcaaagtcttatgaatgagtgtgaacattaaactgttgtgttaaaatatcctgacttggaatcttaagcctaaacaacttcaggttattgtatggttactgctattattagcaaggcttaagggaaagtattttcagtccttatttaaagtcatatatttaaactcaaggtcaaaaaacaaaactgggtaggaggggaaactctagtagcagataaatgcttattggatgacttttcctgtgatgctgccagtatgactattagaatttactgtgatggattctgagtaaatgtatttggtccagtagttccaggaagtgctgtctccttgggaagctgttggtgggagctgaggcccaaggagcgagtcctgcagggacaatggcccctagtgcggtgtggagggccaggcggtatcctttcctatggatggttttagatttgattttttgtttgcctgtgctttgtggggaggagtagttagctttggtttgtttgtagagaaaaacagaacacttcactttggtaaactggcatcttagttttcagtcacttaactagaaactatcctagtgaaatgtaggaaaagaaaatcaccttctttaaaacatttaaaaaataacatcttttattgtgttttctgtcagtgacttcaataatttttagtaatttttatgtgaaaaccagctagcccttttgaaaaataagtattattttatcaaaacacaagatatctggtccaatggtgagagcactaccgattttaacaagtcttttgatggaatatatccttatattgctttttatttgtgttttcaaatttcagaacaattacagtgagggtttgggggtaagtacagagtcctggtccctccgtgcccttagagtttatttagttttagcaagctttgcactaatggcttccattctggtgaacaacttgcgagagggagggagaggcagtgtaacctccacttacgggacctgaagtcttctgagcaaatgttggtcagggtgcttgtattagctatcagcctactgtgtacaaatgtatagtcaccttagcttaaactatgatgtgagaactttaagaactctatattctaaaaggaggctagtttgccactttatatgtttcagcaaagtcaacttaatgcatctgtgataatttatgctatctaacttgtacctaggtttggacaatggggaaaaaaatcattactaccttgcaaacttagaagctaaaaaactgctagtaaatatatcaaagtgactttctcaatgtattcgtaaacaaatctataattattttgctaaaaaactctttagaaggattccagagagttatcaaatgaaatgttattaactaggattatgttctagtctagattattctgatctttggttataatggaatatgatctataaccagaataaacttgagcattgcaatttgaagtcaaagtaaaactttctctataggttaagattttattcactattatatgaaaaggtaggtaactaagtttacaaagtttacctttaaatcactcaagtgagatcacagaaaatataaacaacacaatatagagttttatttttgatgtgtctcacttagccatcgatcgatggccattttcagagtcctatttggtgtaagtatcactgaagaaagaacaagatttgtcatgggactggtacgtttctttttgctgatccaattttccattgcttccttttcatatgagtagccatctaaaaaaaagaaaaaagccacatacacaaattatttgcaatgtaggaaaagggaagttaggatcactaaaatggttataaaaattccactgccaaggcctttactatgatttaagtggtattcttgtcttgcaccattgctcccaaaatatttctgcaatgacatcctaaattctaccatgtaagatacactgattgcacaaattaccttgaccagtgtcccaaaaaaactggaaaaggggccttctgttaaaaattcagatgtagcaccaaggaagaaaggaaatgaatcaggtaggagagaggcgagtggtggtaaagctgcaaggtccagctgtgccgccagatctgtgcatcagttactgtggctacagacgggagcaaagagttccagggaagactcggcctaactttccaacatacggaaaagtcagggaaacaagatgccaagaggttatagagcgcaccctaccctactatggacttgatagaaaaggcatttacactgccaaaagaaaaaaaagatccactggctaaggattttaataccatgttcttacaaacttatttgtacctgtaaaggttgggagggtttgcctcactatttttatacttgtagctctttcaaacagaa

SEQ ID NO: 25299 - DNA, 1926 bp, Bovine  19866880912811
ttttgagaaacatgtctttaaaaatctgagtctcctaagctagtatttcatgttgctaaaaaattactacatataagtttgtttaaagaagttttcattttgataatacttggcagaagagaaattttacttttggaagaaaatatgaagaagttacctgcttctggctacaagatccattttcctatattgtgaagagatttgtttcattcaacttggaataccatccccttcataaaaccttcccaggccatgatagtcagaaggtacctttaattccacacctcactttgtactatcaataaaaatcacagtgtaaaacgttgaactctacaaatctcccatggcacctaaaaatgtcccttagatgtaacagacacctagtaagtctccttaaatgaaagaatagcggggttgttatggaggggaaatgaaaatcaattgcaattctctcccacaacagatttgggctaataatgtaagaattcttctgttaccaagtactaatttccaagtttatggacaaagttatttgacttacacacgatgaacagcacattcccatggcaggatctgctgtgttatcaggctttcagaagtaccagctgcaggtaggttttattttgggattttaaatacacacacagaagggataagtacaacaacagagaagccaaaacctgaaatcaatacattctgcctcaaaccaggaaaggctcagatagggaaataaccaagtccagctgctgctgctgctgctgctaagtcgcttcagtcgtgtccgactgtgcgaccccatagacagcagcccaccaggctctgccatccccgggattctccaggcaagaacactggagtgggttgccatttccttctccaatgcatgacagtgaaaagtgaaagtgaagtcactcagtcatgtccaactcttcgtgatcccatggactgcagcctaccaggcccctccatccatgggattttccaggcaagagtactgaagtgggttgctattgccttctctgaaccaagtgcagagtttctggcaattatcattatgcctcccaggtcaatggttctcatacaggatggagcaccagccttgcagaaagcccctgctcatctagaagcttcacccaggtgctccccaaccaggcacctgcctcccaacctaacagcatgctacctaactagagaacaaaataactgtgacattattaccatcaccaccaccatccagatggccatagatatttattagagaaagaaaaggcatttcacaagctcacttaaaaaatctatttcaaaagcttcctcttagaagccttcctgctcttattttaattgcttgtccacctgcctcctccactaggctgtgggcctctgaatggtcagaccctgccaagcttcaccagcacagttttctcatttcaatatcaatggatatatcagagaggaacacaatctgaatccatctctaattctcaaagggaaaaactgtacctcaaaacacattgccagcctatttaagtaaatgtaacctccttgtttaaaatgcaagaccctgagcatcagaggaacttgtcctgactctcctaagacaaggttacaacccgattttccaattacagaataagcactgggctaggtgtttcattctgcacacattcctgagtctccactctgtgccaatcaaagaggggcacaaagtataatatgttggaggaggaagacaacatcatcaacaaacatgggcaggaagccacaagtccaggcctcccttttctctgtaaagtgaaactgaagtctgagaggagcagagatggttcagagtagcccctgtagagaagaggaaggcaagcacaagattaaaagggcagctcaacagttctgattgcccaaccaagagcaagacacaatgaaagtgtg

SEQ ID NO: 25300 - DNA, 3112 bp, Bovine  19866880922531
caaagctcacttttggtctcagctacatggtttccatagccctggagacaacttgggggttgttgaatcacaggactcccttggagacttctttccattgcaccctactgtcggtccctgcctgagttccgagggctgctgtaggaaagtgccacgaacttggtggcttaaacaacagagattaatcagctcacaattcttgtggtcagaagtccaacgtcaagctgtcagtaggactaggctctgtctccctgatgataagagggagtgactggctccaggtcgctctcctggctgctggtggcctaggacgctcttggcttgtcggtgaccttcttttccctgtgtctttacattcggttccatctgtgtgtctctctctgcgtccaaatttctccttttaataaggaggttgctcagtggtaaagaatctgcctgccaatgcaggagacccaaaagacgtgggtttgatctctgcattggaaaagatccctgcagaagttaatgggagcccactccagtattcctgtctggaaaattccatggactgaggagcctggtgggccacagtccatggggtcacaaagagttggacatgactgagcacacacacacattggataacagcccaccctaatgacctcatgttaacttgatttttggtagagaccctgttttcaaagaagaccatattcacaggtactttgggctggactgtctacatattttggtggggacataattcaacctattacagccccagcctttatacctctacactctgcttttagtgcaggacaagaagagcccatcaagaaactgacctgaggctcaggtctctggatgaccctcaccaagtccaaccaggatgctcaccatgccaagcaccctggggtatgccttcttttgtcttaatgcacagacctgtttccctttcagcctcccaaaaggggctgcctttttctaacttgtacaagttgctctacaagctagctgaagtaccatgaagtcaacttgttatttattcacagacatttgctatactgaacatagattttttccccgcaattctgttctgtgcttatatccatgcatacactacattatctcttttatttatttatgtttttaaaaaggacttaatctttcttttagcagaaacagcatcaccgtcatagtttattttctgtaaaatttcaaggttcagaggaaggatgcaaagcaagtttatgctatgtctcagatgaattaggatccagataagtgacttagccaggcttcctgccttccctttcttactggtttcacaagcgcctcagaggctcagcatatgaaaatctagaaggaacaatgattgccctattttctcacagcatccaactgtgaggcgaagattgagacctggacttgcttattatttgagaaatttcaaacataattcaccagtagtttgtaattaagacagaaaattccatctacccgcaatagggcacgtcctttcccaagagcatgactgagtgctgaacacatttgaatcaccttaaaatctcgtcattgtccattaaattcatgggacaacagtagcccaggctcagctctctaattctagagtttggcaagcagggacagtattttggttgctcactggggatgggaacgccagctttggggagaccagcataaacagcttctgcctctgcatttaatgctgactctgtgctctgtcttcccatagattcatctgcctggacatctttgccaaaccattaggataaatctgaatgggactggagagtgtttcgtatccatgacctctccagagagctcaaaggcacaggactcagagataaccacctgctgatttagcaaggccagtagctaacgcataaatcccagcttgtgcattgtcctgaggagctggacagagtctaaaaaaattgctcaaggtgagccataaaaaagccaaggtgtatcagagtctactgtggggatagatttagtgatagataaattttttgtcagtatgtactgtttttcaaaataaagtcagaatatacccctctaatatttctaggttaaacagaagatttttgtattacctgtttcttctttatctatagtgatggcttagagcctgtttcgtgtttattaacttacatgttcttacaaatattgggatagaataatcccatgtgttaaaatcagagacccaagagctccaaggcagatgagagtccacaagagcaaagtaaacttgaatactcaagaagtgtatgcaaatgacccaaagcaggggtgacccggggctccactgtgtgactgtcttgcctcctaaagtaggggcgtggaaagccctctcagggtagtgctggccttgcactgtcgtcagccgctgctcaagggtccagtggtggcttccaccgtcacacctcttctgccctgtgatttcggatcttacccaggtacctagcttcaagcatggttctccagccttcctggcaatgttggatgagccactcccaatcctaatcaattcattttctgcctaaaccaggcagttagtttctgcactcacagttaagagccctaactgattcgggcactccggtggagaagccagaacttgacccaggcagttggaccccagaacccatacccttaagctccacaggcaccacttctactgaagatagtcactgtgctgggctccagactgtgtgtgcccatatggattattgcccaaaataggacatttttgagaatgaaaagggctaatatttatactcatgccaggactgtcctcagcaaatgaaatggtcatatgccctactaatgaattatgctttttccttatgctatagaagtgaatccatcttctggaaattatacgcatggtgtaaggcccagagctgggcttccctggtgggctcagtggtaaagaatccacctgccaatgcaggagatgcaggtgcaatccctgggtcaggaagatcccctgggaaaggaaatggcagcccactccactattcttgcctggaaaatcccatgaacagaggagcctgggggctacagtccatggggtctcaaagagtcagacaggacttagcaactg

SEQ ID NO: 25301 - DNA, 1357 bp, Bovine  19866880958480
ggaggcaggtgaggatgtctacctaccttctagcaaagtaggatgagaagcacatagacatggcccatgctcagaatattttctagggaagatattttgccatcagtcttcttctgaaagcatcaatgcgtgcaaaaccaccagtggcgggtctgggggctgctgctctcttgtggatccagtgaataagtgaccattcttaattgtaagacacttcagtacaagcaagatgattccttaatgagaaaaagaagatgtgaagtgttttccttcagtgcaaaaatgtcccacaggatacccaagggtagatatgttgttatgaaacgtttggctccagctggataaaaaagctggacctttgtgaagctgggcttctcagcatcctgagcttcttgatgagcagggctcactgagcttaaaattttcctgacagctgatcaccataaaaggaattataaatttcatgggctgggcactcttattcaaacacatttagagatgcagatatttttggaaatcatcagaaatcaaaacatgccataaaacatctatttactgaagagctatacattaaggataatagatgggtgtgtcacaagcgactgaactgagatcataaaacagcaaacgcaacttttgcattagtctcaaaggcctaagcaggtcattgagacccaccatctcaatggggaaactgcacaacccctgtaccacgctgggctcccagcgatctccggggttgacagcactgatcatcacagtggccagtctgcaggccaccatccagggacctggagttggctgccctccagttctcagcacctctaagagctgactttagtgctggccgcgtctaattattgacctttgttcttccagaaaggacttcctagagacactgacagtctgatcctctctttcttctcctctctccctcctcctctcacctgtcccttcagtcggcagcacctcgtcctcaccagcactgttaggagtcagagaccctcgctctgaatacgataggacccagccacctatgcagtattacagtagccaaggggatgccacacacagaggcctgtaccctggtaagatgccagtcgggtgtgtgatagagtatctcgaaaagccgcgtgtccccaggcgcttgaacggcagcctgggaggtaacctctgcctgccttgagatggtcccccagcagcaaaccatgctccactgtctccatctccttcctgcttcgggggctgttgcctttcccacttgttttaagtaaaacaagcagaggcagtggtctgctgaccgcaaataaaaagagcactgtatccgagtgagaacgcatttcccgctcccgtgcag

SEQ ID NO: 25302 - DNA, 3394 bp, Bovine  19866880965822
ttgtgattgcatgctgctaaagctgaaactccagtactttggcccctcatgcgaagagctgactcattggaaaagactctgatgctgggagggattgagggcaggaggagaaggggacgacagaggatgagatggctggatggcattgctgactcgatggacgtgagtctgagtgaactccgggagttggtgatggacagggaggcctggcgtgctgcgattcatggggtcgcaaagagtcggacacgactgagcgactgaactgaactgaactgaactaaaaaaataaataatacctgtttctccttcattaaactcatgttttagaaaaaaaaataggcataataagagagagaacatgatttagttatttgtcgataacttgctgtaaggaggaaggaagaaaagcaaggtcatgaatgagctatttgaatctcattgaaagagatactgataaacttccgtagagctctcttcatcatagagttgttaggatagggatttattcacaagccactaggaagaggcttttaagtaaatgagactatcattctttccatagttagttagctagtgttagttgctcagtcgtctctctttgcgaccccatggactgcagcctgctaggcttctctgtccatggcatttttcaggcaaggatactgggagtggttgccatttccctctctaggggatcttcctgacccagggattgaacctgggtctgctgcagattctttaccgactgagctaccagggaagcccatcgttctttccatagaaatatctaatattttaggcattcttaaaaagtgttttataatcattaattatggaaatcatatcattcattgactttttctacagcgttgaagaaaatatttattttttaaaataaggaacataagatttaaagaaaataaaaagttgctcgtgatgtcaacaaattaaaataggtttaattttttctattccttcccatatttgagtccatgtttcatttcaccttaatttttgaacaaggtttgaatcctagagtaatatttttttccccctctgtggatatccaattgctctagcactattttttgcaaacattatctccccgctactgagttgctttcgcacctttgtcaaaaaatcagttgagcatatttgtgtgactctaattctggggtcttttctgttccactgatctttgtgtctgtccttccaccaacaacagcacagtcttgattatggtagctatacaataaatcttggaattgggtagactaatcccttctacccttcactaattagttctgggagaattattgtagctattttaatttctttgcctgtcaatataaattttaaacagcattgtctacatctaccaagaaaatctttgataagtaattttgctgggcataggattctgagttgtcagttcttttctttcatcattaaaaattattattccacctctgtctgaagtccatggtttctggtgagaaatccagtgccatttgaatgcatttgttcttagtgatttcaagagttgttttcctttgtctttagttttcagaaacttgactgtcatgtggtatggatttcttttggttgatctcgtttgggtagcttagctacttgaatacagatttccatcctttgtcagagttgggacgttttcagtcattatttcttttagtactttttcagcaatgcccttccccccctccccctttctgttactctaagaacataaatattagatctttcattataatcccactggtctttgagactattactttttttcagtctgttttaaacctacttttcaaattgggtaattactattgttctgtcttctaggtcactaactctttccccctctgcccactccattctgctgttaagtagtatccactgagctttgtatttctataattgcctttttcagttgtacagcttgcatttaatttttctatacatcttctatttctttgctaagacttcttattattttgctttagaatttctgttttttgtttgtgccaagcatctttgtacttgcctttgaaacatcactgctgaagtagacactgtcagaaaactcttcatctctggtgtcctgatactgacatctaccgacagatttctttctttcagtgagagattttcaaatgatgactagacatttttgtattatttgatgagacttggggtatgttttaaacttctatttgagctggctttctcggatatcactccagcaggggaagcagggaactccctctaactgctggaactccaggttttccacttggcctccactaatacccgaggagagggggtcaccatcgtcactactgctgggcagggtggatgttccagcttcctatgtggtctctactgacatggtcagggtgactttaacaatgaacaatggtgaaatttcccacatttcactagacctctcctgactccaccccggaagaaaaggggaccttgttacagaccagcagggatgaaatttctgtttggttttctctgacactaccctggcagaagtgtgtgggttcttcattatagtctggcaatgggggaagtctgggttcccctcttggcctttattgccaaggctggggatgggggtcacagttttttcgtatggtatctggttggagtagagccattattgtctaacgtttttctgtcttgctaatctgcccctttcctggttctttggctagagagagcttttgttgggctttttttttttttggtctgcagccaatagtgctggcttctttagctccaagtcctgaatagataagtcaaaggaaaacccagggaagtgacttctgtgtggttcttgagtcccaaagttcttagacagtctgccttcttttctttcaggatcttcttatgctttttctgtagagggtatctagtgtttttagttgtatttagtaggaggaattgggggaaagatgtctactctgtcttttaagtgtacattgtccctgggtgagatttaaagtttattgcagtccagttccttctttgaaatctcacaggaagaagaaataagttatatgatgcaaattaaaaaaaaaaaaacacaacaccttaaaaacacttagctttactgtttctaagtaacatggtctcatgacttcctcccaacccccaactattagttatttgtcctttttaattccttcaaacccagtctgaagtggagaagctttggttttgtatcagtttaactgcctccacagaatctgttatgctgatctttcagaaactggttatgtttgtaaccaggaaggatgtcaatactagagactacaccataggttagttctctctttacttttttatattttcaaagtcgtaaaag

SEQ ID NO: 25303 - DNA, 693 bp, Bovine  19866880981229
cttcccgtttgacagggtaatatcaagtctcttccaccctctaggtgctatcattgcaaagggcgagctttatttcttgttcacagggccactgtaatcacagcagctgataaaccatcaccacagatgaaaaaggaactcctctaaggagtctatggcatgggctgatgataagtcttgagtatgaaaggagaagcgatcctgaagacatgtcaggaagtccattttttcccaaaaagtgttaacaggcactcaatcaatcagtgccagctgaatgaagcctggtattataaatctaaagaaattaaattttttaaattgcactgcatctggcctcaaagcgaaaaaggtcagacaacttcaaagatgccctgtgaaaggcagctattcattacaccaagatttcttgcttatggcgctgacagacggatctttcacttaaagcttcagaatataagatgtcaaaatccctcctccgcttctgtcagagcttgctatgatgctctgaacaaggttataacctccccaggacttaatttcattaggttagggattctcaatacccgtgtagtttgcttttttttttttttcagactcccccaggtgattctgatgtacagccagcaacacgcatttaggactaattatatttcaggccctgctctaagcactttatatatatagtcatttaat

SEQ ID NO: 25304 - DNA, 1286 bp, Bovine  19866880983758
agtccccatgaagacatgccactccacttgaatagctccaccccaaaggcccccagtgtcctaaaaaagcccaccctaatgccccatgccttagagtcccgaaagaaaagcccctcccagtcccctcacgactatctcaaacttttaccaccattctccttgaccccactctagctttcctcccacttcacccagaaacccgaagccagcagactaactgcactaacactccaaattcctgccccggttctccatccaccgatgtatgcacacgcacttccccggcctttccccttcactcctatttccactggcctctcctacacacgcactcctgcactccacctacctcacacttacccactttgttcccctctacagcacactgttgaccttccacaggtcagctcctgtcccctacactcaaccccacttcaactggctactcccttgacctgtgtgcatgctcagtcgctaagttacatctgactgttttcaaccccatggactgtagcctgccaggttcctctgtccttgggatttcccaagcaagagtactggattgggttgccatttccttcttcaggggatctttccaacccagggaacccgctgtctcctgtactggcaggtgggctctttaccactagccaccaggaaagccctgactattccacacacacacgcctcaccaaacttcactttgccatttcttctttgtctctccctaacacagaggctacacggtccactgcaaaccctaagtgcctggcacacaggggttgcagtaactgctgaagaaaccaaaggatataggcaacaaatcctgcttttgctcttaagtgttttattgaatgttttattagaaacatcaccaattaagatctgtcaacagtcacttacatatgatgccatatattttctttctctctaaactgagaagcgccccctccccccgcctgcccagaacaaatattcctttgatgaaagaaagaccagaaacaaaacactacttccttctcaaccaaaacagaaaacccaaaatagcaagacagtttattaaaagtatccagttgacgctggcttaggtaggagtaagtgcagttgtccaagcttaagaagagaaagggaagtttattctcgaaagtttattctcgaccgctatttgggggaggcgatgagactcaagtactaaacacgagagttgcctgaaataataagcctcggctctattacagcgcaagggaggaaaaggaagcaggaactccagtggaaatttccttcgt

SEQ ID NO: 25305 - DNA, 1386 bp, Bovine  19866880984302
gactatacagtccaaggagttctccaagccagaatactggagtgggtagcctttcccttctccaggggatctttcccaacccagggatcgaacccaggtctcccacactgcaggcagattctttaccagctgagccacaggggaagccctaataacattattagaattacaaaattatgtcgtatatatttttaataaaattacaaaaattactataagagatggagaaattatcttttagaaaactcaagacacctcttagttagtaatattttcagtggaacagttccaaccattactccctgtgcctttcagtctcttcactgatctattgtcaaggaaccccagttattagtggtgtggccttgggcaggcaacaattactctgtgatgcagaacctttttctgcattaagttcattcactacagcacctactctgtgccagacactgttctgggctgggggatacatttgtgaacaaaagacaagattgtgttctcaaggagcttattaggtaatacttagatggcccctggcccagaagataacagtacatcatgttagccatcattagctctcaaaattaagtgtcaccttagtaatcattatcttagtcctattttcacattaaaataaaatcctatttgctttattttacctatgcccaaatgcttcttagcaagagaaaaagggcagaaagggggacagttaaatgattcatcagaatctggcaccaccgagcatataaactctacatttcctgggaaagaactgttgtaaagtgctacagataccaccagctactggggatacaacagactgctgccaggaacaagattctgcaaacaacttttgatagatagcatcccactgcgatttggctcctcccaggactttgcaatgatgctgatgaaggtctatttacacctggaggttacagctgacgtgctgctgcacctctgacaagctgcaaattttaactacagagaaatttaatccctaatgatgccagctttcaagctgcccttacaaagcctgccatgagaacatctctttatttgttcagaattattacataatcacaggccatgctcaccacagtcaccatacacagaaagcagcctgtctttcagcacagaatcgaaaaccaccggcaggagaataaaagaattctgctcaatccaaagtaaatacgtgaagtaaaatgataacaggaactctccggagagcagttcccttataaacagcttagatcacttcacaaacacctcgctaaatccaaatatctgaagtaggcccccatctccatctggtgtcacaaatgtcatcggccaccactgaaggcaggatacgccttagagggtttagggtacaacctcaaaaga

SEQ ID NO: 25306 - DNA, 788 bp, Bovine  19866880988468
tccaatttcaggtattaacagactagtgatttgttaacaagatggctactggttgcctgtcattttcttccctactacttatcatgaaatgtccagggggaattcacatgaggtaatgtagtgcttggatataatttataagaacccagattcttcctctcaaaattcaggtgcatgttaaaagatattactctccaattctttaaccaagtgctttgacatgatgtttgggtttgtactatgtcagcatgttaataaaatttattttcattattctacttcttataataaacacataaagctgttttaattggtgagatcaacatggtgaagttttggaagtttaatgccatgtcgaagtatatactgtcacagcataaacatggcttgtattcaaaaaagtttttctgtcttcatatcagtggcctggaagaagtttctcagtcccgacagacacatatttaaaagtagaaccgccagcttctcttagggggagggcattttcttcttaagtagagatgatgatgataatagtaatattagcctttactatgagaatttactaagtgtaagggagtgtaaaaactttacataggttaatttaatgtttcaacaactattactatcttcattctacaaatgagaaactgaggcagagagaggttaacaatcttgccaagatgacacagtaagtagtggagccatgatgagaatccagccatctccccctcgcactgaaggagtctctgtatcccaacgaaacattcattatgagacacatccaccat

SEQ ID NO: 25307 - DNA, 1213 bp, Bovine  19866881016569
ctcctctggttattataccacaactcacccctggactgattagtggcctgtgacttcaggttcccagtgtgtgccgtcagccgggatccactgaggctttccccccaacccctgagggtcagctgtcccttcctctgaatctttcagatgtatacaggtcatagggggacatcaggagctggcaggaaaagcatgggctttggagtcaggacataatttccataggcctcagtattctattctctaaaatgggctaataatagtgtcagcctcataggcttgcagtaaagactaactgagatgagaatgtcaataaaatgcttcgtattttgcctggcatatagatgatgttcaataaaattaatctacttgtcacttctggttacaattacataatatgtttgtcagcctgtctgcctcactagactgtgagctcctcagggtaacagtaatgtcttagctatgccatctctgtaactctcactctctgtggctccagactctagaacagtggtagtatataataggaacccagggtatttgttatctatttccataataatgctacatagtgaaccaaaattaaaacagtcattatttagctcatgattcagcagttagtctgtttaagccaggcttagccgtgtggttcttctgctttgggctgggctcagctgcaggtcatgtaagctttgatctgaggatgggggagggttggggagagtaggggagggtggtggccatgtccctcatcaagtagtagctgagtctgggcctctgcccatggcatctggcagggtcctcgagtgaaagactcttggggatctgactgaaaacttccattgtcacttccaccgcattctgttggccaaagcaagtcacaaggtcagctcaggttcaaaggatagcaaaatagattccattattccatcccttaatgagaagagtggcaaagtcacattttaaagggcatgggttcagagaagagtggagacttaccactgtttttgcaatttgccacacccagtttttcaaatgaatgaggttagttaggaagagaagaatgaaccaaaaaggcaataagaagaaaggtccagtttaagtcatgggcaaggacatttaaattctaggttgctcaatacaagcaagatgaaaattgacctctcaaaccattaagtagttgggcgctctctaaggtacagtaaagagaata

SEQ ID NO: 25308 - DNA, 4269 bp, Bovine  19866881025534
ctaaatattaaacagtaaaaaaaaaaaaaaaagactggggctactttgaatacattatttggaactaaaacacagattgatcaagtccccaggccctgtgcaatttcaattagctatctgccaggagccacagacagcataatatagctgtaccaaggaaatgctatctgcctctgtgaccaaaaatcactctagtatcgatatgtatgattcctcaaagctctcttgattctgctgatattatagccaaggttaatcacacttctctgaatgtcttcaactgcagaggctatagcacccatgcagcactgtacaagattccccaaaaccactgtgctgatggtgcctggcacagttaaccacaccaagatattcatgaacaaatgtcctagattggcagaaactactgaatccttgccagttcttgtggtaaactaagcatccaggttttccaattatacattttttttctttatggattaaggaagtatataacatgaggatcattatttcccaagaagaaatttgcagcatctttcattaccaaaaaataaaaatacccctgagatgatgtcagaaggataaacagaagtaaatactaataacactgtgggcttcccagttggctcaatgataaagaatttgcctaccagggcaggagccacaggagacataggtttgatccctgggttgggaagatcctctggaggaggaaatggcaacccactccagtattcttgcctgggaaatcccatggacagaagaacttggtgagctacagttcatggggttgcaaagacctggacatggctgagtcactgagcacacacaaataacattatggacgttgaaagattgacatatgagattatgatatgagattatgagatatgatatgaggtggtaaaagcatccttgcccctgcatttagtcccttaggccatgtgactaaacagtaagctttttgtgatcacctcttcctttgagatgatcctatatactgtcccatgcacctttagcatcaattccagcttgaccaggtaagtgatgggtcatcactggttctgactcctgcttatcttaacctgcaatcaccacacaagcaagttagaacagcatagcaggacccagacatcatctgtgccagagttattagtagtgcacaagagaatccagcctagttaaagaagggaagtattaattacagggctttagaaagttcacagtctttggaagggtctgagaagcaagctccagactaagcttccaggaacaacatccagaatcgtatatcacaaagctggtctggtaaaggacatgctgcttctggctgtcatcaccactgaccccagaacacactgtgtttgcttgggattgcaccagcaagatggatgtccattctatatctgtctcttcacttaactgtattactctttacctttcatttcagtaattggattattacatgcctcagaataatttcctttgtatttatccatcttaggagtttgctgagtttcttgaaaatacagattgagatcattcatcaaatttggtaagctcatatgtcacttcttcaatattgcctgtatctcattctctgtctcctatttctagggctttaactacatgtacattaaacctttttactatctttcatatttctcttatgctttcttctctattctgctttttattatttttatcttcatatatttcagtttgaagatctattgctctgtctccaggttcattaattctgtcttccaatatgtctagtctgctcttaaggctcattcaatgagttcttaacttaagatattatattttgcatttctaaaatgctcatttgattcatttttatatattttaattctatactgaagtattccatacttttatccattttcatcttttcttatattttctttaacacattaatcataattgttatagttcttaccttttaactacaatatctagatcatttctgagactgttttattcctttattatctgtccgtcactttttcctgtttctttgaatgtttggtaatttttattttgggctgaatgttgtgaaggatctgttgtagaggctctaagttatattatttttctctaaagagtgctgagtctttagtctgaaaggtagttaacttgtcacaaaaatctcctggattgtgttgatgctttatttttacctttttaagggtaagtttgtttcagttttgtccacaatccttaagtgtaattcatacccttaaggcatgacctttctggagtttcacctgaatgcctagagtgctcaccaagattttttcacatgagctcagctaggattccaatatctacacctccccaaaactgtgtgacctctgaaatctctgttctcagccttctaatagttgttctcttttggcctcttggcatctcattctctgcattcagagctcacaagttggcaaagaactcatgagattttttttgtaggcattttggaggcttttatctgccgttcctttatctctggtactctgtcccccaaatctcaggtgcctttgcaacccaaactccaatatctgctttcttcacctattgagattataatttactgcatagtttatttctctttcttccttgtattaaaacatgatgtcagaggaatttcattgcagtccagtggttaggactccacactttcactgccaagggcccaggttcaacccctggtgggggaaacaagatcctacaagccacaaggtacagccaaaaaaagaaaacaaaacaaaccgaaaaaccatgacgaaccccatgaagtcaggaagaaacctaaggtgaacacagggctcatctttaaagtttttcttattttagggatcttattcaggcactggctgtcccaatgcctataaacacttctaaaaataataccttgttcattttttattgttgtttatcatggtatctgttattcattatcaatggaattgaaattcaaaaactatattatagtaccatacaccatgcaatttgtaaaacctaagtctgttctctaacagcaaaggaggctaaaatctgtggagaagggagattatgggaggagctgatgccatgacaaatatggaaaaggtatttcagatatgatttattcaaaaaagtatcttctgtctcattattatctgatttcccttactactatagtttcttggttaagtcattcattagatagatagagatgggaggaagagcacacaaagaagatgaactaagtacctggtaacacggtctatgcctgaaatacacctcagttttatagactatcagattttctttgtaaaaccatatgtgacttcacagcatattcagtgttgacaattaagtcttgtatttcacttcttaatgaccttgaacatccacgtactcgtttctacagaagattccctcataaataaataaggtagaaagaaggtagttaaaacagtactatatcaagaggtatagtggtgctagtggtaaagaacctgcctgccagtgcaggagacataagagacgtgggttcagtccctgggttggaaagaccccctggaggagggcacgacaacccattccagtattcttgcctagagaatccagaggacagaggaccctggtggactacagttgatagggttgcaaagagtcagacatgtctgaagtaacttagcacacacacgttaagaagagaaaaatgcctaaggcttattatatacttcaacaagagtcactcagcaccaagcacattctgatcactgagaaatttgttgcgagggtggtgttagaggagtagaggagttataggaggtatatgctataccaagataaataagatggggctcctgcctgcagttgtacaggggacatagatttttccagtgtggcagaatcactggcaagttatgattatctaataaggggctagggataaccaagaatggactgaacctagccagtgacccaagaaagtcttcctgtagcagacatttgaagtaatcttgaagatgagtgagacttaaccagacaaaggaaggcgagagcagcgttcctgacaagccaacagtggtgggagcaaggacacaaggtcagggaacaaaatgctgtatcaactagagatggagaaaggactacaggggtttggcatgtttaaactgttaaatatgaggtggagtatcaagaaaggagactaggaagggagcccggggtccatgttactgaggacttaaaaagcca

SEQ ID NO: 25309 - DNA, 737 bp, Bovine  19866881046499
ctgagcgactgatctgatctgatctgatcacagcaaatatctttgtttcccctctcctcctcagtctttcccttcatgcatatttatatatggatagatgtgtattcttaataaaatctgaattgtattttgtgtaccgttgtatagctgacattttccacttactttccttctgcccatccgcagtaaccattccatttcaacctttaaaaacagtccttttctgggacttccctgccagtctagtggttaagaatctgccttccaacgcaggggaatgcaggttccatcccaggttggggaactaagatcccgcatgccccagggcagctaagccagcatgccacaaggaaagatcccacaggcctccgctgagacccagtgcagccaaataaataaattaattaaaaaactccctttctaacagggttaaatcaatcatgaagacagccatatggttacctactactttagtcattttggaatcatgatttctaaagtctgaaatgatatcctatttgtgaagctctataagcttctttgatcttgtagcctattttcggttgtggtacgttataactggctgggaattagattatttttatagtagtgtagacacttttgcagtaaacctttaggtggcagcatgtctcaccataaaccacattctgaatagaatttctcagatgcatgagacgtttgacacaggaggatttcagaatctgccgactcccccg

SEQ ID NO: 25310 - DNA, 1334 bp, Bovine  19866881189329
ggacaaggctaaaaaggctgaaagaagccttagactaagtcatgaaagctccagattaaaaaatattttttaaatggtctcattgagaaaattttcaaatgagagtcacacttgaatgaatgaatgctgtatcaaattatctggagacaaagaagagaagccattctaccagaacaaatgcagcctgctttgtctagaggacaaatcattcttgcagcccatttggaaatgtcacttttaagtcaatgagagttgtgttcaaataagagggggatgcaagaccctattatatccactaggacgtgatgttttgcctctgaatggtttctatagtgcatgaaaattcttttttttggggagggggaggcgtctctctttttaatgtcttaaactgttttcaggttttacaaagtgctttagtttttacattgaaagggcagacatgatcacactggaacaccagttgtctggctacagaagctctgactttgggggcaagtcttttgaacttttaacttggtgaaaacagattccttggctcgcgtggggaagctgtcttctggaagtgatccagcacttagaacagtccaagacagccattttctccatctttccgagatatcacaatttgaacagcgatggtgatcagtgaaacaggaagttcagagttgagactgagcaaaactgacagggaagccaattcactgccccacattgaccagatgggctggcatctccaggatttttagactaggcaatccagttttgcttttttggttcattttgacaaactaaaaatctttttaaaaaattatttatttatggctgtgccgggacttcgttgcaacgcaggctctagttgcacggatcgggggctgctctccagttgcgatgtgcggtcttctcgttgcagtggcttctcttgttgcagagcacgagcagggcacaggggcttcagtagttgtggctcctgggctccagagcacaaattcaacagttgtggcacacaggctttgttgctctgtggtgtgtgggatcttctcagatcagggatcatacccgtgtctccttcattggcaggcagattccttaccactgagccaccagggaagcctgacaaagtataaatcttcaaatactattggtaaactcctgaaatcaatttgttgttgttgccattattaacaattgttttttgactactaaaaggtctatatgctaagcaatagtccaacatcatccaattcttctggcagatatactaaaatgactgggtgatgttttacaccattttgaagtatgatttttgaaaaggcaagtttctccatggagat

SEQ ID NO: 25311 - DNA, 1281 bp, Bovine  19866881195857
tacctgtttccttcttgcttccctttcctccctctcggctcttcttcgcacagcctttaaccttttcaacactcctttgcttctaaagagaagaggaggggaaggaagaggaattaaagattactaaactggaactgaacttgcatactgacacaaaaggcaacttgtcttcaaacaaacagatcacttaggataaaggtaaccttgagttttacattaattttctgtgaataaactaacatggggaactaaaagctaaagacagagtgttttataacacaatgaagtgatcagaaggtcactgtctttttataaaagtaggaaaaaaaaacacaatggtgcattctcagcattccacatctaattaaggttatgaggctaaatctggacacattactgtaagatgtctggcataggaatgtgggtctcccccggttcatgaaaagaaaacattaagacagaatcaaaaagataacagttaagaaggaagctacatggttaacggcatgttttacaggtgctactgattatacaaccataaggaaaacattttggaaggctaatcagaataaaacataactgaaaaacatttggaaaataaatacagtgggaacacttttcaaccctgatgtcaggggatctgatcaaatagcacacactgcaatgggtttttaccacatatagtcagggctttggaggtgggggtggtgaggtaaggagaacaggcctgtggctgaatcccttcaataatgagctgtattttttaagcagggttatattgagcacataaaaacaccacaatggtccaggcctaagatgaaacataaaaccacccctcaagcaagagacagacaaaaggaccattattttgtcagttaggcttctttagctctcttccctccactaactcagatgagatggccagacaaccccaaacagtaacaaatctgaatgggttgtgttaccatcacacctttgttaacacgctaaggagagacaggtagaagaaggcgagtagcttgctgctgaagagaaagcacagaggggacagacaactcttctgcagaaaaacttgcctcgtgagcaccaatgcttccaaaggcctcggtataatacccaacacaagcacacaccaccccagagttgattcaaggttttccactgagagggaggaagagtcccaaagtgcggccatgtacaacataagcgcacagggtgacctttcttatcattgggtctgggcctgtatttatctttccaagccttttgttttcttgatga

SEQ ID NO: 25312 - DNA, 1034 bp, Bovine  19866881196152
tggggtcgcaaagagtcggacacaactgagcgactgaactgaatactaggtgcaacacaaggacacaggtagggagaagcctagctataatgcattcattttattaagcttttatatgtaaaaatttgcttcaggtttaatagatttctcaaaatcgtccctagactcttattttataatatatgcaattaagggtatggcaagccatatccaatctaaagctgtttaaacaaaaatttgtttttatcattagtttttcatatcaaatgctagtattaaagattaaagactaataaaaccactagcacagcacatatggggattcagaaatatggtaatttataagtgaataaccagaggcaataaaaacagtaaaattgtttaattaaggacttgggtatttaataacatttataagatctatttttaaaagaagtatacagtctactaacaaccagttatcttacacagtatttgtctttttagtttatgacagtgattttttttttttaacatggactctttaaatgacttctgagtgtcttgtgatttacaccaggctttctagctgataataacctacaagttctgtattagatatctcagaagtgttatatcagacttctttttaaattataaatttatttgtaatttgaaagattcaatttaaaattaaaaatttcaaaatatgctccatggactacttctagtacatcagaaacaatgtttccaacgttgcaaagtataaatgtgggaaatgcttcctcttgaagattcctaaaaacattgttatttaaagtgagacctgtgggccagctataccggcagccctttagagcttagaagaaacgcacaatttcaggcctcacgccagacctactgaatcatcttcatgtgaataacatcaccagtgttttgtacacatgttcaagattcagaagcagtggcatagagcatttaaagactgagaaatctcaaagtaaatgaacctgtttaatctcatctatttcagtatctcacacttatctgacccg

SEQ ID NO: 25313 - DNA, 2089 bp, Bovine  19866881259295
attagggaatgacaagaccatttaggggcatgagaaaacttttgggggtaaagatatatgcattaccttaattgttgtgatggctttatagctacatacatatgtcaaaattcagcacattgtacaatttaagtgttattattgtttagttgctaagttatgtccaactctttgcaacctcatggactgtagcacaccaggctcctctatcctctactgtttcccagaatttgctcagattcatgtccactgaatcagtgaaaaagcaatatgggctagcaatttacttgtgttttcagaagtaaagaaatatataatttccccagtattttaaaggggtgaaacaatgtcttgctcagtcatgtctgactctttgcgacctcatgaactgtagcccaccagactcctctgtccttggaattttccaggcaagaatactggagtgtgtagccattcccttctccacgggtattcccaacccaaggactaaacctcggtcccctgtgtctcctccattgcaggcagattatttaccacctgacccaccagggaaacctcaataactagtactattaaaaaaatactttggtagcaaatgtttatctctgtcatcttgattaaatgctttctcagattttatggcagatataaactgacctagtatgtcttagtactagtgaggtaagcatttcacaaatgatattgatgtacaactaaatgttcatgataaatatagagtattcattttaagcactaatgtttttcattgcattgttgtgaaagtagcaaccatcaataatagggaaagacagccttttgtaattcactgcccgtgagcataccaggccattggaaacaacacgaacacaggaagcatatcttttcatccactgttttagcacctacgtctagtatggtgcctagcacataataggagtctaataaaaatgtgtcaagtaaatgaatgaattacgtatgagtttatttctgcccccagccacacattatatctctctctgcttatgaatgcaaacctaaaataacagctgttaacttaggacagtagcctttactttctgatctggggaaccatgatgcttttggagatgctgaggggttctgcaaacagtaatgactttctgccaaacctttacattgcctgagtgtatttgtcaggattcttagctacaatacaatctagcttcagtcaaataaagaatgattggttcaggaataccaacaaaggtggaacaaatgagtaaagagcaggactcagactgggcttcaaaaaagttcaacatctccatctctcagcaggttagcttcatgaatattcacagcagaccagtttcttttagtgggacacatggtttatgacagccgttaagctttgtatcttggaattttagtcactggataaagaccaactaaaagctttctttggctttaaagtttaaaatcttggaggaagaattttgtttataaaagaatttggctattgaaaaagatttgaacattttttgctctaagtaattatttagtgttcctatccccccttttcttaaacccctcactttagtctcatctgcttttcttcagcatcattcctctaattctgagcctgggtctccttgcccagtctttcccagtcttaactttcctccaggcatatttggcccttagatttcctgttccttgtgattgatatgccttttagtctttttatcttcttgtcttgagtgaagactccttatccaaggagtcccattccaaattctgtctgggaggaattgaggcatgtaatgtgtaagtttcaaaatgacataaaccatagctgtattaaatcttcctggtgcttttagaaggttttcattaaggacaaaaggcagttattttatatctactgtagtcccaagcagcgtgtaaatagggtagaagttcttaaaataacttaaaaaaaaataaagtgggacaccttaaatcatcagacaactagaattttcagcacttcactgaaagaagtgctaagaaatgaccttaattagtaaaaaggtaaatatatgtggaagcaagaaatgatcaatgcagc

SEQ ID NO: 25314 - DNA, 1082 bp, Bovine  19866881271798
aatgtagtatgctgtctgaattaatgaacaggtgaatgaaacccccattagattgagtatttctactgctaggtattttttaacttgtatatatgtttatgattataatataattgattaagatattgtctatttcagatacaaaatggaatctgaaataaaatccttattcagtgaagagaacattggaaatgaatgtctttctgaccttatgaattttggtaggttttgttttttctttggtcccacatttaaaggggagttttgttttaaagatgaaagtgggccacacatttcagtcttttaaatattaactgctgtttgtttttttctaaaggaatccaaaaaatctgcatcttaatgacctgttcttgaagaaacttaataatgtgttgctttgattttgtttcaccatagaacaggagttatcagaacaatggtgcacatatcttaaaaatgtaataaatcctattcagcaattgagagaagatctaaaatacagacagcatcacatttcacagtattcacactcacacagtgaatcaaactctatgaaagtattggaagaggtcagtatatctcctttacttttaatactgtaatatttggaagagtctgagataaacgtatatgttttatgtgcttaaatagaatgtatagcaaattctgtcccttaatctgtccaacatgctcatttctcacctagcaatgttacaataacctcataaccctgctttcctcctttctcctccttccagtgtattctgagatcctatcctagggacagggattaagtcatcctcctggtaaatcccctcagggctcctactggccagggttcctcctgtaataggggtggggcaagtgtgcagcctgagctcctgacctttagcgcaagatccttagcgtgagacctttaaagagagactgttagagtgagatccttagagaccgttagcatgtaaccattaaggggtgactgttagcgctgtggttacaagtcccacttcaccagcagtcagccatgaggtggtcctcacagcacgaagtgtggtgagaagggatcaccaccctctctgggg

SEQ ID NO: 25315 - DNA, 786 bp, Bovine  19866881304007
cctactgtgagcaaagactgtccaggaaagagatgggagggatggtcaggagacctataaaggtggtctgtttaatacaatttctgccctcagaagaatacagagttacaaaccatattgtatatttttatttgtggtaattggcacataatgaatattcattcattggaaccagaaaatccaagaatttgtccccttatttttagttaatcaggctatagatatatattgtattatgccagttttatgtaaatttgttaacttaggcattattattattactaactattaggcaaaattgtttaatttttaccattgaattagctgtacctttggtttacatttgaaagtaatagaatatttttcctttattaacagttaaagtcaaccttgcctttgcatatttaaaatgataatttccttttcagttgaataactcagttcacaattcctgttcagagttaaattatgaatatatggaataatttttcccctgtacatgcaaactttatgatattaaatgtgaaatgagtgactgctgagttggtgagattaaatggatgacaggatcattcagcattaaattctttgtgccgcttgattgtttttctttgcagaatcacttcgggagagaaaattatttcagaaacagagttttttcctgcaggtataacccttgaagtcattccacagctaccgcagaacagtctgtcttcatggtttgtgttcttacctaaattgtaggttttgtcacttttgcagaaaggggtccattcggcattactg

SEQ ID NO: 25316 - DNA, 1282 bp, Bovine  19866881330849
acgtattatttaatttttttaaaaaagtcttattgagcaaaatctgctttcatgttaccgttttattcttcacttttgagagacaatgatatttttagatgcaataaagttgaagtgaataaaattattttatatttatattattactcaattttccaggttcaaaagcaagaataatagaattggactacttctttgggatgggatgaggaaaaatttaattaatgattatgaggccttctgaaattttatttgtcacataaaacttttataatatcacctcaaaccaactaccagtagtcattaagaattataagactggaatagaagaatgatggttctttttctcaatttattactttttagacattagcaatgctcatagtttcttacattactggttatccatagtctcagttctaatgatatggttccctcaaagggttatatttatccacaggcggacttcaaggaagtaggaaaaacttgttattaacagttggtttgatatattaaatagacattataattcctctcatatcaaaatttggcaaccctgtccattgaaattttaatcctgtctttgcctataactgcacaggttttattattttaataacaaattctatctgtatcatccaggttaaaaaatagcatagaccaattgtcttggacacaaatctgtcaagctgatatgtttccattttcttcaatctgatttactcaagattaatttgatttcatatagtgaagaacaaaaacctctcataaatgactctcactccatcctgtaaaagcctgatttttcagttttctgaagtatcaaaaatgtagcctcatgcaccattatactgtatagcttctatgtgaagcaattatatcaagaaggcagttgtgggctaccgtgatactaacaataaagacttctgaactagaaatttattaccactagtcttgtactttccaaaaagacatttaaatgaacataacatatacgtcaatacacagactaagttattaattaagcaaaagcaaaaatctaagactagttttggggatgtccttgagaaattggacctatttttccccttgataaaatgtattccactgaagtcaagagaatttaaacttcattttattcctacagcaaacccagaataggttgagcaatcaccaaatgtgactcttagtctaagaacacaaagtaaatcttttcaacaatgtatttattttaggagaaagctatgaaatacatatgacaaaaaataaaaatctcagtttg

SEQ ID NO: 25317 - DNA, 1709 bp, Bovine  19866881359805
tacatgacatgacaaatacctgtaattttaatcttcaatacacctcatttacaaagctctattttactgatttattttacagttgtagctatagatgagcactttcccctaagtttctaaaaagtagatagctgaacaggaatgagtttcttctgatgcatctgaatagaaagcttctcccccacaccacaccacttcaagcatgtatatgtaccagggtattggtaaattatgttgatgaccagaacagtgctgtgtcatacaagtgtgatgtgagccacatacataatttaaaatttttaactagtcataataaaacattttaaaagataaaatttattttaatattatatttttaactaaatttaacttagtgcaaaatagtatatttttaatatttaatcaataatttaaaattattaatgaggcatattacattctttttttacacaaaatcttttgatatctggtttacgcttcacaccacagcatacctgaattgggactggccacatttcaagtgctgaatagccacaggtggctagtagttactatcttggacaatatggcttaaatgttttactaaaacaattttttttaaaaattggcttcagttgaacctatttatttattcagtatgtttgtgaagctatttaaattctgtttggactgtatttcattagtaacatgacaagtttaattacttgttttagacttagatgagattgtggctttaatttcctaacatttggtgaattaatcatatagatgagacaaaattgtttgatgctccacttagctatgtcagatttgaagccaatatgtggcaaaaactatacagtgataacaagtaatttctactttattgtttgaaaaatatattacattttaaaatattgattcataattatcattcttttatgagatctgaaccttgagtgctatttaaaaacccacaatgattttaacaattttggccctctgggtgtacattgtgaagacccactagttttatattttttcaactaaaaattttcaatttaccctaactattaatgactttcaaaatagctagttagtagtatctgtccctgtttccactttttcctcttctatatgtcatgaagtgctgggaccagatgccatgatcttagttttttgaatgctgagttttaagccagatttttcactctcctctttcaccttcatcaagaggctctttagttcctctttgctttctgacattagggtggtatcatctgcatatctgaggttgttgagccaccagggaagcgctaaaaaaaaatttgaatgaacatattcttacacatgtgactatattttgatgaatacaagatagaagaaagagaaaggagcataacaaacaactgtaattcgcttacttggatgatgttacaagaagttcaaatgctggagccttaattgttgtttagtcaccgagtcatgtctgacttttttgtgacctcatggattattgcccaccagactcctctgttcataagattatccgagaataccggaatgggttgtcattttcttctccaggggatcttctgacccaggtattaaacctgcatctcctgcactggcaggtggattctttacccgtggagccacctggaaaaccagagctttaattagcaggggcatttttctcgagaatgtagtctcagatctttggaaagttt

SEQ ID NO: 25318 - DNA, 1127 bp, Bovine  19866881374322
ttcgccttcagtttctcatgcggaagggctatgtcatatccatccttggatccccagagcccaactgcagtctcctcacttttttcctcctaccctttaccaagctctaaacacctttgttcgtccctttccattgaccatggcaggtctgactgcatggaggtgtggacgagcggaggacatcctaccttccagtttccagcagagaggttctggagtgatccggcagagccttccaaggtggctgggttggaactttctgctaggagggtcagatacggttttaccactgatgggtgccacagcatctcaacgcctttgggggactttgacagtcctgggataggaccaactccatcccactgaaagacaaagaacatatactggtggaggcaaagcgaacacagtattcaacatttgaaaacattcctttctgctggactcagctagagctatgcagaaaagctgaatcatgagaaaaaattttttcttgccaaatatgtgatttcttactcccagagaaacaaaactttaagagtttcatgtcaaataaaatgctaacttgatcctcttgtggtgtcctctttttcttcttcttcttcttcccccagcagcttggctccgaatctttgctgggagactcttttccgagtaagtcatctaattcgttcagccccagcagccgggcctgaggcacctccagctccagccgatacgacaggttcctcagggtgcacacgcagttctccacggtctgaaacccaacacggcgcagggttaaaaccatcgtagcgtgttagtgcaaaatgcttctgtacccagcaccagtggcactaaataaatgtagaatatgaaagaactgtttttcactgatgggaacctacaaactgaaagttagaactctgattccagactcaagttggtgggaccccaagctcacagagtgtgcagagccacccaaagtagagctgaggatctgatttcacactgagtgaaatgtgtggggctctgggaggggagaatgcccaaggtttctgcttcagggctgctgcagtggcagagcccccatattaccagaaccccaccccttctcccagctgggaactctcatcatgacagcaggtgtg

SEQ ID NO: 25319 - DNA, 1186 bp, Bovine  19866881461161
aaaaaaaagaatactggaatgggttgccatttccttctctaggggatcttccccacccagggatcgaaccctgtttggctggcagattctaccattagccacctgggaagctgtaaagtgaagtctatggaaaataagtgctcaaaaatcactaaaataatttttcaaagacaaatttcattcttttatgggaagaaaggttatcaaatgcatcaataaaaatatttgctaatgggagatatgagatagacttctattaaaaaaccaaaaagaatcttaaaaaataatccatatatattcaccaccaaaagcaatgaatggagtttgtgaaactttttttgtacttttctattggattatctatttggacaaagattatcaagataaagctaaaggcaggctaactttggtataaaaatgaaatgtggagttatagatggtagcctttttaatgttttccaaagtaacaactaagcttccccagtggttcagtggtaaagaattcgcctgcaatataggagccgcaggagacgtgggctcgatccctgagttgggaagacaccctggaggagggcatggcaacccaatccagcattcttgcctggagaatcccatggacagaggtggtgggtggactacagtccatggggtcacaatgagtcagacatgactgaagtgacttaacatgcgcacacacaccaaagtaacaattgtaaactgaggaattgctgctcagtgtgttgaggacgtggtaatggaaaaagaggagctttctgacttgacaatttctattttattttagctacctaatagaatatttcttcacattatcactaaaagcatgagagaatttaaatatttatttgacatgtttgaattaaacataaaatgttaaaggctaaaactggatatttgatttttacatgaagtactaactcaaaatatttaagcttctcagggacatgttcatacatcatgaataactggctcgggaacattcagatatacactgactaaagcaaaatgctaatattcttatttggtggcacaaacacccatgcacagagtgacaaatgtggagttctaagctgatgcccagcatgctagaggtaattttgcttaatgttagcaaaatctcattctacgtggaaacttagtaccacccactgcctaagagcacatgtca

SEQ ID NO: 25320 - DNA, 1657 bp, Bovine  19866881668181
taaaccactactgatcattaaagctggtactactaaattctggaattgagaaatgtgaatagatttttcttgtctccataaatcttaagctacaaataaatgtataaatataatacacatacactgccaagtaaccatgctcaatttatattatgacttggtagtttcatattaggtagataatgtttatatacaaatcaaacttgggctgacatatagcattttgaaactggaaactcaattctgtaagttctctggtccaactcctttctatattgtcatctcagtgacctgtttacacactggctactcccattccaaagcaaagcctacttttgcaaaaaatatttcataagcaatccatccacacaccaacataaattgttacaggtataaatacagagctataaaacagttgttaatattccgtaccctataactatggctaaaaaatacttctataataggctaaaagctactggcagctgtttctaagacagaaatatcagaggttgttgctagttttatattggaactgatacaatctattagggaaatagttttttgaattgggaaaactcatatcctcctttcaaggtcaaggtccaagtcttaaagtatcttgtgttctcagcaacttagtactgttcccaaatagaaatgatgaaatatgtagtaaagcagctaaattagtactccccatccagagtatgcaccaggtaaattagtacataaaagcccttagtagtacagtctggctctacttcaaataaatttgatttattctaaaatgaaaaagaaatcaccaaactttcatgcactttacttcttgtttatcactaaatcataacaaatttcttgagctcagttcaggaaagacactgtaacaattcctcccaaggataaaacctcagaaacaaaaaagctgccaagactccctcttcctgtgagaaattatgacagaacagaaaaaagctgcacattatggatgttaaggaccaagccatgaaaaatcagcctagttaatcaaaagagaaccagatctagtagacgctgtgtttccaaggtcaggttgaccctggattgccccctggtccctcagggagcccgcacacatctttcggtagccttgctggctgcacaggtaggttactgggagaaaatattgaacattcatatatatgttcaaagtgatgggaaagaaatatcatatgaggaaagaaaaaactcatatactgcaaataacaccatcttctctatgcctaacagggagcttaggataaatttttgggtgtaatcacagtgacggtcctagcttcttaaacagctatgtctataatcttttcttcttaattctatttcttgttctaattttcatttcatacacacacacaatacacaatatgtaaatacaaagaaattatttttgtgtgtgtgagagggtttgatgttttaagaacatattataaagaggaagtacatacacctaaatcaatatgtaatttagatgtgttaaagcattaatattcaaactacattagggcaagcaatccattttggagtttatacataacgtggattctacttttagtacataattttcatactttatttgaatacagggcatttacttgaacattaatatcttacaagaaag

SEQ ID NO: 25321 - DNA, 1607 bp, Bovine  19866881673552
tagatggatgcttactaggtattgaatttaaaatgctgatagaaataatttgatgcctatgtgatatcatttgcttttagaaaaccatccttccactcttttgtcatatacctgaaagcattaaaagcccaggactaagggtttgaagatttttgactcatcaaatttcaggaccccaggcccttatcagaggctgtttcactcagatctctactcttggtgaatgctggcctccattcactgttcctccactcctaagaatctatagctgcttccaggtaagtgctcccaagcaaaggcaggcttcactggtacagcctttcaaaattcatgttttgtccattaccttttcaaagtattgctcttcccctaccccatttagtgaatgcccctaaaatgcttaactccctgtttttcaaaaaaagaattgatttgagtagctttccaaattcctcaaaggaaatcctcatttgatccactaatttctttcaatttttgagaagtttttcttagctctttaagaagttattatcattatgttaaaaaaatttggctggttattaatatttttctagttgtttgatagtttagtctgacatacctaatccattatgtttattttcaaattttaatatttattattataaatttaatgtttttttaaaagtgagtccatttaaagaaaaatactaatatccacagattatctgcagatctggttatgaagggatactttagtgactgaagtttgcaaacactggtatagtggatgggaccagagccatgactcagattgtcatggtttatgtcttatctagattgcttatgagcctgttagccttgaacaagttgcttaatccctccaacatctgcttcttcatttataaattagagacaataaaagccctaactcgctatgttgtagtgagtattaaatgaggccacatgtgtaaatcacatggcgtaggccctggcatttaataacatttcgtaaatgttagctataatttccttatttgtcagggagaagaatggtaatgatatatttaggtcaatcattagtctccttgattatgacaactcattagcctaatttggaacatttcttggtagatacgaactcttaagtatcaagaagtttcatcattacctcagagagatgtagactgccttagagtagctccccagattctcaaaagaacttttgaatgaaataaacagtcaaccctgatgtgaatagttggttaggttgtgtactacccaactttcatctctaaaatggcaccatgccttgagccgtgttctgtattcactctgcacaactaacacgccgtagccctgggagtgtttttcaatagtgatgtgtattcttaacacatttgcaatactaactgtcacaccataatctgttttaattattccaatttttttaagagaatttcttgaattctagtttctgccctgttactatctgtgtgacttgaacaaatggcttactatccccaggcctcaatttctctgtatgtcaaaaacaagagttggactaaattgtcttcagttctaaaattctaatattcacatgcaaaatacaattctagtatctttgt

SEQ ID NO: 25322 - DNA, 685 bp, Bovine  19866881759578
gtattctatttttaaggacactatttggagggggacaaggtggggccctggacagaggattctgaggaaggggaggagacatgcaccccttacatcctccctgtgcccacttcgctccctcccccagggcctagcagacgcccacccccattctgaggaccatcccagggagggggaggacatggctggccgctgggaggtaccgtttctcaggcttgtgagtggctccagcacgccccgcttgaaggcggccaccgggtcctgcacacaggacctgaggctcagcatgctctggagctggggctcccttatcagcaggtcccggtaggcggccagctggtgggagcggcagagcagggccgcgatgctgtgcacgaactcgggcaccaggcacgtgtaggtgttgtcggcctggcagtagtggtaggccacgacctgcggggaagcagagccgtcagcatcgcctgtcctctccacacggctccttccacgctctccaacaggatgcagtgctcccattctctaacaagacgcgttccttctattccccaggactgagtcaccatttagcttaatggactcagtcattcctccactttggaagaatgctaaaatttgctgaattctaggcagactttaagttgtagccacaagtctgtcatgactgcccctaagatcaccacaa

SEQ ID NO: 25323 - DNA, 928 bp, Bovine  19866882119051
tcctcctgctttctaaaccttaaatttctcttttggccactctatctggaacgataaggagattctgggaaacacggttcacactgtacatatccccactaaaatacccaaaagggagaaatcatagtttgtacagtttaagaaaattattaaaattctaatattaaattaaattataatgttaatgactccctagtagactggttcttatatttacaagtacaaaaaagagaaagtcatggaaaagtaaatagttacaaaatatcactatattcagacttatttaaaactgaaaccactataaaattttgttcttaaaattcccatcatagataccgtttcagtttctcatagctacagtggaagaatgtccaggagaattggttgaacactgaatgctttcctgagtttgataaagtatcaggaacatacggctggaatccatggactacaaagtaatccatgccatttaaaaaggtgatttatcccagtaataatcccactaatagtttcacacttggtgcttattaatgctcattacagcctatctccctcggctccattcagctttaatttcagctgttttctagcacattaacaatatggcagcccaccaaagggagggacagtcgcagacttaatgttttgtacaaaatcatttggccacagaattggatggattggaaaacttaagagcaagattccatttctaccaagaagattccaaggagctgtgcatcttgaagtcctacatgcagccttgtcttcttgacagagtagctgcctcagagaaacattagcttgagagcttctgaagaagaggcctctttggttttgggagactgcggagtataggagagcacactcaattccagcctcggcattctctgtctgctctctcccaggcagaggtgaggctggaggcatg

SEQ ID NO: 25324 - DNA, 2666 bp, Bovine  19866880494272
ctaagggtttctcttctaatctttcacaaactgtcagatattcaagttggaagtgatttattagcacaacctcccactaatagcacaaatttactgtataatatctgacaaaaagagacttgatatttacctaagaaattccagtgattaatttccaacgtactcattgtatttacagacagtgaagccatttttttttaaaaccttggcttctttttcgaaatattcctttatacctcttaccataatccaaacctttaattctcaataagctctcattgcccctctatgcttcaatcaagctaacctattttatatataacagtctaactcctatctacagggagttccttcctttcttatgctctttgtcaaaatagtagtgtcatcttctttaaggccaacttgccaaaatatcaacttttccaggaagttttcagcaactttcagctcttctctcagtagctgcttaattttacattcttcaattaaattactctcttctaactaccaaatgcttttctggacattcttatgtctacaactggaatttccattccccaaggatagctagccatttcttctgtacctcctgcacgtcatttaagtgctctctttccataaaagcacgtggacggccctccttattctatgcatttattttttacttcttaaatgtatttctagatttaatgtggaaataaagcaatacttcctaaataactaccgtgaaagcttttccacttcacagtatatcagcagtcttaaggaaaatgtgccagtatgtacttactactaagcaaatcttgtagcaagctgatgtactcaattcagtaactgaaacaatctaaccctcagattctcagatttatagatttattagtaagatttatggagtatactgctgccagggactgtacaaagatttcacaacctgataatgctaaatgtgacaaaggtaaacaaggatataatagaatgaaggtggaaataagaagaggaatgagaaagaaaggaagtataagaatgtgaagtcagaaatagtaatgatgatactttatttcaggtgctttaaagatgctttattgatctatataaaacaaagatagaggattcaaatgcaattttatacctagggcttccacagataactgtataggttttagaggaaaggtgtttggtttcaaatcttagtttccagctctatcaataattactgagtcacatggagcacattatttaacttttaagtgctctatctcataagtttatgtaaatattaaataagttaatgatacagatgtttaaaacagaatacatacataataaatagttgacaagtgcttctgatggttactgtcaaatgttaacattatcacatgtattatcatgttttatattaatagcaataaatattttgttaacctcctttctgaacttagagtcacctcactgttacctcctacttttagaatcacgatcacacttcagagctgaaaacactatttatcatacatatttctaatattaacttctaccaacccaatttttggaaatttctgcatttccaaaatgtagaacaggaaaacctgttctactcaagacacttctgacaccctaattctctgcagacactgagtatcctgcaacttaactgaaatctgatactcagtgcagaactcagtgcaagactgcttcccatctcagatgctaagagcaaacactgggtcctcaggtacccagaaatcagtccaatatggacacatattgggggttcccacaactaactttcctcaggctcagtaattgctataatgactcaaagaacttagagtactagtttacttattattgctggtttattataaaatatataaatgaatagccaggtgaagaaacacattaggtgaggtccggaagggtcccaagcacgggagcttcatctgtccccatagttagggatgcaacctcctggcatatggatgcattcacaaacccagaagctctatgaactccactgttacaggttttcagagattccattacacaggcaaactgattaaatcattaactattcttgggttctagctcaattcccagcctctctccaatcccctatccctgctcccccacttccagaggtcaaaggtagagctgaaagttccaaccctctaatcaaaactgcagctcttttggcaatgagcccatctccaagagtcacctcattagcataaatacaggtacagttgaaaaggccttattttgaaaaacaaaagatgctcttctcattcttaccactcatgaaattcctagggttttcgaaactcagtaaccagagatgaagactaaacatattattttttattgtatcaccatatcacagctattttaatattttaaattcagaacattcaaaaccaaaatatctccttatcctgatccttccacttgccatatttatttcaggtgctcaggacaaattcttggccatcgcctccaagtaattttatacattttcctctccttcctctgccctccaatacagctctcaaaatccatacatgaacctcctaattatgtctttcttcactgtcacctctgctgcaatcctcctgggtttgtcttccttaaaacatcacttgttaagacacattcttggctttaca

SEQ ID NO: 25325 - DNA, 3337 bp, Bovine  19866880496671
ctgccttgtctatttgtctgtcttacctttagaatacatttctgagcccaggagacctcagccagaggctcagctgcttcagtgtgctgtccacaagcaaacacacagtgcgtccagctgcctgatgggggactctgctaattggaggtctgctctggtcccctgtcaccagttggcagacagaacagactgggccgaagctgatttccagagtcaggcattcatttatctcagtgataacagggtatgtgtagacagaagtagcaaagaaagcaaagggcagctgcagttgaggtggggacagtactaatgcccccaaatcaaagacatgctgcctgtagggccttggcagtttagttctctctccaaagtttaattagtcactaattataaactgctgtcttttattacggatgtatttggccagtgctgcatttttttttttttttttaagaaacatgttttcatctcaagcaagttgcaaatgcttaggtatcaatgttagaaactgcagtcaagtacaacctgtccccaaatctcagccccttgaaacacgatggctcattaataacttaaaaaggatgatgacactgatgctatttatagagtcttgccaggcaggtctgccagcattaaagaaattaacatggagaaattgtcaactggaaaacattagtgtttatcaacaaatcaatcaaacttcaacaactgtaaaccgtgcttttagctaagtgaaatgtattgacaatgacagccacttacccaccttgctgaggagccccaaatccccatgttggtccccaaccaggcagactctccctttgacattgtagtcatcacccactcctgccttttagggaagagtcagtctgcctctgttccacatttaagagcaagctggagagactgggctgtggtctcagttgtatattaattagctctgactgtcaatttgtaaagtctcaagcagactaaattcaataccaaggttagtggctccaggaaccaaattctaagtttatatgtacttcatgaaaggaagactctgatttaaggagtttttcttggttctctcatcttttaaaaagcagtgcttgactctcattgttgtatatttagagatggtgctattttcatttctgggctacatcggtgatgatgacatggcttcggaacctgaacaaagctggagagctctgataggctgctggtgatgtcatctctgtgcctccaatgcctgggaaaagcaccagggactgactgttttcctgacttttcttttctttcttccttcctttttttctttttctttttcccccaaatatgaaatctcactttcacactaagagtacgtttggagtttcatatcttagcaacgttatcactaaagtagccagtgaccgctttgcacagactgacactgcttggcttgacacacagtttcagttctcacagagaggattttgtgctgcatcacactgaatatcgctgctccgtaatttcttgtcattacagcaaaccctttcacgtgctccctttctgtaacccagatgatcaacacttgtcaagttcacctacctaatcaaaggagcctaacagttataggaggacttaaaaatcaaaaaagagaaaatatggccagggcacttagcttcagaattaatatcaccccagctcgtcccaaggatgtctcttatgtaatgcacagccttgccaacttccaccttttgttcttcttatgtgtatattcctaaaacaacaggatggttgaaatgatgttttcactgaagttggggtgggaagacttgggggaacctggaatgagataaaggagtcctctacatccctatttagagggaggggtttatttttgctcagtatgtaacaaatttcatattattttaaaacaaaacaccaatcctgcagttttacttctgacatcctacctaacaccctaagtcccaagttctcatctgttaagtgagacaaaaagacacacctgtctgaagagtcagcattcaacgcactgctgtgtctagagcccactgtgcacgacaggagcaaaactaaaatctgctcctgccaatcagattccaagctctgtgacacaagcaaataaagacaaccaggaaaaaagggaaagttgaaaattgctaagcagtctccacggctggccaaggaattaatccattctcagcactagagtcctttcccctccttgtagctccacaactggttttcactcaggagtaaaatctatagtgctcaaatttgaggggatgtggagggacattaaaatgaaacaaaaaacagaacatagtttcaaaattaaaaagtaaaattcagatgtgtctctacctgtcactaaagagtttggtgagtttgaagcaaaatcttccttaccagatttttatgcaggaaatttaacaggaggatcaaaaaaaaagaaaagaaaactagcagtcgtaaatggatattcacaaaatactgtactgaattttgtgaaaattacaaagtaaatattagtcatggacattggcatcaagacttagattctgattttgtaaaaaatgaatgagaataatagttcaaattgcaaatatgaattcaagatagcaaaagacgacctgtcaaaaggcagtatgtgattaaatatcaattgcactgtacatataattattttatggatattcaaaagaggaagattttacctctaaatgaaatgaccagggtagttttaagaaaaggatgtgagctagcctctgggccacagaagatggatttgcttcagataaatagctggggttgtgggggggtggggtggggaggtggtgttcaagacaggaagaaaggtaagagcgagaccagaaaaggtacagtttcaggaagtggtgggaaaacatgatttgtaaaaaggtgtggtgagaaataggattggaaaaccctgagggttccactcaggtcagctggcgctagaatgtagagcatttaacatagaagacagtcaggcatttgttcttaaactcagttttactgaggatgtgaaatgttctgtctggcagtgcacacactggtttggtgctttctgcccttcttgtacatcttggacactgtacacagttaccaaccccctttcagagaacaaggtctggcctagattccagtcaaaactcatccattaatcatatattaacactggctttgaatgtgtttgataattaaacattctactgtttaaaaaaatcggcataattttttcagaataaaaaatactgtccttgtacctttttatttcagcatcccatattattctgatacacaaaaaaatgtaatttaa

SEQ ID NO: 25326 - DNA, 1901 bp, Bovine  19866880517905
agcaaatttcacttcacttcacttgaggatgtcagagtctagtactttcttggaggtcttcctagaaaaaatatgtcatatattttttaagagaatttcagaaatttgctggacaatgtagtcaacctttaagcagagtacttgcatttctttggaaggacagactttcccttatcatgtgtaaaaatccatttgttgggactgccttttgtatttcttgcctttgtcttccttcctctcccgggaagtctcatactgataatttatgcatctagggagtgaccttgtgatttcccttactctctttggaagtcaaacagccaatatgttgggccaaactggagagacaaagctgtttctagaaagctaaccaggttatgaactacctgattattaatatgagggtgaggcatgaacgcatgattgggggtaagtgtaaagttggccaggaagggatttggctgaacggaataaagggggaaaatcatacagtaacaggtgaggtagtgagtttaggaagtggggagaagagcatatgttaggatatggatgagtctgctgatcctgcggtaactctaaacagttattaagcatgaaatttagcaaatgcttcctgagctaaatcacaccatttaaaaggagataaattcatacacatatggacaccttatctttgacaaaggaggcaaaaatacacaatggagaaaagacaatcccttttataagtgggaaagaagtcatctgggaaaactgttgaaaaagtgagttctatgagggcaatggtggaaaattgaagttggctaagtcagtttaggctcagttataaggtttgaaatggcttaaaatctaaaaggcttatttattctgcagctaacaaggtgacaatttttggttgtgtatggaaatgttacaatcataactccatgtcaggaatatgaatacagctatcattcaacaaatatttgttgggtgtctactcatttgcaaggtactatcaattctgatgagaataaaaggaagtataccacttaatccctgatctaaagtttttctttttacattatggataaggaaatacatgccatatccagagaaagataaataattatgaattattttaaaatcagtagtactggatgtacttgtaacacatgtacacttgtatagtgacacttataacactcttttggtttccattgagcataatctggaatcttccatttgaaattgtttgttataagtttgtctcttcattttcagtttgtaatctgttagttggctctaaattgctgcttgtaaaagagaaattacatagcaaatgtgagtgctgcaaacccactaccatgagaggatttataaagaaaatcttgctaagtccccatctcttctcaactgtgaagtgcattagctgaatggatattctttgtttgtctcaatgattaattatgtcttgcactgtcctagaatttgatatttaattatcctaaaatgctttatgaatatagatcaggtgtcttcaggatcatgtgagtgtgccaggtatgtttgtcgagtgatcttttctctaatcaatgtaaattttgccagagacaggaagcaatagtgacttcttcgttgtctgattttgaactatagctacatctggagggaagggaacaccaccttagagcaccttttatctcaggccacaattggaatttggatgcttatttcagtctcagctattaattctggcttatttccttgtcaggcacacacacagtgtatgtatgtatgtgtgtgtgcacattgtgtgcacgtgcagatcattgacattatagacaacacaaaatgagtgtgttttgtttctgatttgtatttttcttatttattcttgggaggaggggatcacaaggaaatcg

SEQ ID NO: 25327 - DNA, 1609 bp, Bovine  19866880532387
aacagtgatgacactgactctcaatctctttaactttggattccaaacacagtgacaaatgctacccagctgtctgtcagaaataaatttctggattaaatcaacaggccttcaactcagttcagataaaattgtggccacgttggcagcataagagcatgactctgaggaactcacctgaaatgcattctcttcaggtattattatgcagtaatacctcagagaaccaagaaaatgtaagtgggtttgagttaatttgctggataagcaagtgaatatagcccctccctacttcaagcctgtattccacaccagggagcatgtgttgcttctctgtagaaatctactgtgttgaggacatgagcagaactttgactcaatcaaatatgcaaataatgattaagctataggtacctatgttgtgctgtgcttagtcactcagttgtgtctgactttttgtgatgctatggactgtagcctgcaaggctcctctttccacgggaattcttcaggtgagaatactagaatgcattgccatgccctcctcaagagaccttcccaatccatggatcaaatccaggtctcccaccttgcaggcaaattctttaccatctgagccagtgcctactggtgcataataagtacctcagtaacagatataaatacacgcaagacactattttctcctttgaccacttttgcatctacttgcaaagaggagttatgggtataaaacagagcaaactacagacaagtagtaggaagactcaaggaagtttaaaaagaggagacaaaacctagcaaagcaatttgagttatgcctcatagaggaaaaagtgagttttttctgtatctttgtcatctcttctctgcttctctgatgctaagaaactatttacttttgaacttcttgtgaaataagcaacaaatggtacccttaaaatttgagccacttttagttgggaattctgacttgcagatgaaagtgtattgtcatgaaaaccagctgttctaggtttaatcccatgcaagttttaatttactgactcatgtagaagcatctaaaagattcccttgggatgctgccatttttcaaacacattgtgttttgactcagtgagagcatatatttactaattcataaaatacacatttatgaagctatcttctatgagacaggccctatgctaggcatggaaatttaaagattaatgagacatcattccatttacagaactcataatctactggttgagggtggtggtgaaaggagacacagaaacagtaagatcctttgaggtaacaaaaaaagaaagaagcggcatggaagggaagcagtggtatgaattccctagagaaagtttctccaggatattttagggagttttttattgctaagaattaaggtgacacggtaggatagaatcatcattttacagtcaccctttgatcatgtctagaaataatgctttgtgcagggcatatggaaacattttctgttcaacaaagatacaaagatctctcccaggggacgagaaaagtcctgaatgcaaagttatgggctcctgggatctgtttccatctctgccattctctgtttctgtaactg

SEQ ID NO: 25328 - DNA, 1323 bp, Bovine  19866880537550
ttctacaattactttggcgatctcatttcaagcatgcaaatcatattattgaagagcccagcaaaagccatttgttccttggaaccacgagataagttctgtggggtgaatgaatgcagcttggagaaggccagccctcctgtctcataacctctactgcatggtggtaaaatttactcaccttaatatagacatcaaagaagaaatgaaacaaaatcattcccaaaatgaagtagttattttttttattccattcatgaaagatctactttgtaactcatttatttaattaaaaataacatcatttaaagaaaaaattagaaaaaggaaaaaagcacgtgttgttgctaaagttcatggagtcaaagccaagactgctagggagtgagagctcctttatgttccacaaaggtcctgaagctttttccattttctctaccttctggccaactcagctgagctgtaacatggtcagtcttttatacatatatctagaggcaacataaatgggataaagcaatcatagcatagtagcattaatatatgttaaaattcgtttaacaaataccatatgaaaggttagtgacttccctggtggctcagatgctaaaagcgtctgcctacaatgcaggagacctgggttcaatccttgggtcaggaagatcccctggagaaggaaatggcagcccactccggtactcttgcctggaaaatcccatggacggaggagcctggtaggctacagtccatggggttgcaaagagtcggacatgactgaacgacttcactactactactacactatatggaaagttggagctttcctggtagctcgggcgttaaagagtctgcctgcaatgcaggaggaccagggtgtgttccctgggtcaggaagatcccctggagaaggaaatggctacccactccaatattcttgcctggagaatcccatgggacagagaagcctagccggctatagttcatggggttgtaaagagtcagacacaactgagagactaagacacatacaactcacagccacatatatggacggttcagtggggaaagaggaaagataaaccaccagggtgactactctttactggctcacagttgtaaaatggggaggaagtgcccactacactggctgatccagtgatatgtgctatgcaaagtgatagtgctatgcaaagtgctatgcaaaggtaggaattgagttttaatggagagatacagtttcagtaagtgatgaagatcttgcatgaagtcgctcagtcgtgtctgactactttgtgaccccacggactgtagcctatcaggctc

SEQ ID NO: 25329 - DNA, 560 bp, Bovine  19866880566924
cactgttactgttttaaattacaacaactcctatggctgttaggaatccttgatcgtcctgccacacttcagtaacagtattccatacacttccttcttaccagaaatctagcaatcttttatgtataggaagcattgccttacttttttttttttatcagaaccttcaaaactgcatttacgaaagcagcaatctgctatataaatttgaggtttagttctcctagcaacaaccacagaaaaaaattcataaaaaaagcagttgtgactatattgttagaaatattgaatccagctgaagttctttctcttgcctttcccaagcactggtataggatatggctatcgagtctgtcaactggaaaattcttcctaaagggcaaaatgcaacattatggatcacagtcaaccaaagggggaaaaaataaagtagaaaattgccctctgagctgataaaaacccatctgtctctcatgacaagtcagagccattcttcacaggctcccatcctgaagacatttagagggtcataatttccagttccttttccttttattctt

SEQ ID NO: 25330 - DNA, 1880 bp, Bovine  19866880628788
gataattaaagcaatgatgaaatgtgttggttgattccaaatttcctcacaggagtgattaattgcattttggactttgagaaattccaaaggagattgcaatagaagagaatcttgatcttggcctatgtctggctttttttttttttttttttctcacttcttactgttattaaagttgtatctctggatacataaagacagaaatgtgcctagtgcttaagcagatttaaagaatgaccccccactgtgctactgcacattagtaggcattttacaatgtgccagagacatgcagtcaataatttaggagaaaattatcaatatgtagatatttcataagcccacagtcagagtaacttataaaactgatgtctttggagagatctcttttttttttctttttttcttctttttgatactgcaatagcatcatttaatttagcatggccaagatctcaatctggctcatagcccaccagctggttcatggagtaagtgttccaaaccaagggcattcagttaagggaaaaaacaaaatagaatccagaggaaaaggatgcacttttctatctacagatgtgtggtccttgtagctcctttagctcttttccctgaccagaagtaagtgttaggtcacatccccaaaataggcagacttcacatggataaacagctaggatccttctctgtatcattaaactcataactaatattgaccaactactctaaaatgctagacactgagtcaagactgctacaactatcactacaggtgaagatacttagagagtccaggagagtggactttgccaacacaggagctggagctcttcacccagcggagttctccaaagctgatgctctcaaaagcaaaagtgaagtgaagtgaagttgctcagtcatgtctgactctttgcaaccccgtggacagtagcctgcaccagactcctccatccatgggattcttttaggcaaaagtaatggagtgggttgccatttccttctctagggaatcttcccaacccagggatcaaaccccagtctcccacattgtagacagacactttaccatctgagccaccagggaagtaactgcctcactatttctgatcctgccaaaactataaattattcctcaggacactaaataccatgtaggtgaaatcctaacacattagcatttgagatgataataatggggaaattccatagcttctggcatcagaaatctggagctcaggtccaggcatacagacttactgtgatcttaaacagtttttttttttttttttttttaatcctttctaggccttattttcctcacacagttagggtgagaaagtgaaacagaatatgtaaaagtttgtcatatattctgatgagtcatgggaatatgagttgttgtctataaggaagaaagtgaagttagaaatagtaagtggctaggccagtcacatagctggataagttatgaaaggtttgaacagataattcaagtctcttcaaacacatttgtaaacttttctccaaaaggcatgtcaaaattaaattgaattaatgcctattagtcttaggaattttacaggtaatttgttagcactgttactggcacactgtggtaccttataaatactagatattatagttagtgtggcttcccagctgatttggtgataatgagttcacctgcccatgaagaagacacaggagattagggtttgatccctgggttgaaaagatctgctggaagaggaaatgtcaaccctactccagtattcttgcctgggaaattccatggacagaggagcctgtcacgctacagtccatgggggtcacaaagagtcagacatcacttagcaactagatacgcacgcaca

SEQ ID NO: 25331 - DNA, 717 bp, Bovine  19866880642538
gcggctttattctctagggtccactctttgggaaacaaatattaatgttccactgttcccaggtcctttattgtgctataaaaaaatgttttcgattaacctgccaattgaatctggagagctggatagtttttaagactccctcgcttcttcctgaggcaccacaggaaagactggcagattaggattgtactggaaaaggaaagagaaagtctgaggtagaggtctggtcccttggaacagtgctgaattgagtttaccaaaagtaacattaatttccatgagctgaaggctaaaatgcatgaccttgagcaaatcatttaagtacaccaaggtctttgtgtccttatctctaaaatgatggtatgagatgtaacatttttttaaattttattttatttaactttacaatattgtattggttttgccgtatatcaaaatgaatctgccacaggtatacatgtgttccccatcctgaaccctcctccctcctccctccccataccatccctttgggtcttcccaatgcaccagccccaagcacccaggatcgtgcatcgaacctggactggcgactcgtttcatatatgatattatacatatttcaatgccattctcccaaatcatcccaccctctcccacacattttttaaggcttctttaagctctaaaagtccaatgtgtacacgagacacacgatacatttttccctccccc

SEQ ID NO: 25332 - DNA, 1930 bp, Bovine  19866880678138
atacctggcctcattgtccttcaccgtcattatcctttgctctcgtgggattttaattttatggtcgtgacttatttgccaggatctctgaaaagcctggagaaggcaatggcaccccactccagtactcttgcctggaaaatcccatggatggaggagcctggtaggctgtagtccatgaggtcgctaagagtcggacacgactgagcgacttcactttcacttttcactttcatgcatcggagaagaaaatggcaacccactccagtgttcttgcctggagaatcccagggacgggggagcctggtgggcttctgtctatggggttgcacagagtcggacatgactgaagcgacttagcagcagtagcagctgaaaagacagacttgcagagatgcttttctgatagactaacactgcaggaataagttgttggttggtttttgttttttaatcagaaggcctataagtctcagtttcttataaaatcaagataatgatacttgcttatgtggttgctgaggggatctcatgagattctactgtataatagatcaagacatagaattgtccccacatttagtagattctcaaagactttagattctttgcctctctcaggcctcactgcacttccacccataatattagccatggaaatctgcatacatgtgggaaattctttggaattaatggaaaatgttaatatttctcacatgtgactaatgatagctcttcaaccaaagctaaactctaaagtccttccggagctctgtccttcgtgtacattatgacagccgctcacatcagagcatctgtcaaaaattgcagtgggacacatttggcagctacttcctccctcattcatttaatgttatcagttaaggggcaaccataatcaaagaagcgatggtataaatgaagatactgagccaaatgaaatttaacttaaaaaaaaaaaagtaaaataaagtttagttccatcactgccccatgtctgtgagatgtgattcttgcattacaggatacactctgatttgtggttcagtgtatctatcctgggtccctgaaatgtggttttagtactagaagtacagagagcctttcattaccatgggatcaactgtaactaggtcacaaagcatggacctcaaggatagttttgcaaatacaaatgtgcaaatggatttctctgttcatggtgaattagatcagtcttgcttgtagtctgccattttgttgggaaaagactttccaaaacgtccatgttctctggtctctaaaacagctactcgtttgttttgtgagtgcgtctgctcttccataggatggagccaataagggcaatgacttaaaaagcattgccacctgaagtatctgggtacattaccaggctactgagagggagaagcagtcacattagattgatttcacatcagttgtattttgcaacatagacagtagcaacaaagtgagaagagggttgttgtgtttgaagcctcagagctgtctgggataccacctagcacaggcgcctgagctgtcaggaggaagcatggtgctatgcctacttttcctttggaggtcgtgttcttcacaccaacagcacctcttagctctaattcagacattaaaacagtactgactctgcccagcctaatcaaattgcagaaggaacatggcaccaagaagcctgggcatgaaggaagtaataaatatgtttcgaggtgacagtttcaaggaacctgagtctgcacgacagagttgaaggcagacatctccagacggcaaacgctgcctgggagaagtcttggaaacctgcactgtctgaaaggaaagaacagatcacaggccgggtctggatcagaggaaaagccccagagacgtgtgatgagatgcgccttggaaacgctgggagagaataagaaat

SEQ ID NO: 25333 - DNA, 1254 bp, Bovine  19866880741519
aaatgcaaactaatacagccactatggagaagagtgtggagattccttaaaaaactggaaatagaactgccttatggaattgctgggcatacatactgaggaaaccagaagggaaagagacacgtgtaccctgatgttcgttgtagcactgtttgtaatagccaggacatggaagcaacctagatatccatcagcagatgaatggataagaaagctgtggtacatatacacaatggattttctttattttgacagaaaatatttggcataaattaaccgatgtctaaatattataacatagtatgaaaattgtcacatctacacagaaggtgacaatttgctttcttgtgtaaggtagcgtggttaagatttggtggactgaagtgaaatttggatgtgtagcagcaggttacgcctgttcccccactcctagctctcagtgtagccatctgttttcatgcattgatattcttgagggcatgtgctttggggactgagaaggaagctggaatgagggcaccctgctgtctattgggatgctttagcaaaagatgcttcaaactagggcaccagctttgctacctcattcccttgtggttcagatggtaaacaatcagccttcagtgcaggagacccaggttcaatccctaggttaggaagatcctctagagaagggaatggcaacccactccagtattcttgcctggagaatcccatggacagaggagcctgaccggctacagtccatggggttgcgaagagttgcatgtgactgaatgactaacacttttgtgaggttagggtgagcaaactgggctgcggagagaaacagtctttccctgtttcaggggatgacatggtcatgttcaggaggacctggggataagtgaggcagtgtggcagggagtcagccgtctctgaagacatcatcagctgtggtggtggagaaacgctgttcccaatgtccaggtcagtgaaccccttcaaagagccgagagagaaagggcagtgtgcattcattcctgaacaaacatgagctgaggctcaccctggggcctctgagaagtaactgagatgattgtagaccttggggtgtgggccaggggaatgaagaatgcgaatatagttttcaggtatggctgcaggcccaaaaatttgtattattaatattaatatgacctcattttatccacagactgcagagactaagaaattcaggttacacatagtgtattattttcaaagcattttcct

SEQ ID NO: 25334 - DNA, 737 bp, Bovine  19866880766407
gtaatatagaagatgaatgaaagtctatcattgcagtgccaggatgaagaagtgacagctcataatgaaaagaaaaaatagtttccattttgggcctctgtaagtaagaaagtgacagagtcctgggaactgtgaagcctgaaaaatggtccttttgacagacatgcctataagtgagagggccccggatataataccacctataatagagggaataatgattattttaggcattgcatgattttgaataaatccttgactactccccagaaaatggagttgaaaggaatctgggaagagtggtgggttaatttaagcaataaatgaccacactttttcagtcttttaagtcttagttggttaaatttatttctgtcagaaataaccaaaagccaatggtattaataaaaagaattttgcctcagtgatgagagggaaaaatgtcactctagaatcttccctcaggattttgtttccttgtgaccaaatcctttggaattaaattctagattggctatagtaattgagtgtttgtaaactaattgaaatctaaattcaggttgagtcagcaaagtaaaatactgattttttttaaattaataaaaatttcaagatgcctggaattacccaacaagctacttgcatttttcaatagctagtactccttagatgcggcctcatgtgttagcccatttgtagtgtttaaaatcacttcccctgtataatttcttcatcca

SEQ ID NO: 25335 - DNA, 974 bp, Bovine  19866880820785
gaaatatgaaccagtaccagaaaacccaagggcaatcccccaagagtagtctcatgcttgaagcaaaatccagataaacttgccctgtggcaaagtggagagaaagcatgcaagattaggctggcaaagaggatgaagtcccatgagtactccattctcccatctctcctccccatcatggtctgctatttgtatgtaagcttcaatcagaatttagagtcatggaacattttttcctggctcagaaactgcagtaaagtatcttcagttcttttcagcctgggtctgatgctgaaaacatacctgttggaagttatgaacatatcacagatgctgagcaggtgagctttaaaaaaatggggttccatctgaataatctgccaggctataggcgacaaaaagctatttctgactccagcaggaatgagtgattactttgataacaaattaaaacaagcttggaaattggaaattaccagaattaagctatctccagtgaatgactgagctcccctcttcagtacattttcttctatattaaccataaacatgagctcttcattaacagaaattggttcattgctactggccacaaggggaatctattgggtgtgtggcactaacttccaacctgatcaagaagacaacttgttcttaatgtgagtgctttcttgggaacttaaaaattctttatatcccctttggcttcttgcatatgaagccaattgtaatgttcaaattttaaatgttcgaatattttctgtatatgagatgtttatggtaccaaataatttctagatgattactgtttttaataactatctaattaccatattaatcagaaatatccttttggcttgtagaaagtatcaagggacagaggtaagaaacaaagatattcccgttgcaaaccacttgcaagaaacttccaagcttcctgttcacaaagtatggaagtgttgctgaatggaagg

SEQ ID NO: 25336 - DNA, 752 bp, Bovine  19866880834254
ctgcattggaggcagacgcttttaccttttgaagcccccagggaagtccaaacaaggtcttaacttcacctaagtcttttcagattataaaagtatatatatgcatagttgtttcttaactaatctctgagggaatatgttttccttcgaaattcacattcttacatatgcatttgctaagtattgatcctagtaaatcacatgcacactcaagttttgatgatgaacatgtgtttctttgtccctcagcatttattataaggatgcattttgctaattgattttatgctaattttagtgctttcctagtaatcattatggattatagaaccaattttttacaaaatggaggtagacatgttaacagaagttcttcctgcattaaagaaatattcttaaaaacgactgaaaaattgccagatacaggtgctatgttgacatgccgaaaggcttattttattccatcatgccatttgctaggaagggttgagattaaacactgtaatgtttgttgcctagcaacacccacctactagtggtggaaattttccactgaaaaccacttttatttgggtcattgtctttgaaattgcatcatcagaggtctttttcccttcaaaatcatcttatagggctttctagtcttgtctgtgcaaaaagatggagaccacttagtttgggtcacttcatgctctaaaactatgcctttcaatggaaatactctcatattgcagcccatttctttctagttt

SEQ ID NO: 25337 - DNA, 955 bp, Bovine  19866880836532
tgtttctaaaactatggagatagagggcatgcaggaatcatatgaaattttagcttcatactgcatagaggggctcaggggcacttcccccagggggccaaaagcagccttgcttgatctacttagccacgcttatacagcttgctaagatcaccatgaggattagaaccatgatgtgtaaccaggatttcctctggagaaaaatgacagctgcaacagagatggagggtgagaggagacaaggaatagaaggttatcagggatgtggcaggaattaaagaggaagagggaaggaagggagaggacatatttgtctcaaagacttcccttctcaagttagtcatctttgtctaactcttggaagtgccaagttttaaatcaaagtagaagagtaagatggagaaggcaatggcaccccactccagtactcctgcctggaaaatcccatggacggaggagcctggaaggctgcagtccatggggtcgctgagggtcagacacgactgagtgacttcactttcacttttcactttcatgcattggagaaggaaatggcaacccactctagtgttcttgtctggagaatcccagggacggggaagccttgtgggctgccgtctatggggtcacacagagttggacacgactgaagtgacttagcaaagcaaagaggagtaagatagttaaaggagataaagctaattgtccctaaaaccacaacttcaggacacgtgttctgaatatatacagaaacacaaacaatcccaaaccacagttccctcattgtcactgagtagcttccagggatgataatgaagaattgtctcctctttattgctttggctgatgcttgagtctgtggcgccaagaatctggatctcccagagccaggcagtagaaaaacaatacattagccttaaataatgggatctctgatgcccggattgccacagag

SEQ ID NO: 25338 - DNA, 1880 bp, Bovine  19866880849543
ttcaatattatcctcatagtaggtaaaacttatcctatgtgtaagaccagtctttttaatctgtttgtgaaatattctagaacaattttaacctctattgattcagggtaaggcactcttctgatctacccagaagctcagaagactgtgatagattttttttagctcttttttttcaatcccccaattcaaatcctgatctggtatatatgtgcctctgctccacatacccatcagcaaatcctataactcataaaaaattataattcaagactaacatttttcttcatgtatctattcctatccaatcctacattccttccttgtcatacatgcataatccatagcctatagctgagtctttcacttgattgactctatatactagtctagttagtttgtctatgttttattttctatcacaaccgtaagttctgcagtgaattaaaatagattgaggtcattatttctgtttatttccaacacaaattaaatataaaggagattcctaaatgagataatatatgaaaactgcctaggagtggctagcacatttacccctccctcctttttctttaaagagcactgtaagtggaaatgtaactttttgataggcaaatcctaatgtacatgtttagtacagttaagaactacatttgctttacaatcctatttataaacaggaaccaaacagatggctgagtgtctgggctcgagcatatctctctttccctgaaataagaggccctttcatttaagaagagaagctcctgggagtctagtttcatgagtaggctagtccaagtgtgcaaactcaagaagtttctggaatgtagactaagatcatcaactgtcctcatttaggccaccatcacctttgagatcaagggagcctgtataaatataatttactactgtaggtctgctcagaaggcacctggcaggacaacctaattaagtatttaccccagagaccaggctagttctttctggctcattatgctttctcaactaaaattaatttatgtaaataaatagaaatgtgtgtgtgtgtgtgtacacaagtttatataaatatttagaacctttatttggacagtgtttgacttaataactgaataaactatttgttttattgatgaatatcagtttatcttgaacatatgttcttgtctctataccagtttgctcatgactggtctgggacagaagaattgcaggagcctctagcaagtagaccttcaacatctgggttgactttactttcctcactttatggctttcctcacttatagacacaaatctaacactcagcagttctactgacacatgagcaggtaaaggagagaagagtgcatggttggagtcttatagtgcaaagactcagttttaaaatgggaatagattaaaaaaagataacttttttttaattaaattaaaattctttctagagtaagaactgtttgatgatacaaacaattatgtcaatattttaaatgatttaaagaaataatatatatacaatataatgggcttcccttgtagctcagctggtaaagaatccacctgcaatgcaggagacactggtttgattcctgagtagggaaaatccccttgagaagggataggctactcactccagtattcttgggcttccctggtggttcagatggtaaagaatccatccgaaatgctggagatgtgggtttgatctctgggttgggaagaaagaagccctagaggaggccatggcaacccactccaagtatttctgcatggagaatccccatagaccaaagagcctggcgggttacagtccatggggtcgcaaagagtcggacacaactaagcacagcacaacacacaatgtaatatctttt

SEQ ID NO: 25339 - DNA, 1229 bp, Bovine  19866880903769
tcctctgctgcgccgtttttctttttcctttcatctttcccagtatcagggtctttccgaacaagtcagctcttcgcatcaggtggccaaagtattggaacttcagcttcagaatcaatcctgccaatgaatgtcttaggcacttgaaaattcttaagttctttgaaattttattacagaaagttatgtttaattggagttttatgttaaatatattatatttttaataataggaaagcgatgtatagtatgcagaatactgtcagttgtgaagaaatattgcttaaacataccatgaacatccccatccaacttaaagacgttgggtacctcagtacttaatgccctcccttcccttttacttcccccacctctttttttttcccattatatctttcttatatgtcattgtggtcattaatgagaaattcatgttagcagtgtatataataaaaaaaaatgaaagtaaaccactttcttttcattttagcattttcttcaaactagggatgctgaccatttcaaaaacctatagataggtgctgacattttatgtttgtgcccttaccataaaccttaaccaaatcctttagattatttcaggagaatctttcttctcagctaatcctggacacatttagagatctatgaagaaataaattgttctcctcctgatctactgtggcatacttcccgttgttaggtgaataattgagcaatttattttaatcaggagctctttgcagagggggtgctggagagggttaattgctagggtaaaacaactacaggagttcagtttactggggtgctaattgggtaacaggtgagcataaatagtgtggagaagcaggaaattagaacatgggagggacaatgtagattttaagctccacagccctgtaaatgtacttaagtcatcagtgctgcaaactgagtagtaaagtgttttcccttcagacatttcagcctgcagtgctatcaatgggattggcttgggagagaaagggagatggatttactgttgagtaaatgacctcggctgtagcaaacagttttcctttaggctttctgcatcgatgttgtgtgttgaggaaaaaggcaagtgctagtgaagctgggctaattcctagttatgctatgaccagtgactctcttgtaactgtatgtgatatagtttgattattttgtatttagtgtcatacttttggacatctatgagggataaa

SEQ ID NO: 25340 - DNA, 967 bp, Bovine  19866881052014
acttgaatattaataaagtgagtggtgaagtagtttctttttcaagctttgaaagtagtatattactccacttggctgaaaatgttatggaaaatttcgattactagctcatgtcaggaagctttctattaatcatactaaaatatatatatatctagcaatttctagtgggttctgggcccttgcttgaacttagaggtataaagatacctaaaccatggcttctagtcaataagtctgattattagtaaaatatggagcataaaggaaacaaaaagatttcctagttgaatatgccacagaatctgaaaagatcatagtctgttgtggaaaaatttgaccacttgtagatgagtggctggaggagagtttgagaattaaggaggggccacgccattcagcacttgataaatcaaactggaagattggataatttgttgtatggccaacaaaaaattaaccttggatgaaaggattgcctgtgccctttagaaagtttgtgactgtccataaatccaaggaaaagaggaagaattcaggctacagtataccccacatgtaaaatatactgatatctaatactggatgttgcattattctactgagggctttttatttatttatttacatttaacaatttcaataacagacttggaggatgcatcctagttggcaaatcactaatttttctttttcattgccaacatcattgtgcctctaggaaaggtgactgatcttcaggtgggataaaatatcttgcatgtactcttcatttgatttctgatttacatagtaactctgttcagcaaggaacaccttgcatagtttcttggtgctgacttggattttatttacagctgccctaaattgtgttatcatgacataccggttgttcagtattcaacgttgttcctctgtaacttaatatgatttatttctgacttgggttttctttatcaaatactga

SEQ ID NO: 25341 - DNA, 2184 bp, Bovine  19866881099968
ttcacttctttccctgttggctgccttattgcatctctcagctttccaaatttccaggataagatgaaacaaacatacatcagaaaaacataaattcacctatatctacctggaggaaagcccttcttcccccttataggcaccacccaagccaaggggtggatttttgtctactggctgtgaaaactgaaattagaatcaaaagccctctgggacttccccagtggtccagtggttaagaatctgctggttcaatccctggttcaggaagatcccacatgccttgaaggaattaagcccatgtgccacaactacagagcctgtgctctaaagcctgtgactacaactactgagtctacaccctgcagctactgaagcctgcacaggtagagtctgtgctccacaacaagagaaaccactgcaatgagatgcctgtgcaccacagtggagagcagccccccactcactgcaactatagaaagccctcatgcagcaacaaggacccacaacagcattgataaataaatcgtaaaaaaaaaaaaaaaaagaatccctctatgatctaaatatagtcaaaatctaagtaaataatacacaattttttctgcaaatattgacatctaataatcactggccacatcaaaaatatagactaaaaacagtgagtgaatgttagtatccatagtacctagggggattgtggttcatgatttaaatttatggcttaaattagtaactttgtattttatgattagactaaggacactagcatctgtaaggctatacactattacttagtatctacaatgttcaagttccataaaaatagcttttaattttgctctttttttttgccctgacagcctttgaaaatattatatcatatttcaagacattgcacttaaaacttcttaaagttcataacacttgggcatggggatgtgactcttgaaatatttctttccattaccccattttccagaactacttcacatctctactccttaagattccttttcagtacacagtaaaaggacattcttgaacttgtccacagctatttctaatttgtctgatcttcatcagtcagtttaaaggaggataaaatgtcatctgcctcatccatcactaagtgtgtgtgttaatgtatttatctgattcacttcccctgactcgtctaagctacatgcagtctgaatctttcccatctcctaatttatttcagtcactcttcaagtgtgctggagctgatttctcaggtagactcgtctgaaaagatgccatgctctagcagttctatgagcaattatcatcttaatagcctgcaagcccagctttgtatattcactgttggtttactgccagacagaggtccctttcaccataagccctaatttaggactttcaggtgccttctccatggggaaatggttttttgactcctttgggttgcctggagatggttaaagatgctgtaccagtgtacgaggccagtatggacgctcataatgacatctgatggtcatgtggccaccattgctattattgaaaaatttagctcaacctcctcttgcagatgacatggtagaatagtgtggtcagggctattttgttctcagagctgtgtcaggagacttttcttctttgtcgccaccaccatcactatcatgattgcttcagaatctaacatcgtcatgattacttctgaatctaaatgctgattatgttaggtcttatgcatattaagaagtagagtgatataataagataaatgttaacataggtagcaggtgctgtcttcaggtgaagaatataggtagtaagtgtcacaggattccagaacaggaaggttataatcagaagacacaccaagattatgaggaagctggtggaacgtgaattaaggcatgtgtatctgggcaatgatgtgaccatcactgtgtgctgggaataatcaggcaaatcactgacgtgaagtacttatagagaaggacattgaaagttaacactgtataagtgaaaattcaggtcaggaagactttaaattgagcagtactaactttgatttcaggctagaaaaaattaagaaacagacattcaaaacaggcacctcgtcctggcactaataacttcttgatatgaaagattaccagcaggtgcttcatcccgtctttcattcatcca

SEQ ID NO: 25342 - DNA, 1378 bp, Bovine  19866881102459
tgggcagtaagacaaagaaacaatcaaaaaatgtctccctctttttttgtattcattagcaaatacatcaataaatagatccacccaatcaattaatcaatctatccttattgcttttctaattaaaagttaattttgatttacttatgtatctatcactattatttaggcaggaggcgtatgaaagaaatttaaaatattgaccagaaatgtgagatgtggcagctggcttggaaataaatcaattaaagcttcataactatgtagccagtggcacctgtcctaagccacagtaatcctctggatgtcaaagtgggagactggaagaaatagttgttacaacttgctacaggagttttctttcattggttggccagaaaatactctctgatactaatgattataaagtgtttgagaaaacagggaagtacaagagaggtctgagacacagcaaagctgattcagacccatgatctggagtctgggcttgggataatctacagagtacagacatgattttgctcaaatgtcatattgacaatttggggattcatcacctggggaggtcattagatgttccctttactgtgctattctcttttagacatgcagtgggtgaccagctttacagaacagagatgcttggtcatattgttgagatacaggcctgggaacaggagctatagctcaccttttgaccaccaaggttggtaattgcttccagaggggcctgttcttctccggtgagttggaaggcagcaacacagttactcatcaaccatctgtattctaaggtgagcgaaccatgctgtccatacccagtgtccagcattttggatgacagatgaaccctcttatctggaagtgatttagcaggtaggatacaaggtggaaatcaaagctagcccaaacccagattcctgaatgataacagcctgaagggccattttggcattctaatgtttcctgccagatgctgtgcggtattacacgatgtctcagcctgtgctctaccacatgccagctgatgtgttgcgtgttgtggggggtggggagggggctggacagtatgagacaggatcaggttccaaacacaaatttcctagattgcctagctggtgtgaatagagcaaagataaaactacctgtgattcattcatatattctttcattcactccttcatttaggttggtatctttgttttactggaatttgcagtgctgaatttcaagttaaaaaagtaatataaatgaaagaatcaatagccaacttctattgttctaatcatcatgtactgtcctatgtactcttatttttaatctttgacattatttctatttaacatgtaaagattcattactaaggggaatgtttatt

SEQ ID NO: 25343 - DNA, 973 bp, Bovine  19866881163477
atgacctcttctacgtctcactgagcactgtgaatgaagacagacgtcgttatctcagtgattacgagaaattctaaatgtagggagattaagctgcctgagattgtccagctaataagaagtacaccctggatgtgaatggagttcctttaacttctaaatccagatctatttaaagaatacttagtgatataaaaagtatataattagttattagtattaggactactaattgtgtggtactgactagagtgatgaggagttcagaggagcaactgatggtgaactccatcaatcagcgatgcttggtcgtaggatgactcagagaaaagaaaaggaaatgttcacttgcaaagagagtcagacttcagaacagcttactaaattaaaacaaaacaagtattttaaagataaaacaacatgaaaaattagcggtaatcaccacatttaccttggagtgatgttgaagaaacagaactcacctcatataatcatcatattcacaaagatatgcacttacctttacacatcagcatagggaaagcaggttttctttttcttttatcttgctatagagtcacatttatggaaaatctcaaagacttcttttattttgaccataactggatacctttttttcccctgactatggtatgtgaaatgctaggccaaacagggtgcagggagacataaccagtttttgcttccattttcactcacttcatgagtgagattttatgtttttcctggacttttaatatttataaatgaaattcaaactccaaaagcattcaatttaagattcttcttgggctcagaacttgctccatatacctcaaattataccactgatatcttgactaataatttgagcaccaattcccatggctggtttcagcatttactatcaagcagccatgttcttttcaagggcaaattagcattcagttaattcagtgttttatttattcaa

SEQ ID NO: 25344 - DNA, 1968 bp, Bovine  19866881234920
accttgactatgcagatgacaccaccataatggcaaaaagcgaagaaagagcctcttgatgaaagtggaaaaggagaataaaaaactaggcttaaaactcaacttccaaaatgtaaagttcatggcatccagtttcatcacttcatggcaaacagatagggaaataatggaaacagtgacagactttattttcctgggctcccaaatcactgtgaatggtgaccgcagccatgtaattagagacacttacttcttgaaagaaaagtcatgacaattctagacggcatattaaaaagctgagacatcagtttgccaacaaaggtctgtatagtcaaagcaatggtttttctagtagtcatgtacagatgtgagagttgggccataaagaaggatgaacactgaagaattagtgcttttgaactgtggtgctggagaagcctcttgagagtcactaggaaagcaagcagatcaaatcagtcaatcctaaaggaaatcaacactgaaaatttattggaaggactgatgctgaagctgaagctccaatactttggccacctgatgcaaagagcctacacattaaaaaatgatcctgatgctgcgaaagagggtgacagaggatgacatggttggatggcatcatcaactcagtgtacacgagtctgagcaaactccaggaaatagtgaagaacagggtagcctagcatgctgcagtccacagggtcacaaagagtcggacacgactgatagagtgaaaaacagcaacaacataaagacctatctccaaatagttatatttggaggtatctgggcttagaatttaaacatagatttttggggaacatatttcaactcatgacaggaaagaatagcataaataagtattctgcagcaaaaacatacaaaaaaaaaaaaaagaacaacagataaaaagcacctactctatgtaaaattaccaccaaaatgatattaaaatacacaaagtagataagaaaaatagagatagatgccaaagtgtcttgcaaagcaagttgattggtctgtcttctgagtgcagtaggtaataaagaccactataaaggaataatcttgggggggaaagagaaaatgtgagggattaggtgtcagagaaatgtttggatgaatgtgcagggatgaggacctagagcattattgatagaagagaaattaacagtgagcaacagccatgagaagactgcaaattacaaaagccaggatttagtgatagcatatgctgggaacgtgggaaagaagtgtcataaatgacactgaggaaatggacaaggctatatccaggtttagccatggaaatttgagaaagaagtgaaagggagacacttccactttgagtatcaaaatcttttttttttttttacttaaagaaaatttaagggttattttcttaaagtcatgatattgtgtattgtacaaattgaattgaggtaattctaagatatctgaagagaggttcctgatggagagaaaagatttgaggtcacatggaaattattcacaaaagagtgattgatatagtaaagattaacagcaggatgatggtaattatttagacgctgccataataatagcacttattgaatgaatgcccaccgggtgtcagaaattttatatatatattgtctcatctaatcttcacaattactcttgaagatagatatattatttcttctttacagatgagaaatctgaagttttgaaacattaaggaatttgcaagggatcatatagcatgtaagagttgggggagccagtcttcaaatccatccctgtctgacttgaacatttatgtgcttcaactctactttacttgaggataattacttcatctaaggataatgaattcctttcacaggacagagtattaggaatcacacaggaaataaaacttagctgttttctacaggtgggggaaattacattccctcctcttta

SEQ ID NO: 25345 - DNA, 734 bp, Bovine  19866881245572
tggctgctgtctaaaagacagaatgccagattttttaatatctcttgaaagcagctctcccagtatgccgcttatctcttcagatatgtaatttaataataggttccttcttttttatccctctcactgaaatgatacctatagaacatcattaatacctcacatttatacggtactctgagttcttcaaagagctcgttcatctattatcatgctgtgctttatttcatacaacatcccagtgagtgggtagaacaggctattgttattctcattcagagatacagaagtacaggtaaagaaaggtgaaatgatttcctgaaagctatgcaaatgattagtaaatctggaacaaaaattccacttctctgactcccaatgtcactctcttttctttatctgcctcttcaaacctgtaatgtagtttgctcatcttcagcatttaaattccaatctgaggctgagtggtgtggcggttaccaccccagagactgttgctttcccattgagttaccctccctcatttatcatcttactgtggcactgactgtggctctagactcacatgtgggaagaccttttaaacctgccataaatcagatatattttaccttgctgttgtctgtggtctctgaaaaatctattatttatttaagacatttttcttaggcaagccaaagtctcttctcactatgatgaaaacattaagctctattcaatgacatctgattttt

SEQ ID NO: 25346 - DNA, 1382 bp, Bovine  19866881251921
cgtgactgttattaagtagttataaagacatgagaatgctatgaaaatagttgcctgtgcagagaaaattcaagtactgttctatggaactttctgtaattttttttcaaaattattttcaataatctgtgaatgtggaatcacagatatggagggacaattgcacatataatatttttgtataaaatatctcatatgcctagcacccttttttctcattacaacattagtcctaggatttattttgctatgaaatggttgagtgtaagtgctttctgtacatcttttacttttctaaatctttcttcacagcagttgttaactgtgatactcttcacatctatctaagataaatttggaaaatgttaccaaacctttggaaataaatgtcttaagcccagagatgcttgaaaatcacacagaattttgggctggaagtagagaagaaagctgacctccagaaccagacatcttttcgtgtcaccatattatctcttgtcttgaggggttgctgtgtacactgttgaaataactgcctaataacgtttaaaaataaagagaaattaaattttctcctgtgagttttgttcttcagtcatatgttttatcccgggatagcaaattgtttacaagcaattacagtaattaagcataaatacaccccagtgaggcaaatattattatccaccttttaacagatgggaaaacagaagtggagagaacaggaatgacctgcacaaggccaaagagggtgtctgccagacacaggaagggcctgaaacctcaggcactccacgtttgtcctccaacttctggatgatccacactctttaaagaaagtttgacttgtaaaaaattggaaaagagaggatgaaggtggttgatgacagtgctggggaaagagctgctagatgtaacagcacaaaaaagagatggtttgagagatgcaaagtgacatagcctgattcctcagaggcatttggggcaaggtccaggctcatcccgcggcagcccagggttagcagaaaaggtcataagtgaaatgtgagtttctcttcttagaaatatatggtcaagctttttccagttctgcatctttagaatgagcctgtgcccctaaaatgaatattactggaaccacagaatgagatgacatgcttgtgatgaagatacagctgccctttctgaagggctttgggatttgtgggtcaaatgtatggttgcattagtattaggaaaattacatccaagggaaaatgctgaaagacaaggaggctaacgtctcatgctgtgtctttctgctcgttatcacatttgataaacagtttgaattcaagcagaaagcgtgtggccaaacagagtaagacagaaatgaaacaatg

SEQ ID NO: 25347 - DNA, 712 bp, Bovine  19866881258349
taagcttcaattgaagtcacatccctctccccagtctgacatcatctttttcttaatacaactgtttttttatggtatttttttctttttttccatatctctcatttaggaaaacaaacaaagactaattgtatgtgagtgtgtcgtttggttatggtggtgaggtgggtctcatttctaaacaatgagagcgaagtgggtcacggggaagacaggagctatatctacaggactgaagatcagcaaaccaacaggaagcagacaggagaatgtgaggtaaaaaatggggcactggagaaatattcttgtcccctgttctgtcccggaattgtttgcatgttgacctcaagaatgcacacagttcacccactgattagcagtaaactccattcaggaaattctccttattcccagcatcccgtgaaatgctagttctctttgtacggtttgttcttgctgaatgagtatggaagatctctcagggcatctcttcaccatcttttcagagttgcattgttcccagcacaatgcaatctttccttgcttttgtccattccagcttttcattttgagagcagaagctgcttcactttgttggacagattgtctctgactaatacgtctcagcatcaggatcagcttctttgtactcacccagaattttaggctttatttttccaaaacgaatgtatcaagatgactttctccagtg

SEQ ID NO: 25348 - DNA, 820 bp, Bovine  19866881310586
cagttaataggataagagggctgggaaatgaagatgaactttttaaatggcctgtaaaaagacagtgttatataattactaagcaaagaacctcaaactcaagctgtactaaatattctaattcttattgatagatctgaaaagtaaattataactgcaatttgaataattgaagttttaaaagcctgatatctaggtttaacattttttaagagtttaaatactcctggaatagtttttgtggagttaacttttaatgattttacatcattttttgaacatgcctaatttttgtttgaggaaaaattgagtgtaagaaaaggaaacaactcaatagtcttccgtttagttcttactttgtataacttgaatttcttagacttagtagggaacaggaagatagtgaatgtattgaaatatactctttcccccatcttcctcattgtcttctctttcccatctctaaatttccccaattaatttttattaatgtgtagtaactttctgttagaattgctttgtgaaaataataaaaggccagactcttgggcattttattaccctttggttgtctgtgagccaaccttttaataattgtgggtgttacttggtctccatttttcagctccatttttcagcttgtcatattttaagagttttatggctaggatgcatatccacctggggttttggatgtgactactaagttgtagtgtttgatttatatttgagttcatgtctttagataaaagcgtccatctccactgtcttcattttagcagctctgcttgttgcctttggaatgtgctttagtttctgt

SEQ ID NO: 25349 - DNA, 1020 bp, Bovine  19866881344264
ctaatctggttttaatcttctttcgggggagggtttgaatgtacgatgctgatttttctgcctttttttttttcctcccctaagcgcccctcactgaccaaaccatgtgttaaaaacagtttccctcctggaagggattatgccctttgactttcacagccgtctctcccttcctgacatcaaggaggcgggatggcggcgtgcgcgctggtgcggagcgcggcgggcgtctgcggtcgcggcggatgtctcactcggcggccgcgcgcggggacgccttgtttcttccacacctttacctcggccggtgtaggcttatttatttgtaagcatccagggtatgtatgcgcccgtgtaaataaataagtttaaatacaatttccaaatgaacaacatgagaaaaatggtcgatttgtgagcgtgtcaaataatgagttgcaaacacagcgtctgcggccgccgcggcccagcccgtggccgaggccgccctgccatctagcgggacgcgcaggaactccgctcacggcctcgcgcggcctcacttaccctcgcaaatgggcccggccgggccgattctcctaaacgcgttaacttagccgtgctatatcctaggaacaagttaatatacgattcctctctgtcttaaggtcattactgtcgaagcataaattaatagagcgactccagttaattccttttggcgtttgcttccgcaagtctaagcgcagacgtgaaaacagccgcccctcaaagttgtggaggggaggaaggaaagaggccgaaaaggagctcagctggaagaacaggctccctgacctaaaagcccgatggaagacgcgccctttagagacccaacataattccccccacagtcaagctaaaataggagggggagtgcagagggtgggcttcttcggggggcaccgtcgtcacaaggcaacgttgtgaacatacagggttcagttttctatgcaagaggagtaagggcaatcagggctcctctttacgagcaagaagggc

SEQ ID NO: 25350 - DNA, 1215 bp, Bovine  19866881357919
gttgtgagtgagaaaaggtacaatcttattaagaacatgaaatatttatcgaaattatttacacagtcacttaacatttgacttgataaccctgcatctggaatttacactttaggcacacctgtatatatgtttgaaatgacatgtggacaaagttatcctgtcaagtccagcctcaacagcagtttcccaaaagtgcagtgtggtgaaagaatgagaaaccctcagtgcagttacagaggggatcaggggaccaataccaccacgaggtgaaggtgcccacactgatctcaagtctgctttattatactttttgagacttgctggttcatgtttgcaggagcatagcaggccaggtggccttcaatgataatcctgtgcaattaacatttaacatttttgtacccctatttttctgcgtcagggacaaagacccagttaatctttaggtgcctctcaggtgccaaagacaggaacaatctgttgatggctttctatctccagacatacatcctgctttcaagatattttttgttctttcttggattccttcaggagtcacatactgagccatgtcctctcagcaagattgtttaattcttttgtcaggccttttattaggcctgtttcctacattatccttttggccttctttgcaaaattttaacatgtgggaaatattgcaagtatctctatacaatgatatactccatagttgaataaaagaactaagtaggcttctttttatagatacagaaatgttgccagcatattttggcaagtgaagaaactgaagttcaggacagtttatagtatgccaccatttgtataaaaaaagagatgtaataaagtgaacttttaaatgttctcttatatacatgaggaaaccatgtatatgaaaagcatagataataacaggaatgagataaagatttcttaatcattgccttattatatttttattaatctaaaagaattcatttcctattaaaataaaattaaatttaaaataaaagagaaaatattatggaggtcatcccttttggcttctactcagaaaagaaacaaaagtagtgaataattaatgttaaggaactgttattaaagaaaactcaaacttcacttcggagtaatagatttagaattatagctatgcctctgtcagttacaactgggtcagtatattgcattcatcgacttttgcgttcagctcta

SEQ ID NO: 25351 - DNA, 1639 bp, Bovine  19866881462949
tagggttaaagacagcctctgttatgtggaggcaggttaggagttagagagggaaccatctccaaactgagctggacacacacatgaatagaccatatcttgtaaaaaaaacaacttaattcatgaaaatatctgtgtgtgtttgcatttcattattatagatcctttgcacttttcaaataatttaccttttatcagtttttgtatagaatactaaaggaaggccgtgtaacattttaggggatagagcatcacagagagaagagcaaacactagaagacaatgattttgtcataactcactgatgctcctagaaaaaaaggaatatttccaggttgcaggaggggcagatcatgcattttgtcactacaagctgacttccgcacaagcatcttagattacaacgtttataactttttctctttgcacttagaaagcattttcttcaaaaagtagtctggtggaagaatgcagtctttggagctaaaaatcttcatatacccaaagagaataggccatttttaaaacttctaagaactcactatgacaagactatcaggcagggatgtccaaaatgtccctacacacacacacacacacacacacacacacacacactctcacacacacacaaagagacaatggagaaatgagagaatttttgacatcatttagggtccaatctgcccattagaaggctaagttcatatacattatcagtctcctctaagtgaaaaatctcctttacattttcttgcctagtattatgtcatcatcaggggtagcccaggaaacttgagcagacaagtttgaaggaggttggcaggatgaatgctgaatgatatttatatatattgctttggaagagtcaagagccagccttgtgtattacaaagaattcatttcctatgctttatattagcaaatctgtccccatttttctctctcattgtattatattgttcacttcccaattaaagcttaattcataataataaggtcatatttgcaagagtatataactctgagaaatgtaaattggtctaaattgtttgtttttcatctagtatctcattgaaagaagaataatagatggtaaaagagaaaactcagatattcctgaaagaaaagctatatgccacagtaagggtatcaggctaggtgatggcagatcctaggaatgtggtccacagggtgtctcagtatgctcaggtgaaggtacgtgctctgactcacacagagtgagtgaatcatagaatgagaaatgaacacattttcaataggtttcccatatttttctacatttgcctttttttgtcccccttttttttacaagggtggtgtttaaaaaaaattaacaaggatttaaatttcttataagtttgggaaatgagaaatgtaaattggtctaaattgtttgttttcctactagcatcttattgaaagaagaaaaataaatggtaaaagagaaaaatcagatattcttgaaagaaaagccacagtgccacagtaagggtatcaggctaggcgatggcagatcctaggaacgtgtcatcccaaggaaaggggcggaatgaaatctctgccatacttccctgtgtactgccttccaccagccagagagcacaaaggatccagg

SEQ ID NO: 25352 - DNA, 1263 bp, Bovine  19866881464498
atatgatttgccaatattttattccattttgtaggttgtcttttcattttcttgatggtgtcttttgaaatgcaaaatattttaatttaatgaaatctaaatttatttctttttcttttgtctttgtgcttgtttctgaactctcacatctgttccattgatctatatgtttatctttatgccagtacttactatagctttctattatttctcctcaaatgtaaactgattttcccttgtaaaaagatttttattatttatttatctatttgttgctatgtgtaggctttctctagttgttgcaagtggaggctcttctctagctgcagtatacaggcttcttttgtgggcttctcttgtagcagagcacaggctccagggtcacgctccatagttgtggtgcctgagctttgttgacccattgtatgtgggatcttcctggaagggatcaaacctgtgtcccctgcactggtgggcagattcttcacccctaaaccactagagaagtgctcattttccctttctgtgccagagaacaacttggatagcctgcccaatcattataagtctgtcttatcactttttgagttatgtaatatctcagctggaagggaacttggtgattagctggtccagttatttcattttacagatggtgactctaagatccagagtttagagtttatatatgcaattgtgtgggcctttctgcacacatggtacaaagttcaagaaatcttatccatttgtcatttctgtttcaggttttttgaaagaaatcaaatatcatggactttatacttctatttttctcatttccttcccaggatcaagtagcattctgaatctactatgtaccatttcatgcttttgtacttttccaggaccaatataaagccagtttattatgttcattatttattaacatccttttttcattttaacattgtttttaaggtttgttcatgttgatacatatagctttgattctttaattttaaatattctaacatagtccatttaatgattatatatccattttcatatatccattctcctgttgagagacatttaggttttctccatttatttgttctgttataagcaatgtttgcacatattgtcctcctgatcaggtgtgagcatgtctcccagtggagcaatgccacaggagagcagcagaggacctacagtctttaaaccacatattgcaaattgctctctaaagtgcttctcatagctcctttttttcatatcctcaat

SEQ ID NO: 25353 - DNA, 1501 bp, Bovine  19866881490815
cagatattgtttgtaactcatttggcaattaatcatgaactatctgtgacatttcacctcttgttatctgaaattgttatttaagtctatgaatccgcttgccttatccctcagggctctgcttctcggtttccaaggtgatagctagctaggagggagattaactcatgctcagccattagttactaccatatcaagacaactctgagtaatgccatgcattttaaacctagaactattcaggcttcttttagaaggagaaaaaaaaaattcaggcccaaagtattaacctagataattttaaattataacattaattaaataagtatgtagaccatttgagtgtgccagacatgttcctttattttatgtacttaattcagattgaatagtcctgccaggtcagcagaaaattgaatctcagtcttataagggctccttgcagcccagctgacacatattctaaaggctgtataaagatattgcaagggtcttaggaggtgacaaagcatgtacgccatcagccatgttagtaaccagtgagatggcctcatccaagttcttaggggatcttagagtctactgctctgctccctctagaccatgtttggtgggcaaaaattggactccagatccatagcatctaattgtccaaggtatgccaagcagtcatttacgccatttcccaagcctcgtcctgagaagggataagatgtgaatcccattacttgagagactctcagagccttatcaccccccagacttggaaaaattatttactctataccttcctctaaccctgatgagaagctttgccccttcctaccctgctggtgtactcagcataaataggtgaggtctttttttttcttttttttttttaatgcatgtttttattttattttttatttatttatttttttaatttaattttatttttaaactttacatttgcaaaactaataggtgaggtctttacaaaaatccctttgtgatgtggttttctagtagctccacttgtggccccacaaatgctcctgatgagaatacaaagcacctgattaaccgctggaacagaagagtaggtcacgcagactgcaaacatctcgataaattctctacctcttgtatagttataaaagtagacgtaaggtttttaatgtctccagttcttagcacaatgagaagcataataaagttattaattaaatagaaacaaatatgcaacctaataaaacttaatgatacaactcatatgtgatgatgatatttgaagaaaaattgttctaggcattactatggctctgactgccaaggcacagcccttttgaagccatcataagtgtactattatgtgttatatgatgatgactcaatttgcctacggttcttttgtttcagctattgtgaccttttttcatacaaatgagtgtgatgctattcagaatttgcattgtgccaaaattactatttacataataaatatgttgtactttttcca

SEQ ID NO: 25354 - DNA, 590 bp, Bovine  19866881658052
aataaggaagctggactaggtccctgcacttcactgtagtgatattgggttggctgcagggctaaggggattagggtgtcatttatggggccaaaaaacaataagttacattctagttcctgctgatgcatgtttttcctttctctaatcttactgcttttaaacttaagctgcatcagactccaaaaaccctccttccattctactcttagtccttattaagagaaaacacaagaatgttgtccagctcagcacactgccagtcatcacagtattgaaggaaaacatcccaggagctaatgaaaaacacattcactctaaattctcctatgaaaatgtggtaaattgttgcaattattggttccatcctaaataatacctcttgcagtgacagctaatacttgtgcttcaggtcataaaatgatcatgagtcaaaatgaccaaaatttgaattatagctatattttcttctaaagacactgactgttgtctctattagaatcagatggcaagctgagccagtaaatgtaaaataatttacttaatgaaattcttagtagcaaccacatgtgccatattagaagacccag

SEQ ID NO: 25355 - DNA, 1800 bp, Bovine  19866881676041
ctctgtatttcaggtgctttactgagctcagatggagttatccctgcagagacccagaatgtgtttccgctctgcaggacagaggatcaatgcatcatataggctcttttggaagtgttccataacccaaattcctgtatgtcaattcaggtacacatccagctgggtaagcagtttactaagtgatgcttgaagaggtctgatagtaaccctcctcactcccttggcaaaggcatggaatggcttcctgcccttttatttctacctccctcaattacagtcctgcttatacatgtgtctctctttcaaaattctaagtattcactttgacatgatttttctggatacagatataaggggtgaacagaatttactttgatttcatgcccttcttagagtatattcattcagctatataacaaatatttattgaacatctagcatctgtcaggcaaacaattgcatcatgatttagtttcaaattaattgaaagctaaagagataattttttcttggctgaacatttatgcatttttatttgtatcatgtggatggaaaagataaatttcaaaccttgtgttaactgtgaaatatatgaacgaagtacatgttcataccattattcagaagactaaacattagcctctttagctaagtgctggctttgacaatggactttgggacatgaaaatgtgtttgtatggtcacttatggttgaattcacactcttgcattttgtatttcacccagaaaaaccaatttggcaaatactgacatgcattagtagcactattttaacaagatcacaaatgttagttaaatatctaaatttcactgtagaggtacagattgccattttttaatgctgtaggtagtagagatagttgttgattaacagcaaaaccccactctccctctctctctttccaccccaccccatacaccatttgcttattattttcccacagatagctagaggaaggatatttgccgtcaagatagctgggcattcagcagctcagcaaggcagtttgtgtgatgcctgtgattccatttgtcacaggagcctttatgagggaacagaagatataactttgcctcatttttcatttcctgttatcgctcagatttcagtcttcagctgctctgttttcctgtacctctactggagccgacattatcagagagccacctgctacccccagtgccgctgaggccctgtcagtagttcaggaggagagagcttcctcccagggcagcagagaagctcgtcccgtgcagaggaaaccacgcctgcagttaagtccacatatgcagggcgaggcagacatttgatgattaagtaactcccagggaggaacatccttggaattgtaaagcacttttaactttacgaagtactttcccacttctgtttcactagatcttcagagcagcctgtaagacagcagagctggaacaattaggcctgtttgtactttgtgtggagatcaagctttctgtatctgttgcaactggaaatggccagactgggggatgtagctaaggataatcaatggagtcactgagtcagtgatggagaattcaatccaaagatgtgcaaggaaagaatatatatatgcctgcctgcctgctaagtcacttcaatcatgtccaactctttgtgaccctaggggccgtgattctccaggcaagaatactgcagtgggtcaccatgccctcctccagggtttcttcctgactcagggatcaaacccatgtctatgtctcctgcattggcagatggattctttactacta

SEQ ID NO: 25356 - DNA, 841 bp, Bovine  19866881864219
cccctgtaatatctccctgctcctctatgaactctccaggtctgttgacatcttaataagatacccaaaactgaaggctcctctccaccagggtaccaaagcagttgcttgcctattagagggatggcatattctaaaaagacaccttggccttgtggatggaattgtggagttaagctcatttctcacatatggccacgtctccccttcacactgttttctgtatgattgttgcctgtgtgcccctctcccaaacttccagtctggatgatccagctcaggtaggctttgctttcagcctttgctactctgcttcaggactctactttccaaatcttattttcgcattctttgggcttttataatgacccctaaagtcttcattatggtgttctagctcaactcaagctttccttctcctgccccccatcaaaatatatcaactgggctctttgttgttgttcagttgcccagtagtctctgactcttcatataccacatgccaggcttccctgtccttcaccatctctcagagtttgctaaaactcatagccattgagttggtgatgccatccaactatcttgccctctgtcatccccttctccccctgttctcaatctttcctagcatcagggtcttttctaatgagtcagttcttcacatcaggtggccaaagtactggagcttcagcttcagcatcagtccttccagtgaatattcaggactgatttcctttaggatttagtgatttgatctctgtgcagtccaagggactctcaagagtcttctccaacatcatagttcaaaactatcaattcttcgagctcagccttctttagg

SEQ ID NO: 25357 - DNA, 927 bp, Bovine  19866881881170
tactgggcttcagcttcagcaagtccttcccagggcttaaccaaaagctgtgcttaatacaatgtatctgtttctgtgtaggtttcatgcagtttatccagtcagttcctgttgctgaagttcttgatacagaaggaagcattcaggtacagtatctattttaatgatttatgaatttcatgaatatttcttgttagaaaagtttcagtctctataaaaagtacatagagttagaaatgaaagtctctttttctcacttttcttccctcaagttgttttttttttccagagaagtaaacagtgttaacagttggaaatgtttccaacgtagacagatagatgttcagttccttaaactttgcctggcatataataggcaatcaggaattaatggggaaacagaatttaaattttctgaagtttatggttacattatattgcaaagtatggaaatactgatttatgtagccatcaatgaacgttctgattatttccagtttttgttgttattcagaacaaggctatagtgatattcttgtcatacatgttttacataattatgttctttaagacccttttccccaacctccccctccaaaatcattattctcctttaagataagaaaaggcaagttgtactaagccatatatatctttggaattgtttttatattttaaaatcgtgaattagtgtttattgcaaaattcatactgcatgtgaatagtttacttttgttatctttttaatgtaatttttttcctatgaaaaatgtatgtaattcacactgaaaaaattgatatgcctgagatgaaaaatcatatagtgaagggcttgataaaggatatttactatagtatgtttttgtatttctcagtttagagtgtcccagtaattcagtgggagtttacactttcagaaagacttta

SEQ ID NO: 25358 - DNA, 3287 bp, Bovine  19866880083685
tgaagagttgactcattggaaaagactctgatgctgggagggattggggggcaggaggagaaggggacgatagaggatgagatggctggatggcatcaccaactcgatggacatgagtttgagtgaactccaggagttggtgatggacagggaggcctggcgttctgcgattcatggggtcgcaaagagtcggacacgactgagtgactgaactgaactcaactgaactgaggggtgggagggaggctcaagatggaggtgacatatgtatacctatgactgatccatgttgatgtatgtcatgtaaagcaattatcctccagttacaaataattttaaaaataagacattcccagataagtaaaagctgagataatttactactgctggaagaaataccacagggaatacttcagactgaaattaaagcatactagacagtaactttgatccatgtaaaacaataaagaaaaaaaagctcataaaagctcattttaaaaactcataaaaagggataggaaggctgtggagtgaagttctttatatattcccctttttgttaataaccataaagatattaaactggattaaaatggcaaagtgttcttagaacaattcccacaaatgccaatgttgattctcatgcctctaacctttagtagcttgttacaatgcgtaacagatttccctggtagctcagctgataaaaaatctgcctgcaatgcaggaggccacagttcaattcctaggttgggaagatcccctggagaatggataggctgcccactccaatattcttgaacttccctggtggctcagacagtagagaatccacttgcaatgtgagagacctgggttcaatccctgggttgggaagattccccagaggagggcagtattcttgcccggagaatcctcatggacagaggtgcctggtgggccacagtccatggggttgcacagagtcagacatgactaagcaactaagcatgcacgcacaatgcacagcacagctgtctacaagaggtatactttaggttcaaagacaaaaacagaccaaaatgaaaagacggaaaaagatgtacaaggtgaacagcaagtaaaagaaagtcagagtagctatactaatattagacaagatagattttgttttgagaccattcaaagtaaaggagaagcataagatatgtttcctaagtcattgattgtctcaccctagggtagtggctaagagagtgaagagcatctgttaccagtttctacctcttcattattgtcccctctgtttctgtggcttcgtgaagcaagaatttcataaaaaactaaaattgattacagatcctatctaacatacaggtgttttatttggttttatctttattaaaattctattatatgtgaaaatatagtcatacttttattaaataacatatacaaaaaagaacacaaaatgtaaatgtaagctcaattgattttcacatttttaagtacacttatataaccagaatctaaatcaataaatggaacattaataacatctcagagcaaccacttttgtttcctcttctaggtactttctccttcaaaggatcactatccagacttctgacactatagataagtttgatctgtttgcaaacattactgaatataatcagagagtgtatacatttttgtgtacggcttcttacacttaacgccatatttatgcaggacatccatactgtggttataattgtagtttactcattcacactgtagtattggattccactgtctgattaactatagtgtatttattaattctacaattgatggatatttggttagtttccagtttgaagttatttgtgtagagtggtaataaaattttttatatatcttgcagtgaatatatgtaaatatttctcttgaatatataaatgagattaaaactgttgggataggatatatcgatattcaactttaataagaatagtcaaatattttccaaatttgttgtatgaatggacacttcctccagcaatatacgagagtttattaattctatattcacaccaatatttgatactgtgttttttactttagctattctggtgagcatgcagttgtattaattgtgattttaatttgcatttttctaaaaactaaaaagcttaatattttaccatacatttattggtcattttgacatcctcttttctggatacctgcttatttttttgtttgggttttctgtatttttcttattgattcacaagtatattctcccaatctacagattgatattctctaaatagtattgtttgatggacattcttaagagtttaataatttttcttttatggttattgattctgaagccatatttaggaaatatttccctattttaggaaaatgaagatattttccaatgcttcttccaaaagatttatcgttttcccttttacatgcagatctgtagttcatttagagttgacttttatgtgtagtgagagatatgagttgagacatgtgcattttcctatggaaggatagtcaactgacccagcaccatttattaaaataaccacccttccccactgccctctaagactaccttcattgcgattttagaggtctattatctttttgaactgttaatgagaattatgatgattttatccagtatgtattgatgcatagaaagccatgaatccagttcctagaaataaaaaatgttgatactattatttctactattatttagtgatttatagtctagccatgcttattacatgtcttgttctcatgcatcttttttcttctttgatcaataagtttcttaataaataatatcattcatagatttaagaaagtagaaaatacaaaaaataatagagaagaaagtaagaatgactcataattttatcaaccaaaagaaaatcactacacatttttggttttcttcttattttttcctaataaatttattcttcatatttaataaagttcctaagtacataaagagccctaggttcaaacggtaaacagtctgcctgcagtatgggagacctgggtttggtccctggatcaggaagatcccctggagaaagatttggcaaactactccagtgttcttgccaggagaattccatggatagaggaacttggtgggccccagtccatggggtctcaaagagttggacacgactgaacaacaatcacacaaaagtatgtaaaagcccagggatttataatgacaacatagaagattacatcttacttatcaaaataattttcaaaaa

SEQ ID NO: 25359 - DNA, 1300 bp, Bovine  19866880220658
tgctgctgctgctgctgctaagtcgcttcagtcgtgtccgactctgtgcaaccctgtagacagcagcccaccaggctcccccgtccctgggattctccaggcaagaacactggagtgggttgccagttccttctccaatgcgtgaaagtgaaaagtgaaagtgaagtcgctcagtcatgtccgactcttcacaaccccatggactacagcccaccaggctcctccgtccatgggattttccaggcaagagtactgaagtggggtgccattgccctctccgatatatatatatatatatttgagtaaatatatatatatctatttgagtaaatatatatatatctatttgagtaaaaaaaaatatatatatatatttgagtaaaatatatatatatatattttactcaaatagacacatgtgtatctaacacagagattaaagagagagaaatattttaacttaaaagtttatttcaaatgattcatttcagaatttcagatttgaatggtaactttaagatcatctatcataatctcattatatatctcaaggataggaaaccactttaaattaatgataccttatcttactcataaattatttttaattatgttaatttaagtaagatttttagaattaggtattgtcttttgttaattgttattacaactgccagagatttatgattttaattatatacatattagcccattaaaaaatatttaaatagttgaaatcatatcaaaatttaaaataaccataaaaatgttagaagaaatactaaatagctatagtctgtatgtagaaacattagataaaaatatttggtcctggttttattgatggttattacagaatgcctcttgcaaaatgtagcaaaggttatcctagaaccagatttatacaactgcccatggcagtaaatagaagacttaagttgtttcctctgttgatttatttgatgtgctcttacagggaaggcttaactctcatctttttacagcttttctgttttaaagaaaagaatgaatcaaatctcattttttgtgtcactagtccatttcccacattagttttcttctatattcaatttttttgttttttagatccaagaaacaaaatactgtctaaaacttagaaaccctccagattatgaaacaaaatgtttggcaattttttcatttgtacctgaggcgcaacagaagccagacaatcaccataatcactaatacatagcaacacacacacacaaatatgcttacacacacagatgctgggcctcttacagcaagttaagga

SEQ ID NO: 25360 - DNA, 1300 bp, Bovine  19866880361587
tattttagggttgctctaaattttctaaagcatttatcggagacattataacaatttcaaaggtaagttaattactctttctaaaataattgcctagaatcatgaaagatcatgtgtataatttatcatatacataatttacttcataatacatataaatgactgaattaaaacgattactgaagatttcttatatattttaccatattaaataagtttacaacaccaaattcattacttcatgaacttgcaagaggaaaacttttagaagtatgtaagaaatcttaaattattgttgaaatatgtttctaatcactttacagcactatcatgttcacattttttgatttatataaatgatcctaaacttagtagtcattagcaaaggcctttaatatgctaggaaaacaatctacagacttgttatctcagttctttattctaatcttcctgaataatgaggcgacttcaggatattaatagtatcattttctggtttttatcctgaacagaggcatatgatagaaaccatttatctcaaaccaatttagtatcacactgtagaagacagtaaatggaagaagtcttgtattatgatttatttcatgccatatgatctaaggttgctaactatccatttactttatctcatgtccaatactagattgcctaattaaattctgatgtccaaggagtagctattatcaagccaatggtttcctaagattgttaaaaaaaaatattcagtgcagagtttgtgatgaaacttgttgtttaacaatgttctcttttaagatcgcatttgagaattttgcttaagagagtcctggatttcattattcagctgaagctatattcaggctatggagcaatgcaatgggaaaaattcttttctagagctagacaccaactgactttaaatggcccactatatattgtcttttgttatctttagcacatccatattagttaataaacatttatcaaccctctgggtgagcactctagggggtttaattatctcttcgagtttagtatggacataaacaatattatgaatcatctaagcagcacatcttttttaatgatagataaaaaccttgttattaggagtgaagtttaaattcatcattattctgttttataacataacaattacaaatgcagagtaagtacaaattatcctcattgtcagttaatgaaatttaatctaatctattttgaaagagttaacaagattttatgtggactatttttgggtactatcttcaaacattttttgagaaccattatcatccaa

SEQ ID NO: 25361 - DNA, 2039 bp, Bovine  19866880413018
agaaagatttaggaaaattgctacatgtcacttttgcttaccatgaactggccatattttttgtttaatgttatcagctaaaatttgggattccatccctttgagaaaattggagaataaatttttggggaaaaaactgtttactttttctgacatgagcctctagcctgagatattatgatagatacatgatagatcttcagaaaaaaatttagaagtaacttttgtgtactaacacagtaaaccttaacaacattggtattatttttaagttgctaagtcatgtccgacactttgcagtcccatgaactgcaaacccagacaggcttccctgtccttcaccatctgctggagtttgatcaaattcatgtgtccattgcttcagtgatatcatccaatcatctcatcccctgttgccccattctcctcttgccctcaatctttcccagcatcagcgtattttccaatgcttcttactactttagaggtttgaaatatcatatgtaatgacatcaagtctatgtgaaaacaatccttaccaggggtatcttagtttttgtttaaatacttaaagtaaaaaaaaaaaatatatatatatatatatatatatatatatatataaagaccattcttgcattgatctcaaatgttttagatgcttttaatttccaatcattcattctaatactccccttcaacataatgaaaaaaagtattttctttcttatgaagaaattttttttatattaggaaggggttgcttgtgcccctcaagtctcatccccacaatcaccttcaagccaaataatccgcttttcatggagacaaatttcagatacattatcatcaaattaatctctttcctttggatttctttatattattatttttttccctgtttcaattcagtgtgtgtgtgtgtgtgtgtttttactttacaatattttattggttttgccatacatgaacatgaatctgccacgggtgtacacgtgttcccaatcctgaacccccctcccacttccctccccataccatccctctgggttattattaaatcagttttaatgtctgattcaacagtactcatcctaaagcacaaggcattcttcatttctcctttctccctaattcaagttgaaatagacatagccaaaatggcctgccagctgttcacagaatgctccacctttcagtccccacccacctagttccctctgcttagatggagagtgtgtcatatgacaaaaaatgtggctcataattacttttacagttcatttgtcctgtgtcctctagcattaagcctaatgactttgacaagaaaaccatcacctggctccatttcctattctgttggatgtcaatttaacatgaccatggggactgttcattagcctctgaaatttccaggaagaggcatttttttttttcctcttgctttcactttaaatcacttaaactattttaaaacaacttgaaaataacattttaaataattatgcataataatataatttatatacacacattgatgtattaatacatagatatatgcatatgtgcatatataagcactaatttctaagtgggaaaatttgttaattaatcacccttaacagtaaaatagcttgccattagtcaagcctcaggttaattaattcaccagatgatgagtgatataagtcctagtgctttcttcctaactacttactattccatccagaagacatgctcaatatatcactcattgagcagcctggcttctgcttctgtagatgttgaattttagcactagatctgataccagtttcttggaataaaagatatggaatgtaatttttctttggcatagacctatttaaagctggtgagaagagtaggaccatttagtattgaacaaatgaataatttagggagcagctaccacctcccatagaggttgaagtagatttcttctaaataatagcaaccaaatgtctagtcagtgaagtctgtatgcctgcaagcagacattcttaacagctccaccgataagt

SEQ ID NO: 25362 - DNA, 1621 bp, Bovine  19866880452691
tagcttcacaaagttatgactcaaatatttctggccttcctgtgatctaatgttttctcatggaaggaaactttcctcttattgtgaggtaaatacctaccaaatatgtcctaaatcctctcgcaaaagatattattagcactgtgcactcatttataagtaaagaacagttcaacgactctatttgcctttttaatttaatgcattcatgctacttaaaatggttgtgttataacaatcaccattttgccaaaccaaattcacctcataaacattcttttggttaacttgaccctgcttttaaaacttgaaattagaggggaaaggcaaaacatgatctggcagttatataaatttagagaaataaattgattgggattgggtgtaataaagttatcccactggttttgattagttcctcggggtataaaaatgtagtttggttaaatttatattacacacgttacagtccaatccaatttatattagttttatgtaaaaatgctgtacttaaatgagttctccaaatatacatgtatatttctcaaattctctataacccttacatggatagaaactgaaggtactgagaaatatcatgatgggatgtcaggagatgacaacaaagaggagataaaggagaatgagcagagcatattttcttttgcagcatctgtacttctattccagattcattatgagaacttctatagttctagtcatttatatatgccccaaatgagtctactgaattttctttacagcatctatatttctattctagattcattaggagactttctgtagttccagtcatttatatatgccttgtcagcaaactagtcccctcctgagttcacaggctattataagaaagaaagtcccttcatcaatacaatatgcaatttactggcctaataacaaagccaggagaatgaattttatgcagagacctctaacacccaggagcatccttttctatattatatgctctgtgttaaagcatgatgaatacaacatgcagaagtgtttgatgttaatggaaacaggctgtggaattggactaaagagaaaaaaatctttaaaataagaaatcatactataaaagtagcatacaatcatccaagggtgagatccaagaaaatacttttttatatctgttattcctaaatacaaatgaatgccattctattctgtactatggagttatgactccaagtttaacatgtagacattcaattagtggaactcatatttcattattggcatattacactttaagcaataatagatatatagatataaagatatatatagatataaagcacatatatactgatgaagttgtataaagttagcctcttctcaatcactggctgcagatgttatggcacaaggcccgtttgctttcaaatgttagctatgatatggtcccacagcatgccagtaatataaaattgacaaaataaagttaattattaaactctaggcattgcccttcatcacctcactgtccatcttatttttcactttcaaattactaagacacgggatccattctatttctatcattctcttacatcaggaacaagtacagagaattctatggacagagggaaag

SEQ ID NO: 25363 - DNA, 2011 bp, Bovine  19866880533169
ggaatgctgaaggaaattgaaagttaaagagcatgagtagcttttttcacttaaaaaaatatgtatatgcacatataccagcaagttttcgggaaggaattccttaacaataggttattatatatatccaggagtagatatgagttaccattaaaagcgaaaagtgttagtcgctcagctgtgtctgactctttgtgatcccatggattgtacccagccaaggctactttgtccatggaattttccaggcaagaatactggaatggatagccatttccttctccaggggaccttccagtccagggattgaacccaggtctcctgcattgcaagcaggttctttactgcctgagccaccaaagggactctgagccacggaaagaactctgagttaccatgggggttttgattttccttgtgtgcttttttatgcttgtttttagtttttttaaaaaacaaaaacatgaggatatattatttttgcaataatgaaaataaagataaaaactgaaagtatatagctggccacacatgcttttagtaactctgtagtaatctctcactgtttcctgatctgtgtcccactttgatgccctatattacaagtgtgtgtctaatggcaaacagcactgtgtaaactgcttagaggctgcctccttatcttctcctactttacagtataccccattttccttaagccccatcttccatcattcacctgaaataagactgacaactgtgtagggaaactgcttttatagaatgataggcttggagtatttaattgatttgatttgatttaaaaatgaacaggaccttgatcttatgcaagtcaatatcaaagggcaccgtttctaagtgtgtgctctgaatggtttcactgcttccttgagttgcaattctgtagtggggaatcggggtgaaatcacgttagtgaagaaggcatgtgtctggcaagttcccaaggcatgagtatttatggcacgatgaactgtgaatttgatgttgattcacgcacacaacaagcaggtggttcacatctaatttcgttgcctgcaaaaatgagctattttaaaatgtgtaaaatgtttgttttatagaaaatctttagccaaaatgaacaataaataaatcaaggtcagtacaattagattttctgtgaaatggagtaaactcaattgacatggtatggaatacatattctattctagggactatgtaaacaatttggaggatgggatgacaaaggcttgcaaccttttcagagtactttttaataatgacatattaagggctcatatgagctttgtaaaataagggcatggagaggaaccgaagaacatgtacttcacctcctcactccccacaaggaagaagaaaatgagggaggcaggcaggaagggaggaaggaataaaagatgctttccatttctgattgtaaatggccagaaaagagaacatggtcctgtataaagtatgcttgatgtcaactggaataaaatctcaagtgctttgtggaaagttgacataaaaatcttaaaattcctcaagatggcactgtaaatttctcattacttaaattaaaaagtggagtttctattgagcattgttgtttttttttttttttgcaccaaggatactattaatgtttttaaggtaattaccatttcagtttgatcaaaatagccagtaatttaaggctttctcaaagaacactgttctttgagaacagcttactatcctaagacactaggatctcctatgagaagttttcacctctgtacttagtagcacttttccaagctctagatcacatcagatcagatcagtcgctcagtcgtgtccgactctttgcgaccccatgaatcgcagcacaccaggcctccctgtccatcaccaactcccggagttcactcagactcacgtccatcgagtcagtgatgccatccagccatctcatcctctgttatccccttctcctcctgcctccaatccctcccagcatcagact

SEQ ID NO: 25364 - DNA, 1097 bp, Bovine  19866880573153
cctagctgtgatttttctctgtctattcttcctccctcagctcaggattgggcatccaagtgcactgaatatacacagttacaatcccaattcactgatgcacctctgctatggcaattcaacctggaattgtatcagctcccacttcacccaatttctagacttgccttgcttgtggaatcccaactgcctcagaattttaagaagggactattttaacacaactgtaacacaacacaattttaacaacttttttttaatcacagccttaccatgaacccttcaacaattatcaatacatagcttatgcaaatgcaaggactgttaaagtatgtgttcagtttagtgccggttcatgttataattgagtggtcaggtttatccacatgggcacgtgacggaactaaatacaagggcaatgcaagagattacaataagctccttttctgtgtattatatattcacatttgttttctggaagtagttagggataagatgtttaccttttcactacctggcacaattgatagtctccttccctttaataaaattccctccccaactcttctctcaggtcagattttcacacttatctccgtagcaacatatctatgtaatagaaagatacatcttctgaatggctagcaatacaacatcaactgttagagcataacatttttcatgttgaaaacatctggaattcacaaccagtcaagaagtataaaatgtatttggctctttaatagtcacccaaggttgagattgcttgctttattagaattcatttacaaacaactcttattaaccagcaatgtagtataaaactaagcttaatttcaacatcaaaaaaattttttaattcacaaataaagttgcttataaagactccaatcaccatttgtggaaaagagtttatggcagatttgggctgtattaccaacctattactagtacgctaatacctccatttactggttgattatgtcctctggcaaaattcggaactgtctactactctggtgcaaactaatcagttttcaaaattagttattgatctcagacccattttggtggaccaatttagtggctggttcatt

SEQ ID NO: 25365 - DNA, 1779 bp, Bovine  19866880604913
taaattttgaatccaagcatatgagtatgtgttgcatgtgtgcatatgtatataaattcatgaaagtagccaaattaatgctttggtttactatttaatttgagcacaaggaatagacatgcaagaagaactttgtttcattaaaataaggatggtctattcccatctttaaccttctttgggtatcatgtgtttgttccaggatattctgtgcagacaaaaatatgtaaaattgaaaggctatttacaatctgttatatacataattatattgaggctttgcacttagtgtattgactgcacatttgctgatgtgagaaaaagcaaaacaagaaacccagaaattaactacatatcaaatgtttgcttcagtctttgcacattgaataagatatatttcaagttgattttttttttttttttgctgtgacttctgcaggtttatgtacaatatcagcatcttccaaaaacataggttcatatcaatcttcctgtttcctgggtaactatttgaccatattaacttatatttaccttcataaaccagaagagttactatctgactaaactcattcaaaaatgtgcattacttatgtcaagacattaggattttctcagggtttctgtgagtaaataatctagaaactaaggaataataatataaaaatctatctaatggagtgtggattctaagagatgtgaaattatggttaaaatagggtcaccctactagatcgaaaaaggtctttagattattagtatattgacattaattctgtctgttactgttattcttacttgtatcgggtttaattatatcattaaaaagcacatgacacttagtcttttgctgtgcaaataagataaaatgatttgtcctttgttaacttatattttaaaaaacaatgttgtcacctccaaataagtgtattttctacatgagttgaagattctatatatgcagagtccagtaatattagtgcctcattttatacacattttatgcagatctaaaaagctaaaaagttcctagagttctcaggcttacatctttcaacagacatgctactgggattgaataatatggacctggtaacctgaggcagaagtcagtgtgaatttctgcgaactgtgttcaacatagttgtgataaatggggagacttacactattgtttgcaaatagtttccatgtggtaatatattaaataatatcaaataaccaaactataagctactcactggaatgaaatagtttcctaaattacattgacatgtataaaatacagggcttcccaggtggctcagatggtaaagaatttacctgcaatgtgggagagattatggttcagtccctgggttaggaagatcccctggagaagggaatggcagcccactgcagtattcttgcctggagaattccatggacagaggaacctggcagtaagattacccaataaaaagaaattcaaatattaggcataaaattaaatctttgtataatcaagcaaatcagagccccatatttgtagactgttaatcactaagttcattataacttaagggtgtgtgagaccaatacttgcacatgtcttatcatgacccaaagccagaggtggcatgacttagtaatccagtgagacagtggttggaggcagacaaagctaaccccatccacaataacaatgcctcttcaagcttccccagaatcacacccaacactagatcatgaatcaggaatacagagagattttctgaagatcagtgagatctccataga

SEQ ID NO: 25366 - DNA, 1493 bp, Bovine  19866880621965
caaattggtcacactttttagaagtgacaccactaataacaactcctaaatgatattaatcatgtttaaagaaaagagagttcgctttagtataacattagctaactcttgttaaattgattttggccttcttggttaattgattttaaacactatttccttagagcttttatgacgagctgtactggagggaaatgacaagattcctcctgaaatactgtctagaaatatgtttccttcttttttcttaaatgaatactttttaaagagactttttcaaagttgaacttttaatatgtaggaatgatacagtttagaaagcaaatatttatctttaaaggtaagtttgttagaattcaatagatatttatgattaagatctttgataacataacaatgaaatatttaataatagaaatataaggaataaggtgaaagactaattattcattaaaagtctaagaaaacaggaatgcaaatgctgcataaggctcacttgttcatttaggcttcccccacccatctcccctttctaatggccaccatgaacccacaactcctttgcttctctgtgacagtagaatgaaacttaggtggtctttgaccacccccagtctccagctgctcctcattgttcactcccttaacagaatcaggtcttgcctgatgcagcacctcacataccaattgaactggctactgaactagctatctcacatgtcaattgaactggctggaggagactgatgttgaaaatttcttaccggatgtcacattctcaggggtctcacatctcagaaagtgagtgtgaaaactgctgggatctctatcacaggattgtatccctatttcaggtccggtcctcctgggcagttcaccttgtgagtatctctatcagctccctattcaagcacagatggtgaggggctgagttccattgtctgctattgtgagctgaatcagagttttagcagggtcttcccctggacaaattacctaagttgctttggaaggaagaacgtcaaatgaaaaagtaatccattaggtggttgtatggggactgttgaatgagagacagggtcaatttagcagcttttatatgcaaagagttgactcattggaaaagaccctgatgctgggagggattgggggcaggagaaggggacgacagaggatgagatggctggatggcatcaccaattcgatgcacatgagtttgaataaactctggaagttggtgatgaacaggcaggcctggcatgctgcgattcctggggtcgcaaagagtcagacatgactgagcaactgaactgaactgataaaactttagaaattcagggtctgttagaccaaatgttcatcccctctaaaactgaggctcaaaaataaagaaaatgagatttcacacaactataattacacatcaagtatttgggcagacctcactgaaaggaagttaaccataaagacatttatgtttttcaaaatactaa

SEQ ID NO: 25367 - DNA, 1232 bp, Bovine  19866880711460
caatagatgcagagaaagcctttgacaaaattcaacatccatttatgataaaaactctcccagaaagcaggaatagaaggaacatacctcaacataataaaagctatatatgacaaacccacagcaaacattatcctcaatggtgaaaaattgaaagcatttcctctaaagtcaggaacaagacaagggtacccactttcaccattactattcaacatagttttggaagttttggccacagcaatcagagcagaaaaagaaataaaaggaatccaaattggtgatgcattttcttattgaagttgagagcaaagtcatccactgacaagaaaaagtaaagataagtgtaggttgtggaagtaataaaagcaaagttcaactttatatgcatcaaaatggataatgtccagaaatctctgtcactctctgacactgatcttgaactagtatcttaaataaaacatactccctaattctaagtttgattgctagaaaaatatactttctgtaaaattaattacaattcccattaaatgttattctaataaaacaatttttattagttatgtttttgtagcaaataaaaaagtaagtcttccacttcaaaattaaggaaaaatacatttttgtagatctttttgcatttacaacactgcattccaagtagcaataatataaggaaaattattgttaaggaacaactttatcattaaatcaatatagtctctgacttgaaatcaattggcttagagttttaaatggctttattgatttgaatcataaaagatacaaaagaggatacatttgtacaagttcaataacataaaaaggagaaaatttctccatgagaaaaactcaaacttaacatgtggatgactacaggaatttgtgaacaaagtaaatcatttcctattctatcacaaacttagaagaaaactgctgtccatttgtgatcttatcctcttttctgacctagatattctgcataagatatatatcagtggcttctttagaaagtagtaactcaccccagagaaatgaacataaattgaggaaatgttgactttgaccttcattttaaaagcttgaccaatgctttgatttcatctttagttggtttattttctgacctggaagagcgaaacatatttacatttataaaaagttctgactttcatgactaatggatgttaattgctatgacagtgacattttgtatcttacccatattt

SEQ ID NO: 25368 - DNA, 1722 bp, Bovine  19866880721380
aagaatcccctgccagaaggtgacatgggttggatccctggagggatcccacattgggaagatcaagggattccctcatcgagaagagtccttggagaaggaaatggcaacccactccagtattcttgcctgggaaaccccatggacagaggagccttggtaggctacagtccaggggttggaaaagagctggacatgacttagcaactaaacaacccatgtcagttaaggtggtgtcacacgtgataatgtgcgtaataagaaagttgggccaactcattaaaagtatcatcagtataaacagattctggattgtcagtttctcaagactccggaagaagattttttttcccccatagcctttgacaagagttagaaacaattaatataacgattttaaaactcccatagggaaatagcatgccagctaaggctaaaatttgggaccaatgctgctagcctatatgtgaaaacaaaacaacacattacaagagaggctggtgttgattagtaagaaataaacattcctgtggttcatttgaaggcaaatctgtagtagtcagcagagaatacgtgtgactacatctgaaggttggaattttcaagttcctgtgtgcactgagaaactgagtgccacagcaatgcagatgaagaaaagatggtgtcggatgctttccttttccatctggtgttttatagcagctccagtactattgcctggaaaatcccatggacagaggagcctggtaggctacagtctatggggtcacaaagagtcggacacgactgagcgatttcatttcactttcactatgctcacagttactcttaaaggaaaatagaatgaaagataaaaccaccttcacagtgtcatgttgtttatgctgaatagtctaagccaaattattacttaggaataaattaaatattgaataacacagagtccaaacacaaattagatacactcgagggaaacgtctcactacaacgatagcccaagttaattctacttgcctggaagcaagaagctagtgctaccagtcccaggaaagagggttaatatgtattttgccatttccaccctgtattaaattgcaacaatcccagtattctctactactccccctaatttatttttatccatgaatgtagtgcaggagaccggggttcgatccctaggtcgggaagatcccctggagaaggaaatggcaacccactccagtactcttgtctggaaaagtccatgaactgaggagactggtaggctacagtccctggggttgcaaagagttggacatgaatgtattaccaaataacacattatatatttaactttttttttaatattatttctctggcagtggaatataagcttcacaagggcatggattttgaaatattttgtttcattttaaatccctcactcatagtaggcatccaatatatatctttgaaagaaataatttattaatcttgtaaatttaattatgatacaggggatatgatagtttatgtaacaaatattttttccagacacattctgagaaacaaagactgttctgagccctaacaagagatttgttaattaattcactcgtcttttacctagatgcttgagaaatataacttttaagatattttaatataatttaatattttaagaaatatgttcacatatgtattttacatacatgcataaaacatttgatcacatgtaagttt

SEQ ID NO: 25369 - DNA, 844 bp, Bovine  19866880787422
cccagagttcacaattaaatgaatacgtttacatctggtcttaccaccaatgcaatgtgatatttgctacatcccaaactgcagatttaagcttataggggtagattataggagtagagaaaagagagtgtctgttcttgcctggtggagggaaaaagagacagagaattgacatttatggaaaacattattagggttgatataaggatggaaattatattataaatcacttagaacaatcctgatactatataacaacctgttcaataaatataaattttatggctttcagaatgctttctaaatttcttcttcttgattttccagtttggtatgatgcaaataatctgtaacaatttgtcagattgttacagaaagctttccagaagaacaattcgcttttccacaaaagcagtaatattacaatcgaatgaagtagaacacatcacaaactctcttggtccaatttaaatttaatgaactcttagctgaactaagtgtctcatctccataaactcagaggcacaaggtttacagaaactgcaacttcaacattctttgacagtaaatatgactataaatcaaggcgtacatttattttcttccagggttctggttttatgccatctgctcacgtggcatcttgcccatttggaacaatgtcagattgtgtaggatagaggtgttgcctctctgctgtgctcctgactcaagaatgaggctagtactttgggagagggttaacatgaggaaggccttcccaggtggtgctagtggtaaagaacctgcctgccaatgcaggagacataagagatgcaggttccacatcgggtcaggaagatct

SEQ ID NO: 25370 - DNA, 996 bp, Bovine  19866880815427
tcctgagcttcccttgtggctagctggtaaagcatccacctgccgtgtgggagacctgggttcaatccctgggttgggatgatccactggagaagggaaaggctacccaatccagaattctggcctggagaatcccatggacttcagagtccatggggtcgtgaagagtcagacatgactgaatgactttcacttcacttttttcacttattgagggcaagaggagaagggggcaacagaatgagatggttggatggcctcaccgactcaatggaccagtgttggagcaaactctgggagagtgtgaaggacagggaagcctggcacactgaagtcatggggtcacaaagagtcagatatgacttagtgactgaacaacaatataaatattatatatatatatatatatgcatatctttgtaacattaattcctttctgtcctttagacatagttgaatattcatttaaaaaatcagcattgaaattttaatctgcagctccaacttggcagtccagacattctggtattttagtgttaattcttaaacctaatgtagttcacctacaaagaagcattctcagcataggtacagatatatcagtcactggtctgacaccaccatttaggaaaaaggcagatgattggtttgattaaatgtcagaatagaatgattctcacatccacagccatgtcagatttgtcaacatccttcaccctgtctttcttcttgtggtacttatacctaaaactgtgcattaagcaatttacttaggtaatccttttatgagcacctgctacttgagaggcacagagaagtcactagtagaggtgaaaggttactttggggaaaagaagactagataaagcataaacacaagtgaaaagtataattaaagtttctccttaggagagttagttattctattcttcctgtttcatatataagtgcttgaagttgctcagtcgtgtccgactctttgcaaccccatggaca

SEQ ID NO: 25371 - DNA, 1018 bp, Bovine  19866880829489
agttaggatggcctcattcaacagcatgaagttctccaagaaagtgagtccttctttgtccaggcagagtgcagtttctgttcttatcaaatgtaccttcagtgccaccatctgggggactcttgagatgttcaagtataacagcatcattgatgctgcatatgaggctaactctggttgggcatttgactctcaccgaattttccaaggccttcatgagctgtgcccccttgtcatttaaacatgtgtaacacaaagtaaaccagatgagcacatgtctaacataacatgggagttgcctaaagttaaattgctttgatcaatcagatttatatttaaagccagcagtcttcagctaaatgtggtgaccaaagaatggaagtcttatttatttatacaatggtacttgtgtaagaagtaccaaatctcagaaactgctcaggctacctcatgaaaggcaccattttgaagtttccctgctggtgaccctaattaatagccaacatagaatcactctttatagatatgctttcatttcctgccatttcttcaaagcaaaataaatgttttgcctcacagaaaaattaaatatttctatttcagaaaagctgacaaaactatgattgatatcatcaattattaggacattagaatgaccctcataggattgtgtttccatgaatgctagagtttatcacagccatccagaacagccagcatgattctgagttagttacattattttatacaaataaccactagtatttttctaagctcttgcttctttacaaggcagagtttcaaattactattaggaagaaaatttgtcccttgcaattatactgtacatcataattgcccgttcttaaggcaattttcttttactgatcacagctgtagatttttcaaaaggttaggtaactgactaattcattgccaagtaccttatctctggagacttaggttaagaaatgtcattttgattgtctccatggcaagtcatgtcatatatgaacaa

SEQ ID NO: 25372 - DNA, 1201 bp, Bovine  19866880888713
tcttgaaaataaaaatttcaaaaggtcagggaaagcattgcaaaggctatcagtggtgtttacatatctaaaaatgcagttttcctgtgattaaatgtaaaagaaggcttcctatggcttcacaatgagcaaagctgaagaactttcaaaatgaatgcatcttgttacgaaggagtgcacactgacaccccacatccatttagactgactcccacaggcatccaaagtcagtccgggccccaagtctttctaagctgtcattttcttctctgtgtaatgtagcttcttgtcagctcctcatatcctgcttctgcccaccctccaggtcttgtttaagctctgcctcttttgaggtgttacattagtgttctactcaataggaataccactttttgacacaataaaataatgcttatttaatgtgatctaatttacattttactcttaaatgctcatctaattttttagctttcaataaatactctttgaatgcctaccttttagactcagtaataaacaaataagagagaattcctgccttctaaagatttacatctagcaagtgatttagaagttttggagtcagcattccctttgagagcataactgaaacaattgcaactttccccagaaaaatttactcacataaaatttagcacagaaatttgtaggatgcaatcattatgatcatgaaaggagagtcaaaggatgctccccaggtaacatttttaattctgttttgtaaaagtaataaactcttttccacctgaggaagtattgaagagttatctaggggaatataacagaaagcacaggcaaaaggaagaagtgaaaagaagaagaagtgtaaaaaagaatgggacatcaaggaaacattaagatttttcattaggcaagagggtggtgtgaacgtaggttgcagatacatgttggaacaagatggtttatgtacttgctaacatgccaggcctgtttgggggaacagataactcatcttcctaggagaattatcatttttctataccataaggagttttatcatgttcttctttcacatctttcactaactttaagcacctcatatgtagtgctttgcagatattaaatattaaactgagagtgaacaagaaagactaggagaggagagagggagaaggttatgagttagtgatctgcagagttcggaaaggataacaaagag

SEQ ID NO: 25373 - DNA, 1100 bp, Bovine  19866880896674
atgagttatttgtgagagaggggtgatgatattgtatttccaaatgtactgaagattaactttatattaaaaagtaaaatccaggcaggaaaatgaagctatgtagcctcacagattatgataattctgattttcaatgtgacagactaccaacaaactttattcacctctacaagaatttgtgctgttaaaattataattaattaaaaaaaatttattgcagtatagttgatttacaatgtattagtttttgttgtacagcaaagtgactcagctatattctcttttttattgaagtataattgctttacaatgttgtattagtctctgctgtacaatgaagtgaatcagctgtgtacatagatgccctccctcttgaatctccttcctatcccccaatacattcttttccattatggtttatcataggatattgaatgtagttccctgtactttagagcaggatcttgttgtttacccctcctgtatgtactagttttcatctgctaatcccaaactcccaattcttcgcttcccaccccacctccccatggcaaccacaaatctgtttgctatgtctgtgagtctgtttccatttcatagatacgttcatttgtgttgtattttaggtatcacatgtaagtgatgtcataggggatatgtctttgtattcctgacttactttgcttataaaaccatgattctaacagcaacagcaataagaaaccctaacctacaactcacaaatcaaaaccaaagtaaaataaatatcacccacaaagaaagtcaacctaccacacaacaaatgccctggtaatgctgctaactcaaaccaaatagtaattatgagggcgggcatggaaaccagcagagttacatctgatcacaaatcaggccttgcctttatgctttctgccacagtcagggccataatcatagtgccccatttagatgccacgtctgggtcaaaagacatattcagagatccaaataagcaccctgagtaggagcaaactattgacctatgaacatctttatttgcttgttgatttttattcaatatacaatttcgattttagatagaagatacatagttgtag

SEQ ID NO: 25374 - DNA, 2295 bp, Bovine  19866880905515
gcatatttttaaaatttttattttactgtatagagcatgagaatgatggagttatatttttaaacataaaaacttttttttgtttcaacatttgtgaacaattcttctgttggccagtttttttaatcactcacaataaacgcaaagaataagactggtcgttaataaatttttacttcctaagataaatggtgtaaacttaaattgctgattcttatatctttccttgctgctttttttctattgtatacagagttcattggcaaaactgcaggtttcataattaactataaaaactgaggagttcacacagatatgctaataactccattaaacttctccctttatatgtaaattcaagcccagatgttgcatcatttgcaaatcttgcaattaaagcattttataacttcagttatgcaaaggggcaccagactggaaaatgggtaaaattgcttggctaggacattaccatggcaacccactgacctccattcaattagttaccagcgaagattcagctattaattataatggtcaaaagtggatatcatctggctctcctcttacctttttaatatggacatttttcactcaccataaatctttgacttttagaggcaggctcccaaactgaagcattaaaactgatatagcttaagtactgatggaagtgagggtcaagaaaggaatctcatttatcagccatattcaggatagttctccaactttctgtaatctaagcactctgtcaggcaagcttcaaagtgaatattcattactgctcatttttctcattgaactctttgcattctgtgtgtcagcaattacctctcactttagaatgccttccttaattagggccacaatcaccaccagggagcctctgaaatagatgccccatttttggtttagctttacacttttccagggggaaaaaaatagttaatattttcttggcaaaatataaaagaaacgttgtgaattaattacagaagtacttaataaatgatgaaaaaaattctatttgcattagtgccggcttaaacataagaatcttgtattcgatgaagttaaaatatactattcttacagaactttttttttttcttttcttttttttaaattggtgtataattgctttacagtgttgtgttagtttctgccgtacaagtaagtgaatcaactctgcactgacctagatgggtgggatggggggtatgtgagagggaggtccaaaagggagggcatatatatatacatatacatagcagaacatgttttaattgctgtatccacaatcataaaataacaaatactcgttagacttgccaaaacatggtgatcaaccagtgccatacatcttgcactgcactagtcgctgcttcttcattcaacaaatatctactgtacacctacctgtgtataagacagtgttgagggtggtaagggtacagtgatgtccaaacatgacaagttccacaatattgtaaagtaattatccttttctattttaaggagatagaaaatcaaataataaggaactctgcaaccacatagactatacagtctttggaattctctaggctaaaatgctggagtgggtagcctttctcttctccaggggatcttcccaacccagggattgaatccagatctcccacattgcaggcagattctttaccagctgagccacaaaggaagcccaagaatactggagtgggtagtctattcccttctccaagggatcttcctgacccaggaatcaaactggggtctcctgcattgcaggcagattctttaccacctcagctattaggaaagctcaaataataagggaagtatcagttaataagaagtactatgccaagtattaaaatataacaaaataattaccattttgaatagttacaaaatagtgttagtagtacatatggagataagtgtacatattcagaaaagtttttgtcttgaaaataggtagttttttaataaaaataaatttaacattaaaataaaagtaaatttaccttaatattcactgaatttcataagagatgcattaatgagaatgttggacagttctgataaataattcctttggttaaagttcaaaagcaagatttttgatagttgtttactttttaaattatgattagtatagttatgaacattcctgatgtacacaagcaaaaatttcttatgttaatatttccaggagtgaaattgctaagtttaccatagggaatgctcaaaaactccacaggagagtgaggcaatcaattaaagtataat

SEQ ID NO: 25375 - DNA, 993 bp, Bovine  19866880910543
taaagaatccacttgccaatgcaggtgacctgggatcaatccctggataggaaagatcccctggagaagggaatggcaatccactcccagtattcttgcctggagaattccatggtcagagaagcctagagggctacagtccatggggtcacaaagggtttcactctcagtcagtaaacaagaagaacacaggaatttcaataggaaaaaaaaaagactaatgtacagaatatgggcttctgaggtggcactagtggtaaggaaaggcctaccaattcaggagaggagacctaagagatgtgggtttgatccctgggtcaggaagatccactggaggagggcatggcaacctactctagtattcttgcctggagaatcccatggactgtgaagcctggcaggctacagcccatagggctggacatagtctcacacaactgaagcaacttagcaaagacaccttaaagaatacattaactattaatccctaatagagattaactgctaaggggctaagagaattccaaagaatgcaaaaattgcagatatagagagcagtcactgcctcagagactgaggcagagaaccaaagggagaaacaaattttcaagagagcccactaagtctaaaatttagaccccattattgaaagtgtggctgtgatactgtatatgatggataaattcattgagatcatgtactctgagttcaacaaagaggaaacttcctattggggaggagaatttactagacactggcccctagaattttcctgagactttgttgtgaagctaccagagaggtcctgttaaaactccagagaaaatttcccccttattgtgcctgtaaaactcagcaagaagccattgagaaactagcagacttcactaaggaaccactttccgagtctctacagatagctgcttggaggtgagaatcataggagattcagaagacccggatgtcatatgtcaccagagcaaggaggagaga

SEQ ID NO: 25376 - DNA, 1085 bp, Bovine  19866880938230
catttctatgactctattttggaggatataactccatctctaggattttgaaaatctatagggtatacaaatgagactcactgatgatttaaaaaacactaactttctgcaatatgaaaaaaaaagatttttttctattccgaaaaatggaggtataatttataaattactttttctctctacaggttaatataatttcacttaaagttttctggcatttcctgactaattatgtaatgttaaatatgaattcactggagaaatatgtaactaatgtatattcttaagaatgaagctttatcttcttgtacttcgtcttttgagttattgaattgatgaactaccattatcttaattggggctttacaccatgagataattttatctcacagaattaccattttgtttcttggcatcttactacaacagatattcttggtattttattgaaaagatattttatgactcttcatattttattgattgtgatttaatcacaatcagaaaaattttatatatcaatttaagtaaggaacattctgaaatttacacattgcctcaaaagtaggaaatctcctcactcactatgctaattctgatagggaaactttgtctataacatctaacttgaccaagagctttgagaatattttctttggttactttaatgctctgttagtatttctgggtttctttttcctaatcctagacaatatttaacatttatttaacttaatcagaagttgtaaatcttcaaacattttaaagatgaaaagacattacataattttacatcatttatgcaaacatgatatttatgctcaccttctagagttatgaagcaataatattttcagctttctttaattcacagtatgtaaacttcacaatgtttctaatattctttatgccatttttgaaatagatggattgattaggaaattgtgatgtttacagataagttggggacagataaaaattttgaaatgtatttatatattctactacacatcaatttttattatttgaggagcattgcttaaaaataatacaggtgacttcaaactgacacagcggaacattca

SEQ ID NO: 25377 - DNA, 1597 bp, Bovine  19866880962900
agtattcttacctagaagaattcctggacagacctggtgtcacagagtcagacatgactgagtgactaacattaagactaatcctacttcagagcttctctttctccagcccaatgctcattcaactaattcatcctttccatgaatttaaagataacaaacataaatagtattgtcttctatgaatcttgcaagcagaaagtgagtcaatctttatggcatttccatttatgccatatagaaatatcttttaattagttgcatttgtttttatataccatcagatgcagccttagctcacaattttgtccttaatgatgattcattagctatgtttcaaaaatatacagtatttattaatatcaggtactgctcaaaatctacttctaggttaagatttgagaagataccatgtgattcaaaatagagtatcagtgcatctatagtgcattacacttctgatatagtaaatattttatgagtattaacaggaaatttaaagcattactgactcttgataggaatacaggatcactgacctctgtggatggtgccattttccttagctcagattccttagctacttcttgaggtcagaatcataattcccaccatattatatttgtattcttattgagctattcatatttgcaggattttacagacaagttagaactttgtcatagttcaaagatatggtgaagtatttcttctctatgtgtttcaggacatagctgatattttagagcagaatggagaacatctggcagtttattcgaaatgcagaatctggagccccattccagacctgctgaattaaaaatctgcatttttacaaggtccccaagtgttttgtctgtgttgttgtttcagtcgctaagtcatgtacgactctgtgactgcatgaactgcagcacaccaggcttcccgctccttcactatctcccagggttttctcagattcatgtccataaagtctatatgttaaggttttaagatgcattgttgtagaaagcacaagcaataaaaagttgtggttttgctggacatgtctttcacacacggcgacaatagaagagttaggttacgttgatcttatatcaagaggaatagaattgcaagaggagaaaagaagaagaaagagctggcattctttcaagagaaaaagataaggtggaattgttgaattgcatcatcattaaatatgcaggttctaaatgttaacaagcttaggttattttagagatttagtgatgttaatctttttataatcattcaagttctttgttgctaagggactttggcatcagattttgtatttctccaacacttacatgtttaaataaacagcatgtttatttagtgttaaaatgcttcatgcagcattgtttacaattgagcagatatgagtttgttttgatgtaactgttaaaaatgatagtataatctactgggaatatgatacggttttccaatcttcctcaacagatttcacattaccaggcaatcttaatgtaaaatttcctgaatcagtgagagtttcatgccaaaaaattagaatatatagtaagatctatgtatgtgtaaaccatatatg

SEQ ID NO: 25378 - DNA, 1127 bp, Bovine  19866881064015
gcaaattttggtttcgtgacacttggcatttggttttgagtatcatgaaaaccacctcaagatagataaataaatgatattaccctggtttctatttgatttctactttacatgaaaacaaaatagaatttttaacttgaatatgggagtataaataattataaagaaacgtatgtcgttttaatattgtttataattcctttgtttcagtgattatttcagtctttggtgttattgaagccaatttgactactttgtctagaaggtaatcttcttatttctgccacccaaaattcaaaagtaaaaatatctgattttgacttttgaggtggagtaggaattattatgtctttgcctcttcctgctcatcttgattgctctccaactctctaaatctccattttagctcaaaaactagaatgtcacatgtttgatggatttctgttttctgagttttataaagaaatttaatataaattcaatatgtttccaaagtaaatttaatataaactttggttttctatggggaaatatatgataggctataaagatatatgatgcctattttatttttatttggagacattgtagaatagttgcaaggagttaaattggccctgaatatttgttatttgtaaccttatgttgtgtcaatatcgtaggaaacacacaagtaacttgtgactcaaagattgataggtgacagcttctattatcttataactcacatttatcgggcaacaaataaatcaatgtgataaatttattgttagaggtatgaatacgtagctatagtagaatagagggagttttaatttgcttaatttaataattttctaatatctaggtttatctatattagcctgaatgcaaaatgatctttctgtatcaaacgcagactatctctctaaatcccagtcccctatctgaggcagagaggagagccattggttatgcctgtgtgtacaaagggaagggatttataccacaggagaagaactccaaaattacgaatcttgaagttgaaatgggaactgctacacagctcccaccctcctcccttgagagagggcaagaaacctatctctccaaaattttacaagttttaaatgtaatataaacttgac

SEQ ID NO: 25379 - DNA, 755 bp, Bovine  19866881096245
tttactagtttttgttataattgcatctttcaggcaaatcagccatctgaatgagcttgacaaaggccatctcttccagtggttaggcatttgggaatccatgttttcagaaggaagcatgtcaggccaatgctccaaatgttgaggataaacaagtggaattttctggcatctgtgatatgagtcattgacagttattttcatatacattctctctgacagagaaagattatggagggttttcaacttgccaacaatttctctacattaatttgtctggatattttccaaaatatttatctgaagagaaaggcttattattgcctggataacagtgctttttcctaaggcctcacttttgtggatcatgcattgctatccttcgactatgcttgctcatcactgaatattaccatgatgaattaaatgggtgtttttctttattctaaatcagtgccagagatcaaaaagctgctaaaaatcctttccacaagagtgcctcccagaaaaggatgaattatagttattctcgccaacagatacattctgttgtactctatcactttctacgatccaacaacttgaaactgtgccaagctaattagctagttcagtgattgttatattaagagtccaaataggcccaaagaggtcaccctcttcatactcaagtacaactttatcacttttctcaccaatcagaatgtggcataaagtttcccaacaactaaactcaatatattatcttcatgtag

SEQ ID NO: 25380 - DNA, 1340 bp, Bovine  19866881120993
atgtttctgagaaaagcaaaaacatttacactctcaccagccatgaataagcatgtctatttcactaatgcttttatatatagaaagttctcatctagatatttgatcaattattcagttctcagttttttattgctttctttgtggttttatttttacatttaactataaaaattaagatgtattttctattttagtatggagtgaggtgactgtctaaattatttttaccaaagcctattcaattttcattttgtaattttccctgtcattactgcgtaaaagcagcaagttcctttttaatagttctaacaatatattgaaaattatagtaaccagaatcagtgattgtgctttatgtttgctctgcagaacattttctgtacatgaacttggtgatgatcttttggattcccaactccaagtccctacttggttctcaaattaccctatattccctttaccagggcttctctggtggctcagctggtaaagaatccatctgcaatgcaggagacctgggtttgatccctgggttgggaagatcccctggagaaggggaaggctacccattctagtattctggcctagagtattccatgaaatctatagtccatggctgctgctaagctgctgctaagtcgcttcagtcatgtctaactctgtgcgaccccatagaccgcagcccaccaggctctgccatccctgggattctccaggcaagatcactggagtgggttgccatttccttttccaatgcatgaaagtgaaaagtgaaagtgaagtcactcagtcgtgtccatggggtaacaaagaattggacaggactatgcaactttcggagaaggcaatggcactccactccagtactcttgcctagaaaatcccatggagggaggagcctggtgggctacagtccatgaggtcactaagagtcggacatgactgagcgaattccctttcacttttctgcattggagaaagaaatggcaacccactccagtgttcttgcctggagaatcccagggatggcggagcctggtgggctgcggtctatggggtcgcacagggtcggacacgactgaagcgacttagcagcagccagcatgcaactttctactttcactttccctttaccataggccagtggtaaagaatctgcctgccagtggaggagatgtaagagacatgagtttgatccctgggttggaaagatcccctggagaaggacatgccactcactccagtattcttgtctagagaatccccatggacagaggagcctgttgggctcatggcgtcacagagtcagacacactcttaccacattaacaatctag

SEQ ID NO: 25381 - DNA, 806 bp, Bovine  19866881135519
aaagttgtggtaattattttcttaaaattgtcagaatgtgtgctaatctggggatagttatctttattccttctttggcttattacaggtttaaattaagctgaggtttctttagtgttatttttctagagccactgggattagagatgatggattttgtggtgctctgagtatagttaagctcttgtcaacataagtataaaattattgctgtgtgcagttggtatgttttcgaaggtaattaaagctaaacattgtgcagagaaagatgattagaaatcttcaattcacaaagaaatccagctttgctttgacacctaaaacctcacattctttctgtttaaaaaaaaacaaacttaaactatagaacttttagaaaatttttcgtgctgatttcaaaatcaaccccaatcctgaattattttctgtaaaatgcatgattcttacccctgacagtctaagcactatctgaatattttagaaccttatttgttcatttcatattcctactttagttatagaatagtcttgtatacttttgataggggtatattttaaaaacaaacagaaaatgacagacttaattaattacctatttgttatttttttctttttttctaaagctatccacttaaaattttccttttttttttttttttttaatgctgacatcaccattttattagggatatgaatgttgataaaatgcaggagaaagtaggttaatgccaagtatggtagtttacaccatacttggtaatttggttgcttctgaattctccttttcatctttccacacaaaatat

SEQ ID NO: 25382 - DNA, 710 bp, Bovine  19866881157593
aaaatgttagtaaacccaagaaaactattcagtggaatcagctctatgtaaatgaacaccaacatttgcatatttccttttccttcttcatacattaagaggccccaggtggtgctgaaacaagagtgcagtttgttttgggattctgtaacaatttgtatcttttgctcattcaccagctgtgtcaaatatggtgcatgataactggtgggatcttctcattgaagaaaacattttcttttaaaatctggttcttgatagtcatgtaagtggaaaataacttattagctagaaaaccatgatttagatcttaaacccagagtcttactctaagaaaaaatatagtcccttattgctttagaaaacctaaccaggtacaaagagagtggtattatcagtgaaaaccaaagcactggaaaaaaggagaggaaaaaaaggatcacagaaagaagatattactatgttatcttttctaaatattaagataagcagaaattaaaacttctcaactgttcattttaagaaaattggccatataagatcgcaattaaggatgtttacaaaatgtgtagactccattgaaaaatgagaatgtggagacccttgttcaaaaaacagggggaaaaagtacagttaaaggtactaagacatgaagctctttcttttaaagtattttattatttataaaacacaatggaagaacacatgag

SEQ ID NO: 25383 - DNA, 935 bp, Bovine  19866881163402
actgtgttccagctgccacgtggaattctcttcatcccctgtggtcgtcacatcagaagtcatccctcgtggcctttccctgattcatagtcttcccttcctctgagggcatggagttcccacttgagtcccacctcttcaaaaaaaaaaaagcaaaactatttttttggaactttatgtctacttcactctgttacagaatatcattttatgtgaataagtactattagactgcattcttcgagcatcatttaaaagggaaatatctgtattaaaaaatcttggctgaaattcaaggttagctactccctgctgctgctaagtcacttcagttgtgtccgactctgtgtgaccccatagacggcagcccaccaggctcccccatccctggcattctccaggcaagaacaccgggagtgggttgccatttccttctccaatgcatgaaagtgaaaagtgaaagtgaccccatggactgcagcctaccaggctcctccgtccatggattttccaggcaagagtactggagtggggtgccattgccttctccgctagcagtgtccaaaaactgggtacagacctcctcaggtatattcaatttttatgatactttttattacaattggcatttactttgaatgccttataccaaatgctcctcttttctcacctagacagagttctcttatcctcttgtggatcgtttgcccaatactgaaactctgtcaggaaatttttgttggttaaattttaatgctgtggactttgtgatatatgaaagtagaaaagctttaataaagaaggatgaggataggtaaatccaggtactgtgctgacccactagtctgtctttatatttagactttttcacagactatttctagtacaattattttacctcacattctttgaacaaggaacagaaccagataatt

SEQ ID NO: 25384 - DNA, 1805 bp, Bovine  19866881268072
tacgttgaaatttaggataaaactatagatgggttattactccttaaaatgattttctatacctgaaagatgctatattacttcactttctatatatcatgttctgattgtgttttaagccattttttgaccctacagcaaatgagtttcattaaaatttattacagctttattaaatatgagtagcaatataaaatatatccatactaaatcactcatggcagtccaatgccaatctacttaaaataaaactaatgtccttaagctaacttaccagaccttctagtgaatttattttcactaggatttctattctgctaactaatcagctctggtaaagctaatcatttttccaagacacaatttccttatttgtaaaataaaaaaataaaaagccactagctctcaggattatttgtaagcatttttccaatagtctaacacaaatatgtaataggaaaaattattctgagtatctactagtttgttttgcaaatctctgtgttaaaatctaccattcttaaaatacctgacctaccagaatattggagctcataatggtatggttaaaaccacagcaggtactaccctcggaattgtttcttttgactttaataatatttttttcttggggatgacgagtgctgatggtaaagcaaatgcctgtaatagtgatttggacactatttatcttagcttagtaaatatttaggcatgtgccacatgcgtgaaggacaaggacatattatatctgaggctagttgagaagcagaacacagatgtctacgatttatggaaatgtatctgggcaacagttttctgtggtgtttacagagaataaatttcaagaccatgggaaaaatactcaaatgtagaggtctttttaaaatctcatttcacaaataagggcatagagtattctactagagataattttataatatcttgaaagtgaaagcgtttgtcactcaatggtgtccgactgtttgcagccccgcagactgtagcccatccatggaattctccaggcaagaatactggagtggattgccatttcctcctccagaggatcttcccaacccagggatcaaacttgggtcttctttattgcaggcagattctttaccaactgagccatcagggatggaaaaatatctttaaagatacaactaaataataaatattagtaatatttgtataaattttcacctacttgataaaggtgatgccatagttacagttgagttctgtttattttggaagaattctcaatggggaataggagctattaggagctaataggagctattaatagaaaagctaataggaggctattagctttcatctgattaagttgagcacattttctggaacaaggagattccaccagatagaaaaatatctcttttttttctttctacctaaccaagacaaagaagaaggagaaaaggaagggtggttggaggcagagaagagaggagggaggagaaatcacactcaaaacaaacaaaaagccttatccttttatacgtttcataaattattgtagttttgctttgatttctaggtttgcttaattattaaatgttgtgtgtgtgttccgaaatattaaacacatatttgtccagtaccatatttatacatctttataggtttttatttaacctggccacctaaaacaaatttataagtgcttttaagaacttccagaagttaatgactagaaggactatgttaaatagagcagatacagtcatttcagctaagtcatataagaggatcatccttaatattgaaaaggacaa

SEQ ID NO: 25385 - DNA, 1049 bp, Bovine  19866881364430
gttgtgtttgactctttgtgaccccatgggattgtagcccaccaggcttctctgtccacagggcattctctaggcaagaatactggagtgggttgccatgccctcctctaggggatcttcccagcccaggggtcgaacccaggtctccttcattgcagatggattctttaccatctgagccaccagggaagcccaggaatactggagtgggtagcctataccttctccaggggagcttccagacccagaaattgaaccagggtctcctgaattgcaggcagattctttaccaggtgagctacgaagactattatattcttagacttagtacacactcaggagcagtattttgttattttctatgtataatataggattagaactggtctctaagctttggtatttataggctaattgacaagccataaatttgccactagtcacaacgtatataagtatttatataaatatataatataaatacatatgttttatctcacaactttgtatctactggtgcaactaacagtagtcactaaaaaaaaggttagtatagaacaaataaaaatttgtattagagacttaaataatgcttttggtcagctttattttcacttttatattcctatactgatttaggagctgaaatatcctcagccatataaatcacaacaattacaaacccccagactagggttcaaatgagagttttatcttcaaacacactcctttttgctttgcaataagccttttatttacaaatgggttttcattatccatagaaaatgcaaatgatgcaagttaaactcgttcaagattaattttcatttgagaagtgcaagatttgtcgctcttccttttcacaggcaaatatccatagcatacattaatgtttcatgagaataaacagcatattaaatgaatcctcctggacaaatggcatttggtcctatcatatacaaataattctgacatttgataggacaaagaaacatcactttgacattaccctcggttaagattttaaaataaaacatgggggctggtat

SEQ ID NO: 25386 - DNA, 1199 bp, Bovine  19866881377540
aaaatgtggcctaagtggaaattgacaggcaatgctcttgaattagctgttaccatgtcaataggtgtaaattacaacagggaatgttgactttaattggaagatccctagcattgctctgattttagctttgagatacacaaacaagaagtcattttattctgtcacttcacatcatagtagagatacaagtaagggcaataagttcaaccaagacaaatagaaaataaagcttccttttatcaaaaactctagaaggtggctaggtgcactgactcagttaagggtaggtgttaatgatttctaaagactcattaaagatagcgatccatttcaaagtgtgtttagtttgacagaaaatgtgttggagtaaataggatgaacaaagggaacagcaggaataaacaaatattggatcttcactgcttactattaatagtttaaaatctctaaaatataaatgtctcgaaaaaaaggtctccactacaatttgtggaaagtgagacaggttactatttttctaccaaagccattaatatctgagtcatagatctaagtcaagacattggatcagaattaacgatgtgagaaaccattagaaagcaatttaataagacactctaagagacatttatctgttttgtgtgtgcaagttgctcagtgatgtccaactctttgccaccccatggattatacagtccatggaattctccaggccagaatactgtagtgggtagtcgttcccttcttcagggcatttccccaatccaggaatcaaactggggtctcctacattgcagatggattctttactagctgagctaccactgaattacataactatagttctgaaactctggactgtggactacctaggcaggaaggagttgttagaatgtagaaagcatgaaattactgggaaaaaaaaaaaaaaaaaggcaaatacaggtaagtttgaagatggccaacaaataagcagacaaccaaaaaaattttgatctatttacctgatagagatgacagacacgtattaaaaagcaggtctagggttctgagtctctgagcatcattacttcctcaatacactacttccccactaacatcagaacactgggttctccacagagataaacaattcatcgctgcagaggtttggtggtttataacttgtgccagaagaaaaactcaaggcaaagggt

SEQ ID NO: 25387 - DNA, 1088 bp, Bovine  19866881402553
ttaattgaaagcaaatgatttcaaagcacagtcatttgtgtcccagtttagtcatgatagatctcaagcagccttaaaaacatggcctttaattgtacaagcttgagtttggaggctgctgtcttaatcagctcaggctgctattacaaaatactatggcttgggtggcttaccagccacagaggtctgtttggcattagttctggcagctgggagtctgggctcacggtgccagcgtggtggggttctggtgagaaccctcatctgggctgcaggaggcttacttcttctggtgttttcacatgataacaaggttcctcttctcactagagccctggtctcattcctgaggactcccctctcaggagtgaatgaccccaaaggccctgcctataaataccaccacattggtgattagatttcaacatagaatttaaggggggtggcacaaacattcagtcccttaacagttgctcaaacaagttgaccagcttctaagagtggaaagccagcaattttttaaaatgtcattgtaattgtctataccttaaatggtactttgttctgaagaaaatagtaagaatttatcattaagtcttcttagtaattggttaactttctgcctctgatagataatttgtcttataataaaaatgtgccaccgtgaccttaacactttatagtctctgtcagtgtgacaggtgattttcttctctccaaattaggcagtgattctagggactcaaagtaatttttgtgacgtgattgacatgtgaaaaagtgacataccactttcactaaaaaagatgcatattatgagcaaagaggcctctgtgctctgataaaactaaaagggaaaaactactatgttgataattctgaggaagaaagccaataaaaatcatcccatccccatgtacttcattatagactttgaggtagggtcattatttatattagattcttagaataaagttgaactgatttttaaaatgcaacatatagttgagaagataagaagctattgaacattttggatatgagttgaaagaaaataatccatcctattcattgcaaggtttcgagtc

SEQ ID NO: 25388 - DNA, 1027 bp, Bovine  19866881407029
ggggaagtcaactgtgaagagagcgttactcacagaggctcctgacccttagaaataccctcagctgttctgaaaaccacaggaaatctactttgtttactggaagtgtgccaggtgtttctttttcataaactcgtaattgattaatcatcatcatcatctaggaaaaaaagggcaacattatgatgagaggttgtattttccatctgtataataaatagaatatttcaagtgagaaatgatgaagagaaaaagaggagcaaggcagagggaaaatatgaacataaagttaggcaagtagatatataatataatcatagtttatactcccaagctatttgaattttacatctacaaaataaaacactaaattggcaatatcagttaatattttattctagaattataactgttttagtttctggaataatattcagtcaaaaataatgaagtaaagcacagtatgatcatcattttaaaaattgctacacttagatagtaatatcttattaaaattagttgtgaataaaatagaaagctgacagtaagtgaaaatatattttttaaaaagacaatcatcttccttggaagcttccagtattttttaaaaaatggaaagtggtcacttaatagagacggtagaattggagagaagaatgttaggtatctagacattaaattaaaccatgcaaacatgacaagtaatcaagcagaccttttctaaaggcagattagtttaaataaaagaatatgtccctgtgtgggagaataatttacctacccggctgtacaatgaaccatcagggatgaactttagcagagcctggactacatagtaaaaaaatgtacaaaagaattacggattaacagctcattgtgaggactacatttggaaaaatacaatatgaatattaaaaatagatttcaagcttaagaataaatgattgctaattaataagaaatggccattgtctttttgcctctcattgtagttttattgagtctttgttctgaattaccatttaca

SEQ ID NO: 25389 - DNA, 691 bp, Bovine  19866881480339
gatagcaagagttggatacacttagagactaaaccccaccaccaggtgacaagtaattatatccagaaatcaagagcatccagtgcaagaatatttgagaatttccaggttttctttctcaggattataagccaagatattaagagactctttttctagggttgcagggctagttgagagaaggatcagatcaaaacctggtttctctctatacagtgccttgctttcactctcaaaaaataagcattttaactaaacacaggaaacaattcaggactgatgttgaaattataagccatattttggatccaagctctcatatactttccacgttttcaggaaggaaaaagaaagagcagtgatgatggaaataaactaatgctaagaaggtgacaaatacttacttgatcctgtttctcaatcagctgttccatgtctagttctaactgttgcttctaccatacatttttctcagcagacaggtaagatggtctgatagtcccatctcgttaagaattttccacatttgttgttatccacacaatcgaagagccgcatagtcaaattattcattcacataatcaaccaaacagaactaggtgtttttctagaattcccttgctttttccatgatccaacaaatgtttccaatttaatctctggttcctctgcctctctgaaacccagcttg

SEQ ID NO: 25390 - DNA, 1118 bp, Bovine  19866880573336
aaaaagtattttatattatcaaaaaaatgaagcagtgactattttcattttgttatatcaactcagtattttcctattgataatgttgcacaattactcaaaaatgctctatttgaagtctgttataattatctaatgaatgtgttatgcccatataattgagtctagactttatttttttaaaactaataataatgataataaaataaattttttgctgaacattcactttatatatggaactgtagggaaaataatacatgagtaatcttatttaattctcacaataatcctatgatgctggtatcattctttcacatcatttttgtagaagaaattagtctcagagagattaaatagctcatgcaagagtatagaccagaaagtgaggtgtcaagactggaaaatcttttattccagaggaaatgtttctgattaacatgaagaccacagaggcttttacttctttttctccaataggctctgcaaaatgctgattatgtgttttactcattagtcctgggaatatttttggtttgagggcttagccctgcagcttttcctgaccttcatgccctgacctttcatttttctcttttttgtctagaatcttctctcacacagcagtgaagaaaaacaatatatttaactttccccagggaaaagaaatacttgtagattaggtttcatagggaaaaatacaaataagcaaataaataaaaataaagtgaaagtaatcatacattttgaagtcaaatgacacttcatcattccttgacttaagacatacgagggggttattgcttaatcatgtaacaaccaattgtatttaaactgcatattatactatagcttttcattttttcctgtcctcatagatttttcctttttttgagtcattattgtatttttaggactgagaaaatatcaagcctatagaacattcaggaaatgcttacataaattgacataaatgaacaacaaatggatggatgggtcacattctataagaaaacacaagccagagccactgggagccattaatcatccatggtcaaagaaggcagcaaacagaggggcccaggttttcaatgtccccaaaattcaaaagagtccaa

SEQ ID NO: 25391 - DNA, 813 bp, Bovine  19866880954618
tgtggacacaagaagtgcatcgcccaagggcatctctttgggtttaggctagtggcaaatcatgacaggaattcaacctttcccttacaggatgcttataaactgacaaaatcaggttaatgtgaacaccaaggtcaaccacaaaaggaaaagactttcacaaaaaggcagcctaaggtagattagtatttaaggatagcaaacaagtgtaattgatcaatggcacacatgtgcaaccttgggttccttagtacatctggcagacaaccctttcctacccacatcttaccctctattcccaaagcattatccattgttcttaattcactaaaaatgactttacaaataactatttcaaaatgttgataagttaactgtcctttataacccttcaaaaagaaagatgaattgtaaagataatactttgtcaaactttgattattaaaagatagaaaaccatatactgtgtgtttactttggtatgaatctggcaagtatctgaagtaaaaaatatttatccaaatatttacaaattttatttttcctcatggaataaaatgtatagaaagcatgcttatttttaaaaataataatataggattctgtaaagaagacttctgctcttatatgaagatttcaagttgccttatatcttagtctattaaatttttttagaaaaataataataggatttattaagtgcaaaggaactgttttaaaacatgtgtaaaactgtcatagtagatttctttgaataaattttaggatggtttattgtcttgacccgtggcactaatcagtattgttacaagt

SEQ ID NO: 25392 - DNA, 1992 bp, Bovine  19866881077451
ttgtaaaccgatgctaatattactagttaatcccgtaagaaatagaatattccatgactcctattcatgagatacaaagccactggaccaaggaaacctatagctaggtaaccctagaggtactgaggtctacaaaagatgattctgtttttctctccacaagataaggtaaagtatttattgacactatttattgggtatggctacctattttatgccgatcagttcataagtacatatgaaagtgaaagtcgctcaggcatgtctgactcttgcaaccccattgactgtacagtccatggaattctccaggccagaatactgcagtgggtagcctttcccttctcctagggatctccccaacacagggatcagacccagatctcccgcattgaaggctgattgtttaccagctgagccacaagggaagcccaagtatactggagtgggtagccagcctatgcattctccagcagatctttccgacccaggaatcaaaccagggtctcctgcattgcaggcagattatttacaaactgaactatcagggacacacataagtacatatatagtaacctgtttcatcttatttatcattatatgaagcagttataattatcaacattttcctagttaagaaataaactttgaaagagcaataacaacaacaaaaactcaccagtgtcgcccagatagttacagatacagctataatttaagcctgattgactccaaaaacactgaatcactgaatgaaactactatggggaaatgcttctttattgaagtgaagggtaggggggaggggaaggagtaagcagagagaggatgaaactgcaaagtgaggaaacaaaagtcccagaagacatgttgcatgaggcagtttgctattattagctcaccctgccaaatattctacttgattccatcctttggtttagtccttgacaaactctgtgtgccaaatcccctaggtgaagccttgcacttgatactttcatcactagatcataatacctattgtgtatgtgtgtgtggctgtgtgtgccgtgtgcatagtgatttttaaattttttttttattttttattgaagcataattgctttagagaattttgttgttttctgtcaaacctcaacatgaatcaaccataggtatacatatatccccctccttttgaaccttccttccatctccctcctcatcccacccctctaggttgatacagagcctctgagttttctgagtcatatagcaaattccctttggctatctattttatatatggtaatgtaaggttccatgttactctttccatacatctcaccctctcctcccctctccccatgtccataagtttgttctctatatctgtttctcccttgctgccctgtaaataagttcttcagtgtccataaacacttttcagatccataaacactgtttactctgaagatcatctccctgctttctgaggactctatagatgcaccaaaacatgtactcaagaaagagccagtttttattattttaaattgtaaaaatctacaacttttgagaaaatcacagctatcatctgaaagttatatcaacttagtactcataatacgaaagaactaatagctcagaattgaagaaacgcccctatatattggtaagtaatttttcaatgctcactcaccattttgctagaacatttggccttagttctcaacctgtataattactctcctgttttgagtgcagaaatacaaattatccagagagatgcaaacacatttattccagaccaaagtttggggctaaccaataattttacttctgtttatgagttaagaactagttgatatcgagtgtccacaaatgggatcagctagaagcctagattctcaccttttatgtaggtagctggtggtagaattgacatcctgaaaatctttaatagagaacagaaggaaaaagagttaaaggctatctaagaatagggattcc

SEQ ID NO: 25393 - DNA, 1818 bp, Bovine  19866881126581
gctatctaagaatagggattccttggtggattagtgtaaagaatccacctgtaatgcaggagacagagtaaatgagggttcaatccctgggttgagaagattgcctggaagaggaaatggcaacccactccagtattcttgccaggaaaatcccatggacaaaggagcctggtagactacagtctatgggatcgcaaaagagtcagacatgactgaacgactgagcacacatatacaaagaaatgaataacttctctgacactctcttgcatttcatgcatgagctcagtgcagtgaatagattagcacatttagttttcaattcagtagctgagggttgttatgaaagtcgagtgatacagatggtaggcaattattcatgctgcatcagaaaaccactataaagacactattaaaatatgattgttgattagtaatcatcatggtttctgtgaaaaaaaaaaaaaactttagtaaaaatgaaatccctggtggggattgctaatgaattaggaaaagggaaggttaagatgtcaatgtcattaactctgagatcagatgacctagatcatcattttccccttccgaagtctgtcaatttaaaccagtgcttttattataattatattattaatattatccatgtgcatttctaatgtatcacagcactcatgtagccttgcagtcaatataggtcttcttttttaaaagtcacccttgtttcctccttgttaaagcattcatttaattgggtattgcttttaagggaatttgaaaattcatagaacatgattttgccattggtgaacaacctacatagtgtaacaaaaattttcattgttaataatgataacttaatgagagctccgtatgaggtgaatgtggtcagactggattcttgtagattaaagtagattatttttaactttgcacaataatgtgtcaagatagtatggcctgaatgatgcccctgccctgcttcaacaattcaatgatgcccctgcttcaacattaatatgttgaagccctaacctctggtatttggagtcagggcctgtaaggagattgttcttgttgtttagtcactcagtgtgaccccatggactgcaggcaacaatgctcttccacccatgggattgcccaggcaagaatctttgagtaggttgccattttctactccaggggatcttcccaaccaagagattgaacccaccatctcctgcattggcaggatgattcttttcctgagtcacctgggaagcccctttcaggagattagataagattaaataaggtcataaagttaggaccctaagccaataggactggtgtccttctaagaagaagaagcagcactctaggagtgtgcacacagagaaaaaggccacatgaggacacggaagaagggggtcagctatgagccaaaggaaagaggacctagggaaaacaaaaaccagctaacaccttgatcttggatatccagcctccagtactgcaagaaaataaatttctcctccttactccatctgtcgtattttgcaatagcagtcctcatgcaactatttgtaagaaccagtctaggttttgtcaattccacacctttctgatttcatagcctgggttgactgactgtacctacaaatgcactttcagagctgaatttttctaatcaagtactaataaaatgctcttgaggtatatggagtttgggataagggagtaaatatgtaacttttattcttgttttttaaataccgtactgtttgattctacttttctgactttcccaagtttgggaactttaagattcttgagtat

SEQ ID NO: 25394 - DNA, 1643 bp, Bovine  19866881380392
tttttaatctgtagcagagcctgacttcccaatacttgctttaagattctattgttttgaagagtcatttctgagattcctttcatacattataacttttgccttctctgctgctgctgctgctaagtcgcttcattcgtgtctgactctgtgcaaccccatagacggcagtctaaatttgaaccaagttactaattatagtattagaatgctatcttaaattttatatttttagaaaataaaaagtactagcatacctaacgaatgactgtaaaatttgtaaaactctgaatatgttatatgtatttaataacaccacagttagtataatttagtaatattatttgaataaaacagaaaaaagtgctcatagcacatatttatcatactcttcaagaaagaggtaaaggaaaccacctacaatatattcaggaaaaaggaaagtaagcatcatggtttacagttagagatgtagcacaggccagtgttggctccctgcaatgaaatgtgaacttctttgaaatatgtgaaataatacaagcagagatgatagatggaggagaatttctgcttgaaacaatgcatagaaggaattatccaaatcaccctctgtgaaagcatgctgtagctgttgttctctttgtaaaagcaagaggagaaaatcaatatatagtaacagaatatatttttaacagtttagttttttctggtttgtttttccaaaaatgtttttgcaacgtgacaaattgaacttgtggaacttgtgtctagactgatactgttgagatcttaacattttggttttttcaagtacaaaatgagtgggatgcaacataccagggttttctagataattactgccccagaaatactgagggtacttggtaaatttcagattccagacatcattaaagatctactactcagtaccttttgctactataacaaattaaccacaaaatttgttaaaacaagacaaattctggaggtcagagtctgaaaaataggtctcactgggctaacgtcaaggtgtgagcagggctgtttttgttctggaagctctaggaacaacctgttttcttgtcttctccagcttctaaaggcttccatcattccctggatctttgcctcctcttctatcttcaaagctagtagagtcacatcttcaaatctttctctttctgctactaaagtcacatgacctttttttgattttgacctccagttgccttcttttaaggacactcgcagcacgccaggcctgctgagattcatggcgtcgcagagtcggacacgaccgagcgactgaactgaaggactctcgtgattatattaagtccacctggataatctaggatatgcttgatgtctcaaatccttaatttactcacatgtggtatacatatttttatgtaaggtaatataagtaaggtttagagattaagacttcaacatctttagggccatttttctgtttaccaggtcaaattttggtagaactagataatctgacttagcaattaaactctgtattcagcaacatttttgttagtacatacaactatttacttattgattcatctatataatcattaatttattcattattaacaagcatttgtttcatacctgttcgatgtgaa

SEQ ID NO: 25395 - DNA, 3233 bp, Bovine  19866881462999
gagggttttatatttaaattgatatttaaatagaatgagcagtttgatattttgcattacttagtactttccattctgagataaagttcttaagatcttctggttatatttacttcattcctaaagggttttaaaatatcttacatgtaaaaaattttgctagccactctgtattttagtaccttcatccttaaactcttaactatttagtcattacacttaaattttgccagttttaattggaaacattacctcaatattttaccctttactatgggctgattgtgtcctcacaagatttgtatgttgcatcctaaccctaaaagtgatggtaataggaggtgctgctttgggagttaattaagtcacgagggctgagccatcatgaagggaattagtgttctcaaagagtcctcagagagctcccaagctccttccaatacatgagaacacagaagtaggcagtctgcagctcaggagagggccttgaccagaatgtaaccatgcacaatgatcctggacttccaaccttccaaactgggagaaataaatgtctgtttataaactacccagtctgtggtgctttagtatggtataacgcagcctaaacagactaagatacaattctagacgtaaaaatgcagtgaatatacatatatatatatatgtaaaatatctagcacaaattcctggcatatatttagaataatataaaatgtttggggtgtgtatgcgtgtgtgtgcttatatctttgtgtattagtgtataggggcacatgcagagttgattcaggcataaacgtatatctggataaaaaaatttgtaaaatgtttagctataaaaaaatttctagagattgtatttgtcccccaaaccatgtgaagattttattgaataatatgttaattttgttccttctttttcctttcacaatttatgttgttcattatttagttgctaagtcaagccgtgttcttggtaacctcatggactgcagcatgccaggcttccctgtctataacttataccaagtaattatttgcatggaaataccaaccatgttggataacatgcaggtcttaatggaatttgtgaacctgcttaatttatattcccttggcgtctacaagacttcttagtggtcatgaaggagttgtggagggaatcactcaaatacagcatgagtcatttagacaacagttttcagaatcacacctaaccaaaaaatgtacaattctatttggggatcatgtgttatcctgatgtgtttgaattctttatgtacatcttatcatgttataattaaccttcaacttgtttcccagataagtgatgtttactttctttctctttgaaggaaaattcatatagcttctcttagatatatttccagtaaaacatttctcagagcttaacagctctcaacttgataaagatttccatcattaaacagattgcaatgttataaacaaatttctacattaatagctttcctaccaaaataccagtgacaaagtttgaagatgtgagtccacatgtatttgagtctatttctttgccatattaaatatagttttatttagatcacagttcatagaagacacttaaaaggctcaatatttttgctaaaaacacaaatgcttaagatggaggcattcttacataagactaacaattttcatacagattatgattaaaggatccagacggcttttgtccttgtttttctatcccaagtccatcacaatatcttagcagagtactgtatattcagtggacagttaataaaaattaactagggttcttatcagctatatggagactttatagcatgaataatagtagaaatataaacaagtgatgttttaaagctaaatgacatttatatgttttggatcaatgttttctccctctgtgtaatgtacttgataaaatatttaagaaaatataaaatactgtgtactgatcacagagcctttatatttcctttggtcatttctttccaactgaaaggtattctttgaatctgagatccaattatcatcatttgaggaaagattcacactatcaatttaatataaatttttttagcagtctacatgatacatgaagggaataaaactatgtccttatttggtgttaaattgtctacttcatgtaataagcaaatgttgaaaatgagcagaggatgttctgtacaatttttctcaaatgacacagattggatgtccagtaattggctccagatttgatttctggtcaattactcacatttgagaccacattttatgtatcaagtttagcctctcttgcttgagctttttcccatttaataagcactttctatttatgtaatgcctatatctgaaaaatttaatataactcagatttctcattaattctggtgatataactgtgaattagatgagtatgcctttgcagtgatggaaactgaggtagagatagttggagtgggcctcatacaatctcaccatctctcatttgtaaagatctgccttcaaggaggaattgtcacctcatatccattcaacactggtaggtcaccatattcaaaagtttccatagtcactgtcccaagtttttatattttgaagctcattagctgagagagatgcttcagtttttgctactgcatgtacatctggcaagaaaaatctctgcactcagtaaaacaggagtgaggaaaaagagtgactactcaagagcctcactggcgagaacagggcaaattttctttcctagttattaatccattatatcaggttgtaaagcaggcacagttggtcctcaacagaggtctagtttctaaatgtctcagacaataacatatgccagcaacaaagctcaggatcttgggtctaatagtgaggtccttgaaatccgaagaatagcatttcaattttcaatatagtcactaaaataaaggctttgagcattcgatgggaagcagcgagatgacaatgaagcccttacaactggtatatttctcagtccattatttttccgaatacaaaatgaaaatactaaacataaagtctcaggtattactgttcaataatcactctgaaaagaggaaagcaggcatctatactgaaatgtgtccccctagagaaatctcctttttaaagagagatatgtaatgtgaaatgatgcaccaaaggaaatattagcaaaagcaggaatgatgccaaactaaccaaacagtaggaat

SEQ ID NO: 25396 - DNA, 3563 bp, Bovine  19866880406646
actctgaagccggccatctggctccaggctctgtgctgttagccccgagataagcccgcctttattgtgaaagataatgcttgtacaacatggcgagtggttgatcagcacttgctctcattgtctctctagccagagtgtggtttggccaccacacaggctggagtctgctttgtctatagaggaagccagaactcatcaacagacacagcctgggcctctacaggctcactcttttcctgcctgtttcttttagcctacatcccacaggagatgtaggctaaagggaacttgtcactacaagcacaggcagtgggtaagtctccaccggctgccctccctgccactccttccacggagacgtagcccctatccccaccactgtaagccagcccagcccagaggaggaggtgcaggcaggccggccatacccaggcctaacactatggaggacaagctgccatttcacctcttaggtctcagaattgtcttgcatggtcgaggttatgctgctatgagggaggccctgggggatgagacaccatgtggaagagagaggtcacagggagacgatccaaggtgccccagcccacaccaaggcctcacaggtgtgaaagaggatttcctggacctcctagaccagccctccaccagctggatgcagctggacaggcattcccaggcaagattgcatggagcccagccaacccacagaatcatgggatatcttttcatttcaagcctctgagttttccagggggctgttctacagcaacagtgaaggaacaaaggccaagccctcttgcagttccatgtctttcaatctgctctctcctcagccttctggcctttctctcactggaacactcccgcttgttcttcaagatccagctcacctcgtctttgtcacagatgggaagatacagaacagacacacaatctgccagaaggcataagtatctctaggacaaggttcagttgcttatgagtgaaaccccaaagaataatgctgtaaaaagagagaaggttaggggaattctctggtggtccagtggctaagacttcatgctaccatcgcagagggccccggttcattccctggtcagggaactggatcccacatgccacaagaccggtgcagctaaataaattttaaaaatatacaaaaaagagccaggatgtccaaaccctgagtctgctaaaagaaagaaggttatttctcacataagagacttgtagtggtaggtggcaccaggctggaacgagactctgttgccaggtgcccaggctccttctctattttcactgccatcttcagcatttagcttccactcagttcagaaaggtttcctgagcaactgctgcctgaactgctcctggaccagtgggaagaagggtgagaagaggatcagccacatctccctccctggaagatgacttctatctcgtaccttagtatgccaagcgttagtatgccagctctaaagacagctaaaagctaaaaattctatctagccaagtgtgcagctgaaaatgagtttactatcaggagagaagggaagatagatgtaggaaaagtagcagtctcaactcagggtaaattagaaccccctggaaggcaactgagcactaccactaacccacatgtcaattacctccatcccctgctacttgaaacatggttctcagaccagcatcatcagcatcaaccagaagcttgttaaaaatgcaagatcttgggccacctgctaatgattcgtaattgaattataactattcttggatgatttatttgcatacttgaaatagtttgggaagcactgacctagaacagcagttttcaaccctggttgtatgtcagaatcacctgggaaactttctaaagcctcctgaagcttgggtcccacctacagagcctctcatttaattggtctgggtgaaattcaggcgtttgtgattctgaaaacctcctgctagtgattctaatgtataaccgagtttggcaaatgatggctctaggctatttgggggaaagaatttgtctcctgaataacttctgagtcaccctggctgcagcctctcacctgactctctgaaaatttgtttggggcctctactctcttgctcccatttcaccccattctcttcattttggcttgtctgtccgcactttgtggttggaagtaatgcaggggttacactgtagcgcagcatagcagggacataaaactgcacatccccccaccccgcctttaacaacccccctccccacctggaaatcctccattggtctcctgctcctggctcactggccacttagcatattggtcagttctcagttcctcccttgagtccctatttgaagtattcctggaaatgtacaatttttacttcattgtgcagagcaaattatttctcctctcttcaccttactcctctgaggtttatcttttcacattacaggattcattagggagattaccaaaaaatctactttgaagagaaagaatgccactcccttgggagacagaagtggctgtggaagatggtgtttggaataataatagtaaaaaattcttctttactttcatgcatttcaaaatcttttagaatccatactagaaacactgacacatttataaatctacttctttaaaagtaaaacctttcataaggcaaaaatataccataagtgggcttcccaggtggtgctagtgcaaagaaactgcctgccaatgcaggagacataagagacgcaggttcagtccctgggtagggaagattccctgaaggagggcatggaaacccactccagtgttctttcctagagaatcccatggacagagcagcctggcaggctactgtccatagggtcgcaaagagtccaacacaactgaagcaacttagcacgcacacataccacaagtagagtcaaaggacaaatggaaaaatgcgggtgagggaattcaattcatttcacgaagagctcatcatcttcccaacatatgaagaattcctaaaaataaagaaggaaaaagataatttaaatttgaacttggcagagaatgagtggaaaagtttagagaaggatcaaatgccccttatacagaggaaaataggaaagtatgttcaacttcgatcataattggataaatacaaaatgaaactgccctgagagactcctggtttctggtctggtgtataatgagttttgtaagttgtcactccatcctaataacaagtaaaaagctgaacaaactaaaaacctcttagatctaccagaaaattgaggtcacagagcaaaccactgcacccaaagttggagagacaggcagatacagagaatcacatcttacaacctgcaaggaaactagtacagagtacatcgtgtctggatttcaacaaaaaattagaagacgtacttaaggcaaaaacaaaaagaagtccacagtttaaagagacagagcaagcatcatgcaaaattcagatatgcaaggatgttgaaattaccaaactggaaatttaaaatagctgtaattttaaaataaaggctaaagaaaaaa

SEQ ID NO: 25397 - DNA, 1812 bp, Bovine  19866880505536
tttgggttttcttcccgttcagatcactacagagtattaagcagagttccctgtgctatacagtatgttcttcttagttatccattttatgcatagtatcaatatgtatatgtgtcaactccagtctcccagttcatctcatctccccctttcccccagtatcccatacatttgttttctacatctgtgcctctgtttctgctttgcaaataagattataccatttttctagattccacatatatgcattaaaatatggtctttatctctctgtttctgacttacttcactctgtaacattctctagggtcattcacatctctgctaatgacctaattccatttctttttatggctaagtaatattccattgtataaatgtaccacagcttctttatccattcatctgttgatggacattgatgtcgttccatgtcctggctattgtaaatcatgttgctgtgaacactggggtgcatgtatgtttttgaattatggttttctctgggtatatgcccagtaatgagattgctgggtcgcatggtacctgtactttcagtttttaaaggtccatactgcttttcatagtgactgtatcagtttacactcccgccaactgtgcatgaaggggaaccttttgttttagtgtgaagatcccaggaaagttgtacaatgcaagctgggacttccacacagcgggtcctcagtgggatagaatagcacagttgctttcatttgccatatcatggagaggcctacgggggtctgggcatagtagaaaactctgtgagttgtgctccaggaaaggaatcctgctcttctatttctaccccttttatagatactttgggagtggggagcctttgaccagcatatgaaaatgggagtggtcatgagggtatcctgcaagagaggagagaccccatacagcctgtgccagctgctagaggactggcacagctgtgccaggagctcgtggagacctagtgggacggtgagacttctgagagcagaagccagtgccctcgccagctctttgccaggcaggcagaaaagagctgccagaatcagccagataagcctaattattcctccccgaacactcacccaaggttgggagggctggaagtggagggtgtactttttctctaaagcctgtccttaatctaaatgttgtgtaattcggtaaaggaacaattaaggaataaaaatttccagaaagtcattcagtgaaagtcccttctccctcttacatcatgggtgtttcaacaggtaggatggtctatgagaaattttaatcagaagaggccacaacttcaagtaagccactctttaaattcttttccaggcaaactcatcactctgtaaataaacctgtagttgcatttacataaaagtatttagtatgttagcatctcctctgaagattggggcaaaagaaaatagatgggatctctttctgtcagttagggttgtgttcatctgcatgctacagaaagctaggttttggtggcttaaacagacgaggagtttgtttttctctcataacaataaagtcagaggtaggtaattgcagaagctaattgagaggctcaacaatgtcaaggctgacacttctggggtcctcttggttggcatttctcttggttcatggcagttcagccacatgagtgttcaaggcaggaagagggtatagccagaagaggtacatgagatgcagctgtctctttctcaggacaataaaagcattaaagaaaccccttgctctgactcagcatacctctgaccgttgacctacacctgggcacatggt

SEQ ID NO: 25398 - DNA, 1842 bp, Bovine  19866880530823
catgggatttcctaggcaagaatattggagtgggttgccatttccttctccaggggatctttctgacccaggaatcaaacctgcatctcctgtattggcaggcagattctttaccactgagccaccaggaagccctgtgcccaagtcaaaaagtctcctctagtggtgatggcgtgtggtcgaggtggcactcaatcagtaaccgaacttacgggcactctgattagtatcctgacttatcagtgacccggcactcctgactctgtctagaacatcatgttatttatcttaaatggatcttttgcccaatctgtagatgatattaatttgtttctgctttgtaaatcactttgcactgtaaaatgtagtagggaattgctttaaattatattgactataataagttcctctttcaaaaaaccccagactttttccagaggggtcctgactcctaagggaatattcctctattctcaaagttgagaccgtctcttagaatcttgagatgctttcctttgattttcccagcccggtcaccagatagggcttattgtttcaaagcagttgctagagtaattaatacatctattgattaagttgcttcagtgaaataaaaggtgacttttccacccatgacgggactatgatccagtcgactgaaaaacagtatccttactccaaagagaagaggggaggccagctgctagcatgcttttccctttcatgaaaaaaatccacagcatgaaaagaaaaaccatatttttactaattttctcttaaattgtgtgttattctattctgggtgttactttaaattttcacatgtttctaccataatacatggaatcatttttaagactgaagaagccccatgaatgcatgcatgtgcatgtgtgtgttttgaaatcttgagcacctcatgtcccctaagccgtgagcaggacacagagggttctgcgattaacaggacattgtctctgatctcaagagctcagccagggttggagctggtaaggaaaccacaatcccgactcatcccagtatacacaggaactgtggggacacaaaagttgaaccagttacctggaggaagtagagcccctgagggcatttgtggtgagctcgtgacaagaggaatagagatcaggaagtgtttttatatccaagttcaaccaggaaaacagtagccactctgagtgttatatacaagagaatgaatttcctttagtgagttgattacacaggggacaaaagaggctttgaaggcaaccaaagctgagcaatctcaggagactgtttctccagttagaccaaagggacagaggaagcagggatcagtcacctggtagaagatggaacccaggcaacctgtctagtggagctggagctatggagaagacaagaaaaggaaaagtagtctggaatcttgccttttactctctcatccatcaccaggacctcctttcagttaaaaccagcagggaaccagctgttgcagaacccaggaaacatcagatggccctcctggagtatagagcaggacaaggagaagctttgattgtgaacagtaccaggagcaacagagcttctagcagatgtgacccttcagtggtcttttctttttctaagtgaaaaggatcattgttaatttctaaatggactagtttgagaatgttaaaggagtagaagggtactccagtcaaggcactgagttgggagaatgcatggcttaactaaaaatggccagtttgccagtgtggctggagcagagaagcaggaggagatataggacatgagttgaaaattgtaatagccaaccagtccatcctaaaggagatcagt

SEQ ID NO: 25399 - DNA, 2340 bp, Bovine  19866880533746
ccgagcgtataagagttgtgacctgaaagatatcagactgtgggaaagtaagattttgaggagtattcgggagtgacccattgtgctgagcctgttttctaggctcatctctgccttgactattgggagaagaaggcatggggatttgcaggagagcaggcaaaatattgaaggactaggagacttaaaagatgtacttgactgcctagctgctttagattctatgacaatgtaattaaaaacactaaaattagttctttccacattctattgccttactccttgagcatgtgatgggtgtatggggctgtgtctacaagaatgtgcacttgtgtgtctcctcacaactgaacctgaggcttcagtgattcctagagctcagacaatcacctgatacaaaacttttcatttaaagatgaaattactccttggagaattttcaccaaaggcaaaaaagcacaaaaattcttctcctcctctctacatgcctcattacacagagatagaggattcaatgtttgaaaaattatcatttttgtaggttttatttgtgggacgtgagaactgggaaatatagagctcaatttaacagatgccatctctgcctttacaaacgccccactcctgctatcacacaatcagatgtgtgtgtgtgtgtataaatgcatatgcatatatatgtatatgtatttaaagcaatacatcagagttactatgttgtaaagattttagaactctattcgatgctcagttagacacacttattctgtgagtcaggataccggccaacaccagtgtcatgaagaccataactaagggataattggctggttgtcaagatgcatttttagatgaaaagtccacaatagcaaatacggtggggctgccctgtgagaagaggaagtgtggtgtcttggggtgagccacagaccctgagaggagctgctgaatcccattgtctcaccactaatttaccatctgccctgagtcaccaaaattaccctcaggcctctattaagtgggagtaataagcacattttatcgcagcattaaaagagggcccaacgagaaccctggcggcctgcagacttggccactggcaggctgtgggtgtggggacagggaaggaaatgagaaaaaggaggagaagtgtgtgaggaagataacctttaaaagaaagtccgcctcccccggggaggcatgggggccaccaccagtgactgccccagactccgaccagcacgacagtcaccccccagattgatcacccttccgcagaacagaaggtggacttagaaaaggttctgcctctggaccattccctgagctcatcttaatgtggccctggtccacagcatgtgttcaggctgcggtcttaatctgtgagcttctggtgtttaaaaacatctgaaagcttgaaagggaagggggcagttttactgtcttaaaacaaaacatcctgctccaacctgtcatgcttaaatgaattttgcttaatgatttccagggatttttttggaaatccatataaataattttacattttcttggaattaactgaatttgcagccgtgtggtaggttttgagaggcacaggctttcccttgggttctaataaactgaaggtgtgatctggtggctgagtgtgttagagaccttatctggtttgtttaggttactgagcacatttgccagtgggatccaccaagatcttcaaagaggggtctcagcatagcagactttagatactcataaattaaaagtctgagatccccagcttctcagctgcacgtctatgcaggtaacacatgtccttttcatgggctaccttcacagtttgtccttatcactctgcatatgggtctttctggtgcctcttcctcagatggcaccattgactgagaaacacatgaagaatcatatctgctgaagttgtgtgcctttaaagatactaagagacactgtttagacagaggtgagaagtctagtggtgtgtgtgcttagccactcagctgagtctaactctttgcaaccccatggactgtagcccgccagactcttctttccatggggattctccaggcaagagtactggagtgggtttccatttccttctccaggggaatcttcccaacccagggatcaaacccaggtctcccacattgtgggcagattctttactgtctgagctaccagggaagtctagtgaagggggacacatcagatatggttaggccagcagtgtgggatggtggtatttggtgagcccgttggctctgcctcatggactggtgcaggtatgtgtgtacacatatgtacagatgagggagagcgagtgtg

SEQ ID NO: 25400 - DNA, 2636 bp, Bovine  19866880551505
tctgtctagtcaaagctatggtttttccagtagtcatgtatggatgtgagagttggactataaagaaaactgagcactaaagaattggtgcttttgaactttggtgttagagaagactcttgagaatcccttggactgcaaagagatccaagcagtccatcctaaaggaaatcaatcctgaatattcactggaaggactaatgctgagatcgaagctccaacactttggccacctcatgtgaagaactgactcattggaaaaaaactcatgctgggaaagattgaaggcaggaggagaaggggacgacagaggatgagatggttggatggcatcactgacttgatggacatgaatctgagcaatctccaggagttggtaatggacaagaaggcctggtgtgctgcagtccatggggttgcaaagagttacagacgactgagtgactgaactgaactgaactccatcctgcctaataatcacccacctgtgaagtcttttccccattggtttctcagagcttgaggcatcttccttcatggcctcattgatggcataagctactaaagacaggacacatttattatcttcatgtgcacacttccagctctccataattagccaagctcctttgtgggaccacagattcagctttcaaaacagaagaggcatgtaaccatatggctgagtgtcaggatagaaggttagataaggctctatactcaccattgggtatcatttccagagcacttctatggtatcccagtaccaaggtacatcaatgtgactgcttacctgcctgaattcttttgtaaagaaaaaacaactggcttatactagaataaaagttcagattaactttagctgaaactggacaatgagttaggaaacatgaattctatccttcttttatatctcagatctctatggctttggacaaatcattgaaacaacagtttcagtgttatattctgtgtaacaagccaattaggcaatgcacatgcctatcaaattaggtaatgcacatgaaaacagattatccactgtgactgtacaaacacaatggggtgtgacatcagtgttagttgctgttactgatgtgaaaaaagtccgtgacagtggccttccctctgtcatttcgtccatccttgaatacaagtgcacagaacgtgcccaggtttgtgctctagaaaggaggaacagttttaggacacgtggtttgtgttctcaggttgtctgcagcatggatcaggagacaagactgacacaaatcaatgacaagcaaaatgtatgcaaatgcaggatcatacaggatcagactatttgtgtcactacagtcttcagaataaaaagggataatgaagctatactgtgattatgtcaggagaggcagcgcttcctctcattttctgggtgttctgtgatctaatcagttggcacttgcatcaggatctactaatcagtggctctattttctgccattcaccccctttcttcagggccacctagctcagagtaccccatgcatctgaagcccttggctcagttcctctgcaggctgcagaggaccacaggctcccacctctggctttcccaggtggaaggctgagtgcagctcccagagcctgatccagcctgctgtcttctccctgcctccatctgggcctgctgtcagtggacggatgcccatggcactggctcacccacccgaggtgaacaaatgggaccagagctcctgagctcctcagggaaagctaagaaggccggtcactggaacccatcattgcttatgatttgtctaccagggaaaggttacagaaatttatgagtgggcaccatatgccagcacaacatctgctttctcataaggggtgtgaatataggacagtgctaactaagtgcattaaaggagagattccaggcatgagaaaagtagtttaactgcttagggggtgaaaattccaaagcatattaggagttcacagcattattattttttattgatagatattattgtccagagcagttttaggtttacagcaaaattgaggggaagatacagagatttcttgtatacatcctacccctacacatacataacctttcccattatcaacatcccactccagagtgcttcaactgatgaacctatattattatccacaacaacatcattatcgcccaaagtccatggtttacttaggactcactctgggtgctgtatattccatgagttcggacagatgaataatgacatagatctatcatcatagtatcatacagagtagtttcactgccctaaaaaaaatctgtgctctgcctattcatccttccttcctcccacattcatttttcaaaataaatttcatgtagaacattaaatataagtgtagatgactctgctctcttcagaggtgctgggagacccagagtccttcctccaatctcttcccagtggttcttgagctactgtccccactgctgggatcttaaacagtttcaaaactattgttctcgttgattgaaggaaggggaatttattttattttccaatattttctgcatttaacactgaggaaaatcttatctcattctgacagaagatgttggacaatgtttcttacagatcagagtctta

SEQ ID NO: 25401 - DNA, 1361 bp, Bovine  19866880552913
tttatttttaacagagcatatgtgtttattattgaatcccttgcacctagcattgcacctgttgtgatgtgcacattgtgtgtttggagcatataggtatacacccatcctttttgtcctctttcagcacccttacccttctgaagaacagaaaaagcagttggcacaagacacgggactcaccatccttcaagtgaacaattggtaagtaatttggctttgtgtttacacacaatctgctttcccctctggcaacctacagctcttgttttgcattaagaagacacacccagttttccctagtggcttgttgatccaaaggtgagaacacaggatgagccacagcacttgctagattagaaagttttctttctagcacttgctagaaaagaaaacaccgtattgttctacacctcctttataaattgacaaattttaggcatagtaaaaataagtgtttaattcatttagctgtggctctgtaaatgtctcaggtattttttttttttttttatctttaaggacgatcaatagaaagagtaatatccttgtttctatgaaacaagaaactccactgtcacatctgttagattttaaattcgctgaataactaagctcactgagaatttgttagacagtgcattccaggatgggcactccatccttcttatctccctatggaaaaaagaaaaaaaaaagcgtttctactttgaagctattcaaaacttgatgtatctcagggttgtgtaatactgtttctaagtaaatgtgtaaattcctgatttggaagagaagctgagattatgtaccaaggatagccaacaatattctgactcaatgtatagcagtgtggcaaacagcctttgaggaagtatgatttattaccctttgtgattgtgctgaaagccaggtccatataatcacccagagctagtgtcatatttgaagggtatcgaaatctgatctcctttaaaactaagtgtatctaattaattgtcccaatatttttagattagtgtttatgatggggaaaccttatcctctttgaagtaaaatccagaaaaggcccaaagcctgattggggaaaaaggagaactgagaatgccagtctgcagacagaagtgtttctttctgttcaataagtgtcaaagattaatattacagaatctctgattacatggcctaatccattttggtgaataaatttgttctttgatgtccattgcacctacattaacagactcttctctgttagagagcctgggagcctttggggagagatttcagatatattaagccccattacagaaaatgtaattttctgtcaatataatcccatgtattcttcaatttagtatttt

SEQ ID NO: 25402 - DNA, 1142 bp, Bovine  19866880553725
caagagtactggagtgggttgctattgccttctctcactgactgtgcccaaattgcttagagttcagtggggatggctagaggataaacaggccatggagagacttcccctggtggtccagtggttaaaaatccgacctgccagtgcagaggacacaggttccatcgctagtccaggaagatcctgcatgccgtgaagcacttcagactaagtgctccagaacctgtgctccgcaaggagaagccattgcaatgaggcctgtgtgccatgcctaaagagtaacccctgctcgccgcagctagagaaagccatgcacagcaacaaggacccagcacagccaaaaataattaaaactaactaaataaataggccatggaaatatagtggaacacccactgtaattgtaggcacctggaatatgcatctacttctgtcttggagaatcatagaagttctcctcaagaaggggcatttttacactatttcacattctcccaagagttttcacatgtataatcccacttgttcctcagaacgcccttttgaaccagctagttcttttatgaccactgtggatggaggaaggaggactcggcaaatggaatcacttgacaaaggcgacacagataggaggggctgccctggaaagtcagaactgggccctggcctctgggtcagtcatgagttgtctgtgtttggggatgtggggggaaacttggagagatgagaaatagtggcctgacattgtgaaatcactgtgtgaccatctgggaatttggccccgattcactgccaagtttaagaagacctggaacaaccatttcacattcaaatagcccaggcagagcttcaaaacacccactttcccatattaaaaaaaataaggcaaacaaacaaggacagaagagagacagtgaacatgatcactcagagcagctttcataatttcagttacatcctttcttttgtgataacaaatagtcacataccatgcgctggaagtttttaggcttctctgatggacatcatcttcccataactgattcttctaagttatgtatttttaacccgatcccacacatgtctttgcactagtgaggggaccaaatacctagtttgggcctgcaggacccacgcttcaa

SEQ ID NO: 25403 - DNA, 2188 bp, Bovine  19866880565323
tttggaagtgggctcaaggataccgtcccatcttcctctgtaaaacttcctgatcaaaccaatgtgcagtttcgctacttgtcctgcaagacaatgtgtcatcatggtgacagcagtaaaagaatttgaaaatctctaattaggggagctgcagagcaattaacgcatgtcaaatttcacttcatcaagtgccactctaattttccctctaaaaattaatggatttttttttccttttggtatgtgtgtgtgtccccttaaggcaatgttgattcaaatctgctcaagatgcagtgttgcacagctaagcatcttcttgattacaatccgccacacttctaactgcgctcattctcactgccacggatactttgtcaacagtcaaattacaccacgctgataacaatgcataatggtgttcctcctccgaggcccctggcaggagatggggttcataaaaatgtgatgttttcttctcaactgtttctcaaggaagtttgtatgaccaggtcactagttaggcattcattttttgaaatgaattcgttaatttcaaggaaaggagagaaatgatggcatatgaaaacagctcattgaaaaaaggaatcagaagaagaatgaggaattgaaaatatccgtggccaaagttttgcttaaacactttattcgaagacattttcaagagcactattcttggttaaataccaggattttttttttttttctttacttatgggctataaacattggaagcctctcttgaacagacagtatttagattatgagagaagtttgtttaactgccgtatttgccagaatcctcaaaacattacaggacacagaagataaatgacttttttttaaggtcaggactgtatattccagataaatgttgattcattttaactattttttatcctagttgcttgttgcagatctgtatctgagtcaccagcccataggaggaatatttctcactgaaaaaatgaaagaaacacagtgattagatgatcttactttcagtctttttagagattattcagattttatgtctaaaacacaatcggatccagaacaaaaaaggggaaattaaacaaaatgctcgatgtgtatctttgcagattgttcagggagtagagaacattcacatggatgacatttcagttttctcatcatgtaagtatatttttggttatgttttctctagtcatatttagtaaaatatcaaattcatggaatgtacacttcatttttaaaaaattcacaggttgagtccaacttttcattcactgacaactaacttgaaaatctaaaatttgatattttgaggtttgtatttccaaatatcaaaaatttcttccttctcataaggcatgttcttaagtggtctatttcaaacaaaagaaaatgacattccactttcagctagcaaatgttagatttctctcaaagctgattggggactcacttggaagttttgccattagactcacacaaattgaattatattcatctttcccaaatattgttcttcaaactctataaatacagcaatactaggtttcaagtttcatgtgacttgtttacaaataaaggtatcttgagggggggaaaaaaacaagctctttgtacttcagaaggacaaaaacctggaacaatctcgtattaaaacattaacaaaggattgtaaagggaaatttaaagggataaaacttgattatataatgcaatccagcagtaatcaattttaccttcaatatcttgcttttgttttccaaatgctaaataaacaatacataatgcatccctcatcagccaaaccatggaggctctgtgctcaaataacaggaaacatattcaattttcctaacagaagacagttcattaagctgtgccacatcaaataaaactttaatttctccagcatcagagtcgcaatgaaagcaattgaagaagatgagccatatggtacttctatcagcaaacacatattgctcattcccccaaagttttctaattctgctccccagacctgtgtaatatagataatgtgctccgagagcagcaaccatgagctatctagtgtacacttctaatactgtatttaatgggaaataatgaatcataaaagcctagagaagacggcttttgctaacctaaatctcaactgtaatttcattgttctgtg

SEQ ID NO: 25404 - DNA, 2017 bp, Bovine  19866880579122
cagtgtgaagagccacagtttggaaactactgggaatattttccgtgcacgccttccaaggaaatacctagtggaggggtgcggccctttgggggtggtggaggggcagtggggctgagaaaagaggggagccatgggcaagaagagtgtttatgacccccacttagatgcttggttgttgttttagctgtttttttctccttaagaaatataaacctctagatggtacccagtcgctgctgttaagttttagtgttatggccataaatcaaaataactctatttactggggggaggggagggctggggatgttagagttgtgacagccaattttctgcaaactacgaatggggcgctcattctttttgtatctttgcagatgattcaagccatacaagtattaaggtttcatctgttggaattagagaaggtaatttctctagctttttttctccttttgcttccccctcacgcccaaacacacagaaagggagggttcagaatggctgaagttcaggcttcgaagatatttgcataaacgtctttctttctggtaattagtgtcaaggccaatctttgcgtccatttctctttgcagtttaattacaattttagacactaaaactgggatcacaaacgccctagccttgtattcattcttaataccttgctggctttgtgtaagtagttgcagggctctgcatccccttcgatgcgtagaaagctatcctgaatttgcttcacaggttgtaccttctcttcttcctcctagtcttctttgctacctctgagtggggggaaagttttgtttagtttcagtgagtttctggaagacagtctgagagcagcggcaggtcagatacagggggagaggcggagtgggaggaggagtgggcaaggagtgtggaggaggcggtgggggaggcactttaaaggttctgcggagacaaagcagagttgatagttgtgtcagtttcttgaatctgggaatcctgcacatatcccaccttcacactcaagaaagcgtgtgggataacatgattttgctagctgttctataaatctcagcagtaaaaacttaatgcattgtaattcaaagtaacattaaattgtaagcacactggggtttcttgtgaatttttgcatgtcagtgatgcctgtgtcctgtaagacaccgctccacctatccctaaatgttttgaagcattcttttcccttaaaaaattaatcagtttgatacctttttgtggctgtaagggttccccccccacacaccatatcaggagtcttttttttttttttttttaaggaagcatcctaatatatgcttcttatagatagaaaccctaattaccaatgttaaagggacttgggttgtcaggcatatatcgtataccaacacagtactggtcctttatatacatacatatatatgtatatttaagtttttgcttagacatgttggaaaaggatttatgataaaaataactggacaaaattaaatagtttaccttaaatgtcacccacgtaggtcacctctttaatggccacggccccaggagcagatgaatttaacacgggtgttgaatatgttgtagcctgtgaagcatcttgtcactgtcaattttctgggatatctctattttgctagaaaagaaagttattcctaattctggatgcgtctgggggtctctggaggacaattgccctgtgtttcccctatttagaagtttggatctcacaaggggggtggattgcacttgtcaatgtcatttatgaactcctgattatatttccatttttttatttctgtcataatgtaggtacacgaattatgtgacaatttctgccaccggtatattagctgtttgaaagggaaaatgcctatcgatttggtgatagacgatagagaaggaggatcaaaatcagacagtgaagatataacaagatcagcaaatctaactgaccaggtatgcgcttttcaatttcaacatcccgggaaaaaaaaaatctgta

SEQ ID NO: 25405 - DNA, 4330 bp, Bovine  19866880636007
ggtcctgttcttttcggatgccggattcaaggtgccagctccttttcctgctcgctcacaaatgagtctaaaaggatttcagatcactgaagcagactcctggcctgtcagatggctgggagcagaggaactctgggcggccacaaaacactgcttaaaaaacactaggcttctaacaagctggggaggaatcctggccgcacttttcaggttgcgagctctcaaaaccatgcactatatgtcaaactgtcaaacctttcagcgtgggccatttgccctttcaaataatatttaagaattgtttttacaaagttttataggccatggtctagtgaaagaggccaaccaacaaagaaaggaatttgtactacaattcgtctacggacaatttcttgtgagacctgggcccgtcccagcggagcaaggcaggtgacctgtgacagctcccaggctgtcagagagctcagatttcaaacacgctcaactcaaacatccctggtcgcctatttaagcatgcccaggcatttagactgcgctatctcgtgcctttcaaggcaggataaagcggcatttatcgtattcagaccattcaatgggtcagactgaccgtgtcagcgggggctctttccttggcaggtcaaagcccgactcccatttttcttcccctcctaactccctctccacctccaggactaccagtaccccaaacctattctgagggaggcaaaaacaaaatgcccaaaagcgcctgatatttacatcacaagggctgggcacttcccgtggcagtgggccagcaggtagaaataaactgggttgtcagtcaagagggttctttatgtcatagaggcaaaactcctaattagggagatgaactttcaactgccagggcaaaagaacgcgtaaggttgtggaccctcttgttttgctagaaaccaagctggaaaccacccctgcttcaaaaccatatcactgacaactctgtattgagactccatcttttcaggccacattctctccttaacctttacttctctcctccttgagtgtttagagatagagtctttgtccccagaatgtacctagactcaaaaatcaaggtcaacgataaccactatctttcaatactgagtcaattctattgtgccttgaaagttgtgtgaatgatcaaagtttgcctaggactgtacaggtcatgttgagaggtggttaaattttagggtttcctggtttcaaggttaaatattaagggtttctgttttttctcttgtctgttttctcatgtagcacatcttctagaaagaatatggcattcaactcttaaatggggtgcaggcacactccagtctttctagtggccactggtgcagacacccctatgctgtggggaggtcaggtttcctttgtagtcgggctatctgggtgtgccaggttgctaggaaaaatgtaaaacctaccccaagcccacttctccagatcctgacgtgtctacttagccagaagtcagaggggataatgtttctgtgttatgttaagaggataaatggcgagaattatagacaagcctttctcaggaaccagctagaatacttcagaggctttatggaggtgttttgtcttcatttagaatgtgtaatagctatcagaatgatttttctaaaacacgtttctgatcgtataaccctggcacttaaaatccttctgtggctgccctttgccttcaggataaaggtcacactttttagcctggcatagaaggcctttcatgatctctctctggggtgtttttccagcctgtcttccaccagatccccacgggcactgcactggccagcccacctccagcccagtcctgagtccacctggccttctcaggatctcaccgtacacaaggctctctcacgtccctttgtgtgctagttctatgctggtccctttccctgtagcatccttcctggcaaactccttggtgaaccttgtagattcggctcaaccaccatctcctctaaggagtctttgctggactctaataatctttactattcctccactccagttctgagtgatttttcttctccccacattcctctacccaaacatacatcatactctactaggtcttctgatttccatatatgttccctcagtgtgaccacagaatacgtgacaacggggacctggtcatactcctcactaaaattctctaatcccagagccaccctaatatatagggcacagccttgtcaattgcttattaaatgaatgtgtgaatgcacattttttcactgcatggagaaaatcatagtttcaatttccagctgttacaattttgtttgaaacacacctaaatgaaattcttgaaaaatattcaccaatgaaatgtaagaagacatttaaaaatgcattctccaaagctgggaaattttcttacaatttttaagcaatcttggacaagagatgaactaagagttgaagtatcagacttctttataatgtttactgtaacctttgagaaatacatctcttctccctgaaattacaacttaaaactatttacttaactaaaatgcctgctgttttcttcatttttcctgagttcaatatcaaaaaataaagcaagagctatttgcttccttctgcattttcccctcagtgaattaattatatcacctcgcctccaccacccttgacaatctcccagtttaaccctagcaaagaatctcaactgtccccaagcagacaatttgatcctgagctcagactccagactcacacttcacagctatggtgcaaacacaaaactgtggttttcccttggcttagccaaattatgtgtcagtccttcccatagcacccctcccacacatgccttagcaattcttcagcaacaggtatccagggacattaatatctgatactgttacaaattgacatgtcacaggatcctaggagacatcagaaaggtttttgcaagataaatgaaaacataatacaccctcataagccttcttccgcattttcaaaagaaattgagtgaacttcttatatctccaaatctacagccagtagacatatataatagtctaaatccaatggttaacttctacatttaactttgattagggttctgttaactcagcttctcttttgtatctcttctcatccttaggtgttgaaggtttccttgttcttagttcaaagggattctcagttgatcaaagaaaaataacaaaggaaagcagactctcatatatttttatttaaccaccacagctttcctgaaattgttgaggtagttcctttgggaaccaagatgaggtgttgttggtacctgcccaacaacaggcagtgctgagtcctagaagggactttgcaaagtgcccagtgggacagagtgcatcagtggtactgatcaacaagttggaggaaatgggagcagaggagaagatcaagagatcaagaagagcaaactttaagtaaacatattcttggcacttataaaaagaaatatctagctatgctttctaaggttggcttcacagaaattcactatgaggcttttcctttctagttgaatttaggcttgttaaactatgacagatatttattaatagttaaccactgtggaatgagctcacagtctcactctgccctttagtggactcctgatatcacagaaacccccagggaagagatggagaagctgagcctggaagcaggagctctctctataaacctactgtctccttttttaaagagtaaatgtagcattgaaaaatgagctctggatatatatccatcttttgcacaagctgtcactcttatcattcattcattcatttaacaaaaatgtactgaattcctactatgtcccaaacatgaatgccaacccctagagatacaaacggtgaaccaaaccaaaagagtccttgtttcgatgtgctttccagttagagggcacagatgttaaacaaaatagtcacagcaataagtatacaactgcactccatcagaaagaaatataaatccatgagtgtgtgaaacaaaggacattgacttaggtgggagtgatctggagcagaaatctccagaaggtgagagaaaagtcaactcggtagtgggcagcctgaaacagcagacggaagggaaatattgcaggttggaattgcatgtacagaggccctacctgtctggagaaggcatgaagcaaccacagtaccaggacctggcaaagcaagaggaggtgaagctggagaggaaagaggagcaagaccacacagggccttgggggatgtggtcaggatttaggtgctcatccctaggcttctaa

SEQ ID NO: 25406 - DNA, 3455 bp, Bovine  19866880663905
tctacaaaggagtaactcatactgtccagaaaacgcttatctagtaaagatgattaggatttaagatagttaaacatactggatttcagttaaaaagcctccttctttgtgaatttttggctgagtgtggattaactacctgaagccgtggctttcatgtgattctagcaaatatgaatttttattttttcagggaatggaaagtttgcaggacactaggtccaagaactatcagaaaaagaaaaatatccagttgtcctaccatagacaaaggtttaggaattttgttgatacctcttttttccccttaacaatgaccagattattgtgatatttaatttcatccaggctcgttcatttctattaaaaaaatatatcctgaacaactgaaaattgtttaatggagacagagtgctgggtctccatagcttgaggctgcctggcaattatgctgcatgaaattaggcacagtttgttccaattacttaaaatcagatcacatgaaaagtgacagaggggaaaataaaagggttgaactttctcattttatgatatttaaattatgaaatcagaaactgcatgatgtaaagaaacaatctaaatttgcactgacaatttgcaggccatagattgctctttgaagctataatgattcaggtgactttaaagatccaaagagaattttcctgacaccccttgcataaataaaatgtgaatctcttttgctttctaagaatttatgtaaaacttgctcacaaacaagcatgcaaaaatactcttgaaaacacagcacaaataaatgactgtgacaattctcaattttcaaagtaactaaaggtaaatggcataaatattaatttttatccagttctggtcataatattaaaacacaactaacaagacagggcaaaaggtgttaccattcagctgtggtgaagagggaccattgacatgtttattaattcttttgaaaatcactgaaagaagacctggcaaaactgtaagcaaattatattatagaggatgttatagattggaaatgacttaggtacatcagtatacaaccctatatagcaaatagtaccaacaactagatgctaaaatttgcatatttcagtcaggtttgtattacttaagaattgctagcctggagaactcccagatgataaaatcaaggaaaagttacctgttgttcaaagtctcatggttagtgaatagcagtgtaatttatacaatctaatagggtcatatataactatgtagtttttcaactagtatagatgtagatctactatatgtatatatacgtgctttgtgctcagttgtgttcaactctgtgcaaccgcatagactgtagcccaccaggctcctctgtccatgtaatttcccaggcaaaaatactggagtggatcgccatttcctactctaggggatcttcccaacccagggatcaaacccatgtcttttgaatctcctgcattggcagggattctttaccattgtcccacctgggaaacccttcatttggcttgtattgtgtggcaaatatttatgcaataggagtcgtgttttaaaccttgggcagtgaattgcttttaggtcagtgttcaatcattagattttgcctgtgatgactggcatcctagtgagtagggtgattgtcacctatgatcttcaccgattatggaggtgatatactttgctttgaaaagaatgggtaactatcacttttaggaatgaagtaagaaaagtagtgctgtggatctcggattagactgtttatacttcctatgggctttgaaaaaaatcttgtcatacattttgatgttacatttgagtggaaagtatctgtgtatcatggcaagttagagccattcctttgtctcatcaatatttggtttcctttatgtgaaggtctgggctttgaggatggtgaatgagaaatttgagggtgtttgagatgcttaaatgagtgggaaaagaaacatgaccaaggaaagaaataatcagaatgggtgtttctgagtgtgatgcttgcttttatggggataaagcggagagaatggtgtgagaatgataaggcaggctagtggagagtggggagggtagggcttggcatttgagttgagacttgacaatgacattggagtaggaacttgcgagtaggaacctacttggtgtgttggaagaatggaagatggctgaacagaaagtgaggtggggtgaggcgaagaggataccatctagaaggtgggtggggctggatggtggtgagtcttgcaggcaaggtgagtgtatggaggtttttgaagggggacaggaatggagattatgaaaggccttgccacacccttctgtcatgaagaggcttagatgctggatgggaagcaggaagtatgcctgggtcatgttgctgccgatcgtgccagccccgggccagtgtcctcacctgtaaaacgggagggacaatagattccatttatgtccctcaaagggatataatggggattaattaccactttgtctgtaatatactcgaagctcttaagagagcagcactatattccatgaaagcaaagccttattctaattgtgtatttattgattaagtgacaatcaagtcacaatgcttatgggaaaaatggctacatctctgcttgccacaaacgaatcccatgtgtatagatatagaacatatttaaacttacatataagagcattgaagtggtcattaacgagacttctaagcatctaatcggacattattaataagattgaaagctatgttaattaacattcaatagaccagaatttaatttctgatggcacatacagtaaaatggagagttggggtgctttttcccattcatatagagaagagaaagttgactatcaggacagtttctatcttgggagagtttattggggtgaagtgttcaaaatagtcagtgtctcaactagatggaaatcatgtcctcagcttctctcccaggctttagaaatgtatatttcaaacttagatatagttgactattaaatagaaagtatctgtgccaaaactaatcttagtagaattctaaacatttttacaagaagtatggatttcattttattatctaatcatgtaatattttttgtccactcttaactcctgagacttgttcttcgcacgcaaaatgttctggtctttgaccttactacattggcctgtgttcagaatcctagagtatgttgacattcagatagggaaccaactttggtagaatttcatttggttgtgctttacagaagagttgaaatgaatagtgtttttttttttttttttaaatacacccacttcaactttgatatggagaaggcaatggcaactcactccaaaactcttgcctggagagtcccatggacggagaagcctggtgggctacagtccatggaatctcgaagagtcggacatg

SEQ ID NO: 25407 - DNA, 1295 bp, Bovine  19866880675222
aatatgaatgtgatatatttctttttaattaaaagtagctgcattgtggtgtgatttttaataacttcagtgtctttggatttgtacattttagattcatgttggaacttgtacaccaccacgtgctgattgcaaaattcattagcgcgtaaatcaggttttagcgatcgtcttttaagcaaagttagtttgattgtgaagcactcactggttagcttatttattatgaaggtttttcaggcacagcagttaagttaatcagtaacaaataaaagatttaaacctatagacatgtcagccattttttaagaaaaacaaacatttgggacttcttaataaacactcatgaaaatatgttgtaatgtttacttcagaaaccatatttccatattacatgcaaagtttaaaggagattttctagtcctgttgaaaacaggaaggaacatacattattttcttgagtttattacctgactatatgtccatagaagacacttcacttgatttgctttagaatcaatatgcagtttgctatttttgtttttatacatggcttaagatgttgctatcacttatgataaagtcctctcacttacccatgtctctggtaggtatatagtgtcaataactttaaacaagatcaagtgaattcattcttagaaggttttgatgttataattctcttactccataacattttatggaagaaaatcatgataccaaatataattacgaccaaattcaaactgatgggcaaaagcttcttttcctccactgggtcattttagaaaataaacaaaaagtgtgagacatcatgactttaacagtggatttatatacaaactgtgaaactttgaaaaaatctctgggtctcagttttcttatctttaaaatgattggaaatggaagaggattgaagtaggtcgtatctaagctcctcgcaaatgttgaaattgtatgatcttatgagtccattctaatctccttttaagtcccagaggaacaaatttgtaactccaaagataatgcaatgccgtgtgatggtgtcttttcaacaaatagtcacccatagtgacgacttggtacttagacaaagttctcacaaagttaagggaagctttcaggtttttgtctacaaaatccaggtcaatcttacctgtaatggggccagacaaacaagatttaagggcagaataaacattctcaacattttggggtaaattattaagatgattgttcaaatttccacttgttttaccagagttttctctataagacttttgggaagttcaagg

SEQ ID NO: 25408 - DNA, 1596 bp, Bovine  19866880692859
atgagctttgatgagatgcactatttaaattcacactagctttctaaatgtttttcagaatgatttttacttagacaaactgaattaggaatatcattcagcactggtggtggtggtgtagtcagtaaatcatgtccaactcttgtgaccccatgaactgtagcccatcaagctcctctgtgcatcaggttttccaggcaagaatactggaatgggttgccatttccttctccagggcatcttcccaacccagggatcaaaccctggtctctcttactgcaggcagattcttcaccatctgagctaccagactaccagagtaccacctgagctacagagaattcagcactattctcttctgaaacaagcattttgaaagaaaaaaaaaaaaaaattcaaggacactctggggttggcaggctccttatatttgtattatgagttccacctacatgaggaactagaacacatcttcccagtttgagatgttgacgtttcttctgctgttcccaacttctaaaggactccaaattttattttgtttatgctcactttctggtgatctcactcccaccttatttataccatttataatgctgatgactcccacatttttgtttctagaccaaatctctctgctaacttttgactatctcattgacatctaactgtttactggacttcttcacttgaaagctgttatgggttgactcatccccccaaaacgatctgttggagcactaaaccctagtacctccggatgtgaccttgttttgaagtaaagtttttacagaggtcatcaagttaaaatgaggtccttatggtggactctaatccaatatgactggttccctctgggaaaaaaaaggaaatttagacacagaaatagacacacacacagagtgaatgatgtgaagacacacaaggagaagatggccatgtgactggaatgatgcatcgacaagtcaaagaacaccaaatgttgctggcaaacgccagaagctcagagaggaaataaaggatcccttcccagagccattacagaaagtatgccaatgtcttgattcagatttctagcctccatatgtgtgagaaaataaattgcaattgtttgaagctacccactgttgggtatttttttgtagcagccttgaaaattaatacagttgcccaatgaacatctcagacttaaagtgctccaaacagagttgccgccccatcccctcccctgctgcttctccccttttctatccatgggcgctctatttttctggtggttcaaaactctttagaattatccttccttcttattattaatgtatagttgacatatgatatcatgtgtttcaggtgtacagctcagtaaatcaacatttagatacattaaaaaaccatcaccacagtaagcctagttaccatctgtcacacatgaagttattacaatagtattgattatattccctacatccttgtgatttgtttatttcttaactggttacatgtacctctttattcctttcacctagttttgctcaacattcctccttctggtaactgctagattattctctgtatctatgagtctatttctgattt

SEQ ID NO: 25409 - DNA, 1728 bp, Bovine  19866880715100
aatctttaacaatcttgtatagcttggttttcatccaaagtttatatttaaaatattggctactcgtgatggataagacaggggaagatagaaaacaactaaaacttttctctacttcattcttcacttattcattcaacaaatatttttgagaggcttctatatgctaagctctggagttaaagcaaataacaaaatagatgtcattcctgccttcttggaacttaggtcgagttagcaagctttgagtcaacactcaagaggggatgcacaatgtttctcaaacttatttaaatatttttcaagacctaagtgttcagcaacaacacgtgttccaaggaaaagactgggaaatactttgccttaaactgggagatgcaagatgacggcacattagctgagctgtcgacatgccaggtttggccagcatagtaattgataaagctttgggaaacgtctttatgaaggggctgctctctgctattgggcacagactccaccatcatcctttggatgttacctgtcctgcttcaaacattcacattgcctaatggctcctaaacacacttgcatttattgtccccctctcacgacacagaatcactgctgctctgaatgcctattggcatctcagaaaaaactaagaaggaatgaaatttggtgatttaaatatgccaggtggagataaagtctgggtgatggctgtaaagcaaaaatgcacatgcccaaacgggaaaacagcagagactacaggcatctctgtggaatagcaggaagcaaaatgttgtcatgggaaaatgacttgggagacagaccccacaggcaataaaatgagatccatgccaccctggagtgcactcgaaacagaactcctcaaggataagactgtgagataaaatacagaatttcctgataaatttgaatgtcagataaacagcagatacttttttagcataaatatgccccaactattgcacagggcacacttataataaaaaaaattatttggtatttatctggaattcaactataactggaaattatggggttttatttgctaaatctgcaaccctactcaagggacaactaaccagtggcttggtggcaacttgcagatttttttttttcctaatgtgaagaaaaggaactagtgggcacctcccatgtttagacgctcctctcagtggcctgttttggattataaagactggaggacatgcaaccattagaaatgcagaaaggctgaagttcagctgtttgagaacagaatcaatggctttgggcctgggaggggactgtacgagccatctagacccaccctctgtagcaatgctacagaaacagcttaagcagtggcttcattataaccagactgaaaaataccactgcaggggtgttggacataggcacccagacttgcatcttgctctggacaaggaagaactatccagaggctgcagaataccaagccaaattctggttaatggtcagaggaaggaaactataatttttcattttcaacatcacctaatgttttctatgcttcgttctaaaggctttgaagaaaaaaaaaaaagcactttgttcatgattaagttttatgataaaagtatatctaattccacagaaatgtctgtgtcttcaaaaacacagtcttttcgattcttagaccatggttttctccccactggaatgagggtcactgttgcactttaaaattaagctggg

SEQ ID NO: 25410 - DNA, 2086 bp, Bovine  19866880765018
tgagcagccagaataaagtgtgcattgcatcccagaggcatactaatataaaaccattgactaaaaggccaggccaaaccattcatataagtctcttcggaaaataattgattgtttctcccactgtggagaattcaaatcatttcttaatgccaccccagacatactgaatcaatcaggaagggccaggttatgacagagtaacaaaagacacctcagatcccagtggcttaagacacaaggggtatttcttgctctgactatgtatcgtgctcaggttgactgagggctcacctccacttcaccccactctggaccccagatgtgcagagcttgcactatatgaaatgttgctgattgaagaaaaaaggaagtgatagcagtgattcacatgtgggctcttaaagcttataaccagaagtgatcctcaagacttcctctcatatttcagtgatcagagcaaaagccatatctaacataaaggaagcaaaagaatattctaccaattatcttaaagtagcaacagagaaatgtttagtgaacaatagatactaaaatatatcttaacagttcccagaaatgtaatcctcccaagatggagggtgggcatgagtcttgaaacagtttactttttaatgcttactaaactctacgtttaattctgatgaaaaaagtgggggacagatgaacagactcattaaaccagaagccaactctggggttgacattgtgaaaggatggttattacttccagatctctgaataaattttcaaaacaatgtaatgatatgaacccaatgatactgataattttagaactctagctagtagactttcatttctgatacacagacaaaagtgagcatttccaaaggaaattttatcttctgaattaacatataccaaaatatttccagcttttggtgcaaagcaaaattattcattatttttaaggagctaagaaaagaaaatattgtaactgggaactttaaaagatgaatgtgaaaagccaaaatgctataaatgttctctgtatgccagaaatgtctgaactttccatttttactaaattacatctaatgtaagcacatttggccttttccttgcttcctcatactatgatattccaatcaaactattttaatataaactaaatcttgatccaatactattatctcaacccaaagctcattttaaagcagcgtaacctttaatgagatatatgtacaatgggtacgaacagtgatatacctaaaaacctgtttctccagaaaagtaaaatatatttaatatgttattttatcatcaccttcacattccagttgccatgcaattagagacagtagtctacatgagttctcaaggagtgggaagcttctgctatagagcttctgattcctctcctgccttctttaacagaatacttgattttccaggaaaagagggagagcgctggggcccatgaagtatcactgaaagtaggcagcaaggagagaaaagaaataaactccagaaatgaatattctgtccagcttcaatactaagcaagtgcacttgctcaagggcaggcatcagcgaactttgtaaagagccaagtggtggatttgcttgtctgtttaagccatgcagtctctgttgcaactattaactgtgcctgtaatagtatgaaaacagccataaacaatacacaaacaagcatggtcctgtttcaataaaactttatttataaaaactggaaacatattctgcccacgggcgagtgtttgctgatccctgctctccagaagaaatacaaactagtgcttgaatcattgatgtggccatcagtctgcctggcttctcatgttcttttatatccacttgtgtgcatgctaagttgcttcagtcgagtccgactctttgcaaccctatggaccatagcctgccaggttcctctgttcaagggattctccaggcaagaatactggagtgggttgtcattttctatgccagaggatctccctgacccaaggatggaactcatgcctcttatatcatctgcacggcaggcaggttctttaccaccagcaccatccgtaagcccatc

SEQ ID NO: 25411 - DNA, 1183 bp, Bovine  19866880817970
ttctcaagtctcacatctagcaatgggctggtacacagtggacattccattaatactcagtaagttggtgaatgggactacttctatcttcaccttttctaggtttgggagcactcctgtcatcagcttaaaattcacgatatcaaacaataccttttattggcactaagagaattcctttcatgtggggagatgttctgagtgcttggtaaatcaaatattcacaacacacaatcccctccaattttacaggctgaaatcataaagactgtggccaccatatcttaccatcccagtatcccagctcagtccctcagcatctccattttaatcatcacttatctgaatcttaaattggggcttccctggtggctcagatggtaaagcgtctgcctgcaatgcgggagacctgggttcgatccctgggtcagaaagatcccctagagaaggaaatggcaatccactccagtactcttgcctggaaaattccatggacagaggagcctggtaggctacagtccatggagttgcaaagagtcatacacgactgaatcactttctatctcaatctctccagatccatttacctcattccagaggataacgaccaaaaggacaagagtattctcacctgtacccctgtccccaggtacagggagaaaagactggagaatggagctggctcaccataaaatggtcagaagagggtgacagaaactgggaaagacactcatggcatcacaaaacaatcagcactgcagttcatatgaagacaagctgtcatctgtttcagccacggcaatcaaacttagcttagataccaaggagttaaaatgtgaatgggctgaatataaatctagaaatccagacaaataaagcaaatattgatcaagcacttactctatttgcagcactgtgctagggagctgagggagatgtaaaggagccctgcaggtgcagtgaggatgtcagcctatgccgtcttcctggattagctgggtgaggatatgtgggttctaatgcctgtcaaagagattcttctgagcaacttccaaggatgctctaaatctcggaactaattatatttcactcttcattttggctgctaggaagctcagagccaaattaactgcctaccttcttacaactggacatgagcctagtaattcataatgttccatgc

SEQ ID NO: 25412 - DNA, 885 bp, Bovine  19866880846889
atgtaacatcgcaaggccctgagcctcatctgtcaaaggatgctacaatccccatccagacttggactctgtggttctgttgcagtgtttctaaaattttaatccatgctccctttgataaacttcaaaaaatctccctatctctttgttaacttactatttcaggagaaatagcatgacaaaaatcaagttaattcttaagatgcttttttatactacattcactcagaatgattctgatctgtcttttctggccactccctccgccactacttggccttgaggatgggaatcctagccataacccatcgcactgtccattctgtacacaatcctgccaggtgaccagccgtgggggctgagacccgacatctttggatccacacaattctttccattagctttacaatatttcctcctccctaccctttccaagtacgtatgaattctgactcaaactagagatcaaatacagtcaaccgtagcagatgttctagtgatacaggccagcaaaacccttcaactagacaacaaccctcaaaactattcatttacattcaaatcagcatcctaaagtagaacatactggaaacttaaagatatttgtttttaatcatggtgcatttaattccatcctttggcaatatattattcttgaaaaacagtgaccaaatcaatagaatgccagacatctcccatgacaggaagtacatttttgagctaagttacatttggtatccaagaccaataattcccatgggcctgaaagagttaatgtatttgcaaaaggaagtacttttttccttcttcggtgacaggatctaattttacgaggcattaggtccttcagccacacggttaagagggtaaaagggaaaaggagtt

SEQ ID NO: 25413 - DNA, 868 bp, Bovine  19866880880043
atactggtataagcctcccatatggcaagagcagcccaacagggcatcaataaaagcttctgtcattgattcaattctctttatttttatcttacagctgatatcactggaagcataataatgctataataaaagagatgataatatttggtatttataaagttctatttatttttgctcacaggtgcaaagactaatgctaataggaggcagaagaataacttatgaatacatgccatacctgacttccaaaaatatctcctacaagcactgaatacatagaataaatggataggtggatatggtgctaattatacttgtcatcaaataaaattgcaacttgcacaaagaataaaatttgattttatgtatatgtatagacaatcattcatatgttgttatctatatcactattctttccataaacattaatttagcaactactctgtgcttagcactagcaataaagtggtcaacaggatagacaggggccctattctcaagctgcttacattctagcagctaaccaaagggtatataagtaaatttatttatattcttataatatagtataagtcaagatagggaagagtaacaaccttttaatggaatccctctctccaaatctgctgaaataatacagagcaataactgaactcaaaagttaaacacttcagaaccagaaatgcagagagaggaagctggctggagcaactggtcaactgggttccaggtctggaagcaaacactggagctaggaattcagctccatataaaatgagaaactgaaattagggactaagctaaaggtcccctactgatgaaatgaaactgaagttgtagatgggagactactgccctatttttc

SEQ ID NO: 25414 - DNA, 1440 bp, Bovine  19866880898675
aatctgacattttaataaatggtataaaagatactatgtgaaataagtgagaatacattcatttaaatatttgtcactagaatccaatttcaatcaatttaatgcattcatgtgtacagaattaaagcaattggtaacactttgctatactgtctctgaacactctttttccaaatagcatttcttaatctaggaaatatgttcttgttaaagggaaatataagagtgcaaatatttttaaatgattttatatttctgggcttcttggttcagaagttctaaaactgaataaaacataccataaagagtttattctttactgaaaaaaatgcttatttctacatttattgaattatacacctgttgtttattggtatcatgagtatatacagttaaatacaaactataaccagaactaagtcattaactctctttaagatgtgcaataaccatgttctggctttttgatgcaccactgtatacagtataaactaatgcaggataaataagttgtgaaaataaattttatattatttataatcctcaaaaatatatttttacccttgatagtctttatgactccatttataattaaaaggatttataaagatgaggtaaagaactttgaatgaagtgttatgtttctttaagaaaaacttaaatggtatttttccatagaaaggaaatgctgtttctaagtttactaagtaatacttctaaaatgactgcaactttttatgagtttaacaagtttaagcaacattttatagtctttttttccttcattttgacacaatatcaagtcttaaattttacaatggatttaaacatacatgattccaagtcatttagaaaatagtagtaagtaaataattagcattttgagtgatattagaagttattccctgacaacatatgctggcttagaattaattgttatgatgaattcccatttctctagatttttccttacactttacaacacgacatgatcacatgttcattattcattagttgtaagtgtctgggttgttgattgttatttagcaagacagagctatagctctttctttttcttatcattttctccccgctgattggcaagcctcctatgcctgagatttgaacttgaactagtgtgctgggtgtcgtttccctatctgagtacttcacgggttcttacccacacgtgggtttgttttcctgagaagaggaaaaatgttactcactttaaaatggaatgaatagaaaccaaagtcatcaaacattcccaaacccctgtgctttataattaggtgaaaaactgaaaactggtattcttgtttgctttccccaggggctgtgaatacttgatataaagattcatatcagcctctttgggttcttcctcttaaggccttaatggttggttttcagtaactgggattcttaactgatagt

SEQ ID NO: 25415 - DNA, 1218 bp, Bovine  19866880927741
aagaagaaatgggcatgaagttaaaaaaaatatatggttatccactacagtgtcttagattgggcttttctaatggacaatggtgacatctcatatattttatttatttatattttaaataagagggctatcctagtactattgataagcagacatttgtaaatagtcttttatgctggggttgaaattggtgatgaggttgatcatgttgacactggtcttttgtaagatgatggacaactgtctacacttcgggaggcttccaggaagcactgatagacttggataaactcctgttggcctccccactgctgtgcttccatgacacagctgtgaggtctaataccgcgttatgaaatgagtgatcacagatggtgccttgtgcatttagcgccacctctcaactcagttccagaggttgtagaaattgccatataaaaaaaatgacatttctttttactcagggattgccttgtaaatagtagcaactcaggtaatattctagagttctctggataggcttcaggagaggtgcatagacaggggcccagagaaaggtctccaatcttcccatttccctgagtcaatgcaagctgaacacttaccctgtggagctgcatcacacacatattttgccctggataatttctttaatatcaaagaatcaagtttatactagcttaagacacattgcaaacaacagtacttcctggactgagtatgagtaattagctgtgagaggcatgaccgtttggcccccaacccatattgacattttaagacttattatagaaatccacatagtgttcataacataaaaggctagccctttaatgaacatcttatctgggaagcccagctacaatatatttctagaacctcataatgatcacgtttactttatgctctggtgctcttaagctaaaaagaggagggggtggggggtagggaatggatggagaaaaatgttaatttaagttctgtggttaagaccaaagcaaaaactccacagtgttgccatgttagagtggactgcaaagcaagtacaaggacttatttctcataaatattcagcaacatctctgtgttttccttgaagtggcagcaaatccaggaatggaaggtcttgttttccacaactgcttatgagtttgttatgcttgggcataaattacagaagccacgatttcaaccacagtggaaaagactataaagatt

SEQ ID NO: 25416 - DNA, 2688 bp, Bovine  19866880936280
ttttataggctttagcttaacctagaaaacctcagtcaaaaaaaaagggtcagggtagttagaaaaataattcagtaatattttctcatgatgttaaaaatacacttttttcactcaaattccacttgtcttctttggaaaccagcaacttcttttagtctttctacctaagaaagaatccagtgagtcagattttggagtctgttgtttcctcccagatctatgtcccttatcttttggtaaaagtagccagatttcttttggggaccatatgcagtctcagtggggccatcatacaagatgccatgatgccaacaattgactcatctattctcctatggatggattttgaggttttccattctttttctattgtgaacagaacagccatgaataatttatttgagcttaagttagtcaaagtgaatttttgttacttacaactaccaaatactaactgatctatgtaggaatacagaaagttctcaattatcatgcaccattgtttataggtatagatcattgggtacaaattcttttaaaagtatcagatttaagcaatccctaaggatactcttgcacactgctctgctttcacagagaagtattgcactcatcctagttctagtcatctgtcatctaccaattgtggacttaattactataggctttaatcaactggattctctttccctcctaatgagcactgaatagttaccttgctagttgaaaaaaaaagccaagggtgacacaaattgctaataagtatttgcaaagatgctcaaattcattagcaatcatggagttgcaaatcagaccacaatgaaataccgtttatacacttcatttgcataaattaaggcattttctaatatcaaaaattgaaagaggtgaatctataggaacttttattcatgtacattgttgaaaggaaagtaaatttgcacaactactttgaaaaaaatgtggcagtttgctctaaagaatataaagttgaatattttacctagaacacaattcagggtaatacacagtgaaacttctgcccttgtgtcccaggaaatatgaacaaaaatattcattgaacttctgttcacagcagcaaaataaattaccaaaaatcaagcaaaaaaaaaaaaaaaaacccctgagaaacagctcaaatgcccaacaacaagagaagtagatgaacaaactgtagtttaatcagataatcaaaaattatagagcaggaaaaacaaatagactaaatttcacaaacaacatagatgtatcttagaatattgagcaaaaatagaaattctcagtaaactacacaatgtatataattttcataaagctcaaaaaaccatcaaaaccaagcaacatgctatatggatatatgtgtatgtatgtgtgtatgtacatgtatgaaaataatttttagtaaagcaagcaatgcacagcacaaagtttaatatcaggtttggaggaggcagaggtttgtgacatgggagaattgtataaaaaattacaatgaggtttgtgatcttaaattgagtgacaagttcacaactgttcattttattattctgcttcatcacttacatgtatgttacatacaaacgcatgttgaagaataaataaaaataagccaataggaagtaacagcttcatccaaggacaggaaaagagactgatgtacaaatttcacaagtaacactgtagatgtcttggacaaaatctgaatttccacttactaataactcaataatctctcttgctctgagctttctttttcatttttagggagaagggtatagtttagctctaactctttgtatacctttcatggaccacttccccttgaacagtctgcagtattttaaccacttactaaccctataacctgagggtaagtacagtgagatggtaaccagtctctcatgattttgtgagtcacatatgtttaacgtgtgcattttcttcataagggaagaggccgtttctatcagaactataaggttaatgtattccttccttaccaatctcccactctccagataccaaccaatccttctgggaaaaaagcttttatcttatcagagacctatactttggggataatgcagcaatattttattattgctgctaatacgtgcatgtggctagagacagagtatcgctttgttctatgaaaacataaaccttaacagtcagtttaagtggcttctttcctttggcagctgcctttgcaaaggtctgaaagtgcctaggcctaactggagaccttggaagagactcttgcccataaagagaagagaaaagaaagctattgctacctaagcccactacagccaaacatgtccaagtacacgatttgtccaagtatggtaatagcctcagtcactctgaattttaaaaggcgacaaactgttaacaatgataatgcctgggcttaaaaacgagtgcagaaatagattaaatggactggcatatacaaaaatgtgtttttctggctaaatctttgtcttagttcctcctccattcacatcaactgtacttcttgtaataaaaacttggactggagcactaatccatatttatattatcctgttatgctatattatgctgaaagcaacccaatttgctaatagcttgttactttctagcagcatttcccccaggtctaataccattcaattcttt

SEQ ID NO: 25417 - DNA, 1743 bp, Bovine  19866880986633
ttagaacgattatgatttgagtacatttatttatagatgcaaacatcagtcaattgtgagcgaacattgccataccattcccaccaccgggtaataagagtgaggaagtacaagagggcatttgttagcattgctcaccaacaataatgcgtacattctcacgagcagagtactgttcaaagaaaaggttttctcctcttatctcttctatttaaaagcaattttgtgtagttcaatacagccatgtcctatactctgcttgccaccaaggttcctgagcccagtttcctctctctgcctgaaaaccaattctacggttatgtgcgtgtgtctgtttggaactgttgcatgattcctttaagccagcatggttgctaccttagaaaacacttcgttttaacttgaaaagtgctaggatttgttcagcatgtttattctacagaggcagagaaagatctgtaataaatacttctttccaatccatcaagaaactcactgatagcaacaggagttatgcatttggatctgggcagcacatggctccatgccacattcaacttacagattaaaaatagaatctgttccagatgcaaagtaaggcacgttaaaccaactgcctctacctgaaatgcggaaaccaaatctaaggaccacagccatgatctaggatgatgactctgacccacattaacctgtctactgcctccacctcacgtatgaaaaataagcctagggaatattcttggaacctcaaaggaatgcttccactccttgctatgtagcttttattaacattccatcatttagtggagcaattaatgttttccaaagctgattcctttcctatcaagagcatcaggacatctggaaacaaagtaatgggcagtctttctaaaaatacacaagcctacatcctgggaaagaaagtgaaaactaacagcgaaacaaaattccagacacacaaaatgaggtacactattttaaaggccaactttcaatgtagacacactacggaccaggtgacagattgtgagtcaagaaaatactgtttcagtattaaaaaacagtatcctggattcttcaacattctggcaaaagtggatggaatggagttgtatcggcaagtgttaagagtacactattttccatcctggaatcgattaagtcgtaggcaggtaatttgaagattctacataaaaagaaaactcagcagtctggggaaagacaggattagcacccactgagagtccatgaacacgaaggcttgtgaaacaaagcatctactccgaggaaatgctcatcaatcagctgtcaagcaaaggggggaagtcacctcatgttcagagcagtaaactgatgaaatgagtcaccaaattcccatgatagcttgactggccccttcctttccatgcagcccctggtcaccatggagccagagccttctctgcgggaaagcaggccagcagagggtggtggccgggcttccaggagctgccctcagaaagggtgggaagaatgtgcagccagggtgtgggggagaagccatatgccacaatgaccagcctactcagggaggctaccctgagaatacagggaatgtgccggaagggacctgtggtctagagagcagtgttctgagacttggcctgcttccagcctttctgagctcctctacccctcaccactcagtctggtccagtctcctcctcaaaggttctccagagcctcctccttctgactcaa

SEQ ID NO: 25418 - DNA, 1478 bp, Bovine  19866880994799
tagctgagctttatacaatgatctttgtcctatcccatctgacaaactctgatgtacatatataggatagatgttaaatctatctatatattttataatttatagtatcatatgatttgataagtgagctgtttgaagctcagagttttttcttggttttataatatttatttatgagaaatcttttgtgccatgcaagtgaagaagtcacaaataaagacggcaaattaggagaagatgggcatcacagagactggggttgggggggaaagatacatgtaaataaattttacatatatttaaatctaggaggaatattaatagtttggaaggtgcaatgaatagtcctctgagtcctgaccttttagaaataaacctaaagatctagatatacaaatggtatgacagttatgaaaatccaaatagaaattgaatggatatcctattaattcttgccatcaaaacactgaattactaaagtgaaagtggtggtgagatttccaccaattgtattcactgctaatttaagtattactaacagaattcatcattattatgaagggtccaaggtgagacaaaagaaaacaaattcttgcgctatatgcagaacctctttttgtctgccaggggtggacagattgtaattactgtttaatataatacacatttaacgttcttggatggctttgttgtcattgttgttatttttgcaccatcttttatcttggtgtggacttcttgtatggtatgttggaaatgttttctgcagagagaaaaaggcaaatagagtcttgttttgtaaagagtttgtaacaatacatgtttacaaatggcttattttgagatggacaggtgaaaggtgctatgtaagtgccaagtattattatctgtctaaatctagctgagtgaacaaatctttttaatgcccgttttaatgacacagttgttccatatggtagacttcaaatgcataaaacaaccctgagttagtatgttccctggagagaaccagagtgtccaggtgtgtcgtattttaaactcagagtgaaattaagagacagcttttcaaaacgcaggctcaaactgccacctagaccaagttaatttctctctttattgtttcagacaacacagggctattccattaatgaaacaaaaccatgttttatctactgaaaagcaggtcctaatcctgttatgatatctgggcctgtatggattttggtaagaggaagttctctggcactaagctactgagattggattatttatataagtttgattaagtttggtaaagacttgagtatctttctggggaaggttgattttgtaagatggtgtttcatggtgtttttcaggtcttgatgcatcttgttgatgatgggtcaaagctcctcatggcctttaacttggcagatggcaacaaggcacaggaaacaagggctgctagctttgaaaatcatgggacattcataaaa

SEQ ID NO: 25419 - DNA, 1408 bp, Bovine  19866881015085
tggatgtaaagctggagataggggtggtgggggcagggggttggaatttaaagataatatagagccaggcaggctgagataagcagagatttctactgatttaatatttgctttctctgagcatcttgagagcagagtctgagaaacacaaaggtcaggccctggtaatggagtgcatggcagttcacgatgcaagcactctgaggggagcgcttgccacaagaggggggatctccggcaggcagcagagtggagttgctcggcgcttattataaatgattgatgaacactgcttctaaatttagaagagctctctaaatggacatttactcacaaggaaaaaaaaaaaacattctgaaaggtccatccttggaatgattttgtttatggcgctgcgatagttccgggcaattaatccagaattgcgtcactgaaaagattttatattcttaagtgttcactcatgtagttaaagtaaattatgtccttttccaaacatgtttcaaagaactgtactgggttttaaaaatcctggtccctaaatcctacttgtttgtttaattaatctgaaaataactgctccttctttgtttcttaatcacagatcacatacactgtatttgttagcagctgtgaatgcgagcatgtcccagtgtgtttttcttgattgtttaataagagttgaataatactctatttaatccatcaaataggacattacaataacattgatcttttgtttgacagcaaatttgtttgataacaggatagaatataatgtaaccaaatcagtgtcagaagtgcatttcagagaatccaattaaaaacacccatgcacactccagacatggagcagtaggccaaagggaccagtaacagcaagacacactgggcaggagggtactcagggacaagctggccttgccaaacgtccagagcttaagatcaagacaagcacatcctaaggaggtggccattgtgttgaggagggccagcctacttctaaggtcagaatggacaatgaccctcactgtgttcctcctttcttggcccaaatgctataattcttgggaccaaagatcctaaatcctaccttcacttactggcattccttctttcaccttctgctaccacatagtaagggttcttgaggaatgctattttcacagaccagcatccttcttcagtttcaaacctgtataaaagaaaccttttctttatagcattctctttctctgggggtggtggggtgggggtaggggtcagacttccttggtggctcagatggtaaagaatctgcctgcattgcgggagacctgggttcaattcctgggttaggaagatcccctggagaagggaatggctacccactacagcgttcttgccaggagaattccaggacagagga

SEQ ID NO: 25420 - DNA, 1420 bp, Bovine  19866881018066
gtgttatggaatctggctatgtaagcagaggaaaaagatttaaatcacaaccattaagaagataataataaaaaccttctgtgtgaaacaggctttcagcttggggttgaaactcctgcctaggtttttcttcttcactttgggagtttaacaagagcttgttaagagaagcctgtacccaacaccttgatttatatcactgatgtgtttctgaaaagctgcagataaattaaattttgtttttgtaaacggaatctcacgtgtgcttggtagctcagttgtattcgactctttgcaatcccatggactgtagcccaccaggttcctctgtccatgggattttccaggcaagaatactggagcgggttgccatttccttcttcaggggatcttcctgatccagggatcaaaactggctcctgtgtctcctgcattgcaggcagattattttacctgctgagccatcagggagagataaagctgcagataaatcaaattctgtttttgtaaactgaatctcatagatgttctaggaagcttctttcagcccacttaactctgccctgagtccttacttgtacgtaaagtgaagggcataatcttatgcttgaaaatacaaatactaactgctgagtttcttatccaactgctatgttcccagtttaccttactgggtttcccacaagtggaactgctgatctgaaatgatcacggcctttttccctcctcttgagaaagcagaaatgtgggaagggtgatgagccttgtttttcttcacgtatttagcgttgcatcatgtgatttggaaaggcataactaaccccttgagttttctaaacacaagccccatcaatacaagcttgtgatgcccataaaagcaggggaggaaatacagattggcctgcctacttctacagcagagccagggcatcactgagaagctgtggctgccgctcttctccggccgccgctcccatctcagaagtcagtctcatgcttggtcctgctagcagctctctgacagaaccagacacatgtggacagtggaaaagaagaactgcaggagaaattctggcatcttcctcttccatgtgatacagctcctcagccccacctttctagagcatcctcctcatggagtcctgccctgtatctttctgttccctgagataccaggactcatcaaacaggttggaggaggctgttttcttgccaggggaacgtggccctttgcactgcgattgtaatacaatctttcctctctggggctgtgaatgctacagtgcaaaagcgtgtttgaaaacctcttttatcattcattgtctccagactgaaatcatttttgacaacctctgcagaaaacaagcagctttctggctactggcgagtcgattaaagggaggaaacacatgttcactgt

SEQ ID NO: 25421 - DNA, 756 bp, Bovine  19866881023712
agaatctctgtaaacaacacacacacacacacacactcctttaggattactggtgattctctggttgacacattagaaatggcagaggtgaatgtgtgcctgggaggtcctggcctctggcagcaggagggctcagggactctctgttcagcctcctctgggctgcatgaggggagctttctacatccttccttgtagttgctgaaggatgtggcaaggacatgaattgtgtgtggctggctttctgtcctgcttctaggaaagacttctgtgtttatctgcatttttctgagcaccagttggctttgtagctgcctcccaggccactttgtgggaaagctttctttatggtgggtgacgtggcatttcttgtcacttcctcaaattccttcccgctgcctatcagcatcgctctagacttatctgggttgagcttcagccagccagagctaatcctggttcctatttcagaggggcagagtgacagcaatgacgctgccatttcttggcttgtgacctggggtgctggtgtggggagcagagaaaagaggtacaagaattggggcccatgggcttgcttttcagacctggtacctggagtctcctctatcctgtcatcactcttttttctcccaaaggctgacaatattgttgatttcagtgtgcacttgaatgtaacttttccaactgtaacctgaagaaatcaagggtaactattgcctgaacttactctcatcccatctgctgaggtcagcc

SEQ ID NO: 25422 - DNA, 1400 bp, Bovine  19866881037208
tttatagattcctataattttaaggttataaaaggcctttatgtcatttaattcaggggtccctaacctctggaatccaatacctgatgatctgaagtggagctgatgtagcaacaatagaaataaagtgtacaatgaatgtaatgtgcttgaatcatctcaaacccccaccccccgaccaattcagatccgtagaaaaattgtcttccacaaaactggtccctggtgcccgagtgattggggaccattgattgaattggaaccccagagttttactgaggagaaaagcaaaccctagagaggctgccttgcctcagtttaccacctcatcgagggggaagctacatttttccatcttcagcagctctttcctccgacaacaggaatgaaagcagaggcccacaggctaacgtagcatccttaacaaccctagttattgccttgattgagcttatctaatcaaagcacagccctcatagaagggaatttccaaaaagctgcctgaggctgctgatcaacaattcatttttagcatttctttttaaattgttctaagtcgttgcacctgggtcacagtgacagatgaataagggggttgaacggcgacgttctgggcaccaggttggtgagccccctctgccatgtatatgcatgagctcgccatttgcataaagtgaaaaagcatcgctcacaataatcagcgcattcatcttaataattagtggcaataatgttgaagagcggtggtctccacatacgatctctgaggcaccatgggccatttctgttgcagatgaatgatcatcaagagtgacaagttgatgtctttggatcgaccaccctagttccttgtgctttacagcctggcagctggtcaggaaactggggtgatcggtggggctaatgctgtccttccaacaagaccagtaaaaaggagtgatgtgacacctgggatgggggcttaagaaagagcccctgaccactttacgggcccctttctcagccatgtgcatagtaaactagccgtaactgcaaagcaagaggctatttgtcataaagattatgactctctggttaagtgcttgaaagaccaccacttgcactcagaccttctccataaaagattggcttggggtctgtaatttgccaatacttctgggtcaagagaaagcggtttcatatcagaaatgtaagaggatgttttaaggcccatggtacagtgccagaaaggatagaagtgttcataattttcactgttttttttttttttaaaggccctatcaggttaaaataaaaaaaaaacgaagtcacaaaggaatccacttgaagatttgaagagaaactacaaaggacttcattaatacaaaaggggaagattagtcagagaacaaaagaataag

SEQ ID NO: 25423 - DNA, 1440 bp, Bovine  19866881089071
aataaaggtgaaacaaagaggaagtctcaccctcacatcaagacactgccaccagcatagctaggttgggtcttcatcccagttccttcttgtccttcccactctaagtagtatatgtattagagaaacccactgcagtttgcatgacaattttgcaaatagtaactcatttgaccttcaaaataaatttttgagtatagtgtttatctgtcccatttcacaaatgaagaatgagaggattcaataacttgtctacattgaaccagacctttaagataaatgaacttgagtcttatgctccagctccagtggtctctttgtttgtacagccccatagacctgattgatgatttacagtagggttaatgatttagggaagaagtggtttgggaatatgtgagtttgttgtgcttctgagaatacatgaaatagcatacaaggggcttccctgatagctcagcagtaaagaatctgcctgcaatgcgggagatgcaggaggcacctgtttgattcctggattgggaagatcccctggagaaggaaatggcaacccactccagtattcttgcctggagaatcccatggatatgtgagcctgacaggctatagtccacagggtcacaaaaaggtcagaccagactgagcacatatgcatgcatacagaattggatgcaaattttaaaatgtcagataaaaaaactggatcaaagctttattttgttcaagaaactatttatatatctttatgctacaaataaaatgtgaatgttttaagtcatcaaagaaaattctccaagcattcttaaatccatttgaaacttaatttttatataaaaatccaactatcaattataagccagcctaatctgagccaaaagaagtctacagagatctatcctggaaaagagtttcaatgagaggaatacattgacttggttggtatggatttaatataatgaaataacttttatttttatacaattttaaaggttactttccatttacagtcattataaaatattggctatattctctgtgttgtacaatacacccttaagcctatctttctaaaatgacatcttttattaaaaataatgcaactttttctctttgtatatttcccagtaaatcaaataaccccttctctcaattaaaaaggcaggaaagaagaaaggaagaggagaaaataatatttactgagcatctatatagaaacataggcacttgaataggcatgcttacatgtgatttcatttaatcctaaaagtaaccctttgtattaagtacactttatagccacttccctgatggctcagatagtaaggagtctgcctgcaatgcaggagacctgggtttgatccctgagttgggaagattccctggagaaggaaatggcaacccacttcagtattctttgtctgggaaaatcccatggatgga

SEQ ID NO: 25424 - DNA, 829 bp, Bovine  19866881105754
tttttgatcctttaaattgttagagttatagtggtatgtccctaatcctacatcctgtaaaagtcctatttaattaaattaatgtaactgaaatagttcagttggctttacttgttccttttctctaactaaatatcagcttacactaaaatttttattaatcacagtaatgagaatttttatattaaatatatatattacatttagtttaaatgttaatagtctacattattttaataaattgctctaagggagtatatatgaaataagtctctcatgcagattttattggttgctgcatagttaatagacactaatgtgatcagagcctggatgtgatcataagatcagtagttaaaatgattgaaatataaattagaagctggaataattgtttgttagaagctcagataataactgtttggtaatgctcggagggtcgaagaaataaagcattcaaatgtgcagcaggagcaggcaagagaaacactttgaggcagacaaaggctctggatgcttttctactaattgctctttccattctttctctttctctgaagaggtccaacatgcccttctgctcctgtatcttgctccatttttgtttctcagtgaaccttctctccagcaacaagacctcctgtattctttttctctcttttgcttttctactcacagtgcttaagtcacgactgaggatgacaaactctcttaccagtatcttgctgttaacatgcctgattctttgagaactagtagaaaaaccactcattttctgtaggctgggattctctttcttactatggcaagatcagcagactgtgtaaaa

SEQ ID NO: 25425 - DNA, 999 bp, Bovine  19866881113729
attctggggcaactgcttttttctttttcttagctggttattgaaatcctaatgggatgggtgatgaattttcttaggtcaggtaaactgaaaaggctacagctggaattcttcacccagaagaatcggagttaatactaatgatcattgtgaattagaagatcaaaggcgaagcatcagcctgttctccaagttgctgccccagaggccattagtgacctggtagagctctctcccagcctcttgcacacctccttgcctctgccccagcctttcttccccatcctagttatgcacctctgacctgggggaattacagtccagtccgttgatgaagagggatggggaaaaacaatcaaaagggaaaacaaaagtccaacttgaaaactgctcatttatccaggtacataggacccctaagcagatgaactctgactggggctctgtgaatttcagggtgtgattgagatttttgtgctcaaatggtttatacatttcacagatgattggggcctttatgtggtaccttatgtgagggacttttgtagtatcttgatggcaatttgtcagattattttaaaatttttatttgtttccaagactaagttaaaaatatgctataatttggttttctgatatactcttaattgggttgattaaatcaaggattaggttcaaaatggaagtgctcatataagcacagtttaagttgacggttgctgatgcatataactgttggaacactggctggccatttacacttcaacacatgtatcaatatcatgtcttccgattcctcctggtgatgatatatttttgaaggcaaaataccaaactcagtcaatgaatgtgcaactgctcctccttaatttatctttcgagttaaaattggagcgttacatacatatgtgtgagtgtattcgctaaactagctcagtctagcccttaggaattttatgtaatataaactggcttttaactttctcagtgtttaagatt

SEQ ID NO: 25426 - DNA, 1255 bp, Bovine  19866881281688
ttttatttttactttcatagcagtttttttttttttccagtggacatcatattatatatttacttgttattgtctctatgagtcactaaaatataagctcaaaaagggcaggagcttggtctgtcttgttcatgatggtgttcccagcaccttgaacatataggacctgaattagatttaggtgctcaataaacttatgttgaaggaatgacttgctgatttcatatagaaagaaagttgctctatgcacatgactcaaacattggtcattggttatgacttactgcgttatcataaccttgtactaaccagttagcatttgctgcttaaataaccacccaaaaatataacggttccaaacaattgtctacttagcttatgatttgtgggactgggacttgggctgaacattcagctgggtggctttcttggtcttagccaggcttgcttatgcacctggggtcagctttgagtcagctatgtggttctgcttctgggggtttgctgactgttacctgtaatgataggagtgacaaggcatgtgtcttcatctagcaggacaacccaggctatttggatgacagatgttcagagtttcaagagtaagagcagaaggtggaaagccttttgaggcaaatgttcaagaccagtacaaagaggctctgctacagtccatttgtcaaagcatgtcatcatggcagcccagattcaactgatagaggggaaaagtccacctatacaaggatggcactgcaaagcctgcattcaagaaagtggatttaggcaaaggaagattttgtggtcacttgtgaaatctactaccaagccatcagggccttctgagccctgatctagacaagtgtctcttctactaaagcatcatcacatcaaagcaaccttatctagaaagttcaaatgcacatgtagggctaacatcctcatctgcatattcaagaagcctttcccgtgagggagggctgattgtctgccatctaacagccatctcctctcttttctcccccacgaaattaattatgttccatgctgcatgcatctttgctcagctatctaccttacctctcaataaaaagagatgctgtttcaaaataaatagcctgatacactgtaaagaagccgcagatacttagaaacaatattttctaaatatttataagctatatttccagtctgttacattcagtgaattacgtaaataaatatcagacctgcaagtcaccatcccacagcgccagtg

SEQ ID NO: 25427 - DNA, 634 bp, Bovine  19866881328170
aaacttgaccctaacctgcacatgttataatgagatgttctgagcatcctattctgaacctctgatcaaaaggcaggtcctgatggctggtttggcttaaaagtactctaatagggatcttccttctacacgcatgtaaactttgggtgggagaggtgtaatatatgtaaccttatattgataccatcagccttatcctgagggtgtgactagaaattcagcctcatagtgaaccctgaaaaccatgccaggagaattttgggggctgctaatgagaaccataaaataacactaaagaaagatctgaatgaacacgccagatgactgcgtttgtactccctgaattgggtggaagatttatgaatcaagtttggggctgccttagcatctagcctctcataaaatttggccgctgccctgtttaaataaaatggaagataaaagtggtttcaagagtgtgatgaaacgattgtgttattgaaatgctaatttagatgtggtaactgcctaagaaattccccgtttatgaaacatgcccagtgaaagctccttttctacaaagttgtgtgtgtgtgtgtgtgtgtgtgtgtgtgcatgcatgcacatgttctactgtttgacaagcacttcaatg

SEQ ID NO: 25428 - DNA, 699 bp, Bovine  19866881377389
ggaggaatataaaaatagagtcaggcatcctgatttcagatgaggagccttaggcccaaggggggtgggacggatgggaaaaaggtctctgttcaaacaatgaagagagcttcttccattgcagaaatgtctctcattgcaaggaatgcccacacatggctcccagggcccttactgcttcctgagcttgctcggcgattgagcatctcaagttgaatgtatgaaaatgaatttgtggccaaggataaaagtgaaactgatagcaaaagatgcaagttttcagctcagtgtaactcaacataaaaggtgtatcagactcccaagttctgatttgactgctgtaacaactggttgtcagtagcccttggatgttaccagaatgaaagactgtgtgcagaaacacctatcccagtgcctggcatagaggaagccttcagtaaatgctatgccttgtactctgaacagccctccacctccttcaactctacctggagcctgagctctaaaactgcttgatccacatatctgtatgtgctttaatatactgcacagcagattttgtttgtatttgcaagaagctgcaatactccatcagatgtttctttaaaagcttataaattattctttaggctttctttaaaaaaataaacattgaaatgaatatgtgtgcattaaagttcataatcaataaaggatgat

SEQ ID NO: 25429 - DNA, 1288 bp, Bovine  19866881479063
ttgacacagccaacctgtcctgccccactggttaaatttgcacttggtgaagaccagaggagtcctttaagagatctgacacccatcccttggtcagatcatcttgcagggcaagaaagtatcataagaagctgagggtattagccagccttgcccttgatgtttcctgttgaggacaactccagcagactctaaaacagcactgaggttacagatgtcatctctttggaaggggcgttcagccctgtagcatgcctgctggggccaaaactccctccaacagacttttcagccatggtgtatccaagtgtggtccctggactcgcaaatcaggcatcacttgggaacttgtcagacatgaacattctcaagctccaccccagaatctctggggaaagggcccagcagtctgttgaaaaaactttcaggggttctgaagcacactccagtttgagaactactgggtatagcacttagctgctcacaaatctggatgagtctattttgggagtttttcaaaattagatgaatattacatttttgtggagtatttcctcagtaaaaaaaggctctggttacattaaaacacagtcaatgtgcgcacatttgtgtgtgtgtgtgtgtgtgtgtgtgtgtgtgtggcatttgggggtaggagtgacaacacgaaaggccttgttcagagacttctgaactcttaatggcaatgactcagtgaacagggcagagagaatttctcaggattgccttcatcaacttctaatctgaattcctggaaaatcttcattttggacccacagagtagagagggcccagactggaccttggcacagcacagcctcagggtgcccgggctgaggacccagacccacttctgttaggctgtatgacctggggcaagtcccatgttctttggggcatctgcaggagaattggtcagatgatgtccactctgggttcaagatggcgcggaccacagaggcttcctttcttcctgttacctcctctgtgcattgaggactttagtagaagagaccctcccaccaaagacctctcctaccaggaaaaacgtttacaaattgaatgatttctaggttccctttcaattctcaaaatcaccaggcaggcctacgcgtggtgtcctaactttgaagccttgtggggatggagtttatgcattgtttcaaagctctggaggcctcctctgaagatttgttttctggtggtgggcttagcaactctggttttttccccccttaatctattttcttttacaaagaacaaatgt

SEQ ID NO: 25430 - DNA, 946 bp, Bovine  19866881613533
tgaatttgcggtgtccctgacaaatttgaactctagattgctggtactggtcaatgagctccactgtcgtttagttgctaagttgtgtctgactctgtgaccccatagactgcagcccgccaggcccctctgtccatgggcttttccgagcaagcatactggagtgggttgccatttctttctccaaggaatgccactaacaaccaacaaaaggaaaaacgtagtgcttccaacgcttattaattcaaaagctcagtgaggcatcttttcttaaaaagaaaagcctgaagtaccaaaatgttttgtcagtatatatatccccccttaggaaaaaagatttgtagtcaaatccaccaccacccttccccccaaaattatagttgagagaatgaggctcagagtgaagtaaaaaatccccagtggacagcctgctggagatcttcccaatacgccaccctggttccatttttcaatgttgttttcatttgaaactagattcatgcagcttgcctgtgcaaaatgagaaaaaaaaaagggggggggtggttctggaaaggaagagaaggattaaataaaaagttctgctaggatgtagccatcatgatctaatgcaccatgggcagcccagcttcagggaatactgactttcaagggctggtgctcccagggacagctggcactcagctggtcattgtgttggcctcatgttgcctctgtggctcccataaactcaactgatgctatgtaggtttttttttttaacttgcggcacaggaaatttttcctcaatgtgtgtaagagctgtttgattccccaaagaaaaagatttggcaagtcagttaagaggaaagtagaagcactgaacacatgagcacattttaacaatgtccaagtgtaacttttattgccaacagtagacatgcacggaatttaaacacagcccaaa

SEQ ID NO: 25431 - DNA, 795 bp, Bovine  19866881663590
gcctttgataaacagacgaaaaggattattcattaaaaagttgttacttttcttcatcttaaataagcaaatctagcccttaaaataaaaacgagatgaaattaaacattatcgcaagacgtggaaaacatgcgtgctgtcacttttgggtccataataaagataaatcagttgtttttagcagtgcgctctgagtctgtgaagggcatgacagataataggcttggaatttctgaagttattgtacagtaaaatttgttttttcctcaggcattcaatcttttttctctagtgattttgtacatgacaaactttttagtgggtgcattaataatctataagtaatgggttgtcaggtgtcagttagataagattaaaagactgtttaagcattatccatttgcttctttgcatgagttttataggtcaagagaaataactttttgaattgtggttgtttgcacatgctggtttttcctccctctctccctcactccctctctctctctctttctctccctctctctctttctctcgtttggctctggtccagaagtacttgcaagaactgtattacattacataaatcctgcatgtaggagcagattcgaaactcacactgtgtgaatcaaggggacacatgtctcccctgacttctgtaaactttttagttttgaaaatgttactctttctcttctcaaaggaaactttgtcaggggaagcctcctcagtagaggaactgaagctcccagcctgaggagtttcctagcaagtcaggttgaggtctattcttgt

SEQ ID NO: 25432 - DNA, 944 bp, Bovine  19866881926083
acatgattcttcagaaaattctacacccattaagtaaggaacaggaagcaagctaatagaaatgaaatggttaaatgattctgctactcagtatcttattttcctccccaaacatattaatttagaacacagatcaattcaaattgtaaaattccagattctctggaattttctggtggaagctggagccacggaaatgatgacaattaaaatgaaagtggaaaaatgcatttatttgcacctggaattatgcaatgctaacacataatgactctaaaagacatgatatttatctgtacaatgagggttaatcttttctactcagggctatgccaatcttggcagagatgccagccatatcttaaaaagataaattccatatgctttgtagagttatagcatatttcccataaataatgtatacaacagactgtaaataaataatacatttatccgaactgttcaagagtaaagggcagggtggttactcatgagacggactctcttatgaatgaacaatttcaaataaaagtaatgtccaatggtgagttatcacaaagttcttacactaaaatattcttaagtggagagcagggaaggggtattcaaataaccccagatcaggtgggaactttcaaataaatgttccaactaaatgcaaaatgcccaatttaattttattgcttaaatttctattgtgattgttgcatcgtagctaatagcattttacctgttttctgcaattcttaattctctctgtacactactggtttttgtttttgttttgttttggttttttgatcaatgaaataactagatttaaaatgtcaagtatgagtttttgtcccatgaaacacatagaatcttttcattgtatgaataattttaactacagtccatagaaaggaagggtactacggaacaaaaatttaaaaagaacccat

SEQ ID NO: 25433 - DNA, 870 bp, Bovine  19866881946031
actgagttaaggagaggagaaacggccaagagtctgtgtggcactgacgacactttccatgatgccctctacacctggtacctttgtccaatctctgaggatttgctctagagccataactatgacacaaaacaccaaactgccatgtttgggaagtaaacaacaaaaaagttttgtggctttagccaattttaaggccatttgttcccactgaaacttgaaatctaagaaagggaaacatgactttgggtctatttgattatgtctgatacctcttctcttttcatcaaaggatactgacaaggtgaactagattgaacatggtggtcctacatgatacagtttctcaaactttagttgacaattactttagcattctccttcaaggataaagccgtctcaagaaaatttcctgtttaagcctaaaaacaatggagaaatccagaaagctctagaatgtaactacagaagagtgctccccagcaacactgcccaccaattagttagaacatgagaggtctctttttccaccacatcagttaaaaatctaaagggttcctaccaagcctgccactgataatcttattcagagagtaagccatgatttgaaggccctcaaggaatggtttccctccacagcagcctagaacgcttgacttaggtaaaatagtagctatggaaagtcaaaaccaccagtccgtgcaggttccaataataaaacgtacgtgcaatgaatgcagttttggactgtgactacttctacatttgccacggcagtacaagtttccagaactattgttggctggagttttggtctaagcggatcagtcacggtcttgaaagtcactgtaatcagagtaaccaacactc

SEQ ID NO: 25434 - DNA, 900 bp, Bovine  19866880490920
ctgagtgactgatctgatctgatctgatctgattgcatctatcattttgaaacagtaatactgtaatcctttccagacaaatatctgtgtatgagtcattctctgggtagtacctctgtagcttctactcaatggggcttttagcttaagtcaatattttcataagatatttttgcagctcaggttgcatgagctttaaaagacaggaaaattgtatttggaaactgggcaatgttacacagtaatgagcattagcagtggtaagtgaccctgatcacatcacaattctgtttcagggcttttgatgactctaataatagatttgtttggtcataagcacaaaagtaacattattaaaatatttatagaaataatatacaaattttgcataaaagcaagatgcaatatttggaaaggtttttattttttttaatttatttattttaattggaggctaattactttagaatattgtggtggttattgacatacattctcatgaatcagccatgggtgtacatgtgttccccatcttgaactccccttccccacctccctccccatcccatctctcagggtaaaatgacatttatttttatatatcggtaattcatgacattgtacaagagacagggatcaagatcatccccatgaaaagaaatgcaaaaaagcaaaatggctgtctgagaaggccttacaaatagctgtgaaaagaagagaagggaaaagcaaaggagaaaaggaaagatattcccatttgaatgcagagttccaaagaatagcaaggagagataagaaagctatcctcagccatcaatgcaaagaaatagaggaaaacaacacaatgggaaagactgcagatctcttcaagaaaattgaaagtaccaagggaacatttca

SEQ ID NO: 25435 - DNA, 949 bp, Bovine  19866880533766
cagtttagcaaaacccatattaaggatatctgaagctcccgcttttagcttatttgaatgcatttcttttgcactccctgttttggaagacttgggagcaataggtttttccgtgcttttagttatctctttatcaccctcttgaaccatcctggaaactatgctggagattatgtcagtgcatttggccatttcctcaataattgaagtaagtgataggttgtcaatatcgagagactctgaggtagctttacatccagaacttactgaactagtatctgtgtcgacactacataattttgcaatgatatattccaaaattgttgtggaaatgagctgaatattagactgcaattcagtggctctttgctgattcttgtttgtcttctctctacttaccttagaacaagatggctgacagtgagggtgggcccctgtgagcttgcataacatttcatagagtgtttccccaatattatctaacacttgtaatctggaattctctttcagatcttttccattaatgacactatggagagcacatggagtagctaaaattttgtaaaaagattttttatcctgtctgcttggcaaaatgttccctttatcaactttatcagatccatgtgaagctgttggctttgagttatctgaagagagtgaaatattgctttgatctggatgtccacttgataatatttcacaaatacaagttaataatggtgattccatgatgtcatcattgagatctgagacaagagattctaatttcttagtgtcagtaaaacatcctttacctgtgagggatttggtatagtttctttccctaagatttaggtttttctcactgagttctagttcattctggatagcacgcaaaacgatgtttaccactttagctgtgtaagtactaagttgagattgtaatgaagatttgtctgcaagtgaa

SEQ ID NO: 25436 - DNA, 1103 bp, Bovine  19866880669226
aaaattcactcatttttagtgtaaaattcagtatctttttagtaagttttcagttgtataaatatcaccacacccagttttagaacaattttttatcacattagagagactccttgttcccattttccttttgtctctttcctatcttgagccctctgccatcactatctgctttccatcactatagattgcaaggtttttattggggattaaaggatatttattatagagctgttttacgtgaggaagtttctcaaactgtatttgtataattttgataatcttatggagtaagtagtcattatctccattttagatatgaggaaacctgggattaattgattaacatatactcaagatcacatcttagagatggtgaagaaatcatttaattcaaatctgacagataccaagcctccgtttatttttttacatgcactgctttatagtttatgccatagtgtttacaaatgctttcatatattcaattatccatcaagcagttattagcatttaaatgtgtgaagtttcttgtgtctgactctttgtgaccccatggactgtagccccacaggctgctccatctatgggattttccagccaagaatactggagtgggttgccatttccttctccagaggatcttcctgacccaaagatctaacctggctttcccacattgcaggcagactccttactgtctgagccacaaggaaagctttaaatgtgtaaggcattggaatctcaaatacagctttgtttctattcttaaggaactcatagcgtgtgggagaatgtgacaaatatgtgagggatatgattcaaaggacatgaactagggcaaactctgggagatggtgagggacatggaagcctggtgtgttgcagttcatgagtcttgaagagtcggacaggagttggtcactgaacaacaaaattgacaaatcagtgtatgtatgtatgtgtgtatgtaatgtatgtgtccgtctgtatacctttatgtatgtgtgtgtatagaaataatcaattctgcctgaagattcacagatgactcctcctcagaaatggtgtttaagttgacacctcagaaggtgttcacaagt

SEQ ID NO: 25437 - DNA, 3059 bp, Bovine  19866880746696
atccgcagtgattttggagtccaaaaaatattcagttagtgaaggatttatctgacactttggtggacagagcactatgttagatgtctttagatgatataggatgatggaaagacatgagcaatatgaatattatacacatagagaagaagcaacatttagaaaatttactaacaacattgtgcctgttctttggtcacgtagaattcttttaacaggaaagggaaggctttgcaattttcatcttatctcgaaccacataacaataagaatttacttgtgtctgcaaatctgtaataaaaagaaataaaaggggaagaggaagaattgcaggaaaattataaagaatagaatgagcgattattcacacaattttggtagacacacgtttgtgtgtttacattagcatttacaattttatggttaaaactctttagatataaatgcacacatcaaagttagtcattaaattcatagccaatcctccatggtacttgtgatatttttcattacctgaaactagaggaaaccgatgaaggatattcacaaccaatgtttgaagctgatttgcaacttctgtgaaccttgatattgaatacattgtagccgtgcatcaaaatcataagctgatctatgaccaaatttgagacttaggtaaattttcttttctttaggttattaagaaactttctatacctttgtgtgatatctcaatgagaatatttcattgctgtatatttcatcacatctcgtcaaattattttgcttgtggtgctatttgttatttttatttgacataacctttctcatcatttttgctaactgaatttgtttctcctcaagagctcaaaagaaataaggtttatttcacatttttattctgatttattaaagtgtttcttatgtgttcagagtgataattcttggttttttcacttaaaaagtcatttttctgaatatttaagtaatatttatacagtattttaaaatctgacatttagctggaaacaatccatgaaatatttatatgaatggaatgcttcaactaatacataaatatcaacatgaattgtatatgttgaattaaattctgatatagaattatttctaccaataacaaaaaataatatagagaagttttcatgaggtttattattagagtctgaagaaattaatctttgccacaaactataatataacaaaatataaaatacattacatatattacccaaacatcataaaaatgtacagttatttaaaaacaaagaaaaaaatttaggcagaagcattgaaaaggaatttaattatggtgacttacttgtaattataatatttactactatatactcataattttctgttgatatgaccaggattaattatgctaaccacaattgtgaaaattaagataggtttgatattatccatttatttacatagttgtaaatataaatacatacaaaggaacattaaaaaaaagtcatgtaaaaatctgaaatgaagaatatacatcattaaaaggaaagttaacgtctttctaacttttgcatagcttttctcatagctttagaatatgtccctgtatactatttaggaagtagaaaaactacatcttcagccaagattgtgttgttttctcttgtccttttctatcatcatgcataaatcttttgccattaaatgttttacatatgagagactggcctcatttcttttgcgtatgaatgggaaaagggaggataatggtatccaaataagtggaggtcaatgaaattaaaacaggaatattctgattttatgggattgaccacattgataataaaatgttcatatgggatgctatgatacatcaggccagttctaaccattagtcaatcaaccttaatgacacattcaccaatgtcaatattcagagaactagatcaatgacttcttaaagtccttccttaaattatgaatctataatttaatgcattatttggatttactagtgtacctttttcattctcatgagattaaaattggtatatttcacatacatgtaaacatggtctcctttttcattaaaaggcctttactgaacaaacatttcttttaaaaaatctattaattactgcttcaagctagaaagcagttacaacccaggcaaaatctcttctgtaaacaattggaaactataaaattattaaaaattgttttcagagaccagaaaagaggcagctcagaactacgattcctgagataagagaaataaatgagatgaataacaaaactgccatggctttccgcctacaggcaatttctagaccaggaaaacacggagagggaacccaaacaaagcctagtggcctggttgatgtaggaaatagtgactgcagtctgacacatttatggagccctaacagggtcaagacttgggaatggcaacccactccagtgttcttgcctggagaatcccaaggacagaggggcctggtgggctacagtccatggggtcacaaagagttggatgtgactgagcagctaacactaactttaaacaatctctagagtgagtctagaatgcatactgagtcacttcagtcgtgtctaactccttgcaaccccatggactgtagcttgccaagttcctctgttcatggaattctccaggtaagaaaactgcactcagttgccatgccctcctccagtgatcttccccacccagagatggaacctgcgtttcttaggtctcctgcaatggcaggtgggttattaccactagcaccacttaggaagcccaactcctccttatctgcccccaaagatctaaagaattgtttggaagggatcaaaatggtatccaataacttttgttattgcccaaacaaacaaaaataaataaaacattctttaaaggaagacaaatctaaacactcagcaaggtaactaaaatgtttaacatacaataaaagaaaaaaaacttactactcatgtctaaaaacacaacaatgtaacctattacctgaataaaaataagccaatagaaacagacccaggaatgacactatcagaaaagg

SEQ ID NO: 25438 - DNA, 4029 bp, Bovine  19866880758574
atgggggagcctggtgggctgccgtctatggggtcgcacgagtagtcggacacgactgaagcaacttagcagcagcagctactttctacgtgatccactttagtgttgttaatctttctgtcactaagtaacaaggattcatcttattcctgctttcagaaatacattcctcattttcttataaaatccttagctacagtataaaatccaaagttcctcagaatgttgaaggcacttcaagtttttactaacactctcctcaagatccaccgctcttttcaaagcttttcccacattttaggtttttgtaatggcagtccttacattcaaacactaaagtctgaattagtaatcttcttctgcctcatatattactctaaacacagtggttgaaaatagaaaacatttatttttccatggtttctgtcagtcaggaatccaaacacagatttgctgggtatttctgtttcatggcttctcaagagtctgcaatcagggtatgagctgggactacagttgtgtcatagctcaactaggataggattcatttccagactgtctttcatgattcttgatgagactgaatctcatgtctgctgtatcatattcactagaaatgagcaaataagtccaggccataatcaagggtagagtattacagaagggcttgaatcccagcaggcaggggtagggaggggtgaggtggggagcacctccaaggctgcatcctgcagtaattttttataaacatatatgaatgattgtccatagggtgatttgggattgtccataatattgggttaaatattaccgtcaagtggaagatttaaaaaaaaaatactatatacttcgtatcttaaagaggaatccacacatcttgaatgaatggaaagtttcctcaatgtatcttctaagttaaaattttgctttgtttgctttagtcgctcagtcttgtccaactccatgcactgtagccctctggggtcctctgtccatgggatttcctaggtaagaatactcaagtgggttgtcatttccttcttcaggggatcttcctgacccaaggatcaaatccacatctcatgcactgcaggtggattttttttttttttttttttttaccactgagccatcagggaagccccaagttataatttagcagactaattagatgtttttgaagttaggttttctcatacttcctaggtcatgttttgtatacatatgtactgtgaagaaaaagatctctacttaaaactgtgattttcttaaacatgtgttttttaaattgattttccagtataggaatttcaatgcttggcttgtagtctcatgctgtcacatcctttcatgtcctgtcttcacagtgttcatgtttatatactaaggtttattgatatataagaatttatattccactcccccatagttctgagaaaacatcctgtatcagtcagggtccagttttaatatagagattaaacactgtcagttgttttcacagatggagcccaacaggggataaaaggatgcttagggcacatagagaatctaaactgcataaagttcctaccattgttcgaacagggaaaccaaagggaagaagtgatatgagtctagtaagcctgagtcatcctgactgctgctcagacctgtgatgaagggctgcgattgatggtgttcagagagcagaagataggtgtatgcaagttggtgcttctgaaactctgactcctcagttcatgtttctggctactgttcatgctccagagggagtgacgcgtgactgctaggtgtgttcaaagatgctggattctagatttaactctcctaaccagagagaggtcaaccagactagtgagctcctcattcgagctttctaatcttccaccagtgactgctagtaggagagaataattctcagctggtaaaggaattggctgaatatagtttgcagatagaggggtaggcctgaccgaagaaactataaaggtcaagcttcctaacagaaagtgtagtgttttgaggttactaatgacctgcccacagataaagttctgtgagctcttaaaatgtcatatggtttatttagatattgatataacaaaactgtcccaggttgggtttctgataaacaggtactgagaaagaattggtctgcaagatatttattagagattaatatctatttccctggtggctcagacagtaaagaatctgcccacaatgagggaaacctgagttcgatccctgggtcggcaaaatcccctggagaagggaattgtaacccactctagtattcttgcctggagaattccatggataaaggagactgatgggctacagtccatggtgttgcaaagagcttggacacaactgagcaactttcacacacacacacacacacacacacacacacaatatctgtagtgggagggaagagaaagaatttaggagagcaaacttcagcatccgtcagaattactcagaaattgctaatacccactcctagaatatctaatcagctgaatctgcatttcagagatcagctgaatctgcatttttaaaagatcctagttacactgctgctgctggtctggtctttatgtcaaaaaactcttggactttttcgagtaatgctgactcaaaaaaagccttagtcaacctggaaaggagctctcaggagtgttgcccatcagatgatacccagctgggcccaaaggatcaggtccttgtctccttatcttctttagtctggatacaggtgccctgggaacggcatgagggttgtgtaaattcagctctttgcagctgaggcaggctctgaggaattatgagctggaagctgtttgcagaccttcttctctactgttaggcaggaagccttcctgatgggagacctggctgtacatctttacatctaccaaaaagtttgaaataatgtttcttcgttgtggactattctaaatgtttgcaatttccaactaaattaatgtagtgtccaatattcaaatcaaatacaaattttagaactgcagtttctcacagaagcattacacaatggaggaaataatgcttataaaatgaatgtgatatctctgtgttctcatattgttctgaaataattgtgcaataaatctataaacagagctattttacaaaaataacacaggatgcaattaaggatgttagagctcttttgaaggatatagatgtaaagtccaggtataataggtaaaatttatgattcaattacacaaaatactcactttgttgcaaacataaactatgttcagaccacggttggtctaattatgaattcatactgaaaccaaaaataaacttgttgataaactatagcatatttcaacattaatattgaagtatatttaaatatactgcatcttcagattaattttggaatctacatatattttaaagcactaaaactttctgtttgtacatatccagaaccacaaaaatattttttattcagaaggtaactaccaggaggttattattttgagaaatgaatcaatcattcgctatagcaaattttatgtataaaattatcccttttattttgaaatctaatcttaagcatgaattagactttttattttcggctgccctttgcaaatcctattgttgctgagtgtacatctcaggtgctcttttttaatggccattctcagctaggtacttccaactcgatgacttactaacaagcttgttcaaaagttgcagtgagaactctgatattcagattaaaagatgcaacacctaaaataatcatacacctggctgaaattagtgacaagatctaaggaaacttatatgagaatgtcccattctccatggtattcactttgaaaactaaaagtaactccttcgagatttggagctaatcttcatacaaaaattgatatgttttcaacaaaagggaacagataggctacatggttgacagtcctacaagatttcctatgtgaatattttatattgcaataccaaatgaagcgattcaat

SEQ ID NO: 25439 - DNA, 932 bp, Bovine  19866880797926
tgatgggaccagatgccatgatcttcgatttctgaatgttgagctttaagccaactttttcactctccactttcaccttcaacaagaggcttttgagttcctcttcactttctgccataagagtggtgtcatctgcatatctgaagttattgatatttctcccagcaatcttgattccagcttgtgcttcttccagcccaccatttctcatgatgtactctgcatataagttaaataagcagggtgacaatatacagccttgacgtactccttttcctatttggaacaagtctgttccagtgaaaattcagagttgatttcctttaggattgattggtttgatctccttatcaaaatacattagagtttttaaaacaaacaaacaaaacctcaggaattcaattaaagtttgtaaaaaggctcaagaattgctcagaaatacatttttatttgtctctactgtatttattaatctaagaattaaggtgtcatagttttactggatgaaacaatgctaatttggggcactagaagataaatatactcaaatttctcaaaattcacttagttcaaaagttattattgctgattctgtttgctaggtactatccaaagatcaatgcaagtgggaaagcaaacttatactgagatttgagagattctgatactgcttttcttaagctgtagccctatagggcatcacataatatgaaacacataatcagctttcagtatatatttaccttcattaatcataaactgtaggcaaatcctgagcttgaaaatttagacactttattgttgttttgtgttaatgattattgctctttattcccctttgggttaacatttttgaaaactacagagtacagatggtagcaagtccttgcagaaatgtaatcagcatatgtgaacatgatgtattcaaacag

SEQ ID NO: 25440 - DNA, 1099 bp, Bovine  19866880900387
catgaaattgtctctatgatataagagaaatctgagacagtaattaacaagtgttatgtgtcattacaaggaaaagggcatcatctcttcagaaagtgtgcaggtttcaacagcagattcattgaatgtcaataaaaaagtaatgagctttccaaattttgcaaaagcaatttctataaagacctgaaggcttttaggaagcaagagaaaatgaaagaacaaatctactagagacagagttgatgaacttgtccctataatttttaagaagaacatgtctactggtaactcgatttggaagataattttttaacctgtatttcatattttcactttctataataagttttagtgatgattttggcttacttcagcaaagtattagttgacagaacttcctgtttgcaatttgaaattattacatcgctgcctgtaaagtctattttagcaagtctctttctgcaacttgctttaaacatttttttctctaaagcagttttaagttcacagaaaaattgagcataaggtatagagtttccatatactccctgcctgcatccatgtgcagcttcccccactatcaacatgctacaccagtgatacatttgttacaatcaatgtatccacaatacttcactatcctccaaagactatagttcacacagggtttgtgcttggtgttgtatattctataggttttaacaaatatacaggaacatgtatatataattatatatcatgtacaggatagttttactgcccccaaatcctctgtgtgctgcccccaaagccctgacaaccactgatcttttcaccatcgctatggtatgccttttcatgaaaattaagtgattggaatcatgtattatatgacttttcatatttttttcacatagtaatatgcagttaggatccctcagtggcttttcacagctaaacggctcatttctttttagtgctaaataatattctgttgtctatatataacagtttgtttattcagtaaactattgaagtcatctcagttgcttccagatttggggaattaagaataaagtttctataaaaatccatgtgtaatgtttttataaacaagttt

SEQ ID NO: 25441 - DNA, 763 bp, Bovine  19866880938070
gttttgttactgctttaatatgagaggtgtgcaggtagatgaattgaggcagtattgtggggtacagaaagtaatatagcagtgatttaacttctgtttgtacactgctgtgcattatgctgacatccgatactttcatattttgcatgcattgttccttaggtttccctgtgccacttcaagattattctctcaataccaccctggccttggactcactctctaaattaaaatgactattattaataagatacatatgtttgcttctgtacactatgttttaaaataaaacaaagttaccaatagattatattggaattttaaactaaagcccaagaaaaataggccattaaaggttaatagggtttttcttacactgtaggaatataattctctgtactcttgtcaccttcattctaatcttgaggtacagctgttgaataaatggatctgagattattacacagtatatattcatgtgtaaaatggaattgtttttaaagttcattgcttcaactggaatattcgttgtagctttcctgtgaagaaccctgctgtggtatgttatgatacactgaaaacacactttactctttcaggttactcatcagtgcctggagaatgtgctatctttaaaattttgtttatttatttatttttggttacactttgcacctttttgtcagaaatgatatcagttttagcactattcagtggttacgttaaagggcaacatataatatttctacactagcaatgttat

SEQ ID NO: 25442 - DNA, 1031 bp, Bovine  19866880947563
tactgtaagaaacaaattgttcttaaagctgaagctaaaaggcctttaacagaaaaattggggtcaggtccttgaccatgtatcagctatacccagaatcagtttaatattttctatggtctgagagtaaaacacagttgatatctgatcaatgatagtgttgagagtacaagggttttcaggcattcacagcagtaaatcaatatataataaagttttcaacttattgggcataacaaatggcaacaaacataatgaaaaccatatggtagtggttaatggtacatttaatgtcagtgctaactctatttctccacagataatggctataaatttgtgcagcacggttgactgactcatttaattctatcaagtgattttctatgtagtaacaaggcatttttctctacagcttaatttttggaattgtcatattatctgtgaggcacaggacttaagtcagtacttacaagactaaataagcctttcaagttacactgcaactatatcgtggaaactcaacatacacaaacagcttgtcttgtaaatagtatatctgatttttcaaaataacacacatgtctatttaaaatacgttgtgttacatcaaatgttatcatttctttaaacatgacatttattttatagaatttgagattgtaaaagcaatagttatagaaaattggggggaaaatacaaaacctaaaggggaaggggagtcatttctaatatgctcacccagtaggattttggtattttccctttcattatatggattaagtatctttctttctaagacaatatttttacttagaggaataaactcaagccatatggaaaagtttatgggcaccattgccttctctgagagagatcaagacttgactgtaaatgacaaggcctaggatatagaagatgctatgaaaatatctttctgatcctgggacaggaaagaattcctaaaaaggaaaaaaaaaagaaaaaaaaaagaaaaaaaaaaagaaaagtttaaagtaaataaaaataacaat

SEQ ID NO: 25443 - DNA, 1948 bp, Bovine  19866881004743
caagggagatttattattgaatgagataaatgaaactgttgttatcatctctgctccatgtccttgaaaagaatatttttcatgttagaaaaaaaatgtattacttggttttcttgcagcattttttttttttttttggccaccaaaatattttctaggctacactaatatgaagatttttcagcaatttacagaaatggtgcttatgagcatatattttcccttttactactgaaaggaaaccatgggaacatagcatccaattttgtttgacagaattctggttagaaagccacatgtggtgtgtttttgttttgttctatagttgtttccactgtgtcgtgtgattcatcacaaggattttgagaacggaaaatgtcaccaaccaaatatacaaaattaatgagtagtttactccattgcaaagggaaggtagtgaacagtcaggcagaacaaaagcaacaagaatccctgggtataaagccatttcagctaatgaagttcaggtttctgcatgtgatatgaaattgtcagagcaccaatagccatcttaagttttaagtctctggaaaatgataaatgattattcttgcattcgctttacataacttatcagttaaggataatcacatgtttaaagcagccaagagaaacagttgcatacacagctatcagtatctgcagagcaattttagaatgaacttgttactagcagccagattcatttctaatgagtcctatgtccctgtggccacatataaaatgtgatgccaggtttgttctcttatacttatgagccagaagtgttacgattacatttgcaaaaaagtgagttatggatgtctcttacctagctcattttgaccaaaacttgtaaacaaaaggagaggaataataaccagagactattgaactccaaactcctgcctcttcactaattgtgacattttataattctttcccagtttcatcacccttccattaccaagacaactctggggtttttccagagtaaggtcagcttacctctgagttctctacttcaaattcagcagggtttgtactcaacaatctctttctatactcttcagagctttttggtttcctgtgacttgaggctacagctatttgtcttggtaccaaagatgtcttcatttccataattagtggattacatcaaaacctaattatcggggacttctgtggtagtccagtggctaagactccgtgctcccaattcaggaggctgggatttgttccctggtgagggaattagatcctacatgccacaactaagagttcatatactgcaactaaaaatcccgcatcccacaaagaagactgaagatctcaagtaacaagtaagacctggctcaaccaaataaataaatattaaaaaaagaactagcataaggataaaaaaaaaagacaaaaagtctaattactaaaatcctacacataattatgaaaggatgaaacgttttaagccaagaggatcacaggtcatcctgtctattaaaaaaataaggaaactcaggatgatatatgggcaaaatatcttcatttcctttccagatcctccccctgccccaccttgctgttttctcaggagactgactgttactcagatttctgtgccttctggcttctacctgggttcagccctggtgaattccagcaggaagtagggaaagatgaagggtgtgtcgtgggcattcattctcccaactccctgcctagagctggtcacatcccttaagattgctgatccttaccagatcatctgatctgcatgaatttctcttcattcaagtttcagtaacatcttctctcatctcttgaggcggagctctgctactgttcgtcctgagtccctgttgatccagcggtttcctgcatcccattacagtttgataacgagcctctttttcagtaagctctttttgag

SEQ ID NO: 25444 - DNA, 1003 bp, Bovine  19866881138054
tagcatggaaacatatacactcagtatatgtaaaaaactagccagtgggatgctgctgtatagcacagggagctcacctggtgctctgtgacaacctagaggggtaagatggggtgggaggtatgtgagagatttaagaaggagtagtcatgtgtatacttatggctgattcacatgttgtatggcagaaaccagcacaacattgtaaagcaattatcccacaattaaaaaaaaaagaatggaatatgtccattttaagtttccaatgccttgagcaaacaataacaatatctttttctatttgtgtaaaggactcaatggacttttaaaatgtacctaggtgcctgggttatgtgctacatttttctaaaaagccagtggaaagtgttcgttataccaagagaggaaaccacaaagttatttgcatgattggtccactgataataataaatgcccaaaaaagaacaaaaaatatttacacctgagagattatagctattgagttgggcaatctttcttttagcaagttatagtatattttaatgatctttgagctatcttaacaaatagctgtttttcagctccttctacattgaaaaatttcaatttttagaactttctcaacttcttccaattaacttctcaaactaaggttgatatatcacttagtatgttggttactttaaaactaggttgattagatcctataaaatgctgttactcgacaattgtatacaaatggcttccttgaaaaagcttttctttaaatctgtaggtttcaagagaacactttaacaaatgtaaaatatatttcagtcttacacatttctaaaattttgctctcttttttcccctctggaaatatgagtcaaagatatggtggcatataaataggggaaaaattgaacatataatccagaatcataagagagttttgagttttcctttataaaacacagttgttctatagaaacatgaacattcaaaatatagtcctgtccag

SEQ ID NO: 25445 - DNA, 1365 bp, Bovine  19866881195966
aaactgcaggtgctcatagacttttgtgaagaagattcattgatacactctgttcagcaaccttagcacaaaaatgttttgacacattcatatgtgttttcttttggtaatttcccattttcctcatcctattcaggtggtagtcgatttgtgatttttcctgtgggcattttctggcttcccataaatagaagttgtataccagatttctataccctggattttgtttcaaaagctttagtccactgaagagaagaggatcgagggaaagagagcaaacagagaagggtttcccaaattgcaaatgatcttggggaatggaaagatctgtgagtttcctgtacctcagaaatctactccttgtgccctttggtgttcctagccttctctatacatcttagctttgttggtctctgggtggggtgaagccaaaacctttccttcctgtgcagaaagtctggggaagctgtcacttgccttgttctttttttcccaagaaggaaaattcattttggttggggagtttcctcttggccctgaacagtgctggcttggggaatgggttgatgcagcccgaatgaagctgttttttcttccctttctgtgtagttattgtcaaattcttctctgttgaaatttcttaagtggacttcagaacctcccagaaccattttgtccatggatagctgtgtaattgttgatcctagtagatggacaggggctagacatttctactttgccatcttggtgacctcactcttaagtaattcgttttagtttacatccaaattacatgactatgcactattgttcccagtgtctatttttctgattctgggactgcctatgtactcagcgggagaaatctatccattgttttctaggcagtctcctcttctccctgtgttgaatcttaggctaatttacccaaatatcaatcccttccatctctaatatttttgaattcctgaaatcctgtcattggttgaggtgcattcttgctgtgtatatatgtgtgcgtgggtacacatgtgcacacgcatgtgtgtgtgtgtgttttacagagagtagatgacagattcaaatcttctttacttttctttccttaatttaatgatagtttagaggtggaggaaatagtcctaagtggcttgattcactcaagtagcttcttaaaaccactaaattgaattttggccaggggaataacatctacaggatttagaaggtatatgagtgctgtgctgctctcaaaggatttatttttcaatcttttaatgattactacttctttgatctacttccagatttcatacatgcatcacatacattttaagatcataaattatctataatagtttagca

SEQ ID NO: 25446 - DNA, 832 bp, Bovine  19866881234531
ccacctgggaaggccagtcaagggtatatccctgtattctcattatttttttcttaaagtttaaattgattgtcttaggaaaactagcctgagacttttagaatgagcctcagagctggaatggcaagtcccagtaagtcatataactatacagataaacttatgccaccaattttcctattgggttggacaataacaacaacaaaaaaacacattctcatatatccatctgaggaacagaacagaacaaccatttctcacttttttttgctattctttttatacttacctcaaagggttttatatctagtcgtcctgtcttgctcaatgaggtccgtctttctctcttcaactcccttatagtacatgtgtctgagggataacttcttccacctattgatgctcttctcagttctgctatgctatgtccagtattctttaaacattccgtctgaagtttctcaaggggttgagtttttatagaaattactgctaagtgttctgagataatgtttggatctattttgaggggtttattcccaacatgtggaactattttaattgcagagtcctctacaattgaatctttagttgattctttatttaagtcaggaatcatgttaacagcatgctcttgtgccttttcaacaattctgttaatgtctagatctccaaagaaacaagcatttgaattctttggactagctgaatcgaagggaaaatttgaaacttcattaataattaaattagccacttttttagggaaaactccgtttgtactttttatatcatgataaagatcctttgggttccagattgttgtagtacatta

SEQ ID NO: 25447 - DNA, 1040 bp, Bovine  19866881308168
tccttatttaaccactctttgtatctttgattctattgtatcctgatcaccgaagccgtctccccttcgaattctctggatccaccagggctggaccccggcacctggcttcatctgttaatcatttcccttttgttgtaaatatcatcagaactgggagagactacttgggatccagttgatgcccttatcttcctacccaatgtgtatcacttggactaagtttgtgaaactctctaccctttctatagaaacctggtcactgatagttacatttctcacttacgcttagttgtgtcttcttctcccaagacgagtttgtgacagtcacacattctgaggtagttacatcaatgttagaatcagttcttattagtgtctgttcagattccgtctgttttgctggtgacacttcagtcattatagtcacactggatttgggctgacattttcctactgacaaaaattttttcagactgcgattgctcattggtggcttagggtgagccactgtgctggtagtgagcttcatgtcttcttttacttgatcttcaagtgggctttctggaaattcttcttcttcttttacaacctcttgtaaaacaacttcatcttcatcagaagctaagctttcttctttattttctaaattttcttgacgaatatcatgagttattaaccaaatgataagatcttttttgctttggacatcttttaaaagctccacttcggtgatgtcgggctttattaaactctgaaatgaatttctactagaagtctggaattaaagagacaatgaatgttaaaaaacaaccaattcagtcatttttgctgtggttctactgtattgaatagtaaggcaactttcacatggtttctatttcaatttagtaaaattacttatctttaagtgccttttacttatatattagtcatatatttaaaagaaaaaataaatgaaaatcataagcaatatttgctcttttctataattcttttttgcattcaagattaacagtccagttcaaagaagagatcct

SEQ ID NO: 25448 - DNA, 906 bp, Bovine  19866881795713
aaaatattgtgaattgaagtctagagaaggcaagaagtgactttttaaaaataaaaacctttggctacattaaaatagcttttgagttatttttatttcctgccttagctaaagaacttccaacatcaataaatgtgaagaattaccatctaacatttttaccaattgaatatgtgatgataaatttgctttttataaaatgttaagatattttcttagatatgctccattctttataaagtatagctaatcacttaaatagcactacattcccatcaatccatgccattaaaaaaaaatggattatgtaagctgctctctgcaaaagggacattttactcaaatttatgtttttatctataggcaaagtaaaataaacgagcctcaactatatctatgcaattcattttccttaaaaaatataaagaaaatctgggatttctcaggatattatgttattcattgtaatataataaataatacatgtgttttttgtccctagttcctaacacagagcttggaaatccattggagtgtcttatgtttttcataatgggatcctttagatcatagttgaatttatgctaagaaatgactcgtggtgggcccttagatagtttcagtagttttgagggagaggttagccatgtcagaaagaccaagcacttgattagagggttgaaacttttgcttttatttctcaaactctaaggaggggagtgggactagagattaagctcaatcacagggtcagtgatttcatcaaccatttatatttaatgaaactcaaataaaatctctgatacctgaagttcggtacattctggattgctgaacacattgatatgctgacagtgtctttcctggatatattaaatataataaactgatatttttatgttggca

SEQ ID NO: 25449 - DNA, 1433 bp, Bovine  19866880345367
tctaatttgtgtacttcctgttagaaaaagagggttcaccttgagtaaaaaaagaaaatctccaggaaccctaaattcatatgtccatatttgccatctcatttttttcctctttctggtgaaactgaagtgctgatttggtagggaaaatgattttcccaactttcttgtcttaacaactttatgaatctaaactttataattttcaatgtgttgtagaaatggaagaagttccatgaattttgaaaaatattttcacatataggagaaaatttagaattattttcattgctcctttacatattagataatccttaatggttcaattgatgattataattacattttaacaataaagtaagttaaaataatacagtgtactttcactttgatttcattttcttaaaaataaaatactcacaataacatagcctatctttcctgatttgccaggcaaagcagaaataaaatcatgctgtctgtgtataaggtaaaaattaactgttgtgacacttcatatttgtattcctctcttatcttctacattttataaaactaaagagtactaattaaagttactatacacttgaggaactaaaaagaggaagagatccttcaatataaatattcgatctaaaagaatgagaacaagctaggacagtatagcatgtggtttaactaagttttatataatgaatgaaagaaaccgaactagttagccataatttagggtagctatgacactttgaaatgtacaagagatgcataataagcagagaaccataaaatatttgaatcttttcaaaataacttctttactaataactgtatgatttataatgttgtctatgatgcagacacaatcactattaatgtaccacaatgttttaaaatctcagagtcattaccctcaaaaaccttagttctataaatattcctgcctcattcattttgtcatactgtgcagcactgaaataatataaagtgacatttactataaaaagcatacctctatgtgtgttacaacatatatggctatcataaaattccaagcacaaatagagacatctctgtgacatgtacctatttatttcagaaaaggccatttgggagtttttaattagcctagtaacctatctaaacttgtcaagattattacaggctgcatggaagataattatactgcagataatttgtgcaacaaatatttgcattcaatctacgaacaactttcccaacccttgaaatagtcataaaaggacatgctaagtcacttcagtcatgtccaacctctttgtctgtagcccaccagacttctctgtccatgaaattctccaggcaagagaattggagtaggttgccatgctctcctccagggggatcttcctgatccaggggactgaacccatgtcttgtgtctcctgcattggcag

SEQ ID NO: 25450 - DNA, 1336 bp, Bovine  19866880352365
attctagctggtaatggctgcttgtcaaagactgagcccgaggcttgcccttattaaaaagggagattagaaagtgttagaaaaatcttaaagatatatgagtcccaaactaatactttctctttaacagaatcatgagggttgaaagaaacttgacttgggtaagaaaactttctattttgatataatttcaaactttcccccaaaggtgtaagaatagtataaaaaactccagtacagtttttatccgcatttaccaattttgaacattgaccacatttgctttatcatttacacttctctatatacatttataatgttttttttttttctgaatcactgaataggtgcatgtgcataccctttgtacttcagtatgtatttcctaagaataaggatattctctgttataaccacagggaaataatcatatgcagaaaatctaatatggctgcaacatttctcgataattcgattttgtcaattgatccaataataacatttatagcattttttcccccagtataataggcactagttcagatcacattgtgcatttagtggtcatttctcttcaaccttctttaatctgaaacagttcctcagccttttctttgcatttcattcttgaagaatgcaagctagtcacttaatagattgatcctcagttgtctggatggttcctctcataagatatggaaaagatgggcatacttttttttgttggagtgtagttgatttgcaatgttgtattagttcctacatacagcaaagtgaatcagccacacatatacatatatcctctcctttttggattttctctccatttaggtcatcacagagcactgagtagagttccctgtgctctagtcagttctcatagtgatctgttttatacatagaagggaatggcaatccactccagtattcttgcctggagaatcccatggacagaggagcctggcgggctacagtccatggaattgcagagtcggacatgactgagtgacttacacacacacagtgtatatatgccaatcccaatcgcccaatccatccctccccccaagatgggcataattctgattctgagctatttaatgccatgtccatgttcttatgatatagtgtcttttatcccagcaagaaccacccacaccgacagtgagactgaaagagatcatgtccactgttccttttcggaccttttcgtttatatttctgaagaaagccagatgctggttttaagcaagtcacattatctataatgaatcacatcatctgcagtatttcatgttgtttctggtgctaccagatgttgaatagacagccaaga

SEQ ID NO: 25451 - DNA, 1324 bp, Bovine  19866880409534
tgctccttccaccgtattgctctggatctgttttgggagccagggatgaagaacaaaatatagtcttcttatttgatcacaatattaccatggcagagtattcaattcggagaaggcaatggcaccccactccagtactcttgcctggaaaatcccatgggcggaggagcctggtggggctgatgtccatggggtccctaagagtcggacacgactgaacgacttcacttcacttttcactttcatgcattggagaaggaaatggcaacccactccagtgttcttgcctggagaatcccagggatgggggagcctggtgggctgccatctatggggtcacacagagtcggacacgactgaagtgacttagcagtagagtattcaattagtggttttgggaaggaaggaagagagggaaagaaagtagagaggagggagggcaggcaggtggcagcatctttagacaccaggaagagagcactggtttgagcattatctcaaaaaaagaaaagatgatgctactgaagggaagtcgctcagtcgtgtccaactcttagcgaccccatagactacagcctaccaggcttctctatccatgggattttccaggcaagagtactggagtggggtgccattgccttctccactgaaaatgaagctatatctaatcctctttcctcatctctttcatgaggattatcacagctaacttgcatttgtttgtctgatataaagaaagaaagtgaagtcactcagtcatgtccgactctttgcgaccccatgggcggtagcctaccaggtttctgcgtccatgggattttccaggcaagagtactggagtgggttgccatttccttctccaggagatcttcctgacccagagattgaacctgggtctcctgcattgtaggcaggtgcttaaccatttgagccaccagggaagtccttgtttgatataaatatatatcaaatcagataatacctgtggtgtaagtactttataaaaaagcagactgatacgtacatgaagctttgttgaaattattatgaccagaccagctcacttgtttttgttttcaatttttccttatgccacccttcatttgactttgggttaaaaaagaagactcaagaaaaaaaaaatcctcatattctccagaagtcattaaaactagctactaatctttttccctttggctgaacattccaaatatgacaccacttccccaaatgcaaaacattcattattttaatgatacttttatacaggaaacactttctgaatggcattcatccaaaatcttaaagtacactaatcttcaag

SEQ ID NO: 25452 - DNA, 949 bp, Bovine  19866880451728
tatataaaacagattaaaaagcaaggacctactgtatagcacaagaaattatagtcagtattttataataacctatagtggaaagaatctaaaaagaatatatacatatatatgtatagtagaatcactttgctatacacttcaaactatcatgacattgtaaattaactagacttcaacttttttttaattctcttttcagactaaagtttcttttgattatcattgtgtttaaatcacattagaaaagtctaccctttctaaacagcacattggtataagatgtgaagaagttcttgattacgtatgtcagttccgtgtgtcaactcctcatgttactaagaattccagggctatcaatttaattactcagaattgattaaagatgagacagtgtacaaggaattgccttgttgtttcattttggttatctaaacctctacagtccatggggttgcaaagagtcggacacaactgagcgactgagtacacacgcaaactctgcaaagaccccaggccagaagtgctttgttattaatatgaccccatgctattatggccatcctttttagtcacccatcctaagcggctcttctcatccactttttctggataactcctgagtaagacccacttcactcaagtaattttctcaatattcatcttgctggctgggagtgaaattcaagttgaacttcaattttatattgacaattttctgttgaccatggcaaaagattttgaagagagtattgaggttttcatttaagtttttttccctctgggtctttcattaatttttctgctttacatttgaccttactttaagtttaagaatcttttaagcagttgttttcattacagcacaagaaagagaatgtttttactgtgcataagaatggtcatggattcagagctaattagagtcgtaagaagccttaacatttac

SEQ ID NO: 25453 - DNA, 781 bp, Bovine  19866880489090
tctaaggaccaaaaataatctatgacttgggaaaaatcaatgacttcatccagcagtattcagacatccattctacttccacaaaacccaaggcaactgcttctatttatcttgttctagactttgaccctgacacctggctgccaggcgctgcctggttcaatgtgtcgagcttcactaagaagatctgaattagaactagattttcagaggagcatgtttcaaacccctatagtacattccatgaaataatttgcttaaaagagatggaaaacttcagggaggaagaaatgggagcaaaatttaatcagttggaaatgacaaagaactggacgtgataatttcttctaaaaattcagcagcaagtcttcaacaaagttttacttccctgtattttcaagatgatgttgtccacgtttacatttaccaaaaggtcagtagagtgaatcgtgagttattcttcacccagaacccagaatggctgagtccttcagtctcagaacaataaggaactttatatatgctagcaaattaagtttggacaggccaacagtcaggttttctgtgtgaatacttagggttgctggaacagctatgtactgagaaaagtcacagaatatattgatgatgagttttaagtaaaccatgggactgataataacattgctttgggtatatgaagagttcctgacattcagatagtatctttttaagtttatatgctccatttcatttgaactcaataataggtgagcctggtgttatttttttctactttaaa

SEQ ID NO: 25454 - DNA, 1776 bp, Bovine  19866880505217
aaacagtatctcctctgaacatttctgtcggatggagtagggacaagaaagtattcaagaagtgaaataacttgtttcagaaaggacagaacctgtagaaaatgggctttgagtatctagtcacaggtggcagatttaaagtaccctgaagcaattctctttgtttaagttatacaagagcatgcacccctataaacaccctttctccagaaaacagggcaagaactaatatcagataattgcaactatcatgtaccagaatctctcccatgcctgatcctgtattttactgtgagatgttgtttagttgtaagaacaacatggtcaggtggggaatattcatttaataacaagagaaatcaagtttcaaagttacaaaccttgcctgcattcacagagctattcttgcagaactagactctgaatctaaattctctctgagcctatctttaacatcatgcattggcccttcagaacaccaacaaaaattcttcaatggcaggagctataatgaagaaatacatcagaaataagtttgaacgtgggtggaggagactggtaggctacagtccatggggtcgctcaagagttggacacgactaagagacttcactttcacttttcacttgcatgcattggagaaggaaatggcaacccagtccagtgttcttgcctggagaatcccagggatgggggagcctggtgggcttccctctatggggtcgcacagagtcggacatgactgaagcgacttagcagcagcagcagcagccttcctatttggcatttaatcaatctctaataaaactatttttatgccatcaacagtgctggaaaagaggctgtgatggaatcagaaacaagaactacttaatgtacactgtacattacacacttttacaagaacaaaactagtttggatcaatggtgcgacttggtacatttccctgcctgtcctaccaggaagacaggcagcatttctacaagagaatttgtgccaactgactaaaattagatcgtccacatttatgctttgagttggtgtcattatctcagtggcagtgtgggagtttaaacccataatctctgtgtatttagaacggataagacctgatttgcataactgcaagagctcaagaaaccactttgccacattacttcattctggtgatgaattttcaacgtggaccgttcagaattcctcgggagaggaaaggaactctactaattaaatgactgatgtaccaactgacagcaactagcaagtccagcattgaatgacattgggttacaatgtgactctatcaaatgtgtgaatatgggtttcaggaatcccacaatggctaggacagcccaaagtgggatgacggttccttctgacagcatgctgacactgaggcagtgcatctcatcagttgggcacactccatagatggccagatcttaatacagagcaaagggattttattttcacatttttttctcctaagtcaaatgctgcagaaacatagggcgaatgagaaacattttttataaccacattacacaaagcatcataatctgtcagtgactcaaccacatattggataacagtgtgaaaggtatttaaaactttttcttgaggaatataaattcatactcatcataggcacagtagcagagttcttaggaatttgcagaggccaaatgtgatagcccattttttttttttagcctgttatgactgaactcagctgcaagataattgcctattcataatccactatttttacttta

SEQ ID NO: 25455 - DNA, 1551 bp, Bovine  19866880507006
gtttttagaaagatttgcttttcatctgtgcaaaatcgcacatgggacttatcctgccttgctgcacgagggaagtgtcaagtatatgacataatggtagtatttttgagactacagtgaaaaaaaaaaatcacccccattccctgcctcggacctggagtcttaagctgtaattacgatgccatgatcagcatgttgtgttttgtcagctttagcgctgaatgggtggcagcttaattccatgctgctggtaggagcctggtgcagctgttcagaaacgagaatgtttgttgttgtttattgttccgagagtcgcttttttcctctaacagactaatgaagagatgtttagtacatttgcactggtcgactgattgttgcaagcttgactttcaattgatccaacgaggtgaaataaactagcaagctaccccaagaaaagattcactgagattctgcccttgacataaaaatgcatgttcagtttacagctgtttgtgtatataaattctacactgttgtataacatcttcacagtttaaacaaggaattattacattttatattaaatttatatattaaattgaacttcatgattgattctcatgggataaaattattatggcagacatcatttcatttataaaactaaatgtgggaaaacatagcaccatgttcactttcattactaaaattaaaaacgtaaattttgtgagctctcaagagtggcaagacacagtgtctaacccaaggggaatggacagattcattgttaggaataaaattaatatggcagaaaagaatatagatttaaaatggaaagttaaaaacactaaataaaatgaatgaaactttcatgatgttctgaatgtagtctgtttcaagccttgataaatattaaagggttcttgaaatgaaatatgaaagccaacttttcttaagaaactggacatgaaaaagttttcatggactctgaagcactatattatgtttatttctatcttttatttctatctaaagtaaggatggtgattggaggggaagggtgataacaatcacagaatcataacaagaggaaaaaatcaaccaagtgtcataggacatcagagaatagtaggcatggaaatgccatggttggatgtgtgaagaacctgaagcccaaccagaaaggtgaaggggatgctgggaacagccccactgtacccaggggtcatgagcctcagagcagagcctcttttgtgatctcatacaacattccatacaaaacaattcaatttagatgtgtttctcttcttctggagagagacatggtattttcagctcacagggttttcttattaagggtgtagaaaacttcatgaagtatatacaagtctgaaaagatggagttttgcttttgtggttggttagagatggtgaggatagaaagatctagggaactaggtagaagagagggagaggaaccaaagggagataagccgtgggtggggaaatagagctggaaaaatgagaaagaaaaatacagaggaagaaagagcagggagaaggacg

SEQ ID NO: 25456 - DNA, 1426 bp, Bovine  19866880512695
ctctttcttatcccatgtccttgagttccagctctgatttcctgactgatgttctgcctggagtcttcacttttgtccgagtccttcagggactgaaatcctgattctgtattctggtcctctgggttcaattttgtagcttgtcatagggtcttcctgatgccaactacttatctgtttcattttctgctcctgggccttcctgaagactgtaacgattggataaacatgctcacctctcagatttcagggcctggactttctctttattatattctatcaaatggttcgctctgtaggctcttaaaaccatagttctgacttttgccagcaaagtgatgtctctgctttttaataaactacctaggtttccatagctttccttccaaggggcaagcatcttttcatttcatggctacagtcactgtccactcttgaaacacccagacttttgaacatagctagacttcactcacaccaaatcttccaaccacactctccttgcctttgcactaatcctgcccctaactctaacccctaggtctttctggtctctgtccttgcctggcctgtcctagcagcccctcactgagacctgaccatcagagaacataaattccccatctcacactcatccttcaacaatacaaaaacattaggctgacctccccataattcatacttatcagatagtagtttacatttagataatccagggaaaaatcagctcctttaaaagtcacttaataaaatacaatcttgaaggttgatggggtgaaaagcaggactctagagctcaacaacaacaataaaaaaatataaagagaggaaatcactttcatgtgcaggcaggtaaattaaatatttaagaacataccacagcaaaactggatgtttttcaaatgaacagttctgtgaaaagaggcttaggtaactactggtgttaactgctggaaaggttaattacatatcctcttccccgtttttatcatcataactctttagtgatgcatgctttccttaattatacagccttgtccatttcctgtgtagtaattgcagtctcagatgacttttctggagaaaccaccagacttcagctgaagccggttctggttatgtcccagccagtaactgggagccttttccttcaacaaggcacaaatgggcttaaacacatgtagctgagttcccgtcacaaaggaatgttttaaaaatatcatttggatgggtttaaaaagagtacaatttcttcagaggttaatgcatattgtttaaagagaacacgcgtcactgtgtggtttggccaaggactgagttcagaagcttttacgcatgctgaatacacatgatcctttttcagtggactgcctctgtattgattcctgaagtgaaacaagaaatctctctggcccttgtaacgata

SEQ ID NO: 25457 - DNA, 1984 bp, Bovine  19866880521614
cgaggagggaaatgcatcttaaaactggacaaatgacaaacacttcccacatcacttggcagccgtggatcagctcgtgaactaaccagttggaaatctggttgatgtgtcagtctttgtaagttcggtgagcaggaggtatgctccttggcctgaacagtttttgaaactgcacatctgaatctcttggcccatgggaccccaaggcactaccagtccgtgagaccctgcctgaggaccagccttcctcgtttcccaatgacatctcttcctgctggcgctgacgcagtggtgattggcactgtctacaaaggaatctgcaccacatgcattccttgtagtaggatggtggcagggaactggagttctacttatgcttatactgttaacttatctggtatctgagaggaacaatgtctgtgctgcttcctactgtcctcaacaaatattaagttgctgctccaccttgtagtccaatggttagaattcggtgctctcaccgccatggcctgggttcagttcccagtcaggaaaatgtttttgtcttcccaggtggcactgcggtgaagaatctgcctgccagtacaggagacgcaggagatacaagcttgatccctgggtcgggaagatcccctggagaaggaaatggcaacccactccagtattcttgcctagaaaactccatggacagaggagcctggcagacgatacagtccatggggtcacaaagagtcggacacgactgagcgactgggcacgcatactttgtagggttattgtaaacgatcaaagggagacactccgcccccacaaaaaaaaacacacgaaggtctttgaaaggatggatgagactaatgatccccaaacatagctgaggacattttcttctttagtgaagttatttactctcattcctttggttcttgaaggaaagataatcccagcagcttgttttcctagcctttccttttatttgccccttcggatagaaaacgcctgttctgaattactcagctatgcctagaactccaaagcacgcctgtgatcatgcccttttacacatttaatgtggaaaaacctcactaatgagaaagtaggaacactcagggataatgagctgccttcctcctgtggccctgatgtattcatgtgtcacttccagctctgcagcccagctagctactctgctgtcccttagaggttcccgcccccgcctcccacacagccagcaggctgccacagaggctctccccaccctggctgagccgcccctgaaaggcaaaccctggatttgttgatatttcctctacaaagggaagaaatgtttagtaaatcaagcaaacagaagtgatgcaacaatctccaacagcttctggtttatgattgggacacacacagataaacggagcatgttgcccaaggccatgaaactctttggatgggtcagactcccacagctgatggagaccccaccctgatttgatccctggttctttgacctgttggtgaaggatccggtccgccgtagggtttgggggagagccaaacactctatagcaacactggacagaggagatgtgcagggcctaattagtcacctatactcacagcccaggggaagaggactccgtcacacagaacccctccgtgagtcacacttgggaacagaatgaattagcaggggctgtggaggcaggttttgtagaatcaagaggatggggtgcctgcctggttcccaagggaggatgtgattgacttgtttgaataattctgtgggcgcccagggaatggaagcccagtaccctgggataagcaggcactgtggctggttccctggagggtggcttggctaaggcactttattcatggagcagaatggggaggaacttgtggtgaggccagtcaaagccctctggtttcagatgttaaggtggcacataatctcggcttcttttaggcctattccacacacccctcaccacat

SEQ ID NO: 25458 - DNA, 1701 bp, Bovine  19866880534785
tcctgtcttgagcccaagattacaagctccaggtcgtagggggctcttcacttgccttccttgacttctgtccccgtggggcagagcagggacccggaagatggtcagctcttccctgcctggactgggcctctcacagcctccctttcctccctgaaactgtcctccagagactggccccagccagcaaacggaggtggtggtgggcccccgaagagaatggggaatgtaggcagtgtcaaaaggcactcaaattccaatgtttaaaagtactgtgcttaaagaataaagccagattgtggccccaggctgccagtttttgacctctgttagagcctcccatactgagaaggctcgagggattccttcagaataggaacagtttgacctaacaggaactatggctctcacttcagtcacgagacatatgcatgtatttttaaacgcatgttctttattctccctttaagtaaatagatatttaaaaaacacagatgcgtgactctactatgtgactcacagtaaacaatccaatggcaacgcccctcagccttggagcaaaagctaaaaaccacttgcccccttccctccttcctccccccagccttttattaacaaatcggtgtggggggctagcagggagggcaagtgtatgaatgagcttttcaaaaatgacctgtaggtgagaacagctagggtacccctcattttacactacagaatcccaggctgtgcccttcttttaaaaaccatttaattatttcctatgttttggcccttttttcatcctccagtccttatttacatatgtttggcttgtgtgggcattggaatctcaagaggatgttatcaactccactggtgaatgtttttggctctttcaatgtaagattcctagttcacagcaccttatttgtgtttctctgattgctgctaatgggatcctgtccaaacatctgcagggtaaggacttgggggctgagcctgagggagatgactctattgtggccgaggatgggtcctggggtgacgatggtgacctacagttcagaaatcaacatgcagtaatccagctctgtaaatcacatccagatcgtggccatggttaaagactgcagaggaaagctcattagggtgggagggccctctgccgtcttcccagccccctgagcgaccttggacctgagctttacatcttcagctggataatgagagggagttgaatggcttctggggtttcttccagctttaacattctatgactgtatgatttgttgtttgtgttaccaagcaaaacttgggtgtgctcaccctcgagcagtaactaaccaagctattgacacagggtggtagtgaaggaaaactgccacatttattgcagggtgcccagcaaggagtctagggacgctagtgctcaaaagactctaactccgtgacggatttcaacaaagcatttttttttttcatttttggaaagtatttatttatttatttgactttgccaggtctttgttgcagcactcaggattttcagtcttcagctgcatcatgcaaattctgagttgccatatgtacgatctagtttcctgaccagggatcaaacccaattgagagcgtggagtcttagccactagaacaccagagaagtccctcagcaaagtatttttaaagtccagaatgagggaggaggtcacaggccat

SEQ ID NO: 25459 - DNA, 2149 bp, Bovine  19866880621790
tatttttctataggttgcatcctcttttaggatctaacacactagaacgtatgacagttgggtttaagaattctccaactctatacaccagtcagaatggccataacagaaaactctacaaacaaatgctggagagggtgtgcagaaaagggaaccttcttacgcatttggtgggaatgtaaattgggacagccactatggagaacaacatggaggttccttaaaaaaccaaaaatagagataccatatgactcagcaatcccactcctgggcatatactcagagaaaaccataattcaaaaagacatgctccccagtgttcatagcagcactatttacaatagccaggacatggaagcaacctaaatgtccactgacataggaatggatgaagaagatatggtacatatatacccagtggtccctgaccattttggcagcagggggatgatttcatggaagataattttcccatagattaagggtaaagggggtggcttgggggatgattcatgaacattgtatctattgtgcactttatttctaatctaatgccatgattgatctgacaggaggtaccagtccatgacccagaggctggggactcctgatatataaaaggagtttatttatttttttttactcagccataaaaagaatgggaataatgccacatgaagcaacaaggatggaactacagattgctaaactgagtgaagtaagtcagacagaaagacaaatatcatatgatatcacttatgtgtggaatctaaaaaaatggtataaatgagcttattacaaaacagagtcacagatgtagaaagcaaacttacagttgccaggggggaagagagggatagattgggactgagatataaacactactatatataaaatagataactaataaggacccactgtatagaacacggagctctactcaatactccgtaatgatctatatgggaaaagaatctaaaagagaatggatatatgtatatgtgtaattgattcattctgctgtatggtagaaactaacacaacattggaaatcaactgtactccaacaaaatatttttaaaaagaattctccaactctagatatttgcagaattcattgacctctttgctgcagccatgaaaggaggtgggggggtggggggtgggcaggtgggtagaaaaaaaccttctcagacatacaaagacctggactttctctatgtgaaatcaacagtcacagagggccactattgatctggtttgttttccatagggaaaggagccagcaatgtatttaatttcacttctcctttagcagaggtttcaaaattaaagatgcttctagaatctgtaacggaagaattccattaataaggagcaagagttgtgggtttagggtgaacttggtagggtattccttaaggaaaagacattattcacaagttcggatcatgaaactatcaaaatgttcaacacatctatacaatctgattaaaccatttcagaggcatatttccatttaattcgtctgctgccaggctacttgagaaaaatgctgtattttgtgcatattttggacgaactgcttccaaaaccttgacaatatgtttagtttgcataaatcaggcaaaacatattttgttttgttcagcatgctctgaactttcacagttatttcattatctgttcagatggtcccccagccttgcttcaactgaaagggaaattgtaaatgttgttaaaataaaacccggctgatgcattggcagctgtgcaatttgcaaagacccgggttcagggatctagcttaaatccaagaagcttatcttcactaacttctcacggtgatgagcattactattcatcacattttgcagaagtctgtccaatctttcctctttaaggaatctattttcattttagaagaatccatcttatcccatcttcccttctgggtctcaagcattgttgatcctaagttttttcctctgtataaaatatcctacaatttgtctttatggtgatataccttcaagtcacttaattgtgacaactttttcttttctgttttctcttattattatcttttaccattaattaaagaaaactgtattcaaggatttttttttcttttatatcatgtcaattt

SEQ ID NO: 25460 - DNA, 1030 bp, Bovine  19866880659996
agaagcccaatctatgattttaccagcctcataaggagaatcagaaagttctgggccccgaacaagaacatcttggggtcttcattgtcaaacaaagtgaaaaaagttcatgtagagtttcaccagtagacaggtgttccacaaaatattttgagttggaagatgagtctgaagtatttattcctgttctgcacaaaagattctcatcttgattaatttgtgaacttttgattctttggattgcaatttgtcacagatcacaagcaatctttggtcatggaggttgggagaacagaaacttctgacagatttattaccacaagtcatatatctcagctacttgacacagatttccttttgaactcttccattagtattcttgttaccttcccactaaagctcacctaactcacatctgtatacagcataacaaaacagtctttcttcacatgactttcttatccttcacatttcactggctgtcactgggggccggcagactctcacctagccagcagaaagagctcctgattccaagctcactgcagcttccccgggtctttgtttgaatttaatggaaccacctaccctttttagaggaaagaagcctagatttaatgggtgcctagaagcactgcaagcctttttcttctcctttgtttcaactccacataacattcaggtgagtttccccagaagtggaccctcagacatggatctgactgagagcaatttacttgggaggtgatcccaggacgtataagggaatgggaaacggacacagaatcagacatggaagagaacagaggtaggaaggggatgtctaagcttctactttgggtgcagtgaacgcctctggctctggggtcactggggagtggcaagtggacagatccggaatggaaggaaccgtcaagcctttccccatacgtgccagctcatgtccctccctctggagccttctggttatcacacgtccccaccagagccacagggagaacagccaagagcaaaaaagtagttaacagtt

SEQ ID NO: 25461 - DNA, 1691 bp, Bovine  19866880675341
tctagtagagctatggtcaggactacagacaatgcccatatgcccggggcagtgcttggcagagtacaggtgttcaatcaacgttcgttcatacttcacattttggttccctttcctgagtccacatcatttccacaaagacctcaagctcctttagaacattctcttgctttcttcccctttattacctacagcctcggagcctctagatggaacaatctggcccccggtacacactcaatgaggctcaggcaatgaagctaaaaagtgaaaaatgaaagtgttagtcactcagttgtgtccaactttttgcaaccccaaggactgtggcccaccaggctcttccaaaatgtggcgagaccagttattagaagtggaagggagtggggccctgtggccaggaagcaggtcactgtcgtgtttggtccaacccaatgccaggggcggggtggggggcgagggagaagcctatcgtttctgagcctgcaggttgactcctaggctctagtaacgtgccctctggtttcctgaccctgctcaaggtcacacacacgtgtgacaccttccgtagactcatcaccccaggatgaggactttggactcttgtacctcaacccgggtttgatccttgagttgagaagatcccctggagaaggaatggccacccactccagttttcttgcctggataattccatggacagaaagagtgggacatgactgagctactgacatacgcacatctcctcccaagacaggacgaggaaactgcatggtggaagatgaaagagcagtcagtgtaaactgccgacaagtctgagtttgcatcgacaaatcgccactgtggtttggccccctggatacctggtgtattcaatgtccttcctgggttactcacttgacttcaagggcactgttgtagggacaccatggaaataaggacaaaggaacctctgccacagggcccaggcttctggacaccacgaagagctggggctcacccaggatggatgtggtttgggaatggaaaggtctgggttattctggtgccctgctagtggtatgagtaccccttaccatgcccagattgttctgtcttcgtcttttcaaatagttttttcaacttctgctccttccttcactgttcaagccttttttatgtctcctgtttcaactcctcagataagaggatttgagtaatttacaaggtcattttcattcctgaaggcagttttgccccaaaccacatcacaggtggcccctaggtcctgaaagggttaccccagatctagtgcccacctgatccaataagctgtggccagggtggaggggtcccaggcagcacgaaggcacccatggggaccacagagagggagtgggtttgtgactcaggactccctatttctaccctcatcccacaaaagacgtcaagaaatagtcaatacttacggaaagttgacttccctggtggctcagatggtaaaagcgtctgcctacaaagagggagacccaggtttgatccctgggttgggaagatcccctggagaaaaggaaaatggcaacacgctccagtagtcttacctggaaaatcccatggacggaggattttactgcttccccctttcaattcaagctccacagtactgctaaaatgctctttgtatatgcagattaaaccccatcaagaaaaaa

SEQ ID NO: 25462 - DNA, 1833 bp, Bovine  19866880760763
acattactttgccaacaaagatccgtataattaaagctatggtttttccagtactcatatatggatgtgagagttggattacaaagaaagatgagtgccaaagaattgatgcttttgaactgtgatgttggaaaagactcttgagagtctcttggacagcaaggagatcaaaccagtccatcctaaatgaaatcaatcccgaatattcactggaaggactgatgctaaagctgaagctccaatactttggccacctgatatgaagagccaactcattggaaaagatcctgatgctggaaaagattgaaggcaagaggagaaggggacaacagaggacgagatggttggatggcatcatcgactcaatggacatgagtttgaacaagttccaggagatgtgaaggacagggaagcctggcttgctgcaatccatggagctgctgtcggacatgaccaagcaaccaaacaaccacaatacagggcactggatttgataaacatcttacaataaactttgctcccaagttcttctatcttcaaatagatgtttttcttggacttcaataaacagaaagatgggagcattcgtgggttccagggcatagccctgtgcccactgacaagttctatgaccttgggccagttgattaagctttgtgtgcctcagtttcctcaccagtaaaacaaaagctccctcgaagggttgttaggagcatgaaatgagttagtatttgtccagtgctcagctggcactctgataaacattatttaagtgtgtgtttaataaataaataggctgggttcactgaacattcctttgtgggagaagaattactctttatttctattgctcagcaacttgttcacacaatagaacccagctccaagtacatgggagcaagacattctccttatcgtttctttccaccaactagaagacattccacaaatgaaagcatttatgagaaatacatataatcaaacatctctcctaagggctcagatccgatgtctacttaaggaagaaaaggcagcctccgtcttagggtgctccctttctgcaaaccctggggggctttccatatctgaaatggagagcatgatgattccaagagaccacgtttcgagattgttgaagcgattttgtcagtttatgccctttgtgggtgggtgggaagattttccagtctgcaaccaattctttccaactgctggagaagagaatattcactcatggttgtttctgctcaggtcaggggggtcacaccgtgattttttttcttttgtccttacaaggaaatcttgagaactttcttcagacggggaaccaaaaatagtggcaaggaggaacggttgccaaggatgtgtccttttttcccccctctttatttcatttatagtaaaatcttaaatctatgagagtggtttctcacgtcccttccactagacactgtttatcccgaagggtaattcatgccgcatttactccaagctctccggatcgcttatgtttaaacacctacagcagctaccactcctttcagttcatttttacttaccaatcatttttcagaactttatactcaacctctttctgtctctgccaaatttcacaggatctctacagcctctgagagaggcagcattggataaatgctaaatcagataaatgcaaaatgtgaatcagaccatcatgggctctggggacagaacatgggctcaagtcctccacccaccactggctttgaacttgggaaaatgatctgtcctagcttctctcttaacaaacgtgggtaacaatacagaaggctccccttcagtcctcacagaaat

SEQ ID NO: 25463 - DNA, 3028 bp, Bovine  19866880762730
tctgacactgtttcctctgtttccccatctatttcccatgaagtgatgggaccggatgccatgatcttcgttttctgaatgttgaactttaagccaactttttcactctcctctttcactttcatcaagagattctttagttcttcgctttctgccataagggtggtgtcatctgtgtatctgaggttattgatatttctccctgcaatcttgattccagcttgtgcttcttccagcccagcgtttctcatgatgtactcggcatacaagttaaataagcagggtgacaatatacagccttgatgtactccttttcctatttggaaccagtctgttgttccatgtccagttctaattgttgcttcctgacctgcatacagatttctcaagaggcaggtcaggtggtctggtattcccatctccttcagaattttccacatacagatttctcaagaggcaggtcaggtggtctggtattcccatctccttcagaattttccacagtttattgtggtacacacagtcaaagactttggcatagtgaataaagcagaagtagatgtttttctggaactatcttgctttttccatgattcagcagatgttggcaatttgatctctgcttcctctgccttttctaaaaccagcttgaacatcaggaagttcatggttcacctattgctgaagcctggcttggagaattttgagcattactttactagcgtgtgagatgagtgcaattgtgtggtagtttgagcattctttggcattgcttttctttgggattggaatgaaaactgaccttttccagtcctgtggccactgttgagttttcccaatttgctgacatattgagtgcagcactttcacagcatcatcttttaggatttgaaatagctcaactggaattccatcatcacctccactagctttgttcatagtgatgcttcctaaggcccacttggcttcacattgcaggatgtctggctctaggtgagtgatcacaccatcgtgattttctgagtcgtgaagctcttttttctacagttcttcttgccacatcttcttaatatcttctgcttctgttaggtccataccattttctgtcctttattgagcccatctttgcatgaaatgttcccttggtatctctaattttcttgaagagatctctagtcttccattttactcttttcctctgcttctttgcattgatcattgaggaaggctttcttatctcttcttgctattctttggaactctgcattcaaatgggtatacctttccttttctcctttgcttttcgcttcctttcttttcacagctatattaccttttgttttgactttaaccttggttctcctttcattgtaacatgtccatgagggcagggttagtatttgctgaaggactgaatggagaccataccttggagggcatagatatggtcagtaaaaattctacccattcagacatgagtttaaccatgtcatgaatgtggtacatcacagtggttaaaagtcctggctttgggatcaggaggacttgtgtttgaatctcacctctgccacttacttgctgagtgagctgaggcaagtcacttaacttctctgaatcccttctgcaatatcatatttatactgacatcacagggctggtgaaaaatttttttaaatgatggatataaagcatttagcatcctaataaaatatgggcttaataaatggtagcaattattaaatacttaatgaaggggaaagtttgaattatggaatttttattatagaattattactctaatatacatgtaataactaaactacacatggtgactatcataatgtttgagaaaattatcaacagacatttctgaaaaactatttaatttagggcaatcagtgccataggctaaaaagaaaagaaggcgtgaataactacttagttgaagaaagagatcttagtacaacctagtaaatgtcttgaaatgttctccataaatgactatgtaaaaatcacttgaattagcatttcagttgtttgtctgctacagctcattaagtatttggaaaaaaatttcctgagtattttacttataatctgtgatatactactaagggtctatgaaaactcatttttgaaatttattttaaaaaacttttatcggagtataattgctttacactttctgctgtacaacaaagttaatcagatgtatgtacacatatgtcccattcttttcttgaacctccctcccatttcccccacccctcccaaaaagcctcatttttttgcttccctggtggttcagatggtaaagaatctgtctgcaatgcaggagacctgggttcaatccctgggttgggaagatccccctggaagaaggaaatggcaaccctgtccagtactcttgcacagagaaatcccatggacagaggagcctggcaggctacagtccatggggtcgcaaagagtcggacacggctaaagtgacttagcatgcaccaggcgctgaggtttgtcaatcccctggcattattttatcccttccttcagatggagccagtaattagaaatctaagtcagttctgaattaggtattcatgataactgaagaaggcagcagctcagagaacattccaacagagccccatgactgatacactgggagggagcctggttgactcatagagaacagccttgacctttcaaccttgcaaattcaaatgcagtttgtcatccaatgtcaaatgaatttggccgtgtgtagggctgcaggatggagagatgttggcctggaaaaactcgagagaacgtgaaagaggggcattgaaaaccaaaatccacaaaatggttgagaacgcacatcattatgcgcctaacaaattcttgtttcaagataatggccagccctgtgattcctcaggcagttcagactcttaaacagaagaggtcgaagtgggaaattgatgctaatttttttctctccttggcatggaattaggtttgtatttctgtttcatcatctcct

SEQ ID NO: 25464 - DNA, 2461 bp, Bovine  19866880771016
attaatgaccatacactcttaaaagttgtgttttgaaacaaacataaaaaccattaggaaattctagtaagaacaatgaaaaaaatgcttaaaattatttttagcagtacatggatttcaactaagatccaacctggttttcttatctaaagatataatgaccagattttgttaataaagacatgttattccttaaagccttaagttcgattctaaatttttgggttgtctttttctgatgttttttttttttttttctttaaaatgtagagtaaaatttggaatgtttttccttaaacaaaaaattgtgctttaaatttggcccaaaattttcctgtttccctgaactatacacccacacccacccaaacatccatacacacatacaaaatatataattcggaggcaaaacttggacattcctgagagctcaagggatcacattaatttgaactcttaaggtaacttagaaataatttgtcttagtttttattggagtaaaactgaggctaagagaggttttcaagattcacccaggattaccccgcaggtagttacatttctggagctagagctttgatttcctgtaaggcaaagtggatccaaatgagctggcttctagcacagtctgaaccaacaagacagccaccagcaaatatcctgtatttgtgttgatacgacactcaggcatgtccagctctttgcgagcccacggatggtagccggctaggctactctgtccacggaattttccaggcaaaaaaactggagtgaattgccatttccacatccaggggatcttcctgacccagggatcgacccgcgtctcttgcgtctcctgcactggcaggcgaattctttaccactagcgccatctgaactgaactgagtgccgactaccataacacctgtgcatttcgcggctctcagtaaaaatggtggaaatattgctttcaatcctccaccacttgggggcgctggaaacgtgagggtgtgtttataggtgctgcaattacaggatggtgccgctggagtttgcagctctcctcacctggcagtgttccctcctcacactgggaaatactgaaagacccattatcagggcagcgttctttccatgtacctcatttccagacccacctctatgtggtcggggtgggtggggtggcagtctgacttaaattgctctgcttttagtgtgctaaaagtcactttttagaattcccattttgacatatgtacattctatctttaggtttttagatagaaaaggttatgttggatacaagtggaaagtagtcatctttaggtggccaatatatagttttttgtttttgtttttttaaagaactgatttacagaagtgaagtgcaattaaaaaaaagtttagttgtgtaatatcaccttttaagtatgttcagatttttaaaaaaatgcatttctgtacaggctgtgacatgatacatacttttccccacaatattagggatatgtaattgaccggcaaaatttcaagcctcaatttcaagtttttggatatctggtcattatatcttgcctattttcatgatttataaataaaaccacaaatgccacaactaagcagaagcaaaaaagaaaaatgcaccctgtgagtcatatcatcagtcaataaaaatactgtattcctttaaacaaatgtacttataagagctttataacccaaagcaagatatgtgagatggtttaagaagaggttgcagttttgcaacaagaagtctgtacagctcctccaggcagtagcctgtgtctcagaaacttgtttccgtctgttcttgacacttctgcatcccaagccccattatttacaaagttatgcattttgcaagctcaaagcacctttgcgcctcgcaattatgaacgcatgcaatgacatttcatcctttcatgtgcaaattctaaaattcatcataacagaaaagctcacagtcaaaactctgcgatttgaaatgaaaggatcaaaaatgtcagacatggcagaatacggttcctaatagagctctctttatttgttcactgttcttcatttttgtttgttacaaaaatggagtcttgattctttatttaaacagtactgaaactaaactgttcatgccatgcaaaaataacattttatgcacttttttggggagggaggggcttcccacgttttagttcacaggccttattaaccgcatttttaagaaacaagtttttttgttttttttgtttgtttgttttagtgttattattgcttttgtaactagtcacatgctggtttcacgtgtggggcagtaacctgtgtctcccgggttggaatgaatttctggggcaaacaaatggttttccatcttgcacccttcttgactgttgtcctttttcacttctgctacaccatggtaaatgtctgtctacagttggacttgtgtccgggcagaggaag

SEQ ID NO: 25465 - DNA, 697 bp, Bovine  19866880856612
tcctctgaatttgaaggtgagctgctggtcctaagtcgaatgcagagagaaagtaaccaggtaatcaagaaaacctatgggctctactgcaaaaagcttccacagtacctatgctccttcttgcccaggggagaattatttacaaacacaaaggactgtctgcttctactccttaatatgaaacttcctgctaatacagtgtgaaggctttaagccataatgtttagaaaaagtccaaattgtgaagctctaaggttctcattagaatggtaacttgacaatattgcacatttttcacataataaaacaacgtcagaaagtttatccagatatcgaaagacaatatatgtgtacaatttggatgagttaacatcataatgaaagccttcacttttgcacttcctggcttttgtgtgtcattattattatttatgatttgaatgctgacagccaattcagcattgcataagccatagagtaagcacaacttccaccttggggcttattgaatgaatagcacaggcaaaatatctcatattaaaactctccagaggtagctgactctcaaaggcacaaggagctttgtcattaagacactagtcccttttctttatccttcttgaccatttagcttaatttgtgcccctctttgtttggcagaagatcattgaaacaatgaaagaagatgttaattttc

SEQ ID NO: 25466 - DNA, 818 bp, Bovine  19866880897990
cagagggattttcttaaccgttttgagaacttgacagcacttgtcttgtgaaatcatatatcaaaatagcgaagtaaaagtataagagcctgctgctgatcctgcaatcttcacagcctttctgcacagagaacatttttttttttttgcatgagtttgtgtagtacttttgccaatagagttgagacatattttggagtactttgttgaaaaaatataagatgtgaaataagcctgaatgtagagaacttaaaaccagaagaaaaaaaaggcacattttaaagctttcagccttgtcaagaaatagctattttgtctttccgatagacggcttttgagcctgccaagaaaaggaaacgaaatttcagctaacctatcagaactttattttcctttccctatatgccagctttgaagaggctgttctgttttctggttcaagatcatgttttcattgtgtttcctgtaccgtactggtaccctttccactcagagccagtaaacagaacatcttgaaccttcagttttggaggtaaagaagggaagaacggaagtaaggataggaaggacagaatctttatggagcatcttctgtttgattggggaggaatgtgatgggctagaaacccctggaacataatttaaggtgtgaaacaagcaaattccttgtcatccaaggataaaagtaacaatatggcacactttagaccctgtgtttgtttgtttgttcagtcgccaagtcctgtaagtagaccccttggactacagcccaccaggcctctctgtccctcaccatttcccggttcatatccattgaa

SEQ ID NO: 25467 - DNA, 1787 bp, Bovine  19866880987249
tggccgaaaacgggctctatgtctcactatcagaatctgctcgacctctaattaagtgtgtgtccttgaaccagttatttacctgagctgccatttcctcatgggctgtggaaggactcaagaagttgtgtatcaaagtatttggttcagtgcttggcaccttgcacacatattctaaatgttagcactaaaaagtcatctcttgacttccctggcggctcagtggtgaagaacctacctgcaagtgcaggagatacaggttcgatcacgtggtccgggaagatcccacatgccacagagcaactaagcccagacactaccactactgagcacacacaccttagagcctgaactccgcaacaagagaagccacttcagtgagaagcctgcacagggtaactcgagagtagcctctgctcaccacaactagagaaaagcctgcgcagcgatgaagacccagcacagccaaataaacaaataaaaattatatttgaaaaagtcgtgccttcccaggaaggcagctgttggaacagtgaggaagagaaggagaaagaggaggagaagggagagggaaggatgaggaaccagaggagaggaggaagagaagaaggaggaatgttctgagccagcaaccttagctataacttccgatacagccttgcatttggtgctgatgactctaaggtgcttgctaggagccctgaatgcaccatagaaatcctttaaggagctggaggagggagggagtcagggtggttggagagggaagcctgacattgaagggaactatatctgtgcaagtggctatttttgtcagcccaacctcagtgggtgtgctattgggagtctacttttttttttttgatccagctctttttatagtttctggtttttcttaaaggcaacccttcctccatcttttcccaggctgctgaactgatctggaagattgcttatgggagtatttattatgtgcaatctggaatagacaacatttaggttaggaattagctacccctttaagatgtagaaataatctcaccatcaacccaagcagagattcagcataaaggtattttatccatcaagacagcaaacacagcattaccgtttcaaaagggctttagattggcagcacagacaccctctgtgcagggcagcttcagtgagaaaatgagctcacatcagtacatcaatgcggcctatgctctctgttcttatgatgaaaccttgattttgaccatttcaaaacattttcccattgtcatcccactggttcaactagagtccctgctttcaaagagcttttatatgaagttagactgtctgatgcaaaagtaggacatctgcatcatttggtgctttgaaaatacctttttgaagaattgtttgaacattccctacctgttggccatactggaaagttatttttaagagcctggatgtgatgatgactgttgaaccatggaatccatagcacaatggcaatgcatatgtccccatgtgtccctggaagaagagagctgaatgagactcattgccctctcctctgaggcttcaggaccaagcatccagactgagatgatgacctctttaaagagaaaatcagtgccagtgtgctggggtgtgctctagggggctatctggctgactggtgcatacagcatctcacagtagaggaagattttcaatggtttcagataaaggtcagccattttagaaaaatacgaactttttgttttcgcccttattctctcccctggagccaggcaggggtccactgcagg

SEQ ID NO: 25468 - DNA, 1370 bp, Bovine  19866880998371
ctgagtattattccctgtgctatatggtaggcccttgttggttatctattttatagacagtagtgtgtatatgttaatatcaacctcctaatttattttaattgccttttcccctttagcaaccatgagtttattttctatgtctgtgggtctatttcagttttgtaaataagttcatttgtgtgtttttttagattccacaaataagaaatatcatatgatccttgtcttaaaaacttaaaatttttaatgaacatgtttatgtattattttaaagtaaaaattaatttaaaatccagtcaagggaattccctggtggtccagtggttaggactttgcactttcagtatggagggcctatgttcgatccttggctggggaactaagattctgcaagtcacacagtgtagccaaaaacttttaaaaattaacaaataaaaataaaacctagtcaagaagaggagagaaggaagagaaagaagcaaggtgttgttctaactatatgatcattccattgtttctaaaagaaatggatgattagaaagttgatcttggaattaaaaaacaaacaaatacatccttgactcaataagtagggtttttcgtttcttttttgttttgcattgatatgtacagtgcaaatgaaagaaaatggttttggtagctcttggcttgatggtcaccatggaaaatgattttggaatgttagtaattgcaagagattgtttatcttgttactttcaccctgaccaagcccacatcttttctctaaagcgtgtcttatttttagagttgataaatcaaatgtattgtcgagatggaatgcggcatgaaatgcacttgcaaacaaaaacccagccttattcagcagttctttcagcagaaaccaaagcgcagccactatgacttttctctccacgaggctataactatgaacacttcttgagagagttaacatgtgttattgtaaagagaagaggaggaggaggagcaggaggaaggggaagatgaggaagaaagaaatctacctttaaagaaaatttggttatttgaactaatatgtagcagaaaaggcaaaaaccaaaacttaattcttattcattccaagatttgagaccacaagttttaaatacgtaatacccacctaaaagtgaaattgtcagttgttcagttctgtccgactctttgcaaccctatggactatacgccctgccaggcttctctgtccatgggatcctccaggcaagtatactggagtgggtagccattcccttctccaggggatcttcccgacccagggatcaaacccaggtctgctgcactgcaggtagattctttaccatatgagctgccagggaagcccacaaaac

SEQ ID NO: 25469 - DNA, 893 bp, Bovine  19866881140997
tgaacagactgttacccatctacttatgactttgtttgcctgtgaactagcctcagatatttaccaaatttatcaaactgtcccattgtaaaaatggcttagtaaagaaaaagggcaggaaatgactgttgaccagtcattatattacagaaaaacatgaacccccaccccccaccccacaaaccaagacccataaaggaacatatccacagatgggttcttttgcatattacaagatgcccaagtgcccttatggacctcagttgtctacagtgccctcatccacaaagccttatgatttccacaccgtgtcagtcacggaattacgcctcttctttagtttctaccaccgctccaagtaccctaagcattttatgagatttatgaatcacactcaagacctgttgccctaaaattcctcttggaccactccctttccaatcccctacttcttatgctgtgatgcatcctgcatctcagctcacctccccatccggtggatgccagcagaccttgcgttttgtttccctcctcacaattctcaggcagctataatgcagagcaattcatctgtcccaagctctacttcaaacttccatcacccgccaaagcttttagcattctagttagaatatccacccttttggggaatgattcaattattaaacatatttttgtgtgtcactgacatacattgacatacacagaggatttcttcatactgtttagtgagaaacactgttaaaatccacatcgttgaaatctgtttcaaaaaggtcagtttacatttttaaccctacatgggcttcccaggtggctcagctggtaaagaacccatctgccaatgcaggagatgcaagagacgtgggttcaatcctgaggtcaggaagatc

SEQ ID NO: 25470 - DNA, 1547 bp, Bovine  19866881195139
atactcatttaactttataaacctctttttgtattcccctggaaaatacacccccagtttgagaagcactgtttaagtggcagggacacagactgactccctgagggaccctggaggtttccgctgctgggagagcccattcattatcacctagctcagtgaccagggacaaacatcaatgaggaaaggctatttgaaagaactcaaaataacacagtcccaggtatggttaattcagttctgctgactatcctaatgggtgtaaattgccacaagattgttttaactcaaagcttgagatcgatcataagaggatagaaatgggtacatggatatacgtcttgggctggatcccaaatgcaagagtgacaccccagactccctagagttcatttaattagtttctaaacatttccactagaaatttcttcactggggcacagccaacagctctgaagcaggcatttagatctagcactatcctgatatgagctggatttggtaacaagatgaggatgtgccaagtgtctgttcccattaatttcttgtcaaaagcgtcttagtcgtgtagacatgaggaaagtcaacaactcaactattttctcttgaaatttgtaaagaaaaaagtatgtagaatattttagagtttttggtcatgtttaatcctccactccagtactcttgcctggaaaatcccaagggcagaggagcctggtaggctgcagtccctggggtcgctaagagacggacacgactgagtgacttcactttcacttttcactttcatgcattggagaaggaaatggcaacccactccagtgttcttgcctggagagtcccagggacaggggagcctggtgggctgccatctctggggtcgcacagagtcggacacaactgaagtgacttagcagcaatcctcagaacagccttctgaatcaggtgttatttatcaatagaagaccagggaagttatgaatcttcttcagattcacacttgaacttgatgaagagtagaacgagacctcattcacatcctgtggtttcacgtccagtgttccagtgaactacaggaaagtctgttgagttaaggagtgttttttctctattaatattcaaaataatgaaaataaaaaacagaggtgtatttattgtcacacagcttgtttaaagcagcagaggatcatgccaaatgccaatgacttgagataaatgacattgattgtctttagcacatacctttgcccttttggaattctggtcataagagacacatctctgtattaaagagaaggatttattactcatgatatacacattaggcaaagactgaaggaagtcactgattttctagaaaaaaataaagaactttagaatgactgaatctaagttcaaaagtattgtctaatagaatttgattggcatttcactattcattcattcagtaaacaagaggtgagcactcctatattctatagaaggcattgtgcttggtgcttggtgctgggtacagccccccagcctcatggacttactactcatttaaa

SEQ ID NO: 25471 - DNA, 775 bp, Bovine  19866881227141
tgaattttttttaataagcagaataaatgtcaggacagataaatctgtcacaaaagcaaacagaatctcttcataaatagaaaatcacacggagacacgggccatcctgttttttgtcaacttgcataaacctcctttctttcgtctgtcctcggatcgaaatcgcccacatccatcatcctgaggtcaaaccagattttctggttgtgcaggagtccaagacaaaacttattaacgattcccggggggttgatcagctggcagtgcaaagctcatagctccagaagtgaaacgttatcatggccgtttccttaagcatattgctgcctttaaagattattttgcatacttgtttgaacagaagtttaatttaatttacaacctaatggctttgtgtccagaactatcagacggtagacaaatcttcacaggcaacaactttcacagaggatttggaaaaaaattaaataagatgagaatgagatatagaattagaatacaagggggcacaggagagggaaaaggggagaggctgtggagtcctgtggtggtggtttagtcgctcagtcatatccaacaaaatgcaatcccatgggtgcagcccaccaggctcctccatccatgggattgcccaggcaagaatactggagttggttgccctttccttctccaggggcttttcccgacacagggattgaacccgagtctcctgcattgacagacgagtctttacttactgagccaccagggaagcctgaggagtcttgtactctcg

SEQ ID NO: 25472 - DNA, 1941 bp, Bovine  19866881242890
ttgtaggtacaagtctcagaaaagcctcatttcttccctaggaaagttcccattatgtctgtggcattcaaatattattctttcttcaacacaatatcttcttaattacagccacatagaaaaagaaaaaggttgacacaaggagtaatatgaaatatgtgaggggagaacaaggtcaaaaaacacaagttcatttctaagcaattttctcatgtggactcaactcaaatactgacggttgaaaaaatgtaatcaaattgtattcctggccttaaactattatagtgtcttgttaaattacacgatgtgaacatatgggaaataacctagtttttacaatatttcagtgcagttttctatttgatctaataacctgagtgcttggattgttgcaataataagtatcctagaagtacatatgcatatttttcaacagtgagaaatggattaaggtccacgctccaaggctatttatcttacggcccgagcagagaagttggaaggagttcctggatttttttctaatgtgtgtagttgattagagcagctctcctcatctcataggatttcatttgagaaaggacagatttgcgcctgcagggtttcagtgtttatccaatcttaaaaccctggacatgttacagaacagcacatgggcttccatctgtttgctctttctatggatctttttttttttttttttggaaggattgaaaaggtttattatgctaaaaatatattctattctatagtttccaagccaagctgagataattcattttccaaatcctctaaggatgaggatgctatattcacccgttctttaatactttaaacctagaaagccctagtagtagttaagcaaaagtcccaaagtaaaacctgaactagcaatagtgtcggtggctctgcttttgtagcactgagagaaagcttaacattttagatagtttgaaaataactccttgtatttgttgttgttgttcagctgctaagtcatgtccaccaatttttgacccccatgaattgcagcacgccaggcttccctgtccttcaacatctcctggagcttgctcaaaaacatgtccgttgagttgatgatgccatccaaccatcacatcttctatcacccctttctcctcttgccctcagtctttctcagtatcagggtcttttccaaggagtagactctttgcatcaggtggtcaaagtattagagctttcacttcagcaacagtccttccagtgaatgttcagggttgatttcctttgggattgactggtttgatctccttgctgtccaagggactttcaagagtcttttccagcaccataattagaaagcatgaattctttggctctcagccttctttatgatccaactctcacatccgtacatgactattgaaaaaaccatagtttcactatacggacctttgttggcaaagtgatgtctctgctttttgatatgctgtctagctctgtcatagctttccttccaaggagcaagcatcttttgatttcatggctgctgttatttttgccttattcagatcaccataatattattaaacataaatgcatgagggctatacctgcacacggtcattatctccaggttaatgttcagttcagttcagtcgctcagttgtgtccgactctttgcgaccccatgaattgcagcatgctaggcctccctgtccatcaccaactcccagagttcactcaaactcacgtccatcaagttggtgatgccatccagccatctcgttctctgtcgtccccttctcctcctgcccccaatccctcccagcatcagagtcttttccaatgagtcaactcttcgcatgaaggcggctaaagtattggagtttcagctttagcatcagtccttccaaagaaatcccagggctgatttcctttaaaatggactggttggat

SEQ ID NO: 25473 - DNA, 2382 bp, Bovine  19866881300319
tatggtgtgtctgtgtggagtagtgatggattcaaaggttacttctttcctattgcctttgagatacctgctaaacatccaaatagagagtctgagtagaaagttgcctatactaaataggggttactttctaatcaactcttttatagcattaatgtatcttaaaataatgtaatgagttgtcattacatttccctctgtgtaaagttgattggatggatcagatgtgaatccaacacctaaattaaaaataaaagtaatgttcaaaaggtgcttggaattgagtgtgattatctagcaaaatttatagtggatgaaccacatctggacctagagccaagtcactgctgtgccttttatcactggtgtgtgtggctcagggctgccttcattgacttcgggccttagaaagtctctgtggacattaaagtcaagtaatctctaacagtaggcatttaatgagttgttttagcattggatggtaagttcttcaaattcataattccacttcacactgcctttttaatccaacaccatcttcactgaaatgcaacatttgaaagaatctcctagagaaaattgcttattattcctttgaccaaagagtctctctgaaaaattatttactttggaaataatgactttaatcaactgtaggtcaagttggatgttaatagaaagaggaacttttaaaaacaattatttttgtaaagcttgtagaaaatgcaacatgctgcgtaattgtatcatgggtaaaatccgaacctgtttctactggaagaaaagcattaggttcctgcttcgtcttttcctcatcccctagactctcctcagcgaagttttctcaatgaatgcagagcccaggaaaaggcatttttccaacacttcccacaggcttgtgacacggtaattctagggtttggaaaattaatgtcagttttgacaccgatgctatcttgaagttcccaaatgtatcagtctattaaacaggctttggctgccatagagtaaatataaaagtgtctctggggagattgagtcatttttactggtggaggggggtggatctttacatctatatctttatttttatgttttcatcaaagcttagagacactgacagatgaattctttagaaagtatgataaatgctggctttccccttaaaaataagcaagaaaatataccttataaatcctgaaacctctctttttcaagcagactgtcacagatacgcccactcatcagtgcgttgactaagttggtgacaagatcttgggatgcaggatgccgaggtggcatgaagggactgggtctctgtgcagattgtcaacatgagtttgagcaaattctgtaatctctctgaacctcagtttcctcatcagcaaaatggagactgttgtaaagattaaatgagaaaatgcacttgaaatgcattaactcaaagatagaactctttcctgtctctttttgttctaagtcagagaaagtgagcaggagtagaactcttaatattagaaaaaggcagccactaagtgggagctggaggatagagctgaggcatccagcagattgaagtctcaggtttggatttgtaaaaagtgtcgaaggtggccctgaaacctggaattatcagttgaatggacttctgaaaataaaagcaagtatacaaaagtgatttataggcagaggaaataaaatagctacaagatatcaactatctcctgccccatgaaaaatacattttatttaaggaattaaatgctatgtgactattttgggcttcccaggtggcactagtggtaaagaatccacctgccaatgcaggagatgtaagagatgtgggttcgatccctgggttgggaagaccccctggaggaggaaatggcaacccagtccagcattttcgtttaaagatttctaggtgtagtttttcctttccatggatctttacttttttatgatccaccgcaacatgaagtgggttagaacactcaccactcttatctagtcctgcttccaggctcactgccttctcattgccaactgaccaagaacagactcaccaccatgggaagaaccacctgtttagtgagatgcaggtgtcattcctttggttgcaatggaatgatctggccctgctggagtcattccaggtggctctctgaatcacttgatttgatatcatatttggaacagttcagaatcctcacaaggaggaaaagatcactgtgctgagtggtctgctgagattctaatgggatccagtccatggcagaggccttggaagattttcccagcaggctgctgcatgtcttgtttgactccacatctccatcactaaacctattcccacatattttgagtatactgaagtctact

SEQ ID NO: 25474 - DNA, 1453 bp, Bovine  19866881302100
attccgtggtcctcgttatacagagtgggaaatggaggcacagggcgattaagtgaattgcccatagctagtatgtggcagaggcaggacttgaatctaggcagcctggctctacagactgtcctggtagagaaggcattagtgcactggtgttcaaacttgacattgtacagtgggaatcacttgttgcaagtcagccctattgggatgatgctgaaaactagggatggtggggactgactggaaaaccctggcgaagaagcagtgctggctaatgagaagggatctgactctggtttgatcactgatgcttgtctaaaaacaaatcatttggtgcctccatccccttgattgttaagtgctatttcttggtgaaagactttgaatggtgtttgcctgtgtgagtgtgtgtgtgcgtgtgtgtgtgcttgtgtgtgcctctctgtgtgtgtgcatgtgtttggagggattaaagcttgtttggtttggggctaaaggccccatacagtgttcacacaaggataagtacattctgagtgccactcagaaatctgtatgttctctctgtcagcgttgctaggaaaacaaggctggtctcgaatccacaaaggtcatggagaagaccctgaaatgaagtgtagagacgtaggctcttgtcagagctcctgctcaacaaagaccttatcttgggaaaggtctcaatgggaagatgaattctccgtgactatgcgggcaatgcagagaattgctacagaggctatagagagtttaattccttttcaaaaaagccttgagaacagaataaacacattatgcttggctggtgtattcaagaagcctgctctataggaaaagacttttagaatgattctttcccctttcctttgccagtgcctgtcaacgcacgataaaaaactagaatgagggggtccacataccagccctgaaggtcttttttgttacactgaagcagagcattgacgcaaaatcaagtttctatagtcagaaaacatttttaactttctcctgtgcccttcccttggactgttttttgttttttttttgcgggggggaggggagtccaaaaaagtgttttcatagtaaatggtaatccgtatctaccaactcctctcaatctgctataatcttgctttgtccctgccccgatccctgggtcaggaggaggacatagaaaccctcttcagtattcttgcctggagaatcccatggacagaggaacctggcaggccacagtccaccaggtcataaagagttggacatgactgaagccactgagcacgcatgcacacattcttcctggagctcttgtctcaggggtcactgatcctacttgtcccagaattcaacatcactttacagcccttacatttctcgacccattggtatgactgtactctactgacactcttctggaaacttctttccttggctt

SEQ ID NO: 25475 - DNA, 1268 bp, Bovine  19866881306443
tccgggagatgtgaattcagttcctgggtcaggagtatcccttggaggagggcatgcaacccactccagtattcgcttggagaatcccacagatagaggagcctggcgggctatagtcaatagggctgcaaagagtcagacacaactgaagtaacttggtacgcgtgcagcctgacatcagaccccaagtgttagcctctattctaacctgactctcagaactccatgtggctgggcaaagatactatgtgactagaagatctaaagtccactctgatagcaacacacgtgacagccagcaaccaactggccatgtggggcttcagtctggccccctgaggccacctccctgaccctgggctggatctcaggagggatagtccaaataggattggtagttggggggtggatagtcatctgaaattgtttcaagtttatgtgccaaatcttcgaaaatgtaaatcaatttttgaatgcacttaatcttctaaaatacatttgtattaaattacattgacttgtcatgggtcagaatgccctttcttttcatccatctttttattgttgccaaaacaatgctctataagcatagacttcaaatctgtcacagcccccagagttatcaactttaggatgagctccttgatggcattgtttcaccaggtcatttttgggagataggtttttggtttctcttcatttgcatgttatcttggattattctcgtttgtggagttgtagaaaaatgacaggctgatatctctttagtatgagattaacaaatgacccaagaaaaacactccatgcatcaaaagcattcttcccctcatctgtccattttatataggtgtccacttatattccgaggaaagtaagttgtgtccgtaaatgtgaactcacacatttcctgtgtttagctcaacagtttggtggaatcatcaggttctggtggcaatttctatacttctttaaacacaggcatcaatcaggatacagaccataataagcattctgaaaaagctgtacattaagaggtaaaaactgcttgaggaatcacaaatatttattctaaagcagaccttagttcagttagggctatttgctgacagtggtcatctattcaacaccccaaacctatcccaataggagctagttcataattccaatgggcagtccacacttattttcaaaggagaaaaatccggatagaaaaaacaaatacatgttaagcacttgaaattatagacgattatggggtctacaaggac

SEQ ID NO: 25476 - DNA, 1734 bp, Bovine  19866881345022
ccctggggatatcagacaatagtccctgattgagtaggggagggaggcagtccaaataagtatagtgcagtgtgatgaagtctacaggagagataagagggtaatgagaacacagtgggagaaaccattaaatatgaccatgagagattctgtgtaaaggtagaagagttttggaaggagattaacttggccatgatgtgtttttggaaggaatatttgaagatgtgtttaaagaagtcaggaaaaactttagtggaaatgttctgatacaaattaagagaaacaattattagatgaagaattatagcaagatggcaagggttaagaatccagagaagttttctccacaacagatgagagaaaaggaagaaggatagaaatcaaccacacatgacaaccacctcctgccctctaacccctccaagcccagtcttggcagcaaaggtgtctccttcctaacaccaagggcttccccggtggctcagatggtaaagaagctgcctgaaatgcaggagacccatgttcaatccgtgggtctggaagatctcctggagaagggaatggcaacccactccagtattcttgaatggagcattccatggacagaggagcccggtgggctatagtccatggggtcacaaagagtcagacacgactgagtgactaacactttcactttaccagcaccaagatattggtgtaccttgaaagagcagaaatgacttgtatctggaggttcaagaactaaaacatcatctcagaagaaaaaggtaatataaaacatacttaaaaacagaatatgtggtttaaggtccagtttctcaaggtcagaacattcaagaagatgaaatggatgaggagcccaaccttagtcactcatgagtttggactcccatctttctttaattccattctttatcttgaatgcttcagagcctctgaatgttgtcttcagaatgcagaatggaagaatggccatcttttccactatttcctttaactaatttttccctgttatattttctcataaattcaattttcctagggttttccttttgtcttttttggctcattacttttcagttagaatttgttttctttagcctcctttgtcttccttccttccttcgttccttccttccttccttactaaaatactacaattgccagctgtcaccacccactcatgacatcctcctggtataatgtgactgagcagaagcaagtgagaaatgtgtttaactctcaggccccaaagcttctttctacatttcaactacaatgaaatctgtgggagggcgtttgtaatgacttaggtagatagaaaattaagggataatgcagaatttttttccaaagaaaatatattttgataggaaaaccccagccactctatgagccaaacctgtaagtgtttaattgctaaataattgtatttagtaaaaaaaaaaatacaacagcatattttcagcagaagagatctgagatgagagggatgttaccatcctctatattttaaaagattcataaattagatggtattatggttggcgtcaccaagacagttttgttccaggggacaggagagcaagggccatgccttcctagtgcttctactgtttccacaaggatgtcaggaattattgggagttgtgttcttctttatggaaatggggtcacaaagagtcggacatgactgagtgactaacactttcactttaccagcaccaagat

SEQ ID NO: 25477 - DNA, 878 bp, Bovine  19866881485942
tggtctttacctccccttctgctgcatccgaagaagagccaatgaaaacccttggagcttccctgtcactcaaaggccattaattttttacaagatgaaaagtactttttccaaaaataaaacccagagttatcatttcagtaggctggggaaatgtacattcctttttatagctgcaaatgagagcagttccataacaattctgaatttcttcttctaatgctgcagcagtattctcttcttaaaagaaaacaaaaaaaatgtagtaaggcactcgggtgtcctttagaacctgagccacacatgtgcccaacagcgccctcgtcagcttcctccacagcaggcgatgatttcgcccatgtacctgtcacctttatctctctggccctcgggttctccgttttcaataagctgttataaaagttcacatgccttcaggggtcccccatggaatgaaagtgagtgaggggatgaggagggacttattgccaagggagaacttgagtcatctctaggtaaccatcccaactcatttcatggtcctgtttggattacccaaagctgactcggcccatcttaactgtatcagttctcaaggaccaagtgtgcgtggatgcttgtgtgcatgtgttcatcactgccctgcactcaggggtcctctgccacagggggcagtaatgagcaggacccagtgcattctctggattccaaacaagatggtctgctggcagagagccccagggagcagcttgtttatgttttgttgttgttgtcttgtcctacacagtattttaagaaatgtgtgaattacttggaacatttcattgttgttcagttatgtctgactctttgcaaccccatcgactgcagcacgccag

SEQ ID NO: 25478 - DNA, 701 bp, Bovine  19866881520359
cttctaataaacactgcttctattaaaaatatatatatatatatatataatcccagttaattcttgccaccatgtttttgttgaagactttctagaatcccagatttttaaaaagtggtaaatgaatacaccatatggttgtattagaaatactttttaaaatgttgtatatgtgtgtgtgcacacacacaagcatgtatgcaagcatgcgtgcttaaaatacctgcttttttcttcatattcaggttcagtagtcacagtagaaaaaagaggagctagtctgtaagctattacatattgaatggataaacaacaaggtcctactatgtagcacaagcaactatattcaatatcctgagatattgatatatgaccttttgcttgattttaagacaaaaaaaatatacatgcagcccttccaaacagttggctggtacagtctttttggagtttatatatccattgatttgttattgagcctgtaatttgctacttcttccgaagataacgccaataatgttcattttaagtcttctcctacgttaaaaatccctttatttcagacatcttaaataaagtggggctttccccccacccattttcttttctttagcacagaatatcagaagtgctactgtttccatgctttgtacttataaactaacattagactaaaaatgtattgtctaaaatagcatctg

SEQ ID NO: 25479 - DNA, 1744 bp, Bovine  19866881594570
tcaagtccaactctttgtgaccacatgaactgtagcccaccaggctcctctgtccatggaattctccaggcaagaatactggagtgggttgccatttccttctccaggggatcttcctgacccagggattgaacccaaatctcccacattgcagacagactctttactgattgagccaccagggaagacctaatacacgcatacctaacgaatattaaataaattaatgaatgagttagtgactggatacatggccttaagtcagacagcataaattggtacatttatacctacaggaacaggaaatttccccttaaagataacacagtaggatttggcttatacaaggcaaggagccccgagttttacactcttgcccttttgccagacaacctggatttttggtgaagagttagtggaaatatatatattagaatctcaagcaggaaacaagcaaagaaccagacagaatgggctacagattccaagtacaaagatacttgtagtagatgactaaacattttaaggctgtgctgctttataaaatatatcacttcaggaggaatgaggccacaaactcttacctcaaaaaattctttgaacttaaaaaatatcacatataatgcatgtatactccccacacctctgaagcccttatgaaaataataagcatcagaattttatgtaaaatccacttgacaaatataggcaaatctcaaataatattacatttttgaagtaaatgtaaagtcttatctttatatatttctcttaaaatgttcatgaggagatgccctatcaacttttatgatacatacacacacaaatatatatacacacatacatatacatattacaaaagtaaacaaagtactgataaaaactggaaatctacaagataattccattctgatccaatgcatttttgcttgataaattataaggaagtaatcagttccttgaaattgtctatctcttagagagactaattcctaagaagtgtatgtatatatatacacacatacatgcatatatatacacatatatgcatatatatacacacacatacactggtctctttgaacaccattccaaaatgccggatataaattcaagaaaaaaattttcaatgattaaagaccattttccacagatacacaggcagatatgtaagaaacctagatggatatcatatgctcttaaagttgccaacactgtgactgaaagcctgcctatcttttcattttacttctctagcagacagacttactttcgttaccatactggaaatgacaaggacaagttcatgttcacagctgctccaaggcatcagcaaggaaaacttaaaagccaaacagagaagaccagccaaagtagtaattttcactaatctcatctgaatattcagcaaacatgtatgcctggaagactcaactgtgggatttgaagacaagtgagactgaaaatagtttcaacagatgcatggattgattctatttagaaaaacacaggagaaaaagaaaagaaacactagaattgtcaaaggggcaggcaatggagttgctctctggagtggtgtgtgtgtctgtgtatgagggaggttggggaacactaacatggagagggcagggtgaaggctaaaaggagggagaacacaaagagaactgccaagtattcactcctttctccaagagtctgagttgtgccagaaaagaaaaaggagtgcattagacacaactgtatt

SEQ ID NO: 25480 - DNA, 748 bp, Bovine  19866882047015
aaattcataatggggaaggagctacatcattctgtttcttaacaagttcgctaattattctgaagtaagcaaaaatttgagaattgttgctccaaaaagatagggatatttcctttactagctttaaatatgcttgtgtatagatgtacaggccaaatacaagtgggaaaactctcaaaaaaaacccgatagctcccatctctttctggagaaggcaatggaaacccactgccagtactcttgcctggaaaatcccatggatggaggagcctggtaggcctgcagtctatggggtcgctaagagtcgactaggcgacctcactttcacacattggagaaggcaatggcaacccactccagtgttcctgcctggagaatcccagggacagagaagcctggtgggctgccgtctctggggtcgcacagagtcggacacaacacaagcaacttagcagcagcagcagcatctctttcttctcatcatcacaccttcagacatagactgaaatatgttccatataagataaaaacatacttaccaagggtttttccagcttcaattcttgtcaaaaattgacatacgtatatagttctcagttgataagctgttagactggacagtccatgaataatagctgaaagtgaataaagtaaattttattaaaacattaaaacaaaactccaaacttggccctgcagtacctctgtgtggtttgctgagcaagaaattaacgaacgtcacccaaag

SEQ ID NO: 25481 - DNA, 1498 bp, Bovine  19866880128439
ctcagccttcttcacagtccaattctcacatccaaacatgaccacaggaaaaaccatagccttgactagatggacctttgttggcaaagtaatgtctctgcttttgaatatgctatctaggttggtcataactttccttccaaggagtaagcgtcttttaatttcatggctgcagtcaccatctgtagtgattttggagcccagaacaataaagtctgacactgtttccactgtttacccatctatttcccatgaagtggtgggaccggatgtcatgatcttcgttttctgaatgttgagctttaagccaactttttcactctccactttcactttcatcaagaggcttttgagttcctcttcactttctgccataagggtggtatcatctgcatatctgaggttactaatatttctcccgtcaatcttgattccagtttgtgtttcttccagtccagcgtttctcatgatgtactctgcaaattcagacttaaattgaagaaagtagggaaaaccactagaccattcaggtatgacctaaatcaaatcccttatgattatacagtggaagtgagaaatagatttaagggcctagatctgatagatagagtgcctgatgaactatggaattcacaaattaaaccctattaactccaaatgatgtaaatgagatctcaagcccaacagtggctcctcaaatgtctctgcctgatcacaaacttcttccatcccagactgttcaccctccaccttggttccactctgatctgaaatatgagaactactgatgttcctgtattctgattcatctgttcattagagactggaattggtgttctgctaggaaattctgctgttgccaccaaagtctgaaagttgttcaattaagtctcattgtttttaacttcctatgccattagcagagactaaatttgccaagaaaatcactaacatgagtgcaaacagaaatcccaatctccacagacctcctaaaggtaatgttgaacatgtaaacacgtctccagtggtttgctctggctgtccaagtggccacttccatttaccttaagtgctcactgggctggtgtgtgtgtatgtgagtgtatgtttgtgggcttgtgtgtgtgtgtgtcagtcgctccatcagtctgactctttccgaccccatggactacagctctccaggcccctctgttcctgtgtgtgtgcaggccttggacaagaagggtccacaaaaattccagggatgataagcatcaagcatccccatgtctatgaggttatttaaggatggaagaatggcaggctcaatttcttccttttcttatttggtaagagaatgggtttgtgtcatgagaagagccaagctctttttgtgcattagctatcatgaactttttcatggttcggttttggttttctcagctattaaatggtgagatttgggactcccacaacaaggtcattatgagaattcaacaaaccaaaggacagaaag

SEQ ID NO: 25482 - DNA, 2498 bp, Bovine  19866880207750
gagggagggaggcttgggtaaaaagtgcaagaaagcccagaggaatgccaaagaagctgggcaagacggcagccactccctcttctttctaagccagccagcctgcacccatctctctgcctctttttgactttgttcccaaggccggcacctgtgcagaaaccatcaccctttccacagtctacactataatgccttgtcgttgctctttttgcctaagtgcaggacggcaccgctcaccaccatctttctgcctccccccagagcacgtgtttaggccccacgatggggctggctgccggctgcctttgctatgtgatcattcctcagtgagggagcaggtgtctgtcgtagtcatcctggcatcctcacacctcggacagaccacacctcacctggactggatgggcagtgggtactgaattcagtgaaagcattcttttctccctggatccagttccttaaattaagttcatatttaaaaaacaacaaccctcaaaactccctcctcaggttagggaaactgagatgtacttaaaataagcatcacctccagatgaatggacaaagaagctgtggtacatatatacaatggaatactaccccgccataaaaaggagtgcatttaagtcagttctaatgaggtggatggacctagagcctattacacagagtgagtaagtcataaagagaaaaacaaatattgtatattaatgcatatatatggaatctagaaggatggtactgatgaagctgttcacagagctgcagtggagaggcagacacagaggagagacttatggacaagggcgggtggagggggaaggagagggtgagatgaatggagagagtagcatggaagcatatatactaacatatgtaagtagacagccaatgggaatttgctgtatgactcagggaactcaaactggggttctgtaataacctagaggagtaggaatgggcgggaggtgggaggatgattcaagaggaaggggacatatgtacacctatggttaattcatgttgatgtatgacagaaatcaaccaatattgtaaagcaatcatcaatcaattaaaatatttttttaaaaaaataagcaccatttcagttaatttaataggattggaacacagattctgtcaggaaatgagtatgacctttgagatcagatctgggtctttagccgaaatctgtcgtttactcccaggtaacagcaggattgtgccttgtctccacacctctgctgcctcttctgtgcattaaggacaataaccccttctcagtgtccttatgagagttagatgagaaaactgatataacagtactgatatatgtaaatgctcaacaagtattcactgtttcttcccttttagtttaattctagattaagctgcttttgatggtttatttccctttcttcagtattaaggaatcatttctaatacacaaggttcgatccctgggtcgggaagatcccctggagaaggcaatggcaatccactccagtactattgcctggaaaatcccatggacagaggagcctggtaggctacagtccatggggtcacaaagagtcagacatgactgagcgacttcactttcacttttctagaagtacacaaaaatactaattaagtagcaccccccagttgacaacatccacctcacaacagttattttaaagtttaaagtgatggagttggtcatggcagcctcttccgacaacctgccatgagacagcctatgtctcagccctccgcacaccgtatttgtctcactttgaattgtttataactgatcaattcaggtttttgacaaaaaaatggttaaagatcaaaagctaagctctggtgatcttcatgagacttttattcgtgtctcatctgcaaggaaaatttgtgtgtgaataggaaaaacatctctttcagtaaatatagtcactaagtgtatttggctgtattctcataaaattatctcccattccttgtagtttgtcataatgggtttcaaggactcctctttgctcgacacaggaatatttactgacagagaatacgcagttgcagtccctccggctgtaacccagcaagtagcacctattcaccttcgaaactggcatctccatattactcatgccagtcttttctcactaattttatgattataatgaggcagtggtgcactagttagcacagatgaccttctaattgaaagactgtaaattcaatctccatcgctgggcaccgacagaaatttaaataaatacagctcctaaaacccttgtgatgagcggcctaatgaccaggggccagcagagcccaagtcatccgtcacaggggactgccggcaacttctgggtgttaactacacgagtcattaggagcaggttgccctcacaaagcgaagtgagactagggactcttccctggctcagatgcaggcaccatgccttgcttttctgcaacatatgccaagttgcttttttgtcaaaccg

SEQ ID NO: 25483 - DNA, 2004 bp, Bovine  19866880264924
cagagacattactttgccaacaaaggtccatctagtcaaggctatggtttttcctgtggtcatgtatggatgtgagaattggactgtgaagaaggctgagcactgaagaattgatgcttttgaactgtggtgttggagaagactcttgagagtcccttgggctgcaaggagatccaagcagtccattctgaaggagatcagccctgggatttctttggaaggaatgatgctaaagctgaaactccagtactttggccaccttatgcaaagagttgactcattggaaaagactctgatgctgggagggattgggggcaggaggagaaggggacgacagaggatgagatggctggatggcatcactgactcgatggacgtgagtctgagtgaactccaggagttggtgatggatagggaggcctggcatgctgcgattcatggggtagcaaagagtcggacacgactgagtgactgatctgatctgatctgaatttgtgaattacgtagcttctcaatcactagacttatagagtgagtctcaggaaagcatgtgtgttgaaatcaccaaaataatatcaaatctcacggatcaagcccaggcagcatacttctccaacaagcctttcacctgtgtgctagatgagtagaaaataaacggcttaacctccttgggagcacctcgctcctgactactttctgtcataaatgggaaaaacattcaaacaaggaatccccaaagaaaagaaaaagaagctgcaagtgtgggaactggcctcaaggcattgtttagtgtccccaggaaattctgagggtccgactctagtactaaatcttattcattctaggcttccataatacatgtgatggaagccaactggaaatgctttgaggttccagcaaataagatgtaaaaatagtgaacctattttataaatgaaacctcattttctgtatatatacattataaacataaacttagatcatcaggtgggcagatagtccaagatccagaaatgtcctcaaaagtgtcaggatcctcaggtcatagcccaacctaatcccacagaattttcacaacatctgcttaaacgttctgctgggagcaggcacgtgtttccaactccctcaccttcaatactgaaactcctctctattattagtatttttctttttaccagacagggatttcttgctgtaacatatacatacatgcactggataataaaacttccctgattaccttataacagcacattaaaaatttactaagataaaattaatgtgattttaatagtattgttttaatatacagactgtcaggtgacaaggagaaaactatttggaattctgcatgcaagatatatgcctctttcgcagccccttccaaacaatagctgaactggcagaggaacttgtctattcacatttctgagaggtgcctcccaggggaaatggctgaagttgggcccttttaaaatgtgaccggacagtgcttttgagactataatgtggagaacttccctgcatgacagggggaccagggcaaagcaacacatacagagcgttgtttcctgtacacgctgctgtgagattcagccagagaacacaacttcaaagaatcttttgatggagaaaaaatgttttcattcgcccgttttatgatactgctgcaggatacttacagttgatttactataatgatgggacctggctactgtcccaaaggaaaagaaatcctgcctttctcccgccacattgattattcgcagctagaggtggggacgggtaagtgatgggttaaaggggaagatggctggaacgcggcaaatagagatcattagattcccaccacagtcatttgtgcaaggcctgtgacccagggcaggaatgttcccatggtcaggtgcctgctcacactgaaccccaatagacagagcagacctcccacctctgtagggctgctgaggatctgaggggctggggagaagggcaggcggcttccac

SEQ ID NO: 25484 - DNA, 1246 bp, Bovine  19866880395217
cctctagagtctgcatttataaggagttctctccattaggattacctaaaagtaaatattagaaacccttctggaacatagcccacttagcctgtacttttacccataaaactgggcctgcctatcccaaataactaaatgtttctagtccaagaaatgttccttgtttgtcaggctgtcctagggggtgcctttttaaatgttcagcagaaaaagcagacatctgtcactcttaaaaacaaaacttcatttctaagtggtgtaattaaaatcagaacaagagacttaatagtacttgtgcacagtcacccacagccattaaatagcgtggaagggctagctgcaaattcaaccagaaaaacacaccttacacaatgtttatttcatcgtaggaaacattatcactggagagcaataaagactcataagtgacttaaaattgggactacctggctttgttttgtgtccatgattatgttgcattgttgagacaataaagtagatcctgagagaatggaaggggtgccaatggtagaaacacaaagacttcctcccaggtataaaggagccaagtgagcagcactaaatgagaacacttgaacatcttgcatgggggcttgagatcaccccagctcctgccaggcagctctcctggggctcagagaggagttgggttgttccccatggaagaaatggatgagatcagcaaaggatatgcaaaattacaagaaggatagcctttctgtcctagagtctaagaggaaaaatgttaaagtaaaaagaggtaaaatgaatacctgggtgctaacaaaaagggatgcagtcggcccaaggcttcagcgatgccaaaagggtgaactcagaaaacacattgcatcctctgatgaattcctgattctcatggaaaagaatggttcagagcttaccagtctctaacagttaagtctaccaggtcaaagccatttgcatcagttggttctccagctcttatctgtcataatttattcctaaacactgaaagtttacccttgaagctttcatgttcttcacggataaagaaagagtcacagttgagtcctcacaaaagttgcccacaaaatccttttattttatcattcgtatttgtcttcctcttggtatggatagtatgaaattttcagtttacaaaaggatttaatcaacagtgaatgttttgaatcagattaaaacacaaatattttaagagcgatgtatttattctgtcctg

SEQ ID NO: 25485 - DNA, 1641 bp, Bovine  19866880433921
gcagactcatcctcatttcacagaatgttttggctttatgcaaacagtgtatgagaaaaaactgggctaaacatgctaaataaatatgtgtgggggtaaaaaacaacaactttcaatttcaagaatccttaagcatgtgagggtaaagactcaggacaagaattgtttctggaggcttcatagatttcctttcctgctcagaagctgaatcgcagtgggagctggatttgaaaatgaaaagcctgtgacaactttcttctccactcttccccttcccctctaggtggagctgacaggcagcagtgtctttgactatgtccacccgggggaccacgtggagatggcagagcagctgggcatgaagcttccgcctgggcggggtctcctctcacagggtaccgctgaagatggagccagctcagcatcttcctcctcccagtcggagacccccgagccaggtgggacttgcaatcccaacatgagggttggtgggcaggacctttgccaatgattgcactcaagttgccagtgtgaagagactacaaataggtctaatggtatttaacaattccatgcagctttctgtcctgggcggtaattaagtaaggaagagatttgaaaataagaagacattttaataagtataatccagagatctaatttcaggtgaactaaatgcacagaaggtaccagttcctttagattctttttcaaattaatggaggggaaaaggttcagatttggaaagccctctgcctttcattgttaccatggctaaatgtaatgcatttatttatttattcagcaaaattgatggcaaagacttttgaatattagcttgtggagaattaaaggtattaggggcttgcagaaatctcagtttctttttcttttttttttttaagcatcagaaggtacttgaaagatgtgaacagataaattaaggctaaaaagaaaacagaaatggctacattttaaactgcctttctaccctcagtatttaattagatcaattgtatagaggaatgaacagaggtgacattcctcattgggattccttccaggactcttatagactttgcattcagaatgttcccattttcattgtgttgtactgatgataatttaagtattaggggaaaatccatttataaattaaacaaaatgacttgatatccatcagtcccctagttcatcaagctgttcaaacacggggaagattggctggtcggcctgggtcttccgagagcgctggtaattagatctgcgaaggatttattctttgctgattggggctttaaattaattgaagttccacatttgtggttttgtcctttttgtacttttttagaggagatatttcatattcttgtgtggtggagtgcttggccaagcagcagtggtttaaatgttaatttttctcatgagaagtttaagatttttaatgaatcaaggcctgatttgaagtgcaaagttttatttgcttacttgggaaattatttttgccctctaaagatgtttgtactttacttgatatgttgttttaaaacagattcacaaaacaaaagcattttgtgaaagagaaataggaaaaaagaaaaaaaaaaaacatacctttggattaaccttaaaataactcta

SEQ ID NO: 25486 - DNA, 1275 bp, Bovine  19866880483550
tttaaatcatatgttgcaaatatattttatctcgagatccagtcttacttgaccaatagtggccacccccagcaccaagatgaggtttctgaagccacgtccaaggctggtggagttaagagtgccatgactgataagtggtgattgccttgggtctgaaaagggtgaaacggcaataggtgcccatgtcccatccctgttcctggtcttttcattaacaccagtgtgtccttcatctcccattaggtacttttgaagtgaaatgaatgctgggattctatatttccccacttttcaccaagaaaatttagttcattgttaaagtggcaatattaccaaaatatttagcttttgagtctttgataagcagcttcaattttagttatatcttttttttttaattgaactgcagttgatttacaatgtctcaggtatatgcaaagtgattcaccattacagatatatattcttttcagattcttttccattataggttattacgagatattcaatacagttgcctgcgctatacagtaggtccttggtgtttacctattttacatataatagtgtatatctgttaattccaaatctttataatgacctaacaatcatcagttgactcacttaaacaattaatctatttaaaggggaaaattttttgtgttcaaccttgttttggcaaaacaaaaaatgctttttgattctttgacttttaagccagttccattagacacagtctaaaagagaaaagaaatcgtgaccttcctgctattccacctccttaggtttggatggctgtgcttttctcttcaggtcatgtgacaccacagcatgatctgacaagtaattaactactttagaagttactccagcatacactttgaagcagaagcaattctatccctaatagttgcctggcagattgattcttccttctggctcttaaaactctgtgtagtaattgccccagaatttaaaaattatctggggaattccttgtttcacatttagggtacaaatagctagtgatgttctgtaacgtgtttgtgaagggatggagaatcactgtatggataagaaagctctctctttttactacaaagacctggaaaacccttatttgaccagactgtagaactgagtttcaaaattagtaaactggtaacgtgtcggaatatgtgtttctcaagagctgtctctacaggacccatcttctcagagtgaatgctctcacactcaggcactctgggtatggatttgcctcctttaatg

SEQ ID NO: 25487 - DNA, 1355 bp, Bovine  19866880496722
cacggagctatgggtgtgaccagctttctgttgtgaatgtcatcaaatttcaaactgaaggtgagttttaggtccattgaaaatttaggtccgagaaatactgcatacacaaaaaagtgtatgtgtttttccaatcatatggctgtttgaaaatactttctgcataaactctctaacctattgagtgttttaaaacaattttcagtgaaaacatgtttcttaatattaaactcctagaaaggaaggctttttggaaatccagtaaaaagtgaaaacaatctttaaagaccaattggtagggttccaagagagtgtgtactttgtacctgctgaggaagtgctgtagtttggttcatgcgtgcgtgctaagctgcttcagttgtgtctgactctctgcgaccctatggttgtagccggccaagctcctctgtccacgtatggggacagcacaaaaagattctagccctggattggcacagattcgagcacatcccagcacttacatgaagccaggctcagaagggaagcggcaccctcagacaacccccgtgtatgtaggaagacagttatcctgctttgctcttcagtggtcatttttacaaagcaccctttatttagcctcatcatccatcatcataaaccctctataacctcaactgccattgcctctgctctgaatttcctctaaattgtcaacacagcagtggtgccaaggagcgtgctaggatctggtgctggccctcgaatcctagctgaacaggaggtaactgggagtgcccttgccttacggtttctctgcggagaaactcatcctgtaaaaatgctgggttcccatgaagttaaaattggggagtggagagaggcaccttataaaggtaatgactcttttggggctctcttaaggcagcacccaaaatgctgagaacctctctctgtggactgcctgtccaagaagtagtaaatacctatgcagaattagcacctgaacagagcaaatgtatggtctccattacccatgcacatggccagatgttctcacctcaaaaaggtgatttcaccctgccagccaacagaactagctcaagagaaaatgacattgaaacactagcagccttatgccagagagagttgtacagggcaaggaaccattcgtaatctaattaaatatatctgggattccaacaggatggtgttgtagtaaatgtataaaacaagatagagatataggcgctgttatttttattataggtcttggccaaagaattgttttgtaaacatcactgaaagctattgtattggtttttattatatcagatatactttgaagtttatttcttagtccctgagtaaggaaa

SEQ ID NO: 25488 - DNA, 678 bp, Bovine  19866880526995
gaacatagtcaatgtttcataataattataaatggaatataatgtgtaagaactgtgaatcacaacacctgtaacttacataattgtacagcaactatacttcaatttaaggaaagagaaaaaaaatttaatgcagatttcttgcctccatcccaacacatcctgactgatttctgtggataggaccagggatatgttgttaaggccatacggttctgcatttttccacccacaaacaggtgatcttcagacctcactttaagaaacctctacaagcaaaacaaactgttacagattttaacagcagcaacttattagaagagaacagaggtacggaaaagtaaggtaattccttaccttatttcaggtaaggaatatcctacgttaacccaagcaggagacatggaagatggacctggaatcctggctgcctagacagagagcaccattgagatgctgctgaagcaagatggagcccggctcctgaagtttatttcctggatgtaaatcagtgtctgcctgttttgactagacatgcccctcatcccaagtgagaccaaaaaaaaaaaaaaaaaaaaccacctcagagaaacctctgaaaataattaagcatgatgattctggattatctttaattagagggaggctcggagcacaccgaggcttggagggtcatcc

SEQ ID NO: 25489 - DNA, 2265 bp, Bovine  19866880534790
taagctcatacatttccccacacaacacaccagtaattgagagcccagttttgggggcaaggaataatgactttatttggaaggccagcaaagcaaggagatagtgggcttgtgccccaaagaactatcttgcctgagttagaatttgaatattgtaaagcaattatcctccaattaaaaaattaaaaaaaaaaattcatgcttggggctggtgcactgggacgacccagagggatggtatggggagggaggagggaggagggttcaggatggggagcacatgtatacctgtgatggattcattttgatatttggcaaaactaatacaattatgtaaagtttaaaaataaaataaaataaaaaataaattaaaaaattaaaaaaaaattcaaagtttgaccacgcaagaaaaactggaaacaacctgtatgtctatcaacaggtgactggataaacaatggaatactgtttatgtactattgatatcatgcaacaagatgaatgaacttttgaagttcattcaacttttgaacttttgaagtattttgaataattaggttgagtgaaagaatccagacaaaaaaggacaaaagaagggtgggaagagggagtaaattaaaatacttcctggttccggtcagcctctggaagggatgtgttaatttcttcctccctgcagtcattcagaggtgggcctggtcaggatgtttcctataagctaaacaaaggtattttagtttcatgcttattacctgagaagcagggttcccagagatgagccattatgtactattatttagtcactaagttgtgtctgactctttggggaccccaagggactgtagcccaccaggtttctctatccgtgggattgtccaggcaagaatactggcatgggttgtcatttccttctccagaggattggtgtgacccgacccatgagtcaaacacgtgtctcttgtgtctcctgcattggcaggcagattccttaccactgagccaccagggaagccccccattatgtatcatttaagcttataggcaaaatccctttagtgattaacttgtaatactgaattgagtacaaaggttatttcctattacataaggacagatgagaaaagtggagtggtaggtaaccatggtggtccttgaaaaccttgttcaggagcgtcataggtcaagaagagccattgttgttttataagcaggggacagaatttgagctgattaggaaacagtgtctaaggaaggacagaaatgagacagggtgagcagttgccagagccgtgtagtgatttaggtgagagagaatcgtttctgtagaaatgaatgtaaggggcagatctatgagatggaaggggtgtggagtggaggagaagagggctttgaaagtgacctgaggtttctagcctgtgcatactgcaggcagggggctgggggaaggatgctgctgagaggaagaacccaggaggagggtctgctaggctgggaatagggatcttctcgagctcacactgcatttgagggtctggcaggatgttccttgggatctgacactggaaaggcaggtctggagctcaagactgtagtcagggcccaagaggaagatttgggagttggcctcacagtggtcacagttccaatggcacattgtttcgcttcctcagctgcctaaacaagggcttggctttctggctgtgtgagtgaagacaggtggatgggtattttctggggcctgaatggctgatcctgatccgcacaacacagtccttggatccctgagattccaagaaaggagtaggctaatcttgtcctcctctacttagcatagttttgcctcttctccctcagttgtccagcttctcaatctgcaaacaacagctggagggtgagtgagggtcaattcaacagctgtgtgctggaaaccaagcaggcgtccaggatgaacgcactgtcgggccacagctgctgcggagatgagcgtgcgtgtgtgtgtgtgtgtgtgtgtgtgtgtgtgagagagagagaaactcatagcagggtgtgggtcaaaattgctggctgtctctcttttttaaacagacttaattcactttagttttcttgtgttactgtggagtctgcacagaagcactagtttgagtctttacaagatggtcagtgaattctcaacagggaagcttggcgaacgccatctctttccagaggtcaacggtgagacagctgtgggtcttggagctggcagctgctctggccccattt

SEQ ID NO: 25490 - DNA, 985 bp, Bovine  19866880554687
ttggttttaggtacagaactcatggaatccaccaaaaagctgcagtggcaggcccaggaaaggcagaagtcagggcaggtccaaggacctcggcagcccaagttcatggaccttcacttagaggcccaccattaacacagaccccctcaccctcactcttgtctgtgtgcctcatggcgtacattatgaaaacagattccgtggattaggtatggaaaaacgtccaccttcatccaattagtggggtgtcaagagatgggttctcatagcctggtttccactcaatagggcttgtagaaaccaattcttggagttaatggtagaacagggacccagggaggctcttggtgtgagctgctgcttgtggaaggtcctaaatgatgtggcagttctcaagcaggagaaaggttttaatcattaaattgcagggagaaattcctggccttgccttgtgcagtcaattcattcctctgggtctctaagtgcgttgcttccttgctcctggtctaactactcacttagcaaacaggagtctccatggaaggcactgacctgtgatttatgtgtcataaaaggcctggggtgtttgatgcctgtacttatctgcttgagaagaaacattaaatgagagctaatggaccctcggcctctaatgcggctgctgcttgcttaatgtgtggctccatttcaatgtagctccctggccaggccaagctgattttcatcctgcagcgttcaacgaagctcatccacagccacagccatgagaaggagaacccaaaggcccaggagctgcagttttctccttgccgcaccctcaccattgaacgtctcttgccagcaagatgttttatatacaaaccttcagtgttaaaatcctaatgtgaagtgaccatttaagctgaagacaacatttcaaatgatggtttaacaatcgattgtgggatgggagatctccttgactctatactgaacaatttcttgt

SEQ ID NO: 25491 - DNA, 1021 bp, Bovine  19866880586560
gcacaaagaacatccttaacaaccaatcaaccaaagaaagacaaatgccaagacactgccatcatcagccctgcataatattcagaaataacaataaggttaggataagatcaccggaaactcagaccagcggagaatgttaatgacagaaacatagtatttgtgctcagcgggaaggctgacgcaaggcaaggtttgaatcaagtgagtgtaaatacttagcggataaagccaagagtttattttgacttctttgttacttttgggtacgggggtttgggggactggtgaaaatattaggaaagtttccttttttctagaaacaagaatgacagctagacaagccctgcaagtaccctgcttaagtttctcaagggtagatctctaaacaccctgccagattaattaattgtaacactgcctgtgcttgagagaaggaaaatgaggcactagggttcattgtaccttgtctgagaccactcaacctgttcgccttacaggtttgatccctaattcccacaccccttgtcgacttaattgccttcttggagaccgcatcacctccctctcgagttcaggttcctctctctccaatttccgtggtgatcaaaaaaatcttgccctcgacccctgtcttctgctcccctcctctatggatccaaacatcctcttccttcagtgcaaagtggatccgacagggcagcaggcttgggtcctctggttccgggtgggtcagcccgtgcagagagcagtgtagggaacatgcaggaggaagccggagacagccggggaagggaagaggtctctccagaaccatctcttccctcgcccacgtctccctgagcactcgtatactctgttgcctccctccctctgcggggtacacacagctttagagttgaggaggtgatgcttaaggttgcccacataaggcaaacagtaaacagctcttaagaaacataagatcactaatgctttgtcacagaaattatatgaattgatcggccacgcttaaaaatat

SEQ ID NO: 25492 - DNA, 1475 bp, Bovine  19866880638328
ttgcctttaaaaaaaaaaaaaagatttctgtgtaaataattaggctgggttttctttggctacattttcatttgaaggatgcaccctaattaacttaattggactcccctgttttgtaagcctcctagagcacccatttctacccagattaatccaatctattatgttagtgtttcccaaactgataaataatcaccaagggcacttgttatacatattcaaacacaccatggcctcgaaaaccagactctccacatgactgaaaagccaaaattttaacaatttaacatggatgcaaattttggaaaatgatgattctgtgttagttttgggagtttaactctctgctggcatcttcatcccaaatcctcttacacgtggattatccctaggctctgagagcaatgccaacacaacttcttggtctacagccaaatcattggaataaatatacagcttcctaacacaggcaattcatcaacatgcgggtgtctactctgaaagggagagggctcctcaagaagattaggtatgtgtatgccaagtctcagtactttatagtgacagtcattcttcacgaagtgcaggaggaaatgggtgggtcagttctccatgctgccatttcagagttggatgacaaaggcagtcagtcctttggtcatcaagatctgttgaccagagcacttaatcaaacaccaaggctgattcaatgacaccagtagttcggtgttgctctgaacagactgtcatccctgttgggactgcttatcatcctgttgccttccattcttaccttgagggctatctgcttcagcctctcatgaatttactcttttcatttccatctcttatcttggaacatcttgcctttccttctttaacacttaaaacttaacgcacgtgattattaaagtgaatgattactctgagcaaggcactgtggggtggtggagcaggatggaaatctactaagaaaaataaatacatactcagccaagttgtcaaggctataaaaatgcttaagccacagttcctgctctaaaggaacttaagtttactagggggataagacaaataaataacccttaaaacttggcaatgtgaatagccaagaaaaggcaggtataaagcaagcatttttgttgcagaaattaacacagtttggtactgatgtaggaataaatatattaatgaacttcaatagtgggtgtagaaatagtcccaagcatataaaaatagttaatatttgataataatctcatttcaaattggtgaggaaaatattgattaatcaataaattatagtgggacacctgtcaagacttctggaaaataaattcagctgaatccttgcctcactccttacatcaaattaaaaaaagacattaattaggaattcataatagaattataagtggccaataggcaaataaaaaatatagttcaataataaaagaaatgttaactaaagcttt

SEQ ID NO: 25493 - DNA, 822 bp, Bovine  19866880639072
ttgttggtgtctttgctccctcttaccgtaaatcacactatgaataagacagcagaatagccttattttaaagtcctaaatatacatcatgtccctctttctgacacactgtgggtcttcatagaatgactcatacccagcatgactcataccaagagagatggtgtccattacatcaaggatttacaaccacaaagaggtgcaaaacttgggcggctatgtacacaattgaataatgcaatttctaatgtttatttcctcttccattaacaccaaaaaaaacctaccttcttaaatgtgaataaaatgtgcattcagagacatctaaaatactggccagttcctcactgaaaagagcatagtgatgctgggaacgctgaagaggggagttgggggcagtttgcaagcttttggttgccaggggacacttaccatctgtgggtcgaggaaactgaatgctctcgaactgatggcggaaagagccaaagcgctgaaaaacaagggtcagtacaagggttaagtgaaagtgaaattacgctgacccagaaatgcaaatcagtgtgccttagctctctgtagaactcgaggtgcccaaacactccattgtttcttcggattacctagtgtcccaagagaggcttcagtgattcagagaaaagagatgaaatgcagagggaaacagcaggcagtggcagaatccaattttatttgagaagcatctccacagtttatagtggccttctcatagggaagaaaaatgcacttttgaagttctgttccctttctttgtactgcttttctacctttaataggccaaattca

SEQ ID NO: 25494 - DNA, 2132 bp, Bovine  19866880659077
tgaaggaaatcagtcctgaatattcttggaaggactgatgctgaagcttaagctctaatactttggccacctgatgcgaagaactgactcattggaaaagaccctgatgctgggaaagattgagggcaggaggaaaaggggacgacagaggatgagatggttggatggcatcaccgactcaacggacatgagtttgagtaggctctgggagttggtgatgaacagggaagcctggcgtgcttggggtcttaaagagttggacatgactgagtgactggactaaagtgcatgtcattagtaaagttcttggtgtttttttaaccgcttgagaatctgcagtttagaaatgacatagaggttcagatcataaacctggggaaaatgcacctcttttgatgcttattgtcatatatgactcagcgataggaccttgcgttctttagtttccgcctgattcactttaggtacgagcaaaccaaatacagccaaatcagtttccctagaatagcaaatgatttctatataaaccacttgtgatcgagcattctttttattctgcagagaagctttagaatattttccactcattgtccaaataatgcacaggtattgtaatgactgcctggtattaattgtttacataggagataatattgcctttactttcttctgttaagtgttgtatattattcttttggtgctaaaatcctggggtagtctttaaattataaacatataatatacttgacagcctagcttataccaaaaacgggaactaaaatatataaaaccaatctagaaaggtctttattctgaaagctatgtcttgcccttcagagtttttgtttttattgacattaataaccaacatccacaatcctttctctaaaagtggaatgcatctccccaaccaggtaaaatagcagtgtgtatgggagtaatttaggggaagacagaaggagtcctaaaggggaaacaagggcaaagaagaaatgatctttctgccaagagaattagtttactttagaaagaatattctcttacacaattaaaactgtgacattttaggagatgcctgttagtcagaaaacataaaattatcaataacaacccttgctattttgacaattattttcttttctctttttggcttgttggagaagaaagaaagcatttagatacatgcagaacatgtaagtaatctcagtaagatgatattcttgggattttccatatttatatattttttcctacattgtattttcactacccaagagcccgggctgttatttttttcccaaagtctgaagatcaccccatggattaacaaatgattgaggattctctcttaaaagactctttaaaaaactgtcagaatcagcctgagacaaagatttattatgaactatttaaagggcttaatatatgtatccccaatgagcccttggagcaaactaaaaaggaagagtggaattctcaaagaataggacaaatctccaatgccccactttcttcacaccgtgattactgtttactcaaaggataaaatgcctaacctgtcacacaaagtcttcagaagccacaggcctgctgatgtacagtaaaaacaaaacaatgaagaccgacagtcatgtgcttgagaaaggcagctgtaatttacttcctaacctgttcgctaacacactaatgtggctacatcttgtcgctggcgctgatccctgacccacacagcaatcaaacaactacccgagtgccggctgtcacagaagctgggaccgtcaccttaattatacatttctggataacaaaccctcccttaatgagcaacttttctccgccgtgccttcccgctcaccccttctgtccttgaaaaggcccattgtagatcactgtggttggaatttgtgaagcatattcataagtagtcttcctaacaggtaataaatactacctgagcatgctgtttgctttatgagaatgccaagatacaattaaaattataggcttgcactcatgggaggctctggagaagaatcactcaagaccgaagggaaacttctcagtgaacttagaaccacgcttttctcttttcatatctgtaatataataatactttttatgtcaggactgtt

SEQ ID NO: 25495 - DNA, 1866 bp, Bovine  19866880660624
taatcaaaatagtgtatgtaacatttctggtgctgtttattcatgtctaatctaaaagattgctttaaaaatcatgtttataaaaacagctcccaggagagtttacaaagatacacatttcctttgaaaagcctctgagtcaaaagatgtaggattttcatttgaactcctgtttgggtatagaatttataccctgcttcctgctttgataaaggctttttcccaatggggttgatgcagcttcatggtgtatctccagggggttgtgcaactagatttactcctgaagcacgtagcccattcagagattgtgttgttagtttatgaggcacttttggcattaagacccttcccctctacactccccgttaaaactcagcaaacagaagccaacagcaaggtcctcaatgcccctgccatgtttgtattacttgggtgggagcctagacttgccttagacaagacacctagcttctggaattgttccatccccttgaccactgagccagacccaaggggaaatagcaaggcaaaatcaccctccaagagatggactgcaggcagcaaggacaggtcctcaagcctgggtcttagcttggcatccagctttctcgagcagcgtggtcctggatgtggcgccgtaaccgcagtggctttcattgtcctcctctctgtgtatgcctacggaagggtgcgatttcattatttctctggaccacttgtccctctgaatgtatttctaagtttttctcctgtttgactatgcctactgtgtgtcaggtattacgtcacaataacacatatccccttgtcctttcccttgaggaactcatagtgttgaagagcagatggcaccaggaaaaaattttcatccgaagtgacagagactccaaatgagttgtgtataaagaccaatgaggaactgatggaggtgacgtgtgagtcaggtcttagaaaatgtgttggaactgattttgccactaatgggcttactttttctgagtaatggcaaccagcctgctaaagggggaagtgtaaactgagaacttgtttgggattcactcagtaaactagctgactgaacccattaggcaaagtctagactctgacttcaagcaattcagtgaatatttaggctttaagtatttcagttattggaggaagagaccatctggaaagcagactctctggaactcactctcaagtttcctgttgtaaaaatgttcgagggatagttttgatttgtggaactcctggaattaactttgctttatgtttaataatacctaatttcccagtctcatggcagacagaaaataaatggcatatttaaattgctatgtaggtgaaaagaaagaccactactgaagaatgggttttaatttaaatttcagaggacattttacaaagtacatgaacctaacaggtaagctggctccttgagtttgctcttctgtagacaactgaccctggaaggtgggtagcagatccagtgctgggcagaattttgtggatctttttcaagttacctttatgaggaaaaaccatgggtgtccaccatgtgacataatatccatcacttccctggctgtacaaatagttttctaatttgatgttgtagaaaatctttcactgtaaaaatactccttttctttagatttagcacttaagatgtcccccaaccccctcttcccaaaattcattctaattgtgaattttgactgtctgtgtttattatatttataccagatagtatctttgtcttctcttctgccatgggttgagacaatattcatccagctggctttccagactccaaacttaaatggtgcccttcaccatgtgggactggcttaacatttgaaa

SEQ ID NO: 25496 - DNA, 701 bp, Bovine  19866880719805
aaggaaactggtattgcatgtgttatcttagatttatttgtggaattctttgagtctgtgtcttctcgtccatctgtttttgttcatcattcttcccagtactgccacatatagcaagtgttcaaaaaatatttcgtcaatgaattaaatattgaaaagacattctagaagtaatagaagatgagaaagtgctttagaaatagtttagtgctgcttttctcggctctgctgattaagtacatggcagataccgtaactatcagagttccagataagaatccagaaaatgctatcttttacagtgtcatagaaatagaacctttgttccttctcaattgctggaaatatacttgtctttgaatgaaacgaggcattggagcaataaatatgcccttttgccctggctctgaatttatcagttatagttcccacattaaaagcatgagagtcctcatgaaaaagtcaaagaaaggaaaatagatcttcaagctctgcatggagaccctaggtcaaggtaaacatctaggggaggctgaaagcaggaaggtttgggaggttgccagtgtggtctgaggggatctgaaagcctagcttgaccaggaggagtcctttattggcttaactggagggtcacaaatatctgtctttagtgatttctctttgggtttagatttgactatagagttctataaaagtgctaa

SEQ ID NO: 25497 - DNA, 821 bp, Bovine  19866880730647
aatatgaagggagggatctcattttcttgctgaacatgggaaaggaaacaggcagctctgtggcctctgacagccgtctcgtcaccatgaagggagccaggctcaggaggaagccaacacaggggaaggcagaatacagtgtggaaagaacctgggaccttggtgacatcccagagcagtttatcttactattctgggagtctgtcctacctctggacttccagttatttgagataatgcatttcctcatttctaaagccaacttaatgtcatggttttcagctactcgctgtcaaaaagataccaccagagaaatggtcaccagtagccataataaatagtgcacactttttttttttttttacttaatttaggtgctaggtcttcattgttggatgggcttttgtctagtggcgctgagcagaggctactctctagctgcagtgtgtgggcttctcattgcagagcacgggctctatggcactccggcttcagcagttgcagctcctggggtatagagcacagactcagccgttgcggcacacaggcttagttgttctgtggcatgtaggatcttcccagagctgggatcgaatgtactagttccctgaccagggattgaacctgggccccctgtgttaggagtgttgagagtgctaagtcttagccactggaccaccagggaagtcctaaaatatatatatatatattaaaaaatatattgtttttccctcttaaatctttagttcttccatgtgctggtcattgtcttggttggtgttaagtacagtccctgccatcctgtgtgctggtcagttgga

SEQ ID NO: 25498 - DNA, 1541 bp, Bovine  19866880760822
ttaataaatctggtcagatgtgggaaggctttaccattagcaaaagacatatgtataattttatttacagcttagtcatttaagtgattatggcaactagaactataccagtgactatgaaagtgaaagtcgctcagttgtgtccgactctttgtgatcccatggagctgtatggtccatggaattctccaggccagaatactgaagtgggtagcctttcccttctccaggggatcgtcccaacccagggatcaaacccagggcctcccatactgcaggtggattctttagcagatgaaccacaagggaagcccaagaacaatgggtgggtagcctatcccttctccagaggatctttccaacccaggaatcaaaccagggtctcctgcactacagacagattctttaccaactgagctatgagggaagccctatggcctttgcaaaaagacaagatgccacctttaagaagtctccaattatgccaaatggtggcgttgaaacaacacatcaggtggtaaagataaagtagaagtggatatggaactataaaaaaagaaggacaaaaatctatttatgcaccttgaaagatgctttgaattagggtcatatagaggaaatagaactgaactttgggcttaaaggaagagttaaatatgatattatagcatccaaatactgttaaaaaaacactcacttttcacagctaaaatatagggacatcagagtgttcatggcaaatcaattagttgagtctggaatctaggatttcttttcctgtctgattgataatagtccacataccttgaatcattgtgtgtaaattttttaatggattattcatgataataagagacataaatccacttaaatcttacaatagaggaattcaattttatataattatctccataccccatcttcgtaaaagttcttgtataaatagccagtaagtcctgaaactggctaatatgcattttcctaattatctttctcttcaggtgaatgtggtagcaagtcatagattatctgaaagtaaagaacagccaaagaataagaaataaaggacccggataactcaccaattagagaaatatcccttttattttcaaaaccaaaataagcaaattccaaggggtgaaacaaatgaaagaagaaaaaggcacaagtaaatgcattcacctttcctccagcgctcatgtccccttcccttgaagtgctcaaatgttagaaaggaagaaactccgagaggggaaaggtcactcagaaagaagacacagtgcaaacgccatgtctgtaatggagggcaatgtgaagtaaactcctgctctgagcctgtaatgagagagaaaagaaatgaagagctggaaaggtccaatgtcagaatttactataggtaaatttcagtgactgaaaggcacaatgaccaataaccacttgcctgagacaaaaacgatgtgacgtgctgagtctgcttagcccatctctctccccaagtgtttggctccgatctttcagaccactgttctcgcctcagaact

SEQ ID NO: 25499 - DNA, 1082 bp, Bovine  19866880775476
gtctcctagtttatagtctatgggaacttgtatcctactcttgtgtgaaaattgtataaatcttaattgtgttgataatgcttttcaggtttactctattctgctactgctctataccttccttctattaatttctgacagtttcatagtgaaactccaactaataatcttagtttattgacttacaacaagtgtaaaacatagtggaactatatgtaactttgttctgtattttccaagtctcctgtaaatgtgttaacatattgtcataatttacaaaaataaaaaagatgaattatatcgtgttaaagtgatcacagtcctctgacagtaccatctttctcaacatatcctgcgaggctccatccagtgctgattccctccccagcactgctcacatgagagctgcttcatcccctgttcccccaataagatgaatcacccagcagatccagctctccccctcctcctccacagtgaacttccctcattaattaaccttgtctggaagtgagtggaagagctgatgagaagccgtgacatgacacagctgaataacatccctatttatctgttcattctcagtaaataaatctaacagcttataaaacattcaaataaaactggtaatcaccccccctcaccacacaataaacacaaataaaaagaaacagcgatgataatttctccatactcccaatattctccctaatttattaccattgtttgcttatttctttccccttagttaaagattcaagatgttaagccttgctcgatgcaggtcactacattttcctccattttttcccatgaccttggcacatgggctgttctgactttctccgtaacttttcagggtcatcattgttgtcacggacagtaataatggtaacacaagtgccacttactgaagcctggcagggactgtgccattttctactgattttacccaagccccacaacttcatataaaaacgtcctctgtgccgggcattgttcaaggcttacattctcttattatgcctattttgcaggtgggaagcgagacttccagagcttcaaacttgcccacggtcatt

SEQ ID NO: 25500 - DNA, 1112 bp, Bovine  19866880818403
ttggatgtcagaaatcctaattttgaaattaacagtggctgaacgttcattcgcaccttagcatagataggacactccacatacagaaaacatgtttcatgcaagagcaaagaccaagtccagagtcataatctacattattttaccattctaaagttaagaatataaaagctctaatcttgggaaattccaacatttcagttaccatagcaacataaattaagacctatgaaattcatgaaatgcctttggcaacctgaatcttatcaattttacaacacgctaaccaatctctcaaacagtatttattatatgaggagggcgaactaatggaatgcactatggctgtcgccagtgtgacctcttcccattggacagtctagagcttgcagtagccctgttcttgtgggttagtgctctagccttgccagggatagtaacaatcattctcatcaggctttgaaaaccttatataagtcatcgggacaggagcagctacagaaaagtcagaatcagacattttctttgatattaattcttctctaaaaaaataaagcagtggcaaagcaggtctttctagggacaatctttagatgggctgtcccacagcccaaagggcacattgggaacacccttaatttttaacagggaccgaggcaagggagaggtaggtacttgggcagcaccgggtgcattagctccacctacagtgatttgtagtcctgtgacaaaggggcacgtcggaggacagaaaacggactatcttatgccaattttgtattttcctgcctcactgaaacactatacatttactagttgttagctgtgtagtgtcagccagtttgaaattctataggcaaactattagatgtagcgagtattgtcatgttaatgctagaaagatgcattattgctattccaacttttctccatttcagttcttcatctttcccagtttgcactggtttgtagcaggcatatcccagaaggaaagaagggtggaaggggtgaggtatattttgaaaaagcaatctctagtataattcaatatcattagataacttaattgtttgaaaaccaacagaaaattattactacattcatacaacaaa

SEQ ID NO: 25501 - DNA, 1730 bp, Bovine  19866880820780
aatatcaatccatagagaagcatctgaaaagatacaatcaaaatgtttacaatatattcttttgaatgtatgcattttctcttcttcctgtcactctttcctgttgaatttttgttgtatgacacttttacaattaaaaaatgtatttctaattagacttgtcagggtataaattaattactgcatgcgtacactataacacacatttttacttcactaaaatgagcatagttccttttcacctctgaaatatcagctgtattcaacacctttgctaggactcagaagcgaaggggataacacattttcctttattctgacatgcatttccattaattacatgctttctcttgtgttcatcaacagtaaacttcagggtaagtttttcctaccaattttaaacagttctgcatggccaattttcaggtctgtcaagaaaagccaagactaatatcccagtgtcatgtttatagccatctgtgtagaaacaaaatcagctttggacagcttttatcttgctaaggttcacatattttgatgtgcggatgaatacttgggtttagaagcatcagaggattaacatgtttggcaagggagggagtggatctcttcttcaaaactacctcttccaagaattgatggaatgagccattttggaagaaaataaaaacaaaaccaacaaaacaaataacaacaaagccaaaatgaaacaaagcacagtagttttaggccagagttggagcttaactaagcaagaaaacagagtgagtagaaccattttgttttatagtcataagatgatgtccgcagttgtaaagaaatgcggcggcaggcagccacacctggtctgcactgccccgggggcacggagggtaaccaagcatggctggacgcctgcaggctggggtggacgaggcgcaggaggctctccagccagcatttagcgcccacaggtcatgtttcggcctttcaagtacatctgccatctggcctcacttgctttccctataattatttccctttcccctttctgccctggagtcatcttaaaggaaattattaagtataggattaagtacacagcaagcaatgattttttttttttaatcaaatatatctgagataccagcttttacatcatacctttggcagtttcttccttctgaacaaagaagttggttgttctgaaatctatgtccaaaaagctggcttctctgatccctgactgccttgtggataagcccctttagcactgacctggtttgtccggtggccaaatcctaggacctcctggatcctagagcattttacatatacatgggacttccctgggggtccagtggttaagactctggacttccagcgcaggggacataggtttgattcctggtcagggaacttagggcttcccttgtggctcagctgataaagaatctgcctgcaacacgggaaaccttggttcgatccttgagttgggaagatcccctggagaagggaaaggctacccactccagtattctggcctggagaataacatggactgtatagtccatggggtcacaaagagttggacatgaatgagtgactttcacttagcagggaactaagatctcacatgccatggggcacagctcaagaaataaaaataataaaataaatatataaaaattattgccaattatagcaagtgggttgataaacactgtgactgtagctttaagactactaaa

SEQ ID NO: 25502 - DNA, 1317 bp, Bovine  19866880826031
atacctatgttggctgttacatgaatgagcatgtggtgaattttgaaggcagactttgagaacatcatattttagtaagaagcttgaaagatacattgatcaaaacattcagcaaagcaaaatacattattttcggtataaaatatgacccagtatttcttcattgttcacaccctcctttcattgagcgcctgggccttgaacatagtagcagtctgggagatgcttgttaattttaattaaaattggattcctcccagtctcttaaagtcttgaacctcccggcctgggtcaaacagctgaaggaaaggagaataaagtaccaagaaaagctagaacaagatcattgctaaaatatttgtttctgggtttattattttattcaaaagtctaggaagtgaccggtctagaatgtggcagcaaactgctgttaatcccatttacattttcagagttgggatccaggttttcaggtttgttatgggactttatgcaaaactgggcaaatcgatagcattctaaaaatgccgtctgttctccagctcccctcctggtcacaaacaagcgaggctggcgctgggctcgcccggctcctagagcgaggggtaaacccggccgggtgagggactggggagaagggctgtcccgggggcggtcccggggcggagcctgggcggggcccgtgacgcgtggagtcggccggctcaggggctggacctcagcttctccccgcctggggccgccgccgccgcaccagtggtggctccacatttccaaaaggggccctccgactcttcactgggccagtctggcgctgagtcgcggagctccgcacaacttccgctggtctctaaacgggatccctcctccccagagttgcgggcaactttcccctctccctggtgccgcggtggcttggggaccgtggccgccgcaggtagctgaactccgggccacgctccccgcgtctcggctgagcgcacacgcaggtcactctctgcacgctgggggtccccaagactcggctttgcgggagggatgcccctaggacatatcatgaggctggatctagagaaaatcgccctggagtacatcgtgccctgtctgcacgaggtcggcttctgctacctggataacttcctgggcgaggtggtgggcgactgcgtcctggagcgcgtgaagcagctgcactgcaacggggccctgcgggacggccagctggccgggccccgcgccggcgtctccaagcggcacctgcggggtcatcagatcacgtgatcgggggcaacgaggaaggctgtgaggccatcaattacc

SEQ ID NO: 25503 - DNA, 2377 bp, Bovine  19866880877543
gctctgttaacatatcggtgagcagagagtggattcatttcttatttgatgacattggaaggatttttcattctgcctcatcgttctgatatagaatctttctttcttcttgttctactaatttatacacgtatttctgtaacagacccaatgcttttatgtgtttttcttcagataagtcagcaaatacatagaatgagacagagctgtaaagaacatcaagtttctgtcaaaacagttcataaatattcagtagagtttctgcaacacgtaagaagttatgaagatggcattaagataccagtaaatcctaagaaaacctatgctaatcaagctatcacatcttattatattttattcttttatcactttattatctctcagtaatatgtgacaccccccccccccccgccaaaaaaaaaaaaagccctacaaatcctaatttgctgaggcgagatagaattcccgtcttgtcctgggtcaggattttctaaccatgatctcagagtctccgggcagttaggtttccaaaccacttgccactaacacagtcctctctcaggcatgaccttctatccaaatacagcaggtgtcctctgtggaaacaggtctggctgcaaaaggactcctgataaagggcttaaccagtagtacccctgagtcccctcagtaatcttaatgccctcaagaaatctacccaaaaaaagcagcatcttccaaatggtctaagaaattccaccttaaacggcagatttgatgaccttttttacatgctaaaaatggactttgtatgattgctaagactgaaatatattgaaagaaagaaatcagttttatcatcttgctttatcaaagtacctatcctcttaagttattccagtatgaagatgactagcagtgttgctgcctgctcctcatttgtggcaaaccctttcaatcaaaggagttatgaattcactgatttgcactgttggtacattgctgtagttaaaaagtatttgctcaccccagggggccaggcaaaggctatcgacttgctcgcttgatgtaggaaaaagacaaattagtcccctatcctatccaccagcagggggacaatgacccgacctggaaaagtcaacacaaaccactgtataatatatttacattttttttttccaggaaacttcagaggtaccaaatcaactgtgtctagtgtgcaaactgcatgcaagctaatagaatgtgaaataaatttgaggacggctaggtggtttagcttgattaaaccctgtgtgtgatggcgctagtggctatggcttatcctggaggaattttgatagctttgagtggggaaaggcagagagaaaggagttgtaacagaatgctgtttctggatatgactgcttattactcatcacctgtctccagccccatatacaatctcagctgtcttctaacacactaagcaaacaggaagaggaagttttattttagagtctgtcagctagagtaaaggtggacaggtgagcaaattctcttcttgtgctagggcaacaattccattttgcatggatctgtgccttaagtttagtaaacagaatatgtttgctcatttttttatattaccatataaaatgactgaatttactataaaatgaagaggttctcatgtttgtaccaaccagaagaacacagtattagggggaaaatgctatacctttccattatgtaggtcagactatagatcaaagatgggacaaataaccagtttaaagtggaatttctcaatttctactattggtgatttaaagggataattaagaaataataatttttatgaaactttgtgaaaagtcaggtaaggaacaaatgaactaaccaactaaccacagttctgtcataggcaggggaaaaaattataaaagatgaccttattatctttcaaagttccctgaaacctgctctttctcagcacttataaaatcctatcatcataagtcagataaagaaaaacaaatatagtatattaaagtacatacatggaatctagaaaaacggtactgatgagcctatcttctagggaaggaatggagacacggacataggaaatgaactcatggacacagctggggaaggagaaggtgagatgaatcaagaaagtagcattgacatatacactgcatgcgtgttcagtcatttcagtcgtgtccgactctttgcaaccccatggactgtagcctgccaggctcctctgtctatgggatttcccaggcaagaaaactggagtggattgccatgccctcctccaggggatcttcccgacccagggatcaaacccatgtctcctggactgcaggtagattccttaccactgagccaccagggaagccccata

SEQ ID NO: 25504 - DNA, 1859 bp, Bovine  19866880885669
atttcataataccaaaaatcatcagttgctaatagcagtgataactttttcatcttcttccaattatagtcttttcttgtaactcctcaagtgcttcttccctcttcctagcgattatctaacatgtcactattaatctgttcatatatttactgtttgttcaacacctactatgtgctaagtaaatgaagtcctttaatgagacagttatggtatcacagaagggaccctataccaggcatcagcatcccacaagccactcctggttctgtctctatcagctggcttatgttaagcatggattttgagccacctttctcactcacaaaatgaaactgacatttactcacaggattgttgagggaattgcaagcataataactatgaaaatgctttaaaaaaaaaaaaaatctagtgttttaaacagcttggtagatagtgcaccacaagtctttagggttcattttgtgacttttctgcttttgtaggcgaacaatggtgtcttggatttttacgctctaatgccatatccatagcagctgctgttgacttcagcatccaagttagattatcccacacagtttttgatggaattcgtccctaacttaatctgtatgtaatttagtttgctgccagggaagtaaagtacatttgctgtaaaccccaactccgggttgctagccggaaaattcagtgtgctttgtttattgcttttgtttcatatataatgtatatgacctcgggatgatttgttcagggaagagaacttgaggagttacccttgtacctagaatctgctgaaggtgtgctgtaaaagcattacttactcctgagttacccaaatcaacttggaataacgagttattctccaggggctattttctctgcaaatttatgagtttacagttcatgtttcttttttaatgatacatctagcaataggtcttttctgggctttacaaaagcctagcatttcctccatttcgtgtttatgaagccagctaacagctcttctgagttgaagttctccaactttacaatgcaggagaaatgaagatttgcatcaccagtcttgaatatcctgatacctagtcacatgacaaactttcctgagcaactttgtcatctcagtgaagctgcttcccctgtctgtcagacaagtcctgttcacctgctctgaattcatcacctgtagcccccaccccgcccccagcagctttgacccacaaccagaacttacaacagatcacccaggagggtgggtgaacttttgttcttgactggagtgaactccagtttggataaacaggctttgaattatttattccacaaatcagaaaagtttatcttcttcttttgatatattatgagggacgaggacaagttggaggcagcgtatctatggcatcaatacaaataaaagttcagtgtttaataatatgtgaaattagcaactaatgctttctccaaaaataattcagatcagactgaacctgaatcagtctctcaagtggtaacaggaaagtacagttgactgacacccaaaatgatgatggaggagtatgtgtcttaaaggtataacttatccactgatttactgaagtttcattaacaatcacatgaatgacatgtgtgtatcaaaacacagagcgatgtttttcccttgataatatatactgatttctttaatatgtaaatgtcttaatgctggtggcacttggatgagagattgttaaacttgttacaaaggaatcgtttagttcttcagctttgcgttggcagggtgattagacatactggcatgtcacctcagtgtgtctcctctcactgggtaccattacgataaatgactatgagat

SEQ ID NO: 25505 - DNA, 963 bp, Bovine  19866881015507
cattagcatttccatggatggctgggcagcttccttccccggctcccactgcaaagagactccttgccagtgcttgagccttgttcaccaagtcaaggcaattctccaggaaaacaggtcagctgatgcaaaaagggaggcagcaaacaaagagctgaggccaccagtggcctttagcggagcctcaagggttaccccctttgcttttcctattaagcacttatttaaactgaaatttacatgtttgactgcagtccaaggattaatattttgagcccatcctattttaggcatatagtaatgaaaatcagacctggtttttgtctagcatctctcgatttcccaagaagagagaaaacatattcaatctatttgtgatttgtagcctgaggatgcaaacttatctgcatgccctcctaaattattactttcacagatttccaggtatccctctcagtaacatttttcagaaagcaaagctttgaacaagtaaggggggaaaaacttgtctgaacacgtgggaattttataaatgtggagttctgttaagctttcaggtgtctgggaagttgtgtaaatatggaccgatgcttgacagtcttgtagctgtggttttctgtttgagccagaagatgacagatgtctctgggcagcatttatgtggtcactccaattgcttctcacagagcaatcaatgaagcggcaaaatggcattttaagtgcagtgttgggcagagttgggggagatggagtgggagtaggagggtggggaagaggaagaaagaattgcacacctgaacacaaagtcagcaagcacttgtcactgaggccacactttcacatgcccacatgtgtcgctataataaccactcagtgagtcaggactaaagacaaacaagaaagtggtgtccaaaggaaattttggtctgaaatacttcacatacaaatctacttttttaaaag

SEQ ID NO: 25506 - DNA, 1771 bp, Bovine  19866881040829
tcttgcctggagaattcccatggacagaggagtctggtgttctacagtccatggggttgcaaagagtcggacatgactgagcaatcaacactactacataactaaccaagttaggtatataattaaaattaattttgaaaaaagttagtgataaggactataagtcctattccaattttctgtcttttctaaaatcattgtagaaaagcagttaacattcacctttgccatttctttgaacatggtctctttctatattcactgcacatgtacacgtactgcctatccttctatctcgttgctctcctagaaacacatccttattttcaaagagagagttttgctttttacaggtgtgagaaaggaagcgaaagaatgaaggacctctacagttccattttcataatagaagtctgttgttctggaatgatttatatttgaataaggaaaaatgtaaggaacttggaacacagacaaaagtaccttctcatcaaaggttgtctatcgtttcatgaatcacatgtgatggatgagatttatgaattagaatctgtgtcaagagatttacaacatactaaattagttatgacatctcctcgtcggtgcgcataaactttcaacaaaatatctatatcatcaccacaggagcatggctggccagtgttttcattccactgcatcacacccagcccctgtcaactgtggttgatgaattcttgaaggcatgggcttcagatcaattaaaataaacaccacaagctgatttatcaaatcttttctgaatgctctcagaaaatgtcaaaaatctgatccattgacagagaaaagtcagagaatcgtggcagcctatgggatcacaagaccttttcaaaaccatcataaatcaccatagaaaacaaatggggcaccatgtgataagatttctcttgacagctttgcctcaacaagacatatatgagataaatggataccttcgtctatacccaattgccagtttacaaagtttcaagttgtcaaactgtaaaatacaccggtatcaaagtccttccaaataatataccttttttgggtatacaagagtggatttaaaataacacccccttcacatcatccctttcattattgcaagctatgtaatattcctgctagtaatgtgagctttctaaagtgtaagtgtatgtatgtacacgtgcacacatacacatgcacagcaggcttcaaaatgtaccttcatatacatcctggtctgaactaatgaaacttttccatttctcactattcaaagaaaactgctttatagtgctaaagtgcatccaatcaaggtaccctttggttttttcttaatcatcccagtcttgtctcatttcatataggttaagagcacattcagagacaagcaataacaggctaacctattctaatctataccaggaacagagaaatgcttccattaatgagtttttacaaatattatcaaaccctataggtagaggcacagtgtactgggttttgtatttcagagtaaattttaattctaaattataccccatatattcctctttaggaagcaaataggataggactaatttttcaaagcataagaaatcctatgaactagaaaaagaattccttgtgctacacccacgactggcagtatctcactgattctctttctatacctgtaaggccttactcaaattctcccctctcatgaacctttcctcttcaactgtggggggtgggtttagttactaagtcatgtccaaccatt

SEQ ID NO: 25507 - DNA, 1330 bp, Bovine  19866881079873
acagcccagcagctaattggtattaactactctactgaagatctatttaatgcacttaggtaagactttttatttccatgaaattggatctttggtccaaaatttaatctcctgccaaggactctgtactacgtaggtgacgtaacatgtcattgccaggaatataaagaaattgatccgattatttgctaaataatgtttcttcatcagggctaagtcctcctctaagtgggctgtcaaagagaggagcaaaaagcagtcagtattagttggatcttccaggactccaattcagccatgaaaaaaatcagtgcactaaaaactgatttggtatatagattattaggttataggacctttgtctggaaggaataagcaaggcctacgaggtctgatcgttttgcaagtaaaaatattaactaaaatgaaagctataagacatagtattggaatgatatgatattccttcagaatatcatcattatcattctcatgacattaataatcatgaaagaaaacttacctaccattatagggaacataaaattcctaataaacaactttgtttctttctctcttgctgaaggttttcaaaactgttctgaaggaggaatgtagtctggcctgtctaaagctgttcttacattactcccatggtccctggacacagaagggcagaatcctcctcagtcttcagattcactttcacagataagaaaggacactatgaccaaagctttctataacctttagcctaaatttacacgtcaacaacaagagaaaggtatgtgtgcacaaaaatgctagtgagcccttcctgcccaagatggaggaaatgaatcaaaccattaaaacgctaaggcaggagaatgagtttattcaacaagtatttactgagcccttactatatgccaagcactattttatgtgctaggaatacattccattgattaaaaaatacaaaatccctgtcttcattgtgcttacactctggaggaaggataccaaacaatgaacattataaataatttacatagtaagttagaaggtaatgagtactacaggggaaaaaaaaaaaaaaatagagcaattgtgagaaggaagacaagtcttatttggaacatttcctaaaccggacacacacaaaaatatgcttctttcttggaaagtctacgtgcctgtcagtgaaaaaagaaaatatttctggccccttaatgttcatgggattttcaagcaagaaattacaggggttttaaaaatatgaaagtggaattgaaaactaagcagagtaactttcataaaagaggagctccatacagaatttgtgagg

SEQ ID NO: 25508 - DNA, 797 bp, Bovine  19866881080838
tgaaagggaagttgctcaatcatgtctgacttttagtgaccccatagactgcagcccaccaggctcctccatccatggaattttccaggcaagagcactggagtggggtgccattgcctgaaagagatgctgagcaccttttaatagtcacagagataacaagtgactccttatatatgttctacaaatagggctatcttcacagctgagcttctggtttcaaattagacccttaatgaattctttcttctgatttaaacctgcagctctggctagtttacctcctaattggaattaattaatctgtttaccattggttaatttgaatttttttcccacttactctcatgtttgaatattggccacaatcttaaagatattcatactatcaggcacattcttatcatttgtgggaaagatgaaaaaaaaattactgagcataatttgtgtgctatacacgtcagtatatatgtttgtctaaatttttatacaattttaaagtttacttttcacttacggttattacaaaatattctctgtgttgtacaatatatcctcaagtctattttatacctaattgtttgtaccttccactcccctatccccatattgattttcttccctcctctctctccccactgataaccactggtttgttctctacatctgtgagtctatttcttttcgtgttatttcactattttgttttattttttagattccacatataagtgatatcatacaatatttttttttctttggctgacttacttcacttagcataatgccctccaaat

SEQ ID NO: 25509 - DNA, 1197 bp, Bovine  19866881107679
ttcctttattttgatgaattagatattgctacatagaagcctgtgggctttatctttaatgtgcataggagtaatctgttgtgcatgttaataagcaattcctgaatctcaaggatgctcatttggtcattaacaacggagccatgaagtctctgtaggttttcaaagtttcaggcagttttgaaaaactaagtcttccttaaaaatgatcttaaaaatccaggccttgcctttcaggtagttgacaatccttgatatttctgagcttttagtcattcatccagcatttagtctttcatcatttttctgaaatgagcattttcttaaaaaaaaaaaatggtacttatctccatgaagtaaaacaacagcacttaataaaaggacctaggctgaggtggagaagctctgtgttctacttgtatctgtgtacccagctaagtgacttcagccagggtacttaacacacctcagcatcctcacgcgtcaaatgaagatgtcacttcctctcctgaacccacttcagactgatgctatgaagaaaataaaaatgaattgaggctaagaggacagcacagaaactcaaggcatgattctgacttatatcatcacagcaatggcgggtcagatgaggaggataatgtgccgccctgctctcgacgcaggccaagttgcaatgcttcaagttcaggttcaaactatgtgaaagtacccctgccccaaaccatgcctttcaggccgttactttttctgtgtgtgccatacttctgaacatgtgtgtcatggctcatttaccaaaagttgagagattttagtcaacgttcaaggagcacgtccacattttcaatggcaaaaggcacattttgatcaatatgttaataaatcatgcaaatactgtatatacgagtatactttttaatagaactggcacaagaaagtcctcaatgctgcgaagtaagaaggggtgacacaagaaaaccactgctttttctttcaccttttagtcttgtgataaatttgcatacagcagaaaatacaccataaagatcaagtatctcaagtggaaattaaataaagctttgtcaaacttgacagaaccaatcatatacatgagaaatgacaagacaagcagtctttaggttaaaaaaatcttctccccaatttgcatgttttcaaaaatttacatacattatttaaaaa

SEQ ID NO: 25510 - DNA, 1913 bp, Bovine  19866881118361
actactatgtacaaaataagctacaaggatatattatgccacacaaggaacatagccaatattttataataatataaatggaatacaacctttaaaaattctgaattactatgttgtacacctgtaacatataatattgcacatcagctatacctcaataaaaaaaaaagagcctccttcctctcacatgcctgagagatcaaagtttccatcccataataagctaacaaaaaatgataataaaatatggcatgcagccagtacagaaaaatgtattccatatctgctctgttccaaatctcttgatctccacagcaaaaatgggaaattagagccaagcagacatctcacaagaaaagcaaataaagacaaaatgaatgcttcgagtcactagacccaacttagggaattcatggtaaaatctgactgcttcatccactccttctttcccctggggacagggaaaggactgaggagccaggactgcgcctccgcctcgcctatctcttcctctttcctcctcccttctccccatctctccatcttaaaatgcttccttctttctctttctagattgttgttcttttctacagagtgttgatccctggattttcctggattgtcatgatttctgttgaaagactctcacagcagaagcaacacccacatatatatatgttgcctttcttctgctttcttgctccatcagagctctgtggagttattcagtttaattacttctggcactttgcccatcaaaatgtgcaattcttcaaagggatggaaatgacagtgaatctgcctcctcccgagcaattgaggttttcctttgaatcctgttgtcttggaaacaagtgagtttcattgaacatacacctaccataatggttaaaacatcagctagaggcatcactccccccacaatccattctctgttttgcccaactcagaggatgattggctgctagactagaaacaggctgtgagtgaagacatctggattctagccttacctctgaaactattcacatggctataggcaagtcaaataacctttttgagcctctattcccttatttagaaagtggaaaaaatagaacctcttctatctatctcaaattcaatgggaagattgaaagtggaaatagacatgaaaaagcactttggaaactgcaaaaggatgggcaaatataatcacatacttgaattattttcctcttgctcaaaatgaatcatgaaattttagctcagatatgtataagttctgtttattatcttgtcataatggtaaaacagaccacctttaaagacctaagcacctgagagctgaaaatggtcatcagtgaccagtagttactccctttatggtccattctgctaaatgaaaagtaaccccatgcagacaggaaagttgtgcccactactgttgacttccctggtggctcagacagtaaagtgtctgcctacaatgcgagagacccgggtttgatccctgggtcgggaagatcccctggagaaggaaatggcaccccactccagttttctcgcctggaaaatcccatggacggaggagcctggtaggctacagtccatggcatcgcaaagagtcggacacgactgagcaacttcacttcacttcttcactgttgactactcagggtatagtaccaggaacagcctaaagttacttctgttttagtcatccctggctgcataacaagccacccgaatacatagtggcttcaagcaatccttttctttggctcatagttttatgaatcagaaattcaagaaggtcttgcctggggcagttcatctctgccatatccaggcagttgggactggaggacccacttccaaggtggcttcttctatacatgtctgaaacctcagtgctccttggcaactctcca

SEQ ID NO: 25511 - DNA, 1862 bp, Bovine  19866881121841
atgagggtttggatgtgggaagtttattttggaaagggatcatggggaatagaaatgggggatttagaagagatttagttcagagatgatgacataagttgactgatttatttatttttcaagtaaaatagttaagcaaagtaatacatgttcccaaactggccacccaaaaataaccagggttaacatcggtgaacgtcattccaggcctctgtttgtgctggtaaaacaatgggtggataggcgtacttttgcttgaatgcatcacatttatttttcccattgaacttaacattgtttgattctttttttgggggggcctataattgctttacgacattgagttggcttctgctgtacaatgaagtgagtcagctgtgtgtatacataacatccccctccctctgggacttccacccccataagtcaccccagagcatcgagctgagctccctgtgctatacttcaggttcccactagttatctatcttacacatgctagtatatttcagttcagttcacttcagttgctcagtcgtgtctgactctttgcgaccccatgaatcgcagcacgccaggcctccctgttcatcaccaactaccagagttcattcagatccatgtccactgagtcagtgatgctatccaaccatctcatcctctgtcgtccccttctcctcctgcccccaatccctcccagcatcagagtcttttccaatgagtcaactctttgcatgagtattcatgccataaatttaaatcaacaagtccaactcttctcatcatcaataaaaatacagattcacaagctgtatacaattcagtattgaaataaattcacaggaatggtgaggattcactgtaaaagtcttatgtgccacaggttggagataaaactgatgcagttagggggcaattgaagtagtgttatgagagactataggacctgagaaagaaccagtgactgtgagatgagaagcgaaagcgtgcggcatgtgatatctaactgataggacttgatggccaatggcttatagaaagggaggacagtttaagatggtagccttggtgattggagattggtaatgtcctccactgagatcaagaatcctggagaagggataggttcgggttggggatggacgggtggtggttcattttgcatatgccgagctgggggtggggggctgtggcaatgtatatggtatgtgggtctggagtcaggagagagggtgtggctagggttatggatttaataaccttaagcgtttaggggaagataagagaaaaggaacttgcagaggagacagagaagccccatatactcctgtcagatcagacaggtttgtcgttttctcctgtgtttcttgcaataggtcttagacatgcaacctccttcctttcctgggtgctggcatggccaattctgactccccagaggttctgtccccagagggaggtgatgtccccagcttcttctaattcctcttcagattcctgaagacaaccaactagctcctcttagttatctgtccatttatttttgaaatacattttactcctaatcactactgcttaatataataggaacaatacaatttacaaacccataagatttagagaatcttaaaaaattcatatggttttgattcccaatctgtgttcctaactcccttgctgagatagtaactggaattccctttggtccctgctttctgctttcatccctaaaaaatgagagtattaacccttctctctccttctgagtcactcttctctggggaaggactccatcatgacctgctttctggcaaaggctcaggatgcaagctggacagaaagatatgtgtgtttcttattcc

SEQ ID NO: 25512 - DNA, 1011 bp, Bovine  19866881177574
tgatcttgggctagttgggttctccaagtctcaaatgtctcatctataggatgaaaataagaatatccccttcttcccgggttgccatgagggttaagtgagaatacaatttatacatgtacagtaagcactgaataaatgtaaaccctgtattttttttctcattagctcatatgttttagtcttgaacattccacttctaatataaactattaaaatgaaagatgagtggattttctacttttactgaggttgtgttgattggcccaaaggtagaaggtagcttaggggaacaacacaaacagggcttctccattgctctaaaacaaaggttaggaaataaaatgacccacaagccaaatccaacttcctgtctacttttgtaaactttgaatggaacacagtcgtacttgatttgtttacatattgtctatgtctgcttttgtgctcaaatagcagcagtagttgaatagttacaacagagaccacgtggcctacaaagcctaaaatatttagtatctggccctttacaagaaaagttttctgacccctgctctacaaacataaaaaatccaatttttccaagtcacataactctgaaactgcatacattggaaactcatctcctcatggaaaaatgtaaaggctaccttcagaaaggtacctacatttacttcacctcgcttggtgctgtgtaaggctcttgcggatagaagactcacaaggagggtccttccccatgaagaatcccagtgccctgattgagaatcaggtgaatatgcagtgagacagatttctgtgccaatgatcagagcagatggctggggcaacactcaggccaccgtggtttgttattcttttccatatggccgtcagctccattacacagaaaggtggattttgaacagaggccctctgttgtcctccatctcacttccctgtctattggagggtactgagtgccaccaaaaggatgaggactaccagacagagaatcattctcagattttt

SEQ ID NO: 25513 - DNA, 1720 bp, Bovine  19866881232112
aaccctggtgaaagtgaggtgtaaatactgctatcagtcaaatgagaacttatatggattgcttctgtggaccattgcaaacaatgagctgaaagttatgtttccaacatggcaacttagcaatatccattgcccactgatagttcagattaaacacatagacacagacacatgcacacacacacacacacacacacacagagttaaggcagcagcccaaagtttctctctcttgaatattactatagaaagctgagaactgattatagagatgattcttttgtttaaatctgagttttcttactcaaagcactttgaggcctttcttttagtctgatagtggagggcatctcatggtctgtcgtccccttcccctcctgccttcatctctcctcggagggttctgtttatacgtatggagatgttttaagcaaactggagcctttgttggcttacaggagcctagaaactccatttattccagagatcaacaacatcaaattggccctgccccctacttcatttcttgcattaaagggctatattagtcttgccatgatgttaaatcaataacaaagaaaaccatttgatccgtgtttcttttgttaaagggacagatgacgtacttcagttatattttgtatcttatattcaaatcaatattcaggatacttaagcagggaaaaatttcccagaaataaatgcattttctatactcagaagaaatcgtttattattctagagtgtatgtgacttccagaagacaatctgaactattactgatgaattactattttccatggttacaggtgcatatgcagaggtgtagaagttcaggttttggattgtctagatcaacctttatcaaattcataaaatgagttccataaacacagaacttcacatatggacatgaattgcacgctcaccatggaccaggttttgctgtagtgctcactatgactgtcctacccactttatttcataggagtctcacaaaggagcttctattggcactctcactttacaggagaggagacagacacttaaggaagttaaacaatatacttaaggtcacggagtcaggaaaggcaggaccaagtttaaatccttggctgtctgatgtaatagcctatgggcttagtcactcttcagtaaggtggttttgaggtaaggagggttagaaaagggacgtatcttgaaacccttgaaatctgcaaagttaggtaactgttgctttggaccactggatccagagattactttagagaaacagaaattgtggaccttcacaactgttgttgaggcagctcagtacatcagtacatcaaagagtgctgagcctgaaaaaacgaggaactgtgcttctgtttactttttagttctaaagtctgtttttttttctttcttttaaaaatcttttttttttttgacttttaaaaaaaattttattttatttaaaaattttacataattgtattagttttgccaaatatcaaaatgaatccaccacaggtatacatgtgttaattggccaaagcctcatggtagatgatattataaaaatccagtagcttgagaatatacttacaaagaaattatcataattttggaagggcattcattagttaaataaccgtatatacagaaaggtcgttaatctttgcatcattgacatcattttcaaactgatcgtcattttcattattcttaggtagca

SEQ ID NO: 25514 - DNA, 1282 bp, Bovine  19866881232820
tttgaggctctatgtctctgaaaagtgtaacagtattcaataataacctgccttccgctgcaactcagtgatatgttaaagattgcttaaaaacatgttaagtgttgttgtgggaagactggttctttctttgcccaagaggctaattggttgggaagagttttaattgtaccaagagaagttcagcttgggggtacgcccagcactgggcttcccgggtggtgctagtagtaaagaacgcaggagacataagagactcaagttcaacccctgggtcgggaagatcccctggaggaggaaatggcaacccactccagtattctaacctggacaaactcgtggacagaggggtgacagttcatatagtcatgaagagtcggacatgactgaaacaaattagcacacacacacaagcacacacagcactaatgtaggggacagtagggttttggtccttctctggaggtttctaaaagcatacatggaattcatcatgtaggagtctctcctcctacacaagtgtgaacagactagataccatctgggtgtttcttcctacctgaggttgagaaacattccaggtgtccggacatatcagtgcttcccctgaagcctcgcttcagctctgtgttgtcttgaagtgacaactatggtattccaagcttcacaaaatgtaactgtcttgtcaaatcaatagacgaattttcagggaagaccaaaaattctgtcaacccattcagcctttctaagactacgcatatattgcctttcaatcaacccagacacccagaataaattgaaggagaaaaaacttccagagtagaacttacaggcagaggttatcctgatgaaaaatgcaaatagaggagagaaccaataaaatcaaatttttaaaatcctattatctcgttttagtccctgctcacctctgcacaatggtccattacaatgtggtttccagtgtcgttttaaatataactgacattgtttctgatcttaaagaatttacttcccattaccaaggcatgacagaagttctagcttgggatatgtcattttctgccgggactaatcagctagctattttaccaactagaggcataatcactagccattctgtgaagtgtctgtaaactctaagtatgtcagtaactgcagtccaggcatgccgctcacttataggtagctccttttccattatacagcttttataaagcatgtagacaaacaagagcatcccatttttgagtaattctagatctttccagttggtttcctgtgt

SEQ ID NO: 25515 - DNA, 1588 bp, Bovine  19866881256421
tggcttattgttgcctgaaacggttgtaagtttccagttgaagggaaacgcatcttttaacctgcctggaatagccctagaggcaaagtccttgagttctttaatgatgagtggtgttaacaatatcataattgtcaaactcctcaaagaaaagtagcatggaaatgtaaaccattcttcatcttaagctgttcttttgtaataaactagtgtcttctctctgaaatgtatcttttccctctgtccactggacagatcaggggagtgatacagtttggctaatgacccattagcatccagatcccaagcaccttggcacagtggaggaatgttaagttctgtggattttacctctaggacacaagagtggtggtgcccaatacctccatgttgtcatgccctcagccccgtagctcaaaaacagtgaatcagaacccagaagtcaacatgaatgggtaagtgaagcccctaaccaacagaccaaactgtcaccatgccatagagggcaacagaatccaaagcctggagaggccccttgtccacacttcctctccagcccgtggttctcctcttggggaaagagcatcagtggagtagagatgccacaaaagcctgtgacatattttggcccccaaagaatctttttcttgctgcatacagaaatcacacctcctaattatgccatccagtcctgagaacattaaaaggctagtgctctgctagtgaaaattcataggcacctgctcttgattttcttcctacttagaataattttcacacagctgtgatattgccaagtgactattcaaacgttgaggctcagacaagaagggatatgttggatgtttgggttgtaatgatttcagctcttcctctttttttacagcatcattagtaatctgtcattctaataataataattcccttttgacatcatggaggtaagaagaaatcatcactgacatcaaaaatgaggtgatatttcagcagtattatttcactgaagataaaatggaaagctttattactccccatgcctttaaagaaagctgaacaaggcatatgctgaccctagagtttatctacttgagttccttccagactgatatgaaataactaattttaattgttccagccagagtttcagaatgtggtttcccccaaagctttccatctacataatggaaactttctcaaaaacaagctttatccatccataacaaccaggggaatcaaaagaaaagtctattgtaactaagaacaatttataattttcattcttcagcataccttttgttccaagtatttagaaattgatttcactcaatcatgcagtcaatactggattgtgtacctgttgcgtattacacactgggactgggtactaggaagacaaagatggataaaacagaatccttggtccagaaaacggagcaagcacacaaagaaagggccaagataatagagatcttgttcaaggataatgggaggaagtacagacaaaccctgacttatgtttttacttatgaacttgcaactttacaaggtgcaagagtgatacacattcagtagaaaccatacttcaaat

SEQ ID NO: 25516 - DNA, 1916 bp, Bovine  19866881260460
ctggggattcagaaatgatagggcactccatttaatggttcatacttaatgtgcccacttgcctgttcttcccagctaaatagttaaagtgccatagctctgttgtaagctacagtgattgcccaatgcgtggtttttatgcaacgttcatttattcgtgtaaccaacagatagttattacctcttaataagagtcagatactctgctatgttttgaagttacaaaaagcaacatgtataacaatgaattaataatttgaatttattaagaactctgcaaatcagtaaggacaaataagccaagaaaaaatgagtaagtgatataaacatgggattcacagaagagaaaaatataaaaggctaaagaatatttgaaaaggtgttcaccttcactaagctagggaggaaaagcaaattaaaatcagcacaagatactattttatttttacctactagtatgacaaaaatgaagtttattaatattcagtgttgttgagttgtgggaaaagagctgcttcctgtgcttctggtgggaatggtaaatgatccctggctttggaggccaatttagtatctattaaaattgtttctatcaagaacaattggaaacaacctaactgtccctagagtggatagataggacatggtctattagatggtgaaatattactcagagaaaaaagttagagctatccacatcaacatggattgatctcaaaaatgtatcatagagtgaaaagagcgagctatagaattgtatgtattttatgaacatttatgtgaaaagacccacaaaaattaacactatctattttcaatggcatagctaaacagcctagtaaagacacatattagattatagtagaggttatttcttgggttttggttatctcttgggtttgggggaaaggattgaagaaatctaggggacttcatttatatttgtaatattatatattttaggcaaatatatcgtataaaattataatttatttctaacaattaactagagagaaacaatgtaaagaaagcaattcttgtctttgactgtggacaaagctgggattagaacccaggtctctaatttttagtgcagtcatttgtctcttggatgttagatacatttaatttgacttgctctctgcaaagtgagatcttttccagttggcatgaaagttaaggcactttatttctatctttgtagggaatagatttttctttacttttttttttttgtctgagccacatgacatgtgggatcttagttccctgactagggaatgaacctgtgccccctgcattgggagcatagaatcttaacccactagactaccaggaaagtcctagatttttcatttaaatgaatttttaaaatttgaatagatgtctagaatatttataatttatatgttaagtattattgttgttgtttcatcgctaagtcatgtctgactctttgtgacctcatggactataggctcctctgtccatgggatttcccaggccagagtactggagtaggttgccatttccttctccaggggatcttcccaactcagggatcaaactcatgtcttctcttttgtaggcagattctttacccctgagctacctggaaagcccatgtgttaagtagagagactcattaacctacactcagttcaggaatagaagacatgcatttttcaaaatggaaatggtaacaacttttggattctcccatcagagacaaaacctaaagggcttgatagtttcatcagcaccatttccacaatcactagcagccaaacaaatggccctatttggaaaattggaatcttttcctttttgagtgctaaatggctactcggtgatttatttgggctgcttctagagggcaagaagtcacacaaagctctgagtagatgtttccagag

SEQ ID NO: 25517 - DNA, 2268 bp, Bovine  19866881383433
cttggaccatagaggccaggtaacctaagcccctttaaaggataaagacaccaaggcctggaatcacataattagttgcagggtgaaattagatggcaggcatccagaccactgacatcttccttagagtggagctgtttaagaacataaggattatgtagcattgatggagtactttttcttcttttcagagcttcacagtggggagaggctgagttggtaaggaatccagcctctaattatttgtggcttaagtgacgttcattattggctcagtggtggctcttataatcctaatagctgcttccagggatgggtaattccctagtcattatagtcaacttcattcatctcttcttccctagctaggcccatcatttctatctgctaccaatcacctttccccaagccatcctttgcttggtggtatcatttgttaaatctcaattgcggtaacctcagaattccatctctgaaagatgttcaagctaacagcttaactttagctttaagatggcactgcattgacattcaaagacaggatatggggattgctagctgcatggggatatagagtttgagagatatggtaatttaagccttaagatcattgtaaaactgagctactcttcagccttacttttgttctagtatgcagtatgtatgaggcctttcaggtacatgcctagttcacatcttcatgtcaccactgggagtgacttggcactcacggcactgaagctaattcttgagccactagtgcattagtgtgggctctacttgactggttatttcaccaaagaaacagtctttccatttgtgaaggaaattgtgaaccaaattgctacatgtatgtttgaagatgtgcttttaaaatgacaaaacccctactgatctaggtagaaaataaacttactctttagcggaaagacctgcctgctaatcattcatttacttatcaaattttaaaacaaaagcaaaacagaaaaagggaattctctgatggtccagtggttaggattctgagctgtcactgccgagggtacaggtttaacccctggtcagggaactaagaccctataagcactgtggtgtgcgtcctgccctccaaagtaaaatttaaacagatatgttccatgttttaggaactgttctaggtacttaagaatacatcagcaaacaaaaaggaaaaatatcccttttctcatcttgtgttaccaatatcttccctgcaagtatctcatccctataaagatattttaaaaacaaggcaatgtcctgtgaaaataactggctttttacacttcgtctattttttcctatcccttcctataaattttccagggaacatttaatggtttgttactttctttgtagtaattccctaatactaatttttagtaggatttttagtttggcttctttctctatttctccacttgaatgatacaggtagtgttttgacaaaaggaagagaatcatttaatttgataattgtcaataggaaaaagacaagctttgaaaaatgcattaagatgtctgtgggtttttttctctgaactggatttgactgtcatttatgcttctctgatggctcagatggtaaagcgtctgcctgcaatgtgagagacccgggtttgatccctgcttcgggaagatcccctggagaaggaagtggcaagcccctccagtatccttgcctggagaatcccatggacagaggagcctggcgggctacagcccatggggtcacaaagagtcggacacgactttcacttttcagtgacacacagcagtatgtgagctcacagcagtgtgtaagctcatggcagtgtgagctcacggcagtgtgtcagctcacagcagtgtaagctcacggcagtgtgtaagctcacggcattgtgtaagctcacagcagtgtaagctcacggcattgtgtaagctcacagcagtgtaagctcacggcagtgtgtaagctcacggcagtgtgagctcacagcagtgtgtaagctcacggcagtgtaagcttaaggtgtgcaacactgcttttggatgacagcttgatagattcaagttttacattttataactagaaataactcacttgaaaggcaaatgttttaattatggttgccaaagcagaaacgtggtggaaaggggaggggtaaatcaggattttgggatgaacacacatatacacgctactgtacataaagtagaaaaccagtaagacccactgtgtagcacagggaactctacccaatatct

SEQ ID NO: 25518 - DNA, 1193 bp, Bovine  19866881434397
agagtcctaaaagtgctagcatacatctggacctcaggttggtcgagagaacaggatggttcccagccatctccttccctcccccatcaccactgcttcctgcctctatatgataagaaagcagcaactacagtaccagtgagggaatcatcaacagagggggaataacacagatatgctgtcacattatggtggcatttgccaacgtaaaaattattacaacttttgctgtaaattgttctgtaaatttcacaaaatatgcaaaaattgacatttcaagggctgagatcatttaaatttatttaaaatttgaggcccttgagattcagcaaaagaaagtctatttctttatctagctttcatctgtgtgggtcttgttttctttttttagttccttgtttataattcataggtcacaactggccatatttgggctttgaccacttaatccagttttacccatcaatttctcctttgtctcaggcagcagatataaattctctgaatcccaatttttctttttttatcagatcatgcagcaatcctggcctgtctcaaaaagttgacagaaaagcttgtgatatctggaaagcactctaaaatgtttttgacatagattggttccacagtctttacagagcaccagtctttaggatacttttctcattatgttgtcctctcttaatatccaccctaaaacacacacacacacacacacacacacacatcctttctccatgctacagtcatgtcacacatcaccaaggccaagcttccttggttctctccctatagaacattcatcaaaatccatgcttctcacctgagacccttagaaagcttctcttctaaaactgctgctcttgtctgtcacatgccaattatgtctttttacatgagagacatccctgtcagagctgggataaccagagcacatttgccagcccttgaggtcacatggccatggtatgtgtgtactggggattagtttgttaggtagcctctgaaagggcccgtgtggcaggttacttctgcccctgtcctcagaaaggcatgttaaagcagaaatctttatcagaaattaaactcttttctaagttgtcttctctccttctccctcaccacccttagcaccatacccccatgctcttgaaataaagtgtaagggagcagttattatttcgattttcaat

SEQ ID NO: 25519 - DNA, 636 bp, Bovine  19866881562726
ttgatgactgactagaagtggtgaaaagaggctgggatcctggataatgacaatattcacaaagagtccaagaggaaaagtctggctgaaaagacatgaatgctgttaggaagaggctgaatctgaggtacctgagagacacttaaatggaggtatacagggggcagttgggcacatgggtccggaactcagtagagaagcctgaacagaagctagaggcatgtggattttcagtacgtgctggtaattgaagccatgactgcagacggggcagccagggaaagcaatcagagtgggaagagcagactgaagcaactctacatttagaagatgaaagtccaaagggacccaataaagggaactcagaaggagctaacagatttgacagcaaagaggactagccaaataggcaaagccaaaggaggaagggacaaccagcagatcaaatagctcagggaggacaagaaaaagaggaagggacttaccaatttgttttgcccatatggggcttaactgatgactcattgattgtggaatgataagggcagaaaccagattagagagggaatgagaggtaacaaaagaagagataggatcagacttatcttttgcaggaaggagagagaggatgatgag

SEQ ID NO: 25520 - DNA, 622 bp, Bovine  19866881669888
gtaatggatgtggcaaatgtgtggattttgttaggatttcttctgacagccatgaacacagatatattttaaagtaatgtaactgtcctaaatctcgagcagggaatacaatgacttctagtattatttttcacttctccaatgacactccagaagttatatttgataaattccttagaagttatttgacttaggaagggccctgtaccatttaaccttggttttgttctactcagacctgtgtccaaggcccatctaatgtaatatatcacaaaggttaatacgccaaggccttcccagagcatgattccctgggaccgcttttagggaaaacaaccttaaagtgaggctttttgcaacaccggtaactattaccagtctaggtttaagtatgcctcttttaagcccctttctcctctataaaaaagcataagagaaaaaacctagtgcgtcaagaatcaggaaaggtggataaatatacataatcttctttggcttggccaatctcaagaaatagaagctggaaacaaatatagactatcaagaattgtgctgctcttaaaaatgattagttctgctttatattcatgatcactgaaactgccatgtatgatataatctg

SEQ ID NO: 25521 - DNA, 656 bp, Bovine  19866881768400
ttgagtatttttgccttaaaacaaggtagagaaaaaaagacagtaacttgaggtcagaggcccagttatacactaattctgtatcagtaaggctcacaataattcggaaagagggtccatttattttttttatttttttatttttttaagagggtccatttaaactgatgcttacagaggcttttgatttgcccacagttgtatagcagggaagtgaccattaattcaagtttgtcttcttttttaactcttagtacaaaattctttatgataaaaaaaataaaataaaataaaaatggcttatacttgaatgaaggtgagctgagcctgggcaggtagctgtgacccctgggccactacacaccaacaaagacccgggcttcgtagcctgctctgctgctgcaagtcccaggggatacatatgacaaacattcttcaccagtaacttagtcgagaaacccaggtttaagaaataaaaggaaaataagactttccatcctcacatattgcatggacaacttcaaggattcttagtgaagagaatattgttaatgacaaggagaaaatattttgattataaatgttaatggactagacagaacagacaagtgaaagacgttagcatatgttctcctgttaaagaagagtgactattt

SEQ ID NO: 25522 - DNA, 994 bp, Bovine  19866881820768
cctgggagcttctgagcaacagtgagcacctctgagcctaactgtgggaggtcactggaagcctcttgaaatgcagagtgaaatctgccgcctgacacgttcaccctagctgtttggctgctttgcatgcctatggggcaagcaggctattttgagcagatttcataaccctctttgtagctgctgattgcacatgtgtttccagctccgttcttgtggcgagaatgtttacagagacggtgcattgtcagagaatgaagagaaagcaagattgggagattaggaggacaatttccatgtctagacagagttcgcacagccggcgtctgcgccaatcagggtccctggaattcggcaccctgtgcagaacaccctctgaaccctttgtctcatccggagaactctactctgaaatctcccaggtggtggcaaggggagaagagagctctagggcatcctttctgagactaaatccagagtggatttctgagtgttgtcataggaaatcaaaatattgggaaaatctgtgaaagcctgcatacaattttcttaaaaatctcaaatctcaagcctgattctagcgctggtgcacgctgcctttcaatgtcttggccagcaggactgtcttcatcattgtgttgcttatttatttatcccagtctgtttacctcctgtcagcctgatggtgcgcctgcttacctgtcttgtttttaatttatccctttgcttccgtttgccaccctggcccactgcgttcacgccgtccaaaagcactgctactcagttgcactcagctttcatttttgagccccaccatgtgtgaacaactggctccatcgatccccttcttgaacctttgattccatttgttatgtgtcccttttgccctattctttcctcctgactcctgtcacatcctgggtcatgactgcccatcaaaagctacctcagggcaggatctgtgccaatttactattaccaccatcacagccat

SEQ ID NO: 25523 - DNA, 980 bp, Bovine  19866882133081
tcatcatcctggggtacaagaacaactggggagctgagagagaaaaatactttctcttatggaccaatcgcctagcatacaaaccactaaaatggcttcccttcccccaaatggtatctttcacttattactaacactgaaaatttctttcagagacaaagcctgtctttctgcaattagagaaaacaggcttaaaatagaagtgctgtgggatggtaagcacaagtagaaattaggtcaaacccatgtgtgaatgtctaatgtcagatcattgccagttttgctagcagacagaggttagtacttcagaaatgctgggaccccggagggcccaagcatcatcccactaaaagaaaactggaacatcaaagaatatgtaggcatgtatcaagatattgttcagagtttgttctgttgactttttatggaaaaccaaatagaacccaaacagatattgactcttatctctctcttcgtcacctctgaagagaccgtgtcttgaaatcctactctctgtcttcgtttcctggcatctggccttctgaattcatattctgaatcctacaaatcatgaatacctctaacctagctatttccaggtctctgcctagatccctccatcctccagttctttcctcaagagggtaacttgaccatgtttcagcttactcccagaatggcccttaaatttcctccaaggtgttgccagatcctttgaggacaatgatcatctctcatgcctccccatgcccttgattatctgatcattcgtccctcatattaacgtcatccacaacggctcttattgctcctttcagttatccctctctccaaacaattaggtctccacatgggtagacagtcaagacagagggttttctagggggagaaatgaatctgatgccttttatgtgcctgcagagctccaacttggtttaataatccctgagcaccactttgcgtgcggcaaggtataaata

SEQ ID NO: 25524 - DNA, 707 bp, Bovine  19866882211335
ggtttttaataggatatttaggactccagatctatcaaatggccttctccgatggatattcagggtgtcagatattcagtatgccagaacacaggttggagaactgtgaaggaaatataaagtcaatgaagaaggtagcattcgggggcttcagggagtacaaagataattgtggatcaattgtgccagacaatttgaagcaacttaagactgccgtcagtactttaattgtttctgctgcagagtttgaaagagcatttagttcaatgaatgatgtgttaacacctagttggcgatgttctgtccattagttgcatatcatctttgtctttttattaagctggttggtccactgttccacatgcttaagcctaaagattatgtcaagaagtggcttgtaagtggcggcttgaaagccagaaattgtagaaatgtgacaagagaagctctcagctcttctgtcttacttttattttatttgaagagtctgaactgtttccccctccttaagcctgggctcctgggcattgagcgagtcaaaaactacaattttctcatgtaatgaaataggctaaaacgagatcatgtcagtcctaagttaggtaactttttcactttgggaaaatcaataatacctcccctatgaacacccaacgtatggtggatggaaaactatatgcggccctctaaggagttagtaagggtcc

SEQ ID NO: 25525 - DNA, 2004 bp, Bovine  19866880466733
tttgctagcccaaattatttcgctcagatagcactcagggtattcaggccaggtccttactttaagccatgcagcccgcgccacacctcccctgcccagcccccacttgctaatggcgggtgcaggcgtctgcgctgcttctccactgggcgagttaccgtaggtattgaaatctgcgggttttaattgtttatttatttttcctccatgttatgttgccctttgtgcttccaaagctcggcacagattcggcagtgagaaggtttcctggtatttggaaacttctctctttttaagactcccttcccgggacagaactctatccgtccctcttttgtctctttttttgtcttttttattttttcctacctcctttcgaagacttgggatgcttttctgggtgcctgatgtcctctgccagccttcagaagttgttttgtggaatttactcaacgtttaaatgctcttttgatgaatttgtggggggaaagtgttctccctgtcctactcctctgccatcttggctcctcctcccatagttgactcttgaacaacaaaggggttagggatactgaccctccaacagtcaataattaacatattacttattattttgcctccaaatactcagttactccaattctgagattctgcatttgcagattcaaccaaccctggatcttgtagaactgtagtatgtactattgaaaaagaaatctgcatataagtgtactcatgcagttcaaagttatgttgttcgagggtcaactctgtgtgtatgtgtgtataatagaatgttatgcagcctttgaataaaggaaatcccgctattcatgataacatggataaatgaggaaggcattatgttatgtgaactaagctagacagaggaagacagatactgcacaataatatgtctgcatgtctacagagaatagaatagtgtttgccaggggctggagaatgggagaaagaggggaaggctgctaaaatggtacaaaatttcagttaataagatgagtaaggtctgagaatctgatgcagaacatggtgactataattgatattatggttcagttcagttcagtcagtcgtgtccgactctttgtgatattatggtattgcataatcaaaatttgcaaagagagtaaaacaagtgctttcattaaagaaaaaagtctatatatgaggtgatgaatgtattaattgatggtagaaattcttttacaatatatacatgtatcaaatcattgtacaatttaaataattacactttgataggtgaattatactgcagtgaagctgaaaaaatacttgtaaacgttgtgaattttatgttgctgagtatctcaatttgttgccttttataaaaataggattgtgctttacctttgtaggaagttaaattgcagaagagtataatcttttcagaacttgtttttcaactctttcttagtgtgactctagagtagtatgttttacaaatattttcaccttactaataaggtgtgaccctgcaggagtctcttctttgtaccctgggtgattaataaggatgctattctggctgattgggtcatgactgcctcccagccccatatgaggtctagtaattgtttggcttatagtttcatagtctttctttgcccatccctgtggaacttcactctacacatgtgcagcttagtattcagcaaagactcaatgagacacccacacagatttgtggatttccttttctgtttcagttcagttcagttgctcagtcatgtccgactctttgtgaccccatggactgtgtagcatgccaggcttccctgttcatcaccaactctcagagcttactcaaactcatgtccatcgagttggtgatgcaatccaaccatctcagcctctatcatccccttctcctcccaccttcaatctttcctagcatcaaggtcttttccaatggagtcagttctttgcatcaggtggccaaagtactagagtttcagcttcagt

SEQ ID NO: 25526 - DNA, 1770 bp, Bovine  19866880468388
cttgcagggttgctgtgagaattcgagttagtaattgtccaaacacatggctcatagtagagactcagttgatagcaactattacagtaattattcaatcctagactctctgcaacgtgtcacagaaatcagctagaaaaggtgatggggaattgctgcagtagaaatgaatggtgcaattttatcacttaataactctgggattgagaaaaatatataacctctccaaatccaaacctctcatctatattacctgatttatagggctgttggaagcattgaaacagccatcatgaaaatgtttccactttaaatgtaagatctctggatacaatttgactcaaatgtgcgctggtagggatgttccttagtgaagatgagggaatctgaggtgtgccttcatagttctgaaagcagttcctaggctaggaaggaaatggtttttgcagttctttcttagataaatagaaaaactgagacttaaagaagttgtgacatgcccaagactgcgacaaagtcaaatagtaacttggttctctggtctggcagtttctgtcgaacaactttaaaagcaggagatggcccaatgtcattgccagagtgcttcccaccccctgaccccccaagttttcacgaaggaggctagtggagcctgcaataccacttttgcgagaatttgtcaaatggttctcttgtcccagaaggtttacagtatgtaaagtttcaagcaatcccagggatagattgtagtctcaggtactgtaaagaaaatacttttaagcttcttttaaaaataaaattcctctgagatgtttggcctgtggctaatgtgtttgaaacatattttctgtaaaactcaacctcatcaatctacttgcaaatccagaaaggcagcttttatcacacacatcagggcttgtcccaaactctccccattcacagtgggggataaagagaaatgaaccgcaggctcaaggtgtctccatcccgttttcccccagtagttcagccactgaggatgtgggtctactgctacactcagcctcagctctggaagccagtgcttgagcccagactccaatagagagaccattttcttacccttgttttagcatttctcactccctgtgcctagatggagcttggaaggggctgaaagctgtcaccctcttacccattagtagagtccttcctctccaagaaaggctttctccccacttggagtcctggttatgtctatggctcctcaagagtcagcctgtgatggttcgactattcattcatcagaactgtcagacctgtgcatctcctctcccttcttctggctacctcactctgaaacatcatcctccacaaattttgaaatcactgaagaaaggaaacaacgtaaaaactcgattccaactaacactttgtaatttattgctgtatagctggaggagttgccatttaataaatggaggtgactatctcaaaagggagtgaagtaagtcagaaagagaaaaacaaatttcgtatattaacatatgtatatggaatctagaaaacaaatggtactgatgaatgtatttgcagggcaggagtagagatgcagacatagagaacaggctttggacacaacgggagaaggagagggtagaatggattgagagagtagcattgaaacatccacgtaaaagagatagttaatgggaagttgccatgtaacacagggagttcaagctggtgctctgtgacaatctagaggggtgggatggggtgggggggggg

SEQ ID NO: 25527 - DNA, 1098 bp, Bovine  19866880532486
agctggggttcgccctgcccttaggaaatctgatgtcatcatagagggaaactgaagacatggaatgagcacgatggaaatatagtaagaagcacttgaaagaggaggagagtgggaggaagtgcaagagcagaaaaagtgagcagagagagagagggcaggaaaatgacccaggttaggggtggggggcagtggccaaagtggaaagaggtggggggacccagagggcaaaggagcagtagcaaggagaggggaaccggagggagaaagaaatgagagaaagacacacagactgagagaagactttgaagatggccttggccccagctccagtgagggcaaagaagtactcgcacaaatcataaacagacatgctcttcatcctgtgctgacgagatgtgattcctggatttccctggagaaacagtccaagcaaaggtaaccagagccacttataattagcagctccttccctcaagaacccagatttcactgaattggcttctggtgaccgtacaagataatcctgatgatgtttcaattaacagtctatgagaatacaatttctgctggaaaaattccaaatctgagcccaaacccaatgacagcattgccttggcagcatgacacgatgatttcatttcacaggttagggtaaggccatatcccagggtacaccatgccttgaacacaaaagttcctcatcacagagccgctgtgctgggtgtgccagactgacccctcaaaataaatgtgatcgtgacctcagcattatcagatgcagataaaatgccttggaagagaaattgtgagtggaaaggacaaaaggacaacagcaggggaactggggcttccccttgatgagagatccagctggagtcagttagagcataaactttgtttaatcaaatcctcactaataaactccctaaccaaatcctaacacaggtaaacgatgatgcacttggaattcacattgagcttgcatcactgcttcaccaggtgccatgcataaatctgggatgcaggcttctggggctggagctgcagagatgttgtattgggggtatgctcccaccactagacttgtgccactgc

SEQ ID NO: 25528 - DNA, 3125 bp, Bovine  19866880534963
ccgagaagatagatcctacctgcctcaggacaagtaagcccatgtgtcacaactgctgagcccacatttctccactactgaagtccaaaagctctagaacctgcggtccccagcaagagaagcagccacaaagagaaacctgaacactgcaacaagagcgtagcccttgctcacaactagagaaaagccggtgcaacagagaagatccagcacagcgaataaataaataacattatatatatatgtatcttgccaaacagaacttatcactgcatcagacctgatccattggtccagtttgtgacccctgaactccaaattagtgcctccattttaattaaaaacaccaggaaatttggattaaaatttccgccttcttagaggcacactattcaactaccaagcccctctgtgtgccaggcacagagaggattctaggatgttctcattttctcatgacttctctgaccacagagccttctcctcccttgttccatccattaggatttctatgcatgggaaagtggggaaaatggaaatagaaggggaggaaaacctaggcatggaaggaaagttggacccatgtcccattccacaggtgggggtaaaactataaatggccatctttgtttcctcagcagctggcccacagctcatccatcaaaaggctcagtaacgattacagcatacatcgatggattacctactgtatgcctgcctggcaagggcatcatcatattagtatatattttattcttcataacaggacccctttgtataagatgaagaagccaaagcctaaggaagctaaataactggctgagttcatagagctctcaagcagtgggactaggatatgaatctccacgtgtctgactccagagcactcatttttaacattataaggagtgaatgcatgaatgagtgagtgaatgagtgaattaataagtgagcgaccaaagccctcaccctccagccctaccctgccaagcagtgcctgcactggttctgagacttaaaagacctgaatggcaaatttgcaggtttctcagaggaatcttagggccaccagttctcttaatgtctcagggggctcctacttgtcacaggcctcccaagagccgtcagtgttaaacacacattcagtccccttcctgtcacgctaatacacttggcatcatttgcctcttaaatatggtgaaggggaaagatttcaagaaagcagcaggttttatgcatcaaggagggctattatttaccagcgaactagtttctgttgtttttgtctgttccctagtgtataatcagagctcataaaagtgctactgtgtgggaggtctacatttcctctcgattaagcgtccccagatgctaatagatcttgacacgccgtgcctccctgcctgcttcggttcaccttccagcctcgctctcccgccctgctgcagcccaggagctcaggtcatccagccctgcggttgcgtaatcagtcactcttctccaatactgcaaccttgatgtctgcctaagactgtctcttgcttgatgtggtcaagcgtctactgtctgctttgattcagaaacctctccttcatcagaatctgactcccaaggggggctgggtttccttactggttttggaaagtaccaacagtattcccctagtgccttcacacgagtccctgggtgacacgtgctggcccgatggctggacaggcagtcagcaagcatttctctacattgcagttagcaaacttgcactttcaggagctgttgggatgaaaccaggaaattctgtggtcctccagatagccccaatgattctatttttgcaaagtatcatacccaaaggatacaaagcatgacccaaacaggagcctctttgcttttaccccagattccctccctcccatccaagaaaagctctaggggcttaatggctccaccctgaggatgttggcctttgttatccaggaaaggacactgaaagggtcttagaatgacatgatttggaatctgcagaactgggggtcacattattgctctgccatgtgttagttttggcatctgaagaaaatcactgaatctgggggttcattttcctcccccacaaaaatgagagtattaaggacaaaaattgcctcccaaaattattgtgagaatgaaataaattggcatgtgtgaacgtacttgggacagagtaggttttcaccaaacgttaaatgattttccttaatgaagggacgaaggcgtcccatctcattttcccttctcactactgaagtgaaagaaggatcgtggcctccagggagaagtcctgctccccaacctgagagcacgtctctcgcagcgtgatggtggagtttgggccattctagtcttgatttcttctctccatctggccaaggagtctggtgggggtttttttttaagacttttttttggatgtggaccatttttaaagtctttattgaatgtatcacgatattggcttctgttgttttgttctgtttttttggctagagtcgtgtgggatcttagctccccagccagggattgaacctgcaccccctgcattggaagcaaagtcttaatcactggaccctgagggagatccctggtgtcactttaaaactctactcttttaacttaatttttttattatgaaaaatgttacacttacaaagaagtgaaaagaacactaatcatgaacaatctaccagccagttagcgttttgccatgttatatattatacatagtgtgtttatatgtgtatgtgtatgtatatatatatttatttgttgaactattatagacttaatgactcttcatcccaaaatatgtcaacaggcatatccaaaggaagtcattctttcacataactacactgacattatacattaaccaaattaaccatttcctaatatcatctaacactcacttcatgtcaaattttctgaaattatttccagaatagataatcaaaggtacattgttgtgtttcttaaatgtttaaaaatctaaagcagacttcttcccactcgcttccagtcccagcttacctgccacacatacacacacactttgtctcctttgatgctaaatttattcctgtactaagatg

SEQ ID NO: 25529 - DNA, 1414 bp, Bovine  19866880545430
atactggagtgggtagcctttcccttctccaggggatcttcccaatccagggaccaagccaggtctcccgcactgtgggagctgagctacaagggaagcccaagaatactggagtaggtagcctatcccctctccagcgaatcttcccgacccaggaatcaaaccagggtctcctgcattgcaggcagattctttaccaactgagctatcagggaagcccaggcatcttctgggttattataaatgcaaaatctcaggcctacctcagacccacagaatcagaaatgtcaggggattttttaacaagatccccaggtgattcatatgcatgttgaagtttgagacccattgctctaagtgcaggctcatctttttaaaaagttgcttcattatccacctctgaaagctcctagtgaccaaatctaagatttcacacaggatcctctgaaagcaaagatttgtgtgttaatctgttgcaacacctaccctggttcccttactaatggctgatccaccatctattcctggcccccagccacacagcatcctccctgccatgcttcctaattggtaatctgccacccatgaccttgaccagatggtgtactgccttgggacccctggcctcatcagctgattccgcactcaggcagagccacattataaagcggggttagtgcctggagcatccatagagatggatgagcctccaaagactgtggcatgcaattaaagggaaagaactctattaagtatttttatgagaggccaaggccctttgcagataagggtcaccagccatgttattcatctagtcttgctctgtcgtccaaatagaaaatactttacatatgaagaggtatggggagggcacagggcagctgtggagtgcttcaaattcattcagataagtaggactctcttctgccctctcttttccaaagacgggaaggttcgtctccttcccataggtagtgttatctctccttttggacagagccaacttgggagtagcatatatgtgtactatgtgattaacttttgtccatgcacacaactgtgtaatgaacactgattctggagattgctttgattaatagggtctgaggaatttcacacttaatattcgagttgagataaagcatgtagcatcctttcagttcttcaggaactgacaaccccatcgcagccttttatgaaacgcctcgaaagaaatcctttccagatttctgagtgtttgccagcaggttagttcaacatcttcagatctgactcgtttagtgttttaagctgctccagggtcaagaagacagagctaagcagtgagactgcgtgtgggtagcggtttaggatgtaggctctgcagctacaatgcctggttttaattcccaattttgctatataccagctatgt

SEQ ID NO: 25530 - DNA, 1696 bp, Bovine  19866880613398
cagattgagcaccagagccagagccatcgtcaatgccagcattactcagatgcccccatggcgcccagtggggatggggccaagccacataattcatggccagtgtgtgtgcttctggtgtgtctgccaaaatgtcagcctgtaggtgacagctattgctcactggtgaaaagccttcttgtgatttgcactctttctgctcacactattttgagaagttagaagacagcaagcccgtctccttcaatggaagtttctgaaggctgtagactggtgggccaaagaaattgccagattttcactccagaacttaaaatgaaaaccattaatctgctgcaacatagcagcctgactcctagtggcaagccatttactcaattcagtataattcaatgtggcaaatcagaaggaaatgcttcttttttgtctaggtgtcctgtctgtttttcatagcatgagattctcattcttcttggaaaagaccatttaattggctaacaatgaaaacaaccaagtcttctttaaaaaaaaaaatcactgatggtgactcaccctcttctttgcctttgattccctcctattatatacatgaagtgctccctgctgagagcatgaagcctggataattgaacccggattgagtaatttacacggttctgggaagtaaagtcaacaatccacaaactgaatccacttctggatgctcatccaccgaggacccttgacatccgatcgctctgactttctgttcagtgtttactgctttcgcccatccctcaaaccaaagtcatagctcggtaatttcttgttttagaaagtgacaaacagaacaggcagagaaaacactgtatattttggaataaaaatgaaatcattagggtaagtttctattcttggtgactggaattttactctggttctgattaagcacaacaaagatattgtatgtgatgttttcctgtaaatgtatgagatagttttctattgcatgtccatgaatggaaatattaacagactccacttggctccatcaggctctggcttggtcttcacacccaaaaagccatccaagagagaatcacatcctagcccagagtgagtagtttcgttcttgttgtggttttttggcttttttcacagtttcacaattaagaggaagtcttatccacaaaatatgacagtacatggaatagacacattcccttgtctataaattgctcagtaagtaacaactgagcatactaaacatctgtcttctatgcctacattactgtcagaataatgggtccatccagactctacttcttggtggttagagtatttaagtgaggagggtatttcagtgtctgtggactccctcaaggtagtaaataaggagagtttcatgacagagaagtggcaaagtcaaggcattccataaatcaggagatccccattcaatttttaagtgattaggtaaactcaagaacagaggatatgcaggatcccacctatacattatccatatcacagaaacagaaacccactgtcagtacaaagcccagaggacaaagctgttgctcctctaaaccatcagattagtgagtgtctggagaagggttatgagcagtgaccacagagcaggagccctgtgctcttgtccttcctgccacccactaagcacttgcacttccccacttcaagggaagtttcctta

SEQ ID NO: 25531 - DNA, 1203 bp, Bovine  19866880616657
ccaaacgagcactgctggttggagttgatgtgaaaatcagaagaaattctactcgtggcaaaggtcttgggcctgctgaatccagtttcaaatctggctgtaatactctgcacgccatggggccacttgtagcttccaaggataccttatcctttttctgatctggccctcaaaacacagctattgaatggatagattgatcggcaggcacactttaatttcaagatgctttctgtaggttgggaagatcccctggcgaagggataggctacctactccagtattcttgggtttcacttgtggctcagctggtaaagaatctgcctgcaatgcagggagacctgggttcagtctctgggttgggaagatgccctggagaagggaaaggctactcactccagtattctggcctggagaatttcatggactatatagtccatggggttgcaaagagtcgaacatgactgagcgacttttactcactatctgagtgtgggggcccttttgctcccacagcagctttgtgacaaggggataacctatacccaatcccctatgcttcctgagtcccatttcccttagtttgagaaagaaaaaacattttgatattgcatttttagcattaacagctaggccttgccatgccaatgatctccaggtgacatgctaccaccaatttcctgacagttccatcacttgtctctgatttcagatccttctttctaagctagaagcatcatcccaagtaacacagaaaggagacagtgacctaaatgccttgtctgagtcaactcatttttaaatggctcaccttttagggactgaatagtggcatggtcatcaatttcagtgaggttttggcagcagatgattttacatatccatctaatgaccatttttcatcgaaaaatatttttctctgcttctgtgcaactttccctccctcctagcttgttgtggacacacacaattatatatgaatttggaatactggttgggacttaattcatggagaaagttaggacttgtgtgctcagttgcccagctgtgtccgactctttacgaccccatggactgtagcctgccaggctcctgtccatgggattctccaggcaagaatactggagtgggttgtcatttccttctccaggggatcttcctgacccagggatggaacttgtctcctgaattggcgggcggatt

SEQ ID NO: 25532 - DNA, 2087 bp, Bovine  19866880629969
tttagactattttatttagaatctcaattattattttacagaattataagctgttagagctgtaaagagagtgactctggcatgtcccttgatggccaaattaaccaaggccctgaggcctggctgcttatattttagcctcaccacttatccagctgtatgacctttagcaagcgacttaacctctctttgcctcagtgtctcctctcaaaggtcagaattgagttgttgagaggcttaaaagaaataagcatttagcccagggcctggcacctagctggtgctgcataaatgctagctcttcttattaataccattaaagacattcagctataatctggcagtgggttactggcaggctgggtgcagaacagaaagtgatgccccccgtccatcccatgcccttgtccggctgtctctggcagaaagaaatcctgtttacgttacagtcgttgtttatatcccaatctttttggaatggctggccaggcacatgctcagtggccccgtctgagcaagtgcgggaacatggtctgcagctgcaggatgattatctgcaatcatttgctgacaaagacgctgagtaatgaactaagatatttgtttttgaaataatccatcttcttcagccttaccaagtcagaggaaggaagctactccagctatgactaaaacttgccaggccccgtagagttcatagcatctttgccgatggtgattgctgccttacaggaaaagtagatcacaagaagaatatcaacacaaaggtatcttcatagtcaaattcatgctcacttatccagggacttggagaaggcaatggcaccccactccagtactcttgcctggaaaatcccatggacggaggagcctggtgggctgtagtccattgggtcgctaagagttggacacaactgagcgacttcactttcacttttcactttcatgcattggagaaggaaatggcaacccactccagtgttcttgccttgagaatcccagggacgggggagcctgatgggctgccgtctgtggggtcgcacagaatcagacacaactgaagcaacttagcagcagcagcagcggcatccagggactggggacagattttggcatctgctggatcattaacttcttgagatcttaggtgtttttctcttcatggggctgtctcagagtaggcccttgtgtgtgtgtgtgtgtgtgtgtgttagtcgctcagttgtgtctgactctctgtgcttcccgtgggactgtagcctgccaggctcctctgtccatgcgattttccaggcaagaatacttggctgagtagccattcccttctccaggggatcttcccgacccagggatcgaaccccacgtctcctgcactgcaggcagattctttaccatctgagccaccagggaagcccttaaagaatgtttatgcaacagaattgaaaattcttcccacagctggcaccagactattcaaagtaacatcattttttaaaatattatattgattaataacaagaggtcccaatttatattcctggattactgggtgagccccccctgtcatgttgacaatgtggtgttttatttaggaaggagaatgccccgtggctgggctgacaggtgcactgctaaggaaccaactgtcttagctctgagcaaagcctcattccaccttcattaccaacactaaaacacacaggtgtcaggcaaaacaaactccttatttctggcttgcttatttttcttgtccagaatttctttggagaaagctatgctccagtccagccatcggttcccttgtgcaatccactgggatggcaatcacctcattgtttagttacaacccaggaaaagatgaaaagaaagaaaaaagcagagcacacacatacagaatgagggtggaggccgcacaatgataatgaaaaccatttgttagcatttcactcctttctttgtgaatcagctgagttcctggcaccacgcctctgtctgtgaaagggagctgcacctccaaggccttccagggactcatgccaccatgtccgggctagagtgtcaccctttgtccccaggcaggtgcttga

SEQ ID NO: 25533 - DNA, 979 bp, Bovine  19866880654445
aaatagttttgatgatagatcagtatgcaaattgcagcatataattcagaaggggtttaaagagttgattggcatggctataacaactccttccatcctcatctactcatttatctaaacaaaatttctcagcattaatatcaaagcaataaaaaatattaaggggatttacactgggacctgtgttgttctagcaataaggaatattctcattcatggatacatgagctagtagaaaaaaatcccaaccccaccaatctcattaacagatacacctccaggaatattttacttctatgtttaatgattgcttatttaagatgtatttgttattgtagtcaactgtatactaagaataattttaataatactcagtctagaagaaattagttaaaacttgaagctttatggtctcaggaggaaacatttaatctcttttaataaacatataaaaatatttgttcagacaagtataaaagaacattcaagaaaaatctttcaagcataaaaatgcattgctttaggattacatttcattgaaataaaatacaagttcaagaagaaaaaagaaagatgtaaaactttcaaggagcttgttcacatatttttaacaggtgatgaatatataaatgataaatcattatgttttacaccaaaaattaatgttgcatgttaattatacctcaatttaagaaattattttgaattaagctgctcataaatataaatgtttaaaaattgaagagaacatcacctgaaagttttgatcaaaaatttcatgttgtcatttcagatattaaatctgaaaaagaaaacttggatgatggtaggtagcagatcacactagtttctactgaatgcattaaaataagggacatgatcattttctttcaaaatatttaaaatacatcataatgatatcttttgcatacactcaagtttataacacatatcttatgtgtcaatttaatgcatgaga

SEQ ID NO: 25534 - DNA, 2157 bp, Bovine  19866880671022
ccccctgcagtggaagcctggagtattgaccactggattactaggaaagtccccaaatgctccattttttaatatgtggtcagtgttgcaaaaattcaaagctttgccagaaatagaaaactatttagaccacaagtgtatttaaacaacaaatggttacaaacacattatccaaagtaaaaataaaaatgagacctggggttaacctgaaatataaaattccaaaaccggtagtgtattaagtcttttataattattaagaacagtcctataagctagaaatagatgccttttcttagagcagagtcttgttatttttaaaataataaaataggaatgtattttaagcagttaatgaaagtcttacccggtagcccataatgatgtatcacacataaaagtgccacttataaccagtaattattggttataattacttgttaacttgagttaaacatgcaggcagtttgctggcctttttttaaaatcagtattcattatttgaaagtcattaacaagtggtttcttctgtttcagatctttggcatggtattcagcatggtcctttgctgtgcgatacgaaattcacgagatgtgatatgaagctacttctacatgaaaagtgtaatctagagtatacaaatgtcacaggggctgtctcctggctcatttttaatattcaaaggacattaggatctaaaatattttgctgttaactgtacatttgcacatgtatgtgtgtttggctcaagactggtttgcacctttaatgaatgcctatgtatgctgactgagagcatgttcatgtgtgatctgtgtgtttctggtatatgcataatgaaatctggttgctgggaattcctgaatcttggtatgtgagcatatttaactctaagaaaaagatcaaaaagctttgaaaaaagaaacttggttgtttagaagaaaaatgatagtaggtcagtttctcagactctagccataggaagtaagatatagagaattcagggatttctaacttatggaagcaataagccacagagattgagagatcatggtgcagtggtaaaagcgactgtgtttgggttaggtgtacgggtttcctgggatttatttttatatatgtaatctctccagaatttaggattaaatacacctgtaaaactaaatatagcatggaaaatctaatttgaataagtcatactttcctagtattaaaaaaaaaaaaacctcactctggaaagagtgtcacagacaatcacatgctctatgaaactgagtgttttcaggactaaaaggaaaaccttttaacaactttttaaggaaatatttttgttcttatataaagacatttaaatattgctttataactttcctgttctgactcttctctgaaccactgccaccctcacatccgcaaaagggctttgatctcaaacttttctgtgtttcttcagatggaagcatagaaagactaaagcaagagatctggcaggtgcaaattgtgggaaagaaaatttttactggcactgtatctttgaaatacctcataacttgagtttacatattttcctaattttttctatctttcttatttattcacctagagaattcttctttatagattaagaactacaagttttcaccacgtaaaatagattatatcatgagcatccttagctaaaccaaaatagaggaaaacatcctctcctagttttgtgcacacaacagagacaagctaaggaaataaaaatacacacacaacagaaacatgttccttctgtgcaagtctctttataaaattaaaatgtttgtgttctttatggtcttgagtgcttcgttgtaatcccaaatttataatctaaattgacagtgtagtgtacatttttaacaacttgctgcatctagtaaaacatagatttttttaaatttacattttaaaaggccatacaaaaatgaaagtatgggggacttttgaaacccccaaataagtttatactcgtgtgagaacacaagtctttgggtctgcactaaaggaaagtgtacacttcaagaaactttcacaaaacattttgctgaaaaggcctatccgtttgaaataatctcactcccttggagaaccgtgtttctcctgccatacttgctactgctaataaccat

SEQ ID NO: 25535 - DNA, 1460 bp, Bovine  19866880680791
ggagattgcatttggaggggggtcctgagtggaaccctccaaaacagtgcttctcaaacttaggtatgcatcagtatcagcagtagggattaaaattcagatttgctgggtttcactaaacatggctaggcctatggtagagcctaagcatatacatttctaagaaattctgagatattgctagtattatggtagacctcactttgagaaacactgctttaaagtctgagacccagcattatcctggtctagaaggaataccggattacagcagtattccttcatgccctgaagaaggaatagaatgtggtcctgagatgagctggcatttatttccatgcatttataaaagtgaaaaagctctctgattaagtgattactgcatgagaaaagacaaggttttaaaaatagatatgcatttggggctgtttgttcctaatatcattgcattagaaattggtaatatttaaatcagatttaattttagagccccaaccttcactagcatgagactaaaaacaatgacaataatatctatggcaatcacttagtatttcagtattctgggcaggaaattgttgtctccagtagcaaactacctgtacctacactgaacaagagaataccagaggagatgcaagacaggctctcaaagatagcaaccagacatctagatgtggttggcagaggacctggcatgcaaagggggctattgtggttgatctacagcccatcccccaagaaggcagttctgcctaggagttgtggaatgtttgatttagactgaccatccctccccttcaaatcagctagattggaggccaccctggtatatagtggaatatatagaatgttttcagagagagtcactgttacttccctgattgttccctagattaaagtaggggcttttgtgtcacattggaaggtatagtcagcaggtaggccacagcagtgagttctgcaagctcacaagtttctgctattgctgtataagaccaccacatactcttctcaccctccccaacaccccctcctaagccatgtggggcttctggggctctgtgatagctttccttcccttcttccctgatgaactcctattcatccttaagaaccctgctcagatgttacttcctctacgacctggccagataaaacaaattcttccctctgctgtttcccacatcatgtcagaattatctatcatacttagcacattgtgctctaaatgctgctcatgtatttgctttcctcacctctagcttctttgctcttgtatgttgtgcttatgtctcattcttctctgtgtccctagtacctagcacagtggctggtgcagtgcctgcaagtttagagtttaatcaatgaaataaatgaatcccagtgtttgtacagaaaggaaagcattccttagatgcgcagtaggatgcaggctggaaatattagtgcccatagaa

SEQ ID NO: 25536 - DNA, 1475 bp, Bovine  19866880688947
gaccaagtgcatatgctatttaaaacaccaagaggctcaatagtgatctatcagcactgatggaatcaccggatctgctcgcagtatgtgtgaaacagaaatattgtcccaattgctggaggaagtgatagcttcagttcaaagatttttttttccttcctgctgatcagagtgcataaacactacagaagaggaaacatctcataatgctgagtgagatgacacagttacagaatcacggagatgatcgctccagccacctcgtttatgcaggaggaggacacgtttcggaagaacaagggtgcagaccaagtagaaacaaccaggggcaggaccagaactcaggtctcctgacttctaggcaagtcttctttatatcacactctctggctgaggaaaagacctcaagaccctgggtggagtggggaggctgataaaggagcagagatcattgcagctgggggggctcccctatctcctctggaggactatatctacctcttctttgatgtctcctttcttcctctctggtctcttcactttctcaatctccaaggtctcttcccttttgcttgtgagcactcacttgccttttctcttttaaagaaacaactggcccttctgcagcagaatcactggatttctcaacttccttttactaccaaattcctcagcaaagtcattgacattcaccatttccttggctccccttaactccctgcagtctggttcctatcttcttccctttcccttccccctactgaactgatattgtcttcttcaaggtcacagttgcaataaccaccccgccaccagtatcaagatggcagcatttattgagcgcatccttgtttcaggcctggacccaggcccgatcagtagccatcatccatttgtagataaggaagctgaagacctaggaggtacttttcttgctctgcctaaatcaatggctgagcagagatgtgacccaagcctgtggtgctcttgctgttaaacactgtgcctcttcctccttttggccaggttcagcagactatgccagtccttggcttcttctccaatgacctccagcgtctaacattttcttttccaggctcttgtgactacatcctggcttgccatctagctctttgatttctctgtctgccctcagagtgcaacttgcctcccaaggcttagtccatgactttactttctttcccatgctcattcctgcaggtgtcccctcctcattttatgatcccaccccctggttcaactctgacctctcacgcatgcccctcagtcactgacattgagtgtagctatgtcccaggtgctcctgtgttcttgttttagaccatatatactgacaccggcaagggctctgctgccatccccccatccccctcagcacgtccacccaaagtctttgttcttaactcaagctgcagcaaccctgtggatctcatccttggaaccagagagcctag

SEQ ID NO: 25537 - DNA, 2119 bp, Bovine  19866880701811
tttgaaatccagtttattgaatttacagtaaaggttttatggggctttcctggaagcttctcattatggaaactcttgtgctggcagtttggtggctggtgtctggtttgctggggagaggttgagtcaggccctgccttgatggaaagttcctctgcctgggtcactggagaggagcaggctgggggcccgagcaggcctgtcaggctcttggaggggacggctgtcctgcagctgggtcccaaatgggcccctacttgtttcctgtgtgtccatcttctgggggttccaaatatcttctcagaggaagctgtgctgaaagccatctcagtcattaaacccattttcattatttttcatgtgtttgaaaagcatgaggtgctggcccactgaccaaaaagaagccaactccataagcatggatttgctgattataaatagcaggaacacacagacacagggccacatctggatccagagcctggcatgaagtgccaccagcttccccgtaccagcttctttgtctggcttttccagcaccctcttggactcccactttacaccttcctcaccactcggctcccgttctgaccctgggacccctgatttcatgtggagaagagcaggggtgtgggctagggatctttgaaggcccagaagcccaggcttggcaggttctttcctgccaaggccctgaatggacactgattcacgagtcagcagccttcctgtggctgctcatgaaactatcagttcctgcggtgctggctcactggtcctttcccgcgtgccttttatttacgcaccgatgtcactggtgttctgttctttaaaatgcagaggcattcagaatgtgctacctggcatttgaatgacaattgtgaaaatcagttaggttgccaaggtttctcagggcactgatatgtgaccagtgtccttttctgtgagggtgttgaggaggattcccccagagtgaatgtggtccctctgcagtgctcgtggacagccccctttctgatgagctctggtctggcacccagtgagctgcccactaccagagttaccagctgtggtttgcatgactgctctgaatgtggttggtctgataatctctcagcttcctaacctgaggttccagggggaagccagttggaataaacagttattagctttagagttcaagtcccagttctcatacatgcttgatttccttctctgcaaaaaaggagataataatatcaaggctgctatgaggcagaaatgaaacaacctggagctgggatgggagctcactattattccctcctcttcatttcaagtcagttctgtgcttagggtacaggcgccacactgtaaacaatcctgcatttaaaagtaaatagctacttagcttcatctgatacatgatatatacacacacgagtgtctgcatcttgttttgatttctccccactgtctgtgtctccaacacgtatgtctgggcgagtgagtgtatctgtccaggatggcagagctccgagcaccacggggcacagttatctgcctcatgatggtgatgatgctaatgacacctgtcttacatttatgattgcatttgactttcacagtaaccctgggaggaaggaaggactaatgggatgaatggtcacagttgattagactgcctaaggacacacagtgaggatagcaccaggaccagacctaggacgcaggccctgctgtggattgaactggagacttcttaggattgccctctctctgcctccctccaactcctccccagatgttcttctttttaaaaaaatatgctcttgactccctttttcctgagcttggcttgagttccagtagtcaaataaacggctagttttccatgtggtctcaaagcagcataaactaaaagacagggaaggcgttccacagaccctccaggtctggggtctggggtagctgagggcttggttgcctgcagcctgaagctcctggggaagcagagcagtggaccctgcagccagaagagttcagggggaacgtggcccttttgtctagggatctgcaggctaactgctttagacagcgatgctcagccgatccatccttttctccctagattaattaa

SEQ ID NO: 25538 - DNA, 1235 bp, Bovine  19866880710990
ccttgctaagccttcaaattctgaaacacagtccaccccaagcttagtctccccagtcacactttccacccagtgccatgctggtctgaaaacccaagaactacaattattgaaagaactgtcgtaagatttaaaaaaaaatttaagatatgagaatcagataaaattaacataaatgaagagcatgaaacattgtaaaaatgcaagacatttttaattgtaaattataaccagttagctcagaggatcagaaaattgcactgctaaggtccatactttgcgatctcattaactccatttattttcatgtcacatcctggacttaaaccctgaacaactgattaaaaccaacacaaatcagctgacgctcatctacaattttttagaatcagccaatagtattagtttcctttacaaagaatagcatgttactttttttttttttttaagggcgccatcgtgccctcagccctcggtcccgagacctacggagcgacagtactcactcccagccgcgcagcgcgcggggattcagcatgttacttttgaaacatgaagaaagaacagaaaggagacactttgaaaggcccaggaaagttcaagtccatgaataagcaagccacctatctagaagtgaaggagatggaggaagaggagaaggaggaagaggaaagagagggtgaggaggaggaggaaggagaggaaggaggaacaggaagaggaggagtcaaacatttctaaatatgcaactgttcactatgatgtagaaatgggagtgctatgagtgacattagggagacttttctctttatttgataacaatatccatgcatgcgttgctcagttgctcagttatgtccgactctttgcaaccccacagactatagccatgagtgagtgagtgaagttgctcagtcatgtccgactctttgcaaccccgtggactgtagcccaccaggttcctccatccatgggattctccaggcaagaatactggagtgggttgccatttccttctccaggggatcttcctgacccagggatcgaacccaggtctccggcgttgcgggcagacgctttaacctctgagccaccagggaagcccacactatagccatgagcaaacactaaaagtgaacctaatggaaaccaaaacaattgttccaaaatgatgaaatctgggaattaagtctaattgtttaatgctagtaaaaacaagttcactttgactaatt

SEQ ID NO: 25539 - DNA, 3380 bp, Bovine  19866880782443
tatagaactttctacctctgaaggaaaggtgctggttgcgtggggcgatgtccatcctcaccactgctaggcagtgtgtgagtcacgcttgttaacacttgctgtgatgccttcctgctgtgtgctgtatacttgcaagaggtatacactacatacttctagaggtatgtagtgattggtatattaaaacgggaaaatgtacaaattatataggaaagcatcaaaggcaggaggatataaaacttggaaaattgtaactgtggcactcagaaataacaacggcaaccagaataacctggtttaatgacattcagaaatgcagtgcccggcattagtatggccaagcagtaggtctgtatacatctcgttggacctgtgcagagtaggttgtttcagtatagaagactatcacatgccttatactagtctttccagttcaaactccaatatcggaaatcgactcaagtgtcatcattttgaatataagaggaaaaaaaagttaagaacttctggattgtcattttagaggttatataattgactctctgcattattaatctgaaggaaacaatattccgtattttgtcatttgtagcaaatttctcaatatccatacctttatttgatactgcttctgagagaccaaataaaatcattattgtattctccttttaaataagaaatgaatggactgttggggtatgtttaactaatctggaggtaccttcatccagaggcagtactctaggagtctatgtccatttatttaatatttgccgcactaaaagcaacctcactgttttaattttatgctctctggaaaaggaaatcccattactctcctcagagtgcccttttaaatacttgaaagccttttagaaaattcttcctattagctaacctaaatcttttaggttaaaaatgattttttttgtcccatcttgggtggggaaaaaaatgaaagaaaaagagtcaccgtgaagtctagccattttccatatcgtttttgtccctctttaattatttaagaactgtttgtggtattctcatgttgggagagtgaaatgaaaagaccatgttcttttatgacttatgcgtctcaatattacgctccattgttcccatctcagactgtattaccaagttaaggacggtttcttattgtagcttttagatatattttggtcaaacactacttgcataatagctaatccttgccaaatttgtgtttgtgcgttttgtcttccttaatgtacaactctgcaattatgcttgtgaaatgtttttctggttcatttctgaaactttcaaattttgttttataattttattgtttgaaggcttaatgatcacaatgatcttccatcactttggtcatatgtgagaatgttaagccatctagactgtgggtttgtgtaataacataacagttttggataaagtacagatgcttttaaaatccagtattcttgttctaggatattggtacgggatagagcttgagaaaccccatggcaagaatgatgggttcagttggaggtgtgcagtattttagttgttccccaagatatggaatatttgctcccccatccagggttcaaaggtgagaaaaaatgaaatttacattattaacaagaactttttgtaatgcgcagtgagttagagtcattaattctgtatgaaagatatgcactaactacagactatgtcttctttcaacgggttaaccaaccaccttcttcagagggtaggctcatggtagctaaatttgctttgctgaggatttgcagttttaaaaacctcctttattcctcatttgcaaaccctatgagtatgtgtaggctattaggagtggtgtttgctgctcagaacagtgagagcagcaagcttaatctgtcatgcaaacaaaagtgaaaatgctctctgattgcttcagtcacatcctaactacattaaatttcctgccagcaggcaccccattcattctcctacaaacctaatggaagcaaaatggctttttcctgatttctttagttttcaaaaatagataggcagtacatctttggggggaagtgaagcttcaagtatttatatataatatacctcctcggtgtttcttctgaagatagtacacttttgctccagctcactctggcttttaaaaaacaagttgagcagaaacaagtccttatgaaattccaggtacactgtgtgaaatgacttaatgtgctgaaagaagttggctggatatctttaaataggcagtaacacgtatggtacaatcacattcatgagactagacctgccatctcaacctgcaagtcctgtctcatccccttccaactggactgtgtgactgcctcctggcaaatttaacagttttcatatccattttctttctcattttttaaaattgaatagttacatatagtttttgtattcctttccttcttctatgatgtacttgatataacccttttcttgttatttatgattttataacatttaacttgtaatgctttgcagttataagttaactgcaaagaacttgactaagtaccctcagttaaatgttttgtttgattctaatacatatttagtcaggtaaactagaaaagaataactgccgatggtccctgacttacagtggttcagcttacaatttttagactttatgatggtgcaaaagtggtaagaattcagtagaaactgtacttcagattttgaattttcatctttccctgggctagctgtacatagtatgatacagtctcatgaggctgggcagggcagcagctgcagctcccagtcagccctgtgatcatgaaggtgaacaacccaggcacctacgacccttctgtacccacacaaccgttctgtttctcactttaagtacagtattcaataacttaaatgagacattcaatgcttgattgtaaagtaggcttggtgttagatggttttgccagggtgtagactcatgacagtgttctgagcatgtttaaggttgactaggctaggtgatggtgtccagcaggttagatgtatcaaatgcatttcaactcaagatgggttcgtcgggacataaccccatagtaagctgaggaggatctctacaaacatttactgagcatttaatgagtggtgggctctgtaccatgtacttcatcaatttcccccagacctatgagatataaggtattacgattattcctattttgcaggtaaagaaaagtttcacgagatacagtaactgctaaagtcatgtagctggtgtaggggatgaaaaacttgtcccataccatcttatgttcactaactggagggggcggagtctgtaattaaacagacaacagataaacagaagaaaaggcatagca

SEQ ID NO: 25540 - DNA, 5156 bp, Bovine  19866880796013
atacagagaagcagcagtgcactcctggccaggtgttttcaggtagcccagttcttgtatgtcccaggcctgtcctggaagtcgccaaccatttatcctgttcagccacagccaccccaaggacgtcaaacagcacacaggttcctttgtctttgaagggcagccctaaggcaggatacctgttggctggccagtctctgagtaccagtcttttagcccctggggttctctgtggtcacctctgctctctattccgggctctcttcagttaatgagcctttcctgaagctcataaaacattagctacttggcaaagccaaaaggaaaaatctaaagacccaactcctgtctaaaaacagcagtttacacaggcactgtcagcttcttgccttgtttggattgccttcagtcacctcctgtcataaaaggtggacactttggtgaagtcatttttctgctctgccagcatgaccatatgaccacgctctccccagaatggctgttgggttgcaatgtcaggcgacaaagatgttttgcggcctcagcaatcccagtcctttacagagagacccgggcttgtaactgctgcttctccatctgtgtcctctcattaccttccctaaaagctcttttctgactttctagtttcagtgctgtggaaaagaaagccctgaacaggtccaacccacctgcccaaaggagctcctaggacacaaggtaagcgtctctaccagattcctatcctgcctgtggtgttaagatggttcttgctctcaggatggaggttgtgattctaggaggccctctcacagtagcttctagcctcagttttattctatatagaacaggtgaagcaatgctgagtcccaatctcctggtaccctggggaataacagtgtgctgacttgccggtaataatgcaaatagagtggccttaattaagctcaccaaggccaggggtgtgcactcttaagaatgttgccccatgagtgtcttccatggatgtcatggcactgataaatgcttcctttattaaatgctacatgacaggcactatgccaggttctgaaaactctaagataaaaaacagatggtccctgtctcaatggcctcacagtccagtcaagggagttggtgccgtgcagagtacagtatctgcccagcatacagtggagacacagtggagtcaggaaagcttgaccatggatgggattcttgagccaagtttgaacaaggggaggtcatttcaggtcctgaaagtagctggaacagaaaacatgacagtgtgaaattccaggactgcaagagagtagggagcccacagggaatggcaggggacatttttggaaaggctaacataggcttgattttatacctggaacttgagggaagccgttgcttttggtagaggatgaacataatcggtttcacattgtagaaagcactcaggtgactgggggtgtgactggtagaacagaaggctatagattcatggagggaggccatggaggtgacacttgttttcaccctggtaagagaggatgagggcttagagcaagttacaaacagaggggagggagaggacgtgacagactcagagatgtccaggggtagaatccgcagccctaggtgactgactagatgtggatggggagtgaaagggaagaagctgagactttggactcctgctgggtagacagaggctcactcactaagagaggtggacagaaggaaaggagcagttgacagcttcagtttcagtcaagtttgcacactaggtacctgtgacatttgcaggtaatctgagctgaagacacaggtgtcagaatccagcaagctggtgatagctaaagcctaggagtggatggaaatgcccaggggagcatgtagaataaggaataaggtgggcaaaagtactatcatttaaggggtaagctaaggacaagtgggcttccctggtggctcagtggtaaagaatctgcctgaaattcaggagacatgggagatgtgggtttgatcctagggtcaggaagatcccctagagaaagaaatggaacccactccagtattcttgactggaaaattccgtggagagagcagcctggtaggctacagtcctttccatggaatcacaaagagttgaacacaactcaatgactgagcacgcacacacgtgaggacaagtagccagaatgagactgtgtagaaagagtcagaatgagggaaagttcaaagacaatgctcctgtagagtgagggaggtggtggcttatccataaagtcaaatgctgagaagaggacaaggaaataaaggctggaaataatgtgttgggatttgatgcttagaagattcttaatgacatttgccatgcagttttggtgaagcagtttggaatgcgcaagaacaatgtaggaaatgagggaagtatgaggatgtttctagaagcatctgtatcatggtcctcacattatcctatctcctcactttacctcttagtttctttttcatagaaagaaactttctgtgaaagaaaggaggggacatgggcagagctggaggatgcgattagagggggtttttgctttagactgcagatcaagtgcatggtgttacatgatgagtgacagtgtcagtgcagaaggagaggctgaatgtgtaggaaggaagggagatatgtggcagtacaagcttccagaagtgatgagagaataagatccagagtcaggaaaggggttaactttccacagagaagggcagtggcaagaagcagtgtgccttgctcaccttgcatgctccctgcagagagcagtacctggcactggatgaatggggtgtataagtttataggtgcagatgaggaaggttggaagaatttctatggcttgactccaataagtaaagaactcattatctaaagcattggttctcgaacttttaccagaatgcaatgtaattatttttgtgagtctatggccttctctaaactattagctccctgagagtgaaagaaaccatgtcttattttctccaaatccatcatgccattcccagtggcatggcatgtaaggccgatgctgagaaatgttttgttgaatgaattaaccatgaatgaatgaagtgtgataggaaatgtgaggatagtggtaagagtttcatatagcttatgcaagtatcagagagagctgatcattgacaagtgaaaggacctggacagcctaagggcaaatttgggttgcaagaatacctctgtatttaagaggaccaaacagaagttggagaaagtaattacaattattatacaagtgatgtattctgcccctgtccaatattcccccatctgtgaagtttctttggacctgccctgcccagtctctgtgggacacagatggaagaataatgccatccatctcagccacccaagaagaaaacagtcctccagcccccagcacttggctttcctttgttaaatttgaacctgtacagacttcatagcttcttacttacatacctcggagaaggcaatggcaacctgctccagtgttcttgcctggagaatcccagggacaggggagcctggtgggctgccgtctgtggggtcgcacagagtcggacacgactgaggcgacgtagcagcagcagcagcacttacatacctaccactaggtgatacctaccttgcgtagtgaattggaccaagtatttttaaaaagtatgtaaaatcatttaaactgtaaatggcaacccaaaacaagaggctattattctgggtgtattttacttattttttatttgctgaaaggaaagagaagctgcaaatttttaaacgcctcatgttccagaatagcttcctcccgccaggtttcagggctttgaagcagccattggcctaaataggaaaattccaccaaaaggagaggattattctttttctcccaactacatttttggtttatcagaacctaaaggagattttaagtacctaggaggaatggtttaaatatgaccagaagctgacataggtcaattctcacaggaatggattggaactggatgattcacacacaccatcagttgttattcctgatcttttcttttccaaaacagaattgcattgatgaaattgagagcataatcagtgttaagctccagctcatcggaattgtcggtattggaatcgcaggtctcacggtgagaaagttctagaatgtaccttctttgacccctaagaaacctttgaacctttgcatcttctcttcaagtgtgatgtggctgtgtcttcagagagatttctcataaaagacaaagactttttgacaagatatctaagaacaaagctaattagacccatcaatacttaattctctaaaaatgtgatacaaatttccattttaaatgaattatgactttgagtttatcgttgcaatagcttcccattttaagcccatcaagcttacactagacaagtgatttttaattccgagtctcttcttttgttagaaattgaaggtaacataggttaaactctctcacctatgatcttcagaggcagcaccatgtgctgactaacaatgtgatctctggcatcccactccctggattcaactgctagctccactgcttacaagccctggggtcactggaagttttcttaatttctctatgtcttaattccttcatcagcagaatggggatcttaatataccaacctcataaaattgttgtgacgattaagtgggataatagatgtaaagaataattagaaattaattcatataaagtgtctggaatgcagcagtcgataaatgctagatctacatgtaatgagtgttcccaaacccaggacccaggcaaagcatatatagatgtgtgaattgaagaatactgcacccatgcactggcaagtagctcagtacctctaaagccccaaagaagaatgtacaagagtcgatagggtcagaaagctatggtacatgtagcaagagatgacactggaatggtttaggagggtccacataattgagttctttgtgttactttttgataggtcgggctttatcctttaaggtagaggggagccacccaggtttggaagggcatgtagttcaatgtggagataaagttggagggaagtaagatttaggtaggcccctaaagag

SEQ ID NO: 25541 - DNA, 2916 bp, Bovine  19866880833858
catgcattcttaaagcagcgaacatgaacacatacgttcctgggcaccatggtgaaatgcttaagatcatcctggaaccagcttgggctcaaaccctacctctcacaattacaagctgtatggccacagacaacctatgtaactcctccaagccccagtttcctcatctgaaaatgaagaaaacatgcctaccttgcaggactgctgtgacgattaagtgatttacatggtaagagtttagaaggtgcctagcatatggcaaggactacgtcactgctaactggtaaggtttccactgctgttgctttgttctgccacttggatttggtcagtcaattgtactagctgctatgctcgaacagtcacagtgtttacctttaaagatttcaaaattgagaaatcattaatgaggatcactaaacatcatttcaagtctcttttctcctgggtttctctccatatatagtcagctagtgactggggacttccctggtggtccagtgattaggactccacgctcccaatacagggggcccaggttctacccctggtcagagaaccagatcccacatgccaaaaccaagagttcgaatgccctaagaaagattctgcatgccacaactaagaatcctgcatgccacaatgaagataaaagattcctcatgccacaattaagacctggcacagccaagtaaatattttacaaattcgtaaaaaaaaaaaaatagtgtttggtgaaatcctggaaaagtgagcaactcactgtgagaatgtggccaggaaaacatgtgaagcatgtgtgtagaattacaatgtgctgaaaccacaggatgccgtggagaatgtggggacggggtgtgaggcacaggaacacgttggttccttgaggcctcaagtatggccctaacctatggcttggggccctcaactataaagggtaacaccaccacagcacctgcccccaccccagtggcagcaaggaggggaaagggagacatctgaaaagccccgttaacccctgcagcactgggcaaaggttacaagtatcttaatctcctttggtatttcactttgcacaacaggaaccttttccgtttctgaaagttttcaaataagcccccaaaagccattccagccaacaagcaaggctcctaaaagtaacttttatgagagctaaggaaacagggattttctttaagacactaaagatgaggcattcttctgttttcaaaaatacctcagctgactctataaaagtgcctgaaaacaaagcaacaaaagaccctgccatcactctgcacctcagcccaacaggtcactgctgggggaggaacttacataacagagggcggaccatcctgattcctgattttgacgacccgctattctgctccccaggacctgctctttgtctatgccaattcccttttccctcctgtctttttctacactttacaaaagagctcagacgttctatttctggcccagtgactcttccagccgctgctgggtttagaccagatttagcccagggctcggcaggtgacaggcgcgctcaggccagcagggagagatggatgccaaatctgtcccaggtctcacagcctgactgtctcatgggcagccaggcccacctgagggctctgtgagtgaagatgcctctccttccctggccatctttccaccccacaaccagggtctccacacaagggacaagggggtccttatgaaagcaggagaggaggaaaacctatggtcctgaggaggagtcagaaggaagatacagggccagcccaggccaccttctgtctcctgggtgagctggggaaggaggcttcagggttagccagtatggacggggcagctgtcggtcatggtgaggacaactctgaggcgtctatgataagccctgggccgcagagaacacccagcctgcctcccgggtgagggcatctctggccagtgcaccctgtggtaaggaaccagcaccactcacgactgtctgaacataccacggcacgcatcctggggctgttttatgtgtcccctccctgctcccaccctggcccagcatgcagagcaagcagtgttggaacatggaagcccctggaggaagtcagccccactgcatggactacttaaagtgagaagtcacccttcccttttccacccctgcaggtgggattcacacagctagggctgagccaaaactcaaaaccatggcagactcactatgggctagtgtcctagctactgacattgacagagttccaaatgtcacttctctctctgtaaccagagctggatttctctccaccctcctgattcgggctaaacctgtccattcctgagacagatgtggggttgggctttattgctgtcactgtctgaagtgccctcctcctcttgggttcccacccattccaaggcctgtgtcagcaaccgtccactggtctgtctccaaggagttttgggacaaagctgggaggcagcgaccctgtgcctctggagctctgcacacagcagacatttaatacaagcctgctggtcattctccaatgtaaaatattggggaaaaaagctgtctgagatgaataagcagcagtgacttacttgccttcagagccccacgggcacccacaaaggactcaatacacctggctttgcagcaccaagcatgggaatcagacactgattcccttcaaggactggtcaaggtggcacagtcctcgactgctaaaccacccagtcctcgggtggtatgagctgagccacagaaatgacagatccatgccaataccgagatggtttggcagtataactgactccaaaccagagttaggccacctcccccagccccagccaaaaacatgacaaagcccattgttctgatccccactaaggtgcccttgccat

SEQ ID NO: 25542 - DNA, 1871 bp, Bovine  19866880908057
tttctatctaaagaactcaaagcatctcaaaagagcattaattaagattgttttaggctgggcctttaccaagcactaccctattattcaaaacaaagtaatggagagagttccctgtaatatgaaagctttggtgtggcctcaagtacaaggctgcgcccatggcatcatttggccaaatactcacttaaattcactcacatacattactttatcttatttaaactttacaagcatcatttgatctttattctatagatagggtgactaaggtactcagaggataagtaagaccacacagttcacagcacatctagttttagaaagtcagggtgttctgactcgttctacgcgagctgaagggatgggctctgtatctaagtgtggggaggggccttctctcacatctctgaatcacaccacttaggcaatcacgtactgacttgagcgattcgtcctgagcacatccacctcacacaaagaggaaggaagttcactttagtaaggctgataagctacctctaaagcaatacaaactactcaacaaactcaatctaattttactgagcacctactaggggccgagtagtctatttcattttatcatcagaatttccaatgaaccacacgtgaagaacaagcttgaaatattagagagtctgagaatctgggccttaggaagaagccagggcaacacatagtggaggatgaggacaatctacatttccaccatgactcctcataggaaaggcaggaatcaataactgtattaagtgactaattagatttaactccatctgggaaccttaatagtggctcataattttttctttaatcaaaacttacatatttttaaaaaggattcattgtctcagagtataagtgacccccaaaatgttttactatatagacaaataagctcccagccaaggcaataggacttatgaaagaatcgatggtctgtctcttcttctctctcaggttttggttcccagatgtgcaatcctagaaggaaagggaagtggggatggaaagagaagagaaggagggaagaatggacattctctgagatgtgcttttgtaagagcagtaaaaaatagctagattattgagcattcactgcaggctagtcactgagctggtgctatacaaaagttatctcatggaatcctcacacacagcctaaaaggtgggtattatcctcacattgcacagagaaggaagccgaggtccaaggtcactcagctagtaagtggcagagtcactaagttcagagctcgggcccttcatccccaattacactgattcatatgacccatctagatgctggttctctcagctgagctctgaccaaattacatggcctgcgtccattagcccatctaagatcggggccaggcgctggggaagtaatgagagtaaagcacatcacccaccccagcctacaggcccaggggcttagacccaagcaacattcctgccagccttttgtcaagcacattctggtcaggcaccaggcttggcagtctcctctgaccaggattctggaatcctgggctctcaggaaggtcccaaaaggaaaaggagctaccaaccaggtgatgactccaaaagccctgacctcaatgtgaatttgttccatcactcctgaaaggtcagaagccaaagagaccgggtccctcatcctccagttccttaggggcccccaaacgtccccgggagaagggaacaacacagaactgaagcatcttgttttgattgcactgaaaatatccactgtcacagcccagaccccatgaagactaaaaggagcttctccactctgccggcagaacccagagtgccgtgcggagcccgactcactgttctcg

SEQ ID NO: 25543 - DNA, 1517 bp, Bovine  19866880936593
acagagaatgctgcagggttatggcatgggtgaggctggaagatgtcccctcccacacatgggttcatcacaataacatatgttagaagaataaactaacccttggaacagtaaacacaacacacacacacacacacacacactcctatgcatacacatgtgatcacgggcaaggccactgtcaaatcctggacagctctgtttggttctcaaggctgccttttccacttagaaagctgggcagcagcttcatgggtattctttttgtctccctctcgggcacaggaatgtgagaggacaggagtcagaagtcacgtgtctgggcccttctcagccattcttcgtgtccacttattcctggaagtaattcatcctactctgtcccctgtctattctctctctggagccttcccctgagctgcctccaaggtggcaggtgacaggctggcctggccgagaacaaagacagttatccttggctgccacctgtctccctctgcatgcctgccctgtcttgtcatgctccctccacatgtctagtagacaccgcaaggcctctgggcaggggcttttttttattattttttcctttaaaaaattctctggtttcttctgtggttagatggcttatgtttgatgtttaacttctctacacccccatttttcttcattcttaaaaaatgccaacagaaaaatctttaaaatgaacacattgggttgctgttctatatactggagaaaaaaaaaaaaaggtaaaatgaggcatggaagatgccatggtctgaatgtttgtgtccttcagaaattcatatgtagaaatcctgacacccacccccaagtggtattagaaggtggagcctttgagaggtgattaggtcatgagagtagagccctcttgaatgggattgtgtgagcttaatcacatctaactctttgcgaccctttggactatcacccaccaggctcctctgcccatgggatttttcaggcaagaatactggagtgggttgccatttccttccccagaggatcttcctaaacccatgtttcctgtgtctcctgcattgcaggcagattctttactcactgagccattggggaagcccccatgtgaatgagattggtgtccttataaaagtgattctgcagacctccccagcccctcctaccatgtgtggacacagggagaacacagctatctatgaattagaaagaatggtctccccagacatggaatctgctgatgccttgaccttggacttcctagtctccagaattgtaagaaatacatttctgttgtttataagccaaccagtctatgatatttttttgtagcagcttgaactaagacaggaggattttgatggcccctggcaggtttctgagagcagctggggattgccggggagaggagaggttagtcaaggaggggtctccctggacttactgagagtggagaccagaacacagcccaggcccaggtcaaggtccttggtgtttgttcagaacagaataaa

SEQ ID NO: 25544 - DNA, 1287 bp, Bovine  19866880948061
acaataccaggcatctggatacatggtacaaacatgctgtcacatacccagatgtttccaaacatctgggtggtttggcaccccacagcaacagcagctggataatggaattaatttttcacttttcagtcatcacttgacatcagatggacagagtcttatcagctgcaatctgagcacagcccattatctgcaagcagttctttttctcccctcacatggggaattatctctgtcaatcattttattgttgaagaaaaggggaaggaatgtgtgtcttcttgagcctgcgatacatcatctctctatgcctcagttcttttctcattgaaagagccagtgggagctgacaattgctttaacctttcccaccccagaggcagggagaagagagaggaagacaagcaaacagtgttttctacacacaagtctggagaaatttgacaagaacttgtttcttattagaaccactctatctggtttgagatctccccccaccaccaccccctttttctctcactctcttcctaccactctatttacaagtgaaagcgaaatgatggcactttattattcctgtcccttgtgttctcagaaaggcccacattatgtttgtatttttctcaggtagcttagaacaacattgctctgttgcctggggccttcaggggagaggtgggtggtctctagaggctaccgcagacagcaaagtgttcatgttatctctacttatatctggcggcctcaaagtaacgtccagaccgttaacgaagcttcaggacatcaccagggtagaatggtagaatcagcattatttctctccaccccctcaccgcctccacccctactgaaggacaaatgcctacagaagtacagtagctgtgcattcccagggctacaatcactgaggtgcatccgtgtctacacgtgcaaattggtgtggcttaattagagagagagagtgtgtgcgcaggccctgcttgtagaccaaagatgaagggagtggatctggtggctgtttctgttttctggagatttggtggaatagagacccagccccccaagtcaatgcagtcagaaaatatatcagtcaatttacggaaaaccgagtccagtgtgagtgtcggccggcgccgtgtagacgcggcctcagcggccgcggggcgcggcgggtcagtgaagagcctggggtcgccagcccacgccgaccccgtccccggggtggcggggtaaccccgcttcacgtcctctgcgtccggggcgctggccgggctcctccggaggcgg

SEQ ID NO: 25545 - DNA, 750 bp, Bovine  19866880979251
atgtcctccgaacctctccatctgagagcaaaagttcaatagcaggtagaggagggatgagttcacagggagacatggtgctcaggcaaagagaaacccttgcacttacactgctcttaggcatgaatgagcctccaaaagcccaggctgagcatagcatgacataccaatgagttggtaccatggggagctgcagaaagaacactagactgagaatctgaaaagtgaattctatattgaccaccactagtttctagtatgaccctaggcaggtcatttaacatctatgggctttagtttcctcatatgtgacagagagggaccaggctggacgatctctaaggcttcttctagctctgacgtgcaatcccatctggctcagggaggagggagttgagggaagcacagaggccctagatgatgaggtattgctgccaaaatcacccttcccccctccctcctcctgttctctcattgacatgcccttcattatcttgttgttgttgatgtagtgtttttcccacagagctctgtgggataggacagcagagaacacacagaacacaggaaagaagagtggcagtaggaaggggggatgaaaaagaagggcttttctagggtttcccaagctcctgtcctccaggcttgcaggctgaggaggcggccttccaggctgggactctcagaaggtgaaggtctctcaacatcccctcccccctaaccttgcaaccttctcaccagtgtccccag

SEQ ID NO: 25546 - DNA, 1261 bp, Bovine  19866881025263
cttgaacttgatgcaaagtaagtgaaaactgcttttttacaactctctacacaggtggtttactctgcagatttcactagagccaaattgctttcatcccctcttacatgttttccattttttaatctaaacttacaaatgcagtcattgaaaaaaaaaaacaaaactagcctttggggctaatgtatttttttttaataatgattcttttttaatggaacctacatcggcctgacttccttttgtctgaataaaagctctagcacagtataaaagggttgcatgtgctgaaatgttgcccaaggatatgtgttattattccgccccccttgaccagcagggtctcagttctctttccctttcagccttttgtttgaacagatgggattggggaagcaagggaaagaaagccattctgttctcattaactctccccatacacaaacacaaacctgggcttctgggacttagaaacaggacagctcccactccattgccattgagacctggtgtgccgaaatacaaagaaaacctggctgaggacccacatcaccatttcaattgagatggctcaccagcgagattacatttgtatgtttttacaaacacgttcacaaaaatacgtgactacacaacacaggcaaattttacatgtatagaataaatctgtctactgtgtacgctctctaaaatatatcttttcatgaattcctttatcatatataatgacatcctaagaatacaaataacacatttatgatgaaagatacagatattctgtgaactataaaattcttttctcttttattttctttttatatcatagagttaaaatatattgagaatagtggggttcttactattttgtgatcttttgttcagttgtaaaaaatattattaagatttccagtttggaaggtcttgtttattaaagcacttctggccaagaaaaatgtcacaaaaaatttaaaaacatggtccaaatattgaaggctctctctttagaagtctttataaaagtataagacaatatatatgttacatttatacatatacattttacatatatgtatatacaagtatggacttccctcatagctcagttggtaaatcatctgcctacaatgcaggagacccgggttagattcttgggttgggaagatcccctggagaaggaaatggcaacccactccagtattcttgcctggagaatcccaggacagaggagcttggcaggctacagtccacaggatcacaagag

SEQ ID NO: 25547 - DNA, 1462 bp, Bovine  19866881108566
gcctggtcctacaagtactctagtggatctatgcgtgtgtgtgtgctcagtcacttcaatcgtgtccaactctttgcaactctttggactgtagcccaccacactcctctgtccatggggttctccaggcaaaaagactggagtgggtcccatgccctccgccaggggatcttctcaacccagggatcaaactcacttttgttttgttcctgcattggcaggcaggttctttaccactaacatcacttgggaagacccattgaaactatattgttctataaatagatgtttgggtatgggatgtatttctgtagcctgtgtgggtttcaatcttttgatgtagaacaactttgtccaatagaactttccatggtgacaaaactgttctataaatctgcactgttcaatatagtagccaccaatcacaggtagctactgagcacttagaatataaaacttaattcttaatttttaatcttaattaattttaatttaaacagccacatttgactagtagctacccataatggacagtacagacttgtaaaatgacttcatccatttggatttccatgaatggaaaagaatgatcaaaatgatcactgtatgataatgacacaattctggtttagaagtatgaattaattcttttaattttgacataaatagaatgaataaaagcctgaaagtctcactcccctccaggatttgggtgacatctcagagtgtgtgttttcaatatccaaatgacaaaatgaaaggaaaataatttataaaaaccaggtattttactagatgattacctatgtgttttgaatatcagtagatgcttatattaatagcatcaaactctttcacattctcagtcaacatttttaggcaaataattaattaattaataacttactgttaaataataacatctagataattaattcaaactgatgtttggatcagactcctgaacaactgggtggtatgtctacactggagcaaaatttgcttgaagattatgggttcaatattatagatgaagtgttcttgtatgaagtcaatcatttttgagtggtaatatagatatgaaactaagaacaactaatacaaagcaacacagaatccaaaattttttatttgaagaattttgtgatatccttaaatttaatgtacaggtaatatccaaaaagaaatgccctcaatattttcaacagagatagaagctaccagagactcactgggtctgattctgatgactggaatgtagctctcctaagatgctgcctgcacttccgagcttcttcttctgattgacccatgttgatcagcctggacacacaacagactagaattttgtcacttttaaatctgccactttctatgaatatggttgactcaggctagaatgaaaactacagttgttcggccaaattctaggcaagggtttcagagcacctgcttctctggt

SEQ ID NO: 25548 - DNA, 1484 bp, Bovine  19866881160903
cccgcagtcacctcagaggcgatggaggtgaagctgctactgaagtgcacatgcttgtgcatctcgctgccgttggccgtcaggagccaggccccgagggcctggtcttcgccagccgactggttgctgtggctctggttgggcaggagctcggccaggtcccagtggtacgacgggtgtggccccgaccagcgcaatgaggatggcttccgtggccacgtagagctgaaagaggaaacacacagagccatctaggctggaaatgcaattagcaagcttacaaaccttcaatgagcagtcttgcttttgtgtctgtgctgctgctgtgctgctgctacatcgcgtcagtcgtgcccgactctgtgcgacaggagctacagaaatgagacacttcagaaacaaaggagaaaatggaaggaagcttcctgatctactacaaacggaaccatcagctatcgcatctgtaaagcaccctgtagttccttcaagggttttttctgtatttgagatacatcagatttgaggacacagcatagaatggttccacactcgcagggagtaggggaggagggatattacctgccctgacttagactaacattctagttattttctcctcaacaccacacattagttcagataagcagttaccagggcacaggagtgtcctggtcttggactcatgatctaaacaagaaaacatgttgtggcatagttaatgtttccaaaaacagtatatgtgtgtgtacatatacataaatcaacaagaccacacagtgactccaggcagattgtatatacatatatatgagagttaactcaggcaggttgataagaagtccaagcctaaggcccctttaaggaggacataaacattagacaagtaggcctcatgggcagcagtatctcttgttcaaggacatgcctttttttgaactttggatgtacgctatgagagaagtgaagtgaagtcgctcagtagtgtccaactctttgcaaccccatggactgtagcctaccaggcttctcagtccatggcattttctaggcaagagtactggagtggggtgccatttccttctccaggggatcttcccaacccagggatcgaacccgggtctcccacgttgtaggcagacgctttaccctctgagccaccagggaagcccacgctatgggagaaggtctgggcaacattttcacagccttgaggtattttcttttctattctcagcagctagcagaaaagaatagaaggctctgcttaaactagcgaggcgggtgctctcctgcccacttccagtgcctctatccctgttactttaataaaatctacacaaagctctgagtgattgagactgcctttggtcccagagttaaatcttctccttgggagaccacgaatccggcagcaccgatcaccataagctgttgtctatgtgtgtgtgtatatacacatacacacacgtcagggaggaaggacg

SEQ ID NO: 25549 - DNA, 750 bp, Bovine  19866881191653
atctcctggaggagggcatggcaacccactccagtagtcttgcctggagaatcacacggacagaggagccttgtgggctaccgtccgtggggtcacaatgagtcagacacgactgaagccatttaacacacatgcagtaaagcccaggcaggacccagtgataatagtgattgagaaatgaagtcaaacttatggtaaaatctgcaaaaattgatagtcattcattttgcagactcgtaagagaggaatcagcaatgattcttatgtttttgaagtcaataactggggaaatggaggtagtagtattaactgaggtagggaaaacagaaggtggagtaggacggaggtgataggtctagaggcctcagacaaatggtggggccaagaggcattgctcgtttaaatggccattgcccctttaagatcctgcccttcccccgcattaacccaccaaggcccctgctggatttccttgccctaatttacagtctgtgccagagcttctgagcatgcgctgaaggaagagctggcctaattaaggctctcctgaggctcaaggtattgcatctgtggctcttagcaaagagttccattttgagagcatattttccccatctgaccattctttactcatttttctttttctcaagttcttttctaccataatttaatatagtacctgtatttccttttataactcagaagtaatgaacatctggggtttttgaataataaaaaattaaaataata

SEQ ID NO: 25550 - DNA, 1275 bp, Bovine  19866881195163
tttaccattagattgagaagggaaatcttaacataggcataatgtaatctgcaattacaatgagaagctcagcagcgaaaccctgtgcctggcaagagacaggcagctgggtgaaaagtatctccatcatgggttgtgtggatagagcactgtatctttgcctcacgtgtttattgagaggaactgggcttgatttatagctagtgcaatttactgctaattaccaatactttgcagattatcagaggttaggtgagaaaaacagccatgtcaacttaatagcactggtaccaagaattcccaagagatcaggaacttggaagcaaacgggagcagaaatttataggaggaactacagaaagctgttttcctttctttttttaacctaaatgtccattgacagaggaatggataaagaagatgtagtacatattatatacacaatggagtattactcagaaggttgtttttcaacttgactctcaggttaataggaacatcaaagggattatttcagagtctgcttacttggtgtctgtctgtctgtctgtgtctctgtctctctcgcctcactgtaaatgcccctggtattccttaagaaaccaaaaagcctttagaaaattacaaaagtcttagcacagaggacaaaggcttcttagactgggtggaagaaataatacagaatgtattaaacatggggggacatttatgagaagacagaggggaatttcagcaagcttaaagcttgaaggtaaaagagaaagaccagaaacttttcatccttggtgttccctttccctcttccctgaaaaccttcctactcaggatgaatacagatctgaggaaaaagcagcatcttctgcccttaaaaataatcaagagaactcccagacctgaagttgtgagaaatcctgatttgaacatcaggcaaggaaagaactataagatggtcactccttcctgaagctgatggagaaacccagccagatctcacaaagtaaatcaggttttctcatttcttcttccagctgaggttttgtgaatttggaagagacaggaggagaggagaaatgaacagctggctctacagataatatccaaaaagaggatttggttctctaaaccatggcttgtgatactagaatgataggctcctggcaagaagaaggcatctcttaaaaccaggatgaatgtgtttggcaagaagctctgtgatctgataaagaggacttcaaaggaaatttagagaagggagcagggaatgggtcagacaaa

SEQ ID NO: 25551 - DNA, 795 bp, Bovine  19866881222049
taaaaataatggagtaaggattcagacctttgcagtgccaccttctcattccacaattaggagagaaagaattccatcaggggactctggaaagtctaataaccttcccaatatcacgagaatcccagggacttctactctgttgctattatcagggtcagttctttaaaacgcacccaaatctatatgctgttggctgtggaatatccagaagatatggtaactacatcagtctactatgaaaacttcctatgtgagtgagaaaactcactcgtgttctgaggaaatccaaaatttattaactttctaccttggactacagtatattgtggccatttttggaaaagcaattatttatatttcttcaaaatatatcatcctcttcatgggattataatctctgggtgagcagagcccatagggtatgcttcatgtctgccttgtccattgagaatataaagcagatatctccataaacacaaccagccccatggatggatgggtggataggttgagtgatggggctgtaggaaagtttaggagagactccagcttatcatttcagatagtccaaaaaaaaacccacaaaactgtaaaataagaaactggagggcacaaaagtacgctaaaaagagtctaagtaagccaggtacagaccattttaacaggctggagaattcaatcccatagtcgaccaagttgggataaagttaatactatgtaaaacaatataaaaaataaacaatgtaaaagaaagaggatctttctccttcaggagtctccaaaattgcagta

SEQ ID NO: 25552 - DNA, 2410 bp, Bovine  19866881275628
cctggagaattccatggactgtatagtacatagggtcgcaaagagtcagacatgactctgagcaactttcactttcaccaccatcagaactaacctgcctaactcacgtgggctcaacttggccacaagacaacacacataaatgcaagcctctctcaaaacagcttccaaagggggaccatgttcccccaaagggaaaatcaccaaaaaatctgtggcaggacttccctaatggcccatggttaagattccccacttctaatggagagggcctgggttcaatccctggtcatggaattagatcccacaagaggcaaccaagaccaatgggaaagaattctggggggaaaaaaaatcagagatctactaaagattctgaaacaaaggcaggaggatcattaaggacaaactggattcctgtggttttgcctaggaaacaaactcgggcaacatcacatcaagagggtggaccatataagaggcttgagagatgggaagtagagaaagagccaccagacatcgtctcatatcagggcacacatcacataatgctcccccaggccccactctctgagtcatctgtagccttcagagaggtaaggtaaccactaaatacacaagccacctttactcattctgccaatcattatgtagaaacatgtacatctgactctgaccctctcctctactttggagggtgaaggaagaggtaagtgttacctatagatgagagttcgggtgtgcaggacaaaaggaaaataagacaagggatctgctaaaacgcctgtagtcaggaaccacccatggtgggccagaccacttcccttgcccctggagatacatctcttggagttgcattgtgacttccttcccagacaggcaagctttgctcaaaatatgtaaatttaacatgaaatttctcacaggaagaatatttcaaatgtgggttgcagtatcttaaggcaacattgcaaaaggcctaaagataaaaattgcacaagagttggacactgaagtgggacaggaagccttggcttgccttcatgctgttttgctttgttggaacagagctcaaggttcttatgcagtgttgaggcattggcctgacagtttctgaaagactcgttttttcccctctttcacagaagacttcttccactgcattagattaaaagtttctagtggaaaaagagtggcaatgattccaaggaagagctcagagatgaaactgtgatgtataatgtgtcaaatcttcacaatgccactgccaaaaccaagagatgcctcattacagagaggcagtgggagacatcgtggccgcttccgacagcacatgttacttccatgtacagccagaagatgaatttacaagaactggagcagcacaggctccctaaagaggaaactcttactactgattcactataattgtttccttactggtttctccagctcagattgctttttccaatttgatccactgtacatcagctctcagattgatcattcttttgaatccccactctggtgtgcctaccctcctaaatctttctaaataccttagcccaattttcctgaatctttatttccttgatgattttgtcctatctgaataccatctatattattacttcctgaatgttgattaaattgcctcatttattttgcttcactgtaagcaatactataattactgattaaatatttttagtgtgcatgcatataaacacccaactttaaaacgtccatcatgtaccaccaaaagtcatcttgtgaattccctactggcaccatactttggggaacacgattcaagatctgcccatggctccagccaggtgcccttcatgtcccctgcactccagccgagggggatgactcacctttccccacacagcacccacatccatgtttgtcccaccaccatctctgcctttcaaattacacaatcattcaaggcccaaaaccctgacgcccccccctccacctcttgaggccttcgacgactcccccagcctgaagggtatctcactcctctgaacctcactgcccctgaagcactgggcacttctcatttgggactcagtgttggtctcgaaatgggaggtttgggtagatgccatctcccctctcagaacatctgcagccttcttgagaccacatcagtcactgcagagggtctggcacaattaagactagctgaatgaatgtatctccctcactcctcagtcccctctttgtgtaaaatacaaacttgagtcattctcctgctccccacaaaataaagtcccaataacttagcagacacaaagagacaaggtctctcagtttggccccacatgtcattttatcccctctgccatctccctgctctcctcccagccagcaccccaccccaaccacactctag

SEQ ID NO: 25553 - DNA, 1382 bp, Bovine  19866881296209
tcgtgttccgtgccctcctgttggtcctcatctttctcttcgtggtctcctattggcttttttacggggtccgcattttggactcgcgggaccgaaattaccagggcatcgtgcaatatgccgtctctctcgtggacgcgctcctcttcatccactacctggccgtcgtcctgctagagctcagacagctgcagcccatgttcacgctgcaggtggtccgctccaccgacggcgagtcccgcttctacagcttgggacacctgaggtgagggggctcttcctcctttccgggggcggaaaggaccactgctgttttgctagaagacagttaagtccacagcaagtgagggatgttgccaggtgccaagagcaagaccagggtctgactcttttttttcagattttgggaggagctgtgtgtgtatgtgtgtgtgtggagggggaaattcacgtacgttgactttgctgaattctggatggcatgtcacagggactggctgtcttccaggttggagttttgttgggcctgtttccaaaattgttcacagctcttaagaatgatggagaaaggaagccttagtgatggctgctgaccctgcccccaaaatcagcctgtgaatgatggagtgatcaacagttttgttcataatggtacatctggtttaccgtgttgtcccagtggaattattaatcattcctttctcccccactctcagaggttttctgatttgggcaataaattatatggtcaccctagtgaccttccagtaaagaatcaggtgtagattagagactctaaacttgtaagagttgaaaatgtatacatgagaaaaaactagaaatactttaagatgtcatatttgaaatctatacacaaaatctaattattttgtgattaacaaaaagagtgatcattatttattgtattcagtattttgttctgctttgtttttatttaccttgagataagcacatcatatagattgtcttcataaagctcatctgtatttcagatgaggaaacagggctttaggggttttaagtaattaatacaaaagaacatggctagctttgtgcagaatctagcagaccccatgaagccaggcctgagttaatgtcctcattgtagcatttctcactttgtgtcactggcctattcttctgttttcttgcaccaactgtgggctccagaggacaggtgctgcattttactcctctttgcatcctcagtgcctgacctagagcatggcacacggttggcacccaggtggttacaggtgagagaacaatctgagatgtctgacattgtcttctcacggggctctcctgcctcctcgggcaatatatgtcaatgtgtgtatctgcttggcatatggtatgtg

SEQ ID NO: 25554 - DNA, 1300 bp, Bovine  19866881392208
aatcagctacaacctgatacaaaacaaaaaacttaacgtttaaaaaaaaaaacagaaaacaaatactcttcaggaaatggaaaggtagggaaggatgatggcagtgatactgatcataacagctaaaatttattgagtagttacactgtggaagggtaatgctaagcaatttatgctccccaaaccccatatcattatgcccaccttgcagacattgagacttaggttatctgcttgcccaagaccacacaattaaacatgaagaagaccggactggatctcaaacaccatggcttttgagatttgtgaaaaaatcctgagggctgttatcccttattcactgggactcatcatagatgggaacagattccctttgtttagccagcaccactgcaagctggcttgtagcggcagagcttgctttccattgatgctgctcctggggcttctaagaggcatccagacttttaagacaaagaaaataagaaaaaattttaattatgtttagcaaaggacaaaaatatgcttgagatcagtattgttattggcataataggaacagataatgaaaataaaatgcagcctcttaacatttatgttccttccatttttcctatctaggaaaataacttcaagttagaaaaggtaaggttcccacagatgtcagtgacagacagtggaatcccaaggcaagagagaaggttctaaaggaggcttttgggtctaggggcctggccagaaaatttttattttgggagacttgctgtctccttcaaggggctgaggctttgcagaaaggtgttagaaactcagccttgagaaaatgttcatcctttaaataaagggcagggagtttggatggtcttttatctggtgagctgaatgctgttaccagatgagaggtaaagagtctgcatttctccagacttgccagtttctttctgagagagttgccagacgggttttgcaggtgttgtgcagactgcatttgggttgtagcattgcatttgacagataaggtttctgtccttaaagatggtgtgtacctctgggcaagggctgatggtggccaggttgagtatatgagtaactgattgtatgtaaagtactaattaatggcttgatgttgatctgcagaatggatctttcacgctacagatttctggcctccatcttgcctggttaagtatttttattaatgacttggataaagacattgatggcctgatgataaaatttgtggatgacacaaagctggaagagatagctaatatacctggatggcagagctgcaatgcaa

SEQ ID NO: 25555 - DNA, 1274 bp, Bovine  19866881413084
tctccccctggagtgagggaaccagggctgagagagaatgacgactcaagagtcagagtacttctgcaggctgcctgcttgaccataactttccatatcacaattaacattatgtctagatcatgcctcgaaacccaagatcaatcagccttgagtcagctggagctaaaggttcttctgaagaccccctgaagttgagcatgtttgtatggccctctctgttgacacttgtctcagcctccctttcactctcataaggtctcaatgatattttggtcagttttgaaatacaaactatattttgtaaagcttccaaggtgaccccaaggaaaagtcagggctgagagtcatggctgcacaggatgaatggaaaacttgacattggctttgatgaactagcaataaagaaaaatgatcaagaaatgaacatatctcacaaaatataaagtacaggtatggtcacaccataggcaacaagaatgtgtgagcatacagctcacagactcttgaggggacgatgtccctgtcttcccttcccacactccatccccagaattatctaggtataattgacatttgtgaattttgaaagttttttttttttaactccttgcatgccacttaaaatggtctttggtgttggagctatgattaacttattatcaagcccaaggactatttgctgacatttttaagaccaaaaattggaggatgcttgacaaaaagacttcttagaccactcatccctcacaggtgctgggacccaacggctagtcctaagaccagcttacatcacatcaaaatgcaagagtagatggcgtgagcttcagccccctccctcctgaattccacctgctggagttctgtgagctgggaaaactcactagggaggttgggcagcaagaacatgttggtgagggtgtaataatgagtgttggtgctgtcactgtggttttcattgctgtaactgttccccttaattcttccctctctctgttagttctcactctgagcctatacacaaagaaaatctgaaatcttttacattgaaagtctctttttataatttttagcctaatcagacattttttagtatggaatatgactgtgaggtttgctgactgggaactctttctttggggaaaaaaattcagttttggccgtttcgagatgatttgacatgttttaactatttagtggttttggcacaaccaataggaaaatagagcatctggcaacaggacttaggaagatattcaggttcagcaaaaccg

SEQ ID NO: 25556 - DNA, 2225 bp, Bovine  19866881595676
agtgataggacattgctaaaaaataaaaaaagaagaacattgctaactggctatataaacaaacagtggagggattccctggtggtccagtagttaagactcttagctcccaatgcggggagcatgggttcgatccctggttggggaactaagatcccacatgctgtgtgtccaataaataaaataaaacaatatttaaaaaatttaaaaaaacagtggaatatatatatataatatataatgcaatggaatatagatttccttttatattgcacaaacaggactacaaacagcaaacactacacgtaccgtttgctactaagcatttctgtttaacgggctttccaggtggcgtagtggtaaagaatcgcttgcctgtgcaggacatgggttcgatccccgggttgggaagatcccatgtgcacacattcctgataagtgtaagtgacctggggttcactgagcacagtcacttggaaccccctggcatggctgacccttagtgcgctcactcgcacactccttctgtctctggatgcaggctgacagtgtgtggatggatattcccgatgatgatgacctgcccacagctgaggagctggaggactggattgaggatgtgctttctgggaagataaacactgaggatgatgacaacgaatgatgaggaggatgaagacgacgatgacgacgatgataactctgatgaagaggacaatgatgacagtgatgatgacgatgaatagcctccaactccagatgagtttcacaaagacggaacccatagccacccactaccatgcagacagcacaaggcggagcacgcagccccggcccgcgtccagccagttcctttccctttactgacatctctttccccgcttctttctcatcagatgtgcaacttggcaaatgcctttctaaatccagcagtcctgctcgcttagcaaggacagtggggaattattcccatgttggctgtcttgattgttatgaaaaagctttcgttcgttgtcagatcatcagtggccatggcagtgcccgaatctggttgtctagagagagcaatcccctaacacctcgattcaagtttactcgtttgactatgatagtagcagaatggacagcttgctaagtcacaagcacagcgtgaccttacaacagagcccagggaagacacacaatccatttagcccctgtgcttagaatattagttaggatccctcctcaagccaagaagatcccttttagggaaggctcagtcttggaaataaattttgtaaatcagcttctcttggttctattaaacttattattttaggtgtaggtccaaccattatgaactcagatccaaggctttggatggctattgagaggttctgaaaaacatgcttactgattgtcaccatcatttctagtatattaggctattgggatgggaggttgatttgttctctgaacttccctgtagatgaccttcttacatatacacacaggggttgggggagctagaaggattaaatgtttttaattctttctgatgtctttaggtctctgattgggtcagctggtgtcctagcttgagctgggatcctgatatccttccgtcttgtcgctgctattcagccttcccattcagagtccaagttggtttttccagagggcgattccctctccattgatcagtgctcccacaggtgaacaggacaacagtcattaggattcataacgatgctctggggcactgaaaaaatccccacgtgcctttcaaactatctagaagttatattgtgttctgtagttttagcattgggtgtgcattctaatgttctaatttattttctcagtcttttaacacatgggtaagacactgcaaattctttgaaaataggatgatccttttatggaatagcagctaactaactgtcattaaagttttattttgaaagtactgagactatcttgaaaatcctctcttgatttttttgtttttctgctcattctttcctttctgggctcctgttcttcctctctattccttcttagttttcctttctcctctctcttcctttgcctaccctttgaatgtcagtcttccacggtatctctcggctctaacattcttccaaggcagcttatcatccatgcccatcagctaataacttccaagtctgggtctctaaccttgacctctctccttggtttcagactcactcattcagctg

SEQ ID NO: 25557 - DNA, 610 bp, Bovine  19866882066486
acccttaagaatcacttttctcatctgatgttggggggatcatcatcttgcatatatcacatggtggctttaaggaccaaataggaccacctccataaagcccagagcacacttcctccagactcttagctctttaagagacctgtactattttctttggtgactgggtaggggtttggttggtgcaatgggccccgcggagtttgttagcaagagcagctatatcaggaagtactgtctgggtaggaatgaaattcctagtcctgcagccaggcccctctgccctggttacacatcagtgacctgcagtaatgactgactagttgcagagtcaggaactttcacggaaaaggctttctctttcccagcccggagccggggccagtcccccaccccctccctgaggaaagatgctgtgagcccatcctccctccccaacctccacccccagtgcatttcttccagcttcccagtaacaagccccagcatgggctcctgtggggcaagacaaggcttcaggcccagggatatttgcgcagggaggaggtggaagtagtttcaggagcttgattcattacagcagcaatctcggtcaaacaggttcctgcag

SEQ ID NO: 25558 - DNA, 728 bp, Bovine  19866882186615
tactagctcattgtgccctcttcagcagtttgttgaacttctctgaccccgctacttcccttatctgtctttatgaatgaatatatgagaggctgaggcaaatgccatacaaatgtatcttacccggaacagtggttcccaaacccccaccagggcatcagcacttggctcagagcttgtttcagtcagtcccaggtggctcggtggcactgttgggttgggaaaccctgcccaggcacctcattgtctggctgcttagccatcctaaaggaagttccctgccttctctggttgcgttttggattgccccaagtcttccaaaacacacttcacaatcaccgcttacccttccctttgggaaactttatttacagagcactgctgtaggaatccagaattttaccacctgcaaaattaatttttcctgcccttcactctccactggtgttaaaaagagtgaaaccgggaaaaacttgaccagcttaacacccatttatagggtcattttgtactttagaaataagctgcttgttttgcccagttctcattatttggtggaatattttctatgaaatttcccaagcatagacaatattttgcagaccaaaggatacacagttgttattttaaggtaggattgtaattcatataggctagatcacaacattggtaaatgaagtttaaatgtgaacagaaatttacctccctcctcctatacacaggggctt

SEQ ID NO: 25559 - DNA, 1790 bp, Bovine  19866880244510
cagtcctgtggccactgctgagtgttccaaatttgctggcatattgagtgcagcactttcacagcatcatctttcaggatttgaaataactcaactggaattccatcacctccactagctttgttcatagtgatgctttctaaggcccacttgacttcacattgcaggatatctggctctaggtaagtgatcacaccatcgtgattatctgggtcctgaagatcttttttgtacagttcttctgtgtattcttgccacctcttcttaatatcttctgcttctgttaggtccataccatttctgtcctttatcaagcccatctttgcatgaaatgttcccttggtatctctaattttcttgaagagatctctagtctttcccatcctgttgttttcctctatttctttgcattgatcgctgaggaaggctttcttatctcttcttgctattctttggaactctgcattcagatgcttatatctttccttttctcctttacttttcacttctcttcttttcacagctatttgtaatggataaaggcaatattaaaaatttgtgctacttttgattgttttttatatctgcctttcttaaaatctgtataatatccttattctataaaggcaatttttaggagtagggatataagcaaatttcatgatattctagaaacgtgacttcaataaataaagttcagaaagttttgcaaaatgaatgatgggtgtgttcctagaatatcctcatcatcagttggcttggtcaccaagccctctttcatatagggctgtaatgtattttaattaatgtaaactttggcacagatatgctagtcatccactgctttctagagatgttcagacagtagcagaagcttttttagctccattttcctcagaaataatgcaatctttttgaaaatgtcttgatttccatataactaaggactgttacaataaaataaaatccagtgaaaacaggcttacacctgaatggcactttttgtccagatgaagatccaaaggagggcaaggttcagggttgatcaatccagttgcttcatgacttaatgacatcattacttatttctgttattcagtttgtcagctgcatgatcagtttcatccttcgtctggatcatctggggctgtcttattcatatctagcaagacagaggagatccccaaaggttccagaaatctcttttcatgagtctttgatctgaaatgtattagatgctcatctctgaaccaataatggtaccaagggagaggtatttgtggaacagcttagccctgagccccctgtccaagtcctagagccaggggtggattcagcatctggtaacataggtgagatgatcaggagagatgtgatacctcaaataaaataatggtatgaaccaagaaaggatcttaggtaagcagtcacaaagcccagtagagcatccagcacctggaaatttcagctcatgacttgaaaacaaaaatgtggaaagattttttaaaatgagtttctagtctattattattattatagcattaattgaatctattatacttttcattaaaagttcatttttcctttaaatttttacatgcttaacatttaaaaaatatttaaatgtagtgatagcagggaaacaattttgcattctgcttttactagcatttcaatggctgtatcatactccattaagtgtctcagtgatataatttacttaactattgcttctctgtaggacacttaggttgtttgtatttttgatattggaataacccaagtaacaa

SEQ ID NO: 25560 - DNA, 1478 bp, Bovine  19866880414426
catcaaacgggtttgtctttaacctccaaacagggaactttaattaaagagacagtgaccccttttatgagtgtggtcgagttgggtttcagggcccttgtcactagcggctcacataacgctaacaaaagcttgcaggccccaagaggagccggtctccctcgtagatattacagcaggggcacagggtggggatagggggcatggagaagggggaggcaccccagtggtagcctaggtgaagcggtcactgggttcgaggttggaggaggggcctgggctgagggcatagactttctgcacagtacccttggggcatgactcctatccctccaaccatccggatccagaatgcgttgggtgggttggtggcaacttccttaatggttaggtgcgtgaaaatgtcaggggttctcatcctgtttgcctgttggcttgtattataaaattggaagtaatttccaggaggaatagattagataaaacttactctaagaacagtcagatttttttactcacatattcaaaggcaaagtgattttatgataaaatgtaattgctaataagtataataacaatactcaacatatggcatgaaacacaaattctgtcctgaatctggaagtgcaaacactacacaatacacactgctcggaagggagctgtccatccactgcaagagctaaatccaggcccctctgtgcttcctgctctccctcccccacctccatctcccttaaaagtcccaaagtggacaactattgggttagtgttaggagtttgaagggcccttatcttacatctaatcacctcttaactgttgatttttaactaagggcttctctaggtcctataagagatgtttgcttgccctttgatctagttctttgatatcctttgtgaattctttaagctggcgagggctgccagatctgccacacttattcattcaacaaacatcaggggctgttgaaagggacctggggagtaattaattatttcctaaacggtgggtttgtcctaagtgaggtacgttcccactaactaggggctaagttgtcaatgatctgcatagggaattagccacctaaatggtaagctaaggttgcctctactggcaactagggttgagcctaaaccagcaaatttgtggaggtggcatttaaggccaaaacagaatgaaggggttcctcagtgccccctcaattctattgccatacatgggctcctgactcttcctggtgacacatgctcttgccatgtggggacacttaggttagatgtagggacacctgtgagaagacccacaccaagggaggcgagctcacagaccaacagagaatcgcgatggtatcctggatctactcactcgcacccgtgggccttcccgggggcacacacctacccatgtgagcagcctgtgtgtgtgtgtgtgtgtgtgtgtgtgtgtgcccctggagtgcacccacccacagaga

SEQ ID NO: 25561 - DNA, 1440 bp, Bovine  19866880500171
tgggaaagattgaaggtgaaaggagaaggggccaccagaggatgagattgttggatagcatcaccaaactccattggacatgagtttgagtaagctttgggagttagtgatggacagggaagcctggtatgctgcagtccatggggtcgcaaagagttggatacgactgaactgaactgacccatctgtgagcacttttctccagctggggtggggagccacagcctaggcaaaaacagagacactgcctcaagtacttaactgggaggcaggcagcacagccttgcccaagataagcgccttgaccttgaccttagtcctgacctcagatcccagattcacaatatcagccatgtgatctttggcaagttacttttctgagcttgagtttcttcatctgttagtgtctacctcaggattagtgagcgctaagtaagctagtggagtgaaaagtgcttagccaagtgtctagcataaagcaagaacttcaataaatgatagctgttattatttagttttaatctgaggcttttctcagatgataattaaaattgatcttagtattttggggttcactgtcgtctgagcaaaccatatctcttaaaattacagtgtatgtgttctctattctgatacagggagctccagaagctgctctgtcctgctttgtccctgctggcaaaaaattgtgattttccccctccccctaaactcagcatgctaaagctgaggacggggtggtgggtgatgattttccatcctatgtggacatgtcctgataactcccttttccttgctaaccattcgccaggctggaatcaagagagggcaaaccagaaggcccagcttcgggtttgactcccaggacgaccggctggaaggaaaagcaacaggcaaaacaggctcctgaggcactggaatagtgagactacattgttacactggtgacagtgtctgctgaagaagcgccagagctgtatgcacatacaaaataaaggtcacgccacctcaagggagagtgctggcaaactagaggtggagatggcaagacaggaacagaagtgctgccacagggaacaaagaagcaggacaacttgactaggccagagttgtcttagggaacctgtgctcaagtttcaggctttcataccttcacccaggacccctgctacagtgagtaacttggtctgtgcaaatcctggagccaaacactggtgtataggtggctgaggacaaccagcactggcctctgccacttatttacagccgagttggggagaataacctagcaacaacaagacccacatttgtgttctgtgtgaactacactagaatcttttcaagtggggtcctctcatagccaccctatgaagctatgaaggaagctatgaagctgccagggtagtgacttaaagggtaagaatccgcacaaagaatgac

SEQ ID NO: 25562 - DNA, 1081 bp, Bovine  19866880515343
ttgctgcaactgactggctgatctgtttctcctctgtgtccccaccaactgtgatagcccccactgaagagaaaaaggaaaggagttgggaacagggcggatcacatacctggttgtttttccctttttgatgacatttgctttgcatctctggagaggcctcccagcgaatctggagggggtggtaaaggaaataggctgatgcatagaacccaatgcctttgcctctccccattacctgtgggacaaggtgatagggccccagggtgaggaaagtgtcagaaggagcattggatgtaaaggagacctgggccaggaaaggcagtgctgtctgaccagggggttaacagaggactgacagggtttccaggaagttgaggtcctacgatgctgaatgaagctggataccctctgggtggtctaggctccaggggctgacctctttgtgagtcccatctcctatgtcttgcgcattgagagagaacagggcacctcgggctcccaccagcagccttgcagaggcctcctccagcagcagtgttgagtagttctgggcttggcccttgaagtgccgggtcccagagagctctggggagagcgggatctgtgagcccagccctgggactgcctgcctccccacctccagcccccggctcctgctgcctttcgaggttggggctgtcaaaccttcgtaggggatggtcatccgtggggtggcatctagttctctggatggtctccgcagtgagggtccagggactgcagttgctgtgaggaagctcaggaggaagggccagagcctcccccacatcttcctggggaggcccagaccaacaagactcccaaagggagccagggccagaggttgggggatgatgggaagaatagtcacagggtattaaggtccagggaggttgcttagaaggtcagaggtcatggggccagggagggtcctggaatcgggaagacatggaatcacatgattgtgcggccatggaatcccaggtaagaggtcaagaagaggggtggattccagactgcctctcggcatcagttacaaattccatggtggggtcacaca

SEQ ID NO: 25563 - DNA, 2153 bp, Bovine  19866880535020
ctccctctctctcggcaccacttctcttacagtctaggctttctcactgccttgggctgagctgggaaaaagagtgctgtccctgctgttctggcccagctgggtctcaccagaagctactgtgtacctgtttactgtgtgtgattcttcgctcagggtaggctgtagccaggtgttggctggatatatgttgttcttgctgacctgtgttttctccttaggggccaaagcagtatccttacaataatctgtacctggaacgaggcggcgatcccaacaaagaacctgagccagtggttcactatgagatctgaggaggcttcatgagctttgtgttccctaactgactccttcaatcctagaaatttaactttaatgaaatccctaataaaacttagtgctgtggtatctgtgcctcatttcctctgggaatagctactgcttaagcatagctcatttgaaaagaccctgatgctgggaaagattgagggcaggaggagaaggggacaacagaagatgagatggttagatggcatcactgactcaatggacacgagtttaggtagactccgggagtcggtgatggacagggaggcctggcatgctgcagtccatggggttgccaagagtcagacatgacagagtgactaaactgaactgaagcataagaggatgttggtctgttaatttcgctgggaaaggtagttgagggttccagttgtgcagcaggtagttacgggtagctccccatttacagggcggttctgacttttcaaattggaacagatttatttcccataaaaaaacttttaataatagtagttagctaaaaaaagtgtacttttacatgtttcaaaatactataggataaataggtgttctgggacaggcctagggctgtgattgcctctaattttgtgtgtatctcataagaatatgtatttattaaaaacacaccattgtaaataactatacttcattttaaaaaaaagagaatatgtattccaaagcagcttctgaatcctagactgttataagttgacattacctatatttatgaattagaggatagtcactgagttattactgaacctatgcatggctttcattaccttaatgattcatccaagctcctataatagccttaggaagagaaaaaccatgtttttaagggtctatctcaatgcatctgttaaagagaaccaatttatgttcttttcttccctttagggacattttcttaaattacagtgatactgcctaaaaacctgtcccataaaaaagtgtacattcagcatgatctatggaagcaagtgcattcacattagataagtggtcctttggaggtgtgaagacagtgaaagacgtttatgagatcagggagtaggtctgctgaaatgcctctttttttttttcttcttttttgaaatgcctctctgaaggtctccactgctttttatgtcttcattctctgtcctttaaagcatttgataatcatttaacaaacgtctgtctgcctaatatatatgacactgataggccttggggatataaagttgaacaagaaaataattgccttcggtgagttacctagaaaagaaaactagcatttataaaacaaggtgaaaagaatttctaagatgtcccagttgcaggaagagtgtgttttttgttcttttttaaatcatgtcctacttgaaactaaccttatgcctttggttcagatttctttcagaacacacaccttggcctcattccctcctttaaggtgttgcctgaggttcagttttcaatcctgtttcttcaccagtaccctacattcttttctgttctgagttcaaaactcccatatccatgtgaaaaggaaatctagagctgtgtcacaaagacagggcccagtcataatcagctcaccatctttggaggtatatcatactggactacagtagaattcatgcattaaagttctgaatcaaaataacttaggtccaaaatcttcagctgcctacagaatattttacttggaaatgccataattccctcaatcgatatatatgatcatagatatccctgccaactgtttacctatcagtcacaagagcctgttcagctattacaatctgttacaatccgtcaatccaagagttcatcac

SEQ ID NO: 25564 - DNA, 2261 bp, Bovine  19866880541693
aatatagttccctgtgctttataataggaccttgttgtttatccttctatttatactagtttgcatctgctaatcccaaattctcaatccatcccttccccacccccttcctggcaacaagtctgttctatacagacagtatatttgctgtgtccttcatgttctttaaattaactgtccatgcttgtagtaaacatttaattgcttcctatagaaaatgcccttcacaccaataaaggataagctttcaacttgagattcctggactctaccttaaaagatcacttgctgaaatacggtggtaagtacagttctccaaatggcaactctaaagactagctggcttcttcattctcattcctcatctagtcctacatagtttcttctcactcagactgacccaagatacaggcaaaagctgtgctctggtacttattccaggccagtagctaatagctaaggccctctataggcctcaccaggaagccaagcttggtatcgggtagatctctactccagagactgcattccctcaggaaagtgtgcctgagggagcactcatcagatactcaccacaggctggtaggcggggtaagtttcccctacccaaaacatgaacagcatgaaggcgacgaagccgaagaggtgcttacacatgaggttccaattaacaggagtcggggacgtgtccacacggttcctgatatacatgtccaggtcccagtgcatctgagacagaaaggcagatcaccgtcacatactgctcttcctgcaaaaggcaggcagtccagagtgattagagcctcaaacaagacttgaaaggcattctcttgccctgggcaatattctgagagccacatctgagatactctggcccacaggactggatgctggcttatgtctgggtttggttgatcagacacagtcccaatcatgaacattcacaactcaagagcttcaattattctcagaagtcctttacacacacacacacacacagggaacctcagatctcagagcgcttgaccctgcttccttgggcagaaaaaccttagtgttgttgatgtttagtcgctaagtcatgtccgactctttgtgacccatgggctgtccatggggttctcccagcaagaatgctggagtgggatgccgtgtccttcttcaggggattttcctggatcagggatcaaacctatgtctcctgcagtggcaagcagattcttcaccactgagccacaggaaagcccacttgggcagaaaagtgccatctgatctacagaagacatacggaaaaggaagaaagggcaaatgggacatggttctctcaccggttcaccccagttcaaccgcaggtctgggtggtcccagtcataccatggatccctctcctgctgtgagcggtcaggcagtttcggatagtcaccatacctgagagacagcaagaacttctggacacggctttgagagcctccgacaatgcacagccttctcatctctgagatgagaaaccaagtgacaagataatggcctccccctaaggacagaggaactaaccttccaatcaagatctcagtgttttcctgtggtgcacatattgagaaatgttgggttaaagggctgctggtaaatatcccaaatatccccccaaaaagactgtggcaatttacattcctacaaatggtacaaaagagattaattttcctgaatgctttccagtatcaaaattattgttaataaaatatttgctattttgttttattaaatctcaatttttactcactaagcacagcactaactgcagaagtccaaattgttattaaaaattcatgtcaaactccgaaacattatttaacatatgtaagcttttcttatcttctttcaacaaaaagaaaaaaagtcacaccatgttataatgttagcaatggaagggaatttgacaatcaatcactctgttttcctcagtagacagaaaaagaaactgaagtttagagtctgaacctaaggttgcccagttaactggaataaaaacaaaaaggtacagatgagagaagcactgttcctagcaactgtgtttctcaaccacaaaattgacacacatctcgaagcctcaaacaccgtatgggtgtgataggctggatttttcaccaacaagtccaggttcaacttatacagactgctacggaggctgctcttgtccacaacacaataaaagtcataggaaatgatgacaactagacatgtgtcacagaaagtgattggaa

SEQ ID NO: 25565 - DNA, 1214 bp, Bovine  19866880547555
cgtgtccctacaggggcaggaccctcctgtgaataggtgtacagtcttcctagggacatgtctgggtgtataaccctctttgttaatccctgagactgggtgccttgctaattgaatgggcatgtgaatacaactttacatgtaaatatgtatagacaggtggcaggccctttaggtaaacatatgtgtgcagacctcactgtgaatgtgtgtggctgactcttcatgtgtatgtgtgctcatagccctcctatgaatatgtatgtgtgtgtatctatgtgcatgcacatctccctcctctggacacacgtgactcatttaaacctctgtcagtgtgccaggcaccacgctctgagtggttcctctgacctggggtgtattcctcttgcccaatcctagaggctgatccctcctagccttagggctccccccgcccctgccccacttctgcactaagcaaataggaggccccaaaggtaaataggtgtgcctccacagtgagagatggggcctgggcagtttgcctggggcctcttgctgccccagcccccagaccaggatccgatgcccctcctgtggtccagggagcctcttcagtctactcatacgccattctccatttttgggctctgctccagaacagtagtgacctttacctcttgaaaaaaccctccaaattccggttttccccctggccaattcccagtccctgccctctcttcaaggccacctagttaatatttgacctggaaggaaagggagaggccagtggcgcttctggctttgtctcatgagattgggtgagtcaggttttctccacacctagcccaaccaaggaacttcagagatcagacctgaagttcaggggtcagatcagacctaccacctatcccaatcccatccccatctggttgccatgagggagggtccaggtgtggtaacagtctccaagatgtaccgagggaggtggccaaggtctcagggaccctatcgttcaccttttccttgttgctcatgcctcagttaagtgaccttgcacgctcgagcttcctgttcaggtatgacaactgcactgctgagagttggggagggaagagggggcagatacccaccttggtgcctgtgagttcctgtttgcaggtaggggcatgtgtggatgcttagccagaggatacagtacagactcgcatgggcagggcagagatgtgcacccc

SEQ ID NO: 25566 - DNA, 1382 bp, Bovine  19866880549439
atgaaatcatggatctagtcaatgatagtaaagtgaaagtgaagtcgctcagtcgtgtctgactcttagcgaccccatggactacagcccaccaggccctccgtccatgggattttccaggcaagagtactggagtggggtgccattgccaagtgactgttaaaatcattaagtgaaaaactgatagaggggggaaaaaagctgaaggggaactttataatggatagatctggctgacagctccggaacccactgattaatcttaatgtcataaaaagaaaaacgataagaaagtatgcggtcctgatatgatgtgagaggaagttcacaccacatgtaaaatagtcttgccaaaaaaccagacctgaaatcaggcagctgtagaatctaccaatttaagggacagagaaacaggttaaatgataccacaggggtgttatcagcaaaattcagagtggagcaaatttcataggataaatggcccacaatttcttcaattaataaatttctggggtggggggaaggaaagaaagtgcaacttttggaatacaagaaacttaagagccatattaaccacacacattgcatggactgtgattaaaacccgattcaggtgaatttgaacattgcatgtgtatttgatgggagtaaggattatagttaatttttattgaggtgagataatggtattgtagctatattaaaatagcccttaaatgcattccatttatgcattttagaaatgcatattgaaatatttatgggtgaactgatttgatgtctgtggtttgctttcaaataaccctggaggaaagggaaatgtgtagggaagaaataagaccagctacgtgctggtagttgttgaaactaggtgctaagttcatggatttttaaaatatgtatatatacttgaaatcctccaaaataaagttttaacaaataagaaaacccaagccacttcaatattttcctaatatattctcctgaaggagggtctttgatgtgagaaagaatgagcgtcccctcacagtcagggcacaggtgaggtcagagagagcttagaggagagggtgaaacccagggtcatcaggagaacctgagtcctctttggagtggagtgctgcttactgcagaagcctctgccttgtgtctttaagcccgactgttccctgttgggtgggagaagaaaataatatatttggccagcttccctagtcaacccaggttaaggaatagggtttgaaaaggctagtgggttggacccagtgcagaggaaggaggtggaattaggtatctctttttgtgaggctttgttgaggttcaggttcaagatcagagaacagggatggggctagagggatgggtgcttcactaagctgggt

SEQ ID NO: 25567 - DNA, 2007 bp, Bovine  19866880559589
acccgtgtctcctgcacctcctgcactggcaggcagattctttaccactggaccactggggattagcacaaacatagaggcttcaaatagcatgaatgcattatccccagcttctattggtcaggggtctggacgtggttgaactggattctctgctcccatctctcaagactatacccaagtatgggcctgagctcattcagattgttggcatgacccatttcctcgtggtatatgactgtgtccccattttcttgctagctgttagcctataccactctcaatccctacgggctgcctcttttcatgtgcaattcacaacccagctgtctgttttcttcctcccaggcctgggagagaaactcccggatagtaaaaggctggtctgaaaaggtcaggtccacccaagataatctcccctttgattaactcagaactggctggttttgaatcctgattacatttgcaaattcctcttgccatatctgtcctaaatcctcttgccatacctgtcctaagtcacttcagtcatatccaactctttgcgatcccatggactgtagcacaccaggctcctctgtccatgggattctccaggcacgaatactagagtaggttgccatttccttctccagaggatcatcctgattcaggaatcgaacctgggccatatagtggaacataagtcatgaagtgatatcttggtcacaaggcccatcccacctgtaaggggagggttttgacaagggctgagatcatggggactcattttagaattctgcctatcatggtttacaataataatttttaaaaccgatgttcaatggcttccctggtggtccagtggttaagaatctgccttgcagtgcaggagacaccagttcaatccctcgtctgggaagatcccacatgccacaagccaactaagcgcatgctacaaccacggagcctgcactctggagccttgagctgcaactactgagtccatgtgcagcaactcttgaagcccacatgccctagagcctgtgctcagcaacaggagaagccactgcaatgagtagcccctgctctctgcaacaggagaaagcccattcactcaacaaatatgcttgctgtatttatatataccgggcaggctaaaaggaaagacgagggagtcacagcttaccagagcaggatcttcttggggcaccagtaccggctccaacagtcattaggtatcatcctgccctaaaattggaaattctcctcctagtcacatgaggaggatcactgtgtcaagagtcttcaatttggaaggaaaagtgctaggaggaataaggaacactaaagacttccagcacatgagatttttaaacaagaaagaaagaacagacttgactcagccccttaggacctgcctcacttccaaactcgcctttgcacctctaagtccttgatacccctgtaagcctcactggatgacaatcaaccaagctgatgagttacaatcctccaaggagagtccagggcagaagctgccttctcctccctactgatctatgagagtatcacctttaacttcaggtgaggttgatattatctccattttttttttccaggtgagtaaccataatcagagacgataagttactcgttcaaggtcatgcagcaaataaggagcagagctaggattaaacccaggtctgtcagagttcaaaatccatgcccttaattacagtattctttccttgggaaacattatctatctaggctggcattttgtgaggaagatttaaaataagatcctagatatcaaatagaaaggatactctccagaagtgctggactcaaagatggaggatgtttcttcatgtcctctgaattctgcctctctcccccattagctctgatttcacatccttcttccacatatgagaaaattttatacagtcatggccagaccctgtattttccatataatattctgtctgtattatcacctccagcttgagtgaattttactca

SEQ ID NO: 25568 - DNA, 1435 bp, Bovine  19866880569305
gtgtacatacaaagcagttagaaattagggattctctctcaggagaatggtggtattgcaattttttcccctttctgttgagttataccacacatacaatagagctctaggcttagagctcagtgagcttttacatatgcaaatacatgtgctgccaccgtcagatcaagatttctagtccctgtgagttcccttgcgctcctattcagtcactgtctccccataggcagccactcttctgacgctgatcactgtagagtcattctgtgtgctcttgagcttcatattaacagaatcatacagtatatcgcaccaccaaataatttactgggtgcctgctgggtgccaggcactgtgccaagccctggggatgcaacagtgacgagacagacaaaatcccaaccttcgtggaacttaaattctgctcagaagggagagatcaatactgtgggaggcaacaggatgaccaagggggagagtgacgagaaagaagaaagaggatgaagacgaaacaatgagaaatatttaaaatggggtggtgggagggtggaatggtcagaggattgagagaatcctgagcaggcagccacacagaagcctgagaacaaggagggaatgatccactgtgtcacatgctgctgagaggttaatcaacacatatttatggagcacctgcttcgtacaaggctaggcatggagtggaatggagggtggccataaaactccctgtaataatgatctctaacatgtctatagagagaagggaaggccctggcgggggaaaacaccataaaattccaatatgatcatgtcactgccctgcttaaaatcttcctttggcttctcactgccattgagattaagatcaaaacctcaccatggcctcctgggctctggtgatctgactcagtggacccctccagcctcagctctctcttccagttgctctgactcttctggcttcctggccttgttttttcctcttgttctgctccctcctgccccagggcctttgtacacaccattctgcagcctaaaacacttttctccttcgctccacgcctagaaagatctggttaattctactcaccattattcacatctctgctcgatggttgcctcttcagagaagccttccctggttttccagtttagaacagttccctgggttttgcatttccacaactcactttatggaactttctttcctggcacttatcatggtgagtgatgatatatctgtgtggttattgtataaatgtttgtttttctccaaatcggagccccctgtgagagcagagaccttacctgcttatgactgtcagtgattcccagcacctgcctcaatgctaggcccatcatgagggcccgataagcatttactgaatgaatgagcttatgaatttgaagtcaaaagactgtctttaagccctag

SEQ ID NO: 25569 - DNA, 2039 bp, Bovine  19866880644773
cagggtcttaacccactggtccaccagggaagccctaacgctcttgtttttggagatagtgtcatctgtctcttaccacctaggtgtgtcatctgtctcttaccacctaggtttgattgctttcctccatctgtctaaacctctgtagaaggtatgggcagatggacaacaatgtccagggggatcctttagaaatgggagggaagctgagggtctcattcataaggattccttttagagagatggaagatgcaaaatgtattccagaaggactctgaaatcagggaggtaaaaggaaaggatgaaaaggctaacgtgggtccttttaatgaagaggggggtcacgtccagcctctctgtgaggtgtctgatgaaataagacagaggctattttcttgctgtctgggctgggacagctgctacgggacttcatatacctggaccttccaactgaactgacttgttcacgttaatgtattatggagaagctggggctcgtggaggccccctggtgtagtgctgtggtgtttgttacatggaaaaggcaggggaggagtccctttggcttagctcactcagcttgctttgcttgatccaccatgtatgtttgttgttgaaaccttgggctactcaaatgtcagtatttttaccaggcagatgactgtggtggtgtatcagtgaaggttaagctcttataccagacttctttcttatagataagtgatttccagcgtcttccattgagaatcattgccatagtgagccactgttacttataaaaggtttcttactgtttatgtctattggggtgaaaaaggttgagtcactatgtcgagtacagaaggtggtttgcagcttgcttctccctgtagaaactggactgtggatcaccctagaattcctttttctaaagtatggaaagtgttctatctcagaggaacttccaaaggaaaacttgtaaggagatggaccacaagattccatcttgtagactttgatgcctctgaactctttgtcaaggcctatcagatcccggaagccctggagaagctggctgggatggggaggctgtgaaaaggggtgcgctggtggcaggcatgggtaaccctcttcctgctgactgcatgaggagaacgtgtgaccaaaacttttgtctcactgaagcaacgggaccaagtctccaagtggctaagaggcttcatgacgaagaggtacttttggttggaatgagtaacaaggcttgtcatgtggttataaaactcttctaagaggtgctttcatttaaagactacttgtataatacttttgaggtgaaatgctagcattccattctgttggtgtcagctgaagtggaatgggtgtggacacagagagttcttggaccccacttgtccttcagggggcaatgacaacagagttctggctgaaggtgtctatcttaaccacgaactgctgtgtctgaactgcactagggtggatgtaatgccaggattattaaattcgttgtgtgctttatagtgcacagattataaagacttctatttcagttctaaaataatccttaagtttagcaggacaggcctcattatcaacactttgcagataggtaaacagagcctcagagggactcttattgttgcccagaaccatctgatcagtgtgtttttcagccaagagttaaacccgggagttttggtttcaaggtcaagccccttgggttttgctgagccgataagaggcagtctgagccacaggactcccctgaaatcagttgtttttttttaacagagcaaagtcaagtgccagtaggagctggagggcatggagaactgctggtcatgaaatcatcaggagatcccactttattaccacatttgcaacttcttgagtaagatttaacatcctaagaatgcagaatggcttttgagaaaatttctcaagctctgttgcataatctgtgcccactgtgggccttatagattatactccatgggggagtgctcaggactgagcagggaaacacgttggccagggtaggt

SEQ ID NO: 25570 - DNA, 1158 bp, Bovine  19866880694945
tgctgaacactagggagctttatgcaagtaaagttctccccaccctctaagtcccagggggtgacagatgaataagatcaatgtccagaaacaaggcaagctaaactcaccaaaacacagctggataaataacaatgagaattgctaatatacaaccaaacctcaccctctggtatcagaaacagagggagattcaaacccagagcaaagtgtgagaggccacagtggaggcagaccctaactgggggaggctggggttgtaacataccagacagaaaacatgatcttgggccccagagaagcaacaactggaactgagtattcccctgaataaagtcaggaacaaagcaggacaacactgtctatgaaagggaaaccgcaaagtcatccccagggcccacggaaacaagtgagggcaaagtgatgtctctctgagaagtggagaccccaagcctaaccctgagtccaaatttacaccatggggatgtggcaggaactcccagctaagaacttacatccaaatttatccaggatagtaacctgctcagaaaccccagcaggacaagggcaaatcttctttgcagagacatcgtacaatccagaggacatgggactcccacagaaacaagtccaccactaaagatgagctcagtacaacaaatgacagacctcatataaatacagactattatgagggagagttagtagaagtaataagcagaacaattagtaccccccaagaattagagataataacaatccaaaactatccagaacaatccaaaagcaactatatagtaagcgtgtttaaaattctaaaaggtatttctaaaagtatgggtgggtgtgcttactcactcagttgcgtccaactcttgcgaccccatggactacagcccgccaggctcctctgtccatggggattctccaggcaagaatactggagtgggttgccatttattcctccatctaaaagtatgttttgtgttaatcacagatctggatcccacatccccttccttagcactgctcagcaactagtcaggtaatagtgaccttaaaaaggcaaagaagacacctagattgtgttctctggggacttggaggcatggaaagagaggacccccaggcagccctgaaagtagagcctgtcgcctt

SEQ ID NO: 25571 - DNA, 730 bp, Bovine  19866880712611
tcgcccgcggcccccgtgcgggattaattatcagtggaggagagggcagcccggcccagcccagccgtctgtcactaaccaaggctagagtcacccaggacttggccaccctaagtcctcttccaagtctccaggccgcctgccccctcaacttccaaggtgtccccagatcccaaccctaagcccaacctcatatcctggaccctcagacacacttagtcaaggccttgccatcagctgtctaaaccaggaaggcttctctggccccttgactgggttaggccccatatgtgcccccatcattaccctcaaccatcttgagtgactctctgtgcagagtccaaggcatgactgtcccaaccattgatcctaatctgagagaatggcaccatcttccactcaactgcttatgtcagatccctaccagttctccttgactcctccctctccctcatccactcagccaatcagaatccaagtcctgtcagttcagcctcctggaaacagcaaatctgggccacctgcttctagctccccatcaccacgttcagcaactctgcctgttctgtcttgcttgtagctaatgttatctttaaaaatgcaaataatattctggtgtactcccccgccagcacacacatacacagtttaacactttttggtttaacactctttggtggaccaccatggggcctgcaggggggtgaaagtccaaactcttgactcgcaa

SEQ ID NO: 25572 - DNA, 1405 bp, Bovine  19866880715934
catatgtacacataggggtccagttctcacggcaggcttggaggctatcagtatccactgagggtgagatgtagagcagaaccctgcctcccttccccaaagtcctaattctaagcccagaatccaagtttgtgtttgtgagtgtgtgtgtgtaaagaggagggaagtttctgatctcagatgctcaaataggatgcgtgcatgggtcaaggccagtcttgcaagggatggaggggctacataacccaggcaggaggaggccccttgatgtagcaaagtaaagatgcaatggaacaggtaacttaacccacctctactgcagttctagatatggaatttgggctgggagcgctcagcctgcatttaacctgttgggcaggagggtggggctaaatggggcggggggacgggcggagctgccatccccttcccccagtgaccacaaggcttcaaggtctccagtccacatcccgcacactatctcaggttccaaagcttgcgatcctcccccagggccggccccctgaactctgaccaccttcccgctattagatcttggggtggagggaaccgaggagggtagccaacaggatcaatgtaggataggcaggctgtcaaccttcatcccagatgtccacccgcctagtgtaggcggtatccctctctgcccagtaggatgatggtctctccgggcctgagagcccctcccccgctaccctcgccttccttcatcctggacagtttgcggttctctcctctcctcagatctaacctcagtctctcctgctgcagctcgaggacgagctctccttcgatcccgccagacgccaggagacgtgacccagatcccggggagcactgttcaccacgcgggcccccgccccactccagatcccgactctgcggtggcaggtctgcgaccagcgccgcccgaggcctggcccgcgcccctctagagcttttatgcgggactaggggacttggcggtgagaaaggcctggccgagcctggaaggtttaacagacgtagggaaggcctggcctggcccctgccccccggcgcaggccctgccgctgcccgcactccacgcctgtctcacctttgctcgcagatccccggccatgcagacggcgatgcgcggctccgcggccccacagcaccagctgcgggaggaaggggccgcggccggaggcggggctggtggaggcggagccgggggtggagcaggggcctggaaggcggggccagggaggcggggccagcagggaagggtgcggggaaaggcgctctctgctttcgcatccccaccctatactataggtcaaggctcacacagtgccctcgggcgtctggcgtgtcccgccctctagggccgcgccccctggtggtggtttcatcaccctgt

SEQ ID NO: 25573 - DNA, 1228 bp, Bovine  19866880738255
acaaagctgggacagagactggcagggaaacagagacagggactggaaaaggaactggccataatcctccctgccctccagtcccgcagccaacagctgcgccccctcccccttgaaactccattaacactcaattagagggcctgatgggctcaagccagggagccccaccccccacctcctacacacagtccccattccagggttcctctgatgggcccctggggagaaggcttcactcaaatttatgactaactccagcggctgccttgccagcctctcctgcctcctctctcttctttctcccagggtggagcccagagggttgggtgaggctggagcgggccagagcccacgatggaggccccaagatgaaagggagcaggccctggagcagaggaagtgggaggggagaagtgaggaagcgccgtgagagtgtatgagagagaaaaatgacaggccctgaatattgggcgccctcactttaaatcaagataaaagactgaagtggaaaatgagagtccagagaaaccccggacggctcggggcgctaatggaaacacatggctgccggctgcgggcttgtcagcttcccccggcgctgccattcccgtctgataatccggcctgccataaaattagactagcaaatacctcctgacaaagatgcatgtttctctctattgtgccatcataaaaaaaactccgctggtgactcggggagccgcaaacttcaatttaaatttacagtgctgcggaaggaaagtgatatgcactcaaaaattttaataacctattaagttacgacttcaatttcattttatgaatattttccttggggagcacggctatcacagagaaagatagaaatttaaaaaagataaatagtgccattaatctccaacatttctcttccattatccttgaaaattaggagttatttttgttcagatcttcatgtaattagctccctccacttgattcactagccagaaaatgaccatgttcagaaaattaaaaatttgtcattaagtggaatttaacataatatcatttatctttatctattccccagctgacagcaggaagccttggctgccgtaccggctggtgtgtcagagcggggagggactgctcagagagagatactgggggagacagagatagaggcggatggagcgggagaaggccatcccagaggtggccagagctagagtgaggagggacg

SEQ ID NO: 25574 - DNA, 540 bp, Bovine  19866880825701
cgcctcctgctcccccacccggctgtccatcatgaccccaggcaggctgacagcccacccctcagacccagtacttcccacagatgcagaacaacccagaacaccccagcacaacacacaaaacacatctcctaactcctgacacttaaccgtgtgcatgtgttcacagacgatccaccacccacctgctccctccccaccccttcccccacagcccatcagccagttggtgtgccctcccccagaccaccaactcagcacccctccatggcggccttcacgcagaagataggatagccccccgcccaccgccacacgtgcatgctcctacacgggagcacacacacattctccccacactacagcccgggccaggcccacagtgagcacagcacggcctgccatgtttgcacactcagcacacacccacacgcaatgcacaagcacagccatgcagactctgcacagcacagttctacttgggactccaacagctctcagccattcgcctttctccccgcccgtccttttatcccataa

SEQ ID NO: 25575 - DNA, 1450 bp, Bovine  19866880884018
ccacccccccggagagagcacttaaacttgttttcattcccttattctttatttttttaatgtccactctctccggagtcagtaatgttcttcctctctttcctctcccattttctgttaattctgcgccatctgccttagcatctgttaaaaataaaatttccctcacacaatgagaagcttccctgctcctccctcccctctgcagccccccaggtttggtgctggggccgtcagatgccacttcctctcctgggatgtttccccctccccccagtccctagtctggttttcagaggagagatgcagcactgggtgagcaggcggcaggaaggagggggctgcccagggggcctagagctggagggggcagctgcagagggaaccagaacggggtgggggaggtggggggcatgcagaggatggaaccaggctccacccacttgccttcgggaccttgcccaggctggagctctgagctgctgagactgaacacctggcacaggtaggtgacaacaggtgggggagagacttgaggagtgagtcctttttccccagggaaggaggtcacggattaatccatttaccctttccctaaagctgatgctgggggcctgaggctgggatggtggtaggatgaatttaggagatgggagaactgcccccaagacccagagattgtcccctgcttggaatggatatggcgttggacaatgtatcctcaagactggctgtccagaaacaccctccccttatgtgctggaggactttgtccctgctgtcctgggctcagctgggagaagggagagaaagggaatcaactgacccccaagccctgaagactttaggaggcaggaaagtcttggcttgaagccagctggccagaggatttgggaagacactcagtgtgtgtgtatgtttgtgagcaagcgtgtgtatgtgcctgtgagattagtgtcattactgatctgtgtaggtatgtttgaggagtatgtctatatgaactgggttatgattggttttctttctgtgtcatactatgtctggctacgcctctcaggtatgagtgtactgtgtatgttatagtgggtgtatagctatagctatacagctctatagatggtgtgactgtgtggtagtggatatattgtaaccatgtatttttgtgtatattagtataaatggggtcttgcaaaaaactatcttcctgtgtaggtgatgatgtatgtaattgttcatgtctttctattttggttgatttgtatgtgaaaatctacatactttgtttattttgtacattactttatctctcctgtgatgctggatgtaactctttctctaggcagtagttccttttctcttgtgatggggtactctgtatgtgatcagtgccaggtaggtacctctgtgagtattgcttcacttctgagtgaagtgactatgggagtat

SEQ ID NO: 25576 - DNA, 1941 bp, Bovine  19866880909644
ctcttctttatatcttctgcttctgttaagtccataccatttctgtcctttattgagcccatctttgcatgaaatattcccttggtatatctaattttcttaaagaggtctctagtcttaaacttaggtgagaatattccatattggcttgtaaatcctctgtattaaaaagactaatatgcaaccttcccagattttaggttgggaaagagatacagcagatactaaagatatccacacccacagactccttgttgtcaactcagctacactgatgacttggacatatcagtggaagcttagtttgaagccaaaatctatgaacaggtttaccttacaaagaattggaatgggaaatgataatctttcatgaaggaagataagaggtaagtacttgcctatcatagtgagaatctttagcttttccttcatgaaggaaattccctttgcatctagccttctgcagattccaagaaaaaaaaaaaagattcttttcatgaagacatttgcaaaatcaagtgtaatgtttttatcttctttgaacatttcacagaaaaagctattgttgcagtgagttagttgccacaaaaatcaggaggaaacacacaggaattcactcatctcacttggtgatggaggaccagcacacaagacctacagtaatgtgtccaaacttcaaggtgggtgaatgtaatacttcctgcagttactagacttgtatgaagaaagtggaactcttcacaacatatattcaatcagggactttataagaatggtgcgtgggataaggagaatggtgagtctctccagtcaggcataggggctaacattcagtggtgccagaatgcagaagccagagggcataatgatggcttcaggcaggaatcaacaggagttgtctctgcttcttctgtcggtagttctctccattttctgagacatgcacttttctgtcactgtcccatatattcattccactctaccctctgtttgggaagaaaaagacaacagacccttcacagccctgttcctggtctactactgaagggcttaccttcaattatccttagcttggacatccatactcctttccccttcagtctggcaacttagcgagtgattcagtaaaaggaaaagatgttggtcaacctttttcggatgccagtaaaagggataccttcctaccttttggattcatccaacaaagctaataaaattttctaatcctataggacatgagtctcagtgaactctgggagttggtgatggacagggaggcctggcgtgctgtgattcatggggttgcaaagaatcagacacgactgagcaactgatctgatttgatctgatctgatatttcttagtctgtgagttcaactgacttaatcccagattaagataaagtatcaaattcaatctcagacagataaggcaagccaaaattttgacactaacattgaaaagagaagtagttctcctgttcagctgagcatgcctactctcaaacaatttaaaattctaggattttggagctggtagagacctttgtccttgtgactaccccttagtcttggtactcatgaatcttgcctccaaaaatgtccactttatgtgaagtgggactctggtgcagccagaattttttctgttacctctttgtaatcagacaaaatgcaagtggctgagatcgttgtcagtatgtgggtgtggctggggaaaaaataccctctgtgaccaatagttctttcatcactgtactctgctttcatactgttgctcatgaataaaacatattcacaggacattgtgtacttttctttccttattcagtttatgcagatagccacttcctttgggcagtaggacagaaacctcagttctgtgtggctagagatgaaggaaaagaggcatgaagaaactacagcatttgttaagagcaca

SEQ ID NO: 25577 - DNA, 874 bp, Bovine  19866880913975
taaaagtgctatttatacctgcagattattcacattagggatatcttcacgtttttcatccaaaagctttgaaataatcactaggctgaggcactgtctcagttgcctgaaattagaatttttaggatgcatttaatcaatattgtttaagaagcaaatgaatgagccaaaagaagttcttctaatttgcaacacagctaatgtttcaagagaaggctatataagaatatataaactttattagaatagtaacatttccatgtaaaatatttgtacacaaagttaaagttgtctgaagtgcaggaaaaccattgagagcctttatttttgaccctgacgatttactgttagaaaatctattttattgctggaattcctttttattaaagcaaaaaaaaaaaaaaaaaaaaaaagcgaattgattcatttttgtggtatatgccatctatattaagttatcagataagctaaagctaaaattaacaatcaagactattacaaagtgatgtgagctgaaaatcagaatcaggctgtcaatgccttttcttataatatcaaataaaagactctgatctaacattcaagaaatgatgaaaggaaataaaggacctaaaagcatttcattaatgtaaacatatatcattctaatgtttcattctcacttttcaataccttccacgtgatgtccaattagggaccagctgtaccaaccagagaaggttgtggggatgagtggagagttcgtttatggccagagagagttcaggcacctgaaaacaaaccgtgagcacaatttttcacctaagttagtggaatcaagtatctaacagatcatcaatgtcccttcttgacttaagattacaaaaagagcaca

SEQ ID NO: 25578 - DNA, 823 bp, Bovine  19866880918932
tagataaaattagagatgaattcaagtacagcacagattagaagttgagagcttgaaaagtagggaagagactgggcaagtttgaaacgtcacaaaaactagaaggtactgccttaggggtgctgtttagtctagactagaagccttcagtagcttcaaggcacatcacaatataaaaactgccaattatggcagcaaccctctgacataaaggctagaaaatgtaattttctagagtaaccttttaaaacaaacacaatcacattggttactgtacttttttttttttttttttttactgttttagtgcttatgaggttttgatgaactttagtcatctggaatattaactctgtagatgtgttcagtcctctgtgccaaggagatcaaggatgataatgctttagtttgttgctgttacctatcttgtctttctgttgggctttctcagggtagatgaaaaataaatgactctttcgttcagtcttaactttgaaggcaccacactaaaagtatacttcggattgtttttctaaagctctggtaccttcatttgcctggcccgttctctgctctcttcccttcaaagtatgtctgagtggcagagcagtcttgtgtgtttgggttttgacagaaatacttttagttgctgtttagctgtccacagccattgctgggaaccgtagttttctttggatgtacctgagtttgaagtttcttcttcttccttctccattaggttatgtttgctttcattttgtaaaggtcagtcagcagcttaaggctgtagggacattggtgatgatgatgataatcatatcat

SEQ ID NO: 25579 - DNA, 1012 bp, Bovine  19866880937987
cctgagtattgaagtcatcacaaaatatatatgcacatagtttatacataaatgtgtgttaggtaaattgtggagtgcctataaatcttgctctcaggggaatgagggtggggtttactgtgggaagtcataaaccacagagaggctaacctaaaaatcctggctcttttccaccctccaccatgcagaacaaacatcctctgagcagtcagcatgagagtgcttggaaaagagtcataataatcacccaaatattttctggatagttccttgatatgctattctatatttttttcccttatttttttccactctaaagttgttctctgaggagtggatgtctgattccaataatgatccatacttatctgctctgatatgaggccatccactcagcacaaatgaatgttgtagaatccaatcctattcagagaagccgcatcaagaagactgctagccatcaataactgagtaagactgtatttctatgaacaaatattaggcagaatggccctctctgagagcagagtacagtaaagataagaaaataattggcctaacttcatctcctctatactccaggaaattggaagaccaagttaataaaagaccaagaaattcctgaaaaaaaaaatcttgctgtcagtgtagggatttgttccagaagttggagtttctagttggtggtgcttgcagtttctggctaaatataatgctactgtaaaattgcttgcttggattccttatgtttattagaattccaagagtgataaagaattgaccatgtaacaaaaaatatttgaagttataaagcttaatatgaacacagcctaaaccaaaaatcatggatgggcaagaatgcaaaagcaaaactgtgcttcaatctcagggatacaaagctgttatatctagcaaattgataattaagaaattcttcagaaagcaaactaaatcccatgtaagtaaaattcaaaattttatacattttagaaaatctaaaattaggcatcta

SEQ ID NO: 25580 - DNA, 732 bp, Bovine  19866880952541
ccccccaacaaatattagacttcacgagagagtagtttcctctgtacctgctggtttaaaaataggagcatgcaacatggctgacctctatacaggcccaaacgcccacctttccttcttgtgtctgccctcatgctgctagttaggataggtgttaagcaatagggcagagacgcttcctctgcaacaagcagaatttttgcctgaacagccctagcctagctatgtgaagggaagggcctcaatcttttcatcagggaaaatgcaggcagcagaacatgaattacagttctcagtgaacttccagacctagatcttcaatgctccacgtgcacaagcacgctgggagaagtgaccggacctattcaaggacatgcacgtaatcaatgggatccagaactgtttccctgtaactcatttcagaactcttttaactccatagtatggcttcctggcattttccccaagaagtgtttgctggagcccagaagagcttttaccctgagctgtattcttttgggctaagcctgtctgtactagatactgcccagtgggtgagatctgagcaaggcctgtagtttagaggaagtacagtaggagaatcaacagttttctagagaagcacagcaggggctttgtagccaaatagtactaggttggaatcctgattgccaccaatcacttactcttgagctgtaaaatgaaaatacctaccttgcaggacagtgagga

SEQ ID NO: 25581 - DNA, 630 bp, Bovine  19866880959658
tggcccgggagtaccaaaattgtggctttgggcttcagggcatggcatctggttctgtggtaatagataagctcaattagttcagcccttctccagcttctcagagacatcactgagaccaaggcttgatttcaaggccagacagggtcccatccctcgatgcagggggtggggcacctaatccaggtggatccagagcagcagaggcagctagaggggaagaaggccgaggtgcggcgcagtggagggcccagctgatgacactcctggcctctgagctgcgggctggcactgcagaaaagggtttccgggccaggaaagtgcccaagtgggagagacacacatcgaggtgttattaaaattcacctaattattctggagacaataaagccaatgtgccgtttgttccttgggagagagaatgactgagaagggtctcggtggggattgggagatgctgaggcattacttgccgagcaaggcgagcggaggtggcctggggacctggcagcccagctgtaagcagccagcagcagagacagggagcgggcttggccccactggaggacaggttccgacttggagctgttctgaacgcggctcaggtctgagacaggctgcaagcagcca

SEQ ID NO: 25582 - DNA, 1540 bp, Bovine  19866881029466
cggcaggggcggagccccggggggcggcactataataataaggggaacctggaagttaacacaggagaagaatgggctgggtgagaggacaaacaggagaacaaaaaaggaaagaaaagcaaagcagagacctcgtgctggggtctagcaggatccgtgcagggaggccttggctgagttgcggggccggttgccctcaggagaactgcattcaccgggtgggagagggacccgatcggtgaccgccgccgcccgactgcggacctcgaagggggcccagggtggggcggcgcagagccttgcagccgccgggaacagagcggagcggagggaggggcgggaggcacgggcttcctctagggatcccggggcctcagagctgcgctaacgagcctgcccggctgggcgcccaaaagtccggtgggggggttgtcgaacccgcacggccgagctggcgggctggcggaccgacacgctgagccgccggccagccaggtggcggtactcacttagtaaggcggggttgctgaatctccaagcctcgttgtaggccgtgtactgggggtggctgtacgggttgccggagaactcgctccctgcggggggggcgggggagtggggatcagacactcgcaaggccagggcgggcccgacgtgcccggccaggggcctcccccgggtccgaagtgcagatgcttcgccaggcggacgggcggagagagaacaatccacctggtccgcagggggagaccccgtgctaatggtggtggtagtggtggtggggtgtgtgtgtctgcagaagcaccgacgcgcctcccacagcgccgcggaggtagtttcggggcgctccctcggaagcgctccgagtcacccaggaagggcttattctgagtccaggggcacctacgccctgcgatggggaccaaagcctttttagtggagactctggttctaggagccacagccccacagggtggaagcggggggaggatggcgaagacaggctctagggacactttgtcccagaaagtccggggaatggcatctcagcactgtgccaatgcgaggggtgggggctctgctgggaaacactcccctctcatctttccctctagagatttgaaacgtgggccacgcagcaggggaaggaggcggcgggaggaggcaggtggactgcccgcgggttcacaaacggtgaacggagggccccgtgggctgggagccgtcggaagctgcttccctccctccgcgcgagaaaggccaggcccccgggtttccccctcgccctttctcctgtgtgatgaccccagactgtttacagtgatccctaaccgcgggttaagtagaggagaaggggcccctctcggagagggagctggggtgggggtgggggatgcagccactggaaagcctgtttattgacgaggagggaaagcatgcgtgcagcaggataatgagcttctgagctcaactgtgaccaagaggaactgagctatctccttccccatcgctaatgaaacaagtgtaatttcctcatcag

SEQ ID NO: 25583 - DNA, 1201 bp, Bovine  19866881043217
gcctaggggcccggaccttagttccgggttgatggaaccaggatgggggcaatgggactagcaagactcctttccactccccactcagcacatttgttccatgcttggaatgaactccttgctagacaaatctatgaagtatctacccacccctaggcaaagggaactgatatgtccccccccacattacccctaccctaatagccccagactgatacagctttctgagccttgtaaaatagtctaactatatcaataaatattagtagtttgtcaaagcacccaggccagtgcacaggaatagacactcaaaaaattgctaaatgagtttgtctcaggcccattctctcctttaaccagttctgggggcgcttcgggtaggagcctcccctgaacccattccccatttaacatggtacgtttataccctgctgtcattagatgttatcctgcccagctggctactggacttggtcctgtttcctttggaaagctgtgagctccccgggggcagcttcggagccttggctgcattctccatcacctccccgctgcccaccaccactcctgcacaaaagagaactaagagtccacggagcactgtgaaggctcagtcaacacgcaatcctcaggtggatacactggctcagagggagtggctgcggggaggaggcaccaagggaagcctgacttgggacacagacagctgccgtctggcccgtgcagccctgctgtacccggctcaactgctgtgtcagtgcaaagcggggtgacatcagctgtggaagaggttactatcaggcaaagggaagggcaggggagagcaggccaaccgcctgtggaggccagaggctggatcagctggggagagggtgcctcatgggggctgggttcgggtaggggcctgcagggaacaacaaggagggagggagagatgcaaaagagaggtgctgagggcatggaatggttaaggcctctaaccttccacctgtaggacagagggaacattgatttggaattctggaagacaatgagactccccttagccactatacgaagcaagcggggcacacctctctctgaccacaaaagcaaggctggggcatgccctctcttctccattcagctcagaacagagtcagggcaagaaaggctttccttccagctccggtatttgttatttggaggccctgggcctgtc

SEQ ID NO: 25584 - DNA, 3107 bp, Bovine  19866881049861
tgttgatcccatgttggcatgatgacgactgggggtacaatggcagtgactgagttggttcccactcgtttccttgcactgtcctggctcacatctccctttgacctcaggactctcagcagacactactttaccttctaccatctttgaagaacatctccttactgggaatggaggataaacaccttccaggaggtagatatgggttaccgcatttctttaagaaagaattttctaatcatcagagctgcctgaaaccaaaaagcttatctcaggaagaagcaagtctcctaccctgaaggagttcaagcagaaagatcctcaaaatgagactactatgggagcagtgaaatccttggcctctagtatcatttgtaggcccaaggccctaagaagtttctccccagaggaggatgatttcaggcactttcaagagggttattttgactgaggaagttaaaaaatgattgaggacggactctgatctcttattatgggaaggggcattgaggacagagacttccctcctcaaaaggtgtctccacagctgttccagccttatccaaggatctcctttcccctactgccaagcccatggactctccaggggatacacatcttctcactgtcttctcaaagatgaacatggatccagcaaggagctggcaaagggaggaagatgacagtttgtagatatagaacatttgatgatattcaagctatatcaagttatagcacatttgacgatatattgtcagccccaacacctttgatgtggaggtttaatcctgggcggtccctaaggggattggcacctcactcattgctatgccccctgtgttgagtgcagagactggtgaacagaaggcacataggaagcttctttttcttctttcacctttccttcttacacaggaaatacagagaagaaagacaaaaataatgcccatataagttagacaaccccagttgctatttgaatgaccattcaccagacaactctttctgcctgtaaataaacatagacacaggtgcataatatgacacaaacaggatcaaattctatgttctgttctgtaatcttctcttacataaaaatatatgatagatgccattctgtttcaatgaatatagagctatgtgattgttggcataactgaagtatattccattgtatgatgtattgagtcagtcttctgttgatccacatttaggatatttctagttttgcactgttttaaacacacttgagatgaatatatttgtggacagatcttttcacatttgtacgattatccccttagggcaagttcttagaaacaaaagtattggatcgaaaaaatacacattttacatttgggtatatattgtcaaactaccttctcaaaaggttgtaccactctatattcttaccataagagggtatcatcagtcctttaccatttgcttaaataaaagggctctttcttcaaaggcaaaacaacaacaaaacccctaattcttcagaccactttgtatgcgtgtgtgtgtgtgtgtgtgtgtgtgtgtgtgtgtgtgattaagaaggtttaagtaaaccttctatacaaatgtggttgtgtatctgtatgtgttctatatacaatcactacctcataagctgaagtcctacatgaaaagttctctaccaaatctttctctgcctcctcagtgcagggatgaggtctgttgcagctttcctggccccaagaatgtgcattcattgtcagtcttgctgctgttcttgcagtcccctggccaaggttgttaggaagagagtaggagggaggctcggctgggtttgctcatggtgggacttccagtgttaattcaccacagctgtgaagcataaaactgggtctccagctctgtgtgggggaaacagtgaacagattatcccaaatcaatacatctgagtcagctgtagatcattccagggggctccataggttagggaaaggggaggatgatgcggttcagggtcttcctacttgtggtgcctactttacagatctctccaccatccctctctccatatcagcccatggtcagtctccgtctcatatatatcacccctacactcgcatattcacatatagtccacaacccatatacttcccttaaaattgtactcacattctcacaaaatttgactataataattttcatacattacacccacatcctcgcatacaatacattcatagaacttgacgcttacacacacccacttacataaacacacccagtcacccaatattcactcccccacagcctcacactgtcatgctttgtcctaaggaaacctagtcacatgtccctcctagttattgtcatttatattattgcaaccacaactccataccctatatctccacccaacactcccctttcacactctctcagagtcccacaaaattcacagtcatactcttagatcttactcaaagtctcttgaacacatccagttaccagtcttagaatgtcttagctcttccagtctacccatcttattttacagaagggttaactgaaactctgagaagaaaaacttgactaaggtcacacaattagttaatggaaaatctggggtgtcaattccaatctcatgactcccacactagtgctctttctccaatgcttgcccttccccgattgtctcccttccaatcccctatgtcagtccccaacactgactctcagttcagttcagttgctcattcgtctccaactctttgcgaccccatggactgcagcatgccaggcctccctgtccatcaccaactcctggagtttactcaaaattatgtctattgagtcagtgatgccatccaaccatctcatcctctgttgtccccttctcctcctgccttcaatctttcccagcatcagggtcttttcaaatgagtcagttcttcacatcaggtggccaaagtattggagtttcagctccaccatcagtccttccaatgagtattcaggactgatttcctttagaatggactggttggatctccttgcagttcaagggactctcaagcgtcttcaccaaaaccacagttcaaaagtgtcaattcttaggcactcag

SEQ ID NO: 25585 - DNA, 790 bp, Bovine  19866881069721
gaatgagccaggaaggctgcagacatgctgaggagaatgaaaagaatgtgctgtatttcaaaatgtgaatgtgatcaatttatccttcctctgtcctgttttctttgctgcgttcctttttcccaaaagagatggagggatggagaccactgcggtcacattttccagcattggctatatttaaaagaactacactttagaaggtaccgtgtttgaacacccacactgcatcagagaaccccagcatggggtactaaaaataaacaccccaccccagaatacacacaggtgcgctcatgcacacacacgcgcatcctctcagtccatcagtgcgctgttaactataaactgagctctgggggtgagagccacagctcagacattggaagtaaacctttggcaaaaaaaaaaaaaaggaaaaaaatgaacccagagacttccaagtcctttttccttccagagagaaggcgcgtggagatgggagtggaggcgacaggacgcagggctcccacactgccgattccaagggccccactttcaccacacgagccctttgagttgtgcagtgcccagtgacccagctgtgagctgcagccctgagagtggttcccacaagtaactatgaacagaaaagaaattccactccatgctccaccagttgccctgacttctgaaaggtgtttgtggaacattacagtggggtctggcagaggtgctggcttcaagaggcaaggctacatttctgcccttgccatgaggtggatgacaggtggtgagttagctgcctcag

SEQ ID NO: 25586 - DNA, 731 bp, Bovine  19866881075859
atcttccaatttagcctgtaaacaagaacaccttatttttaacacaaatgacagtgaaactataatagcactagcacaaaatacctgctaatttctctatttttttttttaaggtaaattaaaagccagtcatacgaacagtacgttaaatttagcaagacagtcatgatgctaacctacctgtgtgtgtcttccatctccttcactagacgctctaaagtatttgtataagtcccactatgagcatgttcctaaaataaaaagaaaatttaggaatacttcataacatatcttagcagaaaaattgggatgttttaagttactcagaaactaaaaaacaatttctttttcaataacctgggccaggaggatatatatttttttaaaataattttcaccatcatgctttaaattgagaattttgtagtgcagtcaatttgattttaccatctattaggaaagggcactacttataaaaaccctgctagtcttaggaactgactgccaacacccaagggctccatggctaccctgtctttatttttaaattctattttactggaattaaactactaatttttaggtgttactatgaaacagtaacaccttccccaccaaattttacacacatatgaaaatttaattccgcttattcccaagatagcatgaagcacttcataaataaaattgcacaccacaattaacaacatttctacactctaccttcattt

SEQ ID NO: 25587 - DNA, 1028 bp, Bovine  19866881149992
attttaaaagatataactcttcctctccctctccccactgcagaagccaagtacaagaagctggagaagcgatgaaaaacaactgtggggacaaagtcttttttaatgtggaaagaatgttttactaagacctgaatcttcaggttgatgaattgtgaaaactcctcaaaaggcaactacgctggtcgtcccagaaacatcgcaacattggagtaaactggagaactgtggctatccttggaggaacttcttttgaggcagaatcctcagaaactcaacacttataactccttaccttttacttgaatgcttcatcatccattcaggacaaagagtttctcaaagttcagataaacctgggcctgccagtagaatcaaatgagaggacctcttttccctggtagcagttgattactgtattattttcttaaatggttggtttttgagttactgtgtaaaaggtggtttttgtctatcaaggatgtaatgtattgctaacaagattctaaattaaaaaaggaaaacaaagcagtcttgttcttgtcagtttattaccttgtgaatgtcagtaatttacttttccatacattgcaaataacagaaaatcttaaaactgtctcaggccaagtcttctagactgaacagaaacagtggaaggagtgtcattgcgatagcttggtgtatgtgatgggcccctcctgtctcctctttatgagtcagatggctagagacggatgacacttggcatgtgtgctcacttttggaaatataacaggatgtgtgtatgttaggtggggaggtggggctgccacccaggctactcaataagtaaagcattttataaaatatcttcctacttgtgtctgcagcgtcaggggagcttccgcgaacctggctgtattcttttcagactacagacatcagagggtacttactaaccagtctggaagacagtcagtcatatccagagtggggtatcagcagttacgaaggtgcctgaggtccccaattccatttccaaaagagtt

SEQ ID NO: 25588 - DNA, 724 bp, Bovine  19866881150435
ccaactgaaacctgaggggcatgcaagcgggtgtgggcaaacaactctaaactctgcaccaaatgtagagcctgagcctaggaaaagagagttcatgtgaaggacttccaggctacccacggggagggctgggtggctaccgtctgcttttggtgcctgtggggaggaggggatgaatttcagttcttcagttcctgggatgtacagagtggagaatgtcagtttcttagagttctcaggagtagggagacgtaggaactgttctggggaagggcaaaattttcctgaataatctatgagatctcagttgaggttctgccatgaaaagtctccagctgtttttgtagctcaaatttgcctcagggcagagccagggactcctgcccgctgaaggcagctctcaaaggcctgagttaaatcaattacctgcattcgttgtgcaaaatagcctttgctgaagcaaatattttgtgctcttgaatgatccagcctgtaatacccgggcagctcaaagtcactggtagaggcccctcccaccatcattttcttaacaatcagtggggccagctagtctgaaacattctttaccttggagttcctttgatttactcagtcaggaaagactttccccataccagaggtgaaacattttctgcaaacctctagaagtaggcaactgaaactggtttatatatgtacacaacacatgtatgttaatacttga

SEQ ID NO: 25589 - DNA, 823 bp, Bovine  19866881157745
tatgtttagatgatggagagaagttgaagagaacatttggggggaagaaaacagaatggaggaagaggacaatgagttagctggagtggaataggtttataaatagctctcagacaaccagctgcacctggggaactgctaaaaagtcagattccttagctcttggagagcctaattcagtaactccacagtggggttctacaatcaatatttaacaagttcccaggtaattttgatgtgctgggaaatcaggtgtggaaactgctgtgttagaaatattgtgaagtgcatttgatcagtttggttgggcaccttttattgcgtggctgagggatgtggacttgatggtatagtaatgcattagttgaataaatgtttatgaagctcctgtcatgtaccaggtacagaaggtgctaagggttgggaatacattgatgacttggcctgcctctaggaagcagggagccatgttgggattttgaacagaagaatgctgtaatgatgcctaggtttttaaaagattaacctgggaatagtctacagggtggactgtgagaaaggtactaaaagcgggaggctgctgtgtctccagttggctgcacagtgctgcctctgctgagataggcaatgtcctaacggtagcgcgcatgtctgtgcatggacacaagccttcctaccgagccccaggggccccaggctggagagtgcacatagggctggtgtgagcactaacttcacttcaggagagcgagaaatgcagtgtggctcttccatttttcaattctgtaagcacatcacccttttctcctccccttgagctgtt

SEQ ID NO: 25590 - DNA, 597 bp, Bovine  19866881166334
ctaataagtagtcgttaagttgtcttgcaaaaatgttaaatgataaattgggtaatgttattgttgaaatgaaatatgtaaaataaatgagttatttatttctaataaatattttgtttacgatgtatttgtaggggtgttaattattttccccctcaatcggggcaacgtataaattctaataaagtgcataccgtggtgaaggcagcggtggtggtggcggctcctccaggccggccagctttaggacctcggtccgtgatggatgcttgagtcacaagcgattgttctcgctgctatcgcaggctccccagtgtagccagttttctttcttaaaaaaaaaaaaaaaagaagagagagagttgaggaggaaaacaaataggccagggtctccatgatgagatgattaagcacccccagaccagggcttgctccttcgctagctacaaggccctgggcacgcacgtccctggtggagccagctttgagaaggagaaataaatacgtaagcaaaccaagggcgaagaaatgatatccccctgagcactcaccccgggcgaggcgtcctcaaccatccctactatccccctcctagat

SEQ ID NO: 25591 - DNA, 925 bp, Bovine  19866881201698
cttttacacatatttgcatcataaacagcctccaaatctctgggtgccacccctgccctgtcccactccagcacctgaccctccttttctctccttccttccctcccttctgcccgccccctgctccaaatatctgcttgagggtggagaaaggagaatgaagtgtgcttagaaagccctcagatcctgcctggcctttgttgaatgacactaatgtgccaatatgagagatgggtttccctggacccagatccctccctcagactggcaaagcatggcactgggctttcgtgccctccagttctccccaagacccctgtggctgctggttctttgtgtgttcccggatggtttcatatacacagagatatgcctgcccacaccagacacatatagccacttggggattgtggagggaatctctgtcgaggatttttctttttctgtttctaaactgaggcattggttgccaccaaccccaaattcctttaagtttggtccctttaagactctgatcccttttagtctttatttgctaaatcagaggttctctatttgatgaatgaatgtttgttgagagaatgaatgaaagagttttagtggaaattgtatgagtatgaagataagacacacttgattcaaatccttgctctgtaactgactggccatgtggccctggctcctgctttgacctctctgagcctcagtttattcatctgcaaaatgaggataataatgtctactttacaggtagatgtttgtgaggatgaatggagacggctaaaaatgtaaagtacgtgcattttataggtacttgacctatggtggctataataattagtactggtgaataattatattaataatttataagtaattataataataatcccaggaagaggtactcatgggtcattctctgcaa

SEQ ID NO: 25592 - DNA, 1790 bp, Bovine  19866881235885
attatgatttgaaaatattaaaaatgatttgagaaattagaggtttaacaattatcttacttacattttataaaacatatagggtcaaatatgtgcatggactctacggttatagaaccttagtcactttgctggactagttgaaaaatagaaacttggggatcaccagcatatatattgaatttgagctttggtattatataaggtcatgggaagaggtagtgaataggttctaggacattatcttagggaatatttgcatttaatgggggtaaagtaagggccagtcagtgaaagagattttaaaaggagtaactgataaagaaaaagctgaatgggtcagtaactcaagagaccagaagagggaagaagtggccagcaaggaagataaaatcaggctgctatgactgttgttgttgttcagttgctaagtcatgtctgactctctgcgaccccatggactgcagcacgccagattcctctgtcctccactgtttcctggagtttgctcaaattcatgtccattgagtcatttttatatttaacaattaataaattagaggatatttgtcaagaacacagtataaataaaatgacaggacaggaaaaacatggttttaggccagaattgaaatggacataagaattagagataatgattatggattaattttttagtgttttggtaatggtaatcggctcctcaggaagaaagttttatgtgaggagggaatttcttaggatgcacacttagttgaaggcttatgagagggagcccaaatctgttgagatcatgagaaagatagtataattaatagaacctgaatcatatagaagagggtgccagttagaaatacaggtggagaagtttgtcttagaaagcattccttcattcactcattcattcaacacttattgaatgcgaagacatgaggggatgagatattgagatggaagctgggagtgtttaacaaggtcatgctggccatctgccttttcagtgaaacaggatgtacttaaaaatgagtaaattgattgcttgcagatgcatttgcttaaggtattaccattccattgtgagtctttttaaatccacatcagacagtgttataatttgtgtttcaactgtcaaacataattgagaaaatttaagaggggaaaggaaagtctgtttatccatatttgtattctttctgttcttccttcttgatgttccaaaattctttcctacttagagaatctgtagccactcttttagaatagatataaattgtcttagctgtctttcatctgagaatttcttaattttgcctgcatttctgaaggaaatttttgttggacacagaattctgaggtgggtagttcttctctttcagcacttgaaaaatgggccacttccttctggccttcatgttttatgatgaaaatcaactgtcattcagtttttcctttaaatgaagttgcttctctcttgcttttaagatttttctttgtctttagttttcaaaagtttgattatactatgtcttggcatggattttggggagtttatctggtttggggtttgcttgacttcttgactgtaggtttacagttcttgccacatatggggaattttcaggtgtcagttcttcatatactttttccagctccaccctctttctgatctctttccaggacccagtgacaggaatgctggatcttttactatagtctctcagattcctgaggctctgctcattttctttttctgattggtttctctttgatattcaaattgggtaaggtat

SEQ ID NO: 25593 - DNA, 920 bp, Bovine  19866881242913
cagaagggagaaaggatttgttaacacatctacccataatcccacaggaatcaagcctgcggaaaagagtggagagatggtgttggcctcagggggcacttctggtagagctacatttgagggtacactagcaccccgtccagctggtgcaggagagagtcattcacattcatataatggacacttctgtgttctgcggcttttaggtgactttagagaaggacgccaggatgaagttcctgaagctattaggatacagtaaagatgaacttcagaagaaggtaagctgccttcacgtcagaaatacatgtttgttgtagaaaaagagaatcctgccagtggaaaccatctcagaatacctcttcctgggcttcaataatgcatatatgaggattttacctcctggagttattctgattcccaggaaaatagtacaaagatctcagtaagtccagttggtggagtatgaaggtgggaagaaaagcttaatattcatttgatctcgtgttgggaagagtggtattcatatgtttctccctgcaggtggccacatggttgagaagtgatttgaggctgggtgagatccctcagtccaagggagatgacctcaacagtaacagacaacaggccttctccatacaggtatggaaggagcccagccagccccatctagggtagcatagaaaacctgcccttaaggaatcttccccttcctagcccttcactttgctctcaataagtgctcaacttctgtggaagttttcaaactcctcactcatttagaaccagggagagacacagaacccacaaggtttggagctaggagtggagctcttttaaccatgaagtatagcacttcccaaactttacctggttattcttttagctttacccattaagagccaactcttctttttttt

SEQ ID NO: 25594 - DNA, 1246 bp, Bovine  19866881284114
tttctctttgaaggtccactcagctgttttaaaccactgagaagccttcttcagcttctccaaacaaagccagccccttgcctgtgaagtcccacaacgcttagtataagcttctgttatggcagcataaattattgacatctggttttcctccaagagactgtcaacttcctgaaggactaggtcttatttatcctgggagctttagcatttagcatagtgcccataacacagaagtgctcagctagtgttaagatgactgaaagaaatggtttgctctctccacatgctcccacttacctgagcacagtcactgggtaggtagctcatggcagtggccaggctgccctgggctgccaggaggttggcatactgagtgattctgtaggttgtggcagggcctgggctcaccccatcaggaccccgcagtagctccaagctcctgttaagaaccatcactttctccatcaggtcctggagggacaaagaaaagggcagtcagtcctcatcaactcacaccctgctctcttagctcaggcagctcaaccaaggacttccctgctacggataccaggtgatgatacatgatatgtaagagacataacagccagagaagggccacttggcttcacttcccaagctgtttgggtcttacactcttgtacatttctgcctcttcattttggattctttatcttttatgctaatacatctcaatttcagattctgctatccttttatttcatgtgtgactttgtctccccgtgactgtgatcaccatcttctctgggcacccacagagtatctggtacaacttagattcataggacttttcatagatgctaataaaaggcccaaactcagtattattcaaatatagagtaaacttatatacccaaacctgaagtgggaaaaaattacaaagttaatatccaagcagctgctactcaatctcccttgactgagaaggagggaagatgacagcttatccatggaaaaggttccagactttgagggcccttccctcttctctaaaactcctgattctatcctggatacctagaagacccgcctctgatgtccctgcaacctccactgctagcctctcctgaaggcctggtatggagggaccagggccctgaagtgaaggggtacctgtaaagccatgggggatgaagccggctggcattttgcccagcactccaccagccgctccacactcccgagcacacataacagagtctgg

SEQ ID NO: 25595 - DNA, 978 bp, Bovine  19866881300061
cggtcctgactctgcacagtatgcacaatgatcttcaccatctccgtgctgtcgctgtaggagtgatctataaaagaactcagtcagtaggtataacctctcttctgcatgaaacaaaccagccctaaacagaaaattcctgaaaatctgaaactagttttaaataattaacatctccatttaatttcaaaactaaattagtataaaaagttttaagattatatatctataataatcatataactaaaaacaaagtctgtctgtgtgtgtatataatgcatacatgaaagtcaaagtgttagttgctcagtcctgtctgactctgcaaccccatggaccgtagtctgccaggctcctctgtccatggattttccaggcaagaaaactggattgggtagccattcccttccccaggggatcttaccaatcaagggatcaaacccagatgtcctgcattacaggcagattctttaccatctgagtcatcagggaagccccaggtggcaagaatacacagaatgctatacaaaaaaggtcttcatgacccagaaaaccatgatatgtggtcactcacctagaacatcctggagtgtgaagtcaaatggccttaggaagcattaccaacaaggctagtggaggtgatggaattccagctgagctatttaaaatcctaaaagatgctgctgctaaagtgctgcatcaatatgctagcaaatttggaaagctcagcagtggctgcagaactggaataggtcagttttcattccaatcccaaagaaaggcaatgcttcaaactaatgtataattgtgctcatttcacatgttggcaaggtaatactcaaaatccttcaagctaggctttaatagtacatgaactgagaacttccagatgtaaaagttgaatttagaaatggcagagagaaccagagatcaaatggcaacatccactcattcacagaaaaagcaattcccaaaaaa

SEQ ID NO: 25596 - DNA, 1928 bp, Bovine  19866881397218
taaatgtttttacatattaatttgctgatttactttaatactcattttctgtgtataatatatttattgaatcttcttaataaccctatgaggcaggcattattattagcccctctttacagcagaggaaaccaagtcacagagacataagcagcttttctagggctccacacctaggaaatggcaagcatcgccattcaaagccaggcaacctggctctggtccaccacgctatggacctcctctttacagagaccctagcacaagtgctggcggggcttctgtgacctggagaggaagactctgaatatttagaagagataagacatccttgggcttcagtgtagtcccctcaagtctatcttttgttcactaccaccctggccacctctgcccttaacttcctttgcagccaacgttctgtggctggggaggccaaaggaaccgtaggcagcttggactgtgggtccctctgacaccagccctgtttcagaagccttctgctggatcctggaagccagggctcggggtgtagggccgagcacccaccgcccagttgctcacagagactttctgcctcccacgcagctgcctgtcctgacatctctgagagggcctttgattaaagagacaagtgactttgcccattctattgatcagaataaattactaggaactaatttatgggcctccccacagccgatgacatggtggattgtgcgctattggtcagtaaattggattgtcaggctagattattggttcgtatacagttatctctcatagcaatatcaggcagcccaggtagaggagagaaatcctttctcggctgccagttgccaggatgtcacgaggccttctggaaggctggtggggaggggtggggagggaagaggaggagaggggaggagaggcgaggcgaggcctctgtgcaggatgcttattaattagtgcagcatcacagcattaaaagaacattagtgtggaactgtctgcagagtgatggggaaatgacattgtgggcctcctcctgattctccagctatggctctgctgggtagaggcagggagggggttgatgagcagaccgggggatgggaaagataaagagggggtggggatcagggccaagaggaggagaagggaaagagaggccccatttgctgggagttgcaagcagagcaggtctgctaagtgccagtgctgctaagccccacgcgggggaaatggagccgccgttctgctccgtacatcacagccaacgatgaaaagttctagagctgggatttctcaggcaatttggccagtgatgcatggggcagtagatcctcgcgcactcttccgtgcttctgccaagccagcaataacaaaaacttattttttgccagggaaacggatatgagtcaggcagcccatcaggagtaaggggggctttaccacgccggggcgatttgtaccgctcggctgtttccccgagctctaaagacctgccaggaggtgacaaaggcgagacaatttcgagttcacagtcctgtgtcctcgaagcataacagcacaccatagatggggactttcaggggcggtgggttgcaaagtcagcggtctcttcccccaagcccgctgaggagagggacatgcagtgagcaggaggagagtggccaagagcaggctctggagaagtcggaggccctttcggggctgtgaattcctgggagaggcaccctcctcccctccttcctcaccccgggcaggaagggagtgtgggagcgccaaactggccgagggcacaaaagcacacacctccacaacgaaggccttcctgccctcctgctgaagtctaccaggctcctcgctaagcagaccccagggtcacccagctccccaagaaatgtgtagggacacccattcggtcttgtttctccctttca

SEQ ID NO: 25597 - DNA, 777 bp, Bovine  19866881423168
cgaacttctgaaaagcagggcatagctgtatggagtgtattttgtcatgcttgtatcattttgatgtgcagttgtatacagtaagggcagcagctgtcatataaggaagtctattctgctgattgatggtgaacccttagccagtgatgtttgctactagacctatcacctattaaaagtgtaacacctaattgaatgagagttgtgattatagtctccctgattttgatttggacccttttgctgagggggcagactaggtttctctgtaacactgaagcctgtgttccatcctgtgcagtagagctactgtcttgaataagaatgtcttttttcctacaggaaatgtgacacctgctcactatgatgagcaacagaacttctttgctcagataaaaggccacaagcgatgcattttgttccctccggatcagtttgagtgcctctacccgtatcctgttcaccatccctgtgacagacagagccaggtgagcttgcgtgatccgaggagggtatagaactccttagagatccaagatgggcatgggtcccccttctctgtggcagtatgccaggtttggataaactcagaggacagtttcacaatgtagcttacgtattcctggcccctgtggtggtccccagatggtccgggcaaagccctcactgatgctggtgggctctagttattctatttgattggattataaattcatgaaacaaaatgtgtatgtctccattagattttatgattgtttacttttgtcacagatgcta

SEQ ID NO: 25598 - DNA, 1341 bp, Bovine  19866881470000
tgtgcatgggtgtgccgtgggatggagtgcttgaattgtgtatgttacatgtattgctgacacattctggcagttggcttaaggtttgttacttgatgttttgtggtattgtattaaggtgactgcactttgtgtaacactgagttggaggaatttgattattgtttggtggcaatgtctgtatttctgctttgaattattgcattcgttgatcatatcagcatctttctctttcataatgtatgtctcagagcttaggttaatgggtgtctcctcagtgatgtgggttgagtaacaatgttggatctgggtggtggtgtatgatacggtaattactttcttggtggagctgtgggtgagaagacctatcctttagcttttttagttcactctggcttggtcatttgccctgctcctttccaggaggaggattctagagatgcaggacaagtctcttcttgatgaccatctctacagttctattattcttggaaacatgctttctctgctcaatgaaacagatctgatcttaccacagtgacacaggttctggttccatcttccctttatctgtctaatttggagagttaaaccccagggccaaaccctatgcctgtctaaaatctagatccctggtagaactagaggaggatggatgggactaaactcccccaatcccgacgggaataacaacacgaactctagttcagagaatccccagttcgctccactctgtgactctggccatcagcatcttcttccttcccagcatttcccagatgatgtggctcagctgtggcttacatttacagggacacacacacacaccagggaagaatacagaaactcatactaggcatgactttctattaggtgcagagcctttgttctgagcttgtaagtagaagtataaatacatccctgggcatgagactgcaaaatatacagagctgcccaaggaatgcctgtacttcctttgatccaaagctgatacgaagtatggggtagtggaaaagcacaaaggttttagagccagtattgtaggagttcaaatcctagttgtggtacttagcatgtgacctgaattagttactcagcttctctggattccagttacattatctatagacaatcctataaagccctatggggttgtttgaaagtgaaaatgttagttgctcagctgtgtccaattatttgcaacttcatgaactgtagcccactaggctcctctgtccatgggattctccaggcaagaatactgcagtgggctgcccttcccttctccagggggtcttcccaacccagggattaacccaggtctccgcctgcaggcagatt

SEQ ID NO: 25599 - DNA, 762 bp, Bovine  19866881668296
ccccgtgtttttattgtgattttttttggggggggcagggagtttttctttcctttatgttttttatctttaggtatttggggagccatattttcccccctgcctagtgtttaaagttcaaagaaagccaactgaaggaaggaaggggctaggctgtagaggcaggggcccagagtctgctgcgctctgagacagggaggcagtggagagccgtgaggtgcccgctagcaaccacagaatgcagactgcttgggttcattctcctgcagcgctgcgccaggctggggacccatcgcctcgcccaggactcatggtacaggtcacctaggtgggctcaaggttcacagggcaccctgtgcagccagcctcagccagctcgcgttcctctgaccttttagacctccgctgccgctcaggaaagggaacaacaagggcgtttgctctcctgggcaagaggagggtgctgggtctccaacctgactcctactgcaggcgcccaacctcggagccaaggggggtcgccagatgccaggcctgaaggcgctgcctggcgccccattctccctgactcacagcagtcaagaaatcctgcacccagagccatcaacacgcagtcgcagttactgagcaatccaagcacagagttctagcggcagagtccgacctgaccggaccaacaacctgcagccctgtcctgctggcctctggcgactttcggagaaagcggggacacctgcacccggctcgctgctctctcgtccc

SEQ ID NO: 25600 - DNA, 885 bp, Bovine  19866881781856
ccagggcatcgacgaactgcttggatattgcctctccgaagcccacgttgtcgttgcagcctccccacagccagccttggccccctggaaaacatagtgggcagaaaggccgttaagcaggccgcagagagcctcctgggctgctggttctaagtgggttagggggattgaggaaggattcaggtggggctagtgccctcgctctagattagtttcaccccagatttatttttgacacctttgtactcctaacttcagcccatcccctgctcaggactccatgatgtaagtagctaccaggggaggcaggtgtctgcttcccgggctgtgtttctggcctttgggcagagtgtacacatgttctgccagaggttgacgtccagaaggcacaaaatagtgtggaaaaggcgaggaaggtgcagacactgagggggagagaggccagttgaggtaatatggaacagcagttggcagctgaggtggagggcagaggcctgcagaggacactggaggtaaacaggggaaatgagatagggaagggtgtaaggtaagggagttagagaaggtgaggtttgagaaaaaaaaaaaaaaagactggcactttacaggaactgatcacctttaatgaggcgagaatgggcagcagtcagattagtgggctgttgcgctaagtcaaggagagtaggtatatataggaaaacatatatatgcggagatacattattttgagggggtctgtttttcctcatgattatttttgactagttagctttcaacaactggggcaaggaattcctgagaccagccagagactgggattggctgggagctgaacgtaatcttaatgtccattcctttcttccgggaagaaagtgctttattctg

SEQ ID NO: 25601 - DNA, 1340 bp, Bovine  19866880535587
tgtgacgtcaggaaagttctagatgtgctcttggcctccgcttcctcattggcaaaatgcagcgtccacagaaacagacttcgcctggctgccctaggaatgaagtgagagggttgactgcaccccctgtgggagtgccagttattgtgaggtcttgcctggccctcaccgccttccctcctctaggctgaagtcctgagactggaggcggagtccaaccccccttcgttctcttctctccacagcagcccacccctgtgcccgcgacaatggaggctgttctcacatctgtgtcgccaagggcgatgggacgccgcgctgctcatgtccggtccacctcgtgctcctgcagaacctgctgacttgtggtggtaggtgtgagcttggcactttcttttgggacactgaacagggacctgggttctctgcctgccaggttgttgcctggcattttttaaaaatccatagtccctgtggcatctagtgttcaaagcagaatgtcttgttatttgttctcatctctaacatatgcatttcaagcctttgaatttccctctaagcactgctttagctgcatcccacaaattttgatgttggatggcatcaccaactcaatggacatgggtttgagcaagctccgggaattggtgatgggcagggaagcccggcttgctgcagtccgtggagtcacaaagagtgggacatgactgagtgactgaagaactgaacaaattttgataaattgtattttcattttcagttagttcaaatatttttaaattgttctcaataattctttggccctggtgttatttagaagtgtgttgtgtaatttccaaatagttggaaattttctagctatttttctattcctgatttctagtttaatgccactgtggtctaagcgtacacatatgatttctagccttttaactttgttcagatatgttttcttccccagcatgtggcctgtccttggtgaatattccttacgagcttgagaagctatgtcatctgctgtcgggtggagtgttgctctacatgtcgttagatgcagttgagggacagtgctgttcaggttgtctgtccttccttcctgcttctgctgtcagttactgatggaggcgctgaaatccccgataatggatttgtctaatcttttagtagttctgtcttttcccctgcttctacccttgaccgtcttctttccaaaggctgcacggggagtggttaagaatgtcagctttagggtcagccagacctgggttccaataccagctttgccacttcccagctgagtgaccctgggctgctcacttacctctcttatcctccacttc

SEQ ID NO: 25602 - DNA, 962 bp, Bovine  19866880546730
cctcctcctgccttcagtctttcccagcatcagggtctttcccagtgagtcggctctttgcatcagctggctaaagtatattctcttgaagcctcctctgtgtgcccctcttgccaacattagctcctcaccatcgttgaagttgtgtatcccttcattcacttgtattcattaattcattcattaaacatttgctattttgtgtgaaacaccatattagtaaagtcattcgaactacatagaactaacattttctgttaacacagaaatcctccaaacaacatttagcttaagtaaaagaagtttgtttctctctgtagtaaaacaaggctggaggagtcagcagcccaggctgcttcagtcccagttcatccaaagtcattaccttctagtccaaaatggctgctcagttccaaccctcacattcacattccaggcagcaggaaggaggaaaggaaaaggacggaaaaagggctacccatgggattcctttcacctggaatgtgctgggtcccacctggccaatcctgctcacctgtccggtgaggccctccgaatatccttctcatgataatgaagcagttatttgtacaacggtttccgtgcatttgggttcccactagattgaaacctccccgagggctgggacatctgctgcagtcccagtgtgctgctgggggaagcagcatctctcccgggctggaggagggagagatgaggcccagtgctggaccacagcctgggttttctctggattcttcttcctcttcttgctcatcagacccaggctggttttggtggtgaacagggattctaagggaagatgggccagctcacaatgcaggggtgaaattatgctttctgcttgatttccattactctaatggtgacccattttgtctgcctcacaccaggctgtcttcaagatgacaagctgagtgtcccactgggtcactgctgag

SEQ ID NO: 25603 - DNA, 786 bp, Bovine  19866880629637
ccccctgttcctccccagggggcagtgccccttaggactcagggagcttcactcccaggccaggtaaggacccttgtgccaggaggacagtcctctctggggacttcccaggctgaattcgtgacaagttcaggggtaacccctgcaggagggatccccggtcagggaggggcccctcaggatcctgcaatacccctgccacccaccagtgtctccccaggtgggtccctgatttgctgtgtggccttagatcagtgactgcccctctctgggcctggttccaggctgaccactgccaggctcagctccagccctgccccgcctgccgctggctctgcctctgcctggctcagctccaggcagcagggcagggctgtcacatgccgagccacgtgacaggcagcggctgggggctccatcccacgcagaggacgggggctccagcagccccttaccccatcccagtggctgaagcctctggggggctaccagatcctgcaggagggcccggaggcctctcctgccctcccaggtaggcaggggccgcggggagggtgggggccgtgaggagcatctcccgggggcccagttggcccagaggccctgggccacgatcctgggcaagacccagggcaccaaggtggaggggcagcagtgagcccggggcgacaagcctggagcggtggtacggaggatacacctgtccccacacctgtaacctaatcagccgcctgtctgacaccagcacctgtggggggggatcttcctcctttgtgctggctctga

SEQ ID NO: 25604 - DNA, 1346 bp, Bovine  19866880665429
gtgtgggcggaggcgggtggggtctgagtccgagttagatccggtagtacttgctggccttccgcggctggcgctgtagtcactgtcgcacacgtccgtgctgcagggcgtggtcgggggcgccacgccgcggatgatgtagggcctggaggggatacagggaaagggagcctgcattcacagcggctgtccctgggcccccatgagcctccacagcgccacctccaaggtgggtgcccctgcacttaccttgcaggctgccaagtccgggccctggcaaggcctgcagccccgggccaaggtcacctttatggagaacaaggcgcccagagcccactcgggactaaacttaacctgtctgagcttccgtttctccttgacaagacgggaaggatgaaacggtgtccgtttcaaaagtggcttgtgaggattaaagtgagattctgcatggaacgtgctagaaacagtgcctgacaccagacagtgcgccacggctatccccccttgtatcactgctgtaagtggtggagaccagccagtcccgtcttgatcccggggatgtctcctgatgacccccgtgacattgccctgtggcctgggcccgaggtaggcctcacagtgggcaggaaggggagccggctccaaagggcccgccgctgaggaaggtgcagcaggaggacaccccacgtggggccctgggagcaagcaggaccccaacaggcagtgccggaggggaaaggtactggaggcaggaccagaaggaggacaggcgagcggagcagactggaggctgagggggctggcctgctggagtggacgcgacagccctggtgacaggctgtgacgctgaggcgctggggagcccctgcaggttcttgaccagggtcgtgaccaccgggtcaagagctgcgcctcccggattcggccggctccccttccaaggccccgggagtcccccaaacggccaccagagggcgggcggcgccgctctccgcggctccgcggctccaggaccacgagacgcctcccgcagcaccccagacccggctctctacgcgggaggcgggggcaagcctagcggggcccagcctccacgtgctccatcaggtagcccgcccgagcggggtgggccctgtgggctgaggccgccgggtggttgaagctcagcaggttcagctcgcccagcctggctcggagccggaccgacgtcccctgaatcaagcctgcgccgcgaggaaggagaaaggatcgccccggcgagggccggcctcgcccgctccttcccgggggaggcaccgcggggtggcggcccccgccgcggtccccagccggattcaagcaccgtc

SEQ ID NO: 25605 - DNA, 1141 bp, Bovine  19866880705304
tcacggggggccggagcctcattgtcgcttgtcccgcagccccgctaccttctgcaaccccgccctggacgcctcccagcaggaagcagtcctgttcgcgctgtcccagaaggaactcgccatcatccacgggcccccgggcactgggaagaccaccaccgtggtggagatcatccttcaagctgtgaaacggggctcaaaggtgggcgtgggcaccgcgtccccacagacacctgtcactcgggtctgccgcgctcgcaggcccctgaagggccccagccaggttccaggactcgggtaggaacgttcccaggcgtttactgactgaccgctaggctgtgcccctgttggtgtctgacagcgctgggggtgtgggcttgtcctcggggctgtgggtctggactggggaggcctggggcactgtccgctgggccacagtccaggagccacccgctcagcacccgtgctgtgtgctcaggcccctgctgggcatgcaggtgacccggcccgtctgtgcccttcaggagaaggccctgcggccagtcatgggagacagaccttttttggttaattcaagagtcccgttagttgtgcagatggccggttcccggttcctgagatgtgggatgcgatggtgtgtgttaccatgcacttaggttgttaacggttgagagaggctcttttaccctcaacacgagttatcatggattctgagcacgtgaagcgcttgctaccttgctgggtcataaatattggataaggataagaactggagcagtaacagtcaagatctgtaggtcgatgttccctgggtccttcttatgaaccaggcacccgtctaagcctttgcagcgtttgctccttcagtcctcagagagacgggtgtcctagccctgactgaccatcccaggacactttgaggcctttccttctggttgccggtcagcttctctggtcttcggtagccccgtaggttctttcgacctcaggtctagaacccagatgtcgtgtccgtgtgtggtggcgtgtccgtcaggtcatctgcaccagtcctcacagccggatgtttgccccgtaacgtcaccagctgtacacgctccacccttctctctttaaccttaggacttcccacttgttgtaa

SEQ ID NO: 25606 - DNA, 1105 bp, Bovine  19866880804310
cacgcagtgtgggctctgacggctgctgggaacgtggggcctggcctcgggctcgctcgggcctggggttcccctgggttccggggtgacctggggtgcattgctggtaaacgacagcccaaggcaccacctgaccaggctcccatgcggccagagcacacggtgagctgtgcggggtccccggaagccgggtctgggcagatcctgcccacctggttacatggtgtagctcacacgtggtgcacgttttgttactcgggtctcgtatccaaagcaggctccatgtgtccaccacatcacagtcccgagaaaggaggattcgaggaaaggactcacgtccacgtggtaccagggaccctcagaggcaaaggctcatcccgcccaggctcagacagggtcaggcctaagagcgaagcccaggagagcagcagatgcggcccacgtccagggcctcgcagaactttcaacgtcgacaacattgcatcccatcacacaatcttgaacaggctccccggggcgtgacgggagcaggggcggggggcaggatgcagcccacacaaacagagggacgcagtctgagtggaaaggggtcattgctttaattaggtcaggacccaccccggggggcccacccaccccatcctgaggcagaaccactggccctgtgtcaacatgattgttacaaaaataaatatgaaaaaagcagccgctctttagtgatcatggaattaatcttgacagcaattaaatgtgtttagcatctggcatgtctcctaaattgcaccaaaagaatctggaagcacttggtttggcctcagaggcaacccggaagggagggcacaggggccctggcccaggcccggctaagcgcagtgcccgcctggcccgcaggtcacatctcggagtcggcatacatgccgttgatgagatagtccacctgcgtgtagtccttcttcctgtagctctcgtaggcctgcagggcgaacaggatcaggacggtgatgaagagggtgacccccagcaagagtaccgccaggaggaaacttctgttcactgaggacagggccaggggctcgctggagaccaccaggtactggccctgggt

SEQ ID NO: 25607 - DNA, 1552 bp, Bovine  19866880823677
cttgccttattttttgctctgccttagaggaaagcacacacacgtccctatacatgtatgtgcattcatggtatttcctgcattggtcgtataaatgcagttctcacatccttcaaggtgggttagaataagctccttccttgaagcgtgacaaatcacgacagcatgtgatgatcagcttatgtaatactttctcagtgtttagctgtttggctgaataacatgagagcctggttgagtttcacacatcccttctttccctttctcctcctcgttttcagctctgggactttttacctctgtgagaatcgaatattcaatagtactttttaaatttgcatttacaatcattcacaagtaacttggtttaaaataataagatgcttcttgactgtctcattcttcatcttggtattgcgatgtctgaccttgtttccatagcagccctgagatgctctctggtgcagctcaccacaggctaaacaatagacggccaaggtgaagcctcccggcaggtttaaagccgacagttctgtccccacacagctgtctctgccagcccccatttctccacgagatgaatcagaagcagacttcccagctgaaccctggaggttctattcagaattcgggttaattttaggggcacatgagaagtcctgcattggacaagaggaaaatgggcccttttgagaatgaaataagatcagacacacagcttgaaaaactgccacaccacacaatattgtttgtaggagattattaaacataaaaatattggtctgaccttcaaacagtgtacgtcagtagaatttagtgtctatttcccacgggccagctctaactttaatgagaaggaggttatcctccttagctggatagatgacggaaattgaaattaaccataaaatcgactgtaactaaagcaggtagaacagctgagtagaagccttgagaagtcctggttcagtctttgccattgtgggaagaggtattattgctagaagagagcttgaactgatgacgtcagctgccaatgtaacgtgattttttttcctttctggtttctgggaaggaacatgcgctctgcaccgcccagcagcagccttttcccagaagcgagtttggctgattacaaataacctgtttgcttatttatcatgaattgtggaagacacaaatgtcagtacgtattgttccttcaatgtgacctgtgccagtgggcggaagtctcaggaggctttgtccccgcctctgtcagaacagtgactgtgtggagccggtcccttctccgcatgaatggagagattctgcctggcctttccaacggcctcataggcctgaatgtctgtaacacaccctagatctctcgagtgttgtctggggaacttttgttttgttctctgagtaatagaaggctaatattagtgcttgttggagtactaaccataataaaatgaaaggcatcaaggcacaatgcagatatgtctcggggactcgaagagcactgtctggggcacagtctttttgaattcagaaaaccaaaagtcac

SEQ ID NO: 25608 - DNA, 2736 bp, Bovine  19866880831849
gtatcaggaggcttagaggggcagcagggtcccagaagtttccgggttaaggacatgcagatatccattttgtcttgatttggggtttggaaatttagattgtgttctgtagcagataagcctaagttcaaagagcatagtttgaaaaggaatagatggttcactgtgtgaagaaaccttgatgaaagctctcagccattgttagtttgggctgatttttattcttcttggctttgggcgaaagggagaatctagaggtgaacagcaccttggagagcccctcaggccacctgctaaagactaaatgcaggagagaggttaaccgccacccctccacacccccggtgacgaaagaccaccggagaagggagcacagcccacctgcccaggccatgtctcggcgccctctcacttaccagaggaaacttggacttgaggctctcatactgtgccatggttagtctggttttttctaaaataatttaatttgcctcgatttatagataaatcaattgaaaatcagttttgataccggcagatccacaggacagaaaaaaatagtgattcatctgaagttcaacacagttgtattttctttaggcataaagaacactatctgcaattaaaagtataaaaagttttatttaaaaatcatggaaagctggtagcagtgtaaattggtgcaagcacttcggaaaattgtttggcagtagttactaaagttaaacctctgtttgtgctgtgcccggcagtttcattcctgaaaatacaacccctagaaatgagtgtacatgtccaccaggggcttgtacaaatatgttcacagcagctgtgttcataatagccccaaactggaaacaagccgggtgcctctctgtgctggactggataggtctgcagtatatgatgggttacacaggtcagtgggaaaggaagacctccatctctgccacagcccagacagcctcacagacactgcactggtgaaagaagtcagatgacaaagagtacatgctgaagggttccacttagctgaagttgcagaacagcaaaattaaagcagcgcaagtcagaagatgggttcccactggggtgtgttgatgggcagaagacatgagggacctcgggtggggagctggactgtcctctgacctggcctgggtgggggccacatgggggtcacacgggggtcacaaatgccccaattcatcatattccaccatcccttctgcttcactaaaaagtagaacacacaccaaagggtcctcactgcaaaggccctttctgcagagccaggctctggtgtcaagacggatccccacactcatggtgaggggagaaggagcatggggctgccgctgtgatgtccatattgccccaacccagcttaataaagagaacagggccatcttgttagagaggtgattgagacctggggctgaccgtgaactcagagaccagatgccatccctgggccacaatcttctgactcctcggcgcctcagtttcttcatccatcgggcgccaagaggaggggtggtgtttgctccacaaggttgtgtgaggcttcagtgagagaatgcatacatcgcacagaaagatgcctggaacacagtgcacgtttaataaatgtgagctggtagcagagtgccgtgatcccaactattaacatctcaggaaacagtgtacacaggcgccgggaaggagctgtgttcaaatggacacagtgattttctttgcatctttaccgtccactattccacctttaagtattcaagagaatggagcaggaccggggtagaggcccgctgctcgtcgtggccgctcctgaagttacagctagacccagttatggcaagccagatacgtggcactaagcattgttttaagtaataaaatatatcttgatggagttttgcattttctgtcttaggcatgtcttgatagaaatccagaagctttccaaccaaaaattgggaaaggaaaactgggtgatgtgaagcctcgacataacaaaggatgtaattgcaagaggtcgggctgccttaagaactactgtgagtgctatgaggtcagtcaacaattgccaagcattatttttaaaagccaggtaaatggtctaagtaactttgtggttaaaaatttaattaagaatttaattttcttccttccagggcttctaaagagcactcatcaatctaccttaatgtctcaaacataaatttcactttatgaagcaagggctcctttgggagcatgtcgtccccactgagctcgccccgagtgtcccgggagggtgcccagtgccacagccctgcccgctctacggctgctgatctgatgctggagccaccctcaggggccggcagtctgttggctccccgaggtgggcttctgcccagctgagcagagcagagatgctctgggagggcagtgaggacagccttgtccccagacgagccttcccctgggtgctttgagggggcagcttccaagtggacagagaccagaatgcacagctgcccttgctgctggggagatgctgaccagttctcagacagagctttgtttccttcctcaaaagatttaaaggcagtagaaggactggttttctcctttaggttcatccctcactcacctcctttttctgtctctctctgtctctctttgtgttgaagggaaaggaagaaagagggaggaagggaaccctcaggccttgtcagtgaagcagccgag

SEQ ID NO: 25609 - DNA, 974 bp, Bovine  19866880845482
ttttctcattgtattaggtcattgtgacctaatttaccctacttttaaaaactcccccatctatgttgagcatgatgcaattatatctattgtaaagcagtcaaaaccttcctcccggaagtgaagcatctttctagtattgcgcgttcccatttggtctcacctagcatttcttccatgaatcccctccaaaggcagttgccaaattaccccctaccgtggtaccaccttccatacctgctttggtgccttcttttgataacgaaataaactacaggctgctgtgtctaattttgacatatgcaaagtgtcttttgtcttgctggtcttaaatgtttggggtttatagcatgaagccaggacaggtgtctggccctggaacgctggtgtgactgcagcccgccctcgggaaggaacgtcttcgtgtcgggtggcatgaggggtgtggggtaatgtacgactttagctgtgcatgtgttctctgctgcaggcttgtccatgcgatcgtgcctggagcactctggtttccaggtgacagacacgattcacggtatagtatgagtcctctgaagttggagcattctctacagctttaatttctgtcttttagttcttggtttcaagaaatgttttttaaaacaacaaagttgtaatgcttttgttaagtagcaccagctacagtttgtgcttgcttaaaaagctacagtaattaagatttcagaatgttatgtattgaatatatcactttggggtggttgtttttatttcaagtcccaggcaaatcagacccctttcttctgtttcctcagtagaaaatgacaaacatttagtaattatagacgtttatgggcctcagcttgaaaattcatgtccagtattcagctgctgcttctctcatgccatttcagccttcaggaaatgccacatacatatgatattgggtggagtggaaactcccttctctgcccttctca

SEQ ID NO: 25610 - DNA, 862 bp, Bovine  19866880849737
tcctgggttgggggggtgccccgagccggctgggcttcctcctgcccccactcaccggtggatacagtgtagccttggtgctggacgagctgctggacgaggccccggtgacgtggttccggtcgtagaggggcacccccggggccggccgcccatcaggctcacggagctcatcatggacttgccacacgaaatgcctgtgggaggggggccggcgggcatgaggcctggtcaggggccagggcgccccacggacacggagtgctttctccagcccctctgcccaggagacccaaccaggctcagaaaaagaagccccacgtgacgactgtccccagtgggcaactcagatgagctcaggtcaagtccaaagagcgtttctgaccccctcgccccgcagcccgccctgaccgcccttctccacctcctccagggccctcatggggctcaggctcctcacctgtgaagggaccgtgctgggagccgccgggggcgatgaagttgaggggcacgtggggggtcccgctgacgtactcgtgcgggaagggcccattggcaccggcgtagcgctggcacaccacacgctggcacacgaagtagaccccgcccatgatgaagagcgacaggatgatgccaatgaccggcccgatggcgctgctgtgggctgggccgtcgtccgagggcagcttggtgatttctgccggaggccgggcagggagagacggcggacgtcaacccaaacggagcgggtctcctgagggggggcaggcgctgtgtgccctggagggctcgtacccgccccggcccagcacccactggtggagctgctagggggctgggcagcacccctaagggcttgccc

SEQ ID NO: 25611 - DNA, 1092 bp, Bovine  19866880878324
tacaaatctcagtgtcctcccggtggtgcagtccgcaaggccttccacagcttccctgcccctcggcctccccacttggccttcaccctgggtgggtgggggtccctcctactcacctctgccctcctggacacccagcaggcacctcacatccctcccggggtatctccctgatcacccgcccctccacgtccccaggaggaagctgggtttcccgcctcccctgccagcctgagtctgtgtccgcagccgcctgcgtggaccacactcaagggaggctcaagacacacgtctccagtggggacgtgggggtggcaggctactcttcagatcacatggtggcctcagaccctgccatgggccctgggaccccgagggggccaggtagagccccggcagctctcttaccagcctcaccgctgcttccccgccaggtggtcaagcgggtcctggcccagaccagcagcgggggcttctgcgggaacgacggcttcatgcacttgaccctggccagcctgcctttcggaggagtgggtaggtgccggctctcacctccccccactcccctccacagagcctggagtggaaccttccacgccggtcctggcacttccctccgcaggcagacccgcagacacacagcttacgttgttttcagcatcaccgtgaggtccgtccgcggtgcttgctgcagcttttctccccggccagcctggtggcacacacagggcagcccaggtgtgctctctatgccacatgcggctacacgcggctccttcaagccctcccgcaccccctcgggtccatgatggagacagggggctgctgtcagctccccactccaccaggccctagcagcccccaggccggctgcaaggtcctggcctctgaggctggccccagcaagcccgacggctgtatgatgtggggccaccacggcccctctctgagagacctcctcctcaggggaggagagggcccactgggcaccggagtaaatgaccagcagggcctggcaggctgccctggtcgtcccaggccctcccaggcctcccaggccctcccagggctggcacaggccggcccccttct

SEQ ID NO: 25612 - DNA, 1521 bp, Bovine  19866880912851
gggagagtgtagtctgggcgggcctgggaagttcccatgatcgctctgagagcagttgaaaagtcatttgcggttaaagaagtgagtggagaaaaggaatctgctgccgcctgttcagagagcgagcgagccccggcgctcaggcagacgtggcacaggggtgcggtgttgtcagggctgggggcctgtggaggggcgctgtggtacacagcctgaggtctgaggtgggctggccccgggagaatgggaggctgctgtggagagttcggtttctatacacactttgttttcccacccggggaattcaggctgtgtcctgttctctgctcgagtatattgaagtgtttattctcttaacatgtaacgtggactgaacacctgacacgcccagcgttctaataccacagacaacccttctgaggatacaggcagcctgtccaggaacctaaaagtgtctcgagtgcacagtgccacgtgcagcgcagtttcccggaagccagcgtcccccaagcggtcttgcgagctgcgctgcttcccgcaccggggtgggcggctgagggttgcggcccacggcttcgtcttgtcccctctgaggggtccccgccctcgcctcatgagccccagctgtgctctggttttgttggggagactgtattggtttttagacacagaagaaaattcactctggtttaaattggcagaatggcttgaaattattttctcattcccagaagatttttaaaacaattttcacaaaattttaggaagcctttctgatctgtgttctgatttgtgtaagtaaactgttgatacagatgatgacgtgagtatcctgttcttctaggtatccaaatatatcttgtgagttgctcacttctgatgtctcccaaatgaacgatagactgggagaagatgaatccttgctaatgaaattgtatagcttcctcctaaacgattcccccttgaacccactacttgccagtttcttcagcaaggtgctaagtattcttatcagcagaaaaccagaacaggtaaatactgttttctaagaaggtaagtattagggctgagcatcccctgaggtgatcctcagtgattttgtcgcttcagtgttctgagtgtgccttatgtcccacgttctgtaaaagaacagattttacaccttaaatatctgcagtgcttgctgacttaccactgacttaactccttaacaaatacattctaatttgacctccttttttctgagcgcctcatatctcagttttccagtgtacttggcttccttttctgataggtggttggaagcaagagcacgctggggtcagtctgtgagggtcgcgtgaggaggggcacacagtggcagggggtgtgggtggcgtcctggcgactttgtggcagggtcacagtgtgctcatttatccttctccctgacaaagagcacaggcgacgcttaaggcagaaagctttcccataaagattgagattagtttatacaacggtcattttttttttttttttttt

SEQ ID NO: 25613 - DNA, 1988 bp, Bovine  19866880946666
ctgaactttgagcttgctggaaactcagatgaaggaaataatgagcacaaatactcaaaacaaacaaacaaaaaccaaaacaaagctaatcccgggatcagaagggtggtgtctaacctgatcagcctccgcgccctgagtgggcccttgtcctgtccttcgtcaaccccttcctaatatgatgtgacattttccaagagccagtgaggctgatgttctaggagccagtgaagaggaaacttcccaactgaccacgctggactgaaagggcaaagtgcagaggggatggggcgccagggctctctccgtggtcctcagtttcctccacccagtttcctgggacaagttcctcggacattcgcttgggtcctgcatgtgggtggaggaggggcctcggtagtcagcccagaacacagatgagggcttcttgtgtccaagggccactgtctcctgataccctctccctgctttatctcctccatccctgcagtggccatgagaagcttgcagctggggtacggcgcacattacatctgtgtggttacagtggctcacctgaggccaccagcaagtccgtatctctgagactctagttcaggtccctcgattccaaggccaggggtctctccccacctcagccagcctcaggagctgagacccagagttgtggccctgtggttttgggctgaggccctctgggtagcctgtggtgccagcatccttcctcccacttgcaggttctttggcaccaagtggatgatgttcctggctgtgggcatctacgccctcttcgtctccaccaactactgggagcgctactacacgcttgtgccctcagctgtggccctgggcatggccattgtgcctctttgggcctccatgggcaactacatcaccaggtgagtctggtggacagcagggtagaagaccggggacccaacagagttgtattgtccacctcagctgggggaccttaggccagccttatttgccctctgggcctcagtttccccattggtgggacacaggccgggtagcacatatgcctgggtgctacccggctggctgacgtagggcgggggagagccttctctcctttgtggtccaggatggcccagaaatactacgagtactcccactacaaggagcaggatgagcagggcccccagcagcgcccaccacggggctcccatgcaccctacctcctggtcttccaagccatcttctacagcttcttccacgtgagtgccatgcatggggaccctggaggcaggctattacaggcccagaatcacatattgcagcccatcccagtctttccagccctctagtccacagccctttcttaggccaacccttgcttgcttacctccagtgacagagacctcatcacctcactgtccatggtgctgacgaggaggaagtcctcctgcatcgggcacccccaccattggactgccccccagagatgggagggcccctgtcctcccaagactgtgcccagacccctcccagacggtgcctgtcctctccacctggttccatgccccgcacctgacccacaccactctcctgcccacagctgagcttcgcctgcgcccagctgcccatgatctacttcctgaaccactacctttatgacctgaaccacacgctgttcaacgtgcagaactgtggttagtgctcaggggggtgggttccctaaggtctgcttgcctcccctgctgagtcacccggcagacactgggccctcaagggcagaaaggatgcccttgctcacaggaaccagagctgagagcctgccatcacagctctggtgattgggaaaagcaaagggccttgttcttaggacatctgactcaacctggggtcagggtagggtgcatccgggaaggctgcctagaggaggtccatctgggctgaggctgcctgtggaatctcaggatcaagtataccctcaatgcagggagatgtatggaggtgggagg

SEQ ID NO: 25614 - DNA, 3968 bp, Bovine  19866881048099
ccttttgaggaaacacattactggttttacaatgactacaccattttatattcccaccagaaatacagagtaccacttttgtgttttctgattaccattttttcctcgcttccctttttgcctgatttatgttttaaaaactaatggcaaagtggaggaagctgaaggtgaggagacatcacaacagcacagacaaaagtgatggtgacctggactcgggcggagacggcagggtgaggagagccacagattaggagacgctgcaaactgtgtgtaaagagacatacacatttttcactcatttattcattccacaaatattttttatgcctgtgatttcagggatagagaaaacagaaattaacaagaaaagttatggtccctgccgtctcaacactcacagtccagctggggagacagacatgaatataacagtcacatacacagagatcgtggtggatgtgtggcaaaggaacagcgatgggcagagggtaatgggggaactgaccaagtatgacagccaggaagattttcctgaggaagggaatggttttggatgaggaggagttaatcaggagttaatgaggcagacgtggattcaaagtgggtcgataagagcattctaggcagaggaaatagcaggtacaaaggccatatggcaagagagagagggcaccgggttctgggaacagaaaggaggccagtgccatctgtgtaatattgttcattataccaaaatgtacaaaataatctgaatgttcatcactctatactgatgttactacagagtgggatacagtgcagtcattacagtgacataaatctatttacatgtaatattaactctcatattgataataaaagcaagctgtcatattgattactaactttgatacatagtaaaatcacattgaaactgtatagaatatgatcttgtttttatttatgtattatatgtaatcaaacagcatatagttattgataacatgcatagttttacagaaaaactctgaaatatattcaccaaatggtcatctctagggagcaggattctgaattatttaaattttttctttttatttatattctaaaaaactacaacaaatgttattttcttgtatcaagaagacaattagcaaagacatttctgagccagaatcagaagacttggtaacctcttggatatgaaaaaagagagaaaggcagtcatcagaaatgacttggggtcatgtcactgggtaggtgatgacaccacaaatgcagagagactacagcaagagcagggtgaaggctgaaggagaaggtcagaacttaaggtgtggacaccctaagttgaaggtggaaatgtctgataggcagtagggaaatggttttggagcctaatcgtgtcacacgctgctgtgaggtaaatgcagtgcagaggtccttgcactttctggttagggaggctgttgaccacctttgagagttagaaggaggcaggaagatggtccgagagcagtagattaaagaatgaatggggatgaggaaggatgagcagcaagtgaggaaacccttacctgatgtttgtgaaagaagaaaatgagactttggtgacacagatttacaaatcttctacataaagtttttttaaaaagaaagtgaaagttgctcagtcatgtccaactctttgcaggcctattctccaggccagtagtaggtagctgttcccttctccaggggatcttcccaagccagggattgaacccaggtctcctgcattgcaggtggttctttaccagctgagccaccagggaagcccaagcatactggagtgggtagcctatcccttctccagtggatcttcctgtaccaggaatcgaactggggtctcctgcatagcaggcagattctttaccaactgagctaccagggaagcccaaagttttaaaaagtagtcaataaataaaatcacccagcaaagtgtgtagagtgagaaaagaagtgtgcctagcttggatctcggtgactaaacatatcttgaactaggtataaaattctagattgtcagtttttcctctccatgctataaaaatattgttctactgttttccattatttctaacacaaagtctttggtcagtctaggtaatgtcttttctctctggtgtttttacaattttctttttatctttgatttttctttttatttgcttttttgaggttcattagttttctgaaatctgaggacccacaactggaaagcacaggtatcctccaagtataactctcttctgcttctcttttctgtcctgtaatgcttatcagtcatgcgtgaccccctaactagggaccatttctcttcatctctcccatgtttctaacttctttgtcattttatgctgaatctggatctaactctttatctttgtttatcctttctgacttttaattattgcttttatccaggtcatatgtacatagtttaaagagctaaataggggattccctgactgtccagtggttaggacgctgcatttgcactgccgagggcctgggtttgagcccggtcagtccatggggtcgctaagagtcacacaagactgagtgacttcactttcacttttcactttcatgcattggagaaggaaatggcaacccactccagtgttcttgcttggagaatcccagggacgggggagcctggtgggctgccctctatggggtcacacagagtcagacacaactgaagtgactcagcagcagcagcagcagcagcagcagggaactaagtcctgaaagctatgtggctcagtcaaaaaaaaaaaaaaaaaagtctaataattatacaaggtttatgaccaaaaaatgtagttcctggtaattgttccttattttctgatctccagacgcttttggcccttaaccaaatcttttagtatttgcctccataaatctaaataacatgcctgcatcgctgcttcttggcttttcagtttcagcatgatctcttgtttttgtgccatgaaagatgtggatttagccttttcctcttcctactcacacctaaccccctcccaacatgcatgtggcctgttcccagacatcagatgtactttgttagatcagtagtgtttttatgactgtgaaaacacatctgaggtttgattactgttcttcctcaacttctttctcttctccctcacgttaatacttagtttttaaatgtatcgagcactaacttaacccttaactcttctctgcttgtgtaagtgctttctcaacacatgcaaacacgctaggtgctcagtggcctggtctggaggaagcctttcctgccgccgtcaaggtcctgctcctaaggggctggttctcagccctaggtgcggttctccttaccctccttccagcattggtcccagggtttcctttgcttcttccgcatatctgaccccctggctcctggatagcattatcttcctcattcttgattcactgcattgttttcaggcagcatgtcgtccagcagcttcccaagcaagagtgatggagagaatgttttcagactgtgcgtgtctgaaagtgtcatgtctgtcctcacactaagatggtcactttggatggatggtagggttttcaacttcaactaattaagttttcctttaggatttggaaggctttgctgcattttcttctagtttctggtgttgttatgaaattttttctcaccctttgtatgaaacctgtattattctttctagaaccttctgggatcttctttctggtccctgtgctctgaaatctccacgaagtagatttgtgggaaggttacctttgaaggactcacactttataagggtttttgatgcagctcctaccttctgtagctcagacgctgtctcctgtagcagcggccaatctgaactcaagctttgggccactagggaccagcagagggcccagacagcactggcagctgcagacccacc

SEQ ID NO: 25615 - DNA, 1119 bp, Bovine  19866881097276
cgacccccagtttctccaggtacagctgtttgtggaacctggcactgcatcaccctctgaagctgcttgccttggagccaagcccggccaccctggtctcatctccctggccctggtcatagaaccactgcaggaagcggtcctgaccacactgccacgtgtctttgccctgcaggggcggggccactaccgttgtcctcgttgtctcccgctgcctgcttcactgtagagcctcccctgcccccgtgtgcccgtcagattccttcacgttgccaggcctggctcagatcctgtttccgagagtcagggctgtgctcccgttctccctgtgctggcccgttgttagtgttgccttaacatctgccagtgtgcctcacttagagtcatgtgtgcatagtccccacccgcatcggctgggtgccaggctgcccgagggcaggagtgggaaacacttctggtgagcagctgccttgagcgccgcacctcacggggccagctgcgcaggcagaagggccgagctggtggtggagctggatacggtcccatcgtaaactgctggagacccggcgtgttgagcccggggaagaggcccccttcagcatggggtggggtgaccggaaggcaagcccaggggtgctacgattgtacgcgggaaggactttgtctccagaaagtggacctttgcaggtggctgcccctccctgagcagtgctgtctgtgggcacagtgccctttcaggaggaattgttctctggacaagactgtgatgcccccaaagacactctagatctagggtcatgtgacctcacatgtcaagtttacctggataaatgccatcttttcacccctcttttatctcagagccggcgattagacactgaagaattaagtttgccagatatttctgcagaaatagctgagaaaatggccagatttcatggtatgaaaatgccattcaataaggaaccaaaatggctctttggaacaatggaaaagtaagtgctcagctgcttggctctcgcgcggctctccccggggctcctagagtctccggagcggttctcaggaaggccctgagggtcagaggcctttctcagtccacggcgcacacactgtctg

SEQ ID NO: 25616 - DNA, 1379 bp, Bovine  19866881116861
tgtgatttttacaaattctactgcaaatgaaaaaccttgtggacaaagtcaccactttgatcttctcagatacagtgaacaccggccaaactgttttaatttccgaatttattaaaatgattaacctcaatactgcaagtgcatgtacaaaatatttgtaaaaaatgtttttttaatgaaacgttaaagaacttacctcaaatgctgaaaaagtccttttttttttcattctttcagtacaaggaatacattttatctcaaaagtattacaactcagcaaaacaatttaaaacagtaatttgaaaaatgattgaaaattgaatactttacatatatttctatgatcgtttcctaattcttacaatgccacaatctttaccaatcattgcataagctcaggctagaagttttattgattgcaacctcttccaagtggtcggcattgtgtggacctggccgttccacacagagtcctacagcacaggcaggccaactccgaggcccctcactgtaaaaacggaagtcaggtttccctggaaggcgtcggccacggctgccgagcgcttgtgcataccacctcccgaggcagtgaccgccgggcatcactgctccggacccacgggaaggttggcccccaaagacggggcctcagtaaagttaaatgtcataaataagttactaaagttaagcttaaaaaatggagaaaagtgggaaatgtagtattactttttcctttaagactgaaaattcctgaagtggctatcgttggtattccaaaagaatggttcaagatgtggtctctgaacctcttccagactacaaactaggtggggttcccaccaatcaaggtgacccgctgtgctccggtgcttcccggacgcagggtctaagcgtgaccttggcgcgtgagcccccctgccaccccccacggccacccagagactcgggagtgctgggtgagtctgtaaagtgctctgagtgctcggggacagacctgcagggccgcccgacttcgagaggtgaagattctagatggagtgagccaagggggtgtgagtgggcgaggaggtgggccacctgaccccacgttaatacctgaggggtgtaactgcaccgtacaaacagggacaagacaagaggagaccacggaagtaattccttcaaggacagaaggaggggaacattttaaattcagagaacctttacgaatattaccagtttctatttggaatctaccagcaatagttttaaggaacttaacttaaattatgtccccaagaacccagaagctggcaggaatcatgaagtcctaacagtaagcattgaagttttcccattggactgctcattacctgcagaggcctttcagtatcttaaga

SEQ ID NO: 25617 - DNA, 1416 bp, Bovine  19866881226029
cagagctggagaggcagagcactgtggggattcactgggtggcagcccagggacccggggcagccccttctctccctgtgaaaccagacaaccaagccccacctgccccctgttcaggggactttagagacagccagagactggcccagaagtcacttgggaaacaagcatgcttctccccatccaggtggctgggaagaaggagccgctggttgccaccggtgaccttgcctacagtggccacccccgggaggcagggtcggcacacccatttcacagatgagcccaaggctccctccagtcagcccaaggtcacagggctggggcctgcagaacccggatctgaacgtggttctaacaacacccagcatggcccgcagggtacaacggcccatcccagggccttgggggaagtgggggtggggagagggcttgctgagccagagccatcatggaggactccctggaggagggtgagccccagcaaaggcagggcacctgtggcactgggaatgggcagtgtgttatgaggaggagcccctgcctggcagcgtgggggggcgggagggccccgctcaccgagctgtcctgcagggcctgctgcagggtgggcaggtcacgtgtggcacaccaggcctcggcgatgaggcacttgtgcgtggagctcacgctgcactggttgagggccaggtacacggccttcatcttgcggatctgcacttgccagggcggcagcagcctctgcacgcggcccagcacctggctcaggaagcgctccgtctcccccaggacctgtggccggagcaggtgatcagggcggcagtgggccgcgggggtggcggccggaggtccaccctggctgcgggcacccacctcctgcagctcctggctctgctgttgcagctgctgcagggctgcatgccgggctgcctcctcctccgcaaacgggaagacatggcagtggaagctggcagggagcggggcggtgagcaggtgcctggggtccaggccacgtgcgcgggagtgtggaggacggcgcaggcttggtgtgaggtagaggggacacccagggccctgggggggctcaccagtcagtgatcttgcggatcttctgccctatctgcccgccccagtaggagatgaggaaggtcatccacgtggcaggctcaccctgcggaggggcgcccaggtcaccctgtagtccccgcgcccggagggccacactcccacccaagccgcccccggcccgcacccgcgcaccgtcactgggtcctccagctgctgctccgtctcccggaagctggcgatgaggaagccgcggcaggccctccagagcaggcgctccagggccgcggccttgtggggttccaccgcaccggccacgaagctgcgggaccaggcggggctgggcagggg

SEQ ID NO: 25618 - DNA, 1324 bp, Bovine  19866881355792
caaggaagaatgcataactgaattgaaattttctgttaaatcagggatgtgccccccacccaaatcccttcgaaagaaaatagtacaaatactccatcctgggaaggggggacttttgtacttaccgtctcaggacaggagaacttggaggatatatggaaattgatgaggtcctcaccgacgagaatgtacgacaccccatagccgtcatcagcaacctatagaaaagcacattcaaactgaacttggggggaattccttggcggcccagtgcttagggctccgcacctccactgcgggggacatgggttcaatccctggtcggggaactaagatcccacataccatgtggcatggtgagagaatgaatcaacagaaccgtggaaatgaggccacgggaaaaggggatttcgaacctttaatgagaatgccattcatactggcacgaatagccagtaggagcaccttcagggcggggtgcttagagctgagacaggcccgtcctgccccggcgcttgctgctctgtgaactcagacgcccggccacttaccggcccgaagccccctccgcacgacacgtagtctggattcctatccaaattgaacagttccacctgctgtggaggggtctggctgggggataatctccaaggctcagctaagacctggggagttaaacaaggtgacgttctaatgacacttcccagctccatcctcttctgtccccaaggagcccaggagatgaggaaaggcttgcttggtgtttggactgtttcagacaccagaaggctatgtccctgggggccttgctggctctgggggcaggggttcttcggagagggatggagcaggtgaggatacccagactagagaggcaaacactggctgacggggtcttgggcagaaaaggtggcggatacacggagtaagatttggaagggagcagctgtgtgctgagcagactggtatcagctctcctaagctgagggtcaaacttccaggaattttccaaggtgcctgttaaacacagccaccgttaaaaagttacattttataaacataaaagtaaaacaactatattaaaaatgaaagaagtaaatactcaagagctcaagacttccctggctatgcagtccctgggctcccactgcaggaagcacaggtttcaattcctggtcagagcactagatcccacatgctctgcagggtggtcaaaaaaaaaaaaaacacaaccacctcagagctcctcagttcagttgatcagtcgtgtccgactctgcaactccatgaatagcagcatgccagaccttcctgtctaccagct

SEQ ID NO: 25619 - DNA, 686 bp, Bovine  19866881488689
gggccctgcccggggaggccgggctggtgggcagtggctcagaggccggggtgacaggaccccccctccctgtggcccagctctgcagcaagatggggaaggaagagctcgcctcctacaggtgccgcggcccaccccccactccgcggccacggtgcaggaggaacagggagtgggggtggcaagcagtgaggggcagcccagcccgcgtgctggcatcagcctgggccagcaggctgggtaggggccctggcattccccggggcccctgcctgtttacctgaagctcacaagaggagtgctctgacgcactcggtcctcggcctggtgccaaggacctgtggggaccctttcctccttctcttctgactcccttccctcgggtctctgcttggctgatgcctccttcaggcagcccaccatgattactcccttatacgttctcacagtgggcccgcgactgtgctccccaccacactgcatgtgtgtgagttgctcagtcatgtccgactctttgtgattctcatggactgtagcccaccagactcctctttccatggactgttgcaggcaagaaactgaagtgggtggccatttccttctccaggggatcttcccgaccctgggatcaaagccggatctcctgcattgcgggcagattctccaccgtctagccaccagggaag

SEQ ID NO: 25620 - DNA, 2155 bp, Bovine  19866881606425
tgtcgcccgacgggcctggcctgcgactgggtcggcaagaagctgtactggacggactcggagaccaaccgcattgaggtggccaacctcaatgggacgtcccggaaggtcctcttctggcaagatcttgaccagccgcgggccatcgccttggaccccggcacacgggtaaatccagcacctcacctccctgggcgggggcggggcaacggtggtggttgtccagtcgctcagtcatgtctggctctttgtgaccccgtggacggcagcacgccaggcctccctgaccatcaccatctcccagagcttgctcaggctcatgtccatcgagtcggtgatgccatccaaccatctcatcctctgctgcccccttctcctcctgccctcagtctttcccagcatcagtttcttttcctgatggtggggtgggtggggccatgatttccctcttgaatttacttgagaccaagtacctttttcagaggaaacccgcagtcttaaaatgggtccaccctgcagaatttgttgaaacaccctggaatgtgtttcttttctaaactcgctgcaactgatgtgattggccgtggatctgagttgttaaacatctcggtgtgtgtgtgagtgggtgcgcgtgtgattgggtgtgtgggtgtgtgtgtgtgagcgggtgcacgtgtgagtgttggaagagggtctgggcactctgccaggcagagcccacacctttcaccctctctgtgactgcatcagctgaacacggtggaaaaagtgaaactccccgtccggatgtggaacttgcggaattgttgctctggtgtcttctggaagccctctgctcccgccagcttcgtggtctggctgagctcacgtgatccgcagaagctcagggcccagccccagttccaggtggggtgttgtgagtggcgggaaaactaaggacgtacgcagagttgaaggctgggatggaggggagatggcaagctgccctccaggccatgctcgtggccggctttcctagcgggagctcttggctcagtcacccgcgcgcggccctcttccctgtcttcccaccgcctgggaaggacacacccttagctgggcggcatcaagcctggtgcccgcccactggccacgcccagcgcacggctgtgtccgcccgctcctctgctgtgcgctcatcagaaacggctgtcgggcatcttttgaacagaaacgcagtaggaccctggtttctggtcctgatgccctccgctgccctaggggtggtgctcgctgccctgcctgcagccagggtgggagggacctctcagcccacctgggacgggtggaatgagggctgagggcgggtgcctgggtagctccgggagcacgctgggtgagggggggcacttgagtggccgagtaaagttccttccatgggcttctccgcatgttgactgagaaggcacattcggctgtctcttgataccaggaacgcgtggtgcctctggagctgctgggttgtgtaaaagctgagtgtgtgtgtgtgtgtgtgcatgcactgctggaaagtgtgggctggagggtgtgagcatgtgtgtttgtgcctatttgggtgcacctctgagtgcacctgtgagcacacgtgtgtctgtgtcagtgtgtacacacattggggtggctgcgtcagatttattgtcctggtagctgactggccgaggtcagggggacaagcccggtgtccctgctcccgaggctgccccagcatcctgggtggggggcatgccaggcggtgacttatctttaggcccctcaccctccgaggagggctgagccgctccagccaccagggggccaggctcatcttccaggagggtctctgcgttgcctgggaaacagcccttgcctcaggcctctcccatcctgcagtgtggccgcaggggtcacagagggtcattgactgtcttctgggtcatcgtggctggggtggctgagtcccgctggctaagagggggctccgtcagcagcgggagaggctgaggggagcagcctcgaggccctcacagtgccctggggggatgccgagagggtggtatgccactggggagggggcggcaaggcgcaggcacagggaggggaggtggggccttcccgctgtcggtcaggagccgggggg

SEQ ID NO: 25621 - DNA, 936 bp, Bovine  19866881742068
cattcctgtttcatctactctttaggacggtaaccaagagcctatttgaagggactgtcctttttcatctcttagatatcttggtttgctagttgaaaaatcccgttcctgggttgagttttcagtgaatacgctcattcaccttcatgtcgcttagcatgttttccagcctctgtacttgggtttcacatactaatcgcttggttaccaaggtgtcctgtagcaggttgatgcctttcttgttcttgtactgtggattgtggaagtttcggtttttacgtcaagttaagctcggtgtgtagctgggggtgagccggctaagcacggcgttggcggtcggagccctgccatcttttgtaccgttgctctgcctctgcgctgacattgtcacaggcagagtttgttttctgggctgtacttcggatgctaatttactaatttatgatttggctccattttagtagcaacttgggttggattgactttatgcacaatggcagtgatttgagtgtccattagggtgcatagccagacgatgatgtaatccgatccggggccaacgttttacttagagtactttacattcatgattttgcttttgaaaggtggtagtatggatttaccttgggtgtttatactttaaaaagtagtctttttgtattcttggtacagatatttttgattactggtttcaaagcctgtatttttgccacagcttgtattaaattggtatttctgaaattagttgatagttaacatatatgtgtgtgtgcatatatgtataatacatatacacagttattatatatataatatatactatatatagatagatagatagatagatgcctctgaagttatcaaaggatgttacttatttaaggttgtttctctcaattacgagtgtttgtatgctcatttttgatgatttttgtg

SEQ ID NO: 25622 - DNA, 1411 bp, Bovine  19866880458573
cccccttccccacagccttaaactgcctgaggctggtgtgcgccgaacctaacagacagtttctaccaccctcaatttaccggtgaggaaacaggtgctcagaagtcttattttagatctaatttgctgactcccagtcttgggctcagagaagaagactgtctgggaggaaattggaacagtaagtgtttatagttaagactggggttgggagcaaaacaagcaagcctggagaaaagagaaatctgcagtggaggtgtgacatccctccactcaaggatccaaaaggctgtcccccgccacgagcaggcagctgggcaggagatggacagagctcattcccttctccctaggcccagcataccccagcactgcgggctcctctctaagaggcagaagggagaaggatgagggatcccacatccctgagaagcccggaagcttctgggcccagtgtcagggtcaccctgtctgtctcctgtgctcctgggttaccccgagtctctggcactagtcagggttgctggcattggcctcagtctctgtgcagatggtcagcctggacctgtctctctgtggtcctcagtcccacttctttgtgggtcattgtctccatctctggctcagatcagcctgttgttgtgtctgtcctgtgaatgcagggtcaacctatttatgtgtctgttcttccattactgtcaatcaatctacttgtctgtcagtcagtgtcaccctgggaccttggggtcagtccttggactacagggtcacctagtctttcagataccatgtccatctacagtcagcctatctgtctttctgtcccttggatgtcaggatagtctgtctgtccccttggataccaggtctgctcttctgtctgtctttctggctgtttcgtggctactgcctgtttgtctgtctgtctttcggtctcgccatggcttggtccatctgctggtctgttgctcagctcgtggctcgcgtgactgccagttttccggccgccctcccctgcctgctccccctctcccgactccagggctctctctgtctgtctgcgtctctcacatcctcagcgcctccatctgtcgatctcggcgtttccgagtgtgtgttctcgtccctctccacgccccctcacagctctgggccaaaaaacacagcagcttccagcggctcccccgctcctgctccatccaggaacagccctgcaccacagccagctctctggtcttcagtgtgggtccggcttgcaggctctggagggcgaccaggcaaggctgatgggaaggaacaggaacgctggaccaactgagctcactgccgctctggcagtctgtatggggatagtgtgcaggcattagtaacaataatagctcacacttattgagcaccaactgtagacagg

SEQ ID NO: 25623 - DNA, 1449 bp, Bovine  19866880535675
ttctaaataaggaatcccttattaaacaaaaaggacaatttatcagttggttaataggacgaggggaatttgttatcagccagtaacctatctttgcttggaaaaaatcaataccaaagaatttaaacaagaatatttctttactaaagtcaaatgtcttttgtgtgcactcccaggatgaaattatctgaggaagcaacatataggaacagtacaaaatctctctggcctaagtgacttcaattttggttctggtctcttgacaagcagaatgtgagctgaccttctggaagaagaaagggccagtttttcacagatctacttccagcgttctataccagaagccagcaagttctgacccactttccgggtacagcttatccacatacccttatccacacaaacacttcatcctaaagagctgtgtggccctgtaggggcatgtgaaggggagggggccaggcggcactggcatagtgcttttcacaattgaccacctccatcataatcactagagtgcttataaaagtgtagattgctaggcatctcctaggccaacagaattagaatctttggaaactgcatttttgacaagcttccccacacaccacaagtctttcgcacaggaaagtctgacaaccagtgggataaaagatccctaggagagaggcagggaactggaattgagagaagacgagatacgattagagaaggatatgggaattgacagtgggggctgggggtgggggataggggtaaaggcatgcttccgggtatcggcagtcaagacaggtgcgcagtggggacaagtgaggtgaggacagggctctagaaaggatatgacacagggttcgggctggaagaggtgaggatgcatccgcggactggtcaagatagtggggaggcggggaggcggagaaagcagggtacagacgtgagagggaggagcaaaactgggagtaacgggggctctttgaaggggtgaggactgcaaagtgaaaattgggaaatgggggtcacaggaggcaaacaccaagaatggaataggaaccacctagggtagtagctgagatctttcctctgacccagagcctcccccaaaacttcgggccttgacaagcctgagtgcggggcaaaggctggagacggggagtttgggggagacaagcccaataagggatgtccctcaggcctaagctaggggtccctgaagtggatcgagccaagcatgggacgccaggaagtcctgggattccccagagcggcccgctccatctccggctcccggagtctccttcactcaccatcgccgccgccatcttggatccacgtgtcgccgtaatgacgtcagcggaagtagggtttccttggttacggagtttaccaccgcgaggtgctgccctgtttcagtcgctcttgtggtcgcggtgagtggaggtgcaaagaaga

SEQ ID NO: 25624 - DNA, 1434 bp, Bovine  19866880680514
agtttctaatggggcagcagaggccattatctgattctggtaacagatcagtctggctattttgtcaagaaaacatcagacatgcaaggaactgtctggggtgatggaaggcactatgcaagcaagcagcaatggtggctgcattccagggtgtggggagggtggaaacaagtacacgattcaggagcaccaaggaggtgaaatctagggggcttggtgctgattgatacaaaggatgagtgaggacaggtgcatatcagaaagactctgaggcttctacaaccaagttctagctcaagtccccgggctccttcctctaccacatgccctaccgcccacttgtcttcagtgaagtcaacaggggactcacttgaggaaaggaagaacatacagagagaggaacagggctgcagatcaagtaagacaggtatcacttctcgatatttagaaattagatttaaaccaagaaggaggacacagtggtctagaacagctcatttctaatagagaagtattccttttaacttataaagctgggagcagtcagcaagccacactaaatgaaccgcaggctaagtggccgctcaaagagagaatgacactgtcctctagcacatccgctacagatgtcccctcacaaaccccccaccatatgaatctttatcagtgcaccaatctgagaatcaggagcacagccctcagacagcccaaatgaacctttctggaaaaggcagtctggacaacagaaaagtgaaagtcaaagtgttacttgctcagtcttgtccaactctttgtgaccccatggactgtagcccacaagtctcctctgtccctggaattctccaagcaagaatactggaatgagttgccatgccctcctccaggggaacttcccaacccagggatagaacccaggtctcctacattgcaggcggattctttaccaggtgagccgccaacagaaataactgttttagagttaaaaaacttgggttaatggaccttccgggtggtccagtggctaagaccctgtgctccccatgcagggggcccaagggctatccctgctcagggaattagatcccagatgctgcaattcaagatcctgcatgctgcaagtaagacctggcacagccaaataagtaaaaataaatactaaaaaaagaaacaaaacaagcctgggttaaaatctacacctcctgaccatgagcaactttttcacatctctgaagctgctgtgccctctactctggcatggaggccagcggtacctggctgtgcagtcacagggggaaccgagtgagacagtacagactgtgctgcttgaggctctggaccctgcaaccacagttcttgggctctgccaccaactcggtgagtaacctgaggcaagtgacttcacctcctgtggctcacttcccttgtccatgacaa

SEQ ID NO: 25625 - DNA, 1233 bp, Bovine  19866880701685
atattaatgctattccatggggccccttcagagcactggcccctcttggtcaagaccctgcaggacagggttccatctttgcatccaatcatgcctggcagcaggctgagcccatgactggctgctgatccaggcttgttgactgactaaccaaccaaccatcctgtagaagggcagggagcagagacgcacatctcacctcctatcaagtagggattttcgatgtaacgctgagctacatagttctccacgggaatttcatctttctggtcatcagaacttcttgtgtcctagttgtaacaataattgttattaacattttggggggggagcatttcctgtgtaagaggcactgggttaggcactctactttgggtatatgatctgatcctcagatcaaccctgtcaggaaagtactaatgttatcaccattttatagatgagaaactgaagcacagagagggggagtgacttgcccaaggtcacacagctgatgggtggtacagctgggaagtcgtctcacacaggctgggcccagagcctgggcatttaacatccaaatctatgctgtccaataaggcagctaccagtcacatgtggctatgtacatttatattttaaattgattaaaaggaaatgatattacatgtgacagtaaggatgaaattcagaggcatcatgctaagtgaaataagccagacctaaacggacaaatcttgtctgattccacttccacgaggtgagagtagtgaaattctgagacagaaggtaggaaggcggctgtcaggggttgggggcagcggggcaggagttagtgtttaatgggtacaaggttcagctggggaagatgaaaaagttccagaaatggaacacagtttgcacaaaactatgaatgtacttaatgccattgaattgcacacttgaataaggctaaactgaaaatttttatgtatattttatcatagtcaaagaggaaataaattaaaagtccagcctttcaagttgccctagcctcatttccattgtctggatattaacatgtcactaatggtcaggacattagagagcacgagcgtgtgccattccccccactggagaaagtcccattgatggtgctgctggagtatcacccgggcctccaaggacattcctctcccttctcttcctgcggattctttgcagccagcccaattcaggccttttcacctcaccatctgcaaagccctttcccac

SEQ ID NO: 25626 - DNA, 2230 bp, Bovine  19866880710807
tcctttcttacatgcattgtctcgtttagtcctcacagcagcctggtaactgagtactgttatgaatcccattttccagaagaggaaagtagaggcacagaaaaagtcaaataacttacccaagcctgctgaccccgcgtctactgctcttcagccactccttgttcatctgtttttcaggtgggcagcacctcccccgatgtcttgtcaaaggcctttctttcccttttgtacctgggtgactaacttcaaatgctgatgaaggaaaagggacttcatagaatgactgaagaaatcagggggaaaacccttggtgtttgaatataattctggatgtcaattacttgactggcaggcatcagacagataacctgattggtgagataggctacctgtccctcttcttagctttaactcaggcctgaaacatgaagcaggtaggcactgtgagcttgtattctgaatcattcaggcctgaactgcttctagattctggtgataacatctgtaccaatgaggagaagctggctaaagtcctatgccaccagctgactaattgcaaaagattccctttgttgagcctcagctctccctgtctgctgggtgggattttcttttctatatccccttatctccgcaatcttagaaagagttcttgatcaaagcctgtaccatcacaggaaattctgatgtgaaaaggcagcgggatctgggtggagacatgaattataagcacaattctgccatttgctgtgttacccaaggcaagtaactcagcatctctggccctcagtatctgtataggcaaaatggacatgggggtggtcttccaaggctcttccagcgctgcctgaaagacagctttgagttgggtaatcttttccttttccttggtgacttgatgcagtgctttctcccaggccttccagggtggggctttgagagctctgtcttggcagtcagagatccttactgtcagctcatcttatcagcacagacatctgcattgctgcttggggatgttcttgtttaaggctcagttagtccttggtgacacactgtgtctcctcactttgttacactgatagcagacggagagcgcttcacacacaggcacgtctatctttagcatgctggtttatttaaatcatagtttgcattagagagcatcagtgataattgtggtaggtgtggttttatttttataatttttggcaagatatttgcagcagttgcattttgtcatattcgaacatagtgtagaaatggaagtgggtccaagtgaaatagaagtcgtaatagattcttgggagctgagactggacatgctgttacccaccctggggtccttcatccccttcagcactggtttctggaaggacttgctttgaggctttcatgtgtgatataaattaaacagaggctaaagctcatagtactgtctccagcagcataggggactgcagtaatcattacttgagaacacatttaataacctaagcaaaaaagtctagctagtaaatcataaaagattccatccagataagctaaaacgtcagcttgagttacttaagataaccgcaagaagatagttcttggtggaaatagttacgggttttgcaagatctgcaatagcaggttagattctagcccaagaaatacatggtgtttttccctccttatttcttcaattgtcagcattttttttttaatatttttccccctgactataaaaataatgtccactgaggaaaaatgaggaaaatcctaaaaagattaactaagattcacccagaaataactacctgttaaatcatcttactgtccaaaggaaaatgcattcctaaatgtgttttatctcatggatatgcagttctcacctgtttccctaatcattgtcgtttaggctggtttcaaaacttaatgctatgagtaatgctacagtgaacgtcttaaagattatctttgcataagtttgtatttacgtttctgatgatgtttttaaaattaaaacaatattttggttgcagtgggttttctttgctgttgacaagctttctctagttgctgagagtggaggctcctctctagtcgtggtgctcaggcttctcatggtggtggcgtctcttgttgcagagcacaggctctaggcaacgggcttccatagttgctccatgtcacatggaatcttcctggagcagggatcgaacccatgtcctctgcattggca

SEQ ID NO: 25627 - DNA, 1127 bp, Bovine  19866880721435
acaaaggacagagggagaaaaactagatttcctaaagagttcctaaggtaactctaaagccaaagccccagtacgtgcagatcagggcaagcacatggctgctgcctgccttctttgcttctatcaatgcaacctcgtgagctcttcttagccaccaccagcctctttcctagaagcccattactcactctttcagtagcagcatactacactgctgtgtcttgtttgtgcttgttcaggagaacagatgaggtggatgtgtgggaggtggggggacgtactgttctctttctgagtttgtgcggaatttccagggctaggcttccctctcacgtcggccaagtgatgcgacttgcttccttccctctggctgccattcccagctttccagaggtggaggtgcgtgatttcacgtggggggtgggggggcagaatttgactttgaaggtgggggaagttccttccaaactagattttcaaattcatgctcgctctctacccaattccaagctgcctagtaatcactgatattataaacaggtaattccaccctttggaagaagggaggacttaaacaataaaagccagacatcagaggcctttgaggtttattgtgaagtaggcaaatacgccatgattcgaaggctcaagtgggactagtttttagtgttagcacgtgagtcatgcaaaatgtagccacctttgtgcagatctttctaggcacatctccactcgtgatggggaaattgtttatcatattacattgcagtgtttcttcaataagaggaatggttcctgaacaggacatagctcatgttaatgatgagcaaagctctctcgggcatgaacccgctgatcccatcatctcgttcacggccagcctgttggttgaatggtcactgtaagcagcaggtgctaatgagctgagcaagcattctttggcccacagctagtttgtgcagttggagccctccccagattctcgtggacaatccccacatagccgctttgctcccttcacatggaaaagcctcatgaccaaattttggcatgagctcttcaaaggaaattcccctgttgtagcaagttacattgaggttggtaacctgtttgtgtgatgagcttgt

SEQ ID NO: 25628 - DNA, 1880 bp, Bovine  19866880812016
atttcttctctgccctcattttccatttggagccagagctagtgagccccgaattctttaagcctcaagtttccaccactgtaaaatggggataacattctgtaccacacagatagatagatatatatatgagaagatatatatgagcccaggacaggataaagaccacaaatggtcacaggtattgtggctgctcatcatgagggagccaagtcacagactttggggctggagggtcagccacccagtgccgcccagccccaaccctgctgggcatctctcctgattacatccctcctctctctctctcccactccctgctcccctttcctctgccttcctgggaaaccccctgagaaagtccccagcagtagagagcctcatgtgggacatttatttcccggggtcccctgcccctgccattcaaccccacaaccacacccactctacatggaaccaggcgtcctggtattcagctgccaaccatccagcagactgaccctcatcatcacactggctttattggccctgagagccacagagtaaatccccagggggccctgcttcccctcacccccaagtctgtccagaggccctagggctggctgagtgttcaccgctgcaatcttggcttcctgtcccagctgtcgtgagcttgccaggcccgcatcctttgagagctccccagatcccagagtcaggctcaaccctggagggcgtagttggcaggggctatgcagggacggcctgaggccggctggccttcactcaaagaagaacattcctggcgtccggtacaggcagggggtcagccccagtgggtagctggagcttccctggacagggaagctgcctgcaacccagggttccttggggtcagctggcaggggcagcggggcccggagggaggctggaggggtggatggtgcaggggagggggctgctgaggccaagaggtgctccagtcctgggtcagtccccatgcagaaattcagcgcctgcagccggcactggtagctgctcccgatggtggcctcgggggtcaagatgggtgcaggggccttgctaaacccctcagcctcagagaagctggtgggaaagccaaaagcagggcacgaggaagacgaggtggccacagggagctcccctgggcctgcagccttgggagtgggcatctccttggcctctgagggtgtctgaggcctggcatcggtggtggccgggcacatgctggctggcaaggcccccaccagacccccatagcttaggcccttgggttccagtggctccggcgggaatgggcactgtctgctagctgcgacgtcaggggctcctgggtcctggctggtggctcggaggggtccacggcgcgctttggtggggcccttggtgccctcagcacctgcccgtcgggtgaagcgccggcggcggcgcagaaagctgccatgctcaaacatgtcatggcagtcggggtccagcgtccagtagctgcccttgcccggcttgcggtcatcgcggggcaccttgacaaagcattcgttgagtgacaggttgtggcggatactgttctgccatcccggccggttgtggcggtagaaggcgaagcggcccatgatgtagcggtagatgccgctgagtgtggcccgctgccctggagagttctggatggccatggcgatcagggcgatgtagctgtaaggaggcttggttggctcggccgcaggggccaggggcccgggtgggggtggctgctgcatgctggccgggctggccgggctggccgggctgccggaaccgctgaggccaggcacggtgtccagggctggtgtccggcacagcctgcccaggcggttaaaaggcccacggcccagcctcccagc

SEQ ID NO: 25629 - DNA, 2675 bp, Bovine  19866880817318
agaaagggagacatccgtgctcgaaagtttaagcaacttgaaatgggaatgtcagaatctgaacacaagtctcttgcgttgacacaagagcttggctgacacaagagctctttccataatgctatactgttactaataattaatagttattaatattttaattatatacgactcttgaatctgcctgcaatgcaggagactggggtttggttcctgggtcagaaagatgccctggagaaggaaatggcctgtccatggaattttccaggcaagaataatggagtgggttgccatttcctgctccaggggatcttcctgtcacagggttcaaacccacatctcttgcatttcctacattggccggtagattctttatccctgcgttgcctgggaagcccagctccaaaacttctctgttccagtttgccacatttcctgcttatctggtagaataaatactgtctacaccttgagaaatcttttgccctgaagtctttgctcctccacaggtccttacatctctatcttgtagctctttggttagatcatcatgcctaaatggggcttcactggtggctcagatggtaaagaatatgcctgcaattcaggagaccctttgatccccaggtcaggaagatcccctggagaagggaatagctacccactccagtattcttgcctggagaatcccatggacagaggaacctagtgggttacagggatcacaaagactgggacacgatttagcaactaacactttcacacttggtgcttaaatagagattatgcatttgaccataatgcaggtgtttacttttacaatgaagtatttaaacaagaatgttgagaagtctgaatttatctgctaatctgatcactgagttcagaagccttgggctctcccctggcggacgaaaaccaaggcgccaggcttcaacacggtgtagcacagagtgccgtgggcctttccttccacgctgctgcccacacctctcccagggttttcatcgcaaaagcctgagcatcgggactggcccaaagtggcattcagttaatgccagctgaagggagggataaagaacactctgccatgagagacatttcaaccaggcaactcgaaaggggccttggaggctgagcgaaatttaattgagcagagatgagggtaggcttggatgaaggcaacatgcttgcagtcacctggagaaccacctctatacagcgctgtccacggtttcaaagtgctttcctataataatgacaacggcttccgtggacagaaggcttgcctcatgcccggcgccaggtgcgttacatctctgctttcttattcatgtatttttaatgtattatgattactattgtctgtatgattaatatttacttgctgtctctctctactagctccacacaaggtctagggaagcatgcttttttcccctgttgtgttcaaaacagtgcttagtactgaacaggttactgaatcctccacagagacccacgaggtaagatctttcgcccccattttacagatgggcaacctgaggctcagaggggacaagtgacttttccaaaagtagagatccatcccacatgaggacaagactaaaaataaatctatggtctctctccattaccactgcaactgcctggactcagaaatgtccagttggcctcaatgttgggagctgccacctgcctgctcctcacttaataatgataacagcctcgcaacactgacccctccctgagcgcttgctgctacacaccaggcgctcttcccagtgcttcgcgtggtttgactccgagcaacttaggaagtacttgctatgatgcctttatggcagttgaggaatctgaagccccagggaggttaaaaacctttgcaataatcatacaacctgtcagtgggtgggttcagaattcagaatccagcagtctgggcccagcgcccatgcttttcacccctggccacgatgcctcagcaagatggcgagcagtgggggagagctgggacttccagagcacttatgaaggccaaggccactctgcctggtaactattaggcatgctgtcctgtttctcttcatgctgtcttttcaacctcacaatcaccctgtgaagttacagaggaggaaactggagctctgagcaccggacagatgagacagagtcaattagtggttgcctacggcttgtgtggtggggaggaaacggggagtggcagttaatgggtattttgggggtgatgaaaatgttttaaaattgataggggttgatgattacacaactgtgaatatactaaaaaccaatgaattatatgcactttaatgggtaaaatgcacggtagggggattatatcttaatatcgccttttattttaaagtgggggagcatggaaggaagtggcaggggtggaatttccaccggcttcagatcaaaaactttggaaaactttggaaccgctgttgcctcttctttgtctctcacttctcacatacaattatcagcaatcagcatgtatcctaaggcgtgttcccacttctccccactggctcccactgcctggtccaagccaccccctcttctccaaaccaccgcaccccttctacgcagtctctttcctctccccttgctctcgctcctctgttctccacagagcagccagagggatc

SEQ ID NO: 25630 - DNA, 1490 bp, Bovine  19866880873271
caggctgttcgatctccgggcaccagctctccacgtgcacacgcactgcaagccagcagctcctcacacataaatacagacacgcttaacaaaaatagtatatcatcttcacaaggaataaaaactagtttcaaatatgtacagcagagagcccggggtggccaggactaggcctggacccccccaaggatgagacaggccgtgggtggagcagaggagagagagggaggtcagaagagctcctggccaggccatcctgaccttggcagcccggctgctcaggctgaatgggggtggggtaccaattgttcaggccaggcagggctggcccctccggccaatcccagctccaccccacgcacaaggctctccttcctgcccttcctgcctgaggtaggaagaccctagggctcccacagctgctccctgtagctccccctcacctctggaccatggcccctgaaccccatgggcagcagcccaaggcaaagacgccacaggctcatcttcttgcaggaagtgaggcagctgaggccatgaacggctctgcggcacctatctcaagcccagttggtccctcagtcatggtcatggagccagggaaggggaagaactggggtggtgctaaactgcaaggccaccccagctttggcatggggtgcttcctacagctacagtccctccatctcgggtgaggccggcctctagccagagacctccagaggacactgggattggggggagggactttggccaggtcagagagggggaagggggtcctggtccttatttctttatcccaagcatcctgaatccctaattagtcagaagtgggtcctaagtggctcttggagggtggggatgaatggacggggggcccagggccgggaggagggaggagacaggaaatgatcaattctgaggccacagacatcaaaatgaaggcaatctattgtctctctttctggggaaaagggtcagaaaactttccagctccctggcaagaaagcatgctcagggaccctaaatgcggaaggggacccaccaatcgggtggggcactccggcccccagtcacaacccccgacacctgttagcttccaccggggcaggttctagggaattttgtgggttttgatgccacgacaattgaggaaggtggctctcacagaaacatgtaaattctagaaaactaattgcgggggatcaggtctaggcccaaccctgtgatgtgtgggtggctgtgggctccatggagtggttctcctggtggcaatggtggctggacggagagatgtggtggaggcaggacgggggtgtgtgggtgagttggtggtcagtgtctggtcatttccgactgaagagcgagcccagcagaaccacaccagccacagtcatgcccgtcaggaaccagcggttgaagcgctcctggcccttccggctactcggctgctgcattgttcccgtagagttccacaaaagtgtcctgcc

SEQ ID NO: 25631 - DNA, 1761 bp, Bovine  19866880967701
tattgctaacctgggtaagagagtttttaaaaaaataactagattttaaaacattttgaaaaagtaaaacatacacagtaaataatgcaaacagtaaaaatgggtacaacgatgaaaaacaaatcttcctccttcttcagctccctgaagacaactgctagcaccaggtccttgaaaatccctctggagatactctatgcacgtacaaagggaagcattcagaagcatgggcctgccttgatacaacaacaacaacaaacagacttttattctttctttctgtgacagaaagcctactgactgtggctacttaccagcatccaacctcctctccatcaagtggaggacttcctccacttgaacagtcatcaggagattccggctctctctctttgctaggtctcacggggcagtccttagattgggcgtgcttttgtgtgagagaaataaatcctgtcctttcttttcctctaattcctctctgaacctgaattccagttaataaaatgcaagaaagacaaatcctgtactactggcatataaactgtcatccaaaagtcaattaaaaataataagctaactctatattttcaaaaatgatgcagaaaacaggtaatccagataccatcaacaaaccacagaacaatttatcttagaggaaggatcaacaggtgaaacatggcaaaggatgatttccataatatgcaagattcttagtatttgtgcaaccaaaagcaattcagaaatttggtttagaattaatgaccataccaagatgatactgtcagttttagctattaaaatgccactgctttgatattctcatatggctggagggattataaactgaaacattttttggggggtaatctgatactctgtaacaaaagccccccagaattgcacactctttgaccctgctcggacaggaaactcgaacaaacttcttggacaacccagtacttctaggtatgttcagaaaaatgtgccaaaatgccaaatgtacataaaagaatgttcaccacgggattatttaaactagtgaaatagttcataacttacaacagtaaaatatccaatattagtggaatgggtcaaattatggggtatccttttatgtagtcattaaataggatgatgtattttttcagtaggaatatctgagctttagatttaagtagaaaaattagggaatagaaccctgctcagcaagatctgctcctcttttttaagttatgtttgagaaaatgaggcaatgttttccttttttgtatatctgtaattgggcttccctgatggctcagatggtaaagtttgcctgcaacgcggaacgcctaagtttgatccctgggttgggaagaagatgccctgcaggagggcatggcaacccattccagtatttttgacaggagaatccccatggacagaggagcctggcaagctacagtccatggggtagcaaatagttggacacaactgagcaactaagcacaacagatctgtattttccagtttttcttaggggcttatacaaatttataccaattaagaaaaataatgaaataaattaggcaaaagaaaacatcactgttccgaacgcctgggttagagccaattctagcttggtatggaaggaactccacctgctggctccaagatgtttttccatcagcaactcccactgtttctttctaagccttcaggaagaccctaagggtgtccctgtgagcagacttgcccaagtgaggctgccttcaaggg

SEQ ID NO: 25632 - DNA, 813 bp, Bovine  19866881011640
tttacttatcccctatattaggactgtcccgatactttcactttaaagatactaataaaagaatatccatgaagctaagtttctgtatatatatacttaattcttccctgaagacaaattcttaaagacagaatcactggctattgacacatactgtgaaaacgttcctcaggagagtaatattcccttgcgttacagagaggtgtgccagttctcttccaggtactaatagccctcagtattcattttctctatattataccactatacttatgctctgagataaattatgagattaggtccacccaacaatggcaccccactccagtactcttgcctgggaaatcccatggacggagaagcctggtaggctgcagtccatggggtcgctaggagttgggcacgactgagcaacttcactttcacttttcactttcatgcaaggaaatggcaacccactccagtgttcttgcctggagaatcccagggacaggggagcctggcgggctgccttccatggggtcacacagagtcggacacgactgaaatgacttagcagtagcagcaacctcattgttgctcggtggtttggccagtggacttgggtaatttctctcagtggacttgggtaattcagaaggaatttgttctatttggtttacatggtgaaatcaatctacgcaccaaagaacatcatcttcccatggtctcccctatgaactcaatgaagctatacctccacaggtatctttataacaatgctccaattgaagtacttagtgtagaaatatcacatttggagtgggaggagtt

SEQ ID NO: 25633 - DNA, 724 bp, Bovine  19866881035056
gatgttaaactcacaactcgaggtacaagataaggcaggaagcagggagatgagacagctctggagacgtctacttgctgggaacatgttgggagagaggctggaggctggcacggctgtttcttctttaacctgctgtcacaggtgtgtccagtggagccctgtggccccaggagagtgtgatcctgggttactgctgacagatggtatgcctggggctgggagtggaaggaaggcccacctgggggctgcccagggcactcacgctagaatccagaagcacttaacactggtggtagtgattcatcacacacgcagcgagctgccagtgaaggctggagaagagatgaggagcaagacacgtttgcccaccaacgagtggccagggtgccagtggctctgcagctgcagcagtgacctggctgcagcactggctgactggtgaccaaacactgggataactggcaggtcgttaggtcaatcgctccacccctcacgttgggcagcacagcacgcagtggctgacatgggtggagagaagtcaattacaccactttaatgcaacaatgctgaagacgtgaaataagggagagtcgttcgtgttctctgtacaatacatccatttacagaatcagccagtactgtgtacaacatataaatatatggtaaaacatcagaggtgcatacagcatacttacagaagccaaaagttcactttatacat

SEQ ID NO: 25634 - DNA, 4055 bp, Bovine  19866881045556
catgtgccgcaatgaagacccagttcagcctaaactaaagacttgaaaaaaaaaaactcaaaactttctaaaaaaataaaaaaccataaaactctcctcctcctttcctccccaacaattccaaaagaattagggaaaggctaaagaaaaaatacacataggaaatatgggagaactctgaccctctcctggtgcctaagaaataaaggacccttccactaatcttgtcacctattgaaacttaattgcagctacaggataaggtaactttattaaggtcagaatgcacagacttaagcataaggctggccaaaataactgttttatttaaatgacttgaaggtttaaacaaatttatcaacctaattcaatatactcagtttttcatacctgaaattttgtagtcaatttaagataacaccttcttgcctttccaattcaacagatattgaattggtggtttccatgcaccaagactgccctggttcctaactgaactctatcaagagcagtttgtgtccctcctgctccccaaagctacctttgcctgttttaagcctcaacaatctcccttacctctaaactgccaggtgcttacaatacaaaaactagaatatgcagatgctatcttgtcttgttctaattgtcacttgtcaacttgaatcagacttttgtcctcaagcataccagaaaccctttgactgtacacacacagtatcttacaccaatctgagcacagagtataacctcaaagatcaattagctaagtgagctaggagtcacaataatttttatcccaagactgacaacctaatactgaattgacacgcccacagtacaaaaccaaaacaaccaaccaaagggactcaagtctgatttaggggtggcttgacagggggggtgtgatacactgaggctgcaacacaaaaatatccttagtattgcagcaaatagttcgaattttgacatctcatgagacaatttcaaagacaggccatagattatcaagacaaggtaaggctgaatcagggcaaactccaagtgatgatcttaaagcaaaatctgtagagcactcagatgctatcttgtcctaagcaggactgattggaagttcttggtacctaagtactagaaaattgtgagaaaaagaaaccactaatgaagaaaaccggggaaggaaatggcaacccactccagtattcttgcctggagaatcccgtggacaaaggagcctggtgggctgccgtctacggggtctcacagagccggacacgacgaagcgacttagcagcagcagcagcagcaatgaagaaaacagggagaaaaacgatcctacaatattataatctggttcactttttctttccactccaatctgttaagtgttttaggacaggaaatcagaaaggcaataataccccgtgatgcacacaaagggggagaactgataaaaccgaatgaattttaaatcccccaacaggaagttaactccaagtctaattacacgccttcaattatgttctcacttcctttacctttctattttacaaaatagttatgagatgcagttgtttcgtggccacaccttgttttcctccaccaaacgccacacgtcttgagggcgggctactgtatcacccatttctagaaatttatctagattacgggcctcatttcccctcctataaaagagtgctaagactagcaccgacttcactggcttgggaagaaaattaaatgaaaaaaacacacagtgctgagtccagtaaactctaattgcctgtgtgctgggtaataacataattgtcattacccttagcccacagcctcgccctaattcctccatttcccacgctggcctccgcctctacctgctaacacagcctgctagacccgctccgccgaacttcacggagaaatcctgtcgcgaagggaaaggaggccggaagctccgctcctgcaccgcgggtcagggcggctgcaccgcgggtcagggcggcacccccgcagtacacgtcccaggagctgcgccctccacgcggagacctccagtcgcttgaaattagggtgaagaccgccgggcgccccaactgctcctcttccctcctcactgctcacctcagcccagcgctgtcaaccgaccgccgcgaaaacccgccgcgggactcattcagtaccgttgaaaaatttgaacgcagactctgcacaaacgcaccaatcagcgtgccggggaaccggcaatcccagccttccgattggccccttagatcctggcgacgccggaagtcagggtgagggacaagcaaacaaccggccccgaaggcttctgggaaatgtagtgtaactgcgagagccggttgcaacaactcgacgaacgaagttactacaaagcccagaatgctccgctacaaactatttgggataggaggttaaaaatccccctgcagatgcgggagacagaaaagacacgggttcgatctctgggttggaaagatcctcttgaagaggcttccctggtggctcaaacggtaaaacgtctgcccgcaatgcgggaaacccgggtttgattcctgggtcgggaacatcccccggataaggaaatggcaatccactccagcactcttgcttggaaaaatcccatagatggaggagcctgataggctacagtaagagtcggacacgtcctttcctttctttttttttttttcttcctttttttttttttttttcctttcctttcttgaagagagcttgacaacccactccagtagtcttgctggagaatcccatggacagaggagcctggagggctaacgtccataggtcgcaaagagtaggacacgactgaagcgacttagcacgctccctgcaatgcggcatagactggcccttagattctttgccaactgtggagtctctcaaacttttcatccaagtccacgcccggatgttagtgcctgaagccacggtttttagaggattgttcttttctcctttaattccaacatccttggttgtattaccctcgtattgtagaagagaaaacaaaggcttagagaagttgagtaaacttgtttgaaatcacatttttttttaagtggagaagatgggatttgcattaagaacatctagtcctatttatcatcaataatcacttaggaggtaatagcagcaacaagaacaaaaagatgaaccttcaccccacacacacccccctcggaattttgttttagtctgtggcactttcaagtgcccaggcaattctcatatgcagccgggattgagaagcattactccaaaccagtagttctcaaagaactagatgatcagtatagttggaaacttgttagaaatgtaaattttaggtcccacgtgagacttattgaatcagaaactctgagagtgggcacagcaatctgtgttttctatcagcccctcaggtgatactgatgcccactgagttttgagacccctgctctaaaccaagtgacactaacaaaatctcaggcctcgggacctatttgtgttgacaagaagggtttgagccggatggtcttggctctagattctcccaggaccctattccacccagcattctgtgaggctgagatgcctgctgcagattctggcgccacgttacccgagtggcccaggaatcctaggtgcagagggatggtccactctgttgcagcgtgttacttctccttcaagtcgtctgcgccctcctgaatattctccgtctgcaacaacagcccggtgcgttttccaggagcccctcgcccacctagaacgaccacacaccaaaggacaatatcactgcaacaccttccgacttcacactgcgcctcacactgagcacagaggctctgggggcgccaagaacaccttttctcatggcaaatattattagaattcagatgtccctctctaagaaaaaagggaggagatggtcactaaagcataaaatctggatatattttaacggcttttagggctggacttttggagcaaaaagatttactcatggcagaccatagcctctgtcacaaccatga

SEQ ID NO: 25635 - DNA, 1485 bp, Bovine  19866881155654
cgccagctgaaaaggttcctgaactagagaaccagaacaggccctctgagtacagaaacagagaaaatattggtgcacaagcataacttgcggaaccctagccccacagacccagcaagtgtacagagatgcgtggcaacagaaaggcggagctcaaaggaggcccaagggggagaaaggtgaagcatgccacatacaaaaagtcctcaagttttcagggttgtaaggacccctataaatcatctacttagaagaaaagcaagacccatacagatagtggcttgctcaaaactacatagtgaccgtgagacagatttaggagaagaatcccactttactagaaacgcagctcagttcttaaaggaatcaaatgtcttctatctaagactagctttaaggtgaagtccagaaagaagtcctggctcttccctccttacttgctactctttgagctgggaagtaaaattgttgaaatgccagctgcctccacccagacgctgttctgctaaggaagaaacgctagatctctacacgcaaatgcttctggttgacacagcactgtactgacacaactcagttctagaagtctcacaattcttccccaatccctcaagaacacataaaatactaccgataacggattttttctctcgcttaggaacaaagggctcctgggagatgacagtgtttggacgagccttgaagcaagctgcttctttctgctgttttagttcttcgtccagctgtaagaaagaaaatctgtcagccaagcaaccaccaactctccataactaccacctcaattactcaagttcgaatgtttctgaactgtttcatctataaagacagcagatgattattaatcaataccatgggaacacaatgacctaaatccagattgtaaaacctagataggacaaacaatcccatttattcaacatacaaaatgcacatagagcagcctataggtgaaaagggatttagagatttatcaaaccaatataaaatatggaccttttcttgatcctgatttgaacaattcaactgttttaaaaatgagagataggggatatatgaatgctatttgtcactattaagaaattactattaatctttttaagtgtgataacaacactggaattatgcaattcttttaatccttgcattttaaagttacacattgaagtatttttgaataaaatgagatagcacctaggatttgcttcaaaataatcttgtgtaggcaggaatatccagtatagagatgagtaggtagaaagttagatgaagtaagattttccatgttttgagcactagaaaacacggtgccaggttcatggaagttcattatactattcttccttttatataagtctgaaaaacttaaaaaaatctttttattttggaaaataccccccacattctatgtcatgactgctttcaaagcaacagtcctacattctcctagagaacagtgccaacaag

SEQ ID NO: 25636 - DNA, 1088 bp, Bovine  19866881183719
tggagaaggaaatggcaacccactcccgtgttcttgcctggagaatcccagggatgagggagcctggtgggctgccgcctatggggtcgcacagagtcggacatgactgaagtgacttagtagtagtagtagtagagagggtgggctcagaattgagtgggggtggggagaaaaagagaaaatcatataaacgtttaagagagggtctttgaagactaactcatgaccatgtgctaagagctgagcggtgagattaagtcaaccatctgtgctttagtgtgtgaaaagtaaatgtaaaattttaatttagaaaactagataaacaaatgaactctggtgcttatacactgtagaatactctgcagctgtcagggaataggagagatctaaatatacccatcaaagatgtccaagagcacacgggctgcagagtgatgatttgcgtgcgacgccctccttcccatcttcctaccctgccacgcatgtgatagtcttacatatgttctctgggttcctaactatgtctttaaatgaacatcatcacacacccaaactgggacttcagagggaactgaggtgtcggggccaggggatgtcaaaaccgaacttcagttttctctttcgtgttttcattttcaataaaaagaatctattcatggaattttaaatgaatggatttcgtattaaaggtagtagtaaagaccagctcagggaggcctggaatgttctgggcttgtattctctttgaggtcatttaagatttttcaagtcaagccttgggaccatctgttgcctgatgaaatcagggcgtgtggatttaggacgcaggtccccacctggcgtccccatctggctgcatgaccttgggagggtcccatgcccttttcaggcctcagtgtccttaactgcccaatgggagtcagatttcttcattccctggggacatgggaggatggagagagggcaggaggagaatcacatgaatataagggattattctctgggtcagaggagagggagtggcggcctcccctccacctgccaagcccacaaggcacaaaggaagggagggaggagttggggaccac

SEQ ID NO: 25637 - DNA, 1200 bp, Bovine  19866881209069
tgcctggcacagagtgggggctctctaaatgacagtgactggatgataatggtgccagaccccatccccaacatgcagttgcaaaggattgctgggagtctccagggccccaggtgggagggacttcagtggcagtggcatttggagacagttggagtgccaggcaatgggatgagtgcctggcactcatccacggggcaggagtgtcctcaggggatccagctggtcggggagttccatccttacaccacccctacatgtctttgggaatcagctgtccctgcccaggggggtttcctgtcttgcagtgccaggaactgaacccatgatgggaagtgaccctggcagggtttctgaaggctacaggaggaagtgtggccagagtccccatgctcagagcctgggtcaccacagccttcagaaaccaaagggttacgtggctttagtaagaggatagttccggggtggctagggacttcctcagggtatgaggggaagttgctccatcctcagagctgtggggtaagagctgtctcagtgcctctcagcagtcctgactctgtgccaggctaagactgtggccaatttccaagcctgatccttttgcaaagccctcaggcctttaagagggacccctatctctttggtctctgccccttgtcaatggacttcccccctcgtggctgcctcattcaggaacttaccaggacacctcatggcctcaggtctaaatacctcagcctctgatcaatgcatcccaaaagtaggtagacaggatagcagagccagtatgagcctgggctctggggtgagccggatatgggtccagatcccagctcgctgtggatcttgggggtcattcacttcaccactttgagctccagttccctcatccataaaatgaagacaaataaatttgaaaatataaaaattaaaaatttgttcagaggaagataccacagaccagtggttcgcagtatggtccttgaaccattaccatcatccgagtacttgttaaaaacagaagttcttgaacttccctggtggtacagtggataagaatccgcctgccaatgcaggagacatgggtttgattcctggtctgagaagattccacattccacagaacaactaagcccttgcaccttgactactgagccccagctctggagcctatgagccacaactctgagcctgtgt

SEQ ID NO: 25638 - DNA, 1844 bp, Bovine  19866881375450
tgtcaaaaagtagccaagtgctacagacaaagaagcttcgtacatggctatggctgcatttctcacacctgtccccttgcagggtagatcctgtccttgcaggtttcaaggctggagagttctgggtcctccatgacccaggggaggatactggtcttaggtcccccacctgggttcttaggtttcatcctttcaagatgaccttgagagctttaagctcatcctggttgaggggagtcaggttaaagcccttcagctccggtttgcctaggggaagaattcatcagtgagtcagggctcccgttgtccaacctactggccctggagtctagcctggcaatgcagcttacactgcattcatgctgccaaaaacttggccttgaaatctgacagagaagggcctcaaattctgcaaagcacagaacgaggaacatcaacacctgttcctgagttaccaagaacctgcagagtcatgacggctgtgcagaaccctcctaatttgtgccagactgaccaatttggagtggttaggtttacctagaaattcagctctaacctggaccacctgactgaggctttctgacccttagtcagaggtatcttggcccccacagtcacaccctggcataaaatgtgagacactccatgccattcttgtgcctgaaaagaacttgtaacaggaataagatcccaccaacttcctgtccattccatctctggtcagctcaagacaaccctgcccacttcccactcaccagctgcccaccccagcctgccaagtctgagctcatactgtctcccctcctggtttccagccccacgcttagtccccaggccaataccttgggcctcaaagaggcgattgaccttcactttaagttgtttccggagtctttctatttctttatccagatgttcctgatctggaaaaatgagacaagcaaacaagatgaggttacactacagacacccaaggataccagcctctgcccagccccactgaaggcaggggtctgagcatgcgggggtgaaaatgggacttgggagaccagttgaggaagaaactaaaggctaaagaagggacatggcctaccccgaccactgagtgagcccagaacagggctgagcacactagtttcccaacttgcagtttatcagcctgttttcattatgcaaagtaccctgggcagtggatggggaaggcaataccaggactttaggtcaccctctcacaatgaaattatggaaaattcagatttaagaataaaaagacacagcctattcgaagatggatggaaaataggtggttgacgaagtttacaaacccacatccatccaggtgaggagttttcacaacagcaggattgtgacctgaacagtcaacattctgtctcatgctcacacttaaccaattcatggcagggaagagaaggctgtcttacagaatggactgtgcccaaaggcagatgcatcgtgagaagtgcaaccaactgatgacacccaaccaactccatctgctgttttcacccactcatgagtgacatttttgcctttcctacagaccttcattctttctgatggtgataagccctgaccagctaagcattctgacctgggcagtcgcttcgggttctcgttgtaaatgagtaaccaccatcttgcatgatctttgtttagcctgtgtccatccctgagaaagagatgctgccctggaacccttctaggtcagtgacaagaccacactcatgggccaagagagctggggacctgaccctcaacccaggcaggcaaggccctctggaagcttactctaagcagccctccagtccctctgcaagtacaat

SEQ ID NO: 25639 - DNA, 1339 bp, Bovine  19866881659135
tacaataaatctgatttttattacacatcttagtttagagtcacttttacattcctagacaaagagatgatacaaataaatattgactataaaactcagagccccaagtattggcatattctttgtctcaaggtagccaaagagaaggtcaagatcaacagtaactccaaggagccataaagcccactgcctcctgcctgcccaaggatcactcctttcataaacaacctcagaagcatttcattcaggaagtgagggcagggaggagcgggggcagatttccaaacagtgcaagacaacaaccttgcacgacagacagtagccaggcccgctgtttatccaggtccttcgagcattctgattatggcttttagagtgtattagcagccccattttcgtccactgatggtgctgagatggcccaaggtggtgttcacaccaagcctcaacctccagtgggaaatgtgaggctggactgatatcccaagttgacaaagaatggacacttctcacaaacttggcaacgattctacattcagtgaaggggcacttacaagagtcacacaggagaagtagagcgtggcccacgccggagctgagcaactctcttgacgcctgtggtcgtggagatgcgggtggtgccattcaagcagcatgcaggcattcgatggggagccatccaacgttagggtggagtcttaagaaagtgcttcatgcctatgatttgtggccttgagttctgaatccaggggcctgagagacacgggatttgaaatctgaaaccagatgcattcctgcgggcggttgcacgtttgtctcaaactccttctctcagatgagcttattagatcctggggccttgctgccagatatcattagttgctgctgacatgaaggtgctcagagggcttggaacattctagcatgactacagacaataaaaacctggtccctcagtcatcttggtaggtctacacctttagctcaattcagagcccaaggcagcagcttcctggtggcaggaggacactctcctctattcgaatatttatcagatccattttgagagaagaaaagcaccagagactcaacctccagccaggtgttcttcttcttcatttcacagaccaccagatgaacacagctgagtacaaggcaggcctgttttcatgaccctgcctgtcaacttggcttacttcttttgccttcttagaaaagttccatggtcattcaaccacccatggtcagaacagtcaccttgagacatccgtattcagctacagggttatctgcaatttttaattctcagacttcctagaggaaagttcagcctacagat

SEQ ID NO: 25640 - DNA, 921 bp, Bovine  19866881665946
aatgaggcaaagggggaggcaaggggtccgagtgagtgtcagtggccatgcacactgccccctacctcctccccaagcaacccctccctgcccactaccccttgtctccattcacttcctttctttgcagtttctgctaacattttctcacatgttgcacttacttgctaggactgttttaacaaactaaggaactgaaacaacagacatgtattgtctcacggttctggaagatgaaagtccaggaactaggtgccggcaatgacatgtgccctctgaaggcactagagttctaggcctctctcctagcttctgagagtttcttgggttgtaaaaacatagctccagtatttacgtggctcttttttttcttgtgggtcgctctgtgtcttaatttattctttgcataaggacacactcatactggattagtgtccactctgatgacctcatctgcaaaaactcagtttccaaattaggtctcattcacaggtcctgggggttagtacttcagcataacatctggcaacacaagtcaattcataaaacgtgtcagtctcagctctactcttttttttcagtttgttattcagtgtttattaaatagattcagtcttatatatgctacacagattcaaaagcaagaggattccacatgcttatgaaatcagtgcatttagcaaagtaataccatggagataacagcttgagtaacagctcattggtcttttgttaagtgagggaagaggaagttggtctgtgtgagtcatttcacacacacacacacaaaaaaacaattgagttgcaactcatagaagacatacattctaaaaattaaaatattaagccacacttattggaaaacctcactatataaaacacaaataatttttatagagcatgaggaactcctcaccagct

SEQ ID NO: 25641 - DNA, 1161 bp, Bovine  19866881809082
ctggcatgctccctgtcccaggcctgtgtccccattcatgctctggcccacgcaccctggacatgctcaggaatggggctgggggcagggaagtgatgccaggctgggagcagggaagaactcatgaggtctaagggggacgagggtggaggagcggctccagtgcaaagggctcagaacactggacgctgggcaggcctgcacctgctgggagcctcagcgtctgcctcagcacaaggcctacccccgcctctaagggttttttgggtcttgaggttctgggctgaggtctgtttagaggtgttgcttctagctgggaagctgggaacacttccctgcacaacctcctcctcagaggagaggtctctagagactggagtctacctcagaaacttcactggtgagcactgcccgctctgtcccaaggccacggcactctgcctgtcccagacctgtgctaagacataggctggtctggagctggtgagacccgaggcaggagaagtcacttccatcagtggagtcagagaaagcttcggggagggagggacatctgcctgggacagagctttctccacctactcctgtcccccctgggcttaggggctccccctctcctaaaccctagtcccttcctccctggaagcttcctcagcagttcacaccacatcgacttctgaatatttggtaagtaaggtctgaatcctctttaagtatgtaggctgatgagggcaggggtcatgaacttgaccccacagtgccacgctcagccaagtgtgcacatagtcaacagtcaatgtggtggatgatgaagtgggcatggagcggagatagagtgttatttactttgatgataaaagatcttcatacgctgggaatccagcccctagtgatggtcactgagagctgtggggagcatctccctgggtcatgtttcatttaactttataaatacagatacactatttaaaacaaaaaatggaagtctattctgcatgctatcctgaagcctgtgttttgcattttaatattttgtggacttccttgcacgtcagcacgtagaaatccatttagtggctgcagagtattcaagtatgaatataccattatttatccagtccccttttttttgggttgttcccatttttaactattttctga

SEQ ID NO: 25642 - DNA, 1083 bp, Bovine  19866882180069
tgacttccacttccgcacagatgagcgggtcaaacagcatcctaaaaaccaggaggagtataaggaagtgaactttacatcggaactgcgaaagcatcctccatctcctgtaagttgactgtctaagttaatattcttgttagttattcagcgaagattctggtgtagtatttatggtcactgttgataatgtaattgagagaagcatgtgtctttcagttaaaatatatctaaatcctcactttgccccctgttagctgtgtgatcttgaataaatcactttctctgggaagcatcttatcaaattactgtgaaaactgaattgagaatgtacataaaacacatagaattacatgtggcaaattgtaggtacaggcttgttatggcttgtgctattaaacatttgtttaaaaaaatcttgtgtctgcaaagttttgtgcaaactataatgggtttatggggaaagtcaggttggggcagaccactcaaatcctatacagttttgttaccagagcgctaacaaaagcagtaataatcctaaattaaaaatctatcactaagaatttctacttgcatttgcagtcaccagcatcattttttttaagtaggttaatctctttttaaaaaattagtttttggttgcactgggcctttatcattgtgtgtggctttatctagttgtggcgagcaggggttactctttgttgtggtgcatgagctgctcgttgcagtggcttctcttgttgcagagcacaggctctaggcatacaggcttcagtagctgcagtacatgaactcagtagctggggctcttgggccctagtgtgcacgggtttcagtagttgtggttgctccacaacgtgtgaaatcttcccgggccagggatcaaacccaggttccctgcattggcaggaagactcttacccactgtaccaccagggaaatcaccagcattacttgtttaagtcagtcctttgcagacttaaatcctggagttgtgattcttcctttgagatgtaggtccttgagttttacttccagtcagaaactaattttataaaaattagtgacccaaggagtggg

SEQ ID NO: 25643 - DNA, 2180 bp, Bovine  19866880417865
atggctcactcaaaaaagaattatccagcgcttttgacactagtgctgcgattgagacaacctggagcagtggggagtgtagagagtgagaagagggctgaggatggagccctagagaactcccgacattgaaaggatgggcagggaagcaggccctggaggagactgaagaggagccaccagagagaagccactgaccaggggaacttccccagttacatgagattttggcaaatcaatgtcaagtatggggtaatggattgagtgctaaaagccaggcaagaagagggaggctggttgtcacactctccagatgaattcctcaatgctgccaccctctcctaggaacactaaagccaaactaccaacagacctaatcgggtaagcaaggagctttatggagaagggttctcagcttttcccctccctttcttaatggacattccatctgagaacatcaaggaaatacctgaaatgtcatgacttggtacttgcagagctaaactaatgcagcaggttcaaactagctgtagaagtttgagtcctccccaagtttgccctcctcagctgattcctaggaaaaggcagggagcccagttcattctcaaaactgtatcttcttccctggtaggaacttgggctgaaactcatttttactaaaccagagtttagacctactagaatctaatactgaaaacagcttgagatctcatctgggctatcctgtttgctttctatttcactagcctgcagtggcatttgaagcttggttttctacagaaaaaaagatacctctctagatgggccctgctgtatttggttaccctgggcttcccataaataaaactggactccttgggtgaatcctgaaatgtgtttgtctcatttaccttttcaactaaccatgtttgattcatgtacccagaaaaaaaaaataaggtaatgcatttacacatcaagtgcattgtacatgctcagtaaacatcacctgtgcttttcctttattgggctattttaatcttcagtcccaatcagaatcaaaactaaactaattctgttatctaagctttggagagaaaatcaatgtctgccttaagttcagatttccaactaaaccatgaagactaccattcagataacatgctttcatattctaatgccctaagaaaatatcatataccagaaatcttactgcttgcaaatcagtgtatacttggaacaataaagcctcccttttctggggatagctaagccagcagtggattctactacctgtccgaataaaaaaataagataaaagaaaaaacaaaacatacatcattgatctccatggtacacagcttcttacttcattaaataacagtttccaagtaaatcaagatgttagctgcattggaaatcacttggcataaaggaggaaaaaaatctttcagattgtgatatcaaagtcgtcttggctttctgctttcgttcaagttgaaaagaggaacaaggagtaggagaaagagggagaaatgttagacggaagacatttctcaaactggaagatgctgtgacaccttcggtcagttcttttcctggagcaggtacagctcaaaggccattctggaaaaaaaagcctgagcccaaagtaatgtctactagccacgacagtaatcacaaaaacaaattccatacaactcagggccgggagggggcggtttgcttatataatgtgtccatcctgttccaattgcactctcctggtcccacacgtctcaccgctcggcgcttctcatgccccctactggagaaagcaagtacgtttaagaggtaaagagcagcagaagttcccatttccctccaacttcacagttggggaacccaaaaggcagagggcgcaaagttcagctttgattcgaaagacggtccttccctctcttgaaatcgtatcttgcaccttcttggatccggtatccaaaacgactgccagaggctctttttcttggtttgaagaaaaaggactggccagactaaaaaggagggactttgggggaatgcaggattcaagccctgggttgcggcccggaggagaatgatgtcaccacttctgcaagagagggctggggggtggggcggccgacggggagcccgcgccgagcctgcagctgccaagggagcgttccgagcccacgtcaggg

SEQ ID NO: 25644 - DNA, 1611 bp, Bovine  19866880453238
cagcagcaaacaaccaaccaaattgtcgtttttgcataggagtaatgcttctgatttttgagtgctgactaatgagaattactaaaaattagcatttatggaactgcttctatatgccatacattacacttttttttgagctataatttatattcagtaaaatttcccctttcaagtgtactgtaaccataaaagtcctccaaggaacagatgccgagatgggaataaacatgtattatactggcaagtgttggcttgtttgtttgattgactttagctattgtaataggaatttagttgtttgccactgatatcttttacacaatcctataccgcaggtataatttgtagaacaaatttactttaaatagcttgcccatggcaactcagagctggtctgatctttaaaacggtgcttgtagccacatgtgacctattgttgccaagatcctgagtcttccttaagtgacagtgggttgtgcatgtggttactcagaagcagtggagcatggagtatatttcctggctagttcctcagttcaaggatgtgatcaatatcacaaaaactttcaaaaccttttactgacttatctttgcatagtaggactatgcaaagaaaatatggaagagtagaaaatagagaaaaaagtcacccacactctatttagtaagcacataaatttaagttgcagttatggcagttgaggggaaaattattgaaagataacatcaataataagctgggtgaggctactataaaatgagttgtttatttatgtaaattttctctgtgtttcatgtgtagtgatgacattactaaaaatcaatttttggtttttaggaccacagcataaaattcagaagaaataagaacatgtagacaaatattcaatcttctacctttatgattcagatttttgtaaaattagtggaatgattcgactgaaaactagcattattaatcataatatgacttctaaggaattcacctgatggaaggtggtagggaagagaagttaaacaaaatctttgtgatgttgtctttaatgttgttttggtcttttattttcagcagggattagagtggcattaaggaagtaagaaatgtagagaaattaaattgtgtgatttatgggtaaataacttagtaatacgaccccagtgagaccaaggggttgggatttgagggtgggtttgagagaatatgatttgaaagctatcattttttttcctgtattttttgctttttaaatctagggttacatttattcctgcagaaggttatcagtaaaatacaaaaacacagaaacaagaacacagaaactagtctttattccagaccccttgtgtatatgtatgtgtaaactagcaagctataagctctagagagcttagaaaaggcatcctagcctctatctaaccagaacatcaatgtttatctacctatcccataattaaaatcacatgtctgaccataagctctgagtgagggtttgcttaccttaatgcttgtaaactacttggccgcttaagtgtcattggctctgtgaattgaatcagaagggagaaaagtgtcaatgtcagaatctactttaggcctttaagctgatt

SEQ ID NO: 25645 - DNA, 1123 bp, Bovine  19866880492655
agaccttgtgaggcatcactgatataggttgattgggaccaagtgggaattatataattctaatttccgaatccttctttacataggaaaagttttggtaggcagcaacagaaagatgtccttcttgtaggaggaacctctcccctaggcagcctgtagctgcgtctgcttagttaagctgtggagtagtgtgggcatcagtaaaggtggggagaggctgaaacagacctcaggaatgaagtgggaagagcagagacccttgggttggaacttcagtgtgtcacttacatttcagagctacagtttcttcatttctaaggggagttaataacattccttttgctgggctagccataagttctgagtgaggccagagcgggtaccactgaggagcagacacattcatttcatttgtatgtcaggttaacctgtatcatgggagcatcacaccacttcgccgtcagctctatggacacagagctggaggcattttctgagcaaatttatttttcaaaaccttctcttgaggcattgtccatatgttctacgcttgaattttttcttcatttgtgaaaacgtaaacacacgttcaggcactttgaccatattacaattaccatactgtttatcttttttgcttgaacacaagctgcgtgtttccatgctcatctggtctccttggctaagaggatgacttctatgccacttaggaatggttgacatttaaatcttagcagtgactgttggaacacttccagattaattttggaaaattgattgaaatccaatttttttcctctgtaaagactcataagaaactattaacagtgattactttttggatgagaagtttgtgaggggcaaatgagctgtgatggacatcctctgagacaagctacctcctgggattcaaacccttgtgttattcccctcctatctctttttaagtccttattgaaatttttttaaacaatattgcttctgttttatgtttggttttttggccaagaggcatgtgggatcttagctccaaccaggaatcgaatacgtacctcctacactggaaagtgaagtcttagccactggaccaccggggaagtctcctgttatcccctcctcttga

SEQ ID NO: 25646 - DNA, 1710 bp, Bovine  19866880497926
tggtctctgggcctcaggtcaatcccagatacttacccatcctttcccagcagtgaaacttttttttccgtcccctcccaccgctgccctaaggccctgtggtgaaaccatgagagaagtgaggtgatatcctggctgacagaacttctggacaaataggacagttaggatcaggatgtcacacttgtaatctgattcacagcactgccctcacccaggttactttacttagtttttacttgatttacccagaaaagcaagaaatattcatagttgttattgtgccatctaggacccacatgactgagagaaatcaccaacccgctttttcacttcatgactagcagacctggctgtgtcatgtgccaagtccccaagccaatggattcagcagatgatttaccgtaactgtagtttttgcttagatacgttgccagggttggcttcacctttttgcacttgcaccggtctaaagaagacaaaacaaaggcaatgttgaaaaaaggttcagaagtcactctggagagaagaaagagatggagccttgaggctaatgaacttacccgggcttaggcgtttacagtcaatgtcaagaggcctttcctgtaccatcatgtctggagtgatgtctatccacttaacgtctgaaaaacacacagggacacatgggtgtggtcagtgattccagctggagtaaggaatcatctggagacactgactaacacgacagcacacacaaacacacacaaatcctaaacagcaaaaattatatgtgattgtcaactacttcttccatatagactctttgggcttaggaaagaagacttatggctgagactgtttatccagaacaaactaaagtgaaggcacatccatttaaacaggttgatacatacagccaacctggatttatccaacatttatccaacctggataaattatgtcattccctcctaaatctattttaaaatgttgattttccaagttgacagtttacactaatcaaaataaccagaatagtcctcaattcccacctcacattttgcagaaacaatccagagctaccccctaaagaagcataaccctgtatcagttctataattaaagaaatacatttttttttaaactgaattagagaggagcttaaatttcccccccttcacttcacttctccacctccacgttttgggcaaggctctgagatataacttcagaaacgacactaaagcaacaccataatttctttaaatgtgtagcaacttgagtcagggataaaaggaggcaaaaatattcttaggttttatttcaagaagtggatttaaacctgcctcttcttcctagaaaagcaacaaaaagactaaagagaaaagaaggaagtggtggttgagttcgagttaactaagatgccacagacgctggcattgggtcaaagaccatgaaacagacatcacagttttccagggcaactaaatttataaactgtactcctggtgggaagtgactagtactgctttttcagaaagagctttcaagaactaacgttaagtggagaatcctggtaggagtgttttatttattaaatgatattaaaaaagtgctgaaagtgggttcagacccaactgtcactgctattactattttattactacaaagaaaaaattctctagtgtcacctatctaagaaaaatcgcccatccctctttatgggga

SEQ ID NO: 25647 - DNA, 1439 bp, Bovine  19866880536277
aatatactgtctataagaaaaggaacttgaaccaataacttttaccaacataatgatatagtactacttaaaggtgtaagaaatacttgaaacctaaatgaaacaataaagcactacactggtcctcaaaatggtttactactctaattttagtctacttgtgtgtgtgtgtattttaaaaggagaattttagtctacatccaagcagaaaatatattagttgcaaagtaatttagtttccctacacaatgaccagtagctgaagaattgctattcttatgttgaggccaagaatgtgacagtcagataaaaggaatattaattttaaaaaatctgtcagtcttttataacccaggtaaaagtagaaaaaaagttactgacaagggggagctactatgagctcaatcacttttccaaatattttattccttcctggactgtcacactgattaaagctcctacaaaaatcttagccttctcctaagcttcaggccatgacagcagtttgtcctggcaatttggtcttgtggattgttttgggaagtccttgaacataggttagggttagggttacagcatttggtgttttacaagttttcctcacctaaatggacacaaatgtttgttttccttggaggagaaatcattgaaaatactgataatagatgaaggaattaaaaagagaaaaagaagagtatggcaccaactggttagccacctactcttctacatttccaggaaaaggattcaaagaattaaacctttttttttttttttttaaatttccagatgttcaactctgttgaaactgctccagaaaatgcatcagataaagtctcttctgttctcacaatgaccagggccagtctgttagcaatttgggaatgtatttctgaaaagaggaatctcttcagtaactgaaaatgcaaatataccatcacaagtgtctttgtgaaatgtgagcaaagttctccatttatcgggcaacaagattctttatcatgccaacacaagatgagaaaacaagtcctgggataacttatttttcctaggataaagaaagaaatttgtagaattctttctcctttgaaataataaattctttatttaaactaaaacttgaaagtaatatccatttctctgatatgttgaaagtagtctcttggagcctgtagtgtaatcttaaaccattcatcctcaatcatgggaaaaagaagttgccagaagcagctgagtgctccattgagcacagatgagctgaccatctgccaggccccagagaggacaggccctgactattcccatgtcctcgctagatccacctgctcccatctttagtccaggaggcagtcattgcttctgccctgaggatgaaagtaagaagaggacacggtgggcaactgctcattcacagcagcccacatcgctcaacgtcatag

SEQ ID NO: 25648 - DNA, 1735 bp, Bovine  19866880603045
ctagtggaattaaatatacagtaaattaccaagtacacactgttcattttgaagaattgacagaacatttaaagtaataaaataatagtttagtggaaatccttactacagcaaaatgcagaagttcatcttcattcagctcatttttcaattttctgaataaggtttgcattgctttgcaaggtccacaccaggcttggtaaacatcgatcactagaagatgataatattcgtgaaagaacaaaggcaaagagtcttgaatagcagcttctcccaattctcagggcagagaaaagacagagcaggtttttactctgggaagtggggagcggtgctcagtgttggggtgccacaagataccctgagcctaactccagacggtaaacacctgggaagccagtacctgttaggcctttgttctgcatcatctcatcccacaggctttgattattgatgaccgcctgcaaaaaagaaggagtgtcaaaagtcttcaagggccaatgctctaagtaaagaattgttgatgtgtctgcctacctgtaactggatttctcgctttttgcctgccatttatccactgtcacacaaaagagggaagaaaaatagaaaacatgtaaaaggaaatttaaataatgttgtttattcattcaaatagcatcttaagtactgcagaaattttccctcagcagtattggattatgtactttcgcctcttctggagagagaagagtcgtggtctctgaagagctcttcaggctgggatctgtgctaaatgcttgcagcagccatactatcttaccctcccaataattctgaagcaaagtaagtcataaaagaagcagactcacagatatagagatcaaactactagttaccagtggggagagagagatggaggaacaacatatggatagtgagtaagaagtacaaactattgggtataaggtaggttcaaggacatattgtacaacacaggaaatacagccaatattttgtaatcattgtaaatagaaagtaacctttaaaaattgtataaaattttgaactttttttttaaaggtgctctataaggtgggcagccagttgtatgttttgcaaaactatggccagctcaataatgaactctctgtccttcattctatatttcctggcactgaattcccataaagcagtagcttctaagaaaaagaagtcagaactgttaggagacacaggtacttaaacagagtttgtttttcctggaggattatagagtgtctgtgtgccacatgttaattgtccatgaacatgaacatggatcttccttgggttcctttccagggagatttaatttttagagcaaggccaccagtgtgttctgaggcacagcataaactttgtgcagatgttaaatcagtgaggtctaaacaccttgctccctggtgtcaaggttgtttacacatggctccaactgcgtgtgtcactggacactagtgtgaacaaaggagtgaccagaaacaagactacatccggcaaagggaattctctcacgagcgttgcacaaaacagacccttgtctagctgctagattctgaaggatcaagaacaggaactcaaaatccccgagggcatcaatcccttaccaaggcctgtgttttcgcggggataaattcagccaagctcaagtccctggggtgcgcagcaggcctgggcggtggccggactcccgtggcgccgatgctggtgctggtgctgg

SEQ ID NO: 25649 - DNA, 1689 bp, Bovine  19866880671270
ctgacagtctatgattttcgatccatcgatggatacccgcatacccatgcatttataaaaacacagtgctcttacacagggcactgccacctccatgtattagtgtttggaacctcctggagacaggtaattttctcatttgatgctatttggtctagatatacatgtagtccctaccctggctgctatactaagtgagcattaagtatattgtcttagaacatggcctaaaagaagacaggaaagggacagaactattgtgtccaaactgaacgaaatgtaataagaatatcacaatgacatttgggtgatttaggaaggaagtacatggggaaaggtggctcccttatacagagatgaagggacaatggatgcatgtatatgtaaggctgagctgcatcgcagttcacctgaaactaccacagcgttatctgctgtgaaagtgaaagtcgctcaattgtgtctgactctttgtgactccatgaactattcagtccatggaattctccaggccagaatactggagtgggaacctttcccttctccaggggatcttcccaaaccagggaacgaacccaggtctcccgcattgcaggcagattttttaccaactgagccacaagggaagcccattatctgctataccccaatacaaaataaaaagtttaaggttttgaggggggaaaaaggtatctggaaatttcgttgctgctgaatcagatacaatgaagagaaaatggggccacaactgcttaacaaatgttcttcatttttttcaacattcctctgcagaacgaggtggtgagtgagctcagaggggcctccattaggcatagattggtggccgtgcttcccaggggagaccatgattggcaaggttccaatcatgtgtgtgtccgtgtcctgtccacgggacccattcccttggcctgttgaatctgtagaccctcctgctgtgtacgtgctcatttatttgggggtacagacttgttccttcaatctgtagagtttagaaattcttagagagtaggatgtgtccccagtggtggattaaccattgcatttgggctgatcacgagcatctggcctggggccaggagcatgatgggttgtcagtaaacattacacactctcatccgtcacataattcgtttgcacatgtctgaattgagttattgtgctgtaaggtgtagaaagcgagacaatgaattaatttctaaatattatcagaaagcacgcctaccaaatcttaatgaacattgtcctggggatgccttttaatagccaatttatcacttggtggggcagggtaggttttgctatagattatgccatagcaagtttctcttataaatcaaaagtgaaattagttcaattaattcagcttatgtttggaagattcttgcagagctatttggctcagtggaaagaataggagttcaaattagtaaggcctgaatttggatccacgaaattttccagtgacattagggattttttatcctctctgtgccccactttacttaagtgtaaagtggagacaataatgcactgggtcttgtgatcggtggaggtaacataggaatgggatcttgcagacagggacaatgaatggcaccagttattgcatcaccgttactaataaacaggatgaacaggaagagggaatagataaccaatagtgcctgt

SEQ ID NO: 25650 - DNA, 1620 bp, Bovine  19866880764446
gaaggtgtggtcacactgatttcaggaacaaagttgtcctcgaagaaactgatgatgttctcctgctgtagctccttcgttggggtgactttaggaagaggtgggacaggaggccctttccttgtctaagaaacatcacacacaaacaaacagggtttaattcagtggaagatggcatgggagacatgcagaaatgtcttgggaacagagccaggggatgagattgatccctgattcaaattctggtctgcactgagaaatcagcccacctgattcaggcaaagaatgcctgcttgtagctatggtgtgacaagtaatggtccaatgaggaaaattcaggccacaagactccatccatcttaacacaagtgctatatcacagcactgcggggccacgtacctgtgcctctcaagttaaaataaggccatgcgtgcgtgcgtgcgggttaagtcgctccagtcgtgttcgactgtgtgaccctatggactgtagccagccagcctcctctgtctatggggattcttcaggcaagaatactgaagtgggttgccatgccctcctccaggggatcttcccaaccgagggatttaacccacgtctcttacatctcctatattggcaggcaggttcttaaccactagtaccacctaggaagcccaaactaatgccatacgttctccaaagtcaacagcaaatgatttctcacttcagcagcacattagaattctagaactaaaatctagcaagatttcactagtcagtgagaccactgtgggcagcatacacctcactctgcactccagtattttggaaaggcagctcagcagtaaagaatctgcctgccaataaagtcaagtaaagattcagtctccagtgcaggagactcaggtttgatccctgggtcgggaagatcccccagagaagggaatggcaacccattctagtattctcgtctgggaaatcccacggacagtggaggctggctggctacagtccatggggtcgcacaagaatcagacatgactttgcgaataaacaacaaatacgcactttagagctctatccattattcacatcttttcgcaacgatctttagtttcaaccatacacaagaaagcttgagctggattagacagtttaagtttccccataggaatttcattttctccaaaaggagggataatgagggtggctgtttttctctacatttgcctttgcttggccctttctgtttctttcaatcacttgttccatcacttgctgagtgcatgcacaatatgccacgggtgatacaaaaaaaaaaaaaagtgaactgacataaacatcatggccgttcttgctccaggtgttacctaaagactaacaggagggaggccacgtggagaaggcaggattcaacagagccttaaaagtgcaagatgctgagaagacgagatcatgcgagcctcaggaagttgagatcatggaaagagatgtctcaacccactgaagcagagggtatgtgaggaaacataaaaatctgagtaaaaacaagggaagtttattccttagtgatgatcccaatggccaaggctcacactgaaaactcttgtcaatgactgcgccccatgggcttatcc

SEQ ID NO: 25651 - DNA, 1782 bp, Bovine  19866880775046
tcttatactgtgtcatctctaaggataaagtaaagtaggagactcttgccgtagtcttatctccaacttaaagatcaatagcttccctatttaaagaacccctggccagtctgacatgtgaagagcttggaagtcatcactcctattctcacagaaagaaaataccttgaacaaactgaaaatcaataagtgttagatatatcagggaactgagtttacaggaaaaactgcaaccccaaaaacgcaagaactgcaaccctggagagacaggaaaatacagagaattatagtttactagctggagccttgtgctccagtgttcttgcctggaaaatcccagggacggtggagcctgatgggctgccatctatggggtcacacagaatcggacacgactgaagcaacttagcagcagcagctggagccttgtagaaagggccactgactaattagtatcctcactggatactgggcctgggttagtttaggagataaatgtgcctggaggggcccctaaatttttgagttttatgtctagaagcctcaccaggttcttagggtgaatatgggagaaaaatcccttcatacatccagaagaagggggaaagtaaccattttaaaagagtgctttgttctctttaacaaaagcctgcttttaaggaaagctattttaccagagcttaaccaactctgttttaccggagcctaactgacctgggagaagggcaagacccaatgccaactcctcttcctgtctcagttaaggaggagggggaagaagactgagaaatacttgtgaaggtcatagctcagagatgcaggccaaaacaatgaagacctgattatagattgacatgcttatcctcccccaatagttttcaccatagcaaagaggctcctgtatggtacaataacatagatttacagctaaaagaacttcagggctcagagcctaaagaaagagtctctagggaaatccaatgacaacaaaggagacaaaaacaaagacactcaggaaattttagggtcagctgaaactccagtacgttggccacctcatgcgaaaagttgactcattggaaaagactctggtgctgggagggattggggtcaggaggagaaggggacgacagaggatgagatggctggatggcatcaccgacttgatggacgtgagtttgagtgaactctgggagttggtgatggacagggaggtttggtgtgctgtgattcatggggtcacaaagagtcggacacaactgagcgactgaactgaactgaacatctcagctatagcaaactgccaagtataggctaaatcctagcccaataaacattaaatctcacagtaaaggatcatttacctcagttcttttacccaatgattcatgtgtgggttttaacaaaaacaccataaaagcaaagctttttgcttttatgctaaaaagcaaaaaaacacagcttgaagagacagaataagcatcagaactagactcagatatgccagagattttagaattatcaaattgggaattggaaggaatgatgctaaagctgaaactccagtactttggccacctcatgcgaagagttgactcattggaaaagactctgatgctgggagggattgggggcaggaggaaaaggggacgacagaggatgagctggctggatggcatcgctgacttgatggacgtgagtctcagtgaactccgggagttggtgatggacaggaaggcctggcgtgctgcgattcatggggtcgcaaagagtcggacacga

SEQ ID NO: 25652 - DNA, 1819 bp, Bovine  19866880787574
gtgatctaacagaggactgtggaaggggaggatcaagtcaaccctctttcaaactcattatagtcccctaaagtattaatgaagcttcccaggtggtgctagtgataaagaacccacctgccaatgcaggagacataagaaagcaggttctatcccggggtcaggaagactacctggaggagggcatggcaactcactccagtattcttgcctacagaattcccatggacagaggagcctggtgggctacagttcatggggtcgcagagagttggacaagactgaagcaacttagcacacacacatgcacaaagcattaatgacctttttgcttaatactgatactgggaaaattttagttcattgacctaacaaataattacagttctttggcaagattttgttcatggaaactggcagtgtttccaaacactttaatgatgtttattgtcttaaccagcacctgtcctttaccctgtctgcatacttccaaaaaagttaactaaaagagagaatgattcatttcataccctgaggtttccttatgaccacagctgtggccacttctgtgtccagcaaagtatttctttggcaagtgaccttgggaggggtggaaagtggagtggaagaggcctctggaagtctttaacacaggggcgtattctctcctatttgactccaagaaattcccactcatggaatcttgcctatcataaacaacctttcttttttgtacttgattcaacttaataaatcatgtcaaccaactgtggtgaatgatgactgttctttacccaacagaacaatacccttcctagttggaaggacagaaatctatcagttccaatttcctcctgctgggcagagtcttctatctcaactgtctaattcttctttataactcctccactacaataagttcttttctctgatccctaggacaccccggcatgtgttcttctcactgactttgctggtcttaattctgaaatgatatctcttttagatatagaaagatgagaatcgtcatctaagaggcaaattctcaataaggatttctttttaaaacatttatgttaaaaaatcatgcccaaaccagccagatttagaaaattcagaagctcttctactttgtttttaaatgtagacatcaaaagatacatctgtcccactaaataaatggtaactggtacattaaatggtatgggaatggaaaatattccttttattggtaccaacaatagttagtacgcctatcctcccaattgtattacaaatggtcaaattttcatgtaatatctgatatttgacataactgaacctttcctaaataattatgctgcttccaaagctcacaactttttttctaaaccaagcttcttttggaatctgtctccacacggagatgttcttccctattttattctaataacatttttgtgcttatttttatagctgctagacacacctaccatcatctccaatatcaccacagagtcagacacgaccgtagtgacttagcagcagcagcagcagcaactaaactgtggtaactgcaatctgtatattattgtaaccatgtaaagcaaggatgacccgactgtaactaggataactttctggcttttctttttatccatagtgtcgctaatccatctgacattccttggtctaaatttccctctaggattgatattgccttattcatcatttaaccacttgctgctgctgctaagtcgcttcagttgtgtccgactctgtgcgaccctatagatggcagcctaccaggctcccccgtccctgggattctccaggcaag

SEQ ID NO: 25653 - DNA, 3122 bp, Bovine  19866880798836
tgaaaactgagattgttgacaggaaagaaagctttcaagaatcataactgggtcattcactttggcagcaaatactccaatacagtattaagaatatgaaaatatcaccatggtataacaatgcacagtaataagtttattattttaggactagcagttgtgccctaggagggtggggactgtatttttcatttcattgtatttttactgcctgacctatggttgtggtctaatttttatactctaacataaagtagggacatatgtgttataatgaaaagcaatgtctattcaaatagactctttttcattttttttcttagacattttcatatttaaagagtaaattctttttctatcatggaatcttgactgtctagaatggcatttctcatcagctctgggtagctaacacatgagtggatttctaaatgtgggtggggcttccatcttcttttagatgtaagagagttaggtgaacctataagtgtggtaagaaatcccagcttcctagtaagggctgtatccatttctgcttttagccttggcaaagcctttttgaatgattggctgtataggaaagttgcattacagggcctatgggaaaaattgcatacattagggccttcacaggaggagaaggggatgacagaggatgagatggttggatggtaacaccaactcaatgggcatgagtttgagcaaactccagaaaatagtgaaggacagagaaacctggcatgctgtagtccatggagtcacagagttggacatgactgagcaactgaacaacagcaaagggccttaggctgtggagtcaggctggtaaatttgaaccccagctctgactttgttggctctgaaaataacatcagtatgcttgtttcccggtcatgacaatggtgtctacctagaagggctgttgtttcaatgaaataaatgtatgtcaagacattaccatatatatccagtgctttccaaagcacctgttacaggatacatgtcatcatcacggggtagagtagctatggtaatcatgagtctcatgatgagtatattacagtgaaaatacgcattattttggatattagtttaatagcatgaagaggtgagacatatttgatggtcacatgtacacgttgcctcccagcagtgggaagagaggctgcaggaacagcagaggacagcccaggacaagaagcgaacagcagggcgcaccagtcgcagtaacgccccgaagcccaaggggaagccacctgctcccaaaccagccagccccaagaagaacatcaaagctaggagtgctccaaagagcacaaacccaaaacaagcgtgagctaactgctttctgaaatggggacttcctctcagagtgaggccaggcatcacccagacagcctgttagaaggccgcacacccctcgccttaacaaccacagtcctcttcatagacacatcttgcagcatttttcttaatgatatgcttcaatttttctttttaagtcactacaaaccatagtggtaggtatgccctttggtatgcaaggtataagaaagctggtcaaataagcttatcgtattgacagtaaactgtgtgcagactctgtgagagctccacaagggcaaagatgcttttgttcttacaatttgacctgatatgtgcattgaaaaataaatgccatattacaaacaaaacacccaatttttttttttttacaatatgttttattttatttggtggttaggatgtgagcagtttttcaaaatgtgattgaaaatataatgcttctaaagaggaaagcaagaggagtgaatgtttcaaagatctttactgtttgcagaagaatttttgtgatcaaaggggatttttgaacaatctagaaaagtaggatgtggaaaatcagaatcagtctggttttatggtttttgtttttacaaagaagcctttctgctctgttttcagctagaaaccctaaaactaaaacaatagtattgctaaatgaataaaagggaaaggcagacagacaaagtctggacccttgttttctggttaccatgccacagtggagatgctctgatttcatatgcatgtttcttacagcccctttaagcagcactggaaacactttgtatcttctctatgatttgggtaccaattagtcatccccaagcatcttacacctgtgggtgtgatgctcacctcacttcccaggacatcccaggtatcttgacgcccagcctctctgctgattgctggtgcccccaagggtgccttgggcctgaggtaggagggtcaggatccagagcccctggtcttcagcctgctgtggcacccttgccacacaccagctccgtacttggaaaagacagtggcagtcacttgtccatccactactcaaggatatagaagaacaaactgcaagcttaagagtaaaatctcctttagatgtaccattgttgctgcttctcagagtaggggtaagttacatgttgcattcacacacaatgattaaacagataatttaatttcatctctgtaggctttgggacacagaggtgaggtgtgtgggtaagccagggcagagtgaagaaatagcgttaatgagagtgctggcatgggcacccatctcctcctgaaagtgtaacttcatctgtatcctgttaccccacggcaatagagctgaaggaatccaatataaacacccacacagaggtatcaataaaatactccatgtgtgtttctgtctaaaaaacaaaccactctggcccttaaggaaaaccagacaggtatttaggatagcatctaaagaaatctaggaaagtccatgaaaagccattgataccctagattacctccttagcatagtaggaatttggagggtggggaggggagttagaactctcaacggaaatgaaaaaactccctgcaaaacttttttttaagtgcaaaatgacgtaacgagagtttggaaatggcttgacaactttaaacactgtttcctttgaatatttaactgaaatcatatactgcatatcacaacttaataaggtgcattaattactttaattgataatcactgtttgttataaaaaagttgaaaatgaacatcagcccacactgag

SEQ ID NO: 25654 - DNA, 1109 bp, Bovine  19866880815195
ggttctgtgtagtatgactcttaaatgaatctttagaaggaggctcctaaaaatccttatattgtctaaagagccatctcattagatccaaccaatcctatctcttcttttccaagaagaggctgctgagcctagcagatctctcagattaagacaacttcaaatttctagtggaggaaccatcagaattccatagtataccttattaccaatagccagttagtgtcatggagcacttagtatgtgccaggcttctagactgtctctgcactggcatctcatttaaccttcacaacaaccctgcaaccttactactattactatttccattactaagttcacaagaagtggggtcaaattttatattgacatacttattttttttctttttttcttttattttttaacattatgctattccagtgaccagaagttccatatttttaaaatttgcaatgttctcaactgatgaattttaccagtaagtcaatttcttacctgggtgaatccattaaatgaacctccagaagcctaaacagaaatggaaatcagagtatgttatttttttcattacttctgtaggattgataaatgtctattagacaattgggaaactgaagaccaccacaaattttaaaataatacaaaaggtcgctgtgcattcaaatgcttaggaaatggaaaaggccatactgtattattttaaataggttgacaaaaaagggaaagattagttttataattattgctggtatgtggctaaccaaagcctactttcctgataatgagaacatgattccatacaagagccatgagggtttaaatagttctttttttagccattgatagactccagaagcacatccagtacttttctctaaatacatcactttaatgaacagctattatgagattttatagtttcaatggaccttggtagaaacatttcatgtgcttttattggggtgtaaccactttgggaacagtaaattagtctgttttttctatatatcttaatgcttgaacaataaaactgaaagtagaaagaataaacacaataaatgggatggtaaaatagactctcatcaattcccaacacaatcattctg

SEQ ID NO: 25655 - DNA, 1418 bp, Bovine  19866880818968
cttaatgactaaataacaataatcaacaggaataaaatttcagttagacaagacaaataaattctaccgatctgctgtataacactgtacctgtggtcaacaatactggattatatactttaaaatttgctaagaagggagatctcacattgtgtttttaccataataaagtattttttttaatgtttaaatgaggtaagcttctcttttctgaccccaggatcatatctgttctgtaaaactaggatagtatgatgaagcccaatgtatagctctgattgctaaatgtcctgtccccactctggaaatatgtcctaaatgtccagtctccatacatcataggaattcttcttcagactgctgtattcttctgggtgtaataactctgcaactgctacttgtagcacctcaattatacccactagtcatgtcacaggttgtctcacctaaatttgaccacttttatcagctcaccttgtttatgggtgtattaaatatatttcctatggggttggaacagaggtttcttattccttatttcataaatgtcaattataacagttagtcattaaaattttaattatactgataagagagccaaatcacaggaagagatgagcctaggttactgtaaatgtaacagatgccaaagaaggtcagtctacacaacttaagacagtaagctaagccagcgtcttgggtctgaggacgcactctggtttctcacttcccttctaggtcttaagttctagtccaagtccagtgaaagccctagtaaggttcttgttgttttgtaccattgtcacagcgaaaatatcacaaggagggcttcagaacttgaacagagggcaaggtggattaaaccttacccatgggatcaagttcctccttaacatctgaatggtttcctcaaaggacctcacaggcactgaaatgtaggcagctttgagagaagagagagagagagagagaatgtctttctatcttggtctcaacaaaagttgttggtgctctgcacggataagaaccaggattttccaaagttttcctgggtctgtttccccatggctaaggatgcaggccacacactctgcctgtgaagtagccgagggtagacagacgatggcaaatggtttatctccctccacctgcggttctggcccacctccttcccacctccttagcacacttgcatgtgaccaaaggaaatatgtgttatgcaccaggttttctcagtttaaacaaggcactttccaatttggcccaaatagatgtgtatagtatatacttagatcctctttttgccttctcgcctaaaggagaattagaaaccatataaatagagcactaatttgtcaccttaagaaagacattaaaatccaaagaaaataaaaaagctaccatttctattctattgt

SEQ ID NO: 25656 - DNA, 793 bp, Bovine  19866880941478
tatgaggatgaaatccaaaaagcacacagacatggagaatgaatttctcatcatcaagaaggatgtggatgaagcttacatgaacaaggtagagctagagtcccgcctggaagggctgactgatgagatcaacttctaccaggcaactgtatgaagaggagatccatgagatgcagtctcatatttctgacacgtctgtggtcctgtccatggacaacaacagcaaacctggacctagatggcatcatcgctgaggtcaaggcccagtatgaggagatcgccaaccgcagccgggctgaggccgagaccatgtaccaaatcaagtatgaggagctgcagacactggctgggaagcacggggatgaccttcatcgcacgaagacggagattcctgagatgaaccggaacatcaaccgtctccaggctgagatcgagggtctcaaaggccagagggcttccctggaggctgccatcgctgacgctgagcagcgtggtgagatggctgttaaggatgctcaggccaagctggccgagctggaggccgctctgaggaatgccaagcaggacatggcgcagcagctgcgcgagtaccaggagctcatgaatgacaagctggctctggacgtggagattgccacctacaggaagctgctggaaggcgaggagagccggctggagtctgggatgcagaacatgagtatccacaccaagaccaccagtggctacgcaggtggactgacttcgtcctacgggacccctggcttcaaatacagcctgagccccggctccttca

SEQ ID NO: 25657 - DNA, 1995 bp, Bovine  19866881035542
cacacctagtaatttaccctgctctggtttgtggcttccttggcctctacttcctctgcttgatctcgcctaattccccagagtcctgcagaagtacttgggggccagagtcccagctaaatggttcacttggctctgtcttctgggcatgcgcctctatggatccttgacaagagaaggaagtaaaatctggatattcatggattttgcccaaagtaacaacacatgattttaatctcaaaattgtccccaatgttctccagatatctgccagattccatagttttctctcctgcatgcaaacagcgccaaatccttggtcctagattccctaactaaattccacataaaccaacctccttctgctaaaccactttgtcttcagacaaaatgagaacatgctagtgttctttcatatcagcccagtttccacagcatgttaatgaaatagcattccaatggcaatcttgctttaataggacttcatgatttctccggtttttcagccctgaatatgcagaccttctttttccatggcttaaatctaaataactcttttatccattcattatgtatttattggtcctatgtttccaatcaccttatttctgagtttggaagcaattaagtttagcctatttgtatctgacttcattaagtaaatttgctactaacattcttctagagatatatgctatgctatgctatgctatgctatgctaagtcgcttcagtcgtgtccgactctgtgcgaccccatagacggcagcccaccaggctccgtcgtccctagagatatagggatctatctaaatagaaaaattattagtttatttttgaacaaactggtcataccaaatggttatatagggcaagaacctagggaaatttttatctgcattctaggagcacccgctgcaaatactttttttttaaatctatcattcttatattattggaactaactgaatcacctaaagacttgtttccccatcttcctaacctttaatccaggaaatgcaaagttctcatgacagaactagaaagataaggggtttagaaagagtaaaatagactcatgagttttagaattgtatgataatccatttttaaataagaactatctacatattaatataatttccacacaatgttaaactaagaagtgtcctccaaagtttaattgctacacacttgaatacaccaaaatactgaactttagttgtcctgacaaaataaaagtcattttgaattttttgaactgaaaaagcagagacagtactccccaaattagtagactctctcattcaggctgttttcctttatcattaaatgacaacatctactatgaggtcgacagatccacagacatggaaataattctgaatttctgacagaagagaccagtggttagtggcttaggaaagaacattcagtttggaaatgctgtattttaggatgacttaatagagagacatttgaaatgaaaatctctaaggtgctgctccagtatggcttgaactgttctcatgtttatttatctatggggataccagaccacctgacctgcctcttgagaaacctatatgcaggtcaggaagcaacagttagaactggacatggaacaacagactggttccaaataggaaaaggagtccgtcaaggctgtatattgtcaccctgcttatttaacttctatgcagagtacatcatgagaaactctgtgcttggaagaagcacaaactggaatcaagattgccgggagaaatatcaataacctcagatatgcagatgacaccacccttatggcaggaaagtgaagaggaactcaaaagcctcttgatgaaagtgaaagtggagagtgaaaaaagttggcttaaagctcaacattcagaaaacgaagatcatggtatctggtcccattacttcatgggaaatagatggggaaacagtggaaacatttgtcagacttttctttttttaggctccaaaatca

SEQ ID NO: 25658 - DNA, 858 bp, Bovine  19866881043112
aattctggaatttctctggtctttgactgcaaattctgctttcagatcttaatggttgtcctaattattatcagaagggaggtatttacctaatggtagtcacacaaatctctagtgataaggaatctgcctgccaatgcagaagatgcaagagactcggtttctatccctggttgaggaagatgccctggagtaggaaatggcaacccactccagtattcttgcctggaaaattccatggacagaggagcctggcagactacagtccatgacgtcacaaataaatggacatgactgaatgtgcacacaacacacacacacacacattcacacaaaggattgaagacagtagtttgatttctagcagtcatttgtctacagaaattcaggttcacttcgatctccagctaccctggacaaggaaagtgttttggcagtcaagaagagaatctgtgaccgtgtctctctcttagcgcttatgcttccctgttggcagaatcgtatcgccaagcgcagccggaagctggtggactacgacagtgcccgccatcatctggaagctttgcagagttccaagaggaaggatgagagtcgcatctctaaggtaggggccaattccactgttgtcaccagtctctgtactctatgacctgtagcaactttgcttttgaaatgaaatctctcttttctcatggagattggaatcaggacggaatttaaaaattgaaatatgggtcttgctggatgctgtctataattttgtaagttacactaagggttttcaggtccttggtagaattcacttgggtggcactgactcacacattttcatcataataaatgtttacccctagcagt

SEQ ID NO: 25659 - DNA, 913 bp, Bovine  19866881089773
tgtttgaaataaaaagaaagagaaaagttcacctaaactttgtcagccttggtttcatcatccaaaatattaaggtcataatatagtattttggggttgttatatggtttaaatcaaacaacatatatggaagtacctaacaatttaggacactataaacacacaaaaagagattccactgttgaagatcttagtttattaggaagtaagaataattgtatgtcttttatgagtgttctattcatcaaacaaagccatctaacttcaatcttgctttactcaaactgtagtccagaaacgagtcttaacatcaaattgatgttcttatgcacgagccagattgcagatcaacagaaatcagagtaacttggctactgtacatttattatggtccatggtgttaggtttttaagatttggatttttttatatatcacttggagtagaattttgtgattaaagatggggtgaggctagagcacacagacttacttgcattctacataatgaatgtatttcttgccattggaaaatgcctctcaccaactttcattgcagcctagcacgttacgtgccaggcctgaagggagtgtgtacccatgccccttgcattggcaggcagattcctatccactgctccaccagggacgtcctccccttagttagagaactataaatgtgatttggcctatttttcagtcctcaaaagaattgcactgaaatgctgagctcctgtaataaaatcatcattgctaaaaatatttaagaaaggaagctatttttggtgtggaattctgttttctgtctatagattaatttttctgcatttctatggattatttctacaaagtacttttctcagctttgtctcatttaatctccctcaacaatccttagagttctggctctgccat

SEQ ID NO: 25660 - DNA, 1251 bp, Bovine  19866881114919
gggccatgcccatgcagatcctagcccaggggtgtctgctctgacggcactgctggtccccaccaccagtgtgtgcatgtgtactcggtcacttcagttgtgtccatctctttgtgaccctatggactgtagcccagcagggtcctctgtccacgggattccacaggcaagaatactagaatgggttaccatgccctcctccaggagatcttcccgacccaaggatagaatccgagtctcctgcatctcctgcactgcaggtgtattctttactactgagccacgggggaagccccaccccccacatacacaaccagagaacgacctaaaaaatttcaaggaaggtgctcagaagtgcagggaccccttgagaggcagggctaggggagcagggttccttcttgcttattttcctgtcaattggcagtgaggaagaaaagatggcttgtttgaggatttttttcacagcagataccccaactatttggcctaaatctattctcagcgtattttctctctttgatatagctttcccatttacaaatccagaaggattatcttctgaacattctagcttattcctccaagccctcctgtcaccctgctgtgctaaaaagcaagacatcagcacaggctttaagttgtgtgactgttgggatcaagtcagtgctatgtatttatttatttacgtaaggctgcatcttacattttaagttcatgaaatcttcctatcttgcctagtaaatcaaatcaaaataaaattttcagcttgcaaaatacattcacaagatggctctttttcacctgtctgatggggccagcctgaaattatttacatgtgcgccactcacttcctgggtatctgtaacctgcttttaaataccacgctggctattcagttcaatatagcaaatttctggaccagctgcttcttctttcagtggctatttatttcaaagtaaacacattaacattctttgaggacaaggaatgaataagatgaaaattggaggaaaaaatcggtgcctttcaacaccagagtcagtcagtatgggttgaagtttatttctttacatatggcggtacagtagttgaagaatctagctttattctacttaattgcctttgtacctttgtggaaaatgagttgtccatctgtgtatggttctgtctctgggctctgtggttttcctttgatccttttacctacctttgtgctaggaccgcactatcttgatgactgcctcttta

SEQ ID NO: 25661 - DNA, 960 bp, Bovine  19866881124026
ggaaaaaaatcaatcctcattacctttttgtgaaaaaatcttttggtgatgattaagaactttcgaaattgtggaagcagctactcaattgaaactattttattacaatagtgagaaactgatcaacaaagcaagtaacacaggcgtatttaatggataacaccacctacgaaacacagcatatccaggcaacaggctgtagttaaagcaacaaaaatttcgttataacgaactaactcagaatcttctgtctctgagtaatgttgaatgaagtgtatccggaaggcatgatggggtataaaacaaaccactattatgaggaggaagaagaagctcttgatttgagctctgtactcttgatgggtccacatgtctggccaaagagcctttaccagttgaacaatgacccacatctgtatcagaaagagggtcacaactgttgtcatcataatgacaatcatagagtagttcaagataataaactccttgcgtttgaggtctttgtagaactcaaaacactgttgttctgagtaacttggattggtgccatattgtaaaaaaaatattggcaaaaaaattgcactgcccaccagccaaataataatgcttaaaaccaccacatggtacttttggaactgagtttggagtttcttaaaatacacgagcaatcgacttatgatgatggccacatagaaaacaaaggtgaaatacatatgaccatatattatgccgctaaccaatcggcaggtgaaggatccaaactcccagacaactaagacataatagctgaggcggaagggaaggctgaacaggaggatggagtgtagcacgatgatattgagaacaatcgtggcgacgattgattggctgttccttttgagcatcatataagacatcgcaatggcccctgcagcgcctcccagcaaaaccacactgtacagtatatagaatcactctgca

SEQ ID NO: 25662 - DNA, 1157 bp, Bovine  19866881388902
tgtgtgcttatatacacatatatgtttacacacacacacatatatatgtatatacatgattgtgttattttggtcttgatcctcctgttaaaatcatatttttttttgccacaatttggtttcaagggacataataccttttcaatcttccttttaaaaatgtttaccaaatatccacttccttagagtatctggttgggggagaatgagagattacttgagaaactctgatttaaagaaagtaaatagggattttgtcacggaagttctcagagcctgaacatttttgctttttcactgtgaaaaagcaaaaggagatgcagccctccaagcctccaatgaccaaggggatctcaggggactagatggaaaatgccgttttcaaagaataatgcaggtgtgcgcagactcacacacacacacacaaaggatgtcttttttaacttaagtcactaggagttaaaaatagggagaggtgggtatgtcctgtggcaggtccatttctgtaaacacagaaccaaaaaaaccaaaatcagccttgtggtctagacaagcaggcaagtccctgtacacaaatatggctatttccagggaagattttaggaaatatacatatttccagaatccacatgctacagttaaggtttaggccattagagggctctgtagacctgatggatttctgtttccaaccccaggacacactcaagagagaattatcactctgatgaagcagggtgtatgaaatacatccattagagacaagggatgtttcattcattacatcttgaacttctgggtgggattcatacaaatgcttttcctccccattaagcaaatgataaaaatagcaaactgaggacgcaaacctatttgttaaatctaaaatgacttattaaacatttaaaaatattaaaataaaacatatatataaatatatatagtatatatatgaaggaatatatatactatatatatatatatattaaatatatgtatataaaggaaatggtaacccactcaagtagtcttgcctgggaaatcccatggatggaggagcctggtaggctaaggtccttgggatcgcatacagttggacacaactaagcgactaacacacacacacacacacacacacaatgaatcactttgctgta

SEQ ID NO: 25663 - DNA, 1109 bp, Bovine  19866881913193
tctaattctgatgccccaccatggatattctagattcctcctgttcattttttgtaactcccttttcagaccatgagaaaactggctccctttattcaattgcagtaggtatcaggcataactatgctacccgctccctacttgaatgtcttcctgttgggctctgcactccaggccaggccatgcagagacctaccttgcttgaccctgcttaatggctctagactaaactatttaatgaggggaagggaaggtcaggttacattttttcgtatgtttttctttgggatttcttggggctaacatcgttgtaaattctcagaatgtgtctgtgtgctgggggaagtaaattagtatgaaatattcaacaaatttatttgatcctgaaccctgttttgcacgggttgggctttcatttgaggaactcatttcagaatttcaggagaattactcttttgcccttactccctcttccttgatctctgaaggctggagccagtattttcttttattagctcaggaagtctaactgcttgtggcattttgatcctcgaaaaataaaccatgctggatctgtaatactgagtttttctttatgaaagcgattttcttggaagcacgtaaagtttgctttaagaatcttaattctgtgggtctgttgaccctgaatttcagaggattgatgctgggatgtggaaaaaatgggatgcagggatgaggaaaaataaattccaaggaagataagcccaggagattaaaggcactggtggaataggaggctaatttataaatagaagccagaggtggtcgccatactgctttggaaatatctttatttctctccattaaccttgaactgtttcttcctgattctgacctcaaagatggtggtcaagggcaaagtgcccaaagatctgaaaatattccaccaattagtggtttgtttttcctggaataaatgtgataggcttatatttccccaattccagtaaaaagtcttctattttccccctttagtaatttattttattttacccagctttcaagaaaaaacatcttctcttgatcttcttactaactgaaactgcattctctccatctatttaaag

SEQ ID NO: 25664 - DNA, 1328 bp, Bovine  19866880536874
aagagatgggggtctttatcttgacagttggttttctttgccaggctcacccagtaacaatctgggaacaggcactaagcacactgtttcactggcagggttgttatgtccactgaagatccgaagggctgcacccctgcacaagaactttcttgcatggggttgtgtgtgtgtttagggtgtgggaacaccaacactatatgttgtgggaattgccaggaatatctcatatagtccaacctagcaaatatccaatagatttttttttttccattggttctcctgtttgttgtgacgctcatgttcatgaagtctaaagtcaggtttatattttaagttgttaaaaatttttgtcaattgatttgtgttaactcccttttacctctcacctgtccctgcacttagggagtaacaagaacagtgccaggcttattgctgtgtgttaaagaatttactgatttgttttactacaagatctatgatatgcgtccttccgtcacaaacaatagaaacccgcagctccactgagggatgaaagtattcagaagtttctctgtaaagaaacacaatcagctttccagcaaggatagtttccttttcatctagaaatttacatatttatacaaaacctgcagacatttttatctttgcagacattatctctcttttgactccatccaggtttccggtgagatagtccctaataaagtagggaaattagacttttatatgcacttcttgctgtaagtgtgaaaatgcattaaaaggagtggtttgttgtcctcagtaatctcatttggctccagcataattctttgagataatacccttgctagctggttgtattccatgtgtgtatagaccatattatgtttccctaatctaaattatgcaaagaaccagacccttactttccaccatattgtatagacacttatttttactaaattgacatcaacatttcatcatctttgaagtcttgattctgttttcagcttaaaatttttccctcaggttttaaagtctacttcttcctaaaacattttttgaacttgatcatatttacatattatatggctaattctggagaaggaaatggcaacccactccagtattcttgcctggaaaatcccatggatggaggagcctggtaggctacagtccatgggatcgcaaagagtcatacatgactgaatgactttctttctttcttttatggctaattttgctgcacattattttattcttccttctccaacattctctcatcattgttacactttattttttttaacttgattctcacagtagttcagggggttcagaca

SEQ ID NO: 25665 - DNA, 3169 bp, Bovine  19866880544870
ggatgatccataatggaaaagaatgttttaaaaagagaatgtaggctatttcgtggacgtcaggtgtgcgggcgcatctgggaacgcgggcgggaggggaccgggaagacctagcctaagttctgtggatttgaacctccgcatttctaacctaagatctcaaaacgcatcgtgattcctgtcgattggactgtaaattttatgtagataatcttggaaacaatggtaacaagactgaattggaacgagcttttggctattatggaccactccgaagtgtgtgggttgctagaaaccgtcctggctttgcttttgttgaatctgaagacccccccagatgcagctgatgctgtcccagagctagacgggagagaacactgtgtggctgccgagaagggtggaactatccaacggtgaaaagggaagtcgaaatcgtggcgcacctccttcttggggtcgtggcccttgagatgattatcggaggaggagtcctccacctccacgcagatctccaagactgagaagcttctcccgcaggcggagcaggtccctttctagagataggagaagagaaagaacactgtcccgggagagaagtcacaagccatgctgatctttctctaggtctcacagcagatctaggtcaaatgaaaggaaatagaagatcagtttgcaagaggagtggtgtacaggaaataacttcatttgacaggagtatgtacagaaaattcaagttttgtttgagactgcataagcttggtgcattttaaaaatgttttagccgttcacatttgtttgtctgttggaacagtgacacacaaggtgtagttctctatggtttgaaatgggtcatatgaggcatgtaatatcacaaattgttactttaaaatgttcccttaaacaaaatttaatttgctttgaattttagtcttgcataggctgataataaacctctaactcctgcccaggtaaagtcgatgtttaacattatggaaacaaaaactggcaaaaattggaagatttttttcaacatagctgggatatggtatgcagctgtagttaagcggtttttaaaagctgctgtgaactcaaaagctggagaaattaaagctgcacccttaaactggattagaggtttaaaaattccactagtcttcacactggacaaaaggttgtccagttggtgtagaatctaagaagtttcaaggaagttagtttacctttgctttaggttgtaagttccttctgtgattgctgtataagaatacatagctctttgtagcattctttatttggacatttgagactactcaaaataccatatgtcctgccagtttaagggtgcattgtagagctgaactgagttacagtgcaagattcttttttcatgctgtcatttgtaataagttttgtgagaatccttgggattaaagttttggttacaaaaaaaaaaaagaaagagagagaatgtatatatgtgtaaaactgagtcactctactgagttttgctcaatgctgcaaatcaactatgtgtcaacaaaaaagggaaaaaaaataaggtggttccactgtgaacctgtaagattaacagagaagaaaagtctggcaataccaagaatgtcaagcacataggaaaacaaactctcaagtacagctggtgggagtataactttgtataatcattttggagagcatctggcaatgtttagtataattaaagaggcacatacactgcttcccaggaatttcacttctagatatatactctgaagaaattatcaccaatgtgtacaaggaaacatgttcaggatgtatacaagattattttctgtaatagcaaaaaaaattgtactaaatgtagaagaaatgaatgaataatatatgtgtatatatgtgtgtataataaaatatatatcatctttaaacacaaataaaacactaaaaaataaatcaagggatttccctaatgatccagtgattaagaatctgccttccaatgcaggagacacaggtttgatccctggtccgagagttaagagcccacatacttcgaggcaactaagtctgactgctggaaatagaagcctgcaccccaaagaaaggtcctacatgccacaactaagacctgatgcagataaataaataaatgttaaaaataaagtaaaagctagaaatgattaagtgtagtatggaaggaacgtagaaagccaagacaggccaaaagtgaagcctcttgcattgaccacttagccacgctgtgaatgcaaaggaaaagttcttgaaggaaattagtcatgtgtgtgtgtgtgtgtgttttccttcactcttttagagaggtgtctgggcatgcctctgtgatacgttacttcagtcgtgtctgactctttacaacccctacagaccatagcccgccaggctcttctgtccatcggattctccaggcaagaatgctggagtgagttactatgtcctcctccagggaatcttcctgatccaagaatgaaacctgcgtcttatctgtctcctgcattggcaggtgggttctttaccactagcaccagctgggaagcccgatgtggtgtattacattgattaattattaattgattttcgtacgttgaactatccttacattctaggaataaatcccacttggtcatcgtgtttaatctttatcgtatgctgctgaattctatttgcttgtatcttattgaggatttttgcatcaatactcatcaaggacattgatctgtagtttcctttcatgctggtctttggctttggtaattctgacctcctatattgagtcagaaagtgttccatcctcttcactttcttggaagattttgagaaggagtggtattagttcatctttaaatgtttggtagtgaagccatggtccagggcttgctttgtcagatttttgattactgattcaatctcatcactagttagttctcaagtttcaaccttggttttgtgttttgtgttttgtgtttctaaataaatagagtttatccatttcagctaagtaatctaatttgttgatctataattgttcatagcactctcataatctttttattcctatataattggtaataatgatcccatttttatttatattgggttatgtattctctgtctctttttttcctttgtcaaccta

SEQ ID NO: 25666 - DNA, 2592 bp, Bovine  19866880560678
gctccaaaatcactgtggacagtgggcgcagccgtgacaataaaagacttgcttcttggaagaaaaactatgacaacctagatagcatattaaaaagcagagacatcactttgccaaaaattgtccatataatcaaagctatggtttttccagtagtcatgtacagatgtaagatgtgaacactaaaaaaggctgagcactgaagttttgatgccctggaactgtggtgctggagaagactcttgagagtcccttggacagcaaggatatcaagccagtcaattctaaaagaaatcaaccccgtatgttcattggaaaggctgattctgaagctccaatgctttggccacctgatgtgaaaagccaactcattggaaaagaccctgatgctgggaaagattgaagacaggaggagaagggggcgacagaagatgagatggttggatggcatcactgactcaatggatatgagttcgagcaaactctgggaaatagtgaagggcagggaagtctggtgtgctgcagtctatagggtcacaaagagtaggacaccactgcataactgaacaacaaccctctactgcccccccaaggaaaacatttagcagcaaacataaataccaaaatcctgagtcagttgaacctgactctgagggaccccatgaaacacagccctccaagctcctctgttcatgggattctctaggcaagaatgatggagtaggttgccctcctccatgggatcttcccaacccaggggtcaaaccagtgtctcttatgtctcttgcattggcagacaggttctttaccactatgggccacctgggaagccaaaatgtcttattacatactattattttttaacctgtgtcttacgaggtaatagataatgaaattacagtatatctactcccagtcaacataactccttggaaagactgtttatgcgccctgtgtaaaagttagtccattgtttcaatgttttaagaaactatagtcacagaaagagtattgcctggtaaatgtttatttaaaatatgcccccaaactgggctggaactctgaaatgttagatttccttcagaaatgtttacccagattcacaaatctttcagactgtggctgtacagaattgctgagtcaattcatttcttcagacgggcttctctgatacctttttattctgttccaacaaaaatgttttcaatagcaaggaaatttttccctgagagaccatttctacacactgaaaagtttatttcaataattctgcctttttggaactaaataaactttgaaactgaagaagaaaaagagtaacttaaacacttgtgtagctttaactgcatatcatcaatttcctttctaaacagttacctttgtggggtctcccacactatcaactctcaccactataaaaggctgataacagcacagtaattaaaatacagctgagaaaagaagatatttaaactaatttgcatctctgctggagttgtgtgatttccagtgtacacttactgctttgagatgttgggaggaatatagtacaggttttcaaatcaaacaggcagattcaaatcctagctctgacggtcattagccatgtgcccttgggatgttcatttccagtagtcttgagcaaactggaggggggaatggcaacccacttcagtattcttgcctggagaatcccatggacagaggagcctggtgggctacagtccatggggtcacaaggagtcggacatgactgaacaactaacagtgtgcaaataagggtaaggaatacctatatactagctagtattgttgtgaaagttaaattagatctttaaaatatctaatatcctttattagacataaagcttatgtcacatggggacacttaatactgacatttcgtctttccttttgggatgaataactgtggggggtgtgatgaaaggaatcaaaatcactttcaaaatattcatcatatgattttggattcacattcttttttggaaaacaatgttgggtagttcatacagatggttccagggaaggcagggtaccatctatgtctttattttttggtagaaatcatatgactaagaaataaacagcactttcagagagagatttgaaattaaatgaaggatgggtgaatgtcatcacattgcagtatttaattttttaaaaatttcaagagcatgttcgcacacaatgccgctcacatcattatgtgcctgcagtgacatggttatttaaggtggggccagattcactgcagggtgtggcatatagatatcaatacatggcaaacatggcttgagtaattttagcctccaggtttctcagtcatctgacaggctttctgatagaacgctgtgggtgcagggtgttaacaccaaaagctaagaaaaaaaagacaaacataggggtattgcactgttggtctcttaccagtgcatggagcctccacaagtttgagattcattcaacaaatactggttaagtactaatttggtgccagtctctgtatggttactaactagaatacagcagtcaacacaactgatactgttctgacctcatggagcgtgcagt

SEQ ID NO: 25667 - DNA, 1772 bp, Bovine  19866880563067
aatttgtgttcttggttccattattaccaaggtcctcttattagattctagtatccctatgcaacttatattttaactggatcacctacaccttaaagcttagttaatggacttgaaccctaattccactatttgtgcccaattcaaaaaacttcccaagatttccgttaatgactagggattgggaggtggaggtgaaatgtgaaagtggcttaggttttcttggtcatctctgacttctgctgagttaattctgttcattttttcagtttcaaacacggcacttgtgttcatgacaagttctactgacaatttgaagaattcagaatagaatttgcaattttaaaatgggaacaaatttttagtattaaacttctgatcactccacttcaggaattttttccactggccctgttcttcctgtcaatgattcctttctttttctacctcatgtcccccttctcaacttctcctatccagaaaaactcaaattatcaccagaacactgctttgaaattcaacccaaagcccatttttgcatattctgatcatataaggattcaatagaaataaattaatttatagtgtccactttccttaggcagcagctgtagatagcaatttccccccataattcctataattaattaacctttttatttgtgctaggctaatcttaagggttccaaatgcataatgcactggtaaagatcagtaaaatatgcagattagtaaaataccttatttatatgacattctaagtgaaactttactttcaacacattttgttcccctgaaagggaaggccaatctggattagtaaaattactgttttatataatatttttattaaatatctttaccttcaaatatataggccatttccagccaggttaatatatgattggcaaccagaggtctttggggacatgctttcattaacaagcataataaatgttgaagtagatagaagtgacataattaaattgtgtgcttctagaaggctttaaaagagttaggctttttgcagtattattcactaactactcatttagtggataaatctttttttcatagtgaatataaaagtaaaattagtcttaaattatcatattacctaaacaatattggtggagacaagaaaacatatatcctaggtatctaatcattagtgtttctccatgtggattcctcaaacaagtaatatgtttctaatttgaatatttccaaaatctctcttatcttcttttttttaaatactcaaattgcctgattaatatctcctatgtaaaatatcttagcaggattcaatccttttcacagaaatcagaaattaaatatataaaaaggcaaacagcaagcacatacttgaaatcaataagataatgacttaatcagtacaaatgagtgcatttccccttgaggccctttttcttgctatgtgtgtctacctttccctcatagagttgaagaacatctccagcaagggcaacctttgaagtttccaattcctgaatgtattgttacaatcagaaacagatttaaaaactcaaaacaaagaaacagatattttatgagagctctagcagacatgaggactgtggcctgcagatccttcttcaaaagagactcactgctcagctgtgaggagagtagttagctgataacctccagctgttagctccttcaaggtctgccttagcttttagtccaaggtcagacttttacattggctcccagccaaaggctgattaaacctaagtaaaggacta

SEQ ID NO: 25668 - DNA, 2110 bp, Bovine  19866880659302
atctactcagaagcagctgtattaatgcatttataaaatgtagaatattatagaaagacattttgaatctaaaatggtttagtgtttctcaaacttttgaccataagccacagtgagaaatgtattttaaagctggaccagtacacaccagaccctatgcatttgcatgtctctgtaaatggataccaacttatatatttactacatacaagctgtgcaatccggtgtttcctattctgtttttttttaaatgggttgaaatttgcagttagaaaaacattggtatgatatgcagcgtttgttttaatgctgtgactttttgtttacttttcctatttagttttctgtaaaatgcaaagcaatcaaaagttgtttctatacctgcactgtaatacatcatggggcccacacatcaaaaactgtgttgggtctacacagtcaggatcccttggaaggcaaacaaagggattaccatcttcaaaaggcaggtattaaccctcttttaggcacttggagaacaaaggcctaaggttgtggggacttgcctgattagaataggatccactgatgaaagtggagtttaggattcctgaattgagcctcaggtggtgtgagttgtattgattttagtcataaatatacatgaggtctttgcgcattccctaggcttccacagggcctcaagaaatggatttaatccaaaaacaatatgaagagactatttcttttaaatacagagttcaagatccgcagggacagtctatggaaatgactgcttttttttctttaaacaggtatcaaaagtaacactatattacagctgaattgtaacaggaatgcttcgctgtcaaaccaaaagtaagtttcccctgcagatttaactcataacaaacagtacacattctcatcgtgtgtgtgctaagtcacctcagtcgtgtccaactctttgccaccccatggactgtagcccgcaaggctcctctctccatcggattctccagacaagaatactggagtgggtcaccctgccctcaggggatcttccagacccagcaatccaaccctcatctcttatgtctcctgcattggcaggtgggttctttaccactagcgccccctgggaagcattagtctgtgcaactgttatgctgtgaatataattttttaaaaagcaatagaggtaattcaaatgctagtattaagctgaaatcgaatgaatgaaatctaaaaaaaatacaaagcctattttgcttttagtttggtgaaagattagaaatatcattgatttgattttgtatcaagtttgatattattaatacagttcacaaagatatggtaaaatcctgtatttgtgaacttttaaacaggctttagaggactgatgattttaatgacagagttacagaaacataacatgacttactttttttcctcatgctgctgctagggaattgtcaattatgcttccaaatttataaactgaaataaagatttatcatagaataaaaatgcttagctagtttgtaaatagggccttgtatagccaataagttgtgtaccctgtaacattggcaggtgacatttaggaccctggttcacagaattacaagaggggtagggggtcaatgaatctgtcacatgcttgtttgtgccaggcccactgttaggtctgttgtattcaacagcctatacagtatttgtaataaccctatgatgtagcacaaggcatttgatagaagggaacccaggaactgaggtgttgagtacaaaaaagaaacccaacccatggtcacgttgccaataaaaagtgataaattgacatttactccattgtcacactgccccccacaccagcgtgtttagtgtcatccttggggacagcgaaggaaagggaagagtaaggagactggaatattgtaagtcaaagtggatttctttgtgtagtaacattttatcctattgagaattctgacggggagttaccaaaatcagatgggaatgggttgttgtataaagtgacatttatggatgcctttaaaggatgttaaaaacttttttgctccacaaatcccccagaaaggggtctaggtttccatattggaagttggat

SEQ ID NO: 25669 - DNA, 2537 bp, Bovine  19866880738029
ttcactttttagtcatgttgtcaatatgcaaagtataattagtaatacacattccatttactctgcagagatcatatcaccttttgttactgtaatatatcttgtgccctgattaattatttttatttgctcatcctacaatacggttgggactttgaaagcagtcagtctttgtcaaaagaattttgaaaaaagtcaagtatcatactaactgaattggttgcttacaatttaaaaaatatctaggaggactactaagtgtcagaatttgggccaggagttttcacttattttgactaattttaccatcataatacctttcagataattgatgttaattcctgtgaagaaatccaaactcaaaaaggtaattttattaccataataaatgacattatctggatttattggcaaatctttaagtcttgtgtacttgccatgattttataacaattcacaatagattgaaaatataaaatactgcagttataattcaaaatagattgaaaatataaactaattactgcgagctttatatctttagaggagataggtatttaagtttctgagggaaagaacaaaactttttacttgaatgtccttgaaagagaataatagggaaaaaacttgttctataatctaatgaatattttatagatgaaaacctttacattttgcagaatatgaatcaagccaacaggaccacatgagacttccgagagcaggagtcaagagaatgcagtaaagtatgacaaggtaaaatggcaaaccttcatatgaccatgagggtgagagagtcatcatcagggtaggtgagtggttgaattgtcatagctggctgaattacaaaataagcatcatttgtaaagccatgatgatttccctgacatagctaggccagggtgtcctcactcatgagagataattagtagttgcagatgacagacttggatcttgttttccccaagatgcttcagaatggtgtgtggagctcccagtgaattcagagaaaatgtgattctcaattaaatacctttgcaatattttcctgtaatttatcacaatggcttacagaaataattaattgcaaatataactacatacctgtctatggcaatataagaaagtaaggattttccaaaactactgaatgatgtataaattatacatatcaagtttcttcagatatcctggttcaagggcccttgctgttactttgtaggcatcaaccaccatctcttcagcaggaacctacttgaactctccctgctgaaatatatttgcagctctaatggatattttcttcagttcacttctggaaagaaactgaaaagctgatgaaaagtatatcattttcaatttttaaaatggcttttagttccatgctaataaattataagtccatagttcataagttttggtttaagcacataattcttaattttgtttactgtctcaagagtcttagcataaaatgctactttcatcattctagactcttaagaaaaattacctgtcagcttaaattaaagatagtttttaaaaatatgtattttaagaaaagcctctcattccaaagtgctaaacaaaccaccaccctttgtgttgctgcagctgctaagttgcttcagtcgtgtccgactctgtgcgaccccatagacggtagcccaccaggcttccccgtccctgggattctccaggtaagaacactggagtgggtttccatttccttctccaatgcatgaaagtgaaaagtaaaagtgaagtcgctcagtcgtgtccgactcttcgcgaccccgtgaactgcagcctaccaggctcctccgtccatgggattttctaggcaaaagtactggagtggggtgccattgcaaaaaaaacaagtaattaagagtatatatctctatttagtgattacatattgctacatgaaaaattttgttataagcagtgttatcattaaaaatcatggaaaacacttataagagggcatggtggtatagtgaaatgtgcagaatctaggccatggatcattctagaataatttttgttaatatctggttatgggcttcaatgtgtcatttaatctgtatctttttttgggggggatgtatccattattccccaaaaccctcctcctatccagcctggcacataacattgagcagaatttcatgtgctatacaataggtctttgttttttacccattttaaatatagcgatgtgtacatgaccttcctatagttcctaactatcccttcccccaccagccccatctccagcaactataaattcattttctaagtcagggaaaatactctttctgttaagtataagttcatttgtatcatttcttttcaaattccatatataagggatatcatatgatatttctcctgttctgtctgactgatttcacttagtgtgacactctctaggtccatacatgttgcttcaaatggcattgtttcattcttttcaatgcctgagtaaaattccatagtatatatgtaccacatcttctttatccattcct

SEQ ID NO: 25670 - DNA, 886 bp, Bovine  19866880782278
caaaacctgattaaggtgctttgggttgagccaagcatttttagtgatctttgtaaacaaataagcacaagattaaccaaggctgggaagtagggaacatgtgcagtgtatgactctaactgataacaatagcaccaaggctgtggccatggactcctgagccaggctgctcgagctcaagccctgggccccagtacttgctgtatgacccaagatattgatttaatttttttgcacatcagtctgttcatctataaaatgaggatagtaaatacaccttttgtagggttgttctgaggatacattagttaagacatgtaaagttcttagcactacacctggtacatagcaagcatgagagagggaaagggaggagaaaagggaggaagaaaaaccattgacttaggagaaaaattaaacactcccttcgagtgagcagatatttgggcctaaggcgtcatttctttttccaagtaatacctgaattatgactgttacgatgacagaatccaggcttcccgtagatggtgcagccagccagcagaagccaattaatctccaccaccgcaggcaaaaagctcgggctgctcactgagacctgcttccatctcctgaagcatctgccctgcttgtgtttgcagggggtcaggatttcagtgagcctatgtcttccccagtgatgttgctattttgggaattttatagattggcactaaaaagaaaagaactgtgcaggcccacagtggttggtgtgtttgtttttgtcttgttttagagctggaagaaaccttgaagccccaggagccaaatgcctctcatttaacactaggagatcctggggtgagagggctttggtgtcccgacctcagcagtaaggagactcaga

SEQ ID NO: 25671 - DNA, 1683 bp, Bovine  19866880938518
tttgcttttgctccatcttttcattctttctggagttatttcttcactgatctccagtagcatattgggcacctactgacctggggagttcatctttcagcgttctatcttttttccttttcatactgttcatggggttctcaaggcaagaatactgaagtggtttgccattcccttctccagtagaccatgtcttgtcagaactcttcaccatgacccgtccatcttaggtggccctacatggatggctcatagtttcactgagttagacaacactgtggtccatgtgatcagtttggttagttttctgtgattgtggttttcattctgtctgcccactgatgggtaagcttaagaggcttatggaagcttcctgatgggagagattgattgagggggaaaaatgggtcttgttctgatgggcagggccatgcttagtaaatctttaatctagttttctgttgattggagctgtgttccctccctgttgtttgacctgaggccaaactatggtggaggtaatgaagatgatggcgacctccttcaaaacgtcctgtgcacacactgctgtactcagtgccccaaccatgcagcaggccactgccgacccatccctctgccggagactctggacactcacgggcaagtgtgggtcagtctcctgtagggtcactgctcctttctcctggatcctggtacacacaaggttttgtttgtgtcctccaagagtctatttcccagtcctgtgtaagttctggcggctctatggtggggttaatggcgacctcctccaagagggcttaagccatacccaggtctgctgcacccagagcccctgcccctgcaacaggccactgctgacccatacctccacaggagacactcaaacacagttatgggtcagtctctgtggggtctctgggtcctggtgcgcacaaggtttgtttgagccctccgagcatctctggtgggtatggggtttgattctaaacatgatttcgcccctcctaccatcttgctggggcttcttctttgcccttggacatggggtatctcttcacagtcgctccagcaccacacagtcgccactccagcaccaggcagctgccgctctgtggcagctgtgattctatggtaaataagtttcacagtgttcaaatagatgctgtgtgatgaccttaacaatggattccctagttgctgcactcagttctaatttcctcccaaggatcaaggttgaataagtgaaagccatccgggattttcactttatagagaacagacagtttagataccaacctctcacactttgtagtaaagattttacggctgtatatacagagagttccaggcaatcctaaaggtttctctggcccatgcctctgtgcagaggtaagtttttacctccagcagggttttcattatatctggtgttggcttaggtttcctcaatggctcattggtaaagaatgcacctgcagtgcagaagatacaggatatatggattcaccccctgggtcaggaagatcccctggagtaggaaatggcaaccccctccagtatgcttgcctgggaaatcccatggacagaagagcctggtgggccacagtccatagggtcacatggagttggacatgactgaacacgcacacaggctgggtaatgttactcagacccaatcat

SEQ ID NO: 25672 - DNA, 1514 bp, Bovine  19866880995111
cttgtcttatttatgcctgcagggaaacccagatacaaacttttcccactgatgtgctaggactcagcactgcccacactacacaactccagggaactctatctggtgttcccagtggctccgctgggaaagaagccgatgcagaagactcaagagacacgggtttgatccctgggcaggaagatccccaaaaggaaatggcaaccggctccagtattcttgcctaggaaattctatggacagagaagccgggcaggcgatagtctgtgtgatcgcaaagagtcagtgactaagcgcacgctcacgcacacacacacgcacacacacacacacgtaaatggaagccctatactctacagaagctgtgaaggccaaataagattttaaaacactggtcgtaatttaaaatgcaggagagttgttattagaagacgtgtttgacctgaagcaagtgattaatcttcagtaaatctctttttgacactatcaagtgggaatgaacatttcaacacttacttcagagagttgttatgaggattaaatgagattaacatgcacaagtgcctcaaatactaaaagagacaggcaatgagtattatgaccttgagttagcttccagtcctcgggttcaagtatcctttcagctgggcatctgcagcctcaccattaagaaataacaccagcccttggttgagtcagatcatggtggaacttctgtgctatgtgcacacatatttctgagctcttattgaggaaatacctgcaaggctaaggcatggaaggagtttttctatccctcattcccacctttttttaataagtgaaaatttcccctgtcagaacacatcaagataccatggtgacaattgctagaagaatgctagatttagaaagaaataaggtgatctcaattctgttgcctgctacccaggctcaacaccctaagccgaactcatgctggctagatgcctgaaagtaaccacttgccccaaatatcttgaccattctctgctctagaagatagaattcccactttccaaggtctttcaaggtatgagcatagaattaggtcacagccttatctgggacaaagataaattgggacaacattaacagagcttaaaatttaaaaaaaacaaaaattgaactactcacttgactctagatcacaggtcattaaatcaaatgattgcaagggctaagggctatgtaaggtatctgaataaggatgtccacgtgtgcaacccagtagagaaggacagggatttgaacacgtccaactgtaaaagggaaaagattccttgaattgagtcaagaaacacaaacctagtgatatcagagcttctaatttttcaagacaaggaagaaattaaatgtttatatgaaatttcccaattttaaaaatgtatctgcaagtcagatctagccatggctgtcagtgtcctgaatgatgaatgccctgaatccaggaatcatctccctttgaccttaaagtatggaaaaatggaagcgtg

SEQ ID NO: 25673 - DNA, 845 bp, Bovine  19866881032883
caggaatatatacatacacacacacatatatatgtgtgtctatatttacatgtgaaacttcacacacacatatatatatgtgtgtgtatgtattcatatatgaagagggaaagagagaaagcagctttaacatccaaaacaaaattgtcttctctagagtgctaaaattctccctgaattgctattcataccactattgtgtttatagatttcttctttcaaacaacactcttgggaagtactatcaaaccattaacaccttgtctggaatgagcttctaagatcactgaagaagaaccctctggagaggctaaatagagctcgatatttaaccctgacaatcaggaagtaccaattctcctggcttcaggctacccctccaatctcaaggcatagttttagctctgcaagtgtggttagattacactcagtactaatgaagagacttaagaattgcaaagtgccacataaccaatttctagtttctaaaaggagttttaacagcatgtggtcattatgtttttataattcttaaattaattgaaaagtgaacaaacaagatcatgaccatgttttatgtctgcatgtcaatcagttaactgatggattctgaaacagaactaaccattttcttgatttcctcttaatcaagacatttactttctcactgcatcttgttgtatctaatctaatcaacctgctttgcctgtctgtatctaagcctcttaacactttctatgaatcagtgttttaatatattacatatgtcccctcaaatatgcctctgaaattttaaaaggtattatataaggaagcatttgcactgttgcattaaatatacagaa

SEQ ID NO: 25674 - DNA, 1200 bp, Bovine  19866881072157
ctttgtattgggcatccctggtggctcagatggtaaagaatctgcttgcaatgcaggagatccaggttctaccgctgggttgggaagatcccctggagaagggaatggcaacccactccaatactcttgcctggagaatcccgtggacagaggagcctgttgggctacagtccatgagatctcaaagagtcagacacgactgagcaactaacattgtaataatctgcacaaaagatgatgttggcttgggtagggcagtagcgtggagtggggagaagtgataggactgtggatctatttgaaggggtaattggtggtattttcttaaaattggacatagttgtgaaacaaagagaagttgaggttgactgaggattttgtcctaagttactgaggagcccttgtagattaattagaaaatgatgaacagctcggtggaaaaatgcatcatgatgtaattgaacatagaaagtgattttccttaaagtattttttaaagtaaatctttatccaagaaaagtgcacaaattgtaagcatacagctgggtgaatattcacaaagtgtacaaaagacacccatctaaccagcacccagattcagaaacaaaacattacctgcattcattatcattcattcccccttcctaaagtaattctttttcaatttaactctgcatttatgctaaacattttctgcacagcaaatgatgtggatgtagagcgatgggccactgaggaggcgatatctttagaaatcaggagagggaaacttaagaaactcacctgcaaccatgtgacaggaattagtcatctgcttgatctcatgaaattcatactgaaaagttctttcctaataatacaatgtgagaccgacagatagtaaaaatagacatattttctacatagggttcaaaattagaaagttcataggagttgctaaaaaaatttaaaaagaaccctgagttgacaaaaaaagaaacttacataaaaagtaaaattgaatgtactaatgtctaatgatctgtactttcaaagtaaacttttattatctagaaagcttggtaaaggtgaggataaaaataagatttagatgctgaaactaaacattggatttggaatacagaaactatagttttagtttttctcagaagttacatatgaaaaaaatccatgagctaaagtgggtgtgagggacttggg

SEQ ID NO: 25675 - DNA, 808 bp, Bovine  19866881123471
tggttcccctgcctaggaagatgaaaggccctcttcacttcagccgactcctgcttcttctttccactaatggaaaataacttaaagatgggaaaggaactcaaggctgaccttgagctggcagaatgctcttcctcacaagggcttttctagctctcatgtggcatttattctcatttggaaaagccaccaaatactcaaatgtctttaattaaaatacattttacttgttcatatctagccagtcattatagaatatagaaccaacttatttcatgtcatattcactttataatcaggagtcagatgtctcttcacttgaacttaggcgaagttcaaatcctagctctctcccttgttagctgtgcaatcttgagcaacgtacgctattattcttctgtattttctttttaatcatatagagacagatatatagttagggctcttgataacatgtaatacctccaggattaaaaaccacataaaagttctgtgctatctactagcttgtcaatattggccactgctatggcctgaatatttgtgctcctcccaagttcatatgttgaaatcctaatccccaaagttgatagcattaggaggtgggggcctttgagaggtgatcacattacaaggtcagagtgcttattaatagaattagtgtcctataatagatccctagccccttgtgccatgggacaacacagtgaaagggcagcagtctgcagcctggaagagagccctcaccagaccttgttggcgtgccagtcttggactgctagcctccagaactgtaagaaataaattt

SEQ ID NO: 25676 - DNA, 780 bp, Bovine  19866881305800
attgaagaatccttgcatccctgggataaagccctcttggtcattaggtatgatctttttaatatgttgttggattctatttgctattttattgaggatttttgcatgtatgttcatccgtgatattggctcatagttttcattttttgtggcatctttgtctggtttgtattagggtgatagtggcctcatagacttgagtttgggaatttaccttcctttgcaattttctggaagagtttgagtcttgagtgttaacttttttctaaaatttctaaaattttggtggaactcacctgtgaagccatctggtcctaggcttttgtttgttggaagattttttattacagtttcaatttctgtgcttatagttggtcattcagatttatgcaaaacaaaaacaaaaaacttctaaaatttataaatacatattttattaagattgtaaattatttaatattagataatagattatattttaaataaatattttaagtaaatatcttctttaggtgttcatttctgaaattgttaaattaataacatttgaagaaaatgatatataattttaatagtcatgtatataattttctaagctttaaagtttttataaaggttatggtaattaaaatggttccctgaatttcatataattataaaacaactcatgcctaattctaaactgcagtaattcagccctagagtgagatttattctgtagctatgaaaggcaatggcatttacatctagagtaaattaaagcaaatgaagaggaaaatt

SEQ ID NO: 25677 - DNA, 1767 bp, Bovine  19866881359588
cacagtattatacagcagatatctagaatgtacttatcttatacaactaaaaatttatacctggttacatttggttttattcaacttattgaagattttctttctgcacactgtagaaaacctgacttccaaaagttacctggaagaaaatgtaaactttctgggtcccaaatctctagggaaagtatgattctttttgaccagatcatttcatttgcatcagccaactgtcaagtcaaagtgttagtcagtcgtgtccgactctttgtgaccccatggactgtagctttcccaggctcctctgtccatgggatttcccaggcaagaatcctggaatgggttgtcattccattctctaggcgatcttcctgacccagggatcgaacctgggtctcctacattgcaggcagattctttaccacctgagccaccagggaagccaactatggtattgtataatttataatgtatacccgtacaaggattttgctttgagagcaccaggatttcgggatatattatacctatgtttccatagtcatccacttattcttctgatatatgaattagaatgcattcctcaaaatgtaacaggtgttttaatctactggttacaatatattataaacttccttttccaatcataagtcatgtcaacattgaaaaataacatctaccaagagaatttaaggacatggcagcaaattattaatagaacaattgagagtaggggaaggatgcacttgttatagtcatgaatagatgattgatggtggagccaattttttttcatgaaaaatttatgttacactccccaaagactatatggaaagtcttctctgaatgtttacctgtgtattttaagtttaataacagttctagacagctgttacttagtcacatttgtgaaatgatgttgaagacagacatttaagcatgaactcctcaaggacagtccagctttagagactaagaacttcatttattcagagaagcaggcttgaaaatgtgatatatattgactttcagctattatcttttacatttaacagaatatagaatggcactagaggtaaagaaccctccggtcaatgcaggagacataagagacacagccttgatccctgaataggaaagatatcctggagaagggcatggcaacccacttcagtattcttgcctggggaatcccatagaggaggctggaaggccacagtccatagggttgcacagagtcagatacaactgaagtgacttagcatgcacacacgcatagtatgtgtaaatatgtgtttatgaatatatgtgtgaaagtatatacatatataaatgtatttaataggtgatattttgaccttcatcaccaacactatgctcatatgctatgcaaacaataatgttagactggatgttctttttaaactatggttccatggaggaggggcaggcagggaaaccacttccttttatttgaattgttctggagttcattaatttctttctttattcttacagttttgttgtaacatgctgaggtaatgaattaaccctaaaatttcaatgacttagcaatgttttttccttaatcattacatatatccaatgccaattagtaactggggctgggtgaggctttgaattcagagtcactcagggattctggctggcagaggccccattatcttatatcttaatccatgcaatagacaaaacaggttttagaaggccttccagtttccagggctttgcttggtaaagacctgtgta

SEQ ID NO: 25678 - DNA, 757 bp, Bovine  19866881627477
cccttctcctcctgcccccaatccctcccagcatcagagtcttttccaatgagtcaactcttcccatgaggtggccaaagcactggagtttcagctttagcatcattccttccaaagaacacccaaggctgatctcctttagaatggcccatactcaatcctaaagattattacagtttttcctattttcttcttgcctgctttcatggctcttacttcttcttgtacttaccaaaagtgaaatggtttttgtgcctcctcattccttggagggatgcactttagaattcagtccatctggttgacttgtgatctcatatctctgatgggctcaaggaaagttatgatcttatggattaccctcttgttagcacaggggtgatttctcttgtggctttctaaatcctaattgaaaatagtactcttctctctgtgtattaacatgaaagaaaataatagcatattagtttgatttttgtacttaattttatcccaaatcatattgtctggtataagtagctattgaaataaaatccactaaataatagctattaattattacccaaaacacaacaaatcagtgccaacggttaaaactttaaacctacaaatggaaagtgcaataaattaacagacaagatatcagacaccaattattaatagcttagtgactctattaatcatgttatttcttagtttcagttttcaaatgtcaatataaaaatacgaaccaagaatgtaagtttctcacccctct

SEQ ID NO: 25679 - DNA, 1564 bp, Bovine  19866881644671
tgaaaatatacagccatgacatactccttttcctatttagaaccagtctgttatccatgtccagttctaactgttgcttcctgacctgcatacagatttctcaagaggcaggtcaggtggtctggtattcccatctctttcagagttttccacggtttcttgtgatccacacagtcaaaggctttggcatagccaataaagcaaaagtagatgtttttcaggaactctcttgcttttgtaatgatccaacagatattggccatttgatgtctggttcctctgcgttttctaaatccagcttgatcatctggaagttcatggttcacgtattgttgaagcctggcttagagaattttgaccattactttactagcatgtgagataactccaattgtgtggtagtttgaacattctttggcattgcgtttctttgggattggaatgaaaactgaccttttccagtcctgtggccactgctgagttttccaaatttgctgatatattgagtgcagcactttcacataatcatctctcaggatttgaaatagctcaactggaattccatcacctccactagctttgtgggtagtgatgcttcctaagtcccacttgacttcacaatcgaggatgtctggctctagttgagtgatcacaccatcatgattatctgggttgtgaaggtcttttttgtatagttcttctgtgtattcttgccacttcttcttaatatcttctgcttctgttaggtccataccatttctatcctttatcgtgcccatctttgcatgatatgttcccttggtatctctaattttcttgaagagatctctagtctttcccattctattgttttcctctatttctttgcattgatcactgttctacagtccatgggttcacaaagagtcggacatgactgagtgactttcattttcaaaataaaggtactatctgtcaaaatggaaaagcccaggggtagagtagattttagaaaatcaaaaaatgtgacatctcccccattttacggtaacattgaaacttaaaaagattgggttcttgttcataggtacactcgccgggcaagagctgcattttcacagcatctgcgcaacgcaccttgcccttaacaaacttctgtgtttgctttgatgttataataccttcagcctctacctatggtcctccagaacattgacatttttccatttggccaaagtaagatttcatattgtgctgttccattagatacgtaagtccccatgaaagttacaaggacactgtagcccaaataaaagcctttgaatcaggacttgcataggaagagaaagctaaactctcaattcacagtgtgggtactgagcctgtggcttgagggatggatagcagtgcttgaattgacaactgtgctgctgagtgcaaatgggctctttatggacccactgggctgcttctgcccaacctttaatctttcctaagctccagaccaggaatcaaaactggtctgcccaggacttgaggcattttgctatgaatttgcagagcactctaaaggtttgaattccaa

SEQ ID NO: 25680 - DNA, 821 bp, Bovine  19866881726802
cttacacttttaaaatttatttctcagacctttcactttgttcttccttattatgtatgagaaaaaaactaaggcttgaaacaagtgcatttccttccaacaaccgaagaccttccaggattgggtaattgcagtgtattagaatgaaaggctaataaaacccccaatgtaaatattttagtagtttgctaaagaaagaaccctcaaatattatgtagaagacagtttagaatgaggtttaaaaagctccatataaaaacctgtttgacctgttaaaacaggtgcagacaatcacaattccctattaaaagatataatgagaaaaacctgtaaattcaagacaaatgcattggccatgagaactccaaatcaatagatggtgaattattagctacttctagtgttcagagccaaacagaccccagtcactttctgtcagttgacaggaaactggggaatcagtatctatgtaccttcccagggaagggagacttcttggcagaagtttaggatttatccttaatccatcatagttggaccactcatttgccttttgagatatcacttccattaattgtaaaatgatgtagtgcattaagaaatgtagctaaaattttttaagtaaatatgctaatactgacctttaatttcatgtagcaaaatgagttaatgtagcaataatgctaaataattaccttggatcaaaagttaagacacagttcatcaaagtacaaaattgatacagaaagtacagattaaccttccactagtactcccttgttggagaaggcaatggcaccccactccagtactcttgcctg

SEQ ID NO: 25681 - DNA, 865 bp, Bovine  19866881957738
tctgtgattttgagtattttttttctgagagcttttgaaaattttctggtgggtagttaaatttgtatactataatcagtaaccaatgtcaggagtattctcagttgcctataatgtaaataatgaaaattttttagaagtatcattagtatatcttattttgtgtagcagtttgtcaatgacaatcaaaatttgaatatgtaaaacttttgaaatgatacaacttgctgatgggattttacctattactgttctcaaattcataaagaataaaatatgttagagattgtaacataacttgaatgtctgaaatatatatcattaaaataagaattgtaatgataaaaaaaatcttaaccatgtcttctaaaactttagactatttttatgaccctgatttcctgtaaattttattgtgacttggcaatacttgcagattttataaagtattctgtcttcctttcaaagtttctctcccaccacattgtgttcctatagttcattctctgaagtcacatcaaagacgctaaaatgtgtcacttgcaatttagttaatgttttctttaaaaaccctgtttgttcagtaataaggaaactttgataatgaagacagttaatctaagtgcattttattaggggcatgttaaggttagacattcaatgggtaagtgtttaaactcatgggcatgtcaaagctcctggcaagatccactctgaagggaggcagacaaggaaagaaaatttggaataaaaagatttccaaatatgttggaaacagtgttctctaagaaggcctttgcatctaacgttcttaagtcccataactgtagttaggcaccattcagatcttggacataacctcaag

SEQ ID NO: 25682 - DNA, 1822 bp, Bovine  19866880346178
tttcttggttcttcttccctccattatgatcacatgtctcatcactcaccgaatgatatgtaacccagagtcacagacttggtctccaaggatgttgtaaacctaaaaaggatagaaacttcatttttcaaatatgcagctagaagctcagaaaatagctttccatgtcctagagggacactgtggtgggtcaggccactccagggcacagtactggagaccgtcagtcattcttcgtctctctgactgctctgaaaatgagtctactggacagcgacactcatatttccaaaattatactgtggttggattttctctttttcctgtcttcaggtgtctttgacaattagtgaatagatctctaaaacttagaaatcttatttgggctgatcaaaggtacagtattcgtgttatattaaaaaggaatctattgcccttaaattatggatgattaaacaaactgtggtacctctatacatggagatactaatcagcaatagaaaaaaggacagatacgtgcacccacatggattattctcaaatggattacatgaaagaagtcaggctccaaaggctacacactggatgattcagctcacatgacattctgggaaaagcaaaatgatagggacagaaaacaaatctttggttgccaagggctggatagagaggttgactgcaaagaggtctgagggaaaactttttcttatgatggaactcttctaaatcttgattgtgatgtgggttatactatctaggcatttatcaaaactcatagaactgtacactaaaaaggatgaattttattccatgtaacttgtaccttaaaaagtatctgtgctttgctgtgcttagttgctcagtcatgtccaactctttgtgaccccgtggactgtagcccgccaggcttctctgtccagggggattctctaggcaagagaaggttgccatgccctcctctaggtaaaaagtatttaatctcattaaatttatggatttatttctgtatagttatagagcattttaaaaagtctaatgtgtaggtcctcttgccaccaactttcattataaatcaattatttgattcaaagaattaagaaatgcagggctgtttcatatagtaagatagatttccttctggtcccttaccaactcatgctatagacaaactctccagccaactgctgggacccttcacagtcttgccatatttgctagaaaccttctcccataactttacacctaatccctcatattaggcagggctgtgtcccctcagcctctctaacaccagagcttatccctccaaccaggcctttttccatgtagttgcctgaccaggaatgctttccttttcccctctcttcttcctcctcttccccttccttcaccatgagtgaacacccaggaaatgagtactattctagggacaagggaaacaaaggatacacttgataagaatcttatccccaaagagctcgcaggtccaggaaataggatttatgcaatgtggttaaaatgttttgacagaatgatttgtgaattttatttttttttagctcttcagggttatctaactttttgacattgaatactttcacaaataatttttggtaataaggaaaagcagaaattaagggcttaattagtggtttggaccagaggtggtgagacaacttgacatcaggatgtcaaaaattagaaactgtcagtatcaagaagggaactgatgggagggagatgtcctgtggaaacctgttacaaatggcagacacatccatcttaatctatgctgatgctctcattcacattaagaatcaag

SEQ ID NO: 25683 - DNA, 1366 bp, Bovine  19866880405726
taaaagctatcacgcacacccaacccttcacgcacatacacagacccacgtaccttagaaatgtcactgtttatcaagctaggaatccatttgcaattagagttcttgagagagaatgggaaattaagtcaaggtcagaatgtcttgagatcagagaaataccctaaatgtgcacaagcaagttacaaatttgctagaagaaataatttgttagttgtttcacttgatttccacacttctggccaaatctaattataagaagggtcagtgggggagggggatgatttgggagaatggcattaaaacatgtataatatcatataagaaatgaatcaccagtccaggttcgatgcaggatacagaaagcttggggatggtgcactgggatggacccagagggatggtctggggagggaggtgggagggggcttcaggatggggaacacgtgtacccctgtggccattttgatgtatggcaaaaccaatacaatattgtaaagtaaaaaaataaaataaaataaaataaataaataaaaaagaagggtcaccagagaaaaagcagaatgactcacggtaccttccatctaaatcctcgatatcttttatgaacaggcctccttggtgcttgcacatattcttgcatgctcgcaggaggctcttactcttatacaagatgtaatctttgccagtgctcttatttcgaacaaaattgattccttccttgagattggcgacttcagcaggggagagacacaagaggagctcagctgtttgttcgatgctgtgaaaaggcaaacattttgagaggaaacagagaccattgttaggttttaagagagaacaatttggcaatggcagtcaaaacctcttttttttcttaagatactatgtaaggccagccttccaagtacctgggctgagcggcagctgacggtgaactttcttccctcctttaaatgcccatcctacttgttgagggttgaccccaccttcccagcaaagtaatgcctccctcacttgcctgcccatagtctgtcgttgcctctccctgggtatttcagaagaatggcagctgtcacttcagcttctgtggctcattcactccccccaaggcagaagtctgcgtggagaaagaggatgtacactcagctcagtatttccgttggtgatgtctcctcctgaaataagtttctttcagaagccctctatgtttagcttcaataactgctcctcaccttcaagctttcacatcaggacctcctctctttgcccaccgagagtcactctttaggttcaaaagtaactcaatcactgctccttggttaacccttccaagccccccacccacccccaggtcaaatctaac

SEQ ID NO: 25684 - DNA, 877 bp, Bovine  19866880413977
taaaggaaatcagtcctgaatattatttggaaggactgatgctgaagctgaagctccaatactttggccacctgatgcgaagaactgactcattggaaaagaccctgatgctgggaaagactgaaggcaggaggagaaggggatgacagaggatgagatggttggatggcatcaccaactcgatggacatgagtttgagcaagctctgggagttggtaatggatagggaggcctggtgtgctgcagtccacgtggttgcagagagtcagacatgactgagtgactgaagtgaactgaatactatcaaagaagtaagagccaagggcttggcagtgaaggtggtgcagatttgatactgttaaacaaaaggaacttgcgatagcctctagaaaaggttgatttctggaggtaactttatgattgttcaaatgaccaacttccttaaatttgtctgctactggtagtaccaatgtattttgtaatggcataattgagtccaaaacatttggaaaacatcagactttcatcaagaaaataatttttaaaattatgaccttagtgaggtataaaaaaactcaataaataaattctgaaattagaaggtgaaattagtcttgacagcaaaacactccttgacaaatatgggtgcttggcagttggccaatgtctgattagaattgggagagaattgtgttatcagctcagcttcaagctactgagacagaatgaaggctttcctcccctacctcttgagcccattccacgtgaggcctgggataataagcacagtaatggcagggaattacaaaaatataggaggaaagaatcagggctcttccaacccaaactacacacaaattttcatgctattctcaat

SEQ ID NO: 25685 - DNA, 1208 bp, Bovine  19866880434062
tctcctgcattggcaggcaggttctttaccactagtgcaatggtgtttaaattttctgctatttggggataataccttgggtttatatagaaacttcctattgaacaacagtggtctgggaggccagagctgggggaggacactggcttccctggtagctcagatagtaaagcgtctgcctacaacccaggtttgatccctgggtcaggaagatcccatggagaagaaatggcaacccactccagtattcaggcctggaaaatgccatggaccaaggacctggtaggctacagtccacagagtcataaagggtcagacacaactgagcaccttcactttcactttctaaaaaattacagaaaacaaaaagaaagctcattgtattcccttcatttccaccctagaaatacttgtgccttaaaaagagggaaatgtaaaaggtctttggaatttaaactgaatttatgaagacaaagaaattatccttttactcttttcagaatataattgattgaaataaaacttagttgctggaattaagaagaccacacgtttgtctaaaggaaatgcacacagggtttaaaaagatatactccctatgatatgatgaatacgaatatttcaacatggctttggaaactcagattttggactttaaggagccatcactcccccgacacaggccctccagtggtcacttttgttcaagaagagtaagaagcagattttactagaagtcaagaatcagagccatgggagactgaaacttgggcttgaatgggaagactgggatgtactgatgagcttctttctgactctaagtgatgttttctttgtcctttatctcaaggtattttgaagccaaattctaagcatattcatgaacgaaagaaactgaagaaattgcctgggattaagagttacaaagacttggtttttctgagtcacgggtgagccatttttgaaaggactgtgttcagaaagacagttttataaatgaatgctatgtataggtaaaattaaaggtaaacaaaagtataaaatgctacataagaggtttttaaaatttcctagtgctgtatggttaatcaagggctattgtgtgttggaagagagggaagttgcttccattgcttgtatttggctgttagtgcatttttattagatatttatttgggtgtgcattaaaccacaagttgaatggagag

SEQ ID NO: 25686 - DNA, 1669 bp, Bovine  19866880505635
gaattgtgtcctatctgtggatccgggacggccgagtccagcagctggagtgagtacttgaagagaattgcccctggaccagtaatcattacgtctatgttagtttgctagggctgcatagcaaaataccacaggaggggcagcttcaacaacaaatatttatattctcccagttttggagactggaaggtccaagatcaaggtggtagatgactggttccaactgccttcttgttgtgtcttcacatgggagcagggctggagaaggagaggaaggaggggagagagaggagagagacagggctctcgggtgtctcttcttacaaggacactaatcctatggatcaggaccccacctttatgacctcagttcagtgcagtcactcagttgtgtccgactcttcacaaccccatggactgcagcacaccaagcttccctgtccatcaccaactcctggagcttgctcaaactcatgtccatcgagtcagtgatgctatccaaccatctcatcccttgtcttccccatttcctccttatgacctcatttaaccttaattacctcataatagaccttatctcaaatagagtcacattggttaggacttcaacctttgaggggacacagttaactccatttctgtgtctcttatgatctcatctccctttccatgcccccctaagatgtttatgattctaggtttcctctgacggctgagtgcaggaagctgctattcaatttaaataaatttgaagtcctttctgactttttccccacccagactttgatagagttagaaaccgtagcctggaatcttctcacgggactcattctgctcctcagctttcctattattcctgttttgatccatgtggattctttccttttcctcagtattgtaccagataggtcactagacccaggattgccattcccattgcataagtacagaaaatcagatgcagagatggaaagtgacttggccaaagttgattaactcatctttaaccaaccagataggcttaggtttttcattcctagcaggcatttctccacattaccctgcctttttggctataaatgtaggtacatcttctattcctgctgttgctaagaagttgaaagatgaaaatttactcttggagatgtaccaagggagtggtcccggggaaagaactgaaagtgctttataatttccaaagtaactctggaatgaatactgttcagccagatggtggattggcttctaagtgtaattataacagctccctgatcagagcacttgttaccgttggttacaccctcttctgctagcaagttcaggacaggggtctaggagatccttctcagacgttttcagcagagatgtctctactgaggctcttgggtcattagagaaggtgaacatgatgcaccacgaggaatcctacgcactgcaaagctgtctttgaaaataagacccagaaaactcttcagagagagtgcttcaaactccaggtctttgccctaatttcaggagtttctgcctttgctgggtagaatttggtcattcctagagcccttgggaggagaaggcaatggcaccccactccaatactcttgcctggaaaatcccatggacagaggagcctggtaggctgcagtccatggggtgctaagagtcgggcaca

SEQ ID NO: 25687 - DNA, 4520 bp, Bovine  19866880537724
atgctggcagattcgcactggtttaggcccttcctggttctaggtagtgtgtcctcttgtgttttcaaatggaaaaagggatgagggtctccctggggtctcttttataaggatactgatcctgttcatgacctaagcacctcccaaaggccccaccttctaaaaccacctcattgaggagttaggatttcagcgtaggattttcaggggatacagacattcagttcacgtaccggcttagcaaatcatcctggtaggagcaccacattgtgtaagggctgggatcccagagttcactaaccacgaagaaaatatcaactttaagagaagtaggtgaagaactgagctctattatggtatatctttcaattggttaaaaaaaaaaaaaaaaaacattaatagagattttcttttttaaatcccccttggaggaccttccctcgtggtgtagtggtcaagacttcatcttcccatgcaggaggtgtgggtttgatccctggtcagagagctaagatcccacatgcctcatggccaaaaaaacaaaacacagaacagaagcaatattgtaacaaattcaataaaaactttaagatgggggaaaatcccccttggaattttttaagtcctgcatcacattcaccagaagctaagttggtccagcatgctttcttcatcctcccttatcagaagctgtgttttttgactttctgttcacggttaaggatttttttcattgattaagatgagacatagatttcttatgcttctttcaaatggaaaattagaagctggttatttgcacatatttttcaaatgcacaggtaggaaaatgagagcacaaaatatgattgttgtataaattctatgacaaactatgcagcttggtgatcctgtgacactttacagatgaatgaggagttttgtctaatgggttgatttataatctggtccacaaacactgtgagctaatacctgctttgattgaggtggaactggtgaacagaaccatgtgaaggagcagctgcaggagtaggcactccaggttctattagcaccaccaagttgggaaataaacagggacgttgtcttggtgcaaagctgtcagcaagggctaaagatggaagagttcccaaatgaacaccgtgatgtaggttgtaatggagtggacgacagcactgtgtgtgtgtgtgtgtgtgtgtgtgtaggctgtttgaatgtattggggaattagcttatttctggagtataacagatttgaatggtaattataccaatccagaggaggaaattaaaatgtgagaatactaaagcaccttatgaaaggaaccagaaaacatttgtcttcttttaagacagaagattcacacacacacacaatgccaaacagaaagtgggtgtagcttctctccagaaacagcctatgcaaactttaaaaaaccttcacttaatttttggcctccactgggtagggcaccggagaaggcaatggcaccccactccagtactcttgcctggaaaatcccatggatggaggaacctggtaggctgtagtccatggggtcacgaagagtcagacatgactgagcaacttcactttcacttttcactttcatgcattggagaaggaaatggcaacccactccagtgttcttgcctggagaatcccagggacgggggagcctggtgggcttccatctatggggtcgcacagagtcggacacgactgaagcgacttagcagcagtagcagcagcagggtagggcacagagcagagtaggctatggatagccccttgcataatgggagctttctgactggtcggctaagcagagatgcaggcaattttcctgatgcagatgactgtcaaactaatgctatttgcagacactcatctcccttcttggcaggagaaaacctgggctgaggtggtgaggggaaggtagagaaaagcccagcatgagtgatgagtggttagaagaaaggagaagctattattccatccaaacagaactgctatggaaatgctgggctagggcaagaggcaggtattgtgagatataaagagactttttggttgtcacagattattggtgttcagttacatgactttggttgtctaaagcctgtgtgtgctcaccagctacttcgttctttctttttcatctccatcattcaacaaccagatcctatcagccatgccactttaaacccatctttcttttcatggggtctggatatcactgtggttttagctctttgacagatatattgcttttttgagatattcagaaactgtctaaagtcatgggaggctgagacagtagccacatcacgaccctgatttcccttgtcttgattctactcagttgctcacgttctctgtgtgttgctcagaatcccaagaaatgcatttctatctacttagaatttataaaatacaactgctgctggttttatttgttctctattatcacagtgacctagcagatgaaagaataggggatagacccctggtggttcagtggctaagactttgtgctctcaatgcaaggggctcaggttcaatccctggttagggaactagatcctacatgctgcaactaaagaccctgtgtgccacaactaaagaccctgtgttgctgcaactaagaatggtaaaccccaaatatatatacatatatataaagaagagtggaaagaggccataattgctcttagagcagatgtattagaacatttttaacattaaacatgaaatcaaaaatactatttgaacaaattctgagaatggagaaagaatgccttctactgaaggtataaaaaagttagacttggaataaaaggtagtagtgcctttaaaggcagagatagtaactatggtatgttgattctgaaagactcagtttatgtagactaagagtggaaggaagaattctgtaaaaataaatattgagatacctcttacacagtgatacgctcaaagtctgaagtcaaaatattgatatattccatgaattttctttctcaattgtgaaatgatcagtattgtgttttagaaattcatactctgggaaaaattatttagaacattttaaaggttcaggtctacatcaaaggtcaagaagtgactcaccagtctttcatctctaaggtctagtctgctcagtgaaaacaataaatggcagagttctgaatgttcatgtctcgaccccagaaaaattcacagaagcagcaatccatgtgaacttgtcttcaatcccttttgtacttgaatctttagtaaattgcaaaaggcaatgctagctataaattcagttaaccacccacctcacttcaggacacctgtttcgtctttctcgtattggacaatgcccagtcatttcttgccaggacgttcgttcaccccaggcatacaaagatagttcctgtgaccaccatcactactccatgtggtattcctgattggtactgtgctgggtgaagctgagggcctagcttttattctggtcaagagtttgggtggcaaaaatggaatgtggtccagaaaggagtaaaatgtcatgtgtcagaaagattaggttgtctttaaaggacactgttgctattgcaggttctttcaagaatttcaaaacgtgatttttgttttctatggaaaacgtatgaaatttaaaaacatccatttcctgagagctttctgaatggatgaggaaatatggatgattcacagagcattttaaagtagtgatgctgggcaacatgattataatgattaaagatgaaaattgagaatgtatgtgctttggataaatccttttataacagggagttgttttttctcataatttttattgatttaaattctactaaccagggaacacactttatgttcttatccatagaatttgtgctttgtcatagtattcaatatgaatatatctcataaaactatataatacggctatcaaaaccttaggtaatttgtattatatgccgtttactaagttttctaatcacatctctaatctaagaagagggttggcctaatccagcccactcatgtttttaaataaaattttttttggaatacagccaagctcatgtgtttacatactgtccatgactgttctcacagtacagtggcagagctgaatagttgtatcagaggatggtgtggcccacaaagccaatctgaccttacattaaaagtttgctgacttctgacctaaattattagaattttacaagactataaatatgttcatgatctttgtgtgtatatatatatatataatatatgcatatacatactttatgttgttatatatgcatatatacacatgtatgcatatatacacatagatgcataaatatgtacataagcatatatagatacacatatgtatattgggtttacatgtatatatgtgtatacatgtacatatgctcataattttttccttctggttttattgagatataattgacatctagcactgtataagtttatgatgtacagcata

SEQ ID NO: 25688 - DNA, 1027 bp, Bovine  19866880635374
aggtctgtatggttctccaaggtgatgtacttatattgtgtccccgggcccctgtggcttgcagattgtcccatgcagccctttcctgttctttctccacctttatcacccctgctgctgtctgccctggcgctccccacggagggaccaatcaatgtccagtgatgcccagtagggtttggccaatggggagcctcaaaagagattagaagaggggaaaggagtgaggtgaggatgttaattctgaggctcctccctctgaggtcacattgggctggctgtaccctttcacaaaagatgactgctcccccccaaccccaggcagcctttctatatagttctctctctttgcaggttctagaaacctcttcctctcccatcctttggagccaggtcgtgttgccttcattctgcccactgcttccccgacactctactgattcagacctccataagtcatctctttgtaaataaactttcttggaattattctcatatgagccagccatccatttcctaatactcccctaagtaattcacattaataacagcctattgactattgaaaaaaagttttaaatatgcttttagccagtcattcatatttttaaaaatattttttctttatgtagctccttgaatttttttcatttctctttcaattttaggcaagatctgttgttacacataatcccgttcaatttcttttctccttattgtcccccagcaatgtacaaatctttctaaaggctgatccctctgtaatgcatgaaatcgagaccgttaacttcaggaggtgattttaggaggaattacagacctagaaaccattttacttaaaactttttcgctgcttgttaatcttcaccatcttcatggacattattctggagtccaattcacatccgaaacaggtctctgaggttaactggctgtcgctatcatttaagcaaagccggatgagttgaagggaggatcaaggggcttagaacacaagggaaaggttcgaagccacaaatagattcct

SEQ ID NO: 25689 - DNA, 947 bp, Bovine  19866880656873
gatttaggttatgttatataaataaatatgagttttttaagtattgaagtgtagttgatatacaatgttatatgctacaggtgtacaatataatgattcataatttgtaaatgttatgtttcatttatagttatcaaaaatacttgctatattccctgtattgtatccttgtagcatattgtatacctaacagtttataccttttaaccatgtttccctctcctcttaccctccccactggtaacccctagtttgttctctgtatctgtgagtctgcttcttttccattatattcactagtttgttgtatattttagactccacatgtaagtgatatgcagtatttgtctttctctgtctgatgtatttcacttagcataatgccctccaagttctatacatataaacatatatatacatgtatacataaactattaaatagctggtctagattacattattgtgtaatggggcttgacatcaaaaaattggcaagtgatttttataaattaattattgcagaaaatgaccactccttgtaatataatagtaatatacgagaaatccaatctcaagttgttggacagaagggggttgtttgctccatgcaggacatattttatttcctgtcagcgttggacattttgctgactgtctttcacccatgcaacttccaggtcacttggtgcagaagctggaagtgggggtgaaggaggggtttaagactggatcatgtgcctgaatgcataggcctgatttcagaccccccaggcatccactcctgggacacactaaaatgctgagggtgttggcccaactagtttcccattgtgcaagcagatatgtgtgacaatggtaagaaaacaacagcatgagatgcctgctcccttgaggaccttatcatcagaagcagacacgggcaagggagaatgggttcgctctcagca

SEQ ID NO: 25690 - DNA, 1672 bp, Bovine  19866880761687
gtaacatattccttaaggtgtggcccaatcagagttacagttctctaatttttctcagttttcccttcttggtgtgttggattgattctgaggctagcatgttatatgttggcaaagtaacaataaaatcataactttacattctacactacaaagaaagaaagaaatgtgtttcagaaataccagtaatagttctgagattggctataggccaagaccaaggctaagaccatctctgatctaatcaatgtagtcagtacaagagaatgtcctctttgggccagtacctgtcatttgttccagccctgaagaaagatatttgaaggtaatgatggatctccagtggacgtggggactgttgcaaaaggttcagtggggcatggattttgggggtcagccaacaggtgaccaccacaatactcaacacagattctcacacagacacacacacctcagctagcagcaactaaaagcttaaccaaaagaatgagcataaatcatttacagagtatgttagagcaagatattcatactaaagacaaaaactgtgttaagttgcaaaactatagtttagtggaccaaagaggataaataatatataacattgtgatgggttttctttcatctttcctattgaaggacttgtataaaaaagagcactggctttcctttgcacttcaaggattatgcttttgagcactgtacttgtactctcaagtataatcgtattacatcagatcttaaatcaatacttcaacatctttgttaatgttctaagaatgttccatgctcatgactgtataagcattactgaacttggcattctgctcatgttgccttcattgttagattaatgctcatgtaaaaacattgctataattacaatgatggcagttggcagacaccctctgtgagcataaaaggaaaattagagcaccaagaaaatgtgtggtaaagaggagaggggttggctgagcagggggtgataagttctccaagttaaagctcattgaatataaaagttggatttatatactgagctggaaaagatctcaagaagtcatctggtccccaacttttaggcagcagcacacattaaaatgattcaaggctaagagttaattgtattctgtgcagcatttttttttttcccttaaaaattgaacaaacagtaggggaaagaaaagttaattaattcttaattcaaaggttattgtattttgtagttctgaaatatttgagagaagattttaaaattccaaatccctgccagatagaaagaagatatttcaaaataaatattttactctttgctctgccggtgtgatatgaggcagcaattcctttattaccacaaaaagcctaagggaagactttggaactaggattgaactagcaaattctgcttttctgagactgttgagggacaatttgttctttaatttcccccagggataattaagtacacagtccaaccaaaatgctaaaaaaatatgttaattatatttgtaagaaactctcacatatttcatgaaagtatattattcttttcttcatatcctattgatttatatgtaatttaaattatgatagcaacataattttgtataacacttttctccaacaactcaatttccacttctaaaagtttagccccaagatataatcatag

SEQ ID NO: 25691 - DNA, 3521 bp, Bovine  19866880798120
ttttccccccttcccccttctggagtcttttaaaacctcaagcatgtgtcattaaaagaatatttttaatattctgtttcttcatttgaagttgccacagaatttgaaatatctttctcatggcagctgtcttaagaatctctttaaaacatctgactgccttctcctatggatggaaggattatgctatttattgatggatgacttctctctgtgtacaagtcaggatggcagagaaatttaagtggaaaaacttgatggagtgacttttgccctgcaacgaaacgtgtttacccagactgtataattatggttatcaatagcagaagtgattggtatcatcattctgcttcagttttgataaagggtaaatttccttaaggtgtgttttacttaatattgtgtagccggagggtacaggtatgtttcggcagtggtagggtggagagaagaaattttgttcctgccacttgttttacatgtttactgcacaagatgggttcacctttttactattcaaatatcaggtcgtgtttcctgcaacagtctaacctggtatgtagtgctagttggtatggacactattcatcagcataagaaacccatgtcatgagtaaaatttgcaaagacaagtttaaacatcaaataaaataatgttagcacccttaaaaattagttatgattggtacttactgttaagattttttttttgggggtgggtagttcatctttagctggagttgattaaggttgtaatcaaattacaaatgtatttgaatttaaacatttatctccccaaatctggaatctaagcagtttctagtagcttagggtaaacttgttttagctattccttacttgcaggggcaagaattgttaattgaaatattcaaggtttgacaagcttcaggtgtgagcaagatggtctacaaattcaccttaagttgttgattttctgaatttagagaaattcaattacttaaaacattgggggaatccccttataatttgtatttctgactttcttttggctgtcagtcccataaaatagggcatatttgaattggcttgactcagcatttcttgatttttatttctcgtttctttccctagtgcccttccttcctgtaaagctgagagtgacttggttccttgtttttacatttagagactctatgctatttccagcttccatttttcatagagagtttattttcatcgtctcatggtcatgataacgaacatttgtataacatgttctgttgaacacttaattatgcattgctttatttgctcctgcagtagccctctgaggtgggccctccttacatgtgcatttgcagaaactgagatctggaaaagctaaagaacttgtttcaggtcatcctgctaatgaatgacagagtcgggagttgaacccaggcctgtcttaccatttcaccattatactaaaaaactcaaacaaaacaatccttcagcttgttgttcggtggttgtgaactttcacaaagacttggactttagaaggattagagctccctgtatggatttggttggttgatacattattcattgcttggttccacacttgctgagcatgagccagacacatggtatgtccaagatggacgtcgactctgacttcatgggattcagagcccagggtctagttggggaggtagacatctcgacaggcaatgctttgagatgtgctgtgagcaggatgactgaaagcacatgggaggaacccctgacccagagggtcagggaagacttgcagaagggaggcaaatgtaagctaccacccaatggatgaacaagagttactaagggaacagagtagagacatgttctagacaaagaaagcagaatatgcttggaagccagagagagcttggcgtgttagagacatattaagtacagtgggagcaaggggtatggggtggaaaatggcccagcctaaagcgaattctttttcttgcagtcgggatcaggtgaaaattgggattgtttaaacaggtctcttcctaccacctgttcctaatgaccaccacgtaaactttatcctctcctccctcgggaggccgtagggcccagcggttaaggccttgggccttgaatcctgcctggttcacaccatagcccagccactttataacactgttcagcctcgcttcctttctctgatgaaacaggccttataaaagtatctatttgtaaacagtttctttttttttctattttttaatttaaatattacttttttctttaaaaacaaagttgtgttaggtgagaagttgctgtgtagcacagggagcccagtctgtgctctgtaaatggtttctttgtggattaactgggatgggttttaacactgcctaacccactccagtactcttgcctggaaaatcgcatggacggaggagcctggtgggctgcagcccctggggtcgctaagagtcggacatgactgagcgacttcccttccacttttcactttcatgcattggagaaggaaatggcaacccactccagtgttcttgcctggagaatcccagggacgggggagcctggtgggctgccgtctatggcgtcgcacagagtcggacacgactgaagcgacttagcagcagcagaacatgatcaacaaatgagaaagcagaaggaaccaaaggattctgcattctgttttcccagtggcacagatgatttcaatgcccagttgtttgtgttaccttgaaagcaagatggaaggcaactgatgaaacctgaaattcttaaggtgtgtgctggtccaatgaaatcagaaatggtaggatattcaggggagggtgttttatggccaaacaagtttggcaatcaaacattaaacaaagatcaaccagtgtctttactgcacgactttgactcagagactttggtacactcatgtgcatagtggatttctcagaatgagatggaatatacttgtcgttctcaaacttacatggccagaaaccctactgaccatagtttgggaaactgggatggaacagttaaagtgaacatggaacaggctagaacaggctctccgtcatttggaatgtcctcctaggggacattcttcggcctggactttaataaagggctgggcaggtctgctgcaggccacactggcactgtgccatctgtttctgtgatactttcctgtcttgtctttagagggtgttattaggaagtgattctgtgttagatggccagccttttcctcccatctgctaattgaatctccacccaatttttctagtacctggacttttaaaagtggaatttcattcttatacattaaatgttgcagttttaggtaactgtagacttgcatgcataggaagtaatgggcttccttggtggctcagaggttaaagcatctgcctacaatgcgggagacccaggtttgatccctgggtcgggaagatcccttggagaaggaaacggcaacccactccagtactcttgcctggagaatcccatggagggaggag

SEQ ID NO: 25692 - DNA, 2289 bp, Bovine  19866880976318
tttcataaggctgttatggtcaacgtttattgtacacttaccgtgcgtcactcactcttctagaaggacctgaggaatatgacataacccccatgagataggtgctattattatgttcacttcatagatgaaaatctgagacacagattccccaaaggtcacaaagtaggtgacagaatgaagattttaattcaagtggtcagtttccaagtctcatgtgttgaccaccataggcctgcttccttgataaggcaacttggaaatgcacgcatcaacctcccgacagctgagatcttcatctctgctccctttcattatacagatgtcctttcacctatctttattcagatctgctccatcagcaagaccttggacttggcaatccctcattcagctgcctccttaccttggacacctcccactttttcacaactacagcccctcctcagcatcctcattgaacctcctgactctttgttctccagggccattcatgcctcattcctgctttcccttccttctttaccacatcaggaggacctgccatggttctaattcatcttatattttacaaccttttaactttactcactccttctgtctggattattctatcatctctccctccatttcagcatattgaaaatattccccaaccttcaaatgccaaaaacaaatgtgatgggatggaaatgtatgtgtctcccagatccacaagctgctttacctgggagatctcaggtcctctctacccacagtacatcaggaaggacttccagtcaggcggtgttagggggagttttatttgaaaatggttccaaaacctgtgaaagggataaagcagaaaaatatgttttggaaacgtccatgcccattgttttgccaagatctgtctggtacctggtactctgctctccctgagacagcatttgttgtactgtttcagatattcgtgtagtttcacatttccagtacgttgaatgcagtcccttaaaacgtgacaactgtgtcttatttttatttgtctgtgataggccttgctttaaggaattagcatatgtaaaatatagatttgtattctatacacaaaagcattaggacccagtattggtgagggtgcaggtaagcgggctggtacactatttctgggaaggtgagctggcttcctcagaacaatttggcagatgcatcaaaagtcttcacgctgcgtgtgtgttggatactagcagctccacttctaggaatttatcctaagaaaccactatgaaagtatgcatgccacatcaacaagtttatttgccaaaacgtcatttcaaataatgaaaagttagaaacttacagggtgcatcaaagattgttcagtaaacacgtaggtacaaaagtacatatagtactgtcccatttttattttttaaaaaagtgcctgtgacaaaagattatctagacgtgtgtgtattagtcattcagtcgtgtctgactgtttgtgaccccacggaccatagcccgccaggctcctctgtccatggaattttccaggcaagaatactggagcggtttgccatttccttttccaaaaggaactagataccaaaatacaaattgcctctctggatggtggggtcatttgttgttttaactgttttttgttaaggagggtttttatttttaaacattaaaaaaaaaatttcctgcagtagatatgtattggttttatgaccagaaaaatatttaataaactcataaatcccattttgagaacaacaaagataaattgggctgtgactgctttccaagatttattatggaattctcttacacttacacttctcttacatttatgacctgtgttatcaaaacaatataacaaaatagtcttcagcatcagtatcctagaaacttccaagtgaaagtgaaagactctcattcgtgttcgactctttgcaaccccatggactgtatagtccatggaattctccaggccagaatactggagtgggtagcctttcccttctctaggggatcttcccaacccaagatggcattatttttttaaagagaagtaaccttcaaatctccaccaaagttgctacatttcctttttttccagaacaagaagtataagtgctgctgaaaatgagcaaaacttggaatgttttttagcaggtaaaatgtttgagggttgatctatgtgtcccaacactagggaccccaaagataaattaatgagtaacaatgcaaattatatatgtactaggatgacattaaagaacagcagcaacaataacctcc

SEQ ID NO: 25693 - DNA, 1497 bp, Bovine  19866881023329
tgacctcacatcctggaatactgtagagcctgccttccccattaacataacacttagggaaaccaagcttcactttgctattctaataacaattgcctacgaatattctaaacataattaaaggtgttctcaagcagatgcaggggggaatttatctgtgatgaacacaatttaatttcagtgtgcaattaggagcactgttggtttatttgcataggcatgaatagcaaccctgtcgggttttgcatttagcagggttgacctgctccgtgtcagacggaagaatgtgactgtgtcatttttatcagggctttcggtcggtggacatgcagttggcattttgaaaagtgagatggtgcttggcgcttgactcattatgattcagaaaagtccttcgttctctaggctttgttcagtgtgcttacaaatttttagggcaatgtgtggaatttttatctaatgtgtgtgtgtgtttcctcctcccagagcgctgttattgggcctggcttctaatcataacttgaagggagtttctcttgatctcagcaactgtgaggtaagagcacctttagactatgtactggaatagataatagtctgtaaattgctttgtctttttcttggaaaaagtgtaattctgtgactccagagggtatacatgaaacaggaaaatacactttatagaagtttctgatgttctgtgttttgtgagttttatctaaaaatagttatggaacactattcagaaagcactcaaatgtgcttgtaatgaccttttccccctccctgtcttcttgccagttgtttaagtattttgtgatgacactttgagttaataagcattaaactagctttaccatcaagagaagtagaccgtgaagcattcctcatagaggccagatggatacagcctaacttggacttggagaatgtgaaagggaaggtctttggtcattaattttgctttttagtatcttgattttaaaacaagaaaattaagatgcttatcaaaattataacaactccaaacactttttctatccaactacacacagaggagaattgaggctaaaagcttcttacatttctagagtgtacctgaacttttgcactgtcttgaaacttgtagtttgtgtggaaattagcaagaaaatacctcaggacagactgtccagcctcttcagagctatgctttacctaccatgtcgaacctggtgtcttttctcagggctagagatggaaggctcttcattcctcttcttgggtttttatgctcactcttctctcttcgcggtacattcctgccatgtccctcttcttccccaaggctcctctttctttgaggatctagttcaggtccagcctcctctgtacctgcatcagacgcgtactattcgatcctagtttggccataactagctatgcagtcctgggtgaattagttgatagcactacctctcaatttctgtgtctgaaatgaagacaatatttgtgcct

SEQ ID NO: 25694 - DNA, 1762 bp, Bovine  19866881177877
gaagattttatgaaaggggcttccctggtggctcagaggttaaagcatctgcccgcaatgcgggagacctgggttcaatccctgggtcgggaagatcccctggagaaggaaatggaaacccactccagtactcttgcctggagaatcccatggacagaggagcctggtgggctacagtccacggggtcgcaaagagtcggacacgactgagcgacttcacttcactttcactttcagagaagctcctagtctgtagctgctttaacataagattcataggactatctagaaacctcccagatccatctttaaggaccaagcctgacactgagcatctaaagaatcctttctgttctgtgcggtgcctgccagtgaaactcaatgtaaatgccttgccgtgggctcagtctcctttaaagcatctccttagtcctttatctgttttggacacctctggtttatcttgacaaacactctgtgagccctgtcgcctcacactgttctcacacctactctgccctcatgagcttggcatagaaaatccattttaagcttggatttaaacagaaattttctttattcattcatttcctcatcgacaaatggggaaatctcacctacctcacagtggggattagaagaaataatagtcaacggttccaacataaatggtgcccaaatgttcttttctctccccaggcccacagtctcccaacctcagccccaacgttgcttttttttccaattctttttttttattgaagtatagtttatttacaatgttgtattaagtcctgctattcagcaaagtgattcagttatatgtatatatacattttaaaaatatttttccattatggtttatcataggatattgaatataattctctgtgctatacagaggaccttatttatccagtctgtatataaaaagttacctctgctaatcccctcccccttcattctctaacattttatagtttatgaccctaaatgtcaaaagtacaaaattctgaaatattgaccgtaccaaacagaagctggaagagatacacaatttataagtctcaatttcctcttcttactcatcagtataaatttgctcagtgacagattaactcaagaaccatcatttccaagaatttagatgcaaagacacaatataaagcacacagtagcccacatcaacaaccagtgataatttttattgccgcctgttatactagttgccaggaatttttttcgaaaatcttggatgtttgctttaaattagtaataaaagaaaatatgaccggctgttgaagcccatatgctactccttttcagaactacaaaatgctcattcagagttggtttgtacacagcaaggagcagccggaggggagccagagaactcaatgaaaactcaactgtttagaaaactagtaaatagaaaattggagctgtgtgtctctggtttcttctcatttaaagccccggatgcaaatcaagttgatccttgaattttcattacagtttcactgaagactcaaatagaacctctggttaatgatttctgtgctacaaatctcagcttcatctatagttaattctcagaagctttaagcacagttgaccgctctgtgctgcttgaaataatccccattctcctggttctcctctcttgtcactggctgttcttcctgttcctttgctggctccagtgctcctctgaatgttacgttacctcctggctgggctttcaccacttttctcttccttt

SEQ ID NO: 25695 - DNA, 1929 bp, Bovine  19866881225387
gtcccttttgcttgtactttagaaagggggccagcagcacccggcagtaaaccaagggcagaaccccactgttgatggtgttaccactctgctcaactcggcggtcatggcatcagttctgtgtcaccacttcccacagctgaagcctccacccctggctgcactcacagctgccccattccagtattcttgtctggagaatcccatggacagaggagcctggtggactacagtccatgcggtcgcaaaagagttgaacatgactgagcaacaaaacactttcacattatggccaagggaacaatttcctctctgaagcaatttgaatcctgtatacaacctctatgcaggattaaggaaaattttattctaaactactgaattataaagaaaattgtaaatggttataagaaatagagatttaaatttgagtaagatcttcattccttctctttagccattctgattctcctcaatgtaatatatacatagtataatatatagagatctatatggtgaatacataatatcctctagaatataaatggtttttcatcttctttatctttgatgagcaagagattttcaacagagcatttatgttcattacctgtggtggattcattttgatatttggcaaaactaatacaattatgtaaagtttaaaaataaaattaaattaaaaaaaaatatatatatatccagaacctgaccacttcacaaaaaaaaaaagaacttatgtcaacaaatattcaacccttgatatcaaagacaattgtagcttatacttctaaaattaaggttaaagaaatctaaaaattctaatctccagagttaaactcacaaaatcaacaccttagcagaagatacctttaaaatgaccgtaaggttgtaaaacaaaagaaaaaaagacctggttttgtcaatagtcttaaccacaggcgacaaaatggcagttgttccccctctggtaacatgacagggatccccagtccatcagcccagccttgcttactgagactggccaagacctcagaattctttccagagcagcatccaggaaacaaatattaagctgttggtgatggcatcttactgtcggtatcagtctgtgttcctttgaaaattgcaggatcttctggctaatttatgctaaaggagagttataatagctcataaaatcactaagggggctgaaggtacacagtctagcctgaacttctcaagaactgggagctgtaggcagcaggctcctagaagcatcatgcctctgccatgatcaggaagcttctgagtttcatcctgccctgccccttctgattttagcagaattaaagccactgcactggcccaaaggtctacactccctccacaaggccaacagcttgctctgcccacttgctccttcaagactcatatcagggcaccagccttgtcgactcttaagtcatgtgaggatctctagatgtgggatacttgtagctttccaccctacacagcaggaaggtgccttgcaggagggatggcagtctacagttctgcttcagcatctcacaatgaacctgtggcgttagatacaggaaggaagcatggaagaatcaagaagaactctaagatataacagttgggattggctaatgttcatccagcactatctaggagagaaggtgccccagtgagatagatgtccagtcctttgtagaggtgaacctctaaagagaggagagagaagctctgggccattgtcacctgccaaagcatggtcaactgtcttgcttcctcaggactggaggatgaatgtacagttttcagtgcttcacctggaaaagtctctggcaagccagaatgcattggttgtcttaactcggtgacactaaccatcagtatcagtcaactaactcaaggacttggttcagattttactctcac

SEQ ID NO: 25696 - DNA, 1126 bp, Bovine  19866881243897
gtgctgtagagaaaacacaagtgtgaggggtgatcgtggtggagatgggtcagaggctcttcaagtgagctgaatgaggccagccgcgaatgaggaccatccagtgaatgattcctttgttccatgatgaaataaaatactagaaaatgttcttgtaacaaagagtgttgtttgccaagagtggacatgatgtagtgaagagcttttgaaagctttcatttggtgactaatattttgactcagtaaaaaaaaaaaaaaaaaaaaaaatatatatatatataaaccatttttaatcacaaggtcttcatgtgtaaagaaggtaattataattataaatactcagtaatgttcaatgtggtaggagggaactccactggctgtgactgcactgctgtgttctgtccccaggacttttgtcccctgggagactcgatcttgaatatgttacttgtcgaatcacagtcttttattctttatgcataggatgatcataggggccagtatagtcccttgatcttcctagtagttctgcctttacatattcgctttactgaaaaaaggtggcccttttttctgtttcttgactgcttttcttagagtctatacttttgggaataggtttgcctattataaatcattgcacttactttataagaccagagaattttattctgaggaaatctttgtatttagcacttttccaataaatgggccattgattggattttaataaccattttaatgaatgagttgttctgttgtgaaagaatttcacacttaaatcttatttattcttgggttgtgctatatttgtcttttgcaaattacttaaaatgaaaggaattagcacatacgttttctacgaaagtggtagttggtcaatcatgtctgatttcttgtgactccatggactgtagcctgccaggctcttctatccatgggattctccacacaagaatactggagtgtgttgcgatcttcccaacccaagggattgaacccaggtttcccacattgcaagcagattcttcattaaagggtgacttcattgtttcagaatttgtgtctctaccagctttcctcctcccatagagggttcctaatgggtgcagtgttttagtagaat

SEQ ID NO: 25697 - DNA, 1076 bp, Bovine  19866881401072
tctagagctggaaggacttgttccttttctgcggaagttccatgtctctgagttcagctgtcatagcctcctcaccctttgtctctcaagttctctgtatgaacttggggtcattatctctttctctcccagacttcttttgttttctctgggtctttggaacagttcctcagggattccatttgccttcacctctcccctggctcctggtggaaaccagttgggataattgagctgaaatgtagggaaaactgtcccggaatggtgagctgcacacaactcctgttgattaacatggatgtgttaaaccagctgttctggagcctggggccttgggtgttgggcccaacaactggtgccagtcttaggcaggtcatctgtatttccagtcacaaaagatctttctgtcacgttggagaagactgaaatttataagaatcagtgggccattgaaaatgacaatgggtagcttagcctgaaagcagatgtcaccagctagtggcctgaagcctgttctgatgtgctttgagtacccagggtttaaaaaaaatgaaattggtcaccagtatttacagattgggaggttttggtcacacatgtcgattccatctgctcttgagaacttagaccttggaatcaggcccacgtctgtgcctgacatggatcagaagagctggggactgagtgcttccagctgagaccagtctctccagtttgcctcagtccccaaggcgccctcaagtccagtgttggcagccatttgtcgttgtcctcaaggttgtttttctactcagccttttttgctcttttacaaggcttccatgtacatctgagttccctgactcttatcctaagtgatcaggacgtgatgtgtttgaaagtctgttatccttgcaaaagctcaagatgaggggtgctcttatctaagaggcattgatggtgttcagatcaagatacaagtaagaggaagcatgtgtttaaatggagcacataagggatcctttggagaagtgaacaagagatcgatcaactctttagtcatatcttaggtacaatcccttctgtttcagacagga

SEQ ID NO: 25698 - DNA, 952 bp, Bovine  19866881510436
atgctcatttcgagctatacatgccctctttcatataaacatactctgctattggcaatttatacaagtttgctcatggtggttctgccaccagcactgtttcttaacgtctatatttttacatatttttcagggcccaattcaaatacaacttccatcatgaaaccgtcactaaacaatgcggctgaaagtcatctcttctttctctaagctttcaaggcacatgattacagctctcctacagcatttatgcctttcctttattttagttactatacatataatctctcccctgctaatataggaattctatgagagcaagacctatttgactaatttttgaaagactcacagaacgcaacacagtaccaattacagtgcatttaattaaaaaaaaaactagaaagcaaatgtggaatgttagcaaactcatatattaagaaaatatcaatgaatcaaggatcttatttttgctaatttgtttatatttgaaatgtgtctaaaaatttaatttataaagttctttaagactatttaaaagaatctgtaagtgaggagtaaatatttctctaaatacaatgttttattttgttttaaagccatcatcagggagctgtgaaaaaattagttcattcttctttttaagtcaattaaaaaaaattacttacatgaacacacaaaaggtttctcatcatttgcgtatttggaaaaggaataatttcttggcttttaaacttcactcttgatttcttcaacattatagctgtgaaatatccttcttcacgaccttcaggtatttgtggaaaagaatgtaggctgagaggtcaggggtattttgcagtttaccccaagttctcctactaaaaattctattttaacaaacaggtacagattttaaatggatctacatgttaagagtaaactattacttcagaatagttgaagatggcca

SEQ ID NO: 25699 - DNA, 1132 bp, Bovine  19866881529515
acaaattaagtggatatctatgtcatgttattaggaagagtaactacaggggctgagtatcagaagcataccattctcattaagacttgtggtatttcagagtttgggaatacactcagccctctcccttaccacttctgcatccacggggcccacatccctgaccatgtatattacaaagttgctgagtctttattcctattggtggaggtccaaacgcatggcctattgcacatgataaaccactaatgaattactaatcacttttcttgtgtttcctgtaaactggagctgagagaggcctcagcaatagtttgtttttcttggagaaagaaaaggtaaaaccttttaaaatgttatcttcgattttcaacccacaagtcagcaaaccccacctccctctctgttgcttctggtcctcagaatacaattcttactgaggtctcaaacttcctagagctgctcgctagaaacagcacagaaatggtggttggccgtctcgaagcagcaaaaacaggagacctcagccctgtacgtgtgtctcttcggcacaggaaactggctggacagagggcaacccgcaccgcagataaatcagcttaatacacacagacctcaggctccaaggctcctatgacagaaaccatgctgggaaagtcccctttaaaggcaattactgctcctaagagaagtcagtcctctctgcatctgtactgaactcatcttccccaggtgtctgcagacagaaacagatgcacctttttcttaacataggaatataacgctgtgttagctacaaaaacacagaactcttttaagcatataccttagcgtcttaccccacctttactcctactaacaagcatctcagtgaaaagagttttcgttctgtgtctcgaaaaccccaagaagacaggtcttttctatggggacacacctccaacccagtgtgaaaggacaggaacacgctattctaacaagagtgagttttgtctgtaactcccaccaactctgcgggattaaaggattcctgtagacgtccttctgtttcacaaccaatcgctccattatctgtcctttgagcaatagcgaaagaaactccgtttcgaggatccgttcaggaaaccttcgg

SEQ ID NO: 25700 - DNA, 747 bp, Bovine  19866880115906
acataaacaagcttaaagagctatctatgcttttggatatatttctagataaaatattaccaaaaaatattaaaagaaagcctgtactaaagaggttatgcaaaacaggatccattcaataaggattcatacagataggcaaacccagcaatgcctgaactgttatccaagcaaactgtctcaaaaattaaaataagcagttggagttactacctcaataccaggacaagtaaatgtcgtaggagtactaatcctggagcacctatatgttctttttttttttttaattttattttatttttaaactttacaatattgtattggttttgccaaatatcaaaatgaatccgccacagatatacatgtgttccccatcctgaaccctcctccctcctctctccccataccatccctgtgggtcgtcccagtgcaccagccccaagcatccagtatcgtgcatcgaatctggactggtgactcctttcatatatgatattatacgtatttcaatgccattctcccaaatcaacccaccctctccctctcccacagagtccaaaagactgttctatacatcagtgtctcttttgctgtctcgtatacagggttattgttaccatctttctaaattccatatatatgtgttagtatactctattggtggttttctttctggcttacttcactctgtataataggctccagtttcatccacctcattagaactgattcaaatgtattcttttt

SEQ ID NO: 25701 - DNA, 1587 bp, Bovine  19866880346175
aactactctataaagaaagtagtgttattgtctgcaattaataaactggaaaactgaggcttagaaactttgagtaatttggttaaatcttaccactagtcatagcagaactttgaggaaaacataccctagtctggcccatgaccttgacaactatgctccactgtctcctgaagactaagagtcaagataattgaaggtttacttagaattttgcactgacactttcactgaggtttacaagtaactaagagacactttagtttgaattttgagattgacatgttttgcttaccattctgcacgatagtcattttctgctgaaaagaatgatttacttgtataaaagaatgacctgtgattggcttattgtcagaaacaaataaaaaaagttataataaacatgacaggttattttgaaggtggtgaaaacctggaatcaggtgcagtattaccttttttgtatatgtatataatttcatttaccttgtctggagcatccatttttgtctgttttttggaataataaatagagttattttaactgagtgctaatgtggtgagtgccaggtgagaaattcaattgaaatgctgtcacaagatcctttttgttttcttgacaagaggtgtcatgttcccttgaatcctgatacatgggagtgtgaactgataaatagtttggagatgaaattgtcagtcaccattatcacactcaagcaattatcttttctggtggcttacactgccatgaaatgcaagttctggggtgtgaagcaaatagaaggaaaaaatatgaatgtgaccataaattggaagtgcttaggttagaaaactgatactgcaaaggggcttaaacatagggaggaagatttactgctgcttctgagactgagcagaggaaggaagctaggaagagggagaagatcagaggtggatcgagcagaaagctaaggaaacttaatctttagtgtcacttccatgatgaagatcattccagtgaatgcaattcatcccaacagctgtatacttttgtaaaatttgtgcaagacatgtaacagcaatcaattaagtctgctgcctttttctactctgacttctcttccattacatttctccttcttttgagtggttttggagtgaccctagacattgtttgaggcctaaggaaatatgagtggagaatatgttttgttttcatgtaatgaaatatatttatgtgatccacatcattacttcccatatatttaagttactgtttcctcactctggcataagaatagcttctagaaatactcctgttgcccactctgccaacttgattgatgctacgattcataggtgtgtggccaaagtgaaatgaatatgcttaaggtgcccagcatctaaagtatgtgtgcagtggaacaaaacaaggtttaagatataggcagccagaagccagtctatagaaaatttttctaatcatcagatctgtaaaactgtaattgggggatttggtttctatcagtattctcaactgtcagaaatatagttaacaatactgtatataaattaatccagatgtatttttgattttcttctgttgga

SEQ ID NO: 25702 - DNA, 3279 bp, Bovine  19866880385736
aataataaagcccttaggggaaaaataattccctaagatgctataaaatgcccaaataggatgaaatcttctgccaagatttatactgactttgaggtttgatataagcaactcactgtgccttccacaagacttaggaaaattttattggcatttattcaaataactgaattaaatggaaaggagcaaatgtgagagtcaacagatttaaattgcaccctctaactacaaaggaaggtttgcatttgtttatttagatgacagtccatcttggtgccatgatttaggatccaagagcctagtaaagtgagatagcagtgctcttgaattcaacaagaaggcaacatgtttggaagagaatattcccaagctgtgctaatatgaaaacatctgtcagttacagattaattttctccacagattttctacctttggaaacatctgcagctgaaatgtatttctctaaaatgtagattacagaggtcaactagtttatcagccattctaagaactggctgccttccacagtacacagatatagctgaaatagcaagcttaagtgcaaacccttaaaaccagagcaaaaagcagttgggtgagggggaaagactttcaaaaagaacacattagtactaaaataattcagtccgaaactcacttgaggtctgccacattatttcaatagagtaaaatcaacctgttactcattatattaaaggaaagtttacaccaattttctttcccacatacatttttctagcaaaaacatactttttcaaatttaagtaaataaacaaatgaaaataaattgggcaaacaaatgcactttgcagaatctttatttgtaggtttatacttaattattcagtgttttcaaatgcacatgtataataacaagttaggaaaatgtaaaagtagaaatctatccaaaggtctaattaaggtgaaccttaccaaacaattaacaattgcaatttattttagactgagatttaagactctgtagggaacttgcacacaaacgtctgaatttttggtgatgtcatcagaatataattatagaagaatctatagttcttattattttaatattcttattaaaagctaaatttgctgtgaagcagtgccctgttgcaattaacctccttcttatctattcttctaatcattatcctatctttttttctgattcctttctgcatccaactcttattgtcacacacacaaaaaaagcctcttataaagcctctgtgtatttggggatcctgttatctaaataatttgtagaaagaacattttcttaaagcttgaaatgttacactgtaggaaggattctaattgaatagaactcttgagaatcctttataggtaaaaaatatgagtgagatagaaaggaaaggtgagtccataaaataaatttattgttttaagaataccacccattttttgccattatgagtattttctgttgtttttatatttactggatatattacctatcgttttcatagaactccagaactttaattttaggctggaaatctaaatatgcatcaaaattaataattaaatattaactccccaccttgcactgctgtgtattctttattgtggaaagaagatgtgaagttgtaagcaaagtgctaacagccataagcatagagcctttgtcaaaaactcttaccctcttttaagttgaaggatttatgaagaggaaaaagaaaaatatttaggcatacagccagaattgaaggcagcaggttatcttggtaggaaactgcaaaataatattttaccagagggtaaagcaatactttgaaaattttcattgaagctataaggttctctatctgtatcaaagtgcttggagatcatttcaaaggagcttaaaaataaataattgaaaaaaaaaagttatttagaaccaaaggtcttaaatttgaatagagaacagcaaaagagaaaaatcaacaaaggatatctgttttgtcaaatctagctgtatatgttgttaaaggatttattctggtaaatagttgggaacattatcatttttatctctagacatacacctttaaatggattaaaggaataattttgttaaccctatgaggatggtacaaaatgtacttcatgatgaagccattaacaaagtatgctttattaagaaagctatcaatgaaaagatgaaagattataagatttctatatgtgaaaattgttattttttattatgaaaacatatcctcaaggctttccaccttgatgtcagcgtgtgttttgaaatacaagaccttaaatattcctccattatgaaatactgaagtttgaacttaaaattatatgcttctaaaaatattactggaaaggaaatttattttatattattacctatattggtaatcttgaaatatttcaagacaaggcatactaaaattaacgtatttcgctgtgatgaaaaggtttatcttcatatagaactcatatgaaagcttcagtttctgaagcaagttttagaaataacttcatgctgaaatttacattagtctccttaatgtttctaaattgggccatctgaaaataaacgacaattttagtctttatatactttgtctttaaatgaaaaaaattcaatagaaaaaaagcctgaagttttattcagtgtttcatcttatgatagaggaaaaaaattatacagaccaaagaaatgttgtgaatgccatgtcaaaaatttgacacttctaagacttttgtgaaatgctttagtaaagaacaagaaaattatgttaagatttgtcatagagaaaaaaattctttttaacttttgataaattagaacttttttttattcagggatcttaaactcttgaataagggagtatattgtataatgatcatggtgcatttatctctccacctatggtgtcagcgtaagggtcataaggaaaatccacatttccataaatgtctcctctggttgattgccctcactaaaaatagctgagcttgagctgacactctggtaggtcttgtcttattgagggcacccttagtctttaaaaacaattatcttttcttaaagatcagaccctgtaaatcctgacagcctatttccttttcgttgtcattttatattaatgaatggggggaggtagggggagacgtcttttatcctcactttggtccttggtctttatcccagggcaacaagaaaaagaggtaatgctcaccactcatcattcttcacacatttttataatttctttgatgatttaaccg

SEQ ID NO: 25703 - DNA, 1525 bp, Bovine  19866880412468
aaaagcactaaaatgagactataaaaaggattgaatcatttgaatgatactttaatgtcaatatcttgccttaaaattatatttttaccaaaggtcatgattacacaagtgtttatgagattcataggttagatatttgtaccatatttccaaatttagaatctttttagatttgattcctcaataaaggttaaaatacaagttctcctatctcaagttattgatactagaatggaaattcagtgaccctactgaatcctatttttcctgaaacctgaaatcttgtaagtgaatgtaccttattgcttgtattctctgtagatgttgacttgaaaagtcacacataatgagagcattgctgaagtgataaccctatcatttttatacaggttcagccaatagtttcctgatatcaacaatagattcaacggctagaacaagtgactctcctaaaatcctatgacatctatagtgtgaaagtaatgaacgcattgctcaagagaaatggtgtggtagaaatagcagatatttactatctgtctgacagctctcaataataggaagttgacaggttcaatacctaaatgaattaattgttctctattaaatatagtaaatataaagaattatgtataagtgacatatgtataaattcatatatttatatatatatatgttatatatataaagtagtttactgtagtttactatatatataatatatatatttatatatgtataagttcatatatagatgtgacacagatggttcattctctggtgtattttagtgaagtgtgtctgtcagtcactttaacatcctagaatttttaagatttgtgaacatatcgttttaaaaataagatgcaggaagatagtatagagttatggttaaaacaactgactctggatttagattcccttgttttaaacctagttccacccatcagtcattaataagttatttcatgtttgtgcctcagattctccacctgccaaatgggcaaaataatagtccttaatatgttataggcttactgtgaggaatatatgagaattgtgtgcagttgtagcagatagcttgcccttgataaatgtacaaaaacattaaatattattactctatgtaagttgaccttattgtagatgttttcatctaaagttatgtgataatcaaattcttgctcgaaaaactatcatactttttttgcaattaaagaactccaaaaaaagatgatacatttgtatgtccttgttaagctaacatagagttttagtctttgcatttcaagaaaaaagtattcattgttttgataattgggaccgttatgtaaaaatactccaagaagtcatcaaacagatgtgttctaaaattttattaatgaaatatgtgcattgcaaactttgaaattttcattttgttcaactttaatgttgaattttaactgtcatttttttatggaataaaaatgtgaaaagatatttgcttatgtaagtactgctgtcagtatattttaagtagtgt

SEQ ID NO: 25704 - DNA, 834 bp, Bovine  19866880439309
tttcccctaaattttgtataggccagatatcaaaccagtaacaagaagaagcataatatttccattgtatatgtgaacatttcctaatagcaactattaatatgatgtttcaggaatatccactcaagaaaccataaagatttaacaactgtgtagaaaagtgattagtcaacaagagtctttctgaactacatgttcatcttctcttcaatcatttaaacagcccatcagagtgatgctttgttagaaaagaagggtaataacgcatgtgatgagtatactgggcaatgacaggaaagagactcatccccaggggtgggcactatctatacgctggcatttgattttagaaagcttgcaaatgtatttgattgaagagatgaaaccttcccaaatctgtttcctgagttcagaaatacatatcttcctcctcatgtacatttcttaagtattttaagatttatgagcaggttaaaagtgttctctctgaattcacatgatgcttcctttcatataaaaaaatacctcagctttggcaatagataaaacacattatacagcacatgagagggtcaggtaaattcaactttgttgaatgacctgcctcagctcaaacctcagtatcttattttgttcttggaacaggaataaatctaaatttgattagtttaaatgtgtatctttatattttaaatgtctggatagggtgttatctagaattaagcatcaaaaataatattgattaggacttccccggtagtccagaggttaagactctgcacttccactgcagggggcgcagattgatcccggtccgagaagttccacatgccc

SEQ ID NO: 25705 - DNA, 1422 bp, Bovine  19866880442214
aaggaaaaatcagttgtaattttatttgagggaattgtaatcatgtgctctatttccaaataaattagaacaagaacttattccattgccatgagagactacttgtatagttgagtatttcaaaggcatattcagactgccgtacaccatataaacacaaacaggaagttcacagtatataaatatgtacacaaagaatattcagatatattattgtgtactataagaaaaaaggactagaaatcaagagatctgaggtcttatcctttcctgtgcttactcatgtttaaaattctagacaaatccattttttaatggactatagaattaaaaatttaaatcagggcaaagaacaagtatgtgagtttctgtgctcccacacacgctagtcaccacttagctatcagggcattcatttctgctggccagaatggcagtctcaaaatccttttttgtactaggctctaggcagttccttcaactgacttgaatttacagcaaatacaaagttcattggtcatctggtcaaatgaccttaaagcttccttttgtagctaatttttaaaagtacattttctttcattccaaaaggatttgcaacctgaaaagaactcatttacattcacgtgtatactagcaaaataagtgcaaaaagtatgaaaacttctgtacctttaatcacagatatatatatacattcttttcctcttcctcttctcctttttatcctttcttcttcttctccattcccttccttcttctcctctcccttcctcctcctccccgttcctcctccttcttcttaaattacattgattataaataggcaaaaatagattttatttatattctccagaaaatttcacaactgaaactttccaattcctttacaacatagaaaattggcactgtcaggaaaagatgtttctttgtacttgacctaaatagagagacatacactatatttctattcttaacattttataacacagatttcatttatttacattctgtattttccacaaaagaataaagttagcttgtgaaatatacatagacttatgcactttcctacttttttcttttttctatattattaaattttcactgagtatgcaccatccagaaacgatattacatttgaactacattcctcccatagaacacctttcctaacaatgtatatcactgcatcttatgttttatacttatcctctttttgagtgaccagtctcatctgtacattttcctatgtccttaaataatgaggctatttccagcatttcagaatgagtaattaattgcctagcctggaatccatctgatatcaaagtattaatgcctgaattaattttcaacttataactgttttcatttacacctacttccttggtagttatttaaggcaatttcatcttaagt

SEQ ID NO: 25706 - DNA, 2110 bp, Bovine  19866880443746
tataaataaggaaggaaatgtagatcattagaaacttccttatcattcctaaagcataatcaagtgtcctttctggattctggtttatatggtactatgtaattcatgtcacaaataaggcatctgtttgatagatttcaaccaaaatttactgaacacttgctatgtgcctggcgctacactaggaacttgagctttcagtggtggtcaaatgctgagatggtccctgttgtcattcacttaggggatgcagaataaatatctgaaagaatccatgaaagaatattatgcagacagaatagatacattatgaccatccacctcccttcaattagtgttgttgtaagccaggaattctctcctccatatatagtactcaagagcatgaacttttagttttaataggcccaaaccacttgttaagtaaatggccatgaaatatcactttgcctctgtgtcctggtttctgcacatatgcaatgtctgttaaaagaaatattttagcaggaatattctagcagaaaaacctatatctgattctgttctacttccaggcataggggatatttaggccaggttatgtgatttatttcaaccaatgagattttgagcagccatatgtggggcttatatatcaaaacatagaagaaccaaaactgtattctctttccctctcaagctgaccaaggagaacatttgttctttccaagcagtaaaataacatgacagttatcctgatctctcagggaaatatagatatgcatgtggcaagacaataaatattattctaattccttgagattttaaaattacttattacttcagcactgcctaatttattttagattagatgaagcatttgttgtgtttagcacaatgtctcagattcagcaaacactcagtaaatgctagccttcactcatgacatagacggtttctctgaaaatgcttagtttattttcctggtgtttaggaggctgatgttctagacatttgtcttgtataaaaactctcttattctttgtatggggaagctatcaacttctctccacacagactcatgtgaaatgactaactccttcttttatttaaatcactgtacgttgacaatatttgctgtaccaaaggggctcatgttattcagctccacaaagtcgcaaataatatatatttgaaaacaagtggtagctgatgtaagcaccagatggctcaaacataaaatcaagggagctgcttttagctctaccccagggctcttaaagccgccttctcagtcctcctttatatgttgtagtttatttctgaagtgacaataaaattgggagcagcagaatggaaaggagcaccacggcctcggcatgttttaacaatctgctatgcatatgagatgaaactttgccatcaccagaatcaacaacatcttgacacatgattcaaacgtcaagaatatccaagaatgtaagatgtctttgaaacagtgacaagaagctgaagtcaaatccagattggagtccaatgcctgacagaattttgtcttctcttttctgaaagctgataaatatagagggcagttttgaccttgggggctggacccctaggaaatccatttttataaacccttgcattggatagctgcatagagtgaatttagtgtgaaagtgtctcagaaaagtgttatgccctaagaagcaggaatgtgcctactcagatatgcaccagctatggaaaggctcatgaggcagcagaacaggccccatgtcaagaggagagctggtgggactattctagtactgttttgctacatgataaattatctctaacttattggcttaaaacaacaaactattgttatctcagtgtctgtggatcagaattccagaagtggtttagctaggtggttctagcttaggtctcttatgagggagtagtccaggtaataactgaggctgtagtcatctgaggtttgatgagtctggaggactttttttcaagagcattcagagtgttgttggtaggatacctcagtcacttccacatggccttttttagctgcttgtagcaggccttttcccaagctattaattaagggggcagtgggtgaagcactcaa

SEQ ID NO: 25707 - DNA, 1318 bp, Bovine  19866880452140
ttccctgaggcactgcttcattctggatttcattttggctagataaggatatactaaaggattttaataacaaagtgatgacatggagtcatcactataaattcttgtaccatataaatagggaagaaaagtaataaatcaattgttattaaaggaaagaataagactgatacaaattttaaatctataaatccatttctgcacactaacattaaatacataaaagatatatctgcctagttaatggaaggaaataattttaattattataaacatatatatgatatatataaacatgcctattataaatattatatataaaatatcccataaaaaaggagaaaaggcatttaatgtaaatgtatttaagtatataccaaaatccatagatgattattcttgtcacatgattaaaaaacatcaccttagtcatggaacttccaggacatctttagatgaaagagtgagatcacaatgataccctttgactgatttaaaactaataatatctggcatattaaatatcttagttgaaatgctagcatcatatacaaatcttatgtcaagtttggttaatattttatagagcaaagtgcatagaaaatagctttgaaaataaaatttctgctttaatttttctggagaacagaattattttaagctaaataaaatgtatttgttttactaaacatactaaagatataagcatgcatttacaaaatgcatataaaatggatataccatcagatcccttggaggaggaaatggcaacccactccactattcttgcataggaaatcacatggacagaagatcctggccaatcacagttcttagggttgcaaaaagtcagacatgacttagtgactaaacagcaagaacaaattataccatcacagtgtcatcaaaagtcaaagatgtccgtgcttggtgtacaaaggtgaatgtgtgcttacatactagtaatgtgaagacttaacctagttttctggtcttttaactggctcactggaggcttacatactgtgaattaagtttagttgtttttatttggtctaaaaaaatccctgtgcttaacagaaatttcattgacagataagtctaaaaacgggaaattaataaaagagaattaatcatagcatttcaagaaatcattgatatatcctagcctaaaatagttttttcctgttccaatacatacgtcacaagttattatcaccaagtgtacatgaaaatataatatgtaaataaggcttatctaggaaaaagtagtgactttttataatttaatatatattttggaaagtgtactatataa

SEQ ID NO: 25708 - DNA, 1580 bp, Bovine  19866880455044
atgctaaattgtgtccaactctttgagaccctatacccattgcctgccaggctcctctgtccataggattctccaggcaagtatattggagtgggttaccatgatcttctctaggggatcttcttgactatgaaagaataaagcttgcatattataaaagagtaatgcttacaagtttgttttaaggtaggagaaattccattggcaatccatatggagtttgcaatgttatttcattaagtacttataaataatatctataaaaattctccttcaggatgtaaaatgtagagccccatgctatagtatagtaaatttcttttataatgctagtgtctgcgacagcataatgtccatggatgtaggtgttctaagttacattcagggagatgtattatacacttaaaatggtgattatgtaggtagggctgacttcatagcttgcccaggtattatatttcaagatgctagaaagggaacaatttccctaaatccttgcccacaagctaattgttactctcatactacaagtagcttttctaaaccatggaaaagtatggtccagtctctcctactaagtgatttggataaggaactggaaagtggatgtcagaagatatcttgtgaacactagtctaggctgtattctcaggagctagaggagtagttgaccatgaatatgcaatgttttgcaaaggaagtaagaatttgggagccatgtagctcccatgagaatttgggatacatctcatgtggatgttttatacctgtggtcacagtgtttctgcaggaagggctggattcaagaaaagtcaagtccacaacagtagacagggaaaaattggattagagacaaaaataagttcaccttcaggatcctgtggagcaggtgtgagttagaaactggagaggtctcttgaggtaatgatgtttctaggaaatgaaaactccaggacccaggagaggaagaaagtcttaaggacgtaacacaacaagagccagagagtttcaactttaaaatgttataccatttatagagtagcatgagtgatgaaaaaaaaaatctgtgaaagactcaaaaggtaatatggcaatgaagagaatgaaaatgatcataaatggagaagtgaatatatgctgaacttgagagctccggataacacatggtggatgataaaagatggagaagacaaaaaaaaaaaaacctcaaagactaactgaccactctaccatttggcctttgacagtagaagtgattatcctacaatgctgctaaatatatggaggagtgggcaatttataatatactttaagcttcagttcagttcagtcgctcagtcacgtccgactctttgcgaccccgtgaatcgcagcacgccaggcctccctgtccatcaccaactcccggagttcattcagactcacgtccatcgagtcagtgatgccatccagccatctcatcctctgccagccccttctcctcctgcccccaatccctcccagcaccagagtcttttccagtgagtaaattcttcgcatgagggggccaaattacctggagtttcagcttcagcatcatt

SEQ ID NO: 25709 - DNA, 2477 bp, Bovine  19866880461188
attgtttcttctgggcttagccaagcaatgtccctggaaaagccatcgatagtgaggctgtttgatgatcttgcagaaaagattcatcggcaatatgaaacaattggcttggacttcacagtaagcaaaatcattttttaaattcaaactttagtgcaaacactgctttggttaaaatgctctgatttttcttgtctatttttcagtaatcattttcttggcatttgattctttttttttttttttaagcattttatttctctttccttttaatgctttagtgatcattactgtaaatggcagggagaagtagaaagttgaagcatggccaggagagaactgcgtggttttctaccaagaggccacaaagtagattacattgttggtatttgccgttattccctgtatatctgtgggctcatttttctgaaagttggttctgttttaggaggtcagtttcactagtcaaagtcacagaagattgactacagggttcataatttatagtgaaaattaaaattggatgatttgacaaatgaaaaagtaagtatcgggttcaatagagctaagatgaagatgcagagcagattatcatctaaaaattttcaaatgcctatttacacacccaacagaattggggatgggtaagagatgtgagtacagttgaatccccctcttttctgaaattattttgttttacatctgtcctcagttttaaaaacctctgctctaaatgtataccttttttgcaaaatatactctatttgtaactgtcagattatactttctttttaaatttttttttaaacttgagatgtaactcacatacaaaaacctttttaacaaaacagttgtgtgcttataatcacaatagtctattctcagggttgtacaaccatcagtactctcattctggaacattataattactcaaataaagaaaccttatacccaataatggttgcttcccatttccccatacccctgctgctgctgctgctgctaagtcgctttagtcgtgtccaactctgtgcgaccccatagacggcagccctccaggctcccccgtccctgggattctccaggcaagaacactggagtgggttgccatttccttctccaatgcatgaaagtgaaaagtgaaagtgaagtcactcagtcgtgtccgactcttcgcgaccccatggactgcagcccaccaggctcctccgtccatggaattctccaggcaagagtactggagtggggtgccatcgccttctctgttccacagaggcaagataaaataattgtcactagacgtactcagagtaggagaaaatatttttttaaaggcatgattcattgggaaaacatggtcttgtgtaatcattaaatccatgcccctgtctcaaagtgtatagggttcacaactgtcccttcagtactgattttgaagcccattttgactgacatggccccatgcatttttcctggccatcagatcacattaacactgcataccatttatcaaattatgaagtttcagagaaatgaaggtagttattagtgagaaaaactggcatctattcattcaaaataactaagaaactgcataaaaagcgattgcaggaaatatacaacaaataatagcgctagttccaacagtgtcacttgtactaacaacctttataaaaatacctatagcagatttatttcagtagcataaacactgaagagtcctttgacttccaagaagatgaaataatatgtaggtcatgaatacataagttttatttctataactgaaagtatttcaccacttcaagaagtatttatgagacaaattactggaatagtacagaattaaatttggctttatatagcatctttcatacctcaagtatctcaatagctttttgaaagtacagaaatgcagtgacgattggaaactgaagaagccattatgcatttaagggcagatgatataggcttggattcagagacatgctttatgaattcagggaacaggatattcttccactcattctttataagttctgtgtcatctttatgttttacctgaactgcaatcaaggacaggcagtggggctttagtgcaatagctcctttaatcataaagtaaactgtccctaggttgtagggacagggttgccagggaagtcccaccataatattatatagcttttattataagacttgaatttctcaaaccactgaccctgtaatgataagtaaccctggcatagaacactctgtaaaatgccatccgatctccaggatataaataaacttacatttaatttcataggaagatgatagggactggaccaagtttttattccaagatggtcaagaaatggaaaagttggagacaaattggtttttcctatggtggaattcaatttataccaggtggagaaagatctaaaaaaaaaatacctgcagctttttcaataagacgggggaagagaaat

SEQ ID NO: 25710 - DNA, 2245 bp, Bovine  19866880477066
acttttatggacagaggagcctggcaggctacagtccatgaaacagcaaatagtcagacatgactgagtgacttacacttcactacatctcattttttaggaaaagggtctttgacatgacactcatcaaacagtacagtgcctattatggttaggaggtcacttttatcccagaatcccatcatgatgatgtttcatcttctgtaaccaattgcctacactagaaatcaatgatgttggttgttcattcaataatagtgttttcagtgcttggtttgtagcatatatagtgtaggagctagggatttcatagtataaaaaatagcttcaggaagctgctgtcacaagcttacattctagtgatgagagatgcataataaataaaaaataataatagtaccaatctgtcttaatgtaattaacaaataatacctgatattaacaggaggaggagggaaaacaggaggagtagtggtgataggctcctatggaaataaatgatacttatttttggatcattttgtttctactcattatgtctgaaattcaaacctcatttgtaaactttgtgcattgataatatgttttgaacaatttcatatggctgcgtcactgacacctcaacaaatatacaaaacaataatctttgtcatcttcagatgattttaatgtaaaaaaatgatctttaaaaaattatctgtgttcaaatcagttacttatatattatatgaagataaaatagacattttaaaacactttaacactacttgtctatagtgatatgatagtgatggctatgtattaatattttctttcactattctctattttatgccttaatacaactagaatctactaaaatcttgttactctaagtcttttcccttcaatgtatatttttaaggacaaattaatatgaaacaaaacacctacattttgtgtgtaataattctgtacatattgagagatgagttaagcaaataaatgtttctatctttagcttatataattgtggttatagcttaaatcttatgtttcctcttaaaagttattaaaacatgcagatattcttttcccacattaattggagccctgccctcattttccagtacatagttgactaccctgaaagttaaataactctaattattaagattcaaaacattccatgtatcagtgaaggcaattaatgtgatttgaatattattaaatgaaaatgaactatttctgtttcaaaaacctaaatagatatgcttagggatttttacattgttaagttgcctcaaaaataattggacaattcaatataataaagtaaatgcaataaataattttaattcataacaataagtaacatgcttatttgcatgattagggtaaagaatgctttgtacaaatactaaacagagactaatggggaaacctagattattatacttctaaacacattactgtgattaactgtggcataattccactgtagcttcctgtgcaagagttcttaagcctctcctatttactgtgtgaggaaatggccatatatcacatcggagaaactgcataggacttccacaggatttcagactcactggcataatatagagtttggttggaaatacagaaatggaaaactacctaagcagtcagtgcatcagcaaagttttttttattggttttatataactcaactgtttttcttcactagctgtgttttctctctagccctttagaaagacctcaagtacccaatggctattcttttacaaggacatagggagaagtgcagggtcagaggagaattagcaccagtgacagtggaccattgaaagtgaaactgaccttctggacacttaacgaactgggcatacacaccgaggaaaccagaagggaaagagacacgtgtaccccagtgttcatcgcagcactgtttataatagccaggacatggaagcaacctagatgcccatcagcagatgaatggataagaaagctgtggtacatatacacaatggagtattactcagccattaaaaagaatacatttgaatcagttctaatgaggtggatgaaactggagcctattatacagagtgaagtaagccagaaggaaaaacaccaatacagtatactaacgcatatatatggaatttagaaagatggtaacaataaccctgtgtacgagacagcaaaagagacactaatgtatagattagtcttgtggactctgtgggagagggagagggtg

SEQ ID NO: 25711 - DNA, 1808 bp, Bovine  19866880504227
attcaattcataagacctaagtgccaattagctaaatgagaaactcaagcatgatacccagtatttaggcagaaagaggctcagaaaagcaacagagctctgcagctgtaggctgatctgcaaggacaacaacacctgggaaagacatgacccattgaagatagtgttgcaggttgttagggcctgagtagggtgttcgagaaaacaatgcaaaccttttaaagggaatctataaataaggttctgtttggaacataggggacattatttttaataatactatgttgaaagacattttgatattcaacgtgttcaatttcatattacacattaggtaaatttaaaattctttgttaacaaaaagactgatctggttatgaaaattttagttcttaagtctaagaaatcaatgacagctaaactattaactttccaaatcaaaatcttagtgattaaaccagataaatgcaattgccttgtttacatatcctatctgaatctctgtaaaagttattttgttaagtacattcaactacatcttaccctcctgaataaatatacctatgcattacttatttttgatcctccatagtgaaagtgaagttgcccagttgtgtccaactctttgcgaccccatggactgtagcctaccaggctcctctgtccatgggattttccaggcaatagcactggagtggattgccatttccttctccagggtatcttctgacccagggatcgaacctaggtctccctcattgtagacagacgctttaccattctgagccaccttgatcctccatagttcctattaaaaatcaatgcatgtggtaggtatttggcaaatatttacaggaaggatgaacggatatttggagagataaatttaagttttcccaggaagatgaacctggaaaaattaaagcccagatcatttacttttgaaatagaaaggaatgggaaggttggagctaaatgaggaaggaactatcacatgactgaaaaacagattgatgagtagtaccaaagatgatgaacacaaacatggtgatattcactgtcattgctattatttttgcaacgcttctcagtgcacagagcaccatatcgttagaaaggttttaagatattttctgaaccctcatcttagtgtaattgtgcaccatgttctacaactacagttgttgaacccaaaaggagccacaagggtcctttctggtgtcttttcctcagagaagtaatgagtgtaccgaaatttagtgaaaaatgaaattaagcggttcagtgcctaactggaacttagtaaattagtacactgactcatgcggaggtcaagcaataattttacaaaataattcctgaaaataaattttcacttgtcaactctgaaatgtccaatggcttaacttgactgtagacttattatttaaaacatccccatcatttgttatgaaggtaatgcaaggataatattacaatgtgcctgtctcctggttgcaaatgaaacaaaagatgtggtcccttgagatttgctggagacaatgttgaatgatgtattttataaattaaatctttactacatcaaagtgtcagtcactcaagcatttatttaattttctggtatacagaagacaagctcttccattattgtcccaggaagcatctttgttgcatgaatgagctcattttttttttccttaggtcccaaccctgttccttggatgtaggttattcttgagggaaattagacttcatgtttttcatgcaaactagttttttaattccatttaattttatatatcacttta

SEQ ID NO: 25712 - DNA, 1858 bp, Bovine  19866880537857
cctggaaagccctttagaaagtttactctttgcaaagatatatagctaaaggtaccatatatatgttcactgcctaaaggaagagagaattaacctgctactctaaatagtgaccaagagtgaaaatttgatgactccagctaagtatacacagaacatagaaacagccagttaatgttcaaagtttaatattttgtcaaattctattcctttcataggttatttaagaaaatgaagttagcaaagatttattgaaagaagataaatattctttggtaagactgcactctatctttgaacagataaaaatctcttctagtgttcctttgttgctctttgtaaccctatggattggaaatatcttcaagtgtccttcacctcaatggggtattaataatacataggtttgaggaaaagatccttgagaaattcttccaagtttctgtttaggtttctatctgataatgttcttaaatattagcctgcgtatttagtaaatggtattttctacagtgttatataatgaatatagatcatcttatatttgatataactagattataaaagctggtacaaagtcctgaacttgacatacctatttagataatatttttaaaaaattattggagtatagttgctttacaatgttgttttattttctgccgaaaacagaaaaacaaagcaaataagctatatatttatacatatttcccctatttttttgatttccttctcatttaagttaccacagaacattgaatagagttccctgtgttatacagtaagttctaattagttatccattttacacagagtagtatatatatttgtcaatcccatttcacctcaccccctcctcccctcttggtgtctatacatttgttctctagagaatattatttaatgtactataagatatcagttgctaaacctcttctctttaaatgaaaataaaatagtttctagatgaattctgagagccagattcatcaaaacttaatgcacaatagcagtctctacatggcactgaaacaggggtttccctgatagattttagcatttgaagcatagaactcatatttccatgtaatatgcctgaaattcttatatgtctgagacaatgtacttattacctagtcaaaagattggctagacagaaaatgggaagcatgtgctgaagagagagttgcacatagctctatcagtgaatggaaacaaatgtctttactatttgaaaaattgaaacaatatgaccattatgtcaaattaaatttcctggcttactcggcaatttcagaagcatttatcatgataatgtatgaatctcgttgcatatattgtcttggatatatatacaattctaagaaaaagaatctatgtacaacaagttactattctatcctctcagtgacaatgttttgatatgaattttatatattttctacttacacacacaagttaataaacacatactcacacaactccattcagggaagatgaaacccaaaggaaaagagagggaaaattatattcccaaagtgcaaaccatggaggggaggagtatatattctgttttgaagttacacataaatattcaattaacctatttctcctgtcttttttatgactacatatggtgacaaatcttcctaataagaagggtcacagaacaacagatgtgtaaaatagagaactgaaaatatctcaacagatgtctaatttttattttgcatgaaatgattaggaatgtggaaagcacatttggcaaaggatgctgctgctgctgctgctaactcgcttcagtcgtgtccaactctgtgcgatcgcatagacagcagcccaccaggctcccctgtcc

SEQ ID NO: 25713 - DNA, 1775 bp, Bovine  19866880559722
gtgagaaagtgacataaattggagctataaaatttctgcatacagcttcatatgagaaaaaaagaaaattgaggcataagatcactctaatctcatattagtgaatgatctgagaaaatataaagagggactttttttcttttcttagaggagggtcagagaagactttatggaagagaaaaactcagaggttgtcttttaaaattaagaatggctgtaatttgaagaaaaggtatcaccaagttggagtaataacaaaatatcaactaatagatggaagggggagaatttaacttttacttaaaagaagaagatgcgtaaaacaatgaaaagagataaacaagacaagaaaaaaaaatagccaaaactgataaagaacttgaagcttgcagtttgtaatttgggttcagttttgtgtgtcaggggagagttttgagaaatggaatgacatgatccaagaggcagaggagagataactctgtcagagacatatgggactgatgagaactgggagatactgaggcatgagagcctttaaagaaaaagttaaagtcatttagctaacaaatgaccaagttctggatccaatataagttcatgtcaaaattgcatttgattaatatttggagaaagacctagaaaacatgtcccttgttaccagggacatcaaagcccctaattcagtcattcatccatttaagaaatacctgttgtgtgtcatgtgtactagaccccatgataggtactgagttcaccaaagttaataaagatatagccccactttcaagatacttatggcatactggtatggttaaagccatatcaaagttgggcagaaaagtgacagtctgaattaaattatgtagaacatgacaaggcagtttgacaatcaaaaatatatttaataaaaacctactatggtatgtaagcactataaaggctattgtaaaataaacagctcaatcccagtcattaacagcctacaccatgtctagatttggaagacacaaatacacaacagattaaagcaagacaacctttaatctaatgacaaaggtctggtacagataataagagtttatgtgagttgagagaccaaccacatgactctcagggaagacattatagagtagatagatattaatctgcactttagtggaccagttggatttgcatccagcttagacaaaagtctaacaacatctagggatgaaaaatgagctcctcggaatagcagtttggtacaaggaaaaagacatgagcttgcagtaagatagacataagataaaaacatgtatatgtgtgatgtgtgattttgaatagtgatgtagcttttttagttagccttagttacatttattattaaataggaaaaataatgagagcctttttcatattagttgttatgagaattaaagaaaacagtatatataaagtcggatccaagtatgcatgtataaaaagccaattctttcactaaatctgcaattaaaaaaaaaagaaaaacttgctagacaacaatctatttaaggatagagcccctgtctctcatttcctcttttccctagggtctagcacaattcctggatcttacagggactatacttaagttcagttcaatttagtcgctcagtcatgtccaactctttgcgaccccatgaactgcagcacgccaggcctccctgtccataagcactcccagagtccacccaaagccatgtccattggattcagtgatgccatccagccatctcatcctctgttatccccttctc

SEQ ID NO: 25714 - DNA, 994 bp, Bovine  19866880595071
aacagtaaggatagggtagaaaaagatgaatatttacaaagtgtctatattgaaagtggattgcagcctgccaggctcctctatccatgaaattctccaggttagaatactggggatcttcccgacagggactgaacccaggtctcctgcattgcagccagattctttgccatctgaattcccaggaaagcatatattaataatattgatgtcaaaataatgagtaaaataatttctattttcaaggaatatctggtctagtgaaaagacagttatctacctatttaagtgctctatcagctctttatatatatatatagtttataacaattctttcataaaatattgagagatcacagggggaaaactcttcttggggagagtgtcttcctggggagacatgagggaaaatttaataaaagagaaaagagggcattctcccatgaagaagcacatgattctagataactgttgtactattcatttatccttttgttttatccatttcatctaacaaacaaatcctctaaatcatctaacaaatcctctaaaatgtgccaggtatagtgattagcaagatttcaatccttgggcaaaagaactcactgtctaatatacctcacatcatggaagcattgaggatgttctaacagctcttagagtatgcaggagaatacaaagacagctttcaaagagtaaatgcagcaatagtgagataaacagaattccaggcttgtaacaaatatcatcgacctatccatttatccttttgtccattttaacatttttaaactgtctatgtgctaattgcttttttgaaactactctacaaatccccaagtcctagttcaaatgttaactcctctaggaaaaattcagaatctagaggaaatctttaatgtaatgtaaattaatttacttttattcagtgttgatatcacttaggatctgctgccatatggtttccattatcatgaaatttttaagggtagaa

SEQ ID NO: 25715 - DNA, 1745 bp, Bovine  19866880638738
ctgtggaattcgatggaggggggatctttaagaggcatttggttacatgtcatgtattacatgttctctgtttaactgccattgtaggagtgaataatttaacatattacaaacacagttgcatgaaaaatatgggctctttattttctatctctgagcttatcatactcccaaatcccctattttatagagtagtgggaaaatttaagcttaccaagtcaagtaactcagtcatgtttactttatagtgatattaacacagtatcttctggtacttgcagagtctgtcaatgtttatgccacatccccttctctaagacaacatagcccctggatataaatattatcttaagtgtgctcatggcagaaggaagacagattcctaaatcaaagagttgtcctttgttctttcctccagaaacttcttggcttccttaaaaatattccttgctctttatgagtattcacttccctgtagtatatgctattgaaatttgtgactggtaaaacttggttgttttcttatcatgactggtaatctccatgcccgctctgatgacttggctcattctggcatcattcataccataaattatttaaaatcttagctacgttctccatatgggcccctgcccaaagcaggctttctggctttctactcttagctatctctgcgtcatctcctcaaattatacaaggacattctgcatcctttctatagcacaaaggagccaaaggagatgtctggtaccaagacttctctcaacataaatgtaccatactatcactgtcctcagctcagcacccatacacacaacaaaggtgttgctgctgattctattacgtaataccttcccagaagcccaaagaaaaaaattgggacgcaaattcttcttactttaacttccaccataaagtgtacattttccatttacatattttgttcccacctttcaaggatgaccagggtgggactgggcagggcacacagatagaaatgattaacatcttatctttatgaatattgtataggcaacaaaataaaaaacagacaaataggatggcatcaaactaaaaagcttctacactgcaaaggaaagcatcaacaaagtgaagagacagcctatggaacaggagaaaatacttgtaaatgatatatcagataaggggttcatgtccaaaatatataaggaactctaacatatcaatgaacctgaacatgaaagtcgcttagtcgtatccgactctttgcgaacccatggactatacagtccatggaattctccaggccagaatactgcagtgggtagcctttcccttttccaggggatcttcccaacccagggatcaaacccaggtctcccatattgcaggtggattctttaccagctgagccacaaatagcaagaaacaaataaaccaatttaaaaattgcaaaagacttgaatagacacttctcaaaagaatacatacaaatggtcaacaaatatataaaaatatactcaacatcattaagcattagggaaatgaaaaattaaaaccacatgagataacagaatggctattaacaaaaaaacaagacagagaagtgttgatgatgatatggaaaaaagagaatccttgtacactgttggtgggaacgtaaagtatagccactctggaaaagagtatgggagggttctcaaaaaactaaaaatagacctactatatgacccaacgaacctcattccatatttcatcaggca

SEQ ID NO: 25716 - DNA, 1077 bp, Bovine  19866880657048
ctattcattcttagagtcagacagcagcaagggtgaggggttcttctgtttcagatggaggaattaatatgtgagggataagttggtaaaacaaagatgatcagatcattaataggggaaagatgaagtaacaattctcaggttacaaacttggatcatttttcatctctggacttccaaatagaacattttaacagctagtgatctaggatccctttgaagtctagacaatgaaataatatgaataaaaatgtttagcaataaatatatcctttaattgtgtatgacatggattttcttgagagcttttttttttttttgctccacttaaaaaatctgctagactacctactttatagggacatgagtgaagcagttctaaaaataccctcctcaacataagctgtgctcacaccaagccagttatcatgacaaatacttaaattttttgtcaatcatctggatgtttacatacacagttccaaacatctggttgttgaaaaatttatagaaaataactttaatagttcattttgttcaagattgtttaaacctaaacttaagatagttaatacttttctaataaaactgacattgctgcatctgaactcttttaaggaattcctttataaatggcattaatacacattgtgttatgcagctctgctcagtcatgtccaactctttgagaccctatggcctgcctcctgccaggctcctttgtccatgggaattctccaggcaagaatactggagtgggttatttcttcttccaccagggaatcttcccaacccagagatcaaacccctgtctccggtgtctcctacattggcaggcagattctttaccattgagtcacccagtaaacccattagtacacattaggcaagtccttattttggggggtataaagtcccacttggtgaggtgctagttgaacgaaatgatgttggaattatcctaacagactctgtgacgctatctcctgtgtgattaaatctgaaaggtagacatcagagagcttagtagaaatgagcatatttggggtatttattttttttaagttgattaagaaa

SEQ ID NO: 25717 - DNA, 1452 bp, Bovine  19866880681450
aaggtatcaggtaatcatgtaggcccttgtaggctaaaatgagtcctttggcttgtattctgagtgagttgggaagcttttggagggttttgaccaagtgacatctgacttaacattttaaaatgattttctctggctgctgagttcagagtacactgatggagaactaggccagtgctaggagagttcctggtaaatattataaggaaccaagcatcacagaggtgactagaaagaaaagagtgctggtgactaatacatacatatatataatcaatgacaacaatagaggactgatttccaattaaatacactgtaatttaggacaaggagattatgtcatttaaaaatggaataaaatattatttcctatgtttatgcaagtttgtttctgttatataacttgctgtataaacatctgcctggctattcataaggtatttactaattaggatttaaaagtgtcttgttccttcatttgtttcccataaggtggctgtgatttgaatgtcctgttgtaaaaatgcaggtagtctgtaaagggggaggaattgggtatcagctaaattcctttacattttcttgccttcacttttccccaattaccaccgagaagtttggcaatttaaaatatgaatctctatcactaacataaattatcaagtctccatagtaataacttcccattaaaatccttgaagttcaggttttacatgatgagctcagagatggctacataaatgtgtggctctgcaggcaacctgtttaatctaatgtgaaagccatcatgccttttataacttacccgcaagaataactggaaactgcagtatgagcaatagagtcctgagctttaaaaaggaatattcaaaaaaaaaaagaataaaaataggaagagtgtattccattgtgaattttggataagtgtatgagaaggacatctcaataatatctctctaggttgttgacctgaaggatccactagtcgaatatgtggtcgtgctgatgcagagagtgaccactgattaccttcacttcagcagagcactagggaaaatatacttagaaaaatggaaatttgaataaaagaaagtgaaagtcaaatcataacctttgatgttaaagagtcaaagggaaagatgaaggctgccgatccaatgctctccaggatattctgagggaaagggagtcctgtgagattctttagtcttccaaggaatgaaataagaaagcaagacttttaaaaaatcaccttattggaaagattctctcgaaattatagggaagcatagaatgttgagaatatttcagatagaggaataatgtatattttgttgaaacctagctggatagatgtaatttatcagagccaacaggtaaatacaatatcatatatttctacagagtttataatgtataaggcattttacatacattccctcataaaaccaa

SEQ ID NO: 25718 - DNA, 1935 bp, Bovine  19866880704431
agaactagagtggggtgccattgccttctccgataggtaagtatagttaactcataaatttatataaatatgtgtaaaaaatgaataattgtagaatagtgaaaaaaagtcccaggatatagcctcctggattaaaataaattttactggaaaacacagcaggaaaaagtgaatatcttagtaaaattctggaagacagacaggttgttgataagggaaaggcaattagtctcacgtttatttaatgtgatggatactgactgctagattatgttgacagtgctatataaaggttttattttcaggtaatagaatagtgtagaaaaggtagctaaagagagtagatattggagatttgcctgatatatttgtttaataaagattaaaacatgatagaaaaacatatggaatatatattcaggtcataaaaccataatcactctaaagaataattattttgatttcctttttccatttacttaataaaaagggaaatactatcatttttctgacaatctgtgatatgtaacagtagtcttaatacattaatgggtttcccagacttgtttgcatagttcatatgaagtatgtattataaattgagtatctattagccctgtgaaatgtaccacctggcttaaacatttttaaacataggaatgcaatattgacaaaaatctggtataaaagcttacaattttcttttatttttaactctaaaaagtgttattatttttatataacaatgttggacacatcagacttaaaacaatttcctaacattcacctgtccccctgcttaagcaaggtctccagaaatggtccccaaggacaatatacacataaaagtgattgattaagaaagtagccagggaagagaacttctcagtcagataaagcacatccatgggtaaaattatacttaattgttaaatattataaagtatctcaaagattgggaacaaaagatggatgtttaaccacttctatttttaatttgttaaattgaaacatagttgacttacaatgtttcaggtatacataaaagtgtgtatatatatctatatacacacatagtgtgtatacactatgtatatatataaaagtgtatatatatacacacacatagtgaagtgaaagtgaagtcactcagtcgtgtctgactctttgcaaccccatggactatagcccaccaggctcctcggaccatgggattttccaggcatgaatactggagtgggttgccctttccttcttcaggggatcttcccgacccaggaattgaaccctggtctcttgcattgtgggcagacactttaccatctgagccaccagggaagcccatatgtaaatctttgaggaacacatgcagattaggggagaatggcaggcctgcaaagtacatggacgttctgagccctttctccataccttgccctctgcatctcttccacctggcttttcctgagttaagcataccaaaatcattacatacaaggatctgcaaaacatgcacaaccatcctcagaacaatcatccatgaaaaggagaaaaagatgggaacctatgagaaaagatcttctgtagctaaatacattaagaactacaacaagacaagtattgtgggcagatctgtgataaattcaaatcccataccccctggggaaaataattatgttaagtgttccacaggagtaagttttgaacccacatcagatatcccagtccagaggtatgccaccaggaagatgaacctctagaatatttggctttgcaggtcagcgggacttaactgcaggagccccacaggaccatgggaaatagtgacttcattcttaaagggcacatacaaagtcttatgtccacaggcatacagggcaaaagaaataatttgatagaagcctaggccagatctacctgcttgtcttagagaat

SEQ ID NO: 25719 - DNA, 1774 bp, Bovine  19866880711250
cttttaaaggtcccctgaaacctggtagagatcagaaaagagacttcagcctcagcacagggccttcattctctctaatgcttcttccttcctatgctatggacttcttggaatccatctcttttctgcccatttttttttcccctgagagaaaataatttatcctttagatgaatgcagagaattttcttaatatctctcacttcattctcttcaggggaaccttccagctttccaattcgtcatcctaaatccaggggacctgatttactttaaaagcatacatccaaacatcatattaggcgctagaaaaccctaccataacattgatgaatgtaactcttcccaacaatgcctatgactggacaaaagactaattcttaagtagttgctgaaaaatcaagaaatgttattcttgacccctggctatatttattgggcttctcaaggggcagagtagtaaaaaatctacttgccaggagacacaagagacacaggttcaatcccaggttggaagaccctctggagtaggaaatggcaaacccactccagaacttgcctggaaaattccatggtcagaggagcgtggtgggccacaacccataggattgcaaagattcagacatgactaagtgtgcacaggtgcccatccccccaacatttattatagaattcttaatgggcttgtatatctatttccataccctcagcaagtcatcaaaactgggagcattgtagggggatgaggaaaatgggaacaagacaaaaatacacatatccttacaggcaagcctggattgagtgaagaaacattaaacatcattttgaagtgccaaaatgaaccaaactgtattccccaatggtctggatgttgtgaatgtttattttgaataaaggactattaaatagtttctggcaccttctggttaaggtgggcatataactcctttaagattttgaacccaaaaaatggttaatgatttgacttattaagaagtaagtctcagctgtgtgactaattatctacattaggctaatctggccttcttttatgccattcaaatgaggtttactgcatagcaaagcctgcttttttttcttttcttttttaaaaataagttgccccacgtagactcatcaaaggtttatcactttctaaacgctgaatggaggaccagataacatttgtattataaaacagattaccttttccttttttctgtgtgtaatatgtatgtaaaaattagacattgaagatcagagaaagactacaatcatctttttcttttattgtggaagtctccatttaagaagtccctagacttagaactagacattaggagaggcgtctgaggagtaaggagtcatggggatgcaaggttaaagataagagaactctgtatgggattttaatccactggggaagctgtcacagcataattagaagaataagctgcgtagggaccatgcagaatgcagctgctcaaccacagcctatgacaatttagaaaattcatcttttttagcctcaaaataaaagcttttcccacatcaggactgtcgggagaatatgtcttctgtaaactctgcatgaagactgatttaagattcctgaaagaatacagcatatttcattggggatatatttctaaattagaatagcttttcttttatagtgtttcatctttttaactcttcagtggtttaagttcttgattttgtatggctcatgtatttctatttttgaaatggtgcttagccaaagtctaaacta

SEQ ID NO: 25720 - DNA, 788 bp, Bovine  19866880719290
caatcttgattccagcttgtgcttcttcccagcccagtgtttctcatgatgtactctgcatataagttaaataagcaggttgacaatatacagccttgacgtactccttttcctatttggaaccagtcagctgttccatgtccagttctaactgttgcttcctgacctgcatatatgtttaaacatagtcaaaaactaaacatcatatttaatacattctaagtctcaatagtaaacatttttcaattaatttttcaacatcttccaaacatcaatgttcatatatatatatattttaatgttcgtatattataaagggcattttattttgtttctagaggttaaatggccatttaaatggccatggcagcatcctgcagacttgggctgactatttccacttcataaataaacagcttttctcctaggactgaaagaggctctagatgtatgtattccattttgaaagaaacaaaatattattaagcatttccagagaaactcactggtggatagatagtaaagttgcctcaaggtccatcggggaagcccagagattatacaaacattatttgtcagcaaatatatattgattgaatacacgttggtttgccttctaattgctatgtttccttacaaggaactctgtagatcagggattttagtttatcaaaagaaaatgaaatggttacagtttgacctgacattctgcatatggggaaatacacaacagagttatactttttgaaagggactttgggcaaggaaagtgatttatagaacttcaa

SEQ ID NO: 25721 - DNA, 964 bp, Bovine  19866880757749
tgaagaaaagagaaagacgtgactaacattccgggcagctattagtgtgctctccttcctagaaaattctaaaccataagctcactgaatattttagacctggaagaaatgtgagggagattatcttctaatatgatgttgtcatttaatactgcatttcctgaattctgagacccatgtttccccctagtgccaaagagattgatgcttttgaactgtggtgttggagaagactcttgagagtcccttggactgcaaggagatccaaccagtccattctaaaggagattagccctgggtgttctttggaaggaatgatgctaaagctgaaactccagtactttggccacctcatgccaagagttgactcattggaaaagactctgatgctgggagggattgggggcaggaggagaaggggacgacagaggatgagatggctggatggcatcactgactcgatggacataagtttgggtaaactctgggagttggtgatggacagggaggcctggcgtgctatgattcatggggttgcaaagagtcagacacgcctgagcaactgaactgaactggcagtcgaaagcattttatttttgcttttggccagtgttttcaaatttccagttgatacttatctttgggattcataaatgaaaaatcagaatttggggaattttcaaattcccttgccttttctataacacactatttgtatgttttaaataataattagtgaccataataataaacagtgaatcatttttttgtatgataggattgtactgggattttcttctttcaaaacaggaaaatgcatggtttattggcactatcaattaaaatgttgtaataacccataaatatctacttgatatagacatttcgtaataggtcacatttagaatgtgaagtaaaaattgtttacaatataaaaattatactaaaatttaatatttaaaag

SEQ ID NO: 25722 - DNA, 1619 bp, Bovine  19866880876223
ctgagtgccaaagaattgatgcttttgaatcgtgatgctggagaagactcttgagagttccttagactgccaagaagatccaacccagtcaatcctaaaggaaattatccctgaatattaattggaaggactgatgctgaagctgaagctccaatactttggccacctaatgggaaaagctcattggaaaagaccctaatgctgggaaagattgagggcaggagaaggggtcaacagaagatgggatggttagacagcatcactgactccaatgaacatgaattggagcaaactctgggagatagtggaggacagaggagcttggccctggcatgctgcagtccatggggtcacagagtcagacatgagctgaagaacacaacaacaatttggtacagccacaataggaaactaatacaacatccagtttcattctctttctgccatcctatcccttctatatctatatattaatataaagagaaaagagagaaagaaaagaggtgagagagaggaggagagggagagaaactatggaactatgagttttcatagtagggaatatgttaatacatgcccttatttattatattttagattccaacatcagcttcttctgcttttctctgctagataatatttaatcttaaaagtgatcttgaaagaattaaataggaggctttagaagttcaagttaataaaggtttcttttagattaattaactatacaaatagagagcagagtgcaaatcagtttggtgctcctgcaggatgctattagaaagaaaatattactgtcattttcactagaatgagatataattttgtttatgtctgctcattcagtttgtaatacacagaaattcagacaccattgtgtttgagtaataacttaatgctttatctaaaaatacaataatgggaaatcctgataaattaaaccagtatctactgaaataagagtttagaaaaaatgctctcatgtgataattacaaaataagctgttgctagcagtaaactttacctgttatatcataaaggcaattaatggttctgctgaaataattttatagctataaaatggaacagccttttttttttttttttttacccaataagaacattttcctcaaatgaaaaaaattagtccaaaatgctagtttccttattttatttctagccaaaggactagtcaattaataattatgtgttgcctgataaagatttcttaatcttttattcctgttctgaatttcaatttatatcagtaccttgaaacagtaacattaataagactatgatgtataaaatgacaatgatgttagtacaatttgcatagttaggtcttcaagtgcagaacttttgaaataagacctattgaaattttattgtaactatcaccttcataagcagttcgattagctccttactatttgtgatcttctgcctattatttgattggattgttttcatgctgttaagtatcatgagctgtttgtaagttttggagacaaatctcttgtcagtctcattgtttgtaaatattttctcccattctataggctgtcttttcattttgtttatggtttctttgctatgcaaaagtttttaagtttaa

SEQ ID NO: 25723 - DNA, 959 bp, Bovine  19866880895467
gtctggaaggcctttttttacacaaggcttatttacgctcagaactctaaatttaccatgtcgttttaacacattcttgggggctgacagagctggaatactttcataggctaatgtaagtggacacacggaagtaccaaagtgcattaggaaaatggaaatctattctgcttcacggttgaatttacccttctccagagactgaatttatttgcatattttatttcaaatatatgtgagttacactgaagagggtttgaaattaaataaatgccacaattaaatgacagacatggcaatggcacacctagtagcctctcataaatttttcttttcataggaatttacatctttcttacttttttgattaaaaaaagtatctgtcctgtaaaagtgactgaaatattattggaaaaggttggccactgacaggtttacttgagaattactgtttgtgttactaatactttttgaagaattaaaagataagttgaatcaaaatatgggtaaaattatatagcttatttttctaaggggttccttttgataaatattctttcctaaatctgtgcatgatagtctattgatgaatattttcaaatattgaagtcattggaaacattttacagatgatcaacttactacttaacggcttcctggtggctgagacactaaagaatttgcctgcaatgcaggagacctgggttcgatccatgggtggggaagatcccctggagaagggaatggctcccctctccagtattcttgcctggagaattcctcggacagcgggtcctggtgagctatagtccatgtggttgcaaagagccggacatgactgagtgactaacacatatttattgaaaaaaaagactttataccatgtatttattataactcaactaaaattctttatagcaattggatccaagttttaaaaatagcttttataatttcaa

SEQ ID NO: 25724 - DNA, 1149 bp, Bovine  19866880944507
caggaaatctatatttacttggattaccaaaaaattaaatcaattacaaatgccactacaactaatgtcttgaataaaagataagaaagaacattccagtattattttgaagagcttaacaaaattaattaggattattaaatttttaagtgaaggacatttgcccttcagctttcacaataaagactgtctttctctaaattgttaaacttgaccatttttacataagtagttgggaaatgtcaaaatgaaaaaagtaaatgtgacatatctgaaacagtttaaggagaattaactttaataatgggaaaatgtgtacaaaatgagaagataaacaatattaaggggaaaagacaccaaatattctttttaaatattctaaactgaatatgaaacattgattagtaattaacaacaacaaagacccaatgaatagtttttaatatttttttgtccattggaagccatcttgatgtttgactttgaattttaaaaaatgaaacaagttctggaatgcgaaaaccagctgctgaaaaatattagcaatacattttctgactaggcagctgttatgaaaggtgaggacaaagggctgcaaacactctttaaaaactaataagtaagcagaatatgtgccatgccagctcatttccttagtcttgtcagagaaaaagctactgtgacagtaaatgaaattttttgactactttactatttttcaacagctatgttttctttccagattcacctcataagagtattttaaacacatgcaacttgtatttttttcccaagagttataatatgcaaaaagtttattgaaataattgaagcttgagtgtgccattaattgtcttctgaaaacatttggaatgtttcactaaaacaagtgggaaattgcaggctttctatttggaagaatataaaaaccatattttatcatctttttactgaagaataattgctttacagtattgtgttggtattttctttatgaattgggagaaaattcaaataaaagttaatagaatctgatttgaaaatgacagagtttagtgatgttagtaaaaatttattctgatggtgagaagcaaataacagcagaaagtttttcaggagatacaaaaattcattaagagaaagagataa

SEQ ID NO: 25725 - DNA, 1493 bp, Bovine  19866880963106
ggaaaaatcacaaataacatacaagggaactcccataaggtaatcagctgatttttcaacagaaactccacaggccagaaggaagtggcaaagtgtaatcaaactgaagaaagggaaaaacctacaaccaagaatactccatccagcaaaactctcatttagatttgaatttattgcaaatctgcccccctacttgtcttgtagattttatgtctttagctatagaagatcttttctcgtaggttccgactttttctctttttcatggatggttgttctgaagactgttgtgcgtgttctgcagatccttgtgtgtaatgattttggtatgctcaactcaggaacagccaggtggaagagatgcagagggcaaggtatggggaaagggctcagaacgtccatgtactttccaggcctgccattctcccctaatctgcttgtgttcacctaaaaggtttacaatttcaaaagattaatttaattataagtaatcaaagtagtccagggcttccttcgtagctcagctgataaagaatccgcctgcaatgcaggagatgctagtttgattcctttgtcaggaagatcccctggagaagtgacaagttacccactccagtattcctggctcagatggtaaagactctgcctgcaatggtaggagacctgggttcaatccttgggttgggaagatcccctggaggaggacctggcaacccactgcagtattcttgcctggagagtccccatggacagaagaacctggtgggctacagtccatgggttcacagagttggacacaactgagggaataagcatatcacaaagttatgttctgggattatgtaattaataatcaaggaacatttgataggtttttccctgaactttggtgaaggagcagatattagcctgaaaaaaagaaaattgctaaccattagagaaaaacatattaaaattagaaataggttgaagacttaaaaaaaaaaaaaaccacctaggtttaaattaggtttgttgtttatttacactatgtttaaagttttatcaggaggagggagtcattaagtatagctgtctcatatttttaattccagaaattgatactgtataccatcttaaggactaagtaataattttactattcattctgttccactgtgtgaaattatgttggcttagagctaggttaaaaaaataaaaaaactatgaatgtgactattatctgaatctgtaagtgcctttttattcattcaagtctgtgtgctcaaatttgagttcatatcacactcatgagatgttttttaatgaatgtgctaccctgaaaaggtgaacgtttgttcaaaacactgcagaagcaaatgcgccccaaatgcaataaactaacagatttgtatgtgcctcacctaagcagggttttgaaaattcaccctgaaggctagaatattgtctttgtaagaatctcagctttcatagaacacctggggatacgagag

SEQ ID NO: 25726 - DNA, 2219 bp, Bovine  19866881041110
taatgttttaatcctgtgaagccagaaataaaaaaatatattaccctgtcataaaaagtttcagtgtcttgtgttaacatcacaataggttgcagatccaatgttacctctcctccaatctggccagaggcaggggaggaggagtacatattttaagttgctttgaagtaggtggaatcaattcccttccatatcagcactcctactaaaaaaaaaggaaaaaaaaccttaattttgtttgtttgtttcctcattgatacctatttaaatcaagatccttggtatgggaagatcccctggagaagaaaatgacaacccactccagtattcttgtctggaaaatcccatgaatggacgaatctggagggctacagtccatagtgttgcaaagaatcagacatgaccgagcaactaacacacacacacactatagtgtgggatatactttgggatagaagattaaccagtaaagccataattttaaaacttgagtgtttattcatttactaatctgttgaccagctaaatgcctaatcttcctgtgctggttggaaatgcaaaggtgagctaacaagactcctaatgattcttaaccttttgaaaactgctctttttgaaggggagttagggacacaagcaattaccacacagtatggtcagttttggcaacgcactccagtgttcttgcctggagaatcccagggacgggggagcctggtgtgctgccgtctttggggttgcatagagttggacacgactgagcgacttagcagcagcagcaacagtgtgtttccacatgaaagggtttgatgccttttatcaggttgaattcctttcgattcctagttttttgagaggttttatcatgaaacggcattgaattttctcaaatgcctttactgaaattatcagaataatcgtgagtttttttgcttattgatagcaatacgtgacattaattaatgtttaggtgttaagataacttgcattcctgggataactcacttggttctggcatatacatttttctgtatgttgctaaatttataaaggtcttaattccaaatataactgtagtgctctataagaaagatttactttttcttctaaaagtaaaaatgctgattcacaatattactgattttgtatttcactcttctatttcactggaagagccttagatatattcattgcataactataatcattaatgttcatgtaacattaatttcacaaacatatacacatattttaacttcttcctcaggataaaacagtataatgatagcaaatgtaagaaaaagatataaaaatacagcgttttatgaatatgccttatatgctgtttcaagtacatcactgattttctcaatttaccaatcacttacatgaaaactgttcatacgtaccttagtactgagcagcagacattacaaaatacaacaatgctatcagtatttttaactgtcaaggttgaataagaaacaacaaggaagcattggatatctgtctctgagtgtgtgacatgaaatttttcttttgccaatgaaaacaaaataatgttttagcaatgtagttagtcactctataaccttatctacactagttatatattatttgcaagacactaaatcaatgttttcatgtagctgggaaatgagtagagcatttctactttaataatattgagaaatactacatatacacaaggtaaatgccatgacatgagttaacactttgaaaatatttgagaaaaacgttgtttccttaaatatccattgactgcagaccgcttttttcttttgttccaaaaaaaaaaattttcagtaagatttattaaaggaagcatcattatttgtcatataagttggccagaaacataattttaaaatgaaaaaaagtatacattgttaaattaactttcatactttggggaaaattctgccatagcatactcaccttcttttacccaaattcccatggttttgattcatctctttaaaaagttagctgagtaaatacatgagtttgcctaaagtctttaggaaatttttatatcagccatagaaatatttcttataagtgggatttctgaaggtttcctcgatacattcagttgtgagtataagggaatcaattttactttcagtacatgtagtataataacattgagtcttagaataaaggaagaatgaagatttcagtaaagaataaaacaa

SEQ ID NO: 25727 - DNA, 1530 bp, Bovine  19866881054612
ctggcatgctacagtcccatgaggttgcaaagagttggacacaacttagtgactgaacaacataatgtgacaaagtactggcctgttactccttgtgcttaatttgtatcaatgcctattcctgtatcttcctatattctcattttgctcatgtaatatcactacttggtccaggtgtatagtgtgcacaaaatgaaatttgccttgttttgtcccagatgacatagccatggaataaacaagatgaagaaatcattggttatcacttgataatgctatgcaatgttgaaaaattataccatttgttacactgaagtgtgtgctctttttaaggaagccaaactcttctgaaattattgaaactgtcccatctccactcctctgaatatcctattttgtggcacagatcaatacactgaagcttcatgattccctgaagggctgttaggacattggtagtgccacttctttatactcaaaacctcttgggggaaaactgctagatgtatcatctgcctagttctgctatattcccttcttaaaccattgatctctgctcctaattctgcttcagcaggaatatctcttaaacagatgtcttctccattttctgtagacactccttaggtcttttgaacttaacagacttacaagtctttaatcctctattcaatttgttctaaaacctttgcttatgaatctatgtaaccagttttcaagacactttccttatttaaagaaatgtaaaaaacaaatccccaaattatccatgtaatatgaaaatgaagtatgattttgcatttaaaatgttttggtttgggttttaatttggcaagggggtgcataatagtattatcaacagatttagttttctaattatttcatagagataagtattcacaggcatatctcattttattgtgctttgctttattgtaatttacaaatatttgcattttttacaaatttaagacttgtggcagggctgcattgtcagatgatggttagcattttttaacaaagtattttaaaattaagatatgtgcattgttttttaggcataatactattgcacagactacagtatagtacaaacagaacttttaaacgtaatgggaaaccaaaacatttgtgtgacttgttttattgtaatattcattttactgaggtggtccagaactgaatctgtgctatcaccaaggaaggctgtaaataagtttatatttcccaatacttatcaactaaaagttcctgtaacttaggagttcaatttacatcaacagattttattgagctcttactaaatgtaaagtggtgctattaggcactcatgaagaattgatgagaactttttctgtatccaagggcttccctggtagctcagttggtaaagaatccacctgcaatgtaggagaccccagttcaattcctggatcgagaagatctgctggaagggataggctacccactccagtattcttgggcttcccttgtggctcagctggtaaagaatctgcctacagtgcggga

SEQ ID NO: 25728 - DNA, 1305 bp, Bovine  19866881096321
tgaaaaatctgaggcagagggaggttaagtaacctgattacatttatatagctaaaaggtagcagagctaggattcaaacctaggcagttggttccaaagtcttgttcttaactgttatgctactcattgtttgaagaaatatgaatcttcatagaggtaagagtaatttttttgtttgctttaggatgtgaagtttttgtaagatttcctactatttaaaggtactttctttcaatgatttcttgatacagatggcccactgaaaaagagtatttttatacttatcttcaataaaactttctctaaaaccacaaagttagtgaatactatgaaatgaatgccactagataccacttcttaaactactttgcattctactcttttttatttgaatagataagaaaggtaatatatccttttactgtatgaagactttattcaataattcaggcaatgcctaggaaggaaaataagtacttatctaatctccacttcagtcatctaggtgatacagcaatacagaaataatttaatatcctctttaaaacttactgagaaaaagagatcaaaagtttactaacaagattaataactctaagttctcatatgaacctgagattaggtaactctgtgaaggccgtaagtattgatagcaatcagacttagtgagttttttatgttaagagaaaaatcatattcaaatgactgagagttctaattatattatcatgaccctcaaacttaggaggaggctattaactctatctgtaaaatgaaaaaatgttatcaatcacataatttaaaccttgtatggatcaactataaaataatttaaagcagactactcaaatgaggttcagtttgagaggtattaaaaatctattttataatttgaccagagagtgttatattatgagattctttaaatacataatcatagacttgcttgaaattgtttcatttagggggtgggggtaattcataatcatctaaagtaattttaagcattttttgattgattacaatttgagaaagaatttttttttttttttaatttctaaaacactcagtttctcagatcagcaaatcctgttttagactaaaatttagagccatttctggaatgagaggagaaacaactatttaaccaacttatacctctttatggatcagcagcatcaacaaatcctttaactcagcagttacaagaaatccctatgaacttttcaaagttaaataacgttagcaactccacttttttctttaaatagccagcaaccagcattcaaaataactgctaaatt

SEQ ID NO: 25729 - DNA, 1327 bp, Bovine  19866881133593
tattttgtaacaacttaaattgtaatatagtgatttaaaaaactattttatttagatattggtgttaaagagttattctaatatagccacagagtaaatttgaatcttacatttagaaacataaagtgttccaaaaatgcccagtcaccatgcttggagattatcagttggtccataagatctacttggcaaagactgtgaatggggtgctgaagaaaccactataaagagacaataatataaagaatgcttgctatgcaataatccctcttaactcttaagatatttgtgaaatcacataagtaagtgacttcagaagtaagtgctcgaaggaaagaagtaagagtatattgcccttcacaaactctcccttcctggatagtccataaatatctctgtcactctcccccagtcacacatgagtatgtacactgtagggctatcagcttcctggtactcccataatgatgacagggtcatgtatgacttggatgggcagaatttggaagggaatgctcaggcatattgcaagaatttgcagagcagtaggaatctggaaacagactgttggcagctctgcatcccttattaatcattgtgagcatggcagatggtcctcgggttattttccaagagaaatgagaacagggatatggagagaggtcttcctcttctactgtcctcattcaagtaagtgagccattaccttgatatttagatggataaataaaaagcttttattgagcaattaatttatcaaacgtcacctagattctaggtactattgtaggcagtggtgatagagtcataaggcaaacttttgccttcatggctgctaagtcacttcagctgtgtccgactctgtgcgaccccatagacagcagcccaccaggctcccccgtccctgggattctccaggcaagaacactggagtgggttgccatttccctctccaatgcattaaagtgaaatgtgaaagtgaagtcgttcagtcgtgtctgacccttagcatggactgcagcctaccaggctcctccgtccatggggtttacatccaaaatgtagccagaaacagatgacagataaaacaggaaaaattaatctgcatacaatatgttacattgagggtcagcaaattaggacctgtgatccagaagggctctaccttctgtttttgtaaataaagtattggattgaaagtctgaatgaactttttgaccaacccaatagtttcagagggctttcctggtggctcaatggtaaagaatccacttaccaatgtagaagacatgggtttgatccctgcaaaagggggtcagaaagatct

SEQ ID NO: 25730 - DNA, 4419 bp, Bovine  19866881150821
tccaaaatatataaaatcatgtgctttcttatagtgttaactgctcagtcgtgcctgactctttgccacctcgtggactgtagcccaccagccttctgtgtccttggagttctccaggcaagaatactggagagggttgccatttccttctccaggggatcttcctaaaccagggatcgcacctgcatctcttgcctcctgcattggcagttcagttcttcctagaaccacctgggaagccctaaagttatatttaaaaaataatttgtgatgcattttacaatgcaatttattttgcaatttatgatgcatatggtagaatgttactatttccccttagtgtataacctctgggttattcatgttgcccgaattcattttcttgtaaagcagatatttttctcaaaaacatgtagttatgatttttgaaaaggtaacttttcaaaatgcatatattaaatatatgctattttggattaaaaaaaaagactctagcatcaaaactagaaaaataagatcatattttcccataaacacataatatgaacaaataggatattatccagtgattaaaaaatgtttagaaaaataaattctgtcttatgtaatggtcttttctgaaattaatatgcttagaacatcaaattcatcttactttaaaatgtcctttctactatttatccagaaaagaaatgaaagaactagattgtatattttagtatttttctaattagatgagtgtgactgactaacaataactcatttcatggaccttgctttactgttttaaatggatgttcattaaggttgtgccagtggggggaagaggggattgtaattgtatattcaggagtattaaaagaacatttcctgtaggaaacatacagctatctacgctttgtttaatataggattagtatagtgctatgcttaatcagggcctattattaaagaaagctacagagactgcagagagtgttaacaagagaacatcaaacatgagggaatgttctgaaaatgataatgaatacttttcagttgtaaagagtctgaagagaaatatagtgtcagtttttaagtatttttataataagagcataagatctcaactgagagaaacttgtatttgaatctaggtcctactcttatcagctcgccaagtgtgactatttcctctatgtaaaattggaataatgtctattttgctagactgttgtgaagaagaagatagctgacatatccagagtagtgccagacatgtgtaagtccttctataaatgaagttagtattagttatactctttttatcagatcttcattataacagttccaaagcagagttgctagtattggtggaggatggaaaataaaaagatggggtttcataaccaaagaaaacactggatcaggcagctctttatttagcatcctcatacacgggtgcatttggtagaattcaattttgctgcatactatgaggtacaacatttatttctgtttttctccctcccttccttcctttctttcttagaaatgttgctaaatatagctatgttccttggcaggggatttaatcaagtctgattttggcataatcttttcctcagattaccacctcagtagtaggtaataatgtatgacacagaaggaattaaacattggttagatttgtttcttgccctttgtttaacaacaagcaaggagtactatatatgaaaatgttgtatattaatgtatactaaactgttggcaaaaacataagtgcaatattgtttagattagagtaataagctttttcaagtagggcctttcctcatttttaacaatctggatctctgtcatcttgatttttccttaggtagtcttgatatacactagaggaaataatgtttgatgagcttgcattgttttccaaaactgtgcctatgctgaggattcacttacaataatcttggttaatgttttatttcattattcttgagaaataataatttctcaaagttccttgtgttatcaatgcatatatatatatatatatatacatatatatataattgctatctgatttgtacagttaacacatttctatgaatccatcagagtaaagagttttataaggaaatgaaaatagaacattgtgaacaataaaactttataaagaggttaggaactgaaggcagtgttgagaaaatatgtgagcctagtcagccacccaaggaaattttgccttgttttctgttaattatctcatacacttgattcataattttataccttactgaaagaaattattaaatgtaacacacattcagccacacacaggccacaccaggctcactatatatcaggtacagatatttgtataaaatctcatttaaacttctcagtaactccatttcagaattaagaaaatgtaaatacaaagagacaaactaatccactcaaggtcacattgttccaaaacaaagtagtctaactctagaggccgttgttatggcgttagacatcccttagcttcaactgtgaattggaagattcagaaaatgaaggattaaaaaaagctacaagagtcattccttgtgggtagaggttaccctatattgcttcttggattggtttgggggaatgacagaggatataagcaaagtggttttcttaatcatccagcctctttggtcaaaatcatgaagttgaacacctaaaaggatgaggtgagagtgaaagaaaaggactaacaaggaagcataggctgtaggctaattataacaataaatgtcattgattaaacacacatatgcacgtagtgtgacaacaactttttatgttgtggtggattgcaaaaatggccagggttctgtactgtccttgcccctttgcaatatgattttgtaattttttgcgttaagagatagaagctattttcccaattctttaatcttggctagttgcccttgttattgctttgaccaatggaatgtggcagaagtaacattttatgccatttctgagctttggtttcaagtggactcagggcatttatttgttctctgtcttaaaacctctaccacaacatgagaaaacactgatgaaaacgcatagccccattatcctcatcaccctagatagaagttaaccagctgccaggcaaagaccctgagaaagtcttggtgaaacctgtcaagtccggcctaaatcagcagatctgctcagatattttataaactgatgagcagaaataaataagccattgaatttttagtgtattttatgcagcaatggataagtgttacatgcatgttacctcctaaaatcttaaaacagcatttgttggtaaggatcaatattattaacatttcagagataacaaatctctttactagcaatgtagcaatgatgagggccagtattttctgtgcagttttgactttatgcccagggcttgttcctctcagaagggaaaatgttaagcaattgtctgttaatgaagatctagatataaatttctccttactttcaattcagatctttaaatcatgaatcaaggcaagttttttgaagcaaattccaatatccatggaaatggcttcacattccaacacaagccagtttatttggttaacattataaaaagataggccaaaatccagaactgaagcaaagctcatttatttattcaacaaacatttattaagtgcctgccatatgctgggtcctgtgtttggcactgttgtgtaattaatttaaaaagaatctatgatttcagaaaaaactttaagctgaataatttaggcagaacaaggcaagttattcataaagatgcagactaattggaaatgtcctcgtttaatgctatacttatgcggcagtgagaatgctgtggatctaaagggaatgcacgtgaagttctaaaacaatttgtcaaaataattaaacatattaagagtggtactcggaaccagatttcttcaacccactctgtagagaagtcagtataaatttggtgcagcattttgtaatacaaggtatagtgcagcagtaagcccaagtcaaatgctgaaagatggacccggctttatatattgccacaggcagaaccaggaatcacacgaagtaccagcaggctagagccaccagttcaaaatggcatttgctatttgtttggtatgcagctctgttttcttctcatcgcctccagctcataaaaacactagcttcttccagaaagattctctctgtagagaatgctaggcttgaccaaccatggagaaataaattttcttttctctcacagtgtataattttctctttctaactccagagaaggaaccattgatagcagttgatggtatttgtcttcagaaaacaaaagggtctgactcagaattttacaagatctaattattttcttattacaaagaa

SEQ ID NO: 25731 - DNA, 1858 bp, Bovine  19866881160509
tgtgggcaggatgtagttaagtcataaaaaccatttgtgactccgcaatgagatgtcccgaaactgtgtatttggattcctcctagattctaccctatgtatttttttcttttggctggttttctgtatactgtctctgtattaacaataagcataatagctttcaataagtacttgagtctttctagtgcattatcatacccaaggatgaagatggggatcctagaattcatagccagctggtttgaagtgaaggtggtcctcaggatccacaaacttatggcttatgtctgaagtgagggcagtcttgcagcgactatttcctcgaactatacagctggttaaactcattgcacagatgcacttctttcttgaagcatcctctaagtccagtctccctcactgatatcctattcttctaattatctacagtagtatatactgagtatcattgtagttaggtaataagcagatatgataaacaaaggtttggatttggggaaccaagaaaatttagtaatctagtaacttcaaaaataaggggaagtacaagtagggaaggaaaaactacctatataatgctatgtaaaggtgaaagaaaaataagatggtagtgatgctgacaagatgatattagcattttcctaaggaacaactgcaataaagaaacagttcaacggttctatcaacatttaatgagcacacggtagacactgaaaatgtgccaccaactcttcaataacgaatacctgataaaaataactgataacctgaaagtaactgataattattccaacattctgttttttgatagaaaattattctagatgcttcctctggctggtagtttactcctttattataatttttcttatttccttttcctatgtaagatgccaatggtcaatgaggggttcctgcccagtttaacagaaagggacaattctaagtaatgtattatattccaagatagaaagagtagtgatgaacaacaagaacaacatataagtaaagcaatatggaaatagggcagcagaaaccagaaggaataatggagttaaagggccagaaatgggctccattggcatctgcgattagtttgggaaaggtagtcatagaaacttagaaaagtcctgaaattagaaatgatgaattgcttcttggtttgagtacaacagcaggtagtgaaagaggggatagaaagaatgaagatacttattgcctagaatatagtgcctagtgtataggcacttctaggcaatatagtgttctttgtataacacatcttcctttcctggttttactttttcttctttgagaactgtaatggggacacaattcacatttccttgggctgggatgatgaaagactgtattcttttatttttatcccaatataatgcctttaggaaagaaaaacatctcaaataggcatcctagagggtcctgaaggaccctaaattgggacaattctgtaaaaacagaatgtttgattatctgcttgttctgttcaaataacactacaggtcctggctgagctagggagatatgcagtagataagtaacaaggcaagaattcattatttacttgctagagtccgatgataacctaccaacagaataaatgtgtaaatccctactttataagcagtcatcacattccactagaccacttcctagatagttaagccacctgcaactttgctaacatctaccctgtatactggaaaattgatcaatcaaaacaaggcattcaattttgattgcttaatttggtttctatttgagcattagcttttatgaattagataaacagagcacagtgtgtccagtttcagaatactatctaactccaaat

SEQ ID NO: 25732 - DNA, 1465 bp, Bovine  19866881175943
tcttaccgaacgacagatctcggagaaggcaacggcaaaccacttcagtactcttgcctgaaaaatcccatggacggaggagcctggtgggctgcagtccatgcagtcgctaagagtcggacacgactgagcgacttcactttcacttttcactttcatgagctggagaaggaaatggcaacccacccccagtgttcttgcctggagaatcccagggatgagggagcctggtgggctgccgtctatggggtcgcacagagttggacacgactgaagtgacttagcagcagcagaagcagcagcaaggacagcaatggcctttgcttctggcttctgagaaagaaccttcagtgccttgttttggcatgcctgataggaagctctttggctggcggtcttggagtagccagatagtaacaaagtggcaggaaagctttgaacatcaaaatgcaacttagggtgggggctttgtttcacatggtatcagctccatcttctgaagggctggatccctaatgtgggcagtcaactgtgtctacatgatggagttctaggaaaggctttggacaccaagagctggggtaagtttccctggttgatgacacccagtgcatattgtcacatatcaataccaggaaagtaactttgtcttgattgcacggggagaagacaacagaagctccatgttcgaaaatttacttggactctgccctatggttttcccttggctgatataatgtgtatcttttagctgtaatgaacagtaatcatgagtacaacagctttcagtgagttttgtgagcccttctagtgaattattaatattaaaactaaggatggttttgagaacccactgaactagtaatagttaaaatattaatatatattctcatttgcaattataactttctttcaccatggtatgtcaataatgaataagtattgttgagtatcagtttgatatttacaccgagaagactatcctccataagtcagttttaacactaaccaaggctattggtgagcattccttatattaatacattgcttaacctatgcagttttaaagcttttttttttttttttaaaaaggctcccttgcttgctattgataatatgaggtaactggcagatatttccaagactgctgtggtgtgtgttttagcagcaaattttgttgactttcactgaaaatccatccttagggcagaaaatttggcagatgcttttgttcagcaggtttcttgacaaccgcatatgaaaagctattttttgcctttcacagggtctggtcaaaggctgaggtttgcttttggtgacattacgttaattggtctccctagaggctgccagaacgctgaaggcaagttagcatttcctgcctcctgactcctctgagtccatgcttcttgcctactcagtgcactgtttatgcctgcagcatggctggctgccaccctccctg

SEQ ID NO: 25733 - DNA, 912 bp, Bovine  19866881250398
cttcccaggagaagacaatggcaacccactccaatgttcttgcctggagaatcccagggacgggggagcctggtgggctgccgtctatggggtcgcacagagccggacacggctgaagcggcttagcagcagcagcagcacttcccaggtggctcagtggtaaagaatctgcctgccagtttgggagacatggattcaatccctgggtcgggaacatcccctggaggaggaaatggcagcccgctccagtattcttgcctggagaatcccatggattctttgtttagcaactaaacaacaatgggtacatttggaaactgggaatgttcttgagtagctgaaagaaacaattcctctaagtcttttccttaaagaatgtgaactgaatggtcccattctgccatctataggtccaattcatcaaatgtacactgtcacttgatcagtaatttagtaaccaaaaaaagtcattttcagatgttaaaaaacaataaataggtatagcatatgttctaatatactacactaatacactagatgggcccgcataccatcctcatagactagaggtagaatacagactttacatgggtgtttctgcagtaaggaattcccttatggctcaggcagtatagaatccacctacaatgcaggagatctgggtttaatccctgggttgggaagatcccctggagaagggaatggcaaccgactccagtattcttgcctggagaatcccatggacagaagagcctggcgggcaacagtccttagggtcgcaaagagtcagaaacaactgagcgactaacactttcactttctacagtaaggatgtaggatggttcatatactgatttactgacagaagtttggaccccttctcattgttttctgttacaaaccatgctgtaa

SEQ ID NO: 25734 - DNA, 763 bp, Bovine  19866881289631
atggttttcaagtttatactccccaagagcataccagttatttatcagagcatagaaaatgacctatatatttttgctctttagttctaaggaatagaaatctaggtgaagggaattcttagtgaaagtgccatttaaagacctttgtagatactgctattgtggaaattactattaaaatgctgagtactttcacttattctatgtgtttaaaaccaaaagaccaaaagaaagagtgttagctatttaaaatccactaatgacaattgcctttgaacagagatggaacataccatacatcaaactcccctgactcctcttacaatcacaggactccttccttctgagcatgaacatggtcttagacgctctcttatcatagcacacctggcagccattgccagtagatgagatttggcactgaagataaagcctatgaaccatgcctgccttaaaggtttgatacattcatatacatagatctacatatgtatatatacaaacaaatgcctcattggagtccagtcatctctagagagtaagatttaatgccaacatttaaaacataaatcatgtcatctaatttttttttttttcctcaaaattctccataggtatctcttgcacttggaataaaagctcaaaacctataacataaccctacatgatttgacactctgccattactctgacttcacttcctaattcttcctcctttggtcaatgtttttcagccagactggcctctgtctgatggccctgg

SEQ ID NO: 25735 - DNA, 1227 bp, Bovine  19866881292464
ttgcaaggctttccttcattgccttaaataattgagaggtggctatatcttaaagagatttttaaattatggttgcactgctactgggctcatatccaaagttaaatactagttaattttatgtgtataagtttatatcttagattttaattattccttttaccagtttaatgaggtttaatttttcgtattctcaaagtcatacaaaggaagttgatattcagctccagcttaccagattacctgttttccccattatgtcttacaggcaccacaggtcaccttctggatcatcccattctggttcccgttcaagttcaaaaaagaaataatgtattaaaatttacatcttagaaaaaaagtccaatataatgcatgaagcatattttttaagaagttggtgtcttatttggtcagaagtgctaaatctgctagtagaggtgcatgcctttcattgcttttcagaaaaatgcagctgtgtttatttgtgatattaaaagtaaatagtattttaagccatgatgtcccaaaatagatgctttgtttgtcattcattatttacatccatttgcttttttaagctataacatctcagctataacaaagtactttgttttctaatttaaactcttgtttttctcatctccaaatatgagcattatctaggcttatctggactttgggcatggaggcaagactgtggtaaagtagttggaaacaatctgtttatattaatctggggaaaggactcagcctgtttgttaacctgtgtcaaagtgattcttactagaaaaagtttaacagattgttaaacttctttattttgaaattccctatgttaagggtgccttagaatcattgtctctatctagttttactttttgcaccaccaagtttaatacagaaaagttttgtgaattgcagagaagaaaggtgttagtttctgcctttttgacacagtgattttgaacaagaatgcctagcagttcatctctactaatgtggttgatgagaaaaacatacgaaagtgtttaatatttttagaagctttgtgtgataccttttacaaattcagttatcacacaatagggtagacagaattaaatcctagttaacgaataaattgaagaaagcttttgaaatatatttctctttgggtataagaccaacagagacaagacattgtgaatttaattgagcatttgcttttgaggtgtttaaacactg

SEQ ID NO: 25736 - DNA, 794 bp, Bovine  19866881325077
aataatgttttctgatttgttttctatacccttttaaatgatgcccatgactgtattgacctttagtgttggcaagtgcacgttggactattgtctttaggaaataggttgtaataataggtccttttcctcctgtcttatctgacattttggcattcatcacttttaaagattgtattggatttttttttttcatgaaagccctacttttacttgccagtagtagagtttgtcattttcccccattcccaaggattcttaagatgaataaaaatattaataaaaatagaatatttagatattgccctcaagtttaagattattttattaattcatataaaaactgttctctgtcagatttattatcccagttttacaagtgaaaaaaattggagctcagataaatttgtggtttttcccaactcatataactgtcaatgcatatgtgctaagttgcttcagttgtattcgattctttgcaaccccatggactccggggctcccctgtccatggggattttccaggaaagaatactggagtgggttgcaataccttcctccagtcatgacccagggattgaatccatgtctcttttgtctcctgcattggcaggcgggttctttaccactagcaccacccccagtagtaaatgtcaaaatggaattccaacctaggtctatttgattccagatttctgctcttatatacctttttttataaggatgttatctttgcaaagttctttgcagtttaccaaatatttttatttataaaaataaatttatatttataa

SEQ ID NO: 25737 - DNA, 929 bp, Bovine  19866881398435
aatcttaatctttatgtaatcgagaaacatcaactttttatgtaaagaagcacgatgcttatttcagttcagttgctcaatcctgtctgactctttgtgaccccacggactgcagcccgccaggcttcatttaaattgctcaaaatatgaatggaagacatatgctgcggaaataagcccttaatcttctttgacatttgattctaaaactaatatttatagttattgattgatgagtatttgctacatcttattgctctacacaatctatgctgtaccattttaagggagatcttctgtttttttaagcaaagtaaaatagcctaggtaaagttacataagcaataggattggaattaattttcaaagttttcactctttactaccagacactccatatgccatctgtggcttgcttagagacaagtattcaaaagtttttattggaacacgagatgcggattctttgacaattactttccataataatttttgtatatctccaaataaatacacctacttaaacacccgccaataaaaaatcttcctaaacaatttaataaaggacactggtttcagcagagccactaaaacacgtgcttctttgaagcaggcattctccagggctgagcaggcaaaaacacagacctcgtatgtttcggttctaaggaggcgaaaggctcaattcttgtggggaaattaaagaccaataaagaaaaaaaaaaaaaaaaaaaagccagaattcctgcaaccaaaggaggttagcgttcggcaggaaaaagtaaaaacaatacggaaagaaagtttgaattaaattaaacaaaaaacaaacagcaaaatgaactaggtgaagcaaacaaatgagttcaagacagcaacgttttcggaacaagagtcagggttctgcagggaaaagtcacgtgggggag

SEQ ID NO: 25738 - DNA, 1834 bp, Bovine  19866881803735
acattacctttattataatctcattctttatgaattagaaaaatacaaacatacatggcagaggcaaagtatgaaaatacttaactaaacagtctttaatatcttcatgtctctatactccactcctcattaggaaaccaaaatccaaaactggctttgctaatactagaatgttgatttcagtaatttctggtcctagaacttctatctcagtccttttttgcagttataggaaaagtcagttgtcccttctcagaggagtcatatgagatttcctggttaatatttgcaaagttctatggtgattaaagggattgtaaaattgataattgttattatagaggctgatatagtaaaggagtctacctggaagattggcagccagaaaaattttaggttggttgaaaaattttaggttagttctcattatcagagaatagctgctttcagaaaatgtatatttaaatattaacaacacttgagaagcaaatactcccagagataaacatatgctttgaatccacaattacttatgcatcttccctgtgcctcctcattgtctatatttttaaaattctgcaggcaaagaaatgaagttcagtctcaaggtcattggagcaactgtgattttattattatgcccattgaatacactatagaaatgtaatttaaggcattaatatgtacacactaaataaaaccagacagtctgtgggaaaagttattaatggtgctggaattttaccagtttgggaaataaataatataatgtgtgtatctctggaaacaatgcaaactcagcctactcaatagacagacacagtaaaagaaatctaagcaattctgtaattctatgaggagggtaatttcactgatgacagctttccataattttacttttagatagcaaataattttccttattctttattttattgctattttgaattgcactcgttggagtttcaccttttaccaataattcttcaggagatgtattttcactgtttttcatatggcagttactgctggcagtacctagttgaaaccaacagaattacaactctcttcaatatccctacatgacatgggtaatatttcagtttaatccaggggcatgaattgagccaggaacaaccatttcaatttctactgcagtttgtttaggcttaacatggactagctaccataccctctctcagtgaaccacattaaattgcttacagagacctactcagaaagcaaaaggcatggctttactattctcctgacatgcttttgcctaataatcatgaaagctataaaaagaaatccaccacagatgcccttgaaaagctctatactaccgcccaacgaccaagttcccacaagggaagttaaaaagctattaaggttacttcacttttatataacatatgtttagtacaatttttcttaaaaaaccaaagggtctcatctataataatagatcaatcctgtgcagggcttccctggtggctcagtggtaaaggatccacctgccaatgcagaagacatgggttcaatccctgagttggaaagattacctggataaggaaatggcaacccactctcgtattcttgcttggaaaatcccatggacagaggagaatagtgggctactgtccatggggttgcaagagttggaaacaacttagcaactaaacaaggcaagatttccctttaaccctgtgtgtaataatatgactctgctaccttacttatcatgtaagagaccgaatggatgcacaatgattaatccatactctcaaaagttctagaagggcattagtttacaaatgactgactaatgtaa

SEQ ID NO: 25739 - DNA, 2003 bp, Bovine  19866880290468
ctcccactagctttgttcatagtgatgctttctaaggcccactggacttcacattccaggatgtctggctctaggtgagtgatcacaccatcgtgattatcttggtcgtgaagatcttttttgtacagttcttctgtgtattcttgccacctcttcttaatatcttctgcttctgttaggtccataccatttctgtcctttatcgagcccatctttgcatgaaatgttcctttggtatctctgattttcttgaagagacctctggtctttcccattctgttgttttcctctatttctttacatagcggcaagtgctaaggagacgaaacaaagcagggagggggaggtgagatgctggggctggttggggtggttaggttttaggtcagacaaccaggacagacctcactggtgactttggagcccctgtgagctcctgaggtcaaggacattttgctatcactcagtcctgtctttcagactttcatcccccgcctctgcctgaagaagacccatattgcctggagaatgctccccccaacctgggctacttggtccgcatgcagggaggcatcctctatgtgtatgacaacaagaagatgctggagcgccaggagccccacagcctaccctaccccgacctggagacctacacggtggacatgagccacatcctggctctcatcacggatggccccacgtaagtccccttccccctccatgaccaggtgagtccacctctttctgcaggagcactgctctgtagaagggaccagggcaggccttctgctctgggctttccctcagttaaaccaccgcagagagggctttgtgggtttctctcttcccagtgcttttgggcttttgcgacaatttttcttcacagactggcgtattcttcgagttgctcctgcctgtgccttccgcatgcacgggtgtggagctcctgcttgccggtggccacctgtgcaccttaaaatgatggtcagccctcaccccaggccggacagcagcgatgcagagagttaccagcccagggctttagggtagatggtgggggagccgtgaagactgttgcttccggtgttggtttttccatgtttctggagcagggagtgcagggcagcctgggaactctgagccacaactcccaggatgcttctaggcttagctggagctaccctggcagggaactgtcttcctgagttcgggccctcgctcctcagagagcatttaagggaatcagcagtggaggttgtgcatgagtgcccagcttgggggagcagaggaagctggtcacagctgagggacttctctcttgtccttctgtttgggttttgctgggagttgggtgacgccagtttctacgggaggagagtgggccccgaggggatggacagagtgggtcgaggtccttggtgatctgagggcagagggaagagctggggggagagtgggatccctgggagcttgcctcagccagtgtgaacagaggatctgaggggaagccttggggacagggctgttccaggaggtgtgtgagcagcagctgtcctgtctgggagactgtcagggcgagtcctaccaggagagggactgggaaagatgcccttgagagtcccgtctgacccagactctgccatgcttggctgtgggctcatcctggcacacatatggtggtgctggtccaggcttggtggccgctctttacaagggtctctgtgcctgggtgccaagggagccatgtgcatctgggggccacaggggagcagagtggcccgacttgtggttgcatgttccgtgtagctgtggcacaggcacgtggccaggcccctgggcttggatgtgcgctggctgttggctgagaacagtgggtgctcccaccctccagtggcctttgcaagctggtggggacatcagttctttcatggacttctgtcctggtagcaacacccctatatccctcatctgcctacgatgcagaacatccacccctcgtcctg

SEQ ID NO: 25740 - DNA, 2440 bp, Bovine  19866880432291
cctgaaagaattccatggacagaggagcctggtgggctacagtccatgaaatagcaagaatcggatacaacttagggattaaaacccacttaccaccaacccacacaagaatttataagtaaatagtattcttcccttattttacagaaattaagatttagaaaggtgaagtatcctttccaacagctagcaggtggcagagctctgattcaaacccaaacctctttagctccagaattttctctcaaaaccagatttgcttgcctccctgtgatgcccttgctctgacatcatctcttcagcccttttcctctactaatttgacaccatttcttttttgcgtctttgcctgttttctcttgtacactcctgctactgcaatgccaggagcctctccaaacaaagatccccattctctgtctccacatcctgaaagttgaaatgtttaaacctgtctgggaccagcccaaaaggtcaaggttgtctgcagcgtcctggcttccatgcccttccctcatttgccaagactggccacctacctgcctctagtccatctccgaaggcaactctctgcccccagttctgcactgggagcgcccagctctgctaggaaaggggcagagccccaaagtagaccctccagcaagtgcacagtgagcacaggctaatttgtcctaattcacaaggagaggtcccatttctagaagcaaacctattcagcaaagaacaacacaggaattttaaaatattgaaaatactccaagtgccagagtctttctgtggcaggcccggattgttcaaggccttaagcagccccacacttggcatttggaaaattagcaattaccgctgcatctgaacaaatggcatgctaaagtttaccctttgaaaggtgaccgtatgctttgaatcaaaactaggaaaacactttgctgagagaagtttctcttctgatttgtgagtgtacttaaaggaaaagtcccctgatggcctaaaaatactattatattcgggttttgcattcaacaaaaacccttgtataaacaaaaatgtaattctataaaattgagattgtgggccttcccctagttactctgtcaaggcaggcttacatctggaaggcttctcctaaagtagtgcttctcaacatgtaattgcctattacatatgctttaaattgaatttcctggattctattccagattgagggttgtagagcagggggttctgtcatttctaacaagctttctaagaaattcccactgaaatttgagaacgactgccctaactagtgacaggccaaaaaaagagactaatgagctcatgtgaaatgggaagttttagaatcccctaaatgcctataacttctctcaaaaaaaaaaaaacagtccatgccatttcttgcaaaagattgctggtttgtggccaagatggaataggaagaccctgaagccacctctttccacaggcataccaaaatcacaattacttacagaagggaattcatacaactcaacatccaacaaacaaacaacccaattaaaaaatgagcagaagactcaaatagatgcttttccaaagaagacatatattaaattgctagcatggtatgtatattcaataaatattttctaaatctgagctgatccagaagatgaagtcagaaagggaattctgggattccctttaatagaagaaaaaaagagttgagaacctggctctgtgtcctcacaaggccagtgtgcccccagggatgaagttggagaggaagttgcagtgtcctcgggcttggccacatcccagtggttcactactgtctctagtcacataaatcctgccacggtgttcagagatagaatcttgacctggtgagaagcagagcaacaactgtccaaactcaggtctcctcggtgttaagatgctgacacattaatgctgaaagtgtgcagcccagactcaagcacctatgttcttgcctccttctaagagcaaggagcaggcagggagactcagccatgaccttgggctcccatgcatagcatcaaatgtattggggtgtgcataagtgttaccagtgatcaaaggtcttctgttccactctgtacacacccgacatcattttggctttcagcttccccacttcccttggtctggcataaagaaggcccagctgtcagttcttggccctgcttgtcctccagccttcataggaacctagatttcctatagagcaaggagaataggtagctgacatccccttcacttatcagggattgaattaccagtgaggctgtaatttgccatgaggtatgaagcttcttcacagtgtcctgggctgaaaatagaagggaaaggaggtgaacagagttgggatctgacctcaactctgggctctgtggatccagcatggacagcgggcttggggatagcctctctgaca

SEQ ID NO: 25741 - DNA, 2777 bp, Bovine  19866880478282
gacagtgaaacagttttaaagctttaatagtacaaatgccagttatccacactgtaagaccaattactagtatttgccaagatatggaagagaagaaaaaggaatataaggagggtccttaaaaacctacttttctcctcatgtggtaacgtttaccttacccagaatacttcatctctgacactcctagtcacccaatgtgtgggattttttcctcaaaacaagcaattatgcacaacatctgctgggtgtcctacaatttaactgactgattaaggttaagggctcagtcccatgagaccaacacacctcctccacctgagatgccaactgcaaacaggtccccaggttacctacaacttctgtatgactgacttggctacaaatcggaggttcccatgacttcaacctctttggattcaattaatttgctcaagtggctcacttaaaaaacattttacttacaatcagtttattaaaggatatgataaggaatacagatgaacagcagatgaagagatatacagaggaagcctgggaaggtcccaagcacaggagcttctctctctgtgcagctggggtgcatcaccctcccagtaggtggatgtttgaacaacctggaagttctccgaatcccatactttggggatttttatggtggcttcttcatgtaggcatgatcaatcattaactaaactgttagcccttctcccttttcaagagaatagcagataaacgctgaaagttccaagcttctaatcatggcttggtccttctcctcatccaggaaccatccaggagtcccccaagagtcacctcatcagaacaaaacactcctaccacccaggaagttacaaaggtttcaggagccctgtggcaggaacccaggatcaaagatcaaatattagaacaaaagatgtctctagtatattttgacttaggaattacaagggtttcagaagctctgtgccaggaactagcggcagagaccactttgttgttcagttgctcagtcatgtccaattctttgcaacctcatggacagcagtacaccaggcttccttgtccttcactatctcttggagtttgctcaaactcacatccattgagtcagtgatgccatccaaccatctcatccgctgtcgtccccttttcctcatgcactcaatctttcccagcatcagggtcttttccaatgtattgcctcacagattctcatactcttcccccctttttaatgcctaaactcaagttttaccctctctgtggatctacagaactcacagccttctttacacaattgggtttaacaatcaaaattaagcatttaacaatgtattttttatcctcagggaggcagaaatggacagtcatttgctaagataagaaaaatcatagttttcaacatcagttttattactaataaatatttatgatataggctaacaaaagactgaacagttcttcctctgaggtaggagctgcagtatgtcaaacacagagcaccaatgacaacaataataacaagctaccttatttactgagaactttatggaagacacggttctaagcattttaattgtatttttcttattttatttttacataaccctaggagattagtattatcagtgtcctcattttatagatgaagactcttgtcgctcaagaaattaagtaacttgccagatatcacaccattcagctgggattttcaacccaagcactcttctcattgtcatattataccaaatgttcactcaaaacaattgctttgatgaatactgctcgtgtgtgtgtgtaaatatacatacaatatagatgaacacacacacatatatacaaacacatatacacacactctctaaactttatagtcatattgcaaaaatactttagtgatcatcttttgcagtctctgattttatcaccacagatccaccaccagagagaatgtgttagtcatataaattatgctcaaccataaattgctttaaaatggttgacaaaaataaggcagttaattgcactcttacaaaacaaaatacaaatcctgtaactagaaagaaagaattcagatttttatttcaagaccaaattcaaaccatgattgatcactattaaaccaacctttggttttgtttatctacgtttttatttagttttcactaaaacaacgaccttgaaattttcaggaaaaaaaaatacaataaatatttgattagtgacacacactatcactgaagatactagactaagagtttgattataagaatcagaggaatttttcagcttccaggtacataaagattatctatttcatctttaatattaaagagaaatttaaatgggaagaacaggtattccagaaccaatgtaagtcaaaggtttctgtgttgggaagattatttttaataatgtgttacaattaaatcaccaaataatttaaaagtaactgcaacataaatataaccataaataaaacaagaaaagtatcattttaaaagtacagtaatacaacatcagcttaccaattcaattccctgtggaaaaggtgtatcatcccagtccttctgtggaaatctctggattattttccccagacctgctcctgaccctattaataaaatcaaagtgcattaagttacaggtacttaaaaatctgaatactcactttattaatacttatttctaaatgaatacttgttgaataaatttatatactgattaaacatgttcagttttaaagggtataaaactatcttctaaacacaata

SEQ ID NO: 25742 - DNA, 453 bp, Bovine  19866880490646
acatccttcacacccactcccccctgcacacacatatatatacacacacacacacacacacaatgtatcccttcaggtaaaggtgatgttttgggaattaatatgactgtgctttaaaataatcatgttatggggaaagcattttgaaaattgatgtttggaactgtttctattattatgtgattttaatgccaaaatgaagtgtctcattgccaactatagagactggcatagccacagcctccaaaattaagaagtacacttttaaaacccattttgcattcttccaaatgaagagtttctggagtttaaaaaatcccattgttaaaaatatccccagaaacaactgatgaaaatgaaacggcttctaaaacatcaaccagcttatactggtttttgcctccccaaccagcttaaacggttctgcttccttcaaataagttcataatcaaa

SEQ ID NO: 25743 - DNA, 2165 bp, Bovine  19866880537962
ccttcgtcctctgtctgcctgatgacaccacgtctctctttaaaccctccttaaagaaactggattgacgttcccggtgaaggtggcgtgtggaagggatacagtattggtctgctccataagtgggatgctagggacagcgaggggacctgccctgacccccaaatgggcagagagaagcagcacagtttagggattcagaggtcagatgccagaaccagattcgtgggctcagagtccctgagcggaggctcagagaggaaacggatgggagccagtggctgggagcagtgcaggtcatggcctgcttattagaagtgtgaccctgggcaagttagctctctgtgccttcattctgccatctgtaaaatgggaacgacaggattaacttagttattacgtgtataggccttgacagagtgcacttactacatgctatataagtgttgaaaggcaggcaaagaaaagaatcaaccaggcgatttaggccggctactgatagtgagaagccggtgtgcagaggaggtaagggcaagcttctttgaggatgtgagtcttcagccgggctgtgagaggtaaagagtctccctgtccccagatttttatgttataggctgtcctgttagaagttccagagggtttgggagatggcgcaactgtggtttcctttcagcaacagttctcattttgtgtagtgaggaatgctcttacgccgaccattagagcctttgggctttggccttcctctctatgcagtggggagcaggcttggtcacggtagcaccccgcacggctgcctcattgtctacaggaggggttctgagctctcccctccacaggaggtgggaagggtggggcttgccccttcacgaggattccctgggttcgggaaaacagtagaacccttggttggacagttcatgctttcacttctgagcgtttgctttctcaagacgtaagctggcctatgcctttcacagtcactcacttagggagctagttgtaaaaattggcctgttgggtttgatccagggaattcctgagtagacagctgaccccaaagactagggcacctggccctcttttcaatgccttctcctgccctgcacaccagtgactcaggtggtctagtagttcttggctcacgttggttctcttttcctgccagccgagatgccgcgccaattccccaagctgaacatctccgaggtggatgagcaagtccggctcctggccgagaaggtgtttgctaaagtgctccgagaagaggacagcaaagatgccctgtccctcttcacagtccctgaggactgccccattgggcagaaggaggccaaggagagggagctgcagaaggagctggcggagcagaagtctttggagaccgcaaaaaggtttgtccccctgagctgggtggggttgtgcagacacaggtgggctgcagatgcttgtcttgtgatgaggcaccttgtgtgaaatcagctgtcctgggagctgactttagttcttaaccaagactatttaacttaccacgtattcactgaaggatgttgtggctttggttgaaaagatcgaaaaccactttctctgctgctgttttaaaaacaaatcatgtgcctagatactcacgatttccaaataacatttccatcttctttctagaaacttgagggttagttgggaaacatcaattttacttctttcatcacttgacaagtactttgtgttgttaattaactcagctcactatttgccaggtgttgtgctgggcactggggatatattaatgaactagatatagtccctgccgtgtagagcttacagttggtctagacaataattgactggacaaattaattgagaaatgacaagttgtgataagtgctgtgtcagtcagagtctaaccagaaaagcagaaacaccttgagtattggaagtaggatgttttcgcaggaaattggttacagaggtgatagagaaaccaagcaggggggagagaggctgcccagacagtagacacagtaggaagcagctgtccccccagactggagagacagtggagggaagtggggttgctggagcttggggtggaggagttggaactgcagtggcctttccaatggaaactggagcctagggggtgatgcaacagctgcagagatggc

SEQ ID NO: 25744 - DNA, 1139 bp, Bovine  19866880619243
aatccctgtaatgagaactttgccctcatgccctagtcacctccaagtaccatcactttggcccaaatgctagcacattgggagatttaggtttcaacatacatgcattttctttttttttttttgggaggggtgttcacattgtatgacagactcatagacttgataattaggatggtgactttagaacattagagagttgaaggggccaaagccagtttgctaaatgcacatcccaggtcatatgctgtataaactttatatagtccaatttatttcatttctttttagacaatctgtataacctacaaaccgtggcttatggaaagaggcggaagtgactaaaattccaaacttggaggtctgggatgttttttgataccatgacttaagaagtttgtaaatgtttttctattaaattacttatttgtgtttttggcttggaagattatgggttttacttgacagttatctagatggagtcttcagaagatggacaggcagaggctgaccacaaagacttgagagtcattagtagatagatctgcgtcactgtgagtacccaaggaaagtctctgtagagacagaagaatagaggaccaagaactgatctttggggaacactgttactaagatggagaataagaggaaccacagaagaaggagttggggagttgagagagagatttaatttccccaatagtagtagttcttctcaatggtgataaaacccctgatttttggctagttttgtagccatgcaggagagactgtttcaagttactaacagatagaaacacatgaatgagttctggccagttggatgtaattggaaataagacatgcagtatccccagaagtattcttaaaaggatgagggtatttttctcttacttttttctttcctgagactggctgctgctgctcttgctaagttgcttcagtcgtgtccgactgtgtgcgaccccatagacggaagcccaccaggctcctccatctctgggattctctcaggcaagtggatcctgagactggcatactggtataaaaactggagtcatcttaaaccactgtacataagggcccacatcctggggaaattagagcaaaaagctggaaagaacctcggtccctaatga

SEQ ID NO: 25745 - DNA, 1290 bp, Bovine  19866880632565
aggattttgaggcagcgaaaatactctgtgtaatactataatggtgcatacatgtcatcatacaatttttccaaacccacagaatgtaccacaccaagagtgaaccctaaggtaaaccatggactttgggtgactatgattgtcaatgcaggttcatcggttgtaacaaatgttttaccctggtggagctgttacctgacagaggctatgcatgtgtcgggtggggaggaactgggaaatttctgtgcagaccttcctctcaactttgctgtgaccctaaaactgctcttaaaaaatagtctttaaaaaaaattttttttttggctgtgctgtgtggtttgcaggctcttagttccccaaaaagaaactgaacctgggccaccgcagagaaagcgctgagtcctaaacactggaccaccagggaattcctttaaaacagttttgtttttaagcagactataaaacccatggtaagaccctagttttataaaatatacagaaatgtaaaggaagagacacaccatattaacaatatttatggggacttccctgacggtctagtgcttaaaactccactcttccaatgcaggggcacaaattcgatccctggtcagagaactaagatcccccatgccgtgcagcccaggcaaaaacaaaaacccagtatttatctctgaatgatacgattccacagggatctttcatttatttatatttgtttctgaatttcttacttatactttccatgaaagtttagcaaagaatacacattatttttattactaggaaaaaaatctgaataagaattataaatttaaaaagtactgggatgggaagaaagtaaccagagcagattaagccccagccttcgctaacccttttttcacatctgtggcttattagctgagaggcagaagaggttttctgtccggctggctgactgtcacctgtttgccttcttccgtggggaaggccctcacagagaagtcagggcatgcccaaggtcacggactcatgttgcctctgctcctcatccagtgaggctgccctgggctgtcacctggactcagggtctggcctccaaggtccacggggcagaaggaatccccttgaccttcccatcacctggactgtgatgctctaactgctcgagatcctggttactaactagaggcaggacggcatccaagtgcccactttggaccaaacagcctgagcctggagtcctcgctcaccaccccaccgtgttcccttggggcatgttgcttcacctctgtcaaccacaacatt

SEQ ID NO: 25746 - DNA, 1075 bp, Bovine  19866880868102
ttacatcactgggataaagacagagacagggaaacccacgagccggctattacaggagtccagatagaggtggagtctgggcagtgggggtggagtgagagcctggctaaaggagtgactgctaagataaccagcagaactgtgggcaagacaaatgctttaaagaaagacttttttttttaagttcaggacagattgctatagaaccacagagagacgccaccttatttcacttgatactgaattgcagtgtttttttttcatcttttattgaagtgtagttaatatacaatgttgtgttcattactgctgtacagcaaagtgactcagtttacatacatacgcatatacattccttttcatcttcttttccactatggtttaccacaggattttgaatgtagttccctgtgctatgcagtaagagagctgctatgttttaaagtaaaaataggagttttccagactagagggggaaatacatcacaggtggaggaaacagcatgtgcaaagatgtggaggttggggtgagaagactctgaaacaaaccatcttctgtttggttgcggtgttggagtgggacagtgacaggctgaaggtaagacttagaccaggccacgtgccaggccttgagaacagtctgggtgtttgccccacaggcaatgagacacccgtgagtttactccagcggccatagtcagatcttatttttagaacattgctctgacttcagagcggatgatgtattaggagtggacgttgaggagtggagagatgcgtttggaggctttgccgcagtccacggggaggaggatggtgctttgggccaggatctgtccttgggagctgccagggtttgagctctggctgatgagggtggtgttagtaggagaaaacagaccttttagtgacaggaatccctatggaatgcaaacatccgtattaccaagagcaggaggagggaaagtataacagatggagaaacctttataaacaggaggtttcacaagtttcctggggaatatcagtgatacttcccagagtccgaaggcagcacacactcactccagaccgt

SEQ ID NO: 25747 - DNA, 1619 bp, Bovine  19866880936728
ctctagagttaagatattgtggttagtgtactagtaaatttaaaaaaaattaccaaactttttacatgtagaagtaagatctaaaaacaaggttttctgcattttacatctagaaataaggtgttttttttttttttttctttcttagttacgggtctaaggacacagatttttatgttgagtgagagaaaaatgggacataatggtcttccagatagccatgtactcagctaaaaaccaaaggttccattactgaataagagggaaaaacagatactggggaacaactagcagccaggttgactcaaagcctagggaagtactgattgaaaaacagatctacctgttttgtcaagttctttagaggaaatggctgtaaatatttgaaatataaataaagaaaaaccagaaacatatggtattaaagttagtgtcccatctgtgaagacatatcatcccccagacattcccttttttcctaaacaaaagagtagagaaacactgaaaactattagactttcctggttaagctgtgtcaatattttaatgtttacttagattgactacacttacttcctctcatttttcagctttattgccatctctaaccatttctaaatgctgtgaacagtgaccagttgtgctgaaaatctcttgtctcggccacgaaaccccggcttgactaatttcaaatttatagaaagaaaactctgacacccaaatgaagagaattatctaagatcatacatagctaatggatggcagagtcctaaacccaagtctctgtcccccagtactgaagcaactatgtccaaacagaaaggggcccacctgctgttacagtccctggttagtaatggcacagaggccctgttcttcccacccagctcatcagttggcttcatttataccaactaagtgaactattgtactttacttaaaggaagtgggtggtagtattaatattaagcaagatggactctttctgatggccagaactatatgtagattcaatttaattacttcatattagaaatttagttaagaataagtggtgtagtgtggaaggacaagaaaaagtctccaccatcaggcctcgttgagaactggatgaatgaaataaaattggtatcccaacaggaagtcttaattgatcatcatcatcattcagttccctgattctgcctccactctgactgtagattcgttttcttcttttccatgactgctttctctacttcatggtttctgctgtactgcagcttctgcttactgccttctttgccatctcatattcagatcccctgaagaagaaaatcagactgagttagttcatcattttgtgagacagaactactgaacagttctcaggtcatgctaatgtaaaagccactggcctacatacacatccctggtctagttaattgtggcaaagtggaaggaactcatgatagaaagcataacatgtgatgcaagccttgagactgctttttccagaaatgaactgtggctgttgcttaaacccagagctttatatttgtctgtacacttttggtttaaaaatcaaagcatcattaaggaattcagattttaaaatcggtctgccctctcaagagcat

SEQ ID NO: 25748 - DNA, 808 bp, Bovine  19866880991810
taaatttatcctggaaacagaaggaaacaactgaaaaccagtgggaccatattttatagactagtccatcttcagtgggtcagctacctctattaggcttttaacaactccttgacgtatttggttatgggtttatctttatggtgggttctgttttgatttacagtgtttttaatagttataaaggacagggcctttcctgtaaataattattcctaaaaatgtcctaccttgagtttttgcaacctgaacagtgtgaaatttggaaagtttctaactaaaagtcatttatatgctgtacttcccttaaaagaacctaaagctatgatgttttgactctggtcaaatcaagggctagtaacttgacccctgtcatactattatgaataaaaaagtgatttaaaataaataagattttagttgaattccaggcttaatctgaactgagttgataggcaattataaaccattgttggtttcttgagagagtgacattttctggaacaaataacaatttgacatttgtgtggcactccctagtggctcagatggtaaagaatatgcctgcaatgcaggagtcctgggttcagtccctaggtagggaagatcccctgaagaaagaaaggcagtccaccccagtattcttgcctggagaatcccatggacagaggagcctggctagctacagtccatggggtcacaaagagttggataggactgggtgactaacactttcacttttaaaattacttaagggaaagagacacagttagaggtcaggttttctaactaataatcccttagtagt

SEQ ID NO: 25749 - DNA, 800 bp, Bovine  19866881057229
agccccaggaacccaggtatctcatcaattaatcatgcctcatttccttttttaaaaaatatatggtcattaagctgatgattcaaggaatctatgagtgctttatgagcacctaccacgtgcaacatattgggcaagtgccagactgccaggggtcagaatgccagaggcggtgtaacttgatttcagtgaggccttagacaaagcatcccacgattcactgataggtcaggaaggtgagtggtataaaagtataatgacatgattttgcagctgactaaagagccatatccacagaggattgataaataactggtttccgttagcaggaagttttccatcagactcatccttcttataccttgctttagtcagcatttttatatatgacttaaaggaagaagataagcacaaagtttagagtcatagctaggagatgaaagaggcaagatgaaaaacaatctgaagagcatgaaattcagcaaggatcattattcagttgtgtattttgtttttttaaaatcggcagtacaaattcatggggattcctggtttggcaggagttcttgttaaaaacaagtaggtttttttattgaccacagcttcatcaagaggcattaatggaatgtggctgataaaaacaaaggcgagggcaattcttgaccatggtcataaatctcatgtccagataatatgctggcagttcagtcctgttctcatcagaccacgctggggttctattttcacttctaggcatctgcttcactgttggaacatggcacccttaacccatttttatg

SEQ ID NO: 25750 - DNA, 3042 bp, Bovine  19866881078397
tgattttggtattcaccatctggtgatgtccatgtatagggtcatcgcttatgtggttggaagagggtgtttgctatgaccagtgcattcttttggcaaaactctgttagtctttgctctgcttcattttatactcaaaggccaaacttgcctgttattccagatatctcctgacttcctacttttgcattctggtcccctatgatgaaaaggacctctttttttggtgtttgttctaggaggtcttgtaggtcttcatagaatcgttcaacttcagcttcttcagcattagaggttggtgcatagacttggattattgtgatattgaatggtttgctttggaaacgaaccaagagcattctgtcatttttgagattgcacccaagtactgcatttcggactctattgttgactatgaaggctactccattccttctaagggattcttgcctgcagtagtagatataaggtcatctgaattaagttctcccattcctgtccattttagttcacggattcctaaaatgttgatgttcactcttgccatctcctgtttgaccacatccaatttaccttgattcatggacctaacattccaggttcttgggcaatactgttctttacagcatcggactttactttcaccaccacagtcacatccacaactgagtgtttccactttggctcagcctcttcattctttctgtagttactttttccaccctacctcagtagcatattgttcacctaccaacctggtaggtatgaaaaaggcaaaaagttatgtatatatacatatttatatacatataaaatatattcctccgacacagtaaagaatgaaattttgccatttgcaacaacatggatggacttggagggcattacgctgagggaaataagagacttattaggtcaaatactgcattttaccacttatatgtggaatctgaaaaagaaaaaaatgaatgaatataacaaaatagaaactgactcagagatacagagaatgaactagtgatgaccagtggggagggggaggggaggcaagttcagaatcgtggattaagagatataaaccaatatgtataaaataaatgttacaataatatattgaacagcacagggaatatagctaatattttataataatttaagaaaatacttatttatttggctgtgccgggtcttagttgtggcatgcagaatcttcagtcttcagcattcagaatctttagttgcagtgagcaaactctaacttgcagcatgtgtgggatctagttccctgactagggattaaacccaggccccctgcattgggagcaggcagtcttagctactggatcaccagggaagtccttataataactttaagtggagtacaatctataaaaattttggatcactttgttgtatgtctgaaatataaggttgtaaatcaactatgcacaattaaaaaagaaattgctgtcatcaagaagctttcagctcaacaaaggagactgacaagtcaccctggattacttaagccatgggaacacagagaacgttttctcttggggagggaaggccatgggaggggagagtctgaaaggaggtagcatctgatgtgggcctcgcagtgtgagtaggaatgtactagatcaggtgagctgatgctcaaccccattgcaaccttcttccagtgttcccgatactgcaggagctgctaacataaaactatttttctcagatttccttgcaagcagcgctctggatagggtttaggttcttcccataaggttcacaaacatgatgtagagggcaggaatcaggcatgagccaagctcccatccctttgactatttctgctgtcaagcttgtgtggaggtatttgctttttctgcagcacgtgtggtagcagcctcagcattcagacactagctcatgggtgtccagagaaggcagagagaggggcatcttttttgctagtgagactgtggccagtgtgggatggttctggagtgacagctgttgattcctgagagtagaaaatgttcaggccttccagaacctcatctagagttggagtagaagaactcagagcatagggacagtttgcctcaaactctccctcctgtgtctgctgatcacctcaacttctaccctttcatatccttaaaatgagggaggggccaccctttgcaggccctcagagatgatctgcctttgcaaagtgccaggatcttggagccttaactacagctgggagtgaagccatttcattttaacaaccagttgctccaagttaaaaaccatgaaatgtcaacaaaaagcttaagctggccctctccagtcttctactgtctccttcacggaacccatccacacaggcaaagctgtcagccaagtgaaagtgttgctggatccatttaagagataaatgtgggatctttagaaagtctataaactcagcagttgtcaggaagccagcaactgatgtttacccgtggtttctgggctgtgtacctgggatgtgctagttagagcagagttcacctccccccagtcctgggctgcagagatgctgacttgcaatgggtttttacggctcttgttttcaatcattaatgtaccgacatcacgtgccagcttcagcggggttctcgttctctagcaggctcccccactacagacattcacacacatacacacaccactccagatactcttcagagactgacatcacacattcatttgataaatatttatagctctggctggaaagcccacaccaccacccatggatcccacccacagtgggactggccctatgtcagcttggcttgtaaacctctctgagtgcagggcaaggcgtcctgggcaagaggcaataaacacacactacttggttgagcccctgactgacagaatcctgaaaccagaaacgagtctacatttcctgcagagtctgtacgctttagatctccatgggtgctcggcctcggtgggagacaagcaagaggacgaaacggatttggcttttgaaagaggactcttttt

SEQ ID NO: 25751 - DNA, 1391 bp, Bovine  19866881249266
gggaacgctaacagaggagaaagttcttaggctttctgtgctaggaacgggaccagtggcctgagcccggcagctggtccaggcatggtcagattcgctgacaagcagccccaagctgcctgccacagcatctgctccacgtctgggacttgtgactcatcacactctcttgcagccctacattctcatgcaggcctaagcatgcaggccccagggtgctgagggcccaacgtatcaagatcagtccttatctccaggttgccttcctctgcctcagaccctcatccgagtccaccagctcctgggccagggcaaattgcctagaccatctcagatccaggctgagatcaatatcataagaggctcctaggctgagatggattcaagatctcgtggacactggtgtccattccagccctttaaatttagcagcccacgctcccaccgtgcccagctggcccaccgtagtgagctaccagcagcacctgttctaggccaatcctgtttactctggacatactatttttgttctcacctctctggttctcagattcctggctccctaccccggctaccatagctgcctctggccccttcactttggtgacccttcggatttccctttttagaccacagcctctcacatgtttctgactcaacttgcttctgcagtgctggcttcactcttggtctcaggtgagcacccatgattcagccccagcctctgggtaccccctcagctaggatggctcccaggaaaggcagagggtcaggacttgttcctaaggtccctgcttgcttccctgccctcggctttgctttgccctccaattccagcacttgggagggctccccagtcatgcctctggttgctggccccacttaggtccctcaccagagatagctctaccctgagctcagcacctgatttcatcctggccttgccgggcctccaccaggcacccccaacccccacccacaatctcattgagaccatagtaggggagtgagggtctgagaggagagggaaacactgcctcaagtggatcccagacggggtgcagagcctggggagagctttgcctctgtctcctcctctgggaacacttccatttacagattgagggttacccataagagaagcctaatggggcagtagaacgcaaggcccttgccatctcaggcccttgcttcctaccctctaaattgtgcaccgggggaggggtagtgtgttgctccagatgatatcttagccttctgggtgtaagatcctggaagctaacagtagtcccatgtggttcattccttttccttgtctgccagatcccatgcttgactttagggacacatctgatcctccagcctctccaccaaagaacaaaggagtccac

SEQ ID NO: 25752 - DNA, 2270 bp, Bovine  19866881273920
caaagtagttttaaaaaggaaaaaaccacccaactctgggctgtggaagaggcctcgtggtgcaggcatccaatcagcagtcagtgcatctggagatcaagttcctctcaggattagtgaaatcgagcttttgttagcattaatttaatggtggaatgtcaactcacaaacctcaaaaatccttttatgcttcacaccttttttcttttttcataaaaaaatgcaaactcccaaatgtatgtgaagcctgaaaggacaatctgagaaaggcttgtctcttcctttggtgaaataaacaatctgttgtgtcatggcacctgcacagaaatcctgtgtttgaagaacaagttgagactacactgttattcaggatagttagtggtgggggcaaagtagagagagctctacttatgtaaagatctgggagtctcagtggactgtggattttcaatgagccaagaatgacttggttgtcacagcacactgttgccaagtgcatgatgaaatgagtctcattgccttcacatcccaggcctcaccaaatccctgaaaattggcttctaattccatctattgacatggccctcccaaatatccaatagcttatttacagtcttcttcacttgtgatttaaaggtctcctagagatccgcatttctaaagtctattccactagtctagacatctctcaaggaacaatccttgcaatcctgtatttctaaccatcttctgggcatctccatttgagtgtctccatctgggtatttccatccaggcatcccaccagcatctcaaactgaactgatctttcttgaccagtgagtgcctgctcctggctgccctgtggtattaacattcactttacctgcccagggatcaggtcaaaattctggagccacctgacctcttctttccacaccccacatgcagttaggttgcaaatttattgagtctatgtctttcttcccactcttatcactgctgttactacttctgtgcaaagcttcctgcgttcagttatccgtgtgtcatctccacggggatgtttcatagtcatctacacacttgacatgtccaaaatgggactctggagtctattactcctgtaccccaggctggctttcacatctccataaatgactccactgtatatccagttgctcaacctggttcttctctcctgagagccacatgtctatggggtgtttcaggagcacctaggctaatgtttaccccagtcactccactatagccatgtgttgttaaaatgtcaaggtacctccctgccagttggtaaacagctcctactctgagacccctgactctcctccaccacctcagttgccctggaatctcccccagaattccctagatttccccatgacctggcaactcagatcatgaggagatctagtgttggtgcctcatactgcaggggatctctaggatccagtgactccagtaatatagccattgatacctattacaattggccagcatgtgggtcataacagatattttgaagataatccccagtattacccattttgaaaaagaagaaattgacactgaagagattacataatttccctataattccttggagtccatgtggctccaaaggacttttatcagttatctcttgactggtcccactgtcctacaacaatcgtcccaaagcctaactttcaccacacactagtcctgcttagaaacctcctggggctcccaatccacatggagttaagtccaaactcaagcctgggcttcaagtttccttcatagtctgaacaactcaggtcagctccatgacagaagccctgccactgcattcctgagcactttcctgcttctccacttagacccacaccacttattcctctaggaacaatctccctgacccactcttcacatcttgaaaccttgacctgtttggacacctgactgcctcaaatgcccactcctccagaatcaaaccttcctcattgtccccgcttcttcttccttggagcatctgcagctcttgggttcaagttcagcagcccagcccatccatggttgctaaccacattcttccttacagaacagttttactctaatgcctatgtaagcacacagagagagtttgtaaaccactttcacacaccttgtaatcacagatgttacttaccttcttgcatcttatcccataagctcctggaggacaggagtcacattttgctcatctgtataacctcactaccagcagaagtccaagcacaagtcatgca

SEQ ID NO: 25753 - DNA, 1300 bp, Bovine  19866881291496
acttctttttcttgcaatctctcaaaagttagacaaaaagagttcacatacttcaatactctgatttttttcagccgcttctcttagagctataggttgtccatggactgtcttttaagttatcatgggtaagactttacctattatttttgttttattcacagcacaggtcaccatatttccagtccgtgatatcagtgttctggtttcctgccacttgacctcgaagtccgtgtctcctattttgaaaatttgttcttgaagttccctattactgcttctgtatatgttagtcagggtaggctaactgctataataaacattcctgaatttctgtggcttaatatgctaacatcttatttcttgcttatgtcagttgaattctgggaatgcccacaagaagactcagcttctactgagtggggccagcaacttcttggacgtcacgttctgaacggaatgccctgaatctggcaggcagaaaggggactacagggaatgcaaggtactaggcaggagaagtctgtttaggaaactggatctggaaggttcacattcgcctgccccttgctgcaagaaaagacaaaaaaaagattgtctaactgtagaaatcagattggtgaaaatgtagcagtctctatcacagaaaaatgtatcaaaaaaaaaaaaacacacaacaacacacacacacacagaccaggaagatatgggaaactagggtcagaaatgaggatgagaagcagaggaattgatggagcccctggaagggatctggtaacccagggcctgggggcctgggaggcactgtcacccagggtagattctagttcagggttgggcaaggttctgactcagctccacaaaattaggaggcatttggctgctgccaaaggtttggaaatgtgcttttattttcaaactcaggtacgtgacactctatagttcaatgctagcacacctgtgtgaggtttaacaacattaggaactgccagccagtgatacataaaccccgcatctccctctcctcttactccgccaggctgtatatgggagtgacacagaaagtgaaggtcctctaggaggggacatcgcggcaccaacaacagagtcctagggccaagcagaaatgtcagacctcagaggcatggtgaaggaagggaacttttatttctgatcaatatcactcactgttggacatacagggcctgtttctctccatttcactgctgctttggcaacagttccaattgcattaggtccatcttcgcttttaagaaataccgaggagtcctgtttcagg

SEQ ID NO: 25754 - DNA, 1755 bp, Bovine  19866881310554
cacacaagcacatacacatgacattcggtgcacatagtaatgtcagagacaggccttcgagaagctaagagtcccacagagaacgtaaatgagaggacagaaatgcacagaaataaggataagacagctacgcgtgctctggaggattgtggcgtttaagtattttgagagctcctgggggagagagatcaagctgtaaggtaaagagtcaagcacaacatgaaggagcctgtcctaaatgcattctgatgtcctccagacatctgctgagggcctctgagccttgatgtccaagtgcagtggcctggacttctgaatcccatggaccgaggagttccacgccctctccagcatatctgctggttccctgtggggacctcagtctcttggccctcctacctctcaaaatgctagcttcctcacacaccacttctgtccccttaggacaccccctcccccaacacaaaattcagccactcatctggtttgcacaagaaaaactcaatcacaccaagaatttatacacacaggtttcccaaaatacgggagaacggctcctgggatgcagtcatattaaacagcacctggccttctgccagccctgtgccctctcaccacacttttgtctctttcctcctctttctcagaagcaactcaaaaagttcctgggtcttagtccagctgaaacctaggcctggggtgtgggtggggcgagggttggtggcagaagagaactaccctatctccaaggatttctcaaggcctccttccaaagcacacacacaatcttttgctaagaggaagccggcagtaaaagtctctccatcccgtttgtattggtgaattgaagagaacaaaatccactcaagctagattaagcaagaagggatttatgacaggatattaagtgtcttacaggactactaggaagaatttagaaaagattttaggttgagcttgcagtaaagtcttccaaagaagatcctggccaccagggaagccacttgctccaggatcagcactgctcctgctacaaggccagcggcaaaatgcataatcctgggcctcccagcatctatgagactgtggcaggaccccggggatgtctactcatgcctgcagagaaagctcagtcagcctctcagctgcagtgccagcagaaagtgcaggagcagcaaagggctggcctctgcctggctccccgctagatctcttttgcctcacaccttgaggtttgatcatccatccaagggaagacatctgagagtccatcacagtcaggatccactgggcctacccagcaggtagggactctttcctgagcactcatccttgtaatttgggccacacacacatgggtgccctactccttggccccaggcagagccaggactggaatgagacaatgggcaccagaggcccaaagctgaaagaggcacttctatggctcatgcaaatgcaaggtcagcccctggagtgagtgtctccttaaatatttgtgcactcagtcctctgttcgcctcatcgtagttccagccacctcccaggagagactaacctgtactcctcccccagccttgacaatctggaaacaggtcctggctggacaccatggtgagatttccatgtggaatcacatggtgccacctccagcttgattcctaggccagataccagaagaggcaccaggctctctgaaagtcaacccatctatgccagctcccttaatttgagagtcattagtaaacagatgta

SEQ ID NO: 25755 - DNA, 953 bp, Bovine  19866881375866
taagaaaactatttatgatttaatgttaaatcaaagatacatatagaattacagtgcctagactgtgacacactctggctcgtatccatacgaggggcaccgttgggagtctctgacctctaggtgctttgtttttgttggggtgaaatagtatttcacgtagtgtctcatctgggtagtcagaatatcgtcgtggtattccagataggcctaggaagcgttgggtttttgttcagatggggagaattctctagcctcttacaacttagtttttgaccagatgtgaatatttatcacacacaaaccttaccaagactagtagagagggcactacaaaataaaaacaatttgattctttggagaaacaggaatgtgcatttcaactcctgttgatgggcacaagaaacgttagggataatttaaattggaattatggaatgatcctccattcttgttttactttgcttaggaaaaatgaattattggaatgtcacgtatttagaataaggcctgacagagagtaatcagtaaatgtgagcttgtagcatcaacatttatgacacaaatggcaccattcctgtgtgaataaactcatagaatcctcctaacaatgcagcgagggaggggctattagcaccccagttttggagatggggaaacaggcattgagaagttaaatcacttgtctgggctcatgtcgctagtaagtggcagagctgagggcacctggcgtgaccagtcttgctcctcaacattcacccatgtgcgtgctcatgaagcagagatgattcttgtagggctcatggaaaggaaaactgagtggctggcagaccttttagtggaagatggtctttgggttcctgggcttccagggaaggggatgatgaaggctggagaggagaaggaggggagcaagggctggttcgtggtttctgcaccttctggagtggagg

SEQ ID NO: 25756 - DNA, 1391 bp, Bovine  19866881395949
tgtgtgtcacactgaatttcttcccatttgtccagttggagtgtctattaagaggttaagtgcatgcgatctattatctactagctgtgtatcctcaggtatgtgatggtttctctgagtttcagtttcctcatctatattaatagtataccttcctcatggtattataaggattaaaggagatcattaatgtaaagcaattagaacagaacttggcataaagtaagcatgcagtaaataataagagtaattctcattatcttcaatattattccttgattactccatactttattgccttagttcctggaatgttattaacctcctagttacctggttaactattataaccttcaggtttcacttttaacataaattgctagaggaaatgttttctaagcaaccccgattaccaaaactgggtgatgtgctcattttcttgtatgttgtttccttatagcctgttcttccttctgatatcactcatcacactatattacaataggctgctttccatctgtctttcccattatactgtgagctccttgagtgcattccaggtacctgggtcttggtcattaattggtgaagaaatgaaagactatgaataaacagctttttcaagttaaactgaaactgtttcaagttaaaatgaaactgttcttgagccttattctattttaatctttaatactaattttaaatatctctctctatttttctctaagtctacaggttcctagacccttgttgagtgaagaacaggtttctatgaagtcatatggaagaacaaggctcagaattctttcaagttattattgggagtgcagtctgtgatcagatatttgcttttgaactatccgcaggcaatatgatcttctcatcatatttcttgtgcttagccaacttccctcctgctcaatcactgtatgcttagggaaatgtgagatcatttaaacacaacaatctagatagtaatacatattaaccaatactgcattgtttctctttaacagtatggaaaaggcagttataaacaattgtatttctgttagaatggaaattatgaattcattttcactcacagattgtctcattgccgatctcttggcaatctattagatatttccagttccataaatttagatcaaaattactttgcatcttttagaaatccagaacggagagttgttgttaatctgaatccctcctcatttgaatagcccttcccctttctgcagtcatctttatagactgggtgtattcccaacaggcaagtcaaccacagcatgggaaatgtatcacagtggtctttttgaatagcccataagaatgagcagcacgcagttgcttcgttagggtttcttgctcgactaggttcagtcctcact

SEQ ID NO: 25757 - DNA, 1899 bp, Bovine  19866881443546
aatgtacatatccaaagggaaatatctgtttactttttattatgtatgataagatccatatgctcttgaaagattttcatttgttacaaagcaaaagctaaaattaggttgggtggttctggaattcttagaaataataaaaatgtgatgaaaatgaatttaccaaagatttccacacttaatgaatcatcttttttatggattactaacaaaatttgtccttgcatgacaaaaaaatgactgaaattcctgaaagagataaagttatccacatttttatgagattgtgatacatgccccagagtaccattagaagtcagcttgagtaagcacataaccatttcatataaatgaccattaacctatgttaaactaaacataaaatagaaggcattggtcatttcctttaattaaatattcactaagtggaataattattaacaagaaagaaaaaaggtctgacataatatgaatcaatactaaataaaaacaagtccattttctttacatcactattatagattttgacctttactttgtaaatgtgctatgaatcataagatgctgctattcttcattccaatagctcttctataagaatacgatgtcccaagtttagagaaaattcgtattccttttttcaaagcaaagcactgctgtgatttttttaaaattgttgtttataacaagtctgattccagtaaacagtagtgttgtgattttggttaactttttctataagtaatttatcatgtaaaagaatagtgccgttttttatagctgttagaatatattttgtgtaataattttgtagtgatactaactctgttatgtgttttacaatgacaaattttcacatattgaaaagatgtgagaaacgtaataagcaggaaattaaaaacacaggaatacaaatgtaatagacattataataatggttagaaatttaacattttatagtataaagcgttttcacatactgaatctcatttgaacaaaacttacaagacttcttccaagctgagattattccttggttttagtaggtcccaaagtactcttgcctggaaaatcccatggacggaggagcctggtgggctgcagtccatggggttgctgagggtcggacacgactttcactttcatgcactggagaaggatatggcaacccactccagtgttcttgcctggagaatcccagggacaggggagcctggtggaccgccgtctatggtcggacacgactgaagtgacttagcagcagcagcaataaagatacatggagaaggaaatggcaacccactccagtattcttgcctggaaaattccatgcacagaggaccatggcgggctacagtcgatggggtcacaaagagtctgtcacgactgagcacatcagcaatagatacaaatttaccttaaattctgtttactgaactgcctcacattgacatataaagtgattttatcttatatttagtgtaagcatgtgccacaacttgcccactgactggtattttttcctacctattattactgtggaccacatctactagcggcattcccagcttccatgtagttcccattctatgtagctctcaaactcttcatgcctcaatagtatgggataaattagtacccatcatagcaatctgccttaaaagaactactgcctttcaaacatatcctcagggaaaaatgctaaaaattattagaatactgattttatggaatgactgcatatagcagataggcacaatctgtaagaagcttatcctatcacccaggtagaatacttcattctcatctctgctctactcctgatgcttgactcctgtctcttctattctgaaaagactaactgcatccaatatcatctgtgctaagctcatttttcag

SEQ ID NO: 25758 - DNA, 1264 bp, Bovine  19866881574544
agagcaagttattcatagagaatgcatcagtggggacttcccctggtggtccagtggctaagactctgggctcccaatgcaaggggcccaggtttgattcctggtcagggaaccatattccacatgcctaaactaagacctggtacactcaaataaataaataaaattaaaaaaaaaaaagaatgcatcaatggcactcttatccagagaagtatttctgattttcccgttgtaagaattttcactttatataaaatagtgtctagaagtaagtgtttattcactttatttctgaaggatctaggagtgtttattcctgctcctatggctcaagggatgagaagtgacttctttctggagggaccgtttatgccacccaggatgaaaatggatagggacccacttggaggacttgctgatatgtttggacaaatgccaggtgattttgaacaaaagatagtttggttgcattaaataatgagtttaacagttttaatggtaaagagttcttcgtgtctatattttaaggaagcggaattggtactggtccaggagttatccaggatagattttcacccaccatggggcgccatcgttcaaatcagctcttcaatggccatgggggacacatcatgcctcccacacagtcgcagtttggggagatgggaggcaagtttatgaaaagccaggtaagaatacatttaaggatgtttaggcaacaagtaattaaattttggaatacatatgattagtattgtgtttttgtttttgtttttttagtgtaaatgttttaggtttagaaaacctaaaaacaatgtttttctaaaccaaatttatatctgtgacagttatttcaaactgggtgaaatgattttattaagattagtaaagtattagtaaaatcacatcactttatttgacagttaggttagaattttattcttctgtttcatcttttactttctctgggcaaatgcagttaagctttcttgtggcttggcctcatcactttggtacttgattaccataatttgtggacccctttttatctagacttttctttctctctttctgaaataggggctaagccagctctaccataaccagagtcagggactcttatcccagctgcaaggacagtcgaaggatatgccacctcggttttctaagaaaggacagcttaatgcagatgaggtacatttgcctatgttatttatataccatagtttgtcaattcaaaaatctcttgcccgatgattataaa

SEQ ID NO: 25759 - DNA, 1032 bp, Bovine  19866881645230
aatcctatggacagaggaggctggtgggctacagtccatggggtcacaaaaagagtcggacatgaccctagtgactaaccagcaacgatgtagtcaatttacaatattgtgttagtttcaggtgtacaacaaaaatgatttagcttacatatgtacagatatatactcagattcttttacattatgttattacaagataatgcatacacttcccctgtgctacagagtaaatctttgctgtccatctatatcatatatagtagtgtgtatctgttagtctcgtacttctattttatccctcttcccccacccctgttttccctttggtaaccataagtttgtattctttgtctgtgagtctgcttttgttttgtaaataaacacatttgtattactttttagatttcacatgtaggtgatatataatatttgcctttctctgtctgcacttcactcaatattataccctctaggtccatccgtgttgttgcaaatggcaataattcatgtccttttaaattctagctgaaaggccacaggttttaggctacttctgttgtcttaaaatagggctctgaccatgtctctgaaggagggcccctggagcaaatgcggtgggccagctgccaaggctggcagaaggagaggcagagctggaaataaacgcagggtgtttgcttacagattcttctccaccacatcatgggtgagtcagatgacttctcaccccagattctgtttttacccactttcttactcagaggcagggtgggaggattggataaagcttaaaatatatcccccaattatctccttttgtcttttggttttaatgcagaatcaggattctttcattctttgatgcagtcaggaattatttttgactttcttactggcattctgtttgaattcatacttggttgcagagagagcactgtggagtgagtcaggaggttcagtcaaatgtctgctctgagtgcccatcactgggatttggggcaagtcagtctgccttccctgagctgcagttcc

SEQ ID NO: 25760 - DNA, 1076 bp, Bovine  19866881859681
ttgttttaataataatatacatattgtatgctttttagtttgcaaattgtgtgaaattatcacatggtttgctaattcagcatattttacagttgatactttatcatttgattctttttccaaggtggtagcttttgaagtagagcgaattaaagttgaagaaaataacccaatgaagatgataaagcatgtcagagaacttgctgagcaactatttaaaaatgtacgtaagtatatttatttagatagtcattaattttaaaagtattaataaagtattttctttgaaaaattcaaaagcttcatattcctagtgatgatcttttttgatctgatttaaaacccttgagactatgagttccaaatattaaagttggtactgtgcatcaaaatagacctcatttttcaaagtgatttccctgtcaattgatacattatgaaaacatattagtcccagttttccagtttatcatttgccttcattgtgattttcatttggatctctgtcttcttaagagcatattgaatatttttgagatgtaacaattagactcatggagaccacaactacctgggacagatttgaccgatgtattctgctttagcttggtacagtgactgtccactgtatcgtgaaaaacttcgagggtgcattgctttgaatatacaggaatgaaaagcttaaagaaagaaaactgtcaggtgccatacaaactcaagggtgaaagtattccctgataaagaaacgcagtaagttaaagactggaatgtgttaaagtctgtatttggataccaggagagaagagaagatgcacacagaaaagtggatactggctaatgtggatactggcttatttctcctgcatgcgaagattttcagggttgaatctttttactaaaaaaaggaaaataaatgagaagtattgtcttccagtgtaaagttgaggggagatgtatcttaaagaaaatatagttaagaaggatttgggatcagtatcctaatattgcttcagttcagttcagtcgctcagtcatgtccgactctttggaccccataactgcagcacgccaggcct

SEQ ID NO: 25761 - DNA, 878 bp, Bovine  19866881941316
tgataagttattcatttcaccttgtttttctttacagacagctttcttgggacagcgtggtctagttgagaatgatttcctcactaaagttctcaatggaatggcatttgcaggttttgtttcagaaagaggtcctccctatagatcctgtgatctctttgatgaggtatacttattatcaaatgaattcattatttacagacaaaattagtagctaaaagtagagaagcagtgttttaaacatttaattaagataaaaaaatatgtattgtacgtatcagatcttggtgtttataatgtggattagaaaaaatataattataggatgtctcagaagtaaaatgcatagaaattttgaacaactgaatacttttttggcttgtgggatcttagttccccaaccagggatcaaacctgtaccccctgtgttggaagctcagaggcctaactattggaccaccaggaaatttccttgaataattgaattttaaatagttgattaaaatctttttgaaaaattgacagtgattgtataagtagaacttaccagttttatagagcgaaaggtctaagtttaatgtataaatatgttatttcaaactgttattacattaaatctgtgtcctagagccatagtttaactaagccattcttttttatttatttatttattttttggttatctttattttaatcaaagcttggaaaataaagtaaggaggccacaatttcagtttctctataaaagaaccacaaatcagggtgttttcttaagtactaatccttggaaaatatagcaaatttcaagtaagaattagcaccttctttgcatttagctaagccattcttaactaatgctgatttttttctggcatttg

SEQ ID NO: 25762 - DNA, 3943 bp, Bovine  19866880137863
gttgataaattaatagaagtctctttgttcttttttttattttttaactttacaatattgtattggttttgccatatatcaacatgaatctgccacaggtatacacgtgttccccatcctgaacccccccttccctcctccctccccgtaccattcctctgggtcgtcccagtgcaccagcccaaagcatccagtatcgtgcatcaaacctggactggggactcatttcatatatgatattatacatgtttcaatgccattctcccaaatcatcccaccctttccctctcccacagagtccaaaagactgttctatacatcagtgtctcttttgctgtctcgtatacagggttattgttaccatctttctagtttccatacatatgcattagtatactgtattggtatttttctttctgggttacttcactctgtataataggctccagtttcatccacctcattagaactgattcaaatgtattctttttaatggctgagtaatactccattgtgtatatgtaccacagctttcttatccattcatctgctgatggacatgtaggttgcttccatgtcctggctattataaacagtgatgtgatgaacattggggtatatgtgtctctttcaattctggtttcctcagtgtgtatgcccagcagtgggattgctggatcataagcctctttgttctgatctagatcttccaaattatattgatggctgaattttccagttcacagcctttgaagctgctttttcctgagtggtttctcctgactctgaacaatcttgagaacccctaatacccttccagtaaatacttacacttactgtctgttctttgtaatctaaagaaatctgaagtattatatctagcctctttactgggtctttgttttttaggaagtctattcctgttaaggggttcctggtagctcagaggttaaagcatctgcctgcagtaccagagacctgggttcgatccctgggtcgggaagattccctggagaaagaaatggcaacccactccagtatttttgcctggagaatcccatagacagaggagctggtgggctacagtccagggggttgcaaagagttggacatgactgagtgacttcactttactattcttgttaacgtaagagtaattattggaaataaggacaattcccactgaaaaagtaaaaatgaagagtaaaaatgctgagacattaaaaccctatgttataagactacatcattgtcagctttttttaactgaaagaagtgcatataattagaaataattgatggaaacacacttatgtggctaatatatgaggggcagcatttgtaaaagatccttgttcacacccctgtaatgagtacaacaatgttctctaactactcaacatatccattttcaagaaatatgactttagtatagtcaaccttctatttttctttcactataggtgttgtaggttaatattagataattcacagaataatgtagctaacctgcctctgctttatctctcattcctaacccacctagaagatggaataaggtgaaaaatcattgaggataaagcttagccaataaatatttttcatgctactttgccttaatcctttacataaaaatgtttagaactgtggagccaaaagagtgctatgattctaaagtatagtttaaggaaaccaggaaaaacccaatgaaagacagcaatgtttactgcagtttctggatcatagaagaaactcaataagcatctgtagaaagaaggcgagaaaaacataagacagaataaaggaaagaagaggaagggaggaaaaaggaatgtatacaaggtgggtttttgaacatcaaaatggaaattttcttttttgttctttgagaaattttaggacctgcataaattctaacataaattgctctccaaaaatactggaacagagattaaacaagatatctctaaactaacttatcaacatgaaagcattatataagatagacttacatgtcaaaatcttaggcatctagcagacctcactgtaaggtctatgggcccaatatttgaatctgacattatgatcgtcttactaccaatttcatgacctctcagctgttaagttggccaaatagtaatgctatgtcactgtagtatcagaaggagtaatgtagcctatgtatccttatgggtccaaagctgctataaagtaactctactaaattgtgttaccatttgagagaccaaataataactttttggggagccaggaaagtattaaagtccattaaaattgctttttctgtatccagttttccttcctctccctctttctacttctccttttacaattgctagaaactggtctttatagaagtcttttaaaactaggtcatagttaaattaattactcacagtacaccttactttaggatagaaagtcattgtacctatagaatacagcatgaaattcaggaacacaaggagaaatgaagatcataaatcaagttgagtgggacaagaagtgtgaaaatacagaaaaattctttttgtttatccacctaacaaatatttcttgacttacttattataccaaggatatgagctgggctgtggagatgtgtaatcccaaattactttactaatccttaattaaccaccttttattcctagcattgtctactgtgttccttctaatgttacactggaacctgaatttttagatagatctgcataggactgaatgacttcaataaaaaaatgggaacaataaacctaaagtgcctgtctgtgtgtgtgtgctcagtcatgtccaactctttgtggccccgtgaactgtatagcccgccaggctcctctgctcatggaatttttcaggcaagtatactggagtggactggcatttcctactccaagagatcttcccaacccagggatcaaaaccttgtctcttgcatctcctgcactggtgggtggattttttctttcccagtagcaccacctgggaagccctagaccatgtaattatactcaatgaactgcactgcactactcagcactgcattgagtcagcttcaaagacatcaccaaagacaatgttacaacaatagtatccaccctgatgtctaaattctcccttccttacccttcttgagcccccgtcaacccactgtctttcccaagtatcttttacagtgtcatttccattttagcatgctgaataatactgcaataaacaacaaagaaagtttttatatctatagagaaccaacttttctatttggtttagcttgaacataggaagggaaagcagctgttaaataagtagcctgtgtaaaagttcattatgaacattgtacactaacaaagtaaagatgccatattttctgaataatacatgtatataccatgttaatcttttataacatacccttatcaggaaataaatcttattaaggcacaaaaaagttattgcagttattaaaatgggtgaatcaatttaagctttcttatggtttgtcaaatttgcaaaatattatatttctcttcagatagagttacattctgtgtagctcaaagataatccctatggtcttggcatatgttacttaattgtctcagaaggaaatgccataaatagcatgctgtcatcccccacaggcactgtctcatctgtcacagtgggggctccagacagggtgaggtgctctaagacatttcttagtctatgtaaatcacagccattacttcttaccacttttcaatcggtcaattatgtataaacatgtgttaataaaaatttgcctctgtgcctctaaggtacacacccataaagctatgtgagtatgataaagtataaatggcatacattattatttgattcaacctacctcataaattagatccaaagtgcttccatagaaacaaaattccagaaaagc

SEQ ID NO: 25763 - DNA, 3850 bp, Bovine  19866880209261
acagtgaaagaggagagtgaaaaagttggcctaaagctcaccattcagaaagctaagatcatggcatccagtcccatcacttcatggcaaatagatggggaaacagtggctaactttatttttctgggctccaaaatcactgcagatggtgattgcagccatgaaattaacagatgcttactccttggaagaaaagctatgaccaatctagacagcatattgaaaagcagagacattactttgtcaacaaaggtccatctagtcaaggctatggtttttccagtggtcatgtatggatgtgagagttggactataaggaaagctgagcgctgaagaattgatggttttgaattgtgttgttggagaagactcttgagagtcccttggacagcaaggagattcaaccagtccatcctggttgaaatcagtcctgaatattcattggaaggactgataatgatgctgaaactccaatcctttggccacctgatacaaagaactgacccatttgaaaagaccctgatgctgggaaagattgaaggcaggaggagaaggggacgacagaggatgagatggttggatggcattactgactcgatggacatgggtttaggtggactctgggaattggtgatggacagggaggcctggcatgctgcagctcatggggttgcaaagagtcggacatgactgagcaactgaactgagctgaactatggaatgtatctacaaacaaaaagcggatctataagcaaaaacattaataaatgaatcatcaaaaatgttccccaaataacctgcttatccaacagaattcaatcatttttttcaagttttattgggagtatagatacaatcttagactgaattagcctgaatcaatctaaactctgtaccttaaaggagttattattatgatgtagaccttctctgttgtcacatcacaactatgattttttaaagcatttatttttaaatcacagtgacttcttatagttattagcatataaaagtaatggaaatatttaaaatatccctataacattgagttttatttcaaaagaatattttgttgtacatttaaatacctgataataaggcatataatgaagagcctggtagaccttttactttgacaaaaacaactaaaaatggctataaaatctgaaggaaacactgaaaggttgacctctgaaggggatgcagaatccattttatttttaaactgatgctgaaggtgtgtcaaaatatttataatatccacaataaagagtcaaaaacatggctggaagatttctcagacttgaagtaaacatttagcttagtgactctacttattttgtgtgatggggttgaaaccaatgtagagaaagggtcttttaattttcctttacacctattaattgctattttaaactatgaaaaatcacagctaaactatacaaaaaagtatttttacctgccagtctagtttagggaaaccccaaaggcctccttcctaaacatgaaataacacacacaaaaagttaattttttagtgtttcaaaaagaatagctcatctcaaccatatcgcagtctatccgatctgatctccttctaacataaaactaaaatataagtttttctcatacctcagcaagggagtattttaagaacagaccatggagataaaaaatgtcaataatatatttattccttgtagtaagatgtagcctttgcaatccaataaatcaattaggaaacagattatacaatttaggttttctgaatgtcttcttttctaaactttataaaagcatgtttttagagccttagtagttattttattcagatggaattaagtcttttctttttctgtgatgtactttttctgttaattctcattatatgtttatatcttattttaaatgatacatcttttcacttttcttagaaatcaatctcatgaaagatactctggtataactgctactaaaagatgtagacaatttattccttattggaataaaatatctattaacaattagcaactgttaccaatcttatccaagatgtcagtcaaaaagtttattccctagtcaagaaaatactttattatttattggcacttaaatattctggtgtttcaaaggctttggttgctgtctcctcataatatttcagcctttaagctgcttccctgcctcactgagttcacataagatacatctgaaagctttagtacaaatttacttcgaataaagtcttcaattcattttcatggcaccaaaaagacagctttaataactgcaatgacaaataaactggaaatcattccaggccttttcacttaactgacaagtagaacactctcataatgagccgcaggttttacgttttctctttgaccataatagcttcatttaagagcgtcagaccctgacacttcatcatttatctacattatttctcatcttctttcaaataaattatggaatactagactgagcacataaaaacaaagtgacttgttatcagtaaacagcaagataaattgtccagaagttcctcatttagttccctttaaatttaagggcaagttattgggtgcaccttttttaacttccaatgtttgcatttttacagccatcttatttctcttgccactggcctctgtgcactcatccagagcctgatgtggaaggcataaagtaatcccattatcccaaggttggccgctaaagtacaaataggcagaagaggagaaaatcaaataaaaaacttggaaagagatttctccacatctgtaaaacaccctatccataatacatcttgtcatactaggaaatgtgacacttccaaagtaatgaacagtgcaactgtaactcttttagcccttgaaaatatagcaccgattttaaatggatgggcgaatgccatctcctctcatcaaatcagccccatccttttaagtgtatagaatgggagaagataaaatcactatcagattgtatttctttttaaaactgttgagcaagtttatagaaatcctcacatctcttatttcttatttgtttggtattaagtttcaaagacttacttacagaatcatatcagattaataagtacaaaactcagtatttaaaagcatgaaagcatcaatattgtaagtacggtacatattgaagtcttggatgtatgctgtatttatcagtgaggaatgtgtagtgtcatggggtgactgtgtactaacaaattttcaatgacttgagctattctgaaaatagctcacaataagcatagtatttttgttaggcttttcctagctattccaattaatttgatcataagatctttgagatttaataacaaattatacagaaactgattcacagatgacataacatttatagaccccctattctgagctatagcttgaataagagaattataagtgaaagggtatgttttattatttgtcctcaaagaactgacaaaaaggtttttcatttaactttagaatgctatttaacttctgagattctacagtggtaaaaataatttaaggagttaatttatatttctctatatttatccaatgaggagggcatggcaaccaactccagcattcttgcccagagaatcccttggactgaggagcctggtgggctacagtccagttgggctaccactgcagactcagacacaaccgaaacaaattagcacatatacatgcatatttatctactgagggactattccaagttctagctcctgaaaatacagtaatataatatggtctctggctccttctatgtaatccaatcctggaagatgttccagaagaggctgctgaatctctcatccagt

SEQ ID NO: 25764 - DNA, 4530 bp, Bovine  19866880372385
ttttaagatttttgttctagttctgtaataaaaaaaagaaagaaaaaaatgccattggtaattcaatagggattgcattgaatctgtagattgccttgggtagtatagtcattttgacaatactgatttttccagttgaagaacatggtatagctttccatctgcttgtatcatcttcaatttcttttatcagtatcttacatttttcagtgtacaagtcttttgcctctttaggtaactttagtactaggtattttattctttttgatgtgacagaaaatggaattgtttccttaatttccttttctgaatctattgttactgtatagaaatgcaatagatttctatattaattttgtatcctgcaaatttacaaaattcattgagcaagtctagtatttttctggtagcatgtttttggggttttttatgtatattatcataatctgcaaacagtgacaatttaatttctttcccaatttggattccttttatttttcttcttattgctgtcactaggactttcagaactatgttgaataaaagtggcaagagttggcacttgtcttctttgtgatcttagaggaaatattttcaacttttcaccattgagtatgatgttagttgtatgtttgtcatgtatggcctttattgagttgaggtatgttccttccttgtttgtctactttctggaggatgtttatcataaatgggtgttaaattttgtcaaaagctctatatgaatttctgcaccatttcattagtgtcctttgtaacttttttttttttattttcaattttattgacttgagccctctgtcttttttcttgatgagtctggctaaaggcttatcaattttgttcgcttttcaaagaatcagcttgaatttcactgatttttttttccattgttatctttatctctatatcatttatttctgccctgatctttaccatttcttcccttatgctgactttggttttgtttttcttctttctctagttgctttagatgtaagggtagattgtttgaggtaagattatattgctataaacttctctattagaatagctcacactaatgaatatctgccagaactgctgccactagcatctttgtccccagaatgaggcacagctatctccacaggagatcctacaatactggaaggtagtatacagtctcttatgacatccctgcttttatccctgggtcctggtgcagatgagaccttgtgtgtgatctccaaaagtggagtttctgtttctccaagtctgatggaaatcctgcagtcaaaccctgctagcctgcaaatccagattctctgggggctcctcttcccattaccagacccccaggctgggaagccttttgctgggttcagactgatgagtcctgttggaggacttctttggtataattattttccagtttgtgggtcacctaaacaatggatatgggacttgatttttttgcttccatttgacccaacaatcctactcctgagcacgtatctagagataactacaatttgaaaagattatgcacccagtgttcattgcactgctgtttacaatagccaacacagggaaacaacctaaatatccatcaacagaggaatggacaaagaaggtgtggtacatatatgcaagggaatattcctaagccataaaaatgagataatgccatttgcagcaacacagatggacctagaaattatcatactaaatgaagtaagtctgacagtgggagacatatcatgtgatctctctcataagtggaatcgaacttgaaaaagtgataaaactgaacttacttacaaaatagaaacagacgcacaattatcaaaaacaaacttttggttaccagaggggaaatttgggagagtggataaatcaggatcttgggatgaatacacaacacctctgtaaataagatagatggccaacaaggacctattttgtagcacagataactctactcaatgatctatgatgacctatatgagaaaagtttctaaaaaagaatgaatgtatgcatgtgtatgtatatattgaaacattttgctgtatacctgaaactaacacaacattgtaaatcaactatactccaataaaattaaatattaaataaattattttatgtgggatgctcaagtctcagtaggggcctagtctaggtaggtagaatgtggggtctccagaaatgctatcggggtacaattggagctctcagggtgcactttgttactgtgggtgtgtgtggacagtaggtatatttgaaggacaaagagaagatggattgaggtaccctgagcagtagaggtggctcagaaagtgagagaatcaggccccaggccctggaaccactatcatacttctcagacaaagccagatctcacaggatgtacaggggttgcacatactacatataaaaacataaaccccaatgatgggggatgcctcaccctctgcacccaccctattacctgcttagagaacttgaggctgggttaggtctttggaaggattctggcccagaggctatagaatcctctggtggaggattctctggaagctatatcccctctggcaggggagggtccacctgaggccagaatggggccttagcaacaacagaaggtgtccctccacccctacccttgagggacaagggaccctgcaggttattggaactcatgatcacattcacatggaggaagctgaaaccatttgtgactctgctagtaagcaatgaaccacagatgggtcaatgctactgggagggatacgtttaaggtcagagaaatgaagtcactctgctttccacactcctgccctccaacctttcagcaggcctgccactggtgaaacctagtcaaaagttagctaagaaaggtaccctacaggagtcaggccccactgaagacagaacagagcagagcagagcacaggggtgtggtggatgcctctcagggctggcaggcctggcaactgaaaatgcctagtaagaaaattcttctaacagaacacatttttgaacatttaattcaataaagcttcccacctctccctgcctttttttctaggattctggatagtgggaccagtgtgtattttaagtacgaaacagtgattcaaatatgaaaaaggctttagaaggaattctccagtacatgaagaagcttgattcaaaaaggtaaggttgtggcagtagaagaaatgaaatacttttggaaaattatcagaggataatttagaaattgggattaagaaagaaatgtcctgtggtttatattctcatttttttgcacagcccaacaatacccagggaacaaatttgttttaattggtagttatgttttctatgtaagataaacaaggaataagcagaaagtgattgcactcattcaagttttttggtgaattagaaataaaaacgaaatgttctttctgctatcatgagaagaaaatgcccttcaaatagagagagatctggaaaaaactgtatcaaataagaagcctctgtaaatatagaagctcagttggtatttttcaagctgcttaatgctgctgactggacatctttacatgacaaacaccagatggaaaaatcagttgagagtcacaagctgaagatgacttcattataaaatgatcatttactcataattatccagaaaagcccaaaaccctacagtgcttttgtaataacatttgtgttaccaaaatatagcaagagtatacttttgctaaaagtttacattctaatctgtgagagaaacttaattattctaatatgataaacacataaaatgcttgtctaattttaaaattggaatttcaatttccagtaacacatttccccatttatagttgttctcctaaactgctgtttacaaaaatactgtaataacgtagcttttctgattaaccaaacaactgatgatcaagaagacaaagtgactggcttagtctcatcctatgtaaacaaaaagcttattttttttctctatagctgtgcataacaataagatgcttttaataagttttaaagacctagacccaaaatcaatttagcaaatgcctcttccagtgaccacacatcatgacatgtttgcattgctatttggtgataaacaaaataaaaagatctatcaatgaaacttaaataagggagattggttgcaaaaactgcaacattctaaactttagtactatacagtccacagtttgaaacagctcttccaactaaacatagttggattgtttctccagagaggaaaaattaatagctaaaaatcatgacctttcgcttttgacataaattctaagaagtgaaatgcaattggaaaactggtaaaaccttaaattattgccatagagcagaataataaccatagatctacagtaactaaatacatacacccaatctcgggtcacacatttcctctcaagcttatattatagctgacccagtgaatggaccggtccatgtttttattccaactgtactgctgcaaaataaaa

SEQ ID NO: 25765 - DNA, 1190 bp, Bovine  19866880441986
ataagtttagataataaaaattaatgtatttagactataataaagggaaatcaagatttattattttaatcctttaggcctaaacaacgccttgctttaatttctgtgtgattgtttacttatattctatgataaagtccatagggtactatatatctacatatgtagatggtgttcgcattaagccaagtcatgtcctcatagttgtgttctgtcttaaaaaaatccaaactctttattaaattagctgtccagaggatgtttacactgtatgtgcttaaatttagttagagcaagaaagtgaatcataatagtgtcaaagcaactgaaaaccctgaggcacacaagcagtcaaatggaactatgtatacaatgatttaattttatattgtaacatgtactcatgtttctaaaaagtagtaaattatttagtgactaatcttatattaaacttctagtgctgtttctgatgttctttctaataagaaaataaagagttcaaaaactgcttcaattaatttcaactcaagtgttttcccattatgagttaagatatagaaccaaaagaccattttactacagtctatatcccatttaaaacccagtaaggcaaaactgagcatcttctatcagggaaataattagaattaggcagagaaggcaaacaaaaaatataatttttacattacctctatctccagtttatttttggttgagattagctttaaaagaacaaggctcagaagaggggagaaaataactctgattgaatgttgaatgaaatagaataataaagcccagaaaagtatggttcttccaacccttgatatgctgctaacaccaagcacaggtttgagtctaaaattaaatcaactgcaatttggataattttcagcataaaacaaaaaacaaaaaaaagagagagaggggattctacttccaagtagggtacggaaagtttcaaaagtgtctctcatcatatacagacgagaaaaggtcaaataatctacaaaattgttatgttttcagaggttgtaaaataaccagcagaactgaactccaaaaggtgagaagactttctgaggagaggtgggacagatggactctttaatctttggcagacagtggaggaatatataagtgggctggaacaaaacatcttagtattaatagtgaattcttaaacacta

SEQ ID NO: 25766 - DNA, 1290 bp, Bovine  19866880502156
taagatgaggattgtcctttctgaatttctacatgtaatacactgtctctccctgcatctactatgaatccatatttcgtatgaaaactttctataatccatcatccccctaccaaaaaatgaaacagcttatcagaataaagaatagaagtatatttgcaattaagcatcagttcaattaagtgagtgagttctggaaagaaatatagttaacaaacacctcaaacagtgcgtaaaaccaattgggttgatagttcttaccaccttggtgtctcattccaagatttacaatgacataggccccctttttagcaaattaaaccttatgtcacagcttcaaattaaatccaaacctcttctttccctacagaagaaacaatttggccccacgtgccagtagttgagggggggctgataggaaacagagtaaagtgagaactccctaacccagaaggcgtcagatggccaagtcaactgggataaacagtcaagcccacttaaggtttcacattaaaagactggtaaaatatagagaacttaaatataagaatttttcataccacataaaactgaccgggtgccaaaactctacatttctgtgctgtgcaagcactttacggggaatgtgctttttattccatttttacatgtttgttatgggtctgttttgcaaagattgctccaagcctaggtaataaaaataaaaaatgcacacaaatggccatgattaacgcacagaacaatctatgcttctatatgtatgaaatgcataatattcctgtctggatatttcaatgcagaaaaatatgtggaggtcactcaacatttcacaaatttattgtaacagaagatcatgctgtggaattatcccagaatcctagcacacaaagatcttagttttgtatgcttattttgcctataaaatactgtgaatctctttctcatgaatgttgcttggtattaatgtctatatcaaggataaacaggaattgcttccataggaatctgagaatatgacacacgaatgaaagatttttaaatgtattgctagattattatcttaaaatgagttgtagtatactgatcactatgcaaataaaacactgattttagaggacattgattaccaaatatgtgtgatgctttccaatgaaattggaacaaaatctggttcaaaatactctgtaaccagtgggtaagtggtgaatttctggattagtcattttttgtcgagggttttattttcaggatgtacttcaaaatacgagtgtgttttttatcaccattaag

SEQ ID NO: 25767 - DNA, 639 bp, Bovine  19866880510719
acttaagggatgaagagaaggcctaggggaatatgttagaatgagctaatggcattcctacatcagtatctcagattcaagtgattgcttaatagtcaatagtcaaataatacttctgccctgttaaattttaaaatatagaagtaaagagtaaatttgcctcaatgtattatggtagtggaaatgcggacccaaatggataaaaaataagtctcctctcctctcctctcctcagaagaggtcatggcacatgacaaatatgctcatcttttgcaacatagctaagcaaatgcttaactacagtatggtttctcatactgtatatccaggtttgttaaaataacaataacaacaaaaagcaattctgcattatggattggaattcagggtaaagaatataaaataaacatgttgaaagcttttagcagatggaaacccattttaaatttataaggatgcccaactggtataaaggaagcaaaaatgataaactcgagagaccccagatgttgttttatagccaatctagtgaagggaaaataacccagcttactttataactgggggaaaaaaaggcagggagggggaactgaaaatattatataagtctttatcaaattatttctctagtgtataaaa

SEQ ID NO: 25768 - DNA, 2090 bp, Bovine  19866880538019
ttttgagattgcaccccattattgcattttggattcttaggttgactgtgagggctgctccatttcttctatgggattcttgctcacagtagtagatactgaattaaatttgctcattccagtccattttagttcactgattcctaaaatgtcctgtttgaccacttccaatttaccttgattcatggacctaacattctaggttccattgcaatattgttctttacagcatcggactttacttccatcaccagtcacatccaccagaggcaaatgcactaagactatttggaacagaaaataatatacttgtagtttccatagctgccccagaattgtgaattgtagagagatacagccatttctaagagattaatcacaatattgaacaattggtatgaaaaaatatactgaccatcagattagatgctggtataaatgggctgaaaattgttccatcctcagaggattggacggccagagatcttctggtacagaccatcactgatcactcgggaaataactgatctttaatatagaaatacctagcttagaattaattatttttcttataacaagtaatgtgatcacactatttttaaaacatggaaaatatctatcaatgcccagagttttgaaatacccttatttctcttatgttaaagatagttttatacttggtaggttgtggaagagccaatacaacatacatacacatacatatatacatatacacatacacatacaagaaaataaaatgtaaaagatcatgtctggcatatgatacttgaagaaatggacatcagatacaaggagtccaaatgatgcatgctgtgagggaataaaagtcagcactaagcaaaaactagcaaaaatttgacaggaaatagagccaagtttgttgcagaaccatggatctttaggaaatctgaggaatatttaaggaacccttagtcaaccttagtgcatttcatctcattttccagggatggtatagattactgcattttaatttaaaggaacttctgtttaccaacttgaagtttgctaaagaacttacttcgaatcattggacttaacctattatgtggcggatgcacacaaaccctacaatactgtgaaactttagtatgaaaggacaaaggagctcgcaatttcattctctttgttgaagggtcttaaactatgagaaccaaggtagttttaatccacttcacatgtatttctttctgcccttgtacatacatatatgacatggcttgagagtttcccttaagctgcaattactttgggacattttctcttaaatttaagaaatagatgcagaaaatcaggtttgaattcctggctatatgccaatgactaatagttctcttcggctcttttctgtgatgcttctgtaactggatagatgatggtgacttttaatggctgctttgggccttgggaaaaattatatataatatatatatggaaaagaaagccattaaggacaaaagattgtcgaaagctttactgactttcaaactgtgaaaagaagaggccaaggtaccttatgcttttgatgcctgagggctatgaagcagaaagggaaagaagaaaaaaaaatcacatattggggctctgatttgaaatcttttttcttctttccatctgtgggtacctaaatagggtcaaaaagccagcacctcagttattttgttgaaaggctaacaaaatgtctcaactttcagcacacattcccactataagtgataactaagtaagttgatcttcaagtcactaatgctttcttcctgttagaactatagcctcatggtgaactttagaaacaggtttgaatttttcataataaatttcccctgacttacttatgtagataattaaactaaattcttcccctcaagagtcaggttttttctgcagtggaataagtcagataggtttgaaatctgatccaaggttcaatcaaatgttatctcttctttaaaaaatggtacccaagtcagtcattacatgtattggtttgcgtttaggagaaactatgagctcatgttatgaccagtgctatcatcttgtgaaatcacaat

SEQ ID NO: 25769 - DNA, 1581 bp, Bovine  19866880707133
gtgaggtctgggtgggagtagcttggttaccttgtctccatttaatgaagtttgtttttctaatagctcattcatgaagtctattcctcctttatatttggagtgttttgtctccatttttggtctccaagtttgggtaacatgcacagaaatgtgatttaagtcaccgatggtttgcagtttggaccaataatcacacccacacactccttggcaccgtgtcccacagctctcagtgcttacagtcctcctatatatgttcataaaccatagaaatggcacagaagcatgatttctccttagcaacttctctgctgaaatcttgcattgtcagagaatctctctacagagagtcagcagcaagtgccttctcatgactctctttagagtctctctttagaaagttgttaggatagatctgtactgcagcctttccattctgacaccaagcttttctcatgaagtctcgggagacctgcataatccccaactctcactttcatcatttcccatatttaattgtaccgggcagaaatatcacaaaattttgctttggttattggcatcttttttcattttttcccttgttttattttgtgttatagcaagaaaaggaaaagcttaaaaaaggggagaaagagtaaaacacttctactcccctatatttcaaggaaaatgaccatttcactgatcctttaatgggactatatttctaactcttcatagatgcaagacaatagaagatttagctactctttttcaacttgcccctcttcctagcccccgggctctgtgggtactttcttcaaaatattgatgtcctgttccttccttttgtttctcacttcaggtctttatttttcttgcctctactctgaaactttgctactctttcttcaatcacttaccatttaattcattcaagtaatattaaaaaatgaattttctccaaacaatgttccctacgacaaatacttctcattgtctaacaaagttagtcttaatgctttttcttcaagcatacttggcaataaaactggcttagttagaatgtatcctatatgaatataaacacagatggaaactaagcattagagaaacttaaatatttgtctaaaattttagattttagaggccattatacgtacacatgcatagaatattctttaatgaatttaattaggaacaaatcccttccttttaactatgatagcattttgctcctctttatagtatttttggaaggattttaatatttattttgtgtctcttcaatgtcaaacacaatgtttttttcacatcagtatcctattggaatcttattcagatacattaattaattataatggaagggtaaatacactgtggatataattgtttaaaattgtagtagataaaacagataatttattccttataaatgaaatgattcacttgatacttatctcattcacagggtattcttaaaaatacttatactttctctagtcattattgataaggtgaactcgaatttgctccttacccttctttttcactcttgacattttttctgaagtcaaactctgaagtactgtgtct

SEQ ID NO: 25770 - DNA, 986 bp, Bovine  19866880719206
ctgagattcctaaacttttatttatttatttatttattttatatcctatacttttaaaatcaaggcaaaaggcacctggctagcaacaaaattcagattacttggacatgacaatgagaataaaggtcccctgtccttaatcctacatccatctggaaaaagcctatggaggacttcataactaaaccaaagatcactctaagctaactttcagatcattatgggaacccattttacagcatccttcaaaggctttccttcagagccttacttcccaagagttaggccacttcaagttacattttaacacatattagttataatgctaccatttatgcttatttactctgtggcaattatttaagcaaacactctaaatttctccatataattgttataattgcaaattcttataattatgttctcaaaagctgcaggactaatctgggaataatttttcactattagttttctagctgccacacttttgctccacattaagtcattcaataaatttttggaaataacagtaaattttggtgaggattagaatgaaactcttagcaataaggcatttcttttcaaccattgagtgcaaattaaaaagggaaacaacagtaagaccacataagtatgaaatttcaggaaacaagtactcgtatacacttcaatataaagttcatattaagtaattacttaatataagacaagagtctgaaaatttctatgtcctttggtccaatatttcccattggtacaattcaataagaaggaaaaagggatgaggatgatgaaaggtattcaaactgatattaaaattatgaagatacttattcctaaatagtgcaatgacctattacaaagtttaaaagaatggaaaagtttaataatgatgagaaattggtctagctataattttttttaagtttttactttgtattaagggtatagctgattaacaatgttgtgacagtttcaggtgaaca

SEQ ID NO: 25771 - DNA, 1592 bp, Bovine  19866880742914
tccaaatattgtatgcaagcaaactttggaatctcacatcattaaggaaaacagaaaaattcccagcagctacagagctccaatgcttaacacttctttctgcagcccacaactccctcatatgctggctttccggaaagagctccaaaaagcatgactctcaaacaaaatgaatagatgagccactcactgctctaagggaccttcatctataacagatgctcagcgatttcaggagcaagaaattgcagtgagagggataggcatttttagtccattaacttatctggtcatgagttaagtgtgtatccttattatttttttatacaaagtctttctctgtgctttaacttctatttcctcttgtgccaagtggcagtccaaagccttcaattgaatctatattaatctagtttgtttatgagaagataagtgccctgcagacatccataaatgcattcaaacatgtcctggataattttattttcattatttcaaaaatattgacacttggtttttatttatgaccttgattttttctcaaatatggatgaattctatgagaacatgacaaacaggtaggataacttgtgcattatcaagtaggacatagaaacattgaaaacattcagggggaaaaaagtaatctattacaaattacttacagctctgggaaagacagaacattaaaaatattcttttatgatacgaatttttattttattggttaatcctttacaataaatttgctttctctttatacaaatttcagaattctctgtattcattttaatgaatagtgtttatgaaatggcatttactgtgatctagatttgatgccttagggatacaaacaaaaaatctccagctgcgaagagcttgtataatatttagtgttgataacaattagataaataaagtagaaaggatttttttgctagcaataaatgctacctacaaattagtgtcagtatagtcatataaagatttccctatattttccaattctaacataaaacttttaatatgctttcactgaatttttcctaattttccaaacactgtgagctttactctatgttccttacctctctctgtgattcttcagccactacaagcctatctttgtctaacagtttctctatctaaatgatttgtgttccactggcagttctgtactaaagaaagtgatatatcctgatgaagccattaagcacggtactacagacattaaggggatgatataggcatgatttcaatcatgcaaaagggaactaccctagttctgagaaggaaagcaccagagagcttaacccactctcgtctacattttcatttcattagattcagatctggggatgtcagaacaaattaacggttattccccccacaaggcaatcactgtaagtgtcatcactagctgcacggtgagcacccacagggagaagggtcaggactcggaatatacagcatactggagaggcccaaagaacaaattgaggatgaatgggttgatagtacggaaaatatgtttttaaaaaaatgttgatcttttcactctgtgctgtcacgaaaatttcctttaaaaatcg

SEQ ID NO: 25772 - DNA, 1977 bp, Bovine  19866880760293
ttgaggaaaagagaaaattatttggtgtgtttcactattgtacctgtcacacacttttaattaaaaatgtattgacgcatgactaaactgtgaaaaacagaccccatttcagttcaatggaagtaatgtacatgtagcccagtagaataagcccatgtaattatagcacgatagctcaggcacagcaagcctctcacacctcaatctcaaagcagatgtaaatgtcaggcaccaaatatcacaaatctgtgtggactcagcatcagtgattttactaatctagtctaaatacctatgatgaagtcattttgctaatctatggcaaattaaatatgtgtagaagtgaatgttgaataatgagtaactttccttttattcaccactagtattgcatatcagaattaactgaactcagggctgaaactaaatgcatatttcaaatagtggtagatatgtgttaccatgagtttggaacctggacctaaaatactttttatattaactgatttttttttaaagtaatttacccacaaaaacttaacacaatcaagctgaagaaatggaaatcagagactaaggtctgaggtactgtccttcattgagtagtcttgaaatagtcactaatggcaagatgttttagaaatctcagaaaccataacccagtaaagaaaacataaaataaaaaatcataccagtttgatagttctttccatttttaaatcaaatccaacagttgcatatttaatgatggattaacataattaattaggccagtaatcactaattcaccattctctataagatccactatccatgtgttatagtaaacactggggaaaagatgaaaatgcttatagtaaacactggggaaaagatgaaaatgctttatttatttcttcagcggaaagtcttcacattgggcacttccacagatggtatctcagttaatcctaaggacacatttgagaagtaggaattgttttactgatgagataaactgccactttgataaatgaaccgaatttttcatcacacctagtgagtgacagattcaaacttcttatcctctcaaagcaaaatctggtttctttctcaccattgtgatttattgctactcctccattcaagtaaattaacagttttaaaaatggagttatctttaagaaagctcactaacttatgtgaccctaatatactccatgtatttgcatactttaccttattttattatcttaaggctttagagttaataatgcaatctgcatcttacaataaggaagtgggctgaaagaaattatgtgtgtcattcaaaattactaatatgggagacttatttcaaattcagatgtccctagttctcgaagtcctgtttttttttttgttgttttgttttttgtttttttgtttttttggatttaatgtatagaaatggcttaagtgggaggtaaagatgagcatactaccattcagattttgggagttgaagtttaggttgaattatttagacttggacaactaactgaagatttttattccttggcctctcattataaagacccaggataattataggcatatatctggcagcaacataaaacttgatttaaaagggaaaagaactgacatggagtaatgaagtaaaagtatctgatggcctgagaaattgtgcagtggagaagtgaaagctgtggcatggggtgattgttagagaggtatgatggattggatcattctgatacctgtttaatggctgagtgaatgtttcaaccctcactgaaaagacactgacatgacaatatggccttgagaataaaaagtaggagtaaaagagtaaaataaaaacatcattttgagcatgaagaacttaagagtctttatcttctgtgggaacatgggatttgatgaatgaaaaagaggtcagagcaagatataaagaccaatgagtatgattcaattgctcaaatgtgagagctcaag

SEQ ID NO: 25773 - DNA, 1821 bp, Bovine  19866880800305
tgaatactaaaaaattttaaatatacatatatgcataatattatagttaaatcatgaagattatctcatagaaataatagagacttattctacatatattgcatagtattcataaattgcatttctttttagtcttttgttgacaatattagctttgctgctttatacaaagaaaccaaatgtaagtaattaaaaaaataaaacatatcttagtgaactaatgaataacaatgaagtttgaaatttcttctaaaacaactagtctcaggaaaaattctatgcaaatttttacttcacagatatgccttcttcagaaagtggccaccagaattcacactcaacaaatattttaattcctgaggtcttatagaggaagacaatttttgtaattgttctgaaaaaatattctttttatgtccttcaaacaatgaatgcaaacctaaatgagttttatattcctagagggactccctcccagatccatagagtctaagtaggcaatcactcactaccctgtgaaagcaagcagatgatgtctagttagaagtcacagacttttggcaatactaaaaaatctaagagtctgtgtctgatttgaagcagctttttgcttcactttctgtgatagaactaacatgacctgaaataatgcagttgtcaaatgagaatctgttccaaaattaagatttactgaactagtcctttctctgccagtgcattgtattggtgggacatagcaattttatgctttggaagaacagccagaagaaaaccagctgaaacagcagacaatgcatttcattcataacttcacaatttttgtttttctcttgatgtcctgttcttaatattactaggacacagcctctacattttctacccaattaattggaatgtaaagagttcattctctgctatgtgattctttctactttctctataaggaagaaagtttttagaagaacttatccagctaaaatatagaaaagaaactagggcagcaaattttttctcatttttacttatggactatactgaaatggatataaagcagttttggttcacatgtaaaagatctgattcaatactagaaataaaaaaattggctttaaagaagttttggttcacatgtaaaagatctgattcaatattaagaacaaaaaattggcttagcgggtacagtgatatggagccacagaaaataatcattcacagaactcctgacagtttcagtcacaggattccctgcaatgactgaaagaaattgtggggtaacttattcaggaatgattcagaattgatgcaaacccaaagggtaacttctttgttgctgatgttagtggtggaccacaacaaaaatatcgtcattaaaatatctgtcctaaaatggtatgcgtgtgtgtgtgtgtgtgtgttgtcatgaaattgcatgatttgagatgaatcaagtttcatttattgtctccaaatatcttactacttatctgttaaaaatgaaacttctttagtaaaagaaacccagtgtgggggtttctatccaacattgcttccgtccaagagtttgtaaaacagaagttgaatttagaccatactctaacacaaagagataaagctttatagcaatccatgcgtaactccaaaccaaataactgcaaataaattggcaaatggcatggtctttttaatacactgtcagtttatggagctgggataaactaaacctggaatttaattacaaatgaaagccaaaagtatctgaatgaagaaactgagtaggaatatatgtccataatatgctgaaaccctttttcttttctatat

SEQ ID NO: 25774 - DNA, 1241 bp, Bovine  19866880971978
aattcgtaacatttttttcccatgatgcagtctatcattatttagatgactaaaagctttaattatttacttttgggagtccctgaaacccatgtcattgcaaatactgaagaattttctgggaaaggtttgaaacacttccagttaaactcttgagttaatatctcaagaaggaaaaaaaaataatgtttctaccacatattttattaaaccctttaggtccttttacaagagaggaaataccaattaacatataatttagcagaacaaaatattatcccatttcaaccagtacccacttccttgaagtttattcaagcattaataaccatttaatgcaatttaactacactgaggtatccattacattaatataatatatccatcaggaaattagagttttgtttccatgaattttgtattacaagaaggtctttataattttaatctgcatttgatgatgcttaatttcaactcctcagtctctgttacagtgtgagatgatcaaaatgttcctaatgttaagattacaattccttgatttattgagccacaaagcacaaatgatttgtgaatgtgtgtatatgtgtgtgtgtgcgtgtgtatatgagtgagagtcgcttagtcgtgtccaactctctgcgactgtagcctgccaggctcctctgtccatgaaattctctagccaagaatattggagattcccttctccacgggatcttcctgacccagggattgaatctgggtctcttgcattgcaggcagattctttactatctgagccagagaagatacacacacacacacatctcatatttaaggatttagctatttagatgtgcagggttatcaaatctcattaggaatgtaagaaagtgactatatttttgagaatggatcatttacagtgatccttttaaagcatacatattgtgatgatgtccataaagtatcatcttcatgatctggtgtcctctacagtgttttcaaaagatgttatattatctatttggacagctacatcagtagatatgctattttatgctttagctcagaaagtatctgatcatggaactttagctattaaaacacttcaatttgcaagaaaaatgtaattatatgatagcatatgttagaatattagatatttattggacttgataagtatttcattggctatctttaagtgcttaaagagctaaaagaaaaaacttaataatagcaacttgactacatagtgt

SEQ ID NO: 25775 - DNA, 1964 bp, Bovine  19866881034632
gccctgctgtccttgcaggttgtcagaggcaatgagccaggtttatttcaaatggctccttaaatgaacatttattttgtgccagtaacacgtttttgattaacagctccttttgactaatttgcttccctaaacagcccaataaaggactcgtttaaaacataattaaaagcatgttattgcttgtagttaatactgattaaaacagacattaagacaattatcattgaaggaaagtaagcatcgcgtagttagtattgaatccatccttactgtttttatgcatcatatacagagatgggtacttcacaggctagaacaaggtattatttttaatggaatcatataaaaatatgttcctgttttgtttgttttaatgaatggacagatctttgtctctgtggactatggacttttttttcttgcgggaaacattcatatattcaacaaggtgtaaaggtcactgaactgacttcggttatgcagagttaaagctcagctaattctcttgtgtaaatgggatataaactcttcttctttctacttgctctcagtacacaaactctcttggtcccattattgactgaatgcagcttttattagtattatttggtacttttgatccatttgttttcacattgattcttgttttgttatgccatgaaataaaactaagaccttcattgatttctgattctttttaaaacagaacaatagtgaaacaatattatgtgaagtaagtacgtaaagtttttttaataacttctgtattttgcatcaaagtatgatttttttaagaaatcatactttgtgtaggccaggagtccccagcctctgggtcctgatgcctaatgatctgaggtggaactaatgtaataataatagaataaagtgcacaacaaatgtaatgtacttgaatcatcctgaaaccaccccccccccacccccagctggtagaaaaaattgtcttcacaataccaatccctggtgctgaaaaggttgggaaccactggtataggaaattaaaaaggagcatgtgttttgcatgaatgattacttcactgaaaatgaaaatacagaaaaccacctccatttcatgtgaaggatttctttctagaagtatttttattatgatcaacttgatatttaatcttttttttatgtatgggcttccctggtagttcagctggtaaagaatccacctacaatgctggagaccccagttcagttcctaggtcaggaagattccctggagaagggataggctacccacaccagtattcttggacttccctagtggctcagatggtaaagaatccacctgcaatgtgggagacctgggtttgatccctggcttgggaagatctcctggagaagggaaaggctacccacttcaggaatctggcctggagaattccataagtccatggtgtcacaaagagtcagatgtacccttcacttcacttttattttgtgaccattcaagaaggcatgtggtggacataatgaggaattgattttggtatacttgatgagagtgaaatagcttttacagaatgcatttataagaagtcattttaaaagttaaaataaaatcgcagagacaaaactctgctgacagatttgatcattgtttagattcctgtttttctgtggtagcccctggatagtctttcaagtagatggcactcacttaagtgtcttggccagtgcaattatccagggatcatttgtcttctccctcatggttccaagaaaattcaggggtcacaatagtcactagaggccaattcccaagaaacagacaagaacttataaggcattatgtgaacaaaactgtgggggacaaatactaaaaaggagaaagtctttcgtcatgttttatataaagaataaatatttcttttcattacactgcaatttaggctgtttacatctcttttctggatgattccaagaacctt

SEQ ID NO: 25776 - DNA, 1919 bp, Bovine  19866881053232
gacgtggggagctcctctttgctactgctcctgtgccgtcacagcctatttaagtacattaatattataatctattcccttttaaatattatttcatgaatcaacgatatttttgtgctcttgatatgtggcaaaaactgttactagaaatggaatggtgaatgaaggtcagaatccttgttttctttaaatttgttctagttggatggaaaaggggacttttaaggagaggaaaggcatacagtaaataaacagatgaagaaataaaaaaaattcagaaagttacatgtgacaggtgactgtagatggcttctccaaagaagtggaattttgagtgagatgtaagtgttgttggagtaatacggatataaagccttgtgaagaacattccaggcagagggaaaagcaaatgcaaaaggcatgacactggaaaaaattggtatgtttgagaaactgagagaactaattggtggagtcacatcagagttggtcagtcaatgtgctgatgtggattgagttcctttctgccatgtttatttgcctcaatgtcccttggtgatacaattatatctctgctgctgctgctgctaagtcacttcagtcgtgtccgactctgtgcgaccccacagacggcagcccaccaggctccccaatccctggattctccaggcaagaacactggagtgggttgccatttccttctccaatgcaggaaagtgaaaagtgaaaatgaaagtgaagtcgctcagtcatgtctgactcttcgtgaccccatggactgaagcctaccaggctcctctgtacatgggattttccaagcaagagtactgaagtgggttgccattgccttttctgaagtatatgtctaaaatttattaattctaaatgggaagtgatacaaaatataatatttaaattcatattaccagaaaacctatcttagactataataaaaagttaaaaatctgttggaataattatcaaattatatatatgtgtgctcttaatctttcagagaaaaaagtgcaaagaaaaatattactggagtaacagtcatctagaactcatagatttattaggtatattttgtataatgtaagctatgatatgtactagattaaaaggaagggatggttggaggagaaggttaaaatgttcagaaaataaccttgaaatggttttccaaaatgttaagtttgacaggcagtagtttaagaaagcatctttaaaagcaattctaaaggaaattagagttggcttagtaaacattttcattaactcagcatatttccctaaggacccaagtggccaacctatacctcaatacttcccccacttttcttcccacttgcttaagatgaggttaacttttaacagatagaaaatgtgcaaatgaattaatccaaaatcattctaaatcagatattgtggcaggtcactaaatgttgttaggtttgttttagttattaaatattattatcttttacagtgtaaaatgagaatagaactttaaggcaaatactaattaaaccaagatttttaaaaaatcaatattgtttttttactgaaacatatagcaaattacaaatgcaaattagtcatctaaaaactatactaaataaactaagattatgtattataatataatgctatattataacaatataacactaaaatataacaggttgggcacctgtttcttcatagcatcaatataccaaaaaagatgcagtcaattatttttagataagtggtataaaatacatttgatattcttaatttaacaaatgcttctttgttgacacacattactgaatgtggaaattcataagttgcaaatgatcttagctatatcatccattaagtcataattcagacatatattctcatcagttagaattttttcccaatgtaaaaaa

SEQ ID NO: 25777 - DNA, 748 bp, Bovine  19866881085426
tgagcattgccgaagataagtggaaacatggagcttagaaaagtctgaattagaagaaaagcagtattaagaagctatagtcctggatgaaattacctagtggaagaaaagagaagtagaaaataggggtctagagttaaacagtattggacttgttatgtgacttgaaagaagatgaagagaagaggcacagtaaccacaaagaagataaaaggaaaagtcttttcaacactgagtcagcaaagccaacctggcagagattattccatgaaaggatggagaagggctccacaggttttgtgaggtcacaaatcccattttccttcctctagagttgaaattctctgccaggaatgattttgcccctccccttccagagcattggataaattttggaaacattttggattgtcataactgacgggtgctattggcacctagtaagtagaggcaagggagactggtgagtaccacaaagcacagactacagccacaacaacaaaatgctctgctcccagacattaaaagtgccaatattgagatgccttgctctagatcctattgagcacacttgaccataaactgagttttctaaacctttccaaattagaaagggagcatcttcagaatgccaaaaaatttatggtacttcataatttgaaaagtggacccaagacacattttcttctttctagactaactagtagcaacagatcctatatgtttccaacactaaatgtcatgtctg

SEQ ID NO: 25778 - DNA, 889 bp, Bovine  19866881098847
tctgatgtcatcttagactctggcaaagagcccatgtgcatgaaagtttagctatcctgagaaacagttcttgtattttttttacagttaatgattaatattaagccaaactaaagaaacaactcatttgaaaaagtggaggtcattttccaactattacttcatagtgtacactggcattgtgccagggagacagaagggaaagtcctgtaataaagtatgttttaataaattattaatttttcatagccaggctaaagatttagaaggaggatggcattttctaactagggcacaggcttattgaggttaaaactctttttcttttgcccaacattgcaatatggatgagctttagctctagcttatcgtaactgcactgcacaatcaatatttaaatcctgaaagatcagcaataatggatgcaaactgaacagatcaatatttagccttttgtggactataacgtttatcttagccccaattactctatggcataggggttgatttttttaatgtcctgggtgcttggcatctcactaatattattttaaaagttaaagaatacactgtgagacacctgtaaagagaagtattgataaaaactattctaagtaggttaattttttcaaatcacttgataatgataaatttcaattgtgacatatatgttggatttttttttttaatttatgagggagtagataatttaaaattcataaacagatatttccttggaatgttcctcagcagtattgcatgaccacttgagagatgtttggccagcttatctttttataataaaaactaattatgaatctgacaaaatattatcacagtaacattaaaatcttttttaatttattcagatatcacagtataatcaatt

SEQ ID NO: 25779 - DNA, 1021 bp, Bovine  19866881210628
tccgactctttgtgaccccatgaattgcagcatgccaggcctccctgtccatcaccatctcccagagttcacattttcagttcaacacattgacaaaaactacatatatttttactaaaaaaagggctagggtctgttttataaaatttttaacctcagaatacttcaaaccactgttgcaatctactttaatttcactaagaaaaaagaagtaattcaaagcaatttgagattatttcaataataatggtacaactgttcaccttttttttttttttttttcccattaaaaagtgagttattagtgcatttctgctcttagggtaaactcgagtagaatttgtggtagggacagaatttcttatggttactgcagttctatagggcactttcaaatatactcccaaactgtttaacactcccactgcataaaaccgtataggtctctggtatttctcaagcttctgtgtcatataaaatcaatttatgtgtgtatgctttctactacctgatagtttagggattaattataaacaattttaaaataataatttataaaactggtaacataaggccaaggtaatacatggctcttctgataaaatataaggcctaatcaaaacaaaatgcagaaattcctggatggctgccccacaataatattttacagtagaccttttagagatatgttggtaggagagtgaaaaaatatttcaatagacacattccttaaattatgccacttaagcacttgtctatagtgtctacatattagtctagtttacaaaataagatttcaagattattgccttcaattcatttttagatctcttatccagaaagcatttcaaatactggagggagtattcgattgagggggtctctttagtctcatactggatgcaagattttggccaaagtacttgaaaattttaagctgtttccttgtaaatggaattaatgatcccaggaaggtcttactgtggaattaagcaagacaataagtagaaaattcaaatag

SEQ ID NO: 25780 - DNA, 1345 bp, Bovine  19866881257405
gttaaaggctggaactggttattgatatgagttactttactcaaaggcataacatgtccattaaagatcttttggtttttctgttattggtgattatatcaaaagtagaataaatgaatatcctgtttaatttaagcaaattcactgttcagtatatttctgagtactttagtagtctttacaaacggatttttagaataatttctataagtataaaatgtcctcctataaatctttttctatgtaattctctaatttggttcaattttatagacattagaacttgaggtgctttcacatttcctatctttttaaggttatcttttctttttgtatcagaagtacaataattcaagtcccctcttgaaatagaacagtgagtccaataacttcctgaagtaattcctaaaaactctagagaatacagacatatcctgatgtttcttttcatctctgtctataaactgcacatcctgtggcctcatctctgctcctctgtgccacttgaaacatctgcactgaatgatactttggaagatcgatactatagttcctcaaaaaaatatcattagggaattcaaacaaataatcagagtattgaaaattgtctagcagactttgactgcctgtagttcattgattttcccccttacattagaaggtccttgatggctatttctccttgttctccctgtctcactaatctctttcctccttgagctcatctacattcatcccctcacttccttctgtctctttcctcaggtttccactacatgaagctcaagattccttcttaatataccaattatcactctgctgagatgcccattttacactattcaactggtataacctttcacactataatgaaaatagtcatcaacctcttatgaagaattgacatttttcttactgagcaaatatttgggcctgctgccaacacaatactgagtaaggtacttggcttacatattcatgacaaagagggtttatcaaaatgattcatttaaaagtctgacagaaagacaaattttggctttcttctttagaaccacaggacggaatgtgtgaacagattaaatgtagctcattttccccttcaaatcttctagtaatccaggtcagacattgaggaacctgaatacttaaaataattaaaagcaaatagaaataacatttctcccattatcattattattttttttaataataataaactagagaggaattatgttcccatttatgatggagtagcatgtctgaggggaaaaataaaaaacctgaaagaaaacccaaaaaacaaaacaaacaaaaaaggataaagatgaataataatcaaaca

SEQ ID NO: 25781 - DNA, 713 bp, Bovine  19866881378133
gccacaaagtttaaaatatttactatctggccctttatagaaaatgtgtgctggctagatcatactgggattcaaaaaagtgaaaaagatagattccaggattttcacatggaggaactctgatctgagtcttctgtcactttaatgaaggtcaatgaaatgttgccttaacaactagaagagtcactgaaggacttaaaactgaatacactaggtgattttaattacctaggcatctattgggaaaacagcttgacaggatatagattgtccaatcagttatttttaaagggttgctgacagtgcttaatgtggaagagggaggaagctaaagagacggcaggcctcctccgcctgcataaacccaaggaagagcagacaattgcaaacaaaatgagatatgtctcttggaagaggcagagacggtgaaataaatggcagaatttgcaacgctaaggcaagggcttatgaaaagcagttgaagaaagactatgaattttaagaaagtaaactggagtacaaaatgccccaagcctgcaatgactggatatttgcatatatacacgcgcaatcacctgctggaggcactcagaaagtttgccattgacctcgttcgatggaaagattggaatacccaatcattcaggggaaaaaaaaaaaaaggaccagctgtttgagttaaatagaccaaaatttcaaaaaagaactcagca

SEQ ID NO: 25782 - DNA, 1453 bp, Bovine  19866881416644
ttttaggatggactggttggatctgccttgcagtcccagggactctcaagaacttgcattggaaagggttaaaaagacagtaaaaattacaaacaaagacctcccatgctaaaattaattttgtgttattcagctaacagactgacaagcttttattaaaaaaaaaaaatccacacctttaaactggctgtggacccacatagttatcaaaatccccacacccttttgtcatgcatctcacttgaattccttagatgcattatctgcatgtctttattatttatgaggagggaaactgagagaagacaattaatatgccccaaaccatgcagctagttagcagtagaactgggtttataacaaagtactggttctgagctcagagcttttcctgtattctaaaagttgaaatgtgataaagtattgtgttgtacagcattattacatgatttggatttctttctcagaatactggagctctcagggtatgtttgtgcatattggtggaggggttctcagagaatgatgaacctgaagtcccagagtgcacacagggatgcagtttgtctcttgagtcaaagggaataagatacaattacaccttgcagctatagctctcttattaccagaaatgcaagtgaaccattgagagggtgaatactttcagttatatccacccacagattatcaggagaaatatacaagataccatgatagacaacagtaaatgtataaatgtgtttgcttttttgatggaagaaactgggaagtgaatttactagcattcaaaaaaaaaaaaaaaatctagggatataaaaggaatatccagtctgtcatttcatgaatatgagggacaacctaaatgataaagtgattcaagattcatttcagagaaacataactggtgaataccaaaagtttctttgctcctttggtttggatttggtgctttaaactgacaaagtcaaattttaaaagggtgcttcctttagcataacatggacttaattagaaaaatcctttacccatcatactttctggaatggtgaaggcagcttttggaagcagaagcacactataaaatgttctgttcctctaaatctatcctgtggtattaaaagtttctccattggatttccatctcactgggcttttttggcataaagaagtgtttataaagtataaagttgcaaacgacagacaagatgctttagtaatctgctctatgtgccaggctaacagtggactgtcaaggccaaacgtttccatgcagatgattcattgacaagagcagccagtacagacacagaagacttgaaactttaaaatctctagacccaaaatatttcaccagtgaaaattagaatttatatttctgggtgtctttttcttccctcttatcatcaccaactgatgtttatttccctccttttccagaagtttatgccactgt

SEQ ID NO: 25783 - DNA, 1037 bp, Bovine  19866881467250
taaaatacatagccattaactgggaaagataaaagataaaatgttatgggtttctttatatttttatatttgcaaattacataacataactgtatattattttataattaaaaaaacaaaatcaattttaattaggatgaaattatccaaataaacatgccaaatagaattataaatcaaaatgtaagttcaggaaataatagacaggaaaaaccttcagataaagcacatatccactattacttgaaatataatgctgacatgaaataagcatttttctgatactgttatgtattactttttaaaatgtcttatcattaagttttgtgctactaaaatgtcagtcaatcaaatgtggaaagatgagcttatacattcatgaagcagtcaaacaattttagatctttcttttttcagatttgctagaattgacatcacattgaatgtaaattactcataaaatagaaagcattctattaatttaaactgctcttggtcatgcctgttcaacttaccaactgttcctatattttccttaagatatacgtaaaaaaataaaatgaacccttgcaatagtagatattaagcgactaatgttgttaacattactagtaaaggattcaaaggaaggtgtgtgtgtgtgtgtgtgtgagagtgtgtaacattccaggttttctggttgttagattaactggttgttagattacaaggaatgagtcttcagttctataatagaaagaacacaaaaccttaatcaataaacttgataaaatgcatgtcagttattttagacaatttgccctccagtttggataattgttgctacctgtagcctaaaccattaacctctcaacctcagtaaatggagatttcctagcaaaaaaaccacactgccaaaaggaaaccacatttctaacaggagagagagggtagtttgttaatcaaaagtctgtaccacagtgaatttgatagttaaaattgagttggcattttttattttctttcaaaaatagcttcttgtaactcctcaatagact

SEQ ID NO: 25784 - DNA, 960 bp, Bovine  19866881634175
attgaatcctttaaattgcatttaggcagccctgccaatcattagtgttccatttctgcctagatgctaaggttctataaattctaatatctcatgatattaatgttcaaactatattttctcaccaagaatataggacattatgacctccacttacttatataaaagtaaagggagtaaaatgttcagccaaaactgtaatgtctatttctaacaataaataatgttgagataatcttcaaaacttaacagaatcaccagatgatatgttttctagacaagtcaatttacaacaatgtatttttacttttttgcaatgcaacataaagcctaataataagatctgaattctgcaaatataatactagacaaatctgcaagtataacattcttctctcctactgaacatcctgtgaattcatatttacatattacaagttataattatgtagcactggggaaaagggaaaatgtaactgtatatttatatctacaagaatataaaagaacattcataaattacaaatgtgcattgttctaagaaggatacctactgagcttttgtatcttaagggcaatgcataagacaagtttctccatttcccccatcagtgggctaaaaaattataattgtaagtttgaatgactattgattgcttattatagtttctattattagtcataaatggttatgtatgagcacatcattgtaggtatttgttaatgtagagggggaagtttgtattgctatagggataattctccttaagaaactgacaagcatgattataaagaatactgcaaagtacgtatttgcttaaaaaacaattacctaaaatagtacagttaaatgctattttgcttttgcttttcatactagtaggctttctatagtaaattctacgccatagattaatatgaacactaatcaaaaggtctgctaaataaaataagatttaa

SEQ ID NO: 25785 - DNA, 1371 bp, Bovine  19866881654949
ctgcagcatgccaggccttcctgtccatcatcagctcccggagtttacctgaactcatgtccatcaagtcagtgatgccatccaacaatctcatcctctgttgtccctttctcctcctgccctcaatctttcccagcatcagggtcttttccaatgagtcagctcttcacatcagatggccaaagtattggagtttcagctttagcttcagtccttccaatgaacaccccagggactgatctcctttaggatggactagttggatatccttgcagtccaagggactttcaaagagtcttctcccaacatcacagtttaaaagtatcaattcttcggaactcagctctctttatagtccaactctcacatccatacatgactactggaaaaaccatagccttaactagatggacctttgtcagcaaagtaatatctctggtttttaatatgctgtctgtgttggtcataactttccttccagggggtaagtgtcttttaatttcatggctgcaatcaccatctgtagtgattttggagccccccaaaataaagactcactgtttcaaatgtttcccatctatttgccatgaggtgatgggaccagatgccatgatcttcgttttctgaatgttgagctttaagccaacttaaatacattaatgtattccataaagtccttttaattttgagcatactcaagtttttatttcaagttcatcagttaattgactttgggtggtcaatcaaatatattttatcccattttacttatataatatagatgccaaactctagttgaattttaaatataatctctttattgagcacatggaatagaggaaatataataataaaattatatatatatatgaaatgtgcaattaaaagaatggcatagagactcagaagcatataattctgtctaaatccatagttaagaaagactttacagtgggaaagatcccatgaacagaggagcctggtgggctacagtccatggggttacaaagagtcaaacctgactgaacacacacacataattcctattaaggattcagtttacagattagactgtttattaaatacgtcagcataggatatttaataaatgaatacatgtttattggttatgtttaagtattattttcaggaagataaatttatacccctgaggcaaatatcaaatgaacatttgtcaaagagtctatttaactcattaatgaattagtgattaaatggtcaagtttaatcagttcaaatggcattttatgaggaataggtacagagttaattttaaaaagaaatattagggtaagattcttgggttagatataaaactggggtagtatcttacatgacaataaattataa

SEQ ID NO: 25786 - DNA, 1324 bp, Bovine  19866880401172
agctgaaatggtgaccttttctttcctggacacttctcgtgattgagttattcccagaaacagcatgctggcatttatacttaagaattttgatatagttacaaagctataaattaagtagactttccacaatttagaagaaagacagtgaacaaaataaggaccctgagaaaacactaattacgttataaattcttattcatggacatattataatggaaataaaaattctagagacttggaagagagcctttgaactgataattttactgcagtaacactgtcatttaaaactatataaattgatgaactatattttaagtttaatttgttcagttttatttccaatctacacaaattgtacaactttttatataaatatggtatacaaaatgaaaatcattgccaaaatccaaaactattgttcacacatgtcaggctagcacatgaatgtgatggttcttttaaggaaaaatgaattcaatttttttttatatcctgaaaataattaagctttataattatgtgtgctgttaaataattttcatctatatttttgcaatagacattcagagaattttaagaaatttgtgttcattcttgaaactagaatttttcttacagcaaatgttaaggcaactttgtagggagaagaaagtccataaacttttttctgcatattgaagtataccatttatagctatttcaaaatagaaaattgctataccttcaatagtaacacttaagattatttgcatagacttctaggcttatgttaagcatctttattgtgaaactctatagtcttcacctgttctcctctgtgtttctgtagaaattattgaaacactttctaaaacattaaaaaatgtctcagagacattcagctactgtcaaggggagggatatatatagctaggaaccatcatctaacatccttctaaagacttgtcaaatctgtacgaaacagagagatcatttctgcattataggcatgaaaatggttgtaattaacttctcaagcccaactacatggtgagagggataactataaaagaattcaaaccaatctcagcttaattattctgcacagggatgggatgagggcatttccaatagcctcctgttgtgctattggaaccaaagcaagcttgattagtgcacattatgtcatgttcttcttcatccaaatagttatatctactcttaaagccaaattcaattcaagtggtaacctctgtcaacttatagaactatttcagagaatttagtttaaaggtatctgaaaaaggagggtggttccagattaggttgaggtcatata

SEQ ID NO: 25787 - DNA, 1506 bp, Bovine  19866880463466
tttttgatgtacatagatattcttccatctttaaatggttccatagtattttattatacagatgcatttagcattttttatcaaacataagtattttttatttttatacattaagaataaccttgtttaatcttttattctatttaaattaatatatttcctgaaattttaagaagtataattgttgaatataaagctacccagattttaaaggccacagtaaaattgtgtaaccaccctatacaagatattctggattcacttctcaccagcagagtatgagagtgagtacttgaaattatcaatacccattttacctaggagcctcttccatggatagtcaacaaaagcctggttgcaaaggtaccccttatttacttatgctgctgctgctgctgctgctgagttgcttcagtcgtgtccgactctgtgtgaccccatagacagtagctcaccaggctcccccgtccctgggattctccaggcaagaaccctggagtgggttgccatttccttctccaatgcatgaaagtgagaagtgaaagtgaagtcgctcagtcatgtccgactcttagcgaccccatggactgcagcccaccaggctcctctatccatgggattttccaggcaagagtactggagtgcggtgccattgccttctccgttacttatgctattgagcaaatatatcaattttccccccagtaaactatagctagttatttataaaatatgttctgagtggattattatgaatttcaattcggtatcaatatatcaattcagtacatgcattgaataaaaaacatttctctgaatatgaaaaataatacagcttatttttcacatatcagcaaagacttctggagtccagaaggtgattagaaaagtggaattttcaatcttgtaactttcctgagcacacctttcctactttttcagtccccgagagtccttgttatttcagcatctgtgtcttcatacgacgccagttatccaagatgctggaggcaatcagtgtggctcctcgtcaacttcagcagccctggcctccctagtacactgcagtctgggtacttgtagcacatcaatacagggaccttagagaaaaagccaaccaccaccaacaataagaattggtagctctttggaatccctataatttatttgaatatcttgttccttattctttattacaagaccctctgttaacactcaaaaatactggaaaattttctgttctccatgttcatttttctatgggaaaataatgagcactgattatgatttgaacctgtaaaataagtgaagtttctgaagagtcacgatttaatgtagtgctaagaaaagaaataacacatatttacactttaatgaattaaaatactattaattccttttaaaaactaaacacccaactgatcatcaaatagatttaaataaaattaaatttaaccttgttagataaaaatttgggtcactaatagagaaaaggggttctaggac

SEQ ID NO: 25788 - DNA, 1943 bp, Bovine  19866880480836
acgattacctttgtgtgtaacatgtatgcttgcatatgtaaaatgaaataaaacaatggataataagggttgttgttgtttcattgttaagtcatctccaattcttttatgacccatggactttagtccaccaggctcttctgttcataggattttctaggcaagaatactggaatgggttgccattttccttctcatgctgctgctgctgctgagtcacttcagtcgtgtccaactctgtgccaccttctcacaataagggctaaatgcacataatttctataggatatcggaactttccatttctgttgtgatccagatttccttggccataataattttattttgtattctcttgtacagttttataacgcatttctcagtctatcaattgttaaacccttagtaccctaggcttatccttgcagataaaattgtctttttatttatttcttttctgagtattttttcaattttaattggaggttaattgttttatcatattgtgttgatttctgctttacaacagtatgaatcagccacaagtatacatatatcccctccctcttgagactccttcccactcccaccatgaaccttttttttattttagagttgtaggcattacaagatactgactcttgaatgcagtgtaaggaagcttcagtagctctgaccagggttaacctagttgtttcttttgggtgcaatcctcattcaaagtggtttagctgcaaagcatgccaggtagatccttttattttaggtataatatatttgaaagataatgctctatcatctaggtctaaaacatctgactacattaacaccatttggttggttgttcagtctgactctttgcgactttatgtactgcaacgcaccaggctttcctgtttttccctgtctcctggagtttgctcagactcatgtccattgagtcgatggtgccatccagccatctcatcctctgtcgtacccttatcctcctgccctcagtctttcccagcatcagtgtctttttcagtgagctggctctttgcatcaggtgtccaaagtattggagcttcagcatcagtccttcaaatgaattttctggttgatttccttcaggattgactgatttgatccccttgctgtccaaggaattctcaagagtcttctccaacaacacagttcaaaagccttctttatggtccaattctcgtccgtatgtccaatctatacatgactactggaaaaatcaaaactactttaatttcatagggataggtgatgaacctgataaaatataaactccttgagtatctttgtatgtatgtgtgtgtgtgtgtgagtgtgtgagtttgtgagtgtgtgtgggtgcatgtgcgtgtacatactcttacattccttccttttgcattgatgacttctgtcttgggagtcacaaatattttaaggtactcagccataattgagatatacctttcaaaaatgtagctaacagttttgtatgaaacacattttggattatggttgtatataagcagaaagtatctttgggaatgcatcaggcacttaactatagcaacaaccttgagaattgctacaattttctaagcttggtaaagtgtctgtagatttatttcttaattaaatttgcaatttggattacagattttggttaatatcacaaaaatgttacaagcctgggaatagtttattgctgtttaatgtaaattatttgttaattgcttcataacaactttccagaagaaaatagagtatacttagctgcagttttatggctgcagcttaatcccaagacctgcagtctttaagaaaagggacatggtccttttgggtttcctgtggacctttcattttattctttttttttttttgttaactcttttcctttattcttgttgaccaaaaaaaaaaaaaaaaaaaaacattta

SEQ ID NO: 25789 - DNA, 917 bp, Bovine  19866880538020
taacattctcctggtcattgctcagtccctccctccctcatctgctactgcagaatctcacttatttcctctggccacttctttaccccaatatgcctatccaaacagcttcttttaaatcacttctaaaatatgcagtgttaacccaaggcaggcactaaattggagtgatgaaaacactcttctgatgactaagaaaggaattacaaagcagaaaagagcagcaatacataagattttggtcgagggttttcaaagccttcatctgctttcactgagtagaggacactttgtatacacttggtaactgatacagttatcaggtttactgtctattgcttaatttttttccattctccttcagatagaaattgcaatgtgaatttggtagtagtatgtattaatttaaggattgaaggaagatccagtgataggtgttgcaggactaatatttctgtataatctttacagaaaaatgacgggcagttcactgtgatccagctggttggcatgctgagaggcatcgctgcaggaatgaaatacctttccgacatgggctacgtgcatagagaccttgctgccagaaacatcttaatcaacagtaaccttgtgtgcaaagtgtctgactttgggctttccagggtactggaagatgatcctgaggcagcctacaccacaagggtaagatctaacagaatgccttctgaaatactatgctggagacattgaatatttaaagattttaaaaagaaaaagaagttcctcccacataggaagaaagagggaggaaacagagagggtggctaaaaaagtccaaataatttccttgttagatgtcagaaaattcaaatattaaacttagataagctaagtattcacgtaatgagtcttaactgtttattttttttctacagata

SEQ ID NO: 25790 - DNA, 1476 bp, Bovine  19866880559202
tcctagcatgaaaatattttgatagagtgttgtttcctaggcaaatttctttgatatttgccatatacccccacaactcatgggctggcaaaaggcagagcttgatttgtgtgttgttgttgtaaagtcgttaagtcatgtctgactattttgagacccatggactgtagccaaccaggtttatctgtccgtgggattttctaggcaagaatactggagtggttgctatttccttctccaggtgttctcctagacccagtgatctaacatgtgtctcctgcattgtcaggtggattttttaccactgaggcaggaagaaagccttagtttgtgtgtagctcctgaaaattccagagtgatatatatatatcttattttctttagaacagtctaaattttgaggttaggcaatgctatactccttcctgcttttctgtgctatttttttttagagattcttacatatatatacacatatgaatacacatgtgtattaccagtttgtttcattcagtcaggacttatttcagtctcatgagtttctagctcatattcctaaattcctacacatgcctgaaaaatcacacaatcagaagccattcattctgacactttctctggtaccacaagtatgcagctttgtctatacttagtgtttttgtcacagcagtctactcataattcacccacatccaccccaatcaattctgaggtggaaaagcactgataagaattcttaggatcagttccattcacctgcttctctcagtgctgtttggctggaggaggacaagtagtccttgactaaaatcttttgtttctttccttgatagctacatactcctcccataacagttaatttatttttctcttgtttatttgatactggaacataaatgatattttacttttaatatttttatttcattgtactggaaaagggagctcctatacttctattttattctgtctcacccactcaagtccaaattttaatatcatgttacatttgcatacatgaaagtgtgcacacacacaccaatagaagatatatgtaggttagatataaggtacaccacttgctaactcttatttcagacgttcattatgttaaattttcattttgttacaaaggaaaaatgcctaccaaatgataatatatgcttctttaacattttatgaacttgtgttttgcatcatttcaaccaggtgttgtcaagttcatcataatctcagcatgcttcacaaattttaacattatttctgaagtactgtaaattctttgcctaatccagatcctctaccccagctctaagaataatatatagcaaaccttcaagcattcattaactaaatgttattcagtgagttattttttatttctacattttttacttcaaataaatgctggattcaccaagtaaacagagaacagtaaaagtctataaaatgtaatattaaaattaaataaaaatc

SEQ ID NO: 25791 - DNA, 806 bp, Bovine  19866880624527
tggtttcatgcagcatatcattttagaagaggaagtcagagaaataagaaaaataaaagagttaatatatatcaaatggccatgtgaagggaaataaaggaggatgtggggatgaaatctgaaaaactaacctgctggtaagtttctaattcattggaaaactgtttctcaagtgcaattgatcattgaaatcagagattaaagacaaatatagtcaatttttctgtttagaaaaggtgattagtaaacatattgaatggataaagttttagtgctatcctggcaaaatctagttagagaaatcttttctaagaatcaaaatacacatgactctgcaatccaaaagcagagtgtaaaagtatgtaaaaaatctcaaacaggccaatccctaggaaagctttctgttgtgcttcaatgcaagcattatattttgatgcaaaccctatacatagcttacaggacttaatggagagaagcatgttttctttgtttaagaagtgcagcataaattattaccatgatgttaaattattcctcttactgctttacaaatatttgagaacattttgcatgagataaaatatgtctaaatataaatgaaggccactcaatgtgtgaaaggtagcagcattttgtggcacatggtgtgtcgctcaaagaaagaaaaaggcatgacaaaattccatttagttatgcagtattcatttcagactaagtaaatatgccagagaacaagagctttcagtttttattgttgtccactgaatgtaaaacactgccattggtttattatgtatatactttaa

SEQ ID NO: 25792 - DNA, 1230 bp, Bovine  19866880697032
ccagggctcctctgttcatggaatttttttctggcaagaatactggagtggattgccattctctactccagggcatcttccccccacccagggattgaactcatgtctcttgtgtctcctgcattggcaggaggattctttaccactgagatacctgggaagcccatgtccaatctgtacacatacacaaatcttgggaatggaaatgagaaaaaggaaaattggagtggtaaaagaagttctttgccctgggaaacaaagagtggagaagctaaagaaaataatttttactgcagttgggttatagacaggtgagcatattctccttggctctaaagaatagtgtttaaaaatgcaaggataccttatcttgagaagaaggatctcttgaagtttgaataaaagctaaagtaataaaaaataatagaagtaacaaaaaattcactccgtgaaagtaatggacagcacattcatttgtacttcaaaaattagttaatttacctaatatttcataaaaatgtgaaattcactcaaagcataacactaaaaaaatacactataaaaatgttgagaaggaaagaactgggggaaatttgcaatgtatttgggaaagaaaaacattactacatggtacatatgcaaagatacttgcaagcaattatcaataataatgataatataaaagaccagttaaataaagatataccatttctcctgattgacactttaacccactctaattgctgaggatgtgtgggaataatcactatcatatcctattgagcagtgtggaaatttgttcaatttttctagaagccaatatgcataaaaattttaaatgtgcatatactttgacctagcaatttcacttctggtgatttatgcaaagaaaaataattagaaatgtacaaagatgtacaaaatatttttcacagtattatttatgatgtcaaaatagcaacatcaactaaaatgtctgctgggaagaatttgttaaaccaataatataaacttattcaaaataaaatcagttcagttcagatcagtcactcaatcttgtccgactctttgcgatcccatggactatagcatgccaggcctccccttccatcaccaactcctggaatttactcaaactcatgtccgttaagtcggtgatgccatccaacggtctcatcctctgtcgtccccttttcctcctgccttcaatctttcctagcatcagggtct

SEQ ID NO: 25793 - DNA, 772 bp, Bovine  19866880764156
gatgataggtcacttttaggctatatttcccataatctgagggaataaagtctcaggagtagagatgtatgagatggaagttttccctttccctgacatagtcagggaaatatattctaacctaaactgggagaaggaaactcattcatagtacagtgttgtatatcctgtaggctttcaacaatataattgatgatgatgatgctatgacagtcttatatgtacttgtctttagtccttgatattatagctttcattattctgactacatgtagcagtgtaaactacaaagtcagccaatacaaactgggttttcaggaggtaaagagatgtcagatttcaaaataatactttctttcttccggatttctcccttattcaaaaacacttttagtgacagcttttctctttattattcctttacagaaatcatcactgattgcaataagctctgtctccaatttttttgacaggcatctcagaattatggcactagcatttaccctcttgttcacgtcaaactgttccttctattcttggaataattcacaagatatgatatttgagcaatgtaggcttaaaggacacaggcaatttatgttgtgtcaatgatagtgacctctggtttttgaaagaaagacctgaccctttagaccatctctaaagccagtgtgctttaaaggctttaaaggctaaaatcaagatatatcatagaatggagatattttgaaactcacacatgtaccgcaagatttattcccgtcttccattt

SEQ ID NO: 25794 - DNA, 1963 bp, Bovine  19866880853575
caggctcctctgtccatgggattctccaggcaagaattctggaatgggttgctgtttccttctccagaggatcttcccgacccagggatcaaacctgggtctcctgtatttcaagcagattctttaccatatgagctatagggaagatccttaatatttccttctagtctggacataataaaaggcatcaagaagagctatgtggaaaactgagggttgtggttaaaagggggtgtgcttggtattacttttaaagtgtatacatttgtgtatacatttttttttcctgaattaaaataaacaagctatttttaagggttcttctttgattttaacaaatataaaactgcatttcttcatttgttctgtagtgcagtatctcctgactgaaacatacctgcagatattttagaatctgtccactaatttgcaaaagtgatttataatgtcaggtttctgactgtgttcaaggttaggaagtgaaagtctaattccatgacactacagtacacctaaagcactgatttcctagttttaagaaaaaaataaaatgtctaagaacttcaagatccttaaagtctaattctacaaaatacaaaagacagcattattattaaaatcaatcattaagcttctaccaattgccaaaaggcttccttggtggctcagctggtaaagaatccacctgcgctgcgggagacttgggtttgatccctgggttgggaagatcccctagagaagggaaccacaaccaactccagtattctggcctagagaattccatggactgaatagctcatagagtcacaaagagttggacacaactaagcaaatttcagtcaccagaaggaatgttatttttaagagtcaacactttaacatttttttactgattcaaatctatgtttcccaacttgcaaagtaacctgtctgcataatgcatttaatgaaaaatttcaacctcttccctaacagaataatcattcataagtccccatgtgactggaagcaacagttctgtaatggaaatgtcactgcaaccttaaatatagtgttcaccaccgtgaaaactgtaacaacagatgctcacaaatgcctggtgtgatgaatcaatgcagagaaagaaggacagaaagaagtctgtgtaggtgtttgtggagtagggggaagagtgccttacaaacacacaggagtaaacagatggcagtgatgaaggcattctgggataaatttgatttttcataccctgggacttctctgctacctgcaattacctatacatcaattggacaaaataatgacaattcaaaggcaagtggagaaaaaagaaagaacaagaatgactttattgctattattctggtgatgtgaacaaaagaaaggaggtaataaaaaagagcaaatgagacaggggaagttgttttgcaaaagttcagtcagtatacattgactgggctctttgacatatttcatggactaaaatagttcataatacattaatttttcccctattgttgtagtaaataaatgttctgagtaagagaaaacagatttaaaatactcttggagttccttttaattatgaggaaataagtaatttaggctaattttccctcttagaaaaagtttaaaaaattgaacaaaatactcaagaatatctcttgatgtatggggatactgtccctagcagtaattctgatccactaactgaaaggtaaagtggtccttttgatagtcacataggcttacagaaagagaaattggaatctagagcgacccaaaaacaggggctgagggatcccaggaaaatagcattataatgggaaagtgaacttgaaagcctcaatctaagttaagtcagagacattcacatacagaattctgctcaacttcaggttaccctcaatttctgaaaatggatttgagatcttagatcactaggaccataaaacctgggtcaaaa

SEQ ID NO: 25795 - DNA, 2625 bp, Bovine  19866880927830
gcttaaaactgaacataaaaaactcgatgatggcatatggtcccatcacttcatggcaattaaaagggaaaaaataactgaaaacaacagcagattttattttcttgcactccaaaatcaccgtaaacagtgactgcagccatgaaattaaaagatgcttgcttctcggaaggaaatctatgaaaaacctacacagtttattaaaaagcagagacctcactttggcaacaaaggtctgtttagtcaaagctatggtttttccactagtcatatatggatgtgagaactggaccataaagaaggttgagtattgaagaattgatgcttttgaactgtggtgctgggagaggactcttgagagtcccctggatcgcaagaagatcaagtcagtcaatcctaaaggaaatcaactctgaatatccgttggaaggactgatgctaaagctgaagctctaatactttggccacctgatgcgaactgccgattcattggaaaagaccctgatactaggaaagattgagggcaggagaagaagagggcagcagaggatgagactgttggatggcatcaccaactcagtggacgtcaatttgagtaaactctcaaagaggagatagtgaaggatagagaaacctggtttgtgcagttcatgcatgacttaatgattgaacaaaagcaacaatacaaacaattcttatttaatgaatgaataaactgaggtacctaagggtttggaacacttgcaattttaattcatgctgttaccattattggtttcatttttagtgctgttctttatgtggtggagattttaatagttttatactatatgaattcattttttttaaaaaaccaactctaaaaaaaatcaactcttttaggtatattggaaatattgatcatatttttcaaataacatgaagaacttcaactataaaatcctgtggtttattatttttctcggctaagtctttaattttccacttgatgatacaaagaagttccctgaaagatcccagtttcaacgttttactgacatcatatatgacaatgtatctgcatgctcctttctactttcaaaaaatacactctacatattaaatgtatatgtcaggtataaatttcagggcactaatgaataaagcttccatgaaaattactgatgattggctagcaagaaaatactatcaacatatgatgacattatagctacttttcaccctccatattaacaacactttttggaaccactttaattttcctgacattagcactgaaatttatatgatatttttatcataattatttcatctgtatattttacaagtgtaaaagaattccaaaattctaagatgataaaaatgcaatacactatcactgttaaattacctttaaaaatcctattattcaatctggcatcaaaataaagcaaacagtaagccagggaggcttgtttaatgaaacgactttatttttcaggattatactcatcatttggcctttaactgtgcagactggaactatctgtgacacaaactgaataatcctccattatttaaataatttgtaatcaaagcacagcctgtgattcttcagcttattacatatttgcatgttataatcaattaaaagttcatgcgtacccaactgcacaaaactctttaaaatgaaacttctccaacagttctggcagctgtcctgtccggatgtatataatgtggagtggaatacatgaaggattcatgaaacatatgtacatttccattatctatgctctagatcaagtgttaagaaataaccctgaattggaacatgttttctgagtaagttcagattcataacctatggcattaaatattctgaataacactttggaagtgttgaaatcacagaaggcaatcccacataagaaaagcattaattgatgtcaaagactgtaaagactattactcaacagtaaagactgccctcctcttttgtttccatatttttgtatctgtaacttgcttctaagcaggagacttggcttacgatgcagcgtagggactctcataaccaggtcagcatacacaagggtgattttcttggcctctaaggaaacgatgagctaacaggatgttattagtcttcttactcataataactagatgtataccagaaagtagcatggaggcacagtgatatttgtgttacagaacagaatgatgataaccaaagatgtagaatcactggttacagtgaagtttagaataaaagaatagtgggacatatattagtaagattttaaattagtcaaatagatcaattaaatatgagtatcaaagaactctccttcctcaaaccagctggttttatctgaatcagtgatggttgacagaactgaatggtactgatcaaaatctttctatatgcaatttagaacattcccagtcagtctgagctggtccttcaaatttgaaattgggtgaaagccatgtgtgtgtttagttgctcagctgtgtcaaactctttgcaattccatggactgtagcccaccaggctcccctgtccatggggattctcaggcaagaatactggagtgggtttccaagccctccaccaaggaatctccccaactaagggat

SEQ ID NO: 25796 - DNA, 2193 bp, Bovine  19866880989592
tttaataaaaaaaaattctgcccatatttaataagtagtcccagagtttgctattgtgctagacatttttttgtctgctgtcaaatcaacttctcttccttcttcctgcctcgctgggtgctgactcaagccaactaggttttcatatcttcctagtcaatggaccaagcttctgccattgaaaggcactggcaagattaggggaaaatgcaggtcagttctgcctctttgtctctgcattgagcattggccctttctcatccatggtccccactccctccagcagatttcttgtgcttcccactgattctgggctcaggtcactatgtttcctccctttgtcctttcatctctctgaatggttgctgcttcctgagtttgctaatttctcgattgcctcattgtttgcacttccagcatttctaggcatattggtacttaaatcccctgcttccatgcctcattgaattacttagtattcgtttggtttccttgctgcaaaataacttaaacacctctattttttgatgatagaccaaattatttagaaacaaatgcatcacattatttattccaataaattataaaagacaaaaaaggattaatgagaatattaaaaatctggcaataatacctctgctgcttctgctgctaagtcgcttcagttgtgtccgactctgtgcgacctcacagacagcagcccaccaggatcccccatccctggggattctccaggcaagaacattggagtgggttgccatttccttctccaatgcaggaaagtgaaaagcgaaagtgaagtcgctcagtcgtgtcccgtgtctgactcttagcaaccccatggactgcaggcataccaggcttctctgtccatgggagtttccaggcaagagtactggagtcgggtaataatacctctgaacataactttaaggttactgctctgggacataaaatcctaaactgataaagttactgtttccctcagtcagaactagaagaccgaattaaaaaaaaaaaaatctacaaaatctacaaaattcattaacaatttttaaaatgcaaacatattttatattttacacataagtggtagaatgcaatcaaaaatacaaaattcagttgtgctattaatagaattgctggaattcctcaaagaaagatatccaataatacccattcattcacaaatattcctaaacctacccaagttacacaggtaatattacattggataaagaaataaatgtgacattccttcagtttttcctgccattgacacagaatgtcttatttttttctcttgtaaatctctaggacatttttctttattattaagcacaacttcctgtatacagcagatttcagcattttgatttcatgggatttctctattaaatagtaatttttaataaaaatgaaacaagtaatatttcttttaaaggtattttgcagtttacttcactttttcttggagtatatatttttttagctttgtggcaagagaaagtaagacaaaatactttattttcctgtagttgtgttgcctggaagtggttcatatttaaactttattctttcaccttggacaatctgacaaggacaaatgattcatatattaagaaataccccgaactgcaaggtgaggctcacacactttgtgtacagagtgtcctacagaggtgactataatgactataatacatcatctggaaatggggtcgcagaaacagggtgaatccacatcccaggaacaaagtttatttatttatgctgttttgataggagctgctagaggcatttttctaatggtcctaatgagtctctgaagaccttgcttcttgtcttatttcttacagtacctaaaaatagaagtcagtatttgtgcacaatagagatagataaatagcttcaggatttatcttcaacaaaccatgttaatttttttcccccgaatggactctaggagtataagcttgtattcatatggttatccttaatctcttcaggaactaccaacagttgatataaaatatatacaacatatgctaaaattgtgattcgtatcctttgggtcttaaaggtacagtacttcctagccacatccagaatcattcaactatattttagtcctatcctctgcttgtttatttaagctcacttactaccatgacctctgaacaccaaagactg

SEQ ID NO: 25797 - DNA, 768 bp, Bovine  19866881016118
ctggatattaaagttgatgagcagacctgccttttttgggtgtgggtgaaaatccagtctttatagtagttactatgcaccaaattaaatgagatacctttccttctaaaatcatacttttttgtagaagttttatttgcagtctttttttaatgctagtatactagaactgcccttcagatggacctctttgaaaaaaaatgaatgagaaaattgaagaaaaataaataaagcaagagtagacataatagagatgaaacatggaaagttgattgttttcaacagtttttctaaattatttgtgtctcaatgcaacagaacacaagaaattaaaatatttttaatttaaaatatcctgaaattaatttcactggaattaatttcatatatctgcatatcatagaatttctaaaacataaaacattccatcagtgagattgatgaattaaatcatcacttcttaaagtacgcggcacaccacaattttcaatcgccaaattccttgactccctgaaatctcaatcaaagctacctcgtctgtatttggacagtctgccatttatttagaagaaaacgctgactaattatctcattccagccgccaaagtattgaaagaatagagcgggtcagtagcagtaagcggttaagggtgttaaataaactacccacggactcgcacagcctaggaatgctgggcggtgtaacaaggttgttgatgccacaagcctgcggtgggcagcaggcagtcggccaaacccacggccccg

SEQ ID NO: 25798 - DNA, 1711 bp, Bovine  19866881051295
agtctataatttgtatatctctattttctttctgtctctaggtttatatttgtgggtacatgtatgattaaacccttcgtaacccagtttggggggtttccctggtaccttgaagtttacctggtggctcaggtggtaaagcatctgcctgcaatgtgggagaccgggtttgatccctgggtggggaagatcccctggagaaggaaatggcaatccactccagtacttttgcctggaaaataccgttgccagaggagccttgtaggctacagtccatggggtcacaaagagtcagaaacaacttgagcgacttcactttgacttcactctctggtacctcagtttttaaagaatccgcctgcaatgcaggagacctgggttccattcctgggtcggaaatatctgctggagaagggatagtctactgtcttcagtattcttgggcttccttggctcagttggtaaagaatccacctgcagtgtgggagacctgggttcgatccctgggttgggaagatcccctggagaagggaatggctaccaactccagtattctggcctggagaattccacatggggtcgcaaagaatcggacatggctgaacgactttcaacacagtttttaaaagagtcctacctgattggttgaatgaaataaactattttaagctaatgaatattccttcaagttttgttatgttgtgttgtttgagagttgaatgtggattcagtcatgtttatctcccttcttttcttcatttgctgcttttttctcattgttatggttttaaaaaattatacttccttttctacagactttcttccaaatatgcatatttccctcactgcttcttgttaatcatatcccacattgaattttatttttactctgaaatacatgaatttttctggagaatatcattcacatgttttcacacctgagttacatttgagacaatgactaatatattgcagattaatttaatttgaaaagggaaattatttttaaaaatttttattgtatatctccttctctcaatactgtatattgaggctacagaaattttacatctgaattaattttcttttattttgctggttattttctaatcatctttttacttttttgtttttctattttacattctacagtgggaagagattggtgaagttgatgaaaattatgcccctatccacacataccaagtatgcaaagttatggaacagaaccagaataactggcttttgaccagttggatctccaatgaaggtgcttccagaatcttcatagaactcaaatttactctgcgggactgcaacagtcttcctggagggctggggacctgtaaggagactttcaacatgtattactttgagtcagataacgagaatgggagaaacatcaaggaaaaccagtacatcaaaattgataccattgctgccgatgaaagctttacagaacttgatcttggtgaccgtgtcatgaaactgaacacagaggtcagagatgtaggacctttaagtaaaaagggattttatctcgcttttcaagatgtgggtgcttgcattgctcttgtttcagtgcgagtgtactataaaaaatgcccttctgtggtacgacatttagctgtcttccctgacacaattactggagctgattcttcacagttacttgaagtggcaggctcctgtgtcaaccattctgtgacag

SEQ ID NO: 25799 - DNA, 1626 bp, Bovine  19866881124524
tcccttggtctgcaaggagatccatctagtccatggggagggaggagggaggaaggttcaggatggggaacacatgtatacctgtggcggattcattttgatatttggcaaaactagtacaattatgtagagtttacaaataaaataaaattaaaaaaaaaaaaaactagttaactggggtcatcacacacaaaaaaataataataataaataaaggagatcagtcctgggtgttcagtggaaggactgatgctgaagctgaagctccaatacttagccacctgatgcgaagagctgactcatttgaaaagaccttgatgctgggaaagattgacagtaggaggagaagggggatgacagaggatgagatggttggatggcatcaccaacccaagggacatgggttcaggtgaactctgggagttggtgatggacagggaggcctggcgtgcttcagtccatggggtctcaaggagttggacactactgagcgactgaactgaactgaactgaactgaaactatgttttgcttttgtgtacttttatgggccaaagttaaaatttaaaaatagtcattttaataagtattcattgagtgagtacaaaaatccagttactatgcagagggctgaggatataggcaagcatgaaatgttatctctaactttaggatttatatcatatcagaggagacagacaagtatctagataactacaatgaaatgtgataagtagcataatagaaatatagcaagtacaattataactaaatggaaaaaatgattcattttgtatggagggacatctgggtagattttacaaaccctgttaacacttgaattgaaaattttgaagcactgcttgacttttggcaggtataaaaaggtgcctaaagatttcaacaaagggagcactgcaggcaaaatactgggtcaggggaaatccttgggtaatggtgaggatgaagataagaggaaggtctggaggagtcctgggaaatagcaagtcatggagttgggaaaatgatgttgggctcagtttcaacttaaatttgcctttgtagaattagtctactccaagatctgacaatctggtgccaatggtgattcctggacaatttatgtatgtttatcatttgttttcaaacagttgccattgaatatcagttaatattttaataatttggaatcagaacaaaatgctaaattagttcattatcctggcatttcttttcattattgttaactgtggtctttcccaagagtaacatcaatgaagcaaaagataaaaattgtagaaatgtaatagagtttataggtgtggagtcaaagatcccattccatcaaaattaagctcacttctattagcaaaaatatctttactttttcttaacattaaaaatgaatgacatatcagagatgcaccatttaccaagtgcatgtgtgaaacatgaaccaagattttttctcagatccatttcttacctgttttgttgcttggcattgtataacttggggctgacgttataggctgctttgttcaagttcctgtagaagttaaatcaatcaggaagcagtggtgcggattagagggggatctaagggagaagtcaggaatttctcctc

SEQ ID NO: 25800 - DNA, 1359 bp, Bovine  19866881170437
tttctgaatgttgagcttgaagccactttttacctttcctctttactttcatcaagaggctcttcagttctttgatttctgccataagggtggtgtcatctgcatatctgaggttattgatatttctcctggcaatcttgattccagcttgtgcttcattcagcccagcatttcgaatgatgtactctgcatataagttaaataagcagggtgacaatatgcagccttgacgtactcctttcccgatttggaacctgtctattgttccacatccagttctaactgttgcttcttgatctacattcagctttatgaacctttatgaactgtgcttttcctttagtacacatcctctctgagggtcttacctcccactacctcatatgctcctcaaaggaaaaaatatttcagaagcaagttaccatcttctgttctagtttttgaaattaacattttttgttcttcttttgattaaaatattatatgtacaagatatctttatatatattatctgaacccagagttatcatagcttgttactcatgagggcttccctggtggctcagatggttaagaatgtgcctgcaatatgggagacctggattcaatccctgggttggaaagatctccctgggttggagaagggcatggcaacccacttcagtattcttgcctggagaatcccatgaacatagaaccctggcgggctgctacagtccatggggtctcaaagagtcagacatgactgaacaactaaccacacacacacacagacacacacacacacacacacacataataactttaaatgtacaaacagaacatctactaaacaaataaaacaagcatgacaatcttacttgcaggagtacacggtgactactgctgatttattcaatataattgtatatattaaagacgaattacaaattttctttcatatgccaaagcagagcgggacatttaaaaaaaaaaaaaactttattcataattactaagtttccatgtgggaaatctacatgtgaaattgtgcttcatctaaacttcagtgtatgcttaatgaccatcttaaattccttaaattatttatcttaattaccttacgggtggagtatgctttttgtttttctaaaaaataatgaatacaaagctattctggaacaagactgttcttcattatactggcatttgcattatatagtataatatccattccctttagaattcttttctatcactgcccaaataaagagcttttctatatccactaatgtgctctttttttccacttcagcattattatcatctttattagcctccccacactcagtgtgggcctcaatgcttggcattatcttt

SEQ ID NO: 25801 - DNA, 2525 bp, Bovine  19866881192110
aaggctaagttctgaagaactgatgcatttgaactgtggtgttggagaagactcttgagagtcccttgaactacaaggagatacaagaagtccatcctaaaggaaatcagtcctgaatattcactggaaggactgatgctgaagctgaagctccaacattttggtcgcctgatacatacagctgattcattagtaaaaaccctgatgctgggaaagattgaaggcaggtgataaaggggactatggttggatggcatccccaactcaattgacatgagtttgagcaaactctgggagatagtgaaggacagggatgcctgaagtgctgcagtccatgggatctcaatgagtcggacatgactgaacaactaaacaataacaacagtacttcaggaagtctatcacacaattggagtgctattgtcaaagaaaatttagagaagtgaatctgaaataggtatgaataaaatttttaaaaagataaaatgtttttaagtgactgtccaaagagaaaggagttagagacaaagtatagagagcaaaatagatattgtattgtgctttgttgtcttaccaaaagaagactagatggacaaagatgtgattgtttcaaatgttaaaccaccatatacttcccctatggaagctccatctacctgcaatgcaggagacgcaggagaaatgagttcaatccctgggttgggaagatcccctggaggaggaaatggcaacccactccagtattcttgcttggaaaatttcaagggcagaggagcctgacaggctacagtacatgggattgcagagtcagaaatgactgcgcaagggcacatgcacacacacacacacacacacacatatctgttattgttactttatatttttataccggagaggtatttctgttatttgtcctatgtacatttatatcctacctgtcacatcattcagttttgtaattatttctgtatcttattttctctccaaactataagtttctaggagatcaaagctttattgtatatgtgtatatatatacacacatatatgtatacatatgtatatatggttgaagccaatcgagctttatttggatgagccaaatggagtatcagaaaatgacctgtagataaagggttaaatatttgcagatgcatatatagcacactcagcatatatagctgagccactgcttcagttttcttgccatgagaaccccacaaacagtatgaaaaggcaaacagatatgacaccagaagatgagcctcccaggtcagaaggtgtctgatacgctactggggaagagcagaggacaattgctaatagctccagaaagaagctgtggggccatagcagaaactatgctcagttatagataggcctggtggtgaaagtaaaacctgatgctgtaaagaacaatactgcataggaacttggaacgttaggtacaagaattaaggtaaattggacatggtcaagcaggagatggcaggaataaacatcgacctcttaggaatcagtgaactataatgaatgggaatgggtgaacttaattcagatgaccattatatctactactgtggtcaagaatcccttagaatcaatggagtagaaatgctaatgtgtttaattctgaataaaatcttggcaattttccatatcagtaaagaagtttttcaagtactcacacaaatattttcccaagaaacagaacacatcgtatggcaattgaaatactgtagacataagtaaatattacagagctactaactattcctacaaagcaaaggaagggcacctgaattttgtgtttaaaaatatctaatccatccaacaaagatctactctgttccacaatgatagacatcatataaatgtcatatctttttatgaggcattgtcagtttctttctccttccttaaggaaactgcccataccatgttatctcctaagttccatatagagtcccacagtatgtgtcctgagctttaagaagaacctgtatttgaagtcgatagattttgtaaactttacttttgcaattttccatctattaaatgattattaactagatatgtctttgaacaactgtattagtgaagtagaatggcaggtaatgctatgacatattaaaaatcacctttatgaccgtgtctgagaaagagaaacaatttaatataatttcactcatccattcattcacatgtttttgattattttgtcccaggcaatgaaatgatcatgacaaaatttagaaagacagatttcaaatctattatgaatctaatatatagcttttcatattttaagaaagaagatttttataccatatattctttctgctatctacagaagttattgatatatttgctacaagtctcctcctgctcttaaactgtacagatacacatctgagagccattcaagtaacctactacaccctttggaaccactgaaaagctatttactttactctaaagagcagtgatctgcctaaagtgttcacatttaaaagtacagactt

SEQ ID NO: 25802 - DNA, 830 bp, Bovine  19866881206671
atatatatgatgtccttttagagttgaaattaaatataaaaaaatagactctacttcttaattggatatatattaaagagcttttctatttcaacttaccaacttgccttcttccatttgtactaagtgagctggactatatgaactggagtcactatggctcatatacttctttttgggggataagtgaaagataatctcggtcccagtgtttgaacttaacatttagttcaactaattagatcttatcaagatagaaatttcagctaccataccattataactttaacattccattttatgtgaacggaaaagaaactggttagaacaaatctcaacatcacctgaataaatcctgcttttgtgtgagtcactgaagtttttaaatgctatgttttggccacgaaatacaattttgcagtcttctgaggcgtccatgggcttgtcaactgtcacttttctgtgataattatggagagaaatacacagataaatgaaattcacagtgattcgggcagccccctatttcactagattcaattctcttcactataaaacctttcctggagctgccaagtcttaacaacatttgacagaattgaatttaaccttttctttctttccttgccatcttctggtgagagttattattgagaggaaaaaaatagtggccagagcaaaaggctggcaacatttcaaggttgacatgccaagtgttctttgactaagttgcttttagaagagggagggagaaaaaatcactcaaaagttctttcagttccattgctgtacatccctgcaaaccactgagtaaagcaaagagtcagtca

SEQ ID NO: 25803 - DNA, 1621 bp, Bovine  19866881353317
atgaattgactactgcaagatgcagctgtaaaacaagaagactagttgagtcatttgtttctaagaaaaaagaagacaccttcagggcataaagacactttgctaatgagataacaccctggctaaattaaaaacctcggctagcctgaagtcatttagatttgttctttgttcatttctctctgttccctcttctctcttctctccaatctgtcagtgacatacctgtatttacattcttttcatataacagtgagacttcacatgagatgcaaagcactgcatgtttttaagctacaaagagttacgttttgtcttaatataaaagaaaacctttgccaacagatctcttcttagaaagtatttcctgatggaccaattttcctagcagcctcattgactccaaaacagacaacgtgtgggtttctcctgcctcacttcataaagttcgtgagaactggatatggtagtctgccagtgtgagccaaagactgaacgcaatttcagggctacggatctatgtaatcaggttagatcaacaggagagaatatgattcagatagttttaggattcacttctaaaaaaggatttgttttttaaattgcattaggggttgtggaatttatggatttcacaccatttcttctttcacttgaggagttattattttaataacatgagaatctgagaggataaaaatagttcacaaattagtgagttataacaaatagcacctgctgtttttaattttctaagcactcaaagttacttagtataattgaagtctcttaaaggcacctgtcttctgttcaagttcccttttttgatggtaccttacttaaatgcagtgcagcaactgtttattaagtacatattgtgtacaaagctctgagctaggtaatcaagacggtaaaagctaagaaaaatgtataatgttaagaaatttcctgcatgcatatctatttatgatggcatttaaggccttgattcattagttacattttccctaccacactctatgctgaatttatttatttatttttttaagttaaattcttttaaataaccaaccccaacttcaccttgattcttgatttaaaaaggtttgtcattcactctgtaaatcatactgatagatctccttggttattgcagttcttccttataaaaatcaatacttcttctatctagtgaatttgatccttcccagaagtatatttgtttccaaatacttttatgcagttatggatgatattgtttttgtggtttgattaactattgagtaaaccaatgaatgacaccacccttatggcagaaagtgaagaactaaagagcctgtagatgaaagtgaaaaagttggcttaaagttcaacattcagaaaaagatcatggcatccagtcccatcacttcatggcaaatagatggaaaaacagtggaaacagtggctgactattttttgggctccaaaatcactgcagatggtgattgcagccatgaaattaaaagatgcttactccttggaaggaaagttatgaccaacctagacaatatattaaaaagcagagacatcactttgtcaacaaaggtctgtttattcaaggctatgaattttccagtgg

SEQ ID NO: 25804 - DNA, 1091 bp, Bovine  19866881428191
aattcaagtttcatttctaattcatatgttgaatctaccaagattcaaaaagattcatcacatttttatcctatttaaatccaaaatgaaagctgttacacatattaaaaaaaacgataaaaaagatgataaacctgttctccaattacttaatttagaatcttaaactttaaatataaataaatcaattaactccttttaaaatattttttaaagtcacacatcatagtttattcctgtcctgtcacatacatttcttgcatagaagatttgagttctcgtttagaaacactggcaacttattttaaaatagcctgtttgttcttctctagttagatgtgcgagacacagaaatagaacactgtgtgatggaacagatgctatagcaatggtgagtttatatatggatgccaatgacagatgccaccttatagcattagccaataaaaagtatgggtgttacactacttaacaattactcaaatgagctgggctgtgggcaatcccaacagcacaatctgactctcatatgctgtaagtgatctcgtgttgtggatataataaatatccaaaattaattttaaaagaattaataaaaaatgtatttcaaggcaggtatatggatcacctcagttttttgttccccaccctgcttggggaagtgctttatcctctatggcaagaagaaacaaactaaaaataaaatttaatctgaacagaattcattggagatagttgagtaactttgaagattaaaccaagaacacatgttttcaatagctattagttatgagtcagaagtatattttctaggattattttccctttttttgaaaacttacaaacatgaacagttgaaatcctgttaaaattaattggagggaatgtccagtcattttatagtgagtagttactctacatcactgaacatgaatgtgcatttaacgtaaagtagttttatttaatttgaatgtagaggtattctacatagaacacttttgaatctgcatatgtaaaacaattaaactgaaaatcagtcaatctattacagtcatcttatagtcctgccagaattcaattttaccaggttt

SEQ ID NO: 25805 - DNA, 991 bp, Bovine  19866881498161
tgatcttattttatatacaccccccatatatatatatacatatatatatatatatgtatcttgataaactcaattagatatattatgtttcaataccctgaggggttgttcttgtcagtactcacatttttccacctttggccttgtggaaactttttcaagggagcttatgatgcaactccaggttatctttgacagcatctttactttcatgtatggcaacatattttgtacatttcctagactcaccatatgtctcttaagaatatgaatgttatcatagataatgattctagaaatatcacatttaaaataatgataaaatagtattctttaaaatataccccatagttgacctttgctagtgcaatcattctaatttgaactaattaacaatcttatatagcagttattttccagcctatgatccaagttagaatcatacattgcatttaggtgttatatctaaagaatgttgcattttaaagacatacagcaagagttcaaagcaatatttcaaattctaatttagggtttcatggggattttggattctgtttttcttttaacctagtatcttaaagtcttacatctgaagagtttgtctcctacatggaaaatttggttcccaagagtaacaaaaggattactcatttgtttgtacttttttctttagatggcaaatgatattatttttcttatttttgtcatatattatcattattttgctctttaagatagactgaatcaatagaaaggtttcaaaaattgtagtctttaaaaatttatacttctaaatgtttttctaacatctgagttctttctatctcttttatttcaaatcttactgctgtaattttacatcagttgcttccagttgaatgataaaacaggatgaagttaaagttgctaaggcaacatttgatccctaatcccttgcacagcctcagagcagaaatatttgctcatctagtgaatctcttagtagtgt

SEQ ID NO: 25806 - DNA, 967 bp, Bovine  19866881772682
caatctacagtcaagcctgaagaaacctgagcaagggtgatcccccattacatactgaatttagaaaataaattgtacctgaagctaccaatgggcataggggacttctcggtatttggttttctcttcagttaagacatgttaactctcattacctatttggtatgtgcatatcatggtgaaaacaagttcgggttcataagggttaattttttccctataaggaaagtgtgttttcttcctcataagctgttcttgactttgacataaagtactatcctgtttcatgaagccactgagaaagatccaagttttaaagggcaagtcaccacactgtggacaaaataagagttttttcaaatgaaaaagaagcatgcatgatcaagtttcaatttaaaagaaaaattaaaacagaaaaaataatccaagtgcaaactgctttgaaatgacctttctgtattggttctatctccaaacagttactttcttgggcactatttattatgcatttaaagttaacctgtacattcttaaaagcaagtatgtaatagctattatatgcacacaacatggtaaactaagtcctgtcatcttccacatatgtccaatgaagttcatatggcagaacttatacctaaagaatctttagaaggcagttaaaagcatgccaagtctcatcaaagtttacatttgaatttcatataacaagagtattatttttctcttcagagagacagagtcatgatagagtagcagataaacaaagaaatatcccctgatgtgagttgttcaaaaataaaatttctgaaagcaaaatgaatatgaaatactacactgcaagtaagacactctctgagtactaattatgtatatccagtagaatataacttcaaatctttcatcattgccagaagttttaaaattctgagaggagagaaatcaaacttgaagagaaataatctccata

SEQ ID NO: 25807 - DNA, 1710 bp, Bovine  19866880399637
gtatctgaggttgttgatatttctcccacaatcttgattccgcttgtgattcaccacccctgtatttcacatgatatattctgcatgtaagttaaataagcaggatgacagtatacagccttgacgtacacctttcccaatctggaactggtccattgttccacgtaaggtctaactgttgcttcttgtcctgtatgcaggtttctgaggagacagataaggtgatctggaccttgtgttacttgtgttcctgtttaaagacaatttacttaacgtacattgttgactcactaacattaagctcacagccagcaacgctctaactcacttctgaaggaaccttatctaacacacatgttttctccataagacacatcacagcattcttgcacttaggatccctagagagcacttcatgtgcttggagtcattttcaacagtgaaatcgtcaacaaaaatcactaaaatgagaaaaaatatggcattaaatagacttaaaagaaagatgattttttcataatatgagagctgagaccagaaggcagaatgtcatctagtttgaccttagcaaaccttaggaacacatgactcaaatttctcaccactctgtgcatgtccacaaatgactatgaaatgctacaaatattgatctgggttgcaaataaatttaacaagtaaacaaattttcaaacacagaatccatgaaaaatgaggtttactataacacacacagagagagagagagagagagagagagagagagagagacagagatgagagagggggggagggagagtgggggagagagagactgcttttctttctctgctgggatttgagtcacaggctttagctccttctctgctcttcttatggtttgaatgttcagttttgtttgtgtgagatatttcaagcttccctggtggttcaggggtaaagaacccgcctgccaatgcaggagacatgaatttgatcccttggtcatgaagatcccttggagaaggaaatggcaacccattccagtattcttgcctgggaaatcccatggacagaggagcttggtgggctacagtccatggggtcacaaaagagtcaggcatgacttagtgactaaacagcagcagtaataacaatgagatatttcgggatcctttctatatcctcccccgctttttgttttaaccgaagctgatgcagttggagttctgttgcttccaaccaagagttcagagttagtatataaagctcttggcacatagtaggtcctcagtgaatgtgagtccttccctcatggaatacagggttgactaaaggtaaccaatgagtgtatgttgtagggagcaacagtggttaagaaaaaaaggctttataataataacaaaaaattgagagtgacatatttccaactcttccctttatccctaccagcagcagtcacttcttgccatgttccagtacagatggaaaagtcaccgaattacaaacccagttgcaagctatttttggtggagttgtggtgtgtgtgtgtgtgtgtgtataatgtacgcattgggattcttggccacagcctctgtttgtatcagctgtcagcaaatcagaggcgccatacacgtttgtcataattcattacattaattaaccacgtttgagaactgggcacaggccagaggggatgcgggggagggaggcctccacattgttgtgtctgaa

SEQ ID NO: 25808 - DNA, 699 bp, Bovine  19866880538056
ttcacgggtcacttggacaggccctgggagttatagcatcgttcccccttccccgccccccgcaaaccagggctggggctcttgtgagggcatcacaggattctcacctgccttctgtcttccatgctaaaaaggtgactttcagagtcaccattaccttttgaaaactggcctgccagaccctttgagccagtggttcagcttgtgccgggctggcgggtctctgtctgtgggtggaccttgtaatgagggtctggcttccacccacccaggtgtccgcccaggaggtcaggaaggagagcccgctgcagttcaagttccgggccaagttctaccccgaggacgtggccgaggagctcatccaggacatcacgcagaagctcttcttcctgcaagtgaaggagggcatcctcagcgacgagatctactgcccgcccgagaccgccgtgctcctgggctcctacgccgtgcaggccaagttcggcgactacaacaaggagctgcacaaggcggggtacctcggctccgagcggctcatcccccagaggtcagccggtgggcctcgagggtggcgggttagcagggtcagcaagcagggctgtgggggggtttgggttctctgcagggcctggactctgtcaacagcccccgctgcagcgcagtgctcccccgggccccgatccccacccccgaatgggg

SEQ ID NO: 25809 - DNA, 1696 bp, Bovine  19866880538989
agctttgcctgtgagcttgtgtgcgcgccgcccggaaaggtcctcctctgtgtgagcaaagggacaggttagtgatggggctacaggttggtgatggcagccgggggatgcccaccggcccttctcagcaaagtggaaagtactttttctctgcaacttcagatgaaaatgtgccccgccggtgagtaagggagaggacctacccctaacagcaggtgtggacatgctcaggtgtcctccccaggggccgacaggcctccaaaagcctggggcttcttccctgcagtttggaagtaaggagaggacagctttgggttgtttcttccagaagggggtcgaagggcttaatatatcactgtggctgcagacaggtgaagggctaggctagcttgcagagaggagttgccttccgtgagaagagggtgccgtggacagggttccttctaaggctaatcgaaccatgagactggtttctccccagtggtctcagaggccctgggagcgtgtctggatatcctggtagttgcagcattttgggagcctcgctgccccaggaaaagccagcactctgagcaagactgaaaagcatcgccctctagtccctccgttaatgagatcatttctgaatcgctgtttgtttgggttaagaagatattctcctttaagaaaataatcctttcatgattgacgccagaaacaaaagcaaaggctgtacccagcccattttgagacctgtaattttttgtttctttagcagatctaaatccgatttaaatcgttgaaatactttgctgtattatcgctcagttgtaaaaactaaactaccatttatggtgggtaaggaaatggcaacccgctccagtactcttgcctggagaagccaacggacagaggagcctagcgggctacagtctcatggggtcacaagagtcggacacgaattagtgaccaaaccaccaggcagtttcagagccagttaagtcacctgccaccatggaaacactgtttttaatggtatgaatgttagggcggtcacttactcaaaccaagcctggcacctcccaggaagcggtcgttcaccccgaaggtggcctggtcccaaatggtcagttctaggctggactgcctcagctgcgaaggggtgacgcctttgaaaatgaaggaatgcttccactggggacaggcttgcttcttcaggacgggggacttgagtctcaacctctgctggtctggcagagtgagacagctgcacagggaaacagattcaaaacccgtaagctcagcccgccatgtgcccccgctccctgttgctacttgctccttggagagaccacgtgttcggaaagtgctcataaacccaccgcagaacagaaattgtaagcaaggagcgagcgtgggaatttcgagacctggctctgtgatctctcactgaggatgttccaactttcagggtcgaattctgctccgaggattaagagtgctttgggattctaggccacgtggccctagtcttaatctgcctcctttggtgtgaccaccaccaggctcgtcagacctgctacccagggagcagcactctgtacacacattatctcttttaaccttgttctcagacaaaagaaatccaggagggctaagtcagtcgcttgctcaaggccgtacagataagtggcaggcttaggacacgaacccagtt

SEQ ID NO: 25810 - DNA, 1267 bp, Bovine  19866880603583
ccctcttaagtgctctctaagaagtgaaagtgaaagtgttagtcactcagtcagtcctatacgactctctgcatccccatgggctgtagcctcccaggctcctctgtccatggacttctccaggcaagaatactggagtgagttgccatttccttcttcaggggatcttcccaacccagggattaaacccaggtctcccacattgcaggcagattctttactgtctgagccaccaaagaagccctctctagtaccccaaatactcaatgagagaccgcgggcagcagcctggtcaccagcaggaagaaacgcgggaacttgggaccctgcccgggtgacgccaagcgcgcctaggctctctgtgacctgtcctcctcacttagtaatggccttgcgtggttccagaggtgtttcttaggtggcacctttgtctttctggagggagaataagtggaatgatggcttgctccagtcactgaagactgtctacaactggctagttggaatagaacaggtaacggggggtgcttgcccccagagtggtcacagcataagccctgctgaatggcaatttgtaccccagtattatcccaaggaccccagtggcctttcagacaccacctcccctggactttgctgggtcctggagtttcataaacattcacttctttatgtagggtttagagcactgaggttcatggaagaaacaacagtttgtttttaatgctgaaagagcccagccccagctctggaattctcccctggggctccctctctgaccccacaatctcaggtgtcccaagtgccccaatccttatgcattcctggcggcccagcaacgcagaatcaaagagggagccacctcctgcgggctctggaatttcaaagccccgttcataaaagagtttataggagtcctgtggtctctcccaggctacccggacccattgtacttctccagagctgttggtacctcgtaaacagctctcgctgttaaagatcacctatttaacatgtgcagcagcgctgagagaaacactatatatttgctttttctcacttcctgtgggaagggtggggcccaccgctgactgctcttctgcagttgctgtgactcactgtaggagagagggcctttagaagggagggaagtgatttgtgtggtctttggaatgcaggtatgggctgtaccttcaggagtgtttgctgataaaggagcgtcttgtcgtgagaggcaaacctcttacataaaagtatgcagtgtgtg

SEQ ID NO: 25811 - DNA, 1780 bp, Bovine  19866880671446
ggttccggaacctggagttcatcatccgctggcgcaaggagagcatcggggtggtgggggcgaacggggcgggcgcgcgcgtggtgaaccgcggcggcgcgggggtgcccaccgtggggctcggggtggcggcggggctgcgaagcgggctgtctgggcgggaggtgcgaggctctcggggagctgcccgcaggtggagaaagaggccgcttcaccggggtggcgttctcgtcgtgcggggagcccactctggggggcgccagcacaatgactggctccgtctcccccttagcgagggtccggtccacgtgtttgccgcccctggggctgaaggaggagggccacttaggagcagaggaagactgcgggtccttgtcctttcctcccttaaagaacatcacgtcttcattctcctcctcggctgacactgactgctgcgatttggacggcaggggctcccttttggctggcgaggcctgggacgccccatccttcctgcccgcccactgggggcctactctgcccgggaccctggtgcgggcgtgggggtgcaggctgccgggcctgcccgcgggcctgcgcaggtgaccatcgcccgcgcttcctgcctgagcgtccacctggcggtgcttgggaagcgatggggtgccgtccttggcaccggccgagtacgcgggtgctcggacgcccccggtccccgcttctgcgctgtcgtcgtccagattctggggagacgccgcgcgggaggactgtccgcctctggacgagtaagagtctgagaaggaggcgctttcctgcgacgtggggtgcggacggccagcctcggaggggaacgcaggctggggtctggaaggcggacgccccacttccttgctccttgggccgtggggttgtggctgggacgccgggacggccaaggagggtgacttttccagagcagcggacccggcacccatcctttggggccccgtgggctcctggtggtgtggggaccgtggcgcaggtggccggccacccagctgcgttttgggagacccgccctccgcaccagcgtctgtgctctgctgcgtatcctgagccttagaggacggaggtttggcctgagggggcaccccagcccaagtgcccgtggatttggggttctctgggaggggctccttccgctgcaggctcgcccctctctgggggcctcttctcagatggtccgcgccccgggaggcaggctgcctggaggaggaagacacgtgatggttcaccacggtggcaggaagtggcttttcgtcttcagcctcctcttcgctgtcttcttggcctccggggccgcgccgatggtcagaagctgggtgagaatccaccctcgggtgaacccggggggatgcggtggacggaggggagctggaggggtgcaaccggggtccccggccattgccaaacctgtgtggatatctgccgtgggcagcgaagggtctgtttctgagcgaactgaagtgtccagagaccggcgggcctgcgggtaaccgggacctaaatgttggggccgtggctgcagccggcctccctcgctcttccgtatcactctcaccatcgccatcggagccgcctgctccctcagaggcctgtgtcctcgaggacggccgggtggaccctgacggcgcgttggacctggcggccggcgcatcctgaccatccttccagccgcgggagagcggagacccgggctgtggttcggtgatcaggagccgagatgaccccccaggagatggagaaagtctcgagggtg

SEQ ID NO: 25812 - DNA, 1052 bp, Bovine  19866880717487
ttgttttgatgacctcccaaagcccaccaggggcttgcctccaagactcaaaatgggcttatcctgggcactggccaagggtttggaatggcgcccctgtccgaagagcgggaggccgtcggggctcaccacgggagtccctcccagatctgaaacaaaagcaaataaaagctgtgcagccaggtgaaacaatccagggaagtaaaaagcaagtggaaagtatcttctcaatgtcttatattctataatcaataaaaggcaaagaaataatgaaaaggataccagctgaggtcacagtacctgctactatccagaaacttctgggccttttatattgtccattactctgcactagcttataaaagtatataaataccgcattacctgcaataactctaagtctctaggaaggaaagtgattctttccctgtgcttactcctaccactacggacttaagtgttactttggaccagtgatagcaaagttattctgcaaagagccagagagtaaatattttaagctttgtgttgccactattcaactctgccactgcataacaaaaaacatagacagtaaaccaagaaacgcatgtttctgagttccaagaaaccttcgtgtatggagagtgaactatgaatgtaatataatcttcacatgtcacaaatattattctgtgattttttttggcagtcatttaaaaacataaaagctattctgagctcacaggctatacaaaaacaggcagcaggcagggtttggctttagaagtggtgttgctgaggtctgctctggactgcccaatcccaagaatgaagtcaagagtcacctcctctagacggtggagtctgtaggaagatagctggatcaggggaagaagctaagctccaccccttccaaggcacctcatctccacgaggttaatgaaactggaccaagggcccccattaaaaatgaggaaaaggaggaagagagaagttgttacgcttcagatgactcagggcacttttgttccatgaggaccattctcacttacccacaatggttcgaccat

SEQ ID NO: 25813 - DNA, 911 bp, Bovine  19866880818185
ttttctttaccattataatgccgcttggacacaaagggatgaacctagaacaaaatcagcagctgactcctccgtgccaggcggagtgtttatgctttgccatttcatccttacagccaccctgggaggtaaggctttcacagctgagaaaacctctgagtcctctgctccggaagacggcaggagatcctggttcgcacagctgtgttagaacccgggggtgctggatggcaaagccccttctgtgtctccatactgttgaggcccttgccacgtaggggtttggctggcttctgtccttccactcagttggttcttaccacttaactctctgtaccacaggaatctgaagacgcacttgcagcatctcaggtggaaaggcgcgaagagtgtgagccaggagtacaaagagaagtcctgtgcccgctgccagcagaccctggggctcctgctgaaccggggggccgtgtgtcagggctgcagccaccgcgtgtgcagcgagtgccgggtgttcctgaggaggacccgcgcctggaagtgcaccgtgtgcttcgaggacaggtgaggatgggcggggccggccaggatgggcgtggccagataagatgggcggggcggtggggcaaggatggctggaaagcctcgaagatggtccaggacaacaaccgataaagacagctgtcattcttcacacttaataggaaaatgttcagagaatgcttaatatggagctgcctttctagacatggaaattattgtaactcaaaaacacattttgctatatgaaaaaaaagttttgtttttaatttacaaaagtttgtaatggctgctgctgctgctactaagtcacttcagtcatgtctgattactgggcgaccccatagacagcagcccaccaggctcctccatcc

SEQ ID NO: 25814 - DNA, 2333 bp, Bovine  19866880827758
ccttgcccttctgctactgctaagtcgcttcagtcgtgtccgactctgtgcgaccccatagacggcagcccaccaggttcccccgtccctgggattctccaggcaagaacactggagtagggtaccatttccttttccaatgcatgaaagtgaaaagtgaaagtgaagtcgctcagtcgtgtctgaccctcagagaccccatggactgcagccctccaggcccctccgtccatgggactctccaggcaagagtactggagtgggttgccattgccttctgcccttctactagatgaaaatgtatgcaagtctgtccctgctgaataagccgtcttgaaagaagccagccctgacccctgaggctaggtaggccccctcctaccctcactcctaaatcctgtgcttctttttatcaaacctctttgaattgtaattatctgcccatggcccccaggggatccctgagagtagggaccgctttgtaaagatctttcttaaccttgtgaattctcccaagtgttggggattaaatgaaagaatgacaggatgggagagacagcatggggtggaaaagacagacaggatttggaggaggcaggtgtggtgggggttaggagttgagggcagccagagacagggttgggttgagcagactgtgcgacctctggggtaaatacaggtgctgggtgtatgtggatactttagtctggagggcgggggagaggctgggatagagaaccagatgggggccaccagtataaatggtgaggggcagggactggagccgctgcaatggttgtgcagaggccacgtaggaagtgcaggcagagagcctgggaagcctcagcactcatggggtgggagaaaacacgataaatagagcaggatctgtgaggtctgagtggttccagcagaaagaggaagaaagctgtaccaggaggcttgaaccttgggtgagaggccagtaagagacctgagcactcaagtgggttgactgtgtgcctggccctgatttgtgctttgcgtggatcatctcaggtgagctgcagatcagtgttaggataaacctgtttttatagatgagtgaattgaggcacagatgggctaagctgcccaaagatgtaggggaaggaagtgaagactcagggactctactccagactccatcccaacgagagagagataacctccaagtgcaagtgaggctggaagagtgtccccagggatggtattagagagcctcaggccagtgtctgtgatgagggccctggccaaactgcaagggaactggtgagtcagcaatcagtcaaggagacagtgagtgactgtttaatgaagtacaggggtgcttgcaatttcacgaatgtatttgatatcaagaaataattgccagtttatacttttacaattttaatttcttttaaaaatcatcttagctggtttggggtagcctgcagggtttgagagcttctcctgctgccaaaaacatggagactttgccctacatcccacgcgtagtgctctgatgtcccaaactgggctgaagaagcggcccgggtggctgacctgacggtgtgcactctgctggtggcgtcttattctcatcatcggaggaatgactaatgatgtcactgtggaacctcccagtgtcagatccatgactgatgatcgtggccttggaggcctgcagttttcttggcctacagagcaaatggacagtatagtacgaaggaccgcagccagcttcctgtttacagtgggaggcttaggtttcataatcctgggctgatccaatgcagcagacattccaaaactcaatagatttcttgttctgttcattggatttttgttctatagagttttttcatggttagggtattcatgagaatgaaactgcccaggctatctgaatgttaacatgccttctgagaaaaaaatcagtggataatggatttgctcctgttaataaagttttaaaggctgtatcaatcctctaacatgaaatgtgggaaagaatgaaaagcagcagaaaaagaagcatctgtgaaaagataggaagcatataaagctcagactagaaagccttctgcatatggaagagagaagcttatcacagtatttttttccctgctgacctatatgacatacattaatgatgtgaagtgacatgatcttagttttttgcttcttaaagaaaatatactccatttctacaactagatgattaaatacaacaatcttttttacaaccctcttaacatgttttggagatgatgtttctaattttcagaaattaatgtgaaatcaggaagcaagatcccatatactgagaa

SEQ ID NO: 25815 - DNA, 1050 bp, Bovine  19866880899697
taatgcaatacacttaaaaaatgggtgagacagtaaatgtgtattgtctacaattaaaaatatatgtatttagataattagagctggcatctggattcccaggtggctcagtggtaaagacttcacctgccaatacaggagacacaagacacataggtttgatccctgggtagggaagagcccctggaagaggaaatggcaacccactctagtaatgcttgcctggagaatcccatggacagaggagcctggtgggttacagtccatgggggttgcaaagagttggacacgactgagcacacacacaactacaaatttcctaaaatctggcacacctgtctctctgatgagctgggtcagactagaacgtaagtccctagtttattatcacccccatcaaccatcaactcacgctcagatctatctccactatacctccatgagagtggaattgtgtctccactgtaattgatctacaccagatcaagctacagacttctgggaaataagaacaaacagaaaggggcctgcatgtgcacactttttaaaagacctttaagctttcctatttattgttcaacaataatttagcttaaatggaaaagtatattactggcataacaaaaaaaatcagagtaaataaacaaagatgcaccatttacttctctgcaagttgctgatttttactttgtaaagatgataaacactagctcactctgcttactcactgtccaccatttaggaatggaaacggatacattttggttaaaaggcaaaaactttttttccccttacttcttctggtttataccctataatttaattcatggtcaacaaaagattaaagtctgccaaagaaaattacaatgagtagaagcagttcacgagtacttaatggaagttgggggcaaattaacacactgctgtcatagcgtgtgtccgacacacgtccttacttgcacaagcgtgtccagggtaaagatgtgctccccacgaacgttgtagaacttgaccatggcactcttcagaagagggccattggggaggtca

SEQ ID NO: 25816 - DNA, 814 bp, Bovine  19866880922613
gtatctgatgagacagctttcctaagacatcagggtcaggcctgttggacgtttgtcgccagttttgatgatgatgtcatagtttagaagatttccagtgttatgatcttgacaacatatgcattttagataaaaagtgccttagagttctctctagtaccccttcttgttaacttgaatatgatctcaataggcttccaatctgtgcactttcccccaagggaaagcgtgagactctacaccctggaaaggcccttcttggcactgagggacaagtagccattgaatgtggacaacctgactattgatcactgatgcttttagagaaagatcttgatcaaaagagggaaatgtaaaaagttaataaacaataacctcagttaaatagacttgggaggatagaaaggagaactctcacaatctgtgatgatcagttcagttcagtcactcagtcgtgtctgactctttgtgaccccatgaaccacagcacgccaggcctccctgtccattaccaactccctgagtccacccaaacccatgtccattgagttggtgatgccatccaaccatctcatcctctgtcatccccttctcctgccttcaatctttcccagcatcagggtcttttcaaatgagtcagctcttcacatcaggtggccaaaatattgggagtttcagcttcagcatcagtccttccaatgaacacccgggactgacctcctttagaatggactgggttggatctcctttgcagtccaagggactctcaaaagtcttctccagcacaagagttcaaaagcatcaatttctttgg

SEQ ID NO: 25817 - DNA, 749 bp, Bovine  19866880929781
acacttaataaactgggttttttaatagttcttagaattgtacacgtcttccaccatccaaaataacacgatttcgatgctgtgatttatttcggtcattccacagagaatgggcactacgcaaacgagccatggaaacgccgtgctcggccggtgtacttacggtgaagttcatttccttgatgggccgcttcaggtgttcgaatcccacagtcactgtatacttagtgtaattcaggtagctgaggtgagccacgatgatttctgcacatttctgcaaatgcacaagcaagatctgtgtccttaaagcacgcaggactcactctcccccaactgacttgtgaggtgacccattccaaccacagaggatcagcacggagcatctccagggagctcgccaggagcccaggggaactcaaatggcagccaaaagcagttcttagaaagaaagaaccaaatggacatatttagaaacaaataacacatgatttacaatcattagacctcctctacttcataggattcaaaatagtatgtcaccttgagaatagactactggttgccaacgggcgggggaggcatgaaagagctggactgggagtttgggattggtagaaggaatgttatttgggtttccctggtggctcagatggtaaagaatctgcctacaacgcaggagatccaggtttgatccctgagttgggaagattcccctggagaaggaaatggtaacccactccagtattgtt

SEQ ID NO: 25818 - DNA, 1484 bp, Bovine  19866880940813
accttattatgtaaccttgatccctagatgcatgtcaaaaagtgtagtccagttatttcagggatagcatttccaaggtctcgggaaatgttttttctagatcttttgactatttttgttggaatagtcaaagaaaacctgcacacatagtaagggaaatattttattgtgaaaagaagaaaatttcatgaggttctacttattgcagtgtagattccccatgtgctaaatttcttgagttacagggaaatgttcttacaattattttggaggttgggaagttttctttgtcgttactaacactgtaggttaaaacatttagtggacagtgtgtgtctgtttcctacattgatttcatgttaaaaaaacttcgaaagcttatttttgttgattgcccatgaatccaggtttattacacatgtcatgtgctttgtactaaataaattctgtgttcttttggtcagatgtgcttcaattgcctgagaccaatgttagtgattttgattaaagaaaagagagaagttagaccggtctcttaattcagatttttatatttggttataactggtatgaggcagacagtgacttaaactgtcgttcttggagatgtgaaacggtggcttgacatgaaccgtgtgtttcagaaccgggggtagtgtactttgtgctggttactgcagaaaacagcaatggagtgagccgtcctgtttacagagcggagagcctgcctggtaagtcttaccttagaattggaggctatgtttttgtgacttagactgggaaattctttgcttcttcaggtcaatgcaaatctagaaatcattaaggagttcccaaacaagaaatttttagacctgtatagcaagctgaaagattgaaaactaggagaaattcatcccttcttctaaagtacttttgatataggttactagtgctttgtcttaagtttgggggtactcactacagttaaccatgtataaaagaccgaaaatatgtgttgtccatacagtttaggggtcaggtcacttggatggcctgagcagatcctttggaagattgttgagaagaccgttgaaatgtacattgagggatgcagtgaagtgtggaaaatcaagtagtcctcctttctaacgatcaagttgcattttcctaatttaggaggtgaatggatcaagattgatggttttcccattaagggtccaggaccatttaatgaaaccgtcacaggtactacttgctcattcggttcatgtcttcactgaagcaccatctcgaaagagggctgtgcttctgtcacacacatgtgctcacaaaccttcatttagttcccattgctaaactaacacacacgccgcacgttttggtcgatctgcactgcactggatggaccagactgcagccagtattgctcattcctcacggctctttcatgttctggtgtggggggtatgtccttgtctacatctggggatgctgttgctctg

SEQ ID NO: 25819 - DNA, 740 bp, Bovine  19866881002373
atgtggggtctcttttggtaaaaacaattcacggtggctgctcgatgcctgtaatgttcagtgaaagtgcgtccagtgttgaaaggcagctttcggtaccttggaccaggattaagaaaatgttttcaaccttcccacccatcctcctatgtcacgtgatgttaaagtaattcacgtttgcatatcaccagagacacgcaggttggtaaactctcagcagggcacccagagcccagggagccccgcccggtacccacagggctgctgtccccaccacctctcgtccggggctccccccgtgcccctgtggttagagcctgatgctgtgcagcaccaccttcctgggtgacccccccagcccagggtctggcctgcactgttagtggtttccaggcctccgcagggctgcaggtgcaggcctgggttcaggtcacgtgctcgtacctcattttcacccggcacttctgttcccgcagatggtccggcagcgtaccccatcccggtgcagaacatcaagcccctgctcactgtcagcttcacctccggagatatcagcctgatgaacagctatgacgacttgtctcccaccatcatccagtcagggctgaaaggtacggagccgcccgccttgcgagctgggtgtcactcccaggcctcctgaccactggcctctacagggcttaatggagtctgtccgtgaaggtctttcctctcgctcctctgcttgtctgaccagtcga

SEQ ID NO: 25820 - DNA, 1339 bp, Bovine  19866881487397
agaaagtgaagtcgctcagtcgtgtccgactcttagcgacccccatggactgcagcccaccaggctcctccgtccatgggattttgcaggcaagagtactggagtggggtgccattgccttctctgagcaattgactgtacttggccactaataatcctttgggctattgcttctcattcatattcatggggagaactggctggctttctataaaggagttgaccctttagagctcgactctcagggaatctgttgtggccgtttggctggtccatccttgtttctcaggttattactttacctgtgtaaaatacaggggccatcaagttgggcttgagttttcttggccagtgaagtgatgctctggggcatcctcacccaggaggcttctggaagcaacatttatttcatcattatttatagctctctaaaagaggaggaataactgaagcccacagcaaaagtcatagaatctctcctatacccccaccaaacggtaccaaagaaaacagacatgtgttaacaaggacatggaattttcctgcactacagatgggcgctaaaccgctacagtcaccatggaaaatagtttgaggtgtatactaacactgaacatgcacgtaccttttggcccagcatctcctcttaggtatgtgcccgacagacatatacatgtctgtcaatgggcgcgctctaaaatgttcatagcggcacaatttgtaatactcctgaaccggaaggcagccaaatactcataacagtaggacagataaatttggcttgtcccatactagaatgggcatcccaggttatgctagtggtaaaaaatctgcctgccaatgcaggagatgcaagagatgcgggtttgacccctaggtcgagaagatcccctggagtagaaaatggcaacccactccagcattcgtgcctggagaatcccatggagagaggagcctggcaggctacagtccatggggtcacagagagtcagatacgattgaagtgacttagcatgcgcacgtgacatgtactttctgtgtgtgtgttatgcttcattagaaagctctaaagaacaccagctcctgtgtctcattgactagatcggggccccttgtcctttcttgaacacaggctggcaaggggatggcatcagactttagcaagtgtgagtgccccagaagctgaaggggagcccgttccccaagacttagctctttaagggactcctcccttgtgttagaagaagatgtggagaatggatgtcgggtaggcagtcagctatgtccatggcatgaagggtaaagggtaaagacaatgaaggacaaaagaaagtgaaag

SEQ ID NO: 25821 - DNA, 2611 bp, Bovine  19866880255103
tcttgcctgttctctttccttttcttttatgtcgttagttagttagttagtcgctcagtcgtgtccactctttgtgaccccatgaactccagcacgccaggcctccctgtccatcactaactcctggagttcactcagactcacgtccattgagttggtgatgccatccagccatctcatcttctgttgtccccttctcctgcccccagtccctcccagcatcagagccttttccaatgagtcaactcttcgcatgaggtggccaaagaattggagtttcagctttagcatcagttctcccaaagaacacccaggactgatctcctttagaatggactggttggatctctttgcagtccaagggactctcaagagtcttctccagcaccacagttcaaaagcatcaattcttcggcgctcagccttcttcacagtccaactctcacatccatacatgaccactggaaaaaccatagccttgactagacggacctttgttggcaaagtaatgtctctgcttttgaatatgccatctaagttggtcctaactttccttccaaggagtaagcgtcttttaatttcatggctgcagtcaccatctgcagtgattttggagccccaaaaaataaagtctgacactgtttccactgtttccccatctatttcccatgaaatagatctatgccatgaccttagttttctgaatgttgagctttaagccaactttttcactctgctctcactttcatcaagaggctttttagttcctcttcactttttgccataagggtggtatcatctgcatatctgaggttattgatatttctcccggcaatcttgattccagcttgtggttcttccagtccagcgtttctcatgatgtactctgtatataagttaaataagcagggtgacaatatacatccttgacgtactccttttcctatttggaaccagcctattgttccatgtccaattataactgttgcttcctgacctgcaaataggtttctcaagaggcaggtcaggtaacatcacatattaaggtttctttctgtttttggtgtggaagaaactggcagaggttctgatttgacgattatgtctttagttgggccctcagagcaaggataaggatagggatatctgggataaggataataaacagagaagcaatttggatctttttcttccatactttgaattgctcagaaaagtaaagatactgatttcttcctataaattgttgattgctaatgataaacaatttcctagctttatttccattggggatacttctctttaggatattacccccccaccccacccccacggtagtattcatggatggaattatatgttcatttttaactccttgcattaatcttgttaaaatgtgttgatcgcattcatattgctatgaatatgtttttcatatactttatacttcaaggaattctgaatcactttattaaaatcatatgaaaatgataaaggaagtgttaacttaatatttcaagaaattccagatcactttattaaaggtcatatgaaaaggattaagaattggcgaccacaggactatggggctagaagtcatctttgtaattatgtgaggcttctgtgtttaccaagacatctgtagtcgtttaagaatgcttctatgaaaactgtaatacttatttgaatttttcatgattgtttataaagatagtaatgaaatccaaccaccagaaaaaccaaacaaaattaggacagatgtcgtattgctagttttcagttctccttttccaccttttttttttttaatgtcttgttgataggaaatggcagcaagggtactacaatcatcttgagtattattattattattatattctgctttgcttactatcctaaaaacttttatttttctccccacatcgttaggggaggacatttattattttgaaaatttcaaggagatttgaaagtgagtgagagatattcagaaatgaagttgcacgcccaccaaaacaacttacgttttaaaaaatgaagtttttaggtttatagtttcagattcactgtagaagaaatgtgttgtcattcagtgaaatgatatcatctttctgtctttcctcctccccaatgggcattgtagctttgttatgaattctctgtaggctcatggtgaccaaaaaggaatactgaaaaaggggaaaatgagaacacagaagaaaaaaattcagtaacagtgaatttctgtgtcatagttaagagtgggcagaaagaaggagagttcctgtatctttcctgaattgagtgattccttgacataactcagccaagcaaaccccctggaaataaatacagttgctacttgctatcctgaaggatctggattcttacctggatactgtgctctccatgtaccccattttaaagtaagagaaagtgtctagaaattttcctgcatgttgtcttactgatgtctgaactgcatttgtatgagtgcattgtcatctccagatccagatcctggctaaacatcccagtctgctgaaagcatttcagacatactacagggaagagagctttatcaactgtttattctgttcaaaccatgctg

SEQ ID NO: 25822 - DNA, 3980 bp, Bovine  19866880401917
taaaaaagatagcttttatatgccaccatttttaagtttttattttaatttagacaaaatatttgactaaattttttatcagctactttctaagcctgtatgtattttaattcacgatgtgtgtgttgtgctaagtcagttaagtcatgtctgactctttgcgaccccgtgggctgtagcccactaggctcctctgcccatggggattctccaggcaagaatactagagtgggttgccatgccctcctccaggggatcttcccatcccagggatcaagtacaggtctcccgcattgcaggtgaattctttacatctgggccaccagggaagcccttaactcaatgatagtgatgctgaatttaagaatccctcagttgttatttttatgtaccttttataactcattgttgtatgcagctataaagttattgtgtgacattgctagagaagttctcttgactggattattttgtccatcaatgtggttcatatataccatatggttaatatataccaactggtaatgtgataatttgctcagccttggcaatcagtaaagattgacaagataacacaacaaacacttttggctgtgatgatttgttttattttgttgttaattgtttttaaccactgcttgtctttattttaccagctagcggtaaataattaaagtattatcaagcatggttgttccctccacttccaggaacattagaattgaacactattgtctgtgtcccctttaaaccatatgtaaagttctaatataacaatgttaacaatttaatatgtaatcctcttcaaaacaagttcttcatgggtagggataggttatcttgatcatcattttagttccagcacctgaaatagtacatggcacagttatcttctttgactcctgaatgagtgaatgagtaatgctaaagctgattataatcattactcacctcttcattagcattttgtagcactttccaactcagtatttcatatatagcacatgagagctggagtgattattaaaggtgatctaattccttttattatgaatggggaaaagctgagatccagagaaaacattgacctgctgaaggacacagagcctgtgactggcagagttaggcgtagaactctgggtgccgtgtggtcagaccatgttcccattacactccttgccactgcccactgactactcagtcatttctccccagcagttcaacgttatacatagttggtaatgctgctttctacacgtatagctccaaggactttgctccctggtatttacagtgtctaactggattatcctgaagtaacatttttcaaaccaaggctgacatctaatagagccagaaagttccagaagttccagaatacagattatatgaagcaaagagctttcttgctcttgtaagttcaataatttcacaaaaatgcatagataagattgggagaaggacacttttattatcatattgtaaactacatgcagttcttgaaataacattctgaaaaaatttgtgccagatgtcatcagtttgagctgagttggcctgtggtggttggcctagtgaccattcaggtatggaaaggaaacatggaatagcaccgtgagttgtttgttaagagaaataaattaaccagttactgacaaatacagaagaggcctgggttttaatttggtttcatttggagtttagagtgaaactggatttattttcttttagtgttgttcagtcgctaagtcgtgtctgactctttgtgaccccagggactgctgcataccaggcctgcctgtccttcactatctcctggagtttgctcaaactcatctccattgagtcagtgatgccatccaactatctcattctctgtggcctccttctccccctgccctaaatctttccaagcatcagggctttttccagtgagtcagctcttcacatcaggtggccaaagtattagagtttcagcttcagtcattccagtgagtattcagggttgatttcctttagtattggctagtttgatctttttttagtgggaaaaagcctaatgataaggtaggtctgtttactctgggttccaacaggagtgcaatcaaaatgggtagagtatggtttatttaaagaagctctctgcaaaggtacaaatgggaaccaccaaggagagtccagtgacctaggccggaaaggagaatgagtggcccagaacctgaaaagagtgtattagtttcctgttgctgctgtaacaaattagcatgaagtcagtggcttttaaaacaagacttctggaggtcagaagtctgaagtgggttttatgggccaaaaatcattgtatcagctgggctactttcctttctagaggctctaggagagaatcattttcttagctttctggcttgtagaggtcttttgcattccatggccactgttccttcctccattttcacagccagcagcagtgggtcaagtgcttctcacatagcacccctctgacctcttctgccacccttttaaatgtttaaggactcctgtgattatattttcacccagggtaatccaaggcagtttccctatttaagatcatgtaattaacttaaatttcatttgcaaccttaattccttttgtcatgtaagacaatatattaacagatcctggaaactaggacatgggtattggtggggggcatattattctgcctaccacaaaaagtgaaaggtgcatagagtttgttagcttcagcaagctgtgaacttcagtcgggaatccatctagcctaaggtaaccttgtagaaaaaagccagggaaataaatgctgtgccttcaagcctgctgccagagctcgccattggctgaacccatctgaaaaccagaaggtgtaggcacgctgttgatgtagtggactccatacagggaggcaagggagaaaggagggaccagaaggggcaaactgaacctgtcccacaaaggaactgtaggcattctaggtcttgacttctggaagactactttctgcctcagtatagtttttgtgcttgcctggtagctcaactggtaaagaatctgtctgcagtgcaggagacccgattcaattcctgggtcaggaagatcccttggagaagagttaggctacccactccaatattcttgggcttccctggtggctcagatggtaaagaatctgcctgcaaggttggagacctgggttcactctctgggtcgggaagatcccctggagaagggcatggcaactcactccagtatttttgcctggagaatcccatggacagaggagcctggtggtctgcagtccacggggttgcaaagagttggacatgactgagcaactaagcaagcaagcaagcatagttattgtgcagtcattgctaatgaagtgcccatcacccaggagaggagttagtatgatgagagaagctgtatcatttagttttgtagttcagccaatatttgcttcccttttgttatctgcaagtatttatagtaaagtcttctttaaatagttccttctagtgttggctgcatgctgttaattaagaaaaggttcatgtgtgttcatgtagacaccagtgttagtgaacttccctgctgcccccaggccaccccaagcctactgagaacagtaattgatgaggcctctcaaagcagtttctctcccttcagtctccaggagcttaatggcagagtgtttcttgatggtgagctgttgcatgtggggcaagacagttcttccccccgccccgactgtgcctcatggtgtgtgagatcttagttccccaaccaggggtcgaattgacacccctgctttcaaaatgcagagtcttaaccactagaccaccagggaagtcccctttcttccttaagtgaggactgtccagtgtgttacagaacatgtaaaatttgttgtctccacccactcaataccagtagggtcccgcagttgtagcaaccaaaa

SEQ ID NO: 25823 - DNA, 5946 bp, Bovine  19866880440891
ctcagtttgatgtgccttgatgtgccgagaatttgacatttaaccactagcattatcttaaagacattcagttctttatatacataaaataaattttgttaacaaggaactctgactttaaaggaaaaaatcttattacatttttgaacaagactcaaagttcctctgatactctaaaagaaaaatcattagtgtcatttttctattaacaataactacacagtgtttattatgtgccaggcactatttatccaaatgagttcatttaaacttcataacaaagcacagaggttaagcaatttgcccatggtcatcagctatgaaactgggagagatgaaatctaaacctaggacatttggcttcagcacacaagctcgccatcattttctatcccagggatcaatggatttgccctgtataggtgcaaaacatttttaaatgtttataattgaaattaaaaaattttcagctttgtgggccatacagtttccgaggcaactacttatcaccatgggtgtagggtgaaagtagccttagttaccatgcaaacagtgggtgtggcgatgttccacaaagctttctttacaaaaccaggggacgggctggatttggccccccagccatagttcacctatccttgatctgcaccatcaaagcattaaaaaggcttcatgtcaaattattaaataattttaggcctaaacacagtaaatataaccactataaagttgttaaggcagtatttctaaaactatatttagagagctctgaagtagtaatttttattagtttatagactatagcagctaataaacacttcatttatttaagtcttgaagactataatgacacagtttcttcacagtattacaataaatgttttcaataactaaaaagacataaaagtatttaaatattattatgtagtatatattaaatgtcttatttctaagattaagtggactatctttactaaatggaagaatctcaaactgaaaactggtcatattctttcaacaaaactaaagctgcactcacacatatcaaaagacaaaaatcactgccatttgtatcaaaaaattaatgtgcttcagtcacatatgttttcatgaaagtttaaacatgaaatcacctttaagatcttggccatgtgatctgctccctgccatgtcagattacaccccgtgaagttgattgtcttaagagtgacagagttctttataccttgacaaacaactaaaagaaaaaacaaaacaaaacaaaaaaagaaaaccacacacacaataagatgaagagcctatacattggtcaaacttgacttatttgcttttcttgagtcaattggaggtttatagctagattcttaaaatcactgttgccaatcttccccaataggtaactgactgataggtgcattctaaaataagtcataacgaagtgctaaagtgttccagtttacagcaatagtttaattctgctgctgctgctgctaagtcgcttcagtcatgtccaactctgtgtgaccccatagacggcagcccaccaggctcccccgtccctgggattctccaggcaaaaacactggagtgggttgccagtttaattctacttagatactaaaactgaatacactgagtactgaaaactttattcctcaccactcagttaagtattatataccttttaagacacacgggaaaaaagaaaaacctaaaatgcataagactcttacttttatttccaatgatatatcccaattttcaatcaacaatttaaatgtcaactataaactcagaatcttattaggtactatgcaatataatacagtaatataagatagacgatctcaaactctgttccctgaaattgaaatgcagcccaccttagccctccaggccagtactgggcacagtgaacacccacggatgcttaaggatcccagcagtcaccttctttgtgattacttccatgatacacccctgccaacactactgagtttgctcgccttttaaatgctcttacagtactttgaatatatctcctactttaacacatttccgcagtgcattataattattactgaagatggatgttttagccatttaaagatacagatttttttatgctcttgacatcttgctatttcccttcccataatatttcttaaagagaaaccacaaaaatataaacaaacacaaaaaacagaaaatacaaaatgtgtggtttggggcttaatgcaaactgaagtaaaagtagtgctcagagtacccagcatgacagacttccgtggtacaaatgagaacggaccacggtacgagcagatatgggaaacaatccagccggggacagcaccaaggaaaggtacacaggactcaacgtggtgtgcagtgaatcacaagaccagtctgatgggaagactcaagactgacactcactttctaaacctccatctccaatcggacaattcgcaagagacaggtgcaccagagtggccgatttattccaatccctttaatgaggaaaaaaagttcaaaattttattggtttagtttccccccaaagcaactatcaaacgttggcaggctcgctgaagggttacctttgtcaacatcgttaagtctctctctctcagaactagcccgtttagctccaggttccttagcgcacctgacgcacttaaacagcatttaagagctttacacaactggaaggtcacgtctttatttcttatcgcaggaacacgacttctgtaaactttattcctgtcagaagctaaagcaaaactattgtaaaatgagtgacttcaaccatacattttatcatcattaaaaagcatccactctgggctaaggattagaaaagactcctgccctttaaaccctctttatggatggacatatgtaaactcaaaactttaaccacatgagataaagaaagataatctatatgtacagaggttcctatggaagcaaaaagttatatctaagtgatggcttcatgatcaccctgaagctgaatctagaaagatgacactacttagagttggacagggaggtggattaactgcagagagcacccttgtgaagacattcaaaccggatacctgctgggcactgtaaatactgcaggtcgggatgataaaaggccaggggtgcaagtgggagaagaaacaaattaaaatagagatgttgtcactccactccagtctcaggccaccactgagctgctttctgccactatagattagtttattttctggagttttatagatgaaactatacagtaggtagtttttttttttctcctggtctgtcttttctcactcagagtaattattctgagaaacctgtatgcaggtcaagaagcaacagttagaactggacatggaacaatgaactggtttaaaattggtaaaggcatacatcaaggttgtatattgtcaccatgcttatttaacttatacacagaccacatcacactaaatgccaggatggatgaagctcaagctggaatcaagactaccgggagaaatatcaataacctcagatatgcagatgataccacccttatggcagaaagcaaggaggaactaaagagtctcttgatgaaggtgaaagaggagagtgaaaatgctggcttaaaactcaatggcatcaggtcccatcacttcatggcaaataaatagagaagcaatggaaatagcgacagacttcattttcttgggctccaaaaacacttaggatgatgactacagccatgaaattaaaagatgcttgctccttggaagaaaaactatgacaaagctagatagtgtattaaaaagaagagacattactctgctgacaaaggtctgtctagtcaaagctatggttttcctagtattcatgtatggatgtgagagttggaccataaagaaggctaaatgccaaagaattaatgcttttgaactgtggtcttggagaagactcttgagagtcccttggactgcaaggaggtcaaaccagtcaatcctaacagaaatcagtcctgaatattcattggaaggactgatgctgaagctgaagctccaatactttggccatctgatatgaagagccaactcatggaaaagaccctgatgctgggaaagattgaaggcaggaggagaaggggacgacagaggatgagacggttggatggcatcactgactcaaggacaggagtttgggcaaactccaggagatagcgaaggacagggaagcctggcaagctgcagtccatggggtcgtaaagagtaggacatgactgagcgactgaacaacaacaattattcaggctgttgtggatagctcattcctcttaattgctgggtggtattttgttgtaaggacgtgctacaatttataaacctagtgatggacacttaagttgtttccaccttggggctactgaaaataaaactgctttgaacatatgaatattaaaaaaataaaataatagagatgttggctgaagcaagtctgggagacagtatggcttttataccataggtctggggctacgctggctcaataagggtgccactgctgattagaaaaaggagccccgctgctgaaggaccagttagataaagggaatgattagaaaaagaatcctcccctcagggccaaagagccccatgaggcttggcagagcacagttcagatttcatccctctgtgcaaaacacaagctgtgcaactaacatgcaataatcctgtgtgggaaagctattgcaagcattgttttaaacatatctttttattttagaacatcactcaagctgagtaggcagatggacttagagaactaagcccaagtgtagcaaaaccacctaagtgcttctgcaatagtccaggcaaaatgtaataatatggatgaagaagcaaatttaggaagaggccaaaagctagacccactggatgcaagacataaagaaagttcagtgaaggaactataagagaatgctttctgccatatatttttcttatattcaatgcaaaatattagggaaaattaagtacagtggactttaaggtccctttcagctgtaatttcttttgatttctaagttattactctggttaagtaagtaccttcagaggtaaggaaaagttcctacacctgaatgggatgcagagaataatctgacttcctttcaccaggggatgagctgagctgtccttggagaagagttaacagatggtgtgaaccccagatcctagaaaagggccaggtacatgataagcattcaagtttttaaaaacaaatcatttcctctcctagatctacacacatctcctctgccagctactttctctcattcataaacattctcagatgtgtccacttaaaaaacatctcagaactataactcattggatcttctttgtgcataacctcatgccttcaaacacctgtcctccccaaaacccagatctataccttgggcccaggcctgtttaccagttggctctaaagcactgaagatgaagtaacatcctctccccatccccactcccttcctactgtgctctgtatctctcagaaagatgtggcttttcacccaagcttgctgccttcctttatctaactggtcactaggtcccacccattctgaatcactgatctctaaaatccagtccaaccatttataacttaatttggacccttagattcaattcatctgcatccaattaactgcctttcacatggagatcagagtgagtttctaaatcaaaagtccatctcattgttctcagtgtttcccacagacttcagcataaacaaccaaccttctgacaggacaaacaaagcccctttctgtctggccccacgatatttccagtatcaactctcatctctttcccaaaccctgagttccactccagtacattagttttgccatattttcttatatttctcaac

SEQ ID NO: 25824 - DNA, 806 bp, Bovine  19866880471262
tcgactccttgtcaaggaggtatctccctgttctaaaccagtatcagttatctataccaagaacttgccaaatatttaagttttggggggcatatcttgtagtgttgttttgtgatttaattttcatcagttttacttcttgattccctaactgtgatacagactttctgaaggctttgtactgagtgttagtacttcagagtttccaacaggcttccttcaggaccagctcaaaaaatacctcttctatgaagactcacccaagcagtacagtgaggtttattgtgtaccatttcttcagtatgaactttgaaataggaaatgagaaaacatggtgttttttttaaactcataaagaagagaaagctctaggatggccaaggagaatgattcttggacacaatttaaggctaacaccaagcaaaagcatgttgtaaatgacacagtctaatttaatgggcagccagtaagggcaatgcacatacctgtagagtcagaacagaaggataaaaacagaattaatgtattctatcagcacacacacaggtggtgtgcactaaaaggaaaacctgctctttatcacagggctgtgttgtgaggaatgcaaatgtatttagaattagaatcatgattttgtttggtcatgtctcagctaatgcagcataattttcttttgttttttgttaatttttattagagtatagttgattcacaatgttgtattggttttctgctgtacagcgaactgactcagttatacatggacatatagtcactctcctttagattctggcccatttaggcca

SEQ ID NO: 25825 - DNA, 2705 bp, Bovine  19866880539671
tgtggaccacggcagcagctttgtcctctcttcctgcactgggggagctctctttgaaatccatcttccaccccactatccaagagtttctcgtgaacataaactcactcacgttctcatctactcaaaatcccccagctcccatcccagtttcccactctctacaggacagaatttccaatgtaaaccctgaagaacctcctggtcacctcagctcccactctgcactattaatcttagccaagaggacccctctcatttccctggcaagcctattcatatcaccatgcttttctctcgacaatcccccagttcagccttcaaaactgctacttgtccttccctacccaaatcaaatggctccttttctctgaagtctttcctgcccctcaccatgcccactcccaggcagtcactcctgtctctttactccttcagtaaatgtgcatcttcacctggtcagtctcacagaggatctaggctggcctgatgacagagaccaccacttctctttcctcttcttctctctagctcctaaagtgatcagcaccttttaaactataaataaacacttactataaaagagaagatgctgcccatcttagagcttcatgggtgtatgtaaatttacatcctttctctctccatccaaacctatgatgggaatacacacacacatgttcatttcacccaacaaacacaagtctaagatggggaaggagtggcaaagttgtatggttaacctaacatctagaaggcaaagattcagaaacccagattttcagataaaagatctgcttttttcctttatgactgacaaaaagtttctacaataaaactccctagaaacaaaattggcaacattcagtgttaagtcttctgaaatgtatcattacctaggtatttgggcatcaccatgtgaggggttgagatctctggtcccatggagagtatatacaacacatgctctaaggtcattcttgtccttactagaggtcactgaaaaggacccaaattcaatgggacgggtagattacattgtgtgcatgctcagtcatttcagttgtgtctgactctttgcaaccctatggactgtagcctgcccaggctcctctgtccatgggattctccagggaagaaaactggagtgggctgtcatttccttctccagggatcttcctgacccagggatcgaaccctcaactcttacacctcctgtattggtagggtgggttctttaccactagtgccacctgggaagattacattaagccaacttaattaacagccagttaactgttctaactgttctgcttttgtttctatctgcaggctgtgtccctgtgtggtccctcttgtcagtctccaccttgattaccccctctcccaccaacactaccctgcttggtttgggggaggtgattacaagtgctggtggcagcacgtagtgggacagtgggatgcttgctctacctcctttaattgctgcttccctcctatttgttaaaagttccctttactctcctctctccatcatttttcagcctcatgtagccacacaccccgtataccaaatgacctggcatctccccttcaatgtaaagcttcagaagaaggtgtttcccccccacccccacccctgacttatgaggctttctctttcagccctgggtggaaatcagcacagattcctgttcttatcaactgagtgcttaaggaaacagagcaggtgccagagtcaataggatatcgaaagcgagattttgctgaagattatttgtaatggggttccgctgctgacacacaatcaggagttcacacttggtgagaaagcatgacaggggaaaagggccagaacttcacaaaggggacaggcttggtttgcctggatctaactggccaggtaaaggtccatgcttttgtaaacttggacagaatttcctcctctcgctgaaagaacactctcgtctgtatatgcagacaagaaacacaccattctgccccaccctcatttcaatagactgtcccttaggccacctgaccactttccccacttatggcagtacctgctttgcctggactctgggttcagaggtacaagagctttggcagagtgctaaagaaaagggacatactgtcgctgtacagaggaagtatagccatggtaaccatggtttggcaaactgttctgccttgctaaggtctgggagtcccgtgcccactgctcctggttctcacaccctccactagcagcaggactcaaacagttggctcttctagtccacctacagcatgaatttacctcctctttccaggtatccatttatcatctctagaagtattactgctcagctgtggggccttgggaagactcctggcacagtgcccttggtcccaactcttctcttttgtccttcaaaacacagtaccttttgcaggcagctcaggtatcttaatatctgaggaggaaacctcagatatttgttctaatgtttgcaattatacccctggccttgtatttacaattatactttttctaaagagctgaaagaagatgacatcaatcccttcaagtcagcgcagagatgacttgatttccattttaccagtggggaaactgagacaaggctgatggatttgtatcctggtagtcagtggtaaggctgtcaaaatagaggctcttttagcatatacattcaggcact

SEQ ID NO: 25826 - DNA, 708 bp, Bovine  19866880574740
gaaaaaaatcttgacatattaaccttgaaagaaggctactgtagtttttagtcaagtcacttgaattaatatttgaaaacatagtgaaaataataggtcagtttttttcccctgcctcatgagaaatataatgaatgatttttaatgttgtaccatatacagagaaggaacataatcatcaagtccaaaagctgaagggagcccttgaggccttccaggcatgttctcctcctctatagctgagtgagcacatgaggttcactgctgaccatgtggccagcctgggtggacgctctttccacacacctgcctgtagatcatctcacgagaaatatgaaatgaggcagaaaatggcatttcagatctgtcctgggccttttcctccactgccgttttcatttgttgctttccctgagggaaggccacgtgagccattctatcctgagcaggaatttactggtttgatgaggccttcacagtgctttccagagcatggtgtctggtcattttccaactcgtgcatttttaaagtatgcagtttatgactgagtgtaacctgaaagtctgggccacttacattcacgttttttatggcctgaagtaatcaatgctaaacatctgtgggtaggtattctgactggttcctacttcttaaaatgttgttatgatgatgactttgggatttttatgggatcttcacgcatccaa

SEQ ID NO: 25827 - DNA, 1522 bp, Bovine  19866880593826
gggcttctgatattctacccaggaatctcacgcacatacaaaaaaactgagggttgaaactcatgtaactaaaagggagccagaaaaatgtcttaatgctaaaactttaaattctttctgagatttgagaaagcaatatgaggttcaaatttcagcataacactcagaaaggatcatggaggggaaaaaaaaagtttctttttaggagccaggaaagaacagcggccaaagcaaaataaatccttttccaagtgatagaccaaggacatctaaacagaaagccaattgttctcaaatttaactacaatctttagtcaagaccacctcctggagagtcaaatcgagatgctgataaagcttcccagatagacacagccatctcccatagtctgtgatgtcttctgaaaccatctgggagaagtctttctgttttaggtcagttttacagaagatgatatactgatacataaacagaacagaaatggggacacaattctagacattggtgtaaatgatctatgagaccagcaagcaaaagagagtatggacattctgatgtgactggcaggttggctctatggggacagggccttatttctcttgttctctgaatcctttggatcctataacacagcacataagtaagtgaagtcgctcagtcgtgtccgactctttgcaaccccatagtctgtagcctaccaggctcctctgtccatgggattttccaggcaataatactggagtggattgccatttccttctccagagaatcttcccgacccagggatcgaacccgggtctcctgcattgtagacagatgctttaccatctgagacaccacggaagtccaataaatactcgtgcatgggtatgtattgactaagacaaccaggatgatcacggtttgggaaagcaataggaagagggtttgtctggccaagagaaaactcaggactaattggacaagtctgttgagtaacaaagcatcctcacatgggggcaggcgagctgccatttgccccttctgatgaggactctcgggacccggggccagccacacagggcaacttaggttgtgtactgggtttcctggtaatgactcacatggtttaagaaaattccttttggaatctttaagcaggagtggttctcagtagcaaggagggtggtccagaggagaacacctggaattgggggcactctgcttggatcctattacactgaccttgggcagcagctatgccatgtgctgggcatttctgcccctgtgagtgctacattcctggtacttgctattctaaagatactgatttatgagagaatctggctaatgctggggaaaattccaagtgattctcctactgctatggtcaaaatgtttgtgccccacctcccccaaaaattcgtatggtgaaaaccttatgcccaaatagatggtattaggagggcctttgaaggtgattaagtcatgaatggagccctcatgagcaacattagtgcccttatatttattataaaagag

SEQ ID NO: 25828 - DNA, 1760 bp, Bovine  19866880619969
gaagcactgggcaaatcacgcagctcacatgtcatgtagctggccctgataaagtttcttcagttgggaaagttctgaatgtggctagaaagtaaaggaagagatcataaatatgaaagttacaagagaaaaaagggaatgagaatgacacaggagcagttttcttgtaggtggagggcaaaaaggtggtggtcctgactcagaggagaatgatgcaggctgagaatggaaacggagatccagcctcagggttataaccaggtatctcccagggatcagtggtaagcactgatgggtaacatcctcctggacagagtagcaccttccacaaagcaccaattctggctggttaattaattacaagattgcttttcacacctttctttgaaactcagtggcaattgtgtttcctttgaggtcagagaaccgtgagtgagctttgactatttgttctatccgccttgggaaaaaaactcagtctatagtatggagagattgagggaatcgtcatggatggtgatttccatgtcttaaacgatagaaacttaagcatcactgaactctaaaggccgtgagcataattcaggccctaggacagagaataagtaaatgcagtgctcatttaatcaggcaataccattaaaggagtgagaggccaaactgccacataaatatgagcaggcaggaaagtatatttgtgagcacaatgaggagcaatggtgactaatgcaaaccagagagtgtcgggcctgttgaaagatgctcagaagcaaatacttccagaaccaagtggggactgagcagaatcctcccagaggttaggtttaattgcttggccatcagtctacaagccctgataatgagtcgttgagaaaaagaagaccctatggtagttcagaaaagcactgaatccagtatctgttaagcagaaggtaggcacagggcctctattgggtgtatacagagctgcttttcagcgttgacgttgttctgtgtccctaagaaggctgtaggctaccttcatggtctgctagggtttaattactagtcaggaagttcttttattgctttggacaaactcacttcattttcatcctgtttcctctttgtgtagagctatcttctcctaaggttgaacatatctttctacacagaaagacatatttttctacttttgttacaagagtatgtgttgttttccccgtttgaaaatattggaaatcctaatttgtaaaacatggtgtgagggaccaaagagtttcatttcatcagaataaatgatggttctgtctgtcaacagagatgttagtgattgattaatcttaagtaaaaaggattcttcctttgatttcacgttttgccaaagatccttagatttttgcatcattcatactctgcttttcacactctggttcctcatcttgctctctggactccttttgcttctcaagaggaattgcctgaatatgttttaccagctctcagtgttaggtgacaagcattacagagtttttacatggcagactgggaaggagatactagaggccatgagtttccagttgtgtcaaggagaacccttatacattcctatgtactccaggcattagtaaaaggagaaatcaattgctctcaaactttcctaagaatcagttcagttcagttctgttgctcagtcgtatacgactcgttgtgaccccatggactgcggctcgccaggcttccctgtccatcagcaactcccggagcttgctcaaactcat

SEQ ID NO: 25829 - DNA, 1009 bp, Bovine  19866880627067
tctgctttatgagtctcaatgactataattaacacatgtgaagtctttcatagagagttataattatagtatctcttatatgctttaaagtccaagcttgcagcctgtacttgagtcacctctgtaagatctcccaatttattgttattttgttctcttctgtgttcagtggtaggaacatcattcccccaagaggaataacttctcttccgttatctgtgttgcttagaaaatattcgcatactgggctgaaaactatcctgaaactagtttcatcaatcccttgaagacacagggactctcaaagcccctggaacacatctacttttccaaataattgaagttgtccttatgacacacctggggtttgctttcttctttatgtttaacattgtgagttctttctatcatttcttataaggcaggaacatcttgccctttatcattctagttgttttcttaaaaaagaaaaacaaaaaacccaagtggaacctagcacttgaggtatgtttttatgaagtcagagtagtatcttttcccgaactgagaacacatgtgaattcagaaatctttgtcttttgtctaagcaaatcatcccaagaaaaagcaattttgagtatagagggcatctgtaactttcctctaccaataccgtgatgattcttataatttttcttcagtacagaactatttatttgtagctctgtttttgacttgtggtcatctatgatctgcatacaatcctctgcatttttgcatttgttatatatttgcatatggctcccacctcatcccctgccagttgctgagagcacttctttctattgaatttcattctgcttctgttgggagcatctttccaaggccaagatcatttcaactttttttcaacatctagtatttctaatccttcctagttcactctcagagaaaagtagatgaacctatcataataagatttattaagaattacattaagacaagtgtttttgttaagagtcagtaaaga

SEQ ID NO: 25830 - DNA, 4519 bp, Bovine  19866880691515
cccccgccatttgcaggcttgggaataagataccttgcataacataggtactgtggtttggttttgttttctgtctgaaaagtcaaatacattcagttcggttcaattgctcagtcgtgtctgactttgcgaccccataaaccgcagcacgccaggcctccctgtccatcaccaactcccagagtccacccaaactcatgtccatcgagtcggtgatgccatccaaccatctcatcctctgtcgtcctcttttcctgccctcaatctttcccagcatcagggtcttttcaaatgagtcagctcttcgcatcaggtggccaaagtattggagttttggcttcaacatcaatccttccaatgaacacccaggactgatctcctttaggagggactggttggatctccttacagtccaagggactctcaagagtcttctccaacaccacagttcaaaagcatcaattcttctgtgctcagctttatagtccaactctcacatccatacatgaccacttatgtaaatagctcaatgcaattttattctttgatgcttatgaagatttttctggcattcacagagttacatgcccattcatctatcaaaactgaaagagaaatattactcaaaaaagtgttgaaaggcacaggtctaaaaaaaatgcaacagaataaaactgaaaaatggctcagtcctaaacattctaagcattctgggaagcatgggtacactttaaaacttattgctgttctaattctctgtatatcatattcatggctttaaaaaaaattactgatttctttgatgaagcatttagcaaatgaagaaatagaatcttaattttggaatgatttgattgcttctaattgcctgttgttttttcacatgtctgagtttaacatcacataaagctattgaatcattagctctgaaaacataagcccatcacttaatcacataataagggaatcagaagcatccaggatagccaaggaacctaacctggaagttctaagactcaactgggagattcatctgtcttcaggatgccctcatagctataattttccagtctcatatgaaaattcattgccccatccacaattgaacattctagggagtggaagcggagaaggcaatggcaccccactccagtactcttgcctggagaatcccagggacagtggagcctggtgggctgccgtctatggggttgcacagaatcggacatgactgatgcgatttagcagcagcagcagcagcagggagtggaagaagctttgagttatattcactttctgaaacaagggactcttgaaggacttgagatgggagagaaagggcaggacaaagtggctctcacttcctgagacacccacattctgcctatagaatgtgtatctctaaataaacttgctttccctttactctggctggctctagaatcctttcctgccctgaaccaaggaccctcacttggcgatctcacttggtggacgggatatttgcctctactgccacagtcttcagcgtgccggcctcccctcctctctctcctcccctcctcccacacagcagcagtagtggtgcaatgcagagggagccttaaactgacctgaacgttgtggtgagccctctgcttaagaacaaaaactgtggaatagacctgcctttaggacttcccacttctgactgtacatcccaagaaagtgatttactctctctgagtctccatttctttatttaaagaatggaagaagtaatctcaacttcaaatagctgttctaagaaataagatggcatctgttaagcacacggcctagttctcggcacatggtaagtacacatgaaatggtagctactaatgttattgccatggctgtttctttcttttaaaatggatgtatatttgatttacaatgttgtttgagtttctgatgcacagcaaagtgattcagttataaatgtgtgtatattctttttcagattgttttccattggagtttattataagatattgagtagcatagtttcctgtgctatacaataggtcctggttgtttatctgttttgtatatagtagtttgtatctgctaatcttaaactcctaatttatttccccccttttcccctttgataactgtaagtttgttttctatgtctgtgagtctgtttccattttgtaagtaagttcacttgtattatattttggattccacatataagtaatatcatatgacatttgtctttctctgacttacttcacttagtatgataatctccaggtccatttttcctaagttctgcctgccaattgttctacaaaccaaccatcaatggaaatctttggatcttatcagtggaagggagttttaaaattttgttactcaatccacttaatttacaggtagagaaattcatcagtctataaaatagctaagaagacacacacttgtccaaggttacactgaatgacagagctgaagtctcttgattttcatacttgagttcaattctgcttgaaatgctgaagtactttggttatgttccgtatgtacagaattattccttctgctttcatatttttctaattcttgctgtttaagttctagcttgctatcatgtaagccttcagctaaccaatgtactcatttgaaaaaaatcagaaaacagtaaaaaataattaaaagatgaaaaacttaattggaagagaaatattttgaaaatggtcaaaaagagtacaagataatcagaagaactatatatgcaaaaaacattgtaggagaataatgactttgttataaatgatgatagttttctttttaattttctaaagaacattttccaggaaaaaatgatgtttgatgcaaagtttaatgtatactcttcatgtaagtaggtttacactgctaaaaaatttttaaagtatttttatcctaaatatttcagctaaacgagagtgaagattttgaagaaggggagggtggagggagtgacctggtactgttttttccctatgacaggaagagtttaccaagaaacagaagatggatgccacattgttgggtggtaggtactgtggcaggtacttctatagccagaaggacttcactaaagcccaaagcaaaagaggaagttcaataagtggttcttgctgacagctaagacactgcgctgagagctgaggagaagcattcttttcttgcagtagttcagcatcacctcggctttattctcttgggcctccagcctggagtgtcaccaactcatccttgacttgggagagtgtagtgcaggaaatctactgaatacatgagaatagtactaatactgttatggttacttggatcaaatgacataagatgaagtaagagtcctcttattcttatttacataaacaaaacgtacttactataaataatgcaaataatatgaaaaagagtgaaaaaccaaatcctctgtacccacagtatgtggtatcttgttctatttttttcattcaaccgtatgtcttttttaggctcttctatgaaataaatataaatctacctcattttaaaaaataattaaatttatttatttttaattgaaagataattgctttctaaaattgtgttggtttctgccaaacatcagcatgaatcagccataggcaaacctatgtcccttccttcttgaacctccctccccatcccattcctctaggttgttacacaggcccagttccagttccctgagtcttacagcaaatttctactggctatttattttatatatggtaatatatttgtttccatgttactctctccataacatcccccaccctctccttccttccccaatgccctccaccctgtgtccataagtctgttctctatgtctgtctctattgctgccctgcagatatgttcatttttatcatatactatgaaagggaaagtgttagtcacttagttatgtgtgagtctttgtgaccctatggactgtagcctccaggctcctctgtccctggaattctccaggcaagaatactggagtgggtagctcctttctccaggggaatcttcctgacccagggatcgaactctggtctctagcactgcaggcagattctttactgtctgagccaccagggaagccctatcatatagtattccacaatataaatgtaccatatttaatctaatcatcctctaattgaaagaaatttctctttttccaattttttgtattataaataaagcttcaatgactagctatacttatattataaacatctgtgaatatttcagaagaatcaattcttagaaatggaattaagaactccaaaaaactacttattttgaattttgatagctatttctgagttgtcatcaaaaaagattgtacaaatttacactctaaaactatgtgagggaattccttggcagtccagtggttaggactccatgctctcatggccaagagcctgggttcaatccctggtcaggaaactaagatctcacgagctgtgtatcgcag

SEQ ID NO: 25831 - DNA, 1538 bp, Bovine  19866880752219
tttggtattttttttttttaatgccccaaagtatcccaatgtgccagcaagattgagaagtgagtttatagtaataaaactaagtatatatgtgtagacctcagccagtagatgaatgctgctgctgctgctgctgctgctgctgctgctaagtcgcttcagtcgtgtccgactctgtgcgaccccatagacggcagcccactaggcacctctgtccctgggattctccaggcaagaatactggagtgggttgccagttccttctccaaagcgtgaaagtgaaatcgttcagtacttcccgacttttagcgaccccatggactgcagccttccaggctcctccgtccatgggattttccaggcaagagtgggttgccgttgccttctccgagtagatgaatagttagccataattacctactgcagctgggaagtaaggccagtcctgactaacacggcagcagtgctaggctcaacgctcacatcaccgaaccaagcaagcccctcccccaccaactgtctcattaggactttacacattttttaaaattaattattaaattagttttggctgcactgtgagacacgcagggtcttagatctctgaccagggatcgaacccatgccccctgcagtggaagggcagagtcctaaccactgaacaacctttagacatttaaaaatttcccttttcctctcattatattcttaaaatctttatcaacattgattgtcctgggaagggaggaagctcagaaaatataggaaaatacatgggagaaaattaatattatccataaccctaccacccaaagataacccttgtttacattttttgcttgatcttgaatcttttctattcagatggatagacatgaagttatttacaagttaagatcacagtggacataatatgtatttatttttaaatttgtacaggcatatggaaaatgctcaaataggatgaaattttacacaagaagtgaatctcccctcccagtacctacccacctctcacctcctcagaggcagccggtgttactagttctgtggcagacttccagaaatattgatagctatatcttctagttacaaaaatggttgcatactacacaacctattctataatttgctctccttacaatacatctcagagatgggtccatggccttcacctttctttttgaccctgcatagttttccagtgcagattcccgacaatttcttaaccagtccattattggtgagtatttgtttccaatgttctgctacttttataataaatatttatttatgtgtttatttctttgttcatcccttaaatttttttcatttgctaagtatacttcaaaaattatgctaatggctactgggcattccattgtgtgaatttataataatctattcaaataatactgaactgttagacatctatgttgtttccatttttatcattatgaatgatgatgcaatgaacaatccttacatataaatctttgtatctgcatgtccctagaataaatggaaacggtataatt

SEQ ID NO: 25832 - DNA, 959 bp, Bovine  19866880754055
ttactctgctatttaatagttaaggcaatatattaaattatatttagcctttgatctggaatttacatacttttttacttacaaaattttaaagtaaatataaaaatgggctttttgtcaatttatagatttgaattataaacatacttaaaaactacatcttgtacatctgtgagagtggcaccaatactcttcagcaaaagatgtaaagaacgaattgccatcagtccttcatgctgttctgaatctttcggttcttcaccacctgaactcagtgaaacacttaaatgcaactaaagaaataaacagataaatatttaaatcactttctttataataactcttaaaattcaatctcattctaaatttactataccatacataagatttcaaataacctagatattaattttgatataattaataagtggaatgttaaaggaatttaaaatctaaacagcacctttaaaaattttaaatccaacaatgtaatgtatgttatttagctcaatccaattcttttggtaaacctaggaaaatattaatctttataaatttttagtaacagtaacaatctagaagttgaagttgtggaaaataactcaaatatctccaaaatttctccaagttgaatgtttcaactattagaattaagttatcatggtgaaagaaagtgaagtagctcagtcatgtccaactctttgtgaccccatgggctgtagcctaccaggctcttctgtccatggaattttccaggcaagagtacccggagtgggttgccatttccttctccaggggatcttcccaaaccatggatcgaacctgggtctcccgcattgcaggcagacgctttaccatctgagccaccagggaagcatggtgaagccagttaaaaacatttttatattatatgcatgtgtgtgtgtgtgtgtgtgtgtgtgtgtgtgtgtgtgtgtata

SEQ ID NO: 25833 - DNA, 1089 bp, Bovine  19866880768488
gggcacagtaaagcctgtaaggtcactcttaaagtcactcctggctgcaatggtagaaactacctcaaacagactgcctgaacccaagtcttgtgtcagggattttctgggggacaaaccctaaaatagaaacctgaggaaaaagcaccctaaccacttgggtgaggcaaaatgtttccaaggagattgggcaggagaagggcttcttggcaaaattttgcctgaaaggttgaagaatgaactcagcactatgtagatgcttccggaactgctgttgcttgactgttgctgtatggttaaaaaagttttaatcaaaattgctgcaaagaataatatagagacccacaaaggaaataagataagaacagttatgtggggttttgtgagaggaagagagcaaaagaaaagtcttgaaaaggaagattcaaagaatgattcatttctctaatctgagtagattatgcagcccctggcaagtatctttcatttaatagcacacagaaaatgtttgctgagtctgtgactggaataggagtgagaggtggggatgagtatattaataaataagcaaatattaatttgctctgccaaagaaccctcctgttacctgctcctgggatgaagaagaaaagaaaagcacacggtgacctccataatcaaattaacacaggatgcttcatgaagtaacacagggcgagacacagttgaaagctcttatcatgataaggccaggagaagagtttacagagaaagatgaatttgctaggtgaacctgactgggcatggggacaggtggattaaacctcaaggagtgagacatgtgtgacttcagaagtctacagaagattttatggagtcctcgatagttaggagctatagctggagaagcaatagttttgatcctctgtccctaatcattttagaaaagcctgcctcacatattacacttctagtaatgcttatcctgtatcctaaaccatctccccattctttccgatgtctctcctgacatttattcttcctttcctccttccctccttccctttttcttcccctctgcattctgttccacctaccttcttaccatcc

SEQ ID NO: 25834 - DNA, 2138 bp, Bovine  19866880779539
atgatcatatatttattatttaaaaagtggaaacatacaggattgttttcaattttagtttttacagcttctctgtgtctataaacataaagaatgtctatttagaaaactcaaaaaaagggaaatagaataaaatgaaaagattcaaattagcacttagaagtaatcacttttaacattttggcatctaccttacctttgtatatataaaagttatccatacatttttatgtaaaattaataacacattatacatcttcacatataacttcatttttatacctatcaggtgtaaattattttcagttaaaattgatttttaaagatttcagtttttgcactgtgtaacattttactagtattatttgacatctttgagtaaagctgtttgattaaaaaaaaaaagcgaggcattcatttatctttctctaatgggtaaactcatacataaacccaccagtcaatattttgtggccattaaaaattcactctagttcaagaactagaaagtagcattaagaaaaaaaaaaaagagtttcttggcagtttatctaaagactggcctttataggatatgaatattttacaatttgattcctacgaacacttacattgacctttttctctatttgctttggaaatgtacaagatgtgatgagtctaagcattatcaaatgcttttaataaaaaataaattccatttatccaagaacaagaagtcatactctttatttgaacaatgttatgctatgctatgctaagtcacttcagtcgtgtccgactctgtgcgaccccatagacggcagcccaccaggctccccggtccctgggattctccaggcaagaacactggagtgggttgccatttccttctccagtgcatgaaagtgaaaagtgaaagtgaagttgctcagtcgtgtctaactcttcatgaccccatagacttcagcctatcaggctcctctgtccgtgggactttccaggcaagactattggagtggggtgccattgccttctctgttgaacaatgttaggtagctataaatgaaaagaaaattacagcgaaatgattgattaaaaagaacttaaattctcttcccactatataaacgtacccatttatgggcagtgagccccctctctctgaggaaatgctgttctgagaccatcaaaatatatgatatattttggaaaattactcacttttgtacagtgatatgcatcttaaaaagcactgtcaaacataccagtttattgaattctcatgaaaagcctgcaagttgggcagaccagggttaatattctgttttataggagagtttggtaagccagctgttagatgacctcaatgctccccaatcatcattcatggcttcgtttaatcctcagcccttgaatgtgggctgggcctagtgactttttcctaaacaacagaacagggcaaaggtgacagcatgtcactctgtgataaggttagaaatgactacaatttccatcttatgagcagattctctctgttgcttttctacttgcctgcttgaatgaagcaaggtgtcatgtctgggaaggcccatgtgacaaggaactaaatcccaccaacagccatatgagcttgcaagtggatccttctccagttaaatctagagacaattacagcccaaccaactcgttgcttgcagctcatgggagaccttgaagtacagaagccagctaagccaggccagatctctgacccacagaatctatgagaaaataaatgtgtattgtcgcaagtcactttgtggcaacgtgttatacagcaatagagagctaataccaatggtagtccgaggctgagtgtgacctgtttgcagaaatagtgaaatatggccacaattctgtggtagacctgccatacacagatgagttctaggtcccctccgcttgcatctggacaggcctgtgattgcttccgtccacagagttcactcaaagtgatgctatttgacttctaaggcagggatataaatacatcttactaatatctttacttatttattattgttctttttaatgaatcaaagttatacattttgttgaatgtttatatctttattgaattatagttcacaggatataccatcatattcaagaatttt

SEQ ID NO: 25835 - DNA, 1496 bp, Bovine  19866880787434
tatatgttttgtaaatattttctcccaatatatggcttatcttttcattctcataatagtttctttcttagagaagtttctaagtttaatgaagtccaactttttcttccctgcatcatattgctgttgtacctaaaaagtcatcaccaaatgcaaggacacccagattttttagtaaataaatgtatccttttaatttggtaaaatatacataacatacaatccagtggcattaaatgcattaataatgttgcattctaagaaatgtatttcaatatacatacataattttaattgcaaaagtaaaataggttctttttgaaactttaaaaatataggagagcagaaagtataaagtaaaagtcacccacaatttcccttcccaaagatatagctattgatattttggtgtacaacctttcaaacacatccctattcagttcagttcagttcagtcgctcagtcgtgtccgactctttgtgaccccatgaaccgcagcacgccaggcctccctgtccatcaccaactcccagagttcagtcaaagtcacatccatcgagttggtgatgccatccaaccatctcatcctctgtcatccccttctccccctgccctgaatctttcccagcatcagggtcttttccagtgagtcagctcttcacatcaggtggccaaagtattggagtttcagcttcaatatcagtccttccaatgaagacccaggactgatctcctttaggatggactggttggatctacatccatattatatcatattatattgtatcatattaaatatatataactttaacaaacataattaggatcattctgttcacattgtttgaaaatctgcttttcaatttaacaatgcatttcatttgatattatgtttttaacaatcattaggttttttttttatgtagcacacttgttcatggttacttcatattctatcacatgatatagcataatgtatttagccaattctctaacatttgatttctagaaatgtcgttttactaggtcaaaaataatgcctggtcttttaggcttttatttacttatttattttattgtcactaaattgctctccagaagagtgttgccagtttataagataagagcatgtgcatttcttcacattaccaccaatgcttgacaattaatttaaaaagaaagctaaatctctaccaaacaaaatgcatcgatacagctcgcactatgggaaaatgagaggaaggggttatgttcagcaatcagaaaatcgaaattaacatagtcatcttctaaaagcaccaaaaatggaagaaattttaaaactcatctgagaatggaagaaacaaggatcatctcctttaaataataatgtattttgaggaaaaccttattgtattttgtctgttaaacgtattcaggtttaaatttcttggcaggacttaaccctgaatttcaaaacctccaatgctttaagctgtatatttttcttcaaaaca

SEQ ID NO: 25836 - DNA, 836 bp, Bovine  19866880811541
gaactgtgctaccagaaactgtgctaagtgctaggaatatagtggtatgaataaataatgttataagatccctgtcctctttccctggtggtcaaatggttaagactctgtgcttccactgcagagcgcacaggttctatccttggtcagagagttccacatgccacttggccaaaaaaaaaaaaccaagaaaacgaaatccctgttctcaatggaacttctcaaaaaaagtagggaaaacagatatataaccagtacacccgtaagtaaataactaataaaccgtgatcaaaactctggagagaaagaacaaaaacagagttagggagtgatggtggaagggctggggtggatctcgcctagaaacttaagctttgacctttgagtgggtgtgagagtccagttttaaagagattattttgttgtttcactagcaacagtcacagtgagccttgcatattaggtccctgtaacagagtacatagtattgggaagttccgtgagattcaaaggttacttaggaagaatggctgtttacaggaggttggttatgttgcttagagcaacaggattctgttagagggagagattgtgtgcaaacagcatgtgtgaccaggatatctaggcagcggctatgtgacaagggaaagggcggtggcggctataattgacatggtcgaagaataagcaaatattgatgtgggactttaaaccatggcaatgctaggaaattcaaggaagtaacaacagcagtaaggtatctgtgtgcttcaaatataaggtttgtataaagttaaattcttcagctaaataaataggaaaaagtcttcatgttt

SEQ ID NO: 25837 - DNA, 1211 bp, Bovine  19866880823532
tctgtccatgggattctccaggcaagaatactggagtgggttgccattcccttctccagaggatcttcccaacccagagatcaaacccaggtctcccatgttgcagacagattctttatcatctgagccaccagggcagccacaaggcactgaacccagtctatttcagggagcctcctagatccctgcaaaacaaggccttggttataaaacgagggtctctaaaatctaagaagatacacaggcaattctgaaaagattctttttttctttgaattcttatccctcaagacttgaaatctgatctgggttgattttctctcttcctgttttcttcaagaatgcaaaggccagatatttttctgttccaaaaacctatgggtaaaataaggcagcttaccctctttaattaagagggtaattaaaccaaaccatagtagcaaagagctgatggggttccctttggcacaggcctttgaccacactgctttggcccttaggagccttgaaggagcgcttttgcagtttagaggactatgggcctgtcccgttgagatgggctgctgaaacttaaaaggtccctgaaactttcattctgttttcagtttgcccagtatatttctatggtgggtattttaagcatctttagagatgagagtcccaggataaaacaacggcaagtgaaacttggcaaaccctagaagtctgcaattggaattccacactgtatgcgtagctgctaggaagctcccatacctactgataagaccatgtttgtgtctactctgaggtcccctgacctaggacaccatgcgtcttaggaatcccacacttcccgttggggcacatctgaggtgcagggcccacatcagttgctggagatgcaatggctatgttcccaggctcagagcagcattagccaaaggggcctgctttcttttcatgatatgagatgacccacccagtggtatcctggtaaatggttaacagggagccgtgcaggactgtggtactggtaatgagcactgatttccatggttgaaatactcctccaccattcccaattttaagctactgatttttaaggtcactacttaagtcccaggtagcacagtggtcaagaatctgcctgccaaggcaggaggtacaataaatgtgagttctatccctgggtccagaagatctcttggaggatgaaatggcaacccact

SEQ ID NO: 25838 - DNA, 1839 bp, Bovine  19866880861431
ggctggcagactagaaagcagcataagtccaaagtcccagaaataatgtctgtggccctacctgctgttgggagaggatgcagtattctgtggatggagtggcagcatcctgaggacatcctgaggacagggcagcatatgcccatgcttgtatgactgctcctgctcacacccttcactttctagatctgtgtattgctcaggttcagctcttatttctctgagtttgctctctcctcagagaatttaaatgacttgactgacaactttaaatcattttaataaggggggatgtgtgtagaagaagggtcatagtctctggaatagatggatgatttactgttctctctttggtctgatttctcagattcttggtgaccctagacagatatatgagctgggtttcagcttttccttctgcaaagtgggggcagagattactagtgggacacaggggataacatctatgaagccactgatggcaggactggcccaacctgacaccatcccttcaacccaggaccattttcctcatcagaaagggaaggagttacactaagttcctgagatctacaatttgaatctgataacagatacccccaaatgtgtgtaagacacactgaaaatccttcatattttgatatagatagacagccttaaagatgatggtaatttcatcccatttcccagctctgcaaacctccaccccaatctctgggcaatcatctaggaatggctttgtgctgacttacaagggaatgtatcataattttcctatccactgctccaggacaatgctgggagagacccactctcagattgcatgtatagataattttagatgacattccaaaattccagctctttgagtctgagaaacatcgtgcattaccacctgccccacccccagctctgctcctctaactacctcttctttccccataaaacatgtcctttcaacagcttgcaacttgccaagacctgtcataaatttcaggtagttgtgcaaagtcagagaagtgggattggatccagtgccagttggatagaagtgattccatcatcagtggaaacactgacctaaagttctaactaaaggacaacatgttagtactagatgctatgatcagcctttcagcctcagcagaaacacctggtagaaagatgggcctcagcagttatgggctcgcaaaagttgccaagtagcttctcaggatcaccagggcttcgtggagggtttcatgcctatcctcactccactatttaaaaaataaccaactttttaaaaagttgattaagtttggaatattcactatggaaagttccagaaaaataatgtttcagcaacaaagactgtcaacaatgccatctatttcattctttctgccttttttaattcactcttggagtatcaagcaagcactcatcagtatacctgatactgaggtatagccatgagcaagttaagcacagtctcagctctcagagaatgtactttctagaatgtactcattctacagtgagtaagttttagtatttcattgactagcaagttatgagagaagtgtcccaagaaatgagataagggtgggcagggggtacttttgataaggtggtcagtcacagtgtgaaaagatggtgcctcaatagactgagagatgggcagagccagccatgaggaggctggagggagggaatttggtgagggaaggagcctgagagagtcctgggactgaaggaggagttcggagattgagcaagtaaaagccctgagccaagaggtgaccaaggaccaggtcaggtgaggtcttgtgggccttttaggagttcagttctaaa

SEQ ID NO: 25839 - DNA, 883 bp, Bovine  19866881141987
ctctccccattacacttaaccattggtcaaacaacatattctctgaggcccctctggttgggcccgtggggaagatgtttgggggcaagtggagcttcatggggccttcgtgtcaactgccatctctcctgcaaggtattgctccaacctcggccactcactgtaatgcaagaacacactggggtcaccgtattggcacagagtgggattaaccagatgaagtgctctcaaacaatcaatggacataatatgacacattgcctctctacagcagctgtgatcccataattacctcctcatgactggagtgacaagaacatctgaataattcaggtactcaatgtctaaatactccaagatgcactgggggggcataaatccaaagacgctgcaggaaaagagagccattcagctcgggaggatgtttgaccccagaacgcggagggtcttggcccagcacagacaacaactcagccaactatctgggaaggagaggtctacttgtcagcgttccagttccttctgagtctatcttcagagtgggacttccttctttgctggaagtggtgtaaattctcagaagatcaggcacacccatgctcaaatctaagtacaaaaacacactgcaaagccaaatacaaagggctcctccactgttaattggaggccatccatcagataaggttgattttcttctacgtgtttaatatggcaccttcacaagagataagaacacttaatgaaaatctacttgccaactttaaaaagttagcactcaaaacacagatgaagtgactgcaaagctgctttacacaaaaagtaggaaagtaagcagtaaacagaaaacagattttcttaaattccacactgttttgttaccact

SEQ ID NO: 25840 - DNA, 1018 bp, Bovine  19866881182256
caatagcacacaaagttaaccctacgatctctttaatactctgtagcctctggaactaccaaaaaagaaaaagaaaattaaaagttttaaaaggtacattttagaactcaaaagtcatctttcctaataacagaggggagagaaacaatggaattattaacatgcaagatcttcccaaaaaggcttgtatacttctatacattcaatgagttcatgtctaagaacagcaaaaactaaaaagaatgtgaaacaatattataaatgtttgggcactattatgcaaatacataggatcttttgatctcagatcctatgtatagcaaaaaccgattatgaaattgtaagctgagatgtataaacccctcaccagcatttatgttgatttcaaaattgctttgatcaaacatgccacagaagttattaaaatttaaaaatacatctacaaatgcctatgggaagacccagtagaaattttaggtttgatgatgcattttagttagttccctttaaatcctggacattcacaacatccaaaagtaaatcttaccaagaacactaatcccaattcctttgtagtctaataattctttttgcatctctagcaacacctaggaaaaaaaataaaagaaaataagatgatttcagtatgctatgcacaactctctctggacacacaaactgcaaaagaggaggggcaaggagaagctccacccgctgggtctgtgaggaagcatctgtccctgccacagccagtcccttctctctgcctgttcccaccaaaccccgatgatgcaacttacattcaagttgagtatgaaactatgcaatatgaccaattctaagatacagtttttccaaaggcacaaatttagagataaaatctcacttgaaagtaaaataaaaatccaagtaggaagttttctaataacaattctttacctgtcaatatcagttaaagaataactttgggaaaaatctgattccctagaaaatgtccccttcacaattgcatttgcga

SEQ ID NO: 25841 - DNA, 990 bp, Bovine  19866881233994
ttcgaaacatttctgtccctgaaaaacctgttctgatatcctgagattatcgcacatgtaaagtctcatgttactggaaaattcaaacacagagaacaaaggaatatgaagaattctttttctgccactttacccagaaaaacagcaaccaggtactatttcctcagttatgctggggcaggcactaaacacacacacacacacacacacacacacactcagggttagtttctgccccgagtgatcaaggtaacactttcactgcggctgaagagttaccacggaaactcagagctggaagaatttttagagactgatgaatccagcctcttccttttaccaccaaggagcttctatgcctttctgacttgcccaaggtcacactccaaaacagaaaccattcttgaacctacatcaaagatttctggcaattcatcacaagcatatagacaacatccagctttttcaagtagttgaaagtttaaaagtattaaagggaaaagtaattcattaaataggcaatgtatcaaatgaagtggagaatgtttagaattctggaaaacatacaaatcagaaataatattactgattactgctttatcggatagcataatataaagtattctttgagttttttgaatcataaaaactaaaaaaaaaacaaacacaaaactttctcttttggtcaacatgattctccttaaagagaagatgactttaaacagaaattttagatgctcaaaataaacactttgaacatgtaaacatacttttgttggataataagttttctggccatttcctggtttgtatcaagatgcagcttgatacatactgcaatgtatgcagacagaattgatttaattcttctaagggcaaattcaaaatgccttataattgcaaattatctggtggtagttgtggtagtttgtgtagttgtggtagtttgtgtatatgtgtacaaataaattggctttatcaaggccatgc

SEQ ID NO: 25842 - DNA, 883 bp, Bovine  19866881341009
gaaactttgttgagtgcctctgcctttcggttattatgtgatgtggtctctgtctttactgatggagagttagattaattacaaattaattacatttgaggataacagaggatgagatggttggatggcatcaccaaactccaatggacaggagtttgagcaaatgccaggagatggtgaaggacagggaaagcctggtgtgctgccaggtccacggggttgtaaaatcagacaccactgagtgactgaaccaacaaattgcactctgaatgttttagttttgttctttaaactagatgagactacttttgttttcttttgatgacagtgagaaaaaatcatgtcaaatattttcaatcttcttttatagttggaacatgaaaatgcccagttaagaaatataaacttctctttgtctgaagcccttcatgcacactcattgacaagcatgatcctggatgatgaaggtgttttgggcagcattgagaattccttccggaagttccatgctttcttggatctccttaaagatgctgggttagttcttttctcttcatggcattcttctctttgtaactttagaggtagtttgctgaggaacttgagcggtttttattacttccatgaccatatttagccaaatgcagcgaattataggtaatagagttgatttttttttaaatgagtaaatctataaagaaaagcaaataggggagcctgctttggtagagtgggaagcccattataaacaagtaacctgtagacagagtaattagtaggtataattttttgtaaagactacattgaaggcaattttaattgaaaatatttgggaatggataaaaattttactgcctttcacttatttttctccttcaataag

SEQ ID NO: 25843 - DNA, 930 bp, Bovine  19866881365770
tatgtattttgttaacagttcttataactttcctaactaccctaaaacaaattgtttttttgtttcatagatgaggtagctgaggttcaggaaacttgagagaccagcctgaagacaaagggctgaaatgtgctgaagtctggttggttctcaagctattgttcctggacttcctctttgctactttggttctctgggttactcagtgagagagagattctgtatagttgaccctagatatcagcaaagtcaaccaacgaaggatgaaaaatattgttagggggaaggaattccagaaagctccaaaaatcaaagcttgaatttgttgtgccctggcaacaactagcatagcatttacgttgtattaagtaatataagtaatctagagatgattttaaatatacaggcggatgcataggttatatacaaataccaagacatttttataagggtcttgagcgtctgcacatacctactctgttctgatactgcgtgcagagggacatgggtgctgtaacaaaggagaatcagtagatccctagcactgaaagattacatacaggattcaaaattttcatcagagacttcaaaaggctgtgtcatgtagtaatttgtaattttgctgagccatgagttgaatcataagtgtggagaggctgtactataggaatgagtcactggctttgagaacccagccagcagtagctcagtgtgactttgctattctttgtcagttttgcagtcatgcccataagaaaatgcagcaacagctgtcactctgtgtacagtgcaccatacacagagaagtgtacactgatgaagtcagagaaggtgaaatggtctaagaaatgacagttcttgccaagtttttggtaggaaattttatggagtatttgcaaatttgaggactcattgatatccattatccag

SEQ ID NO: 25844 - DNA, 760 bp, Bovine  19866881404803
cctagtggtccgtgtgactgtgagagctggaccgtaaagaaggcagaacaacaaaaaactgatgcctttgaactgtggtgctggtaaagactcctgaacgtcccctgaacagcaaggagatcaaaccagtcaattttaagggagatcaaccctgaatattcactggaaggactgaagctgaagctgaagctccagtattttagtcatctgctgtgaatagacaactcattggaaaagtccctgatgctgggaaagatcaagggcagaaggcgaagagagtgtcagaggatgagatggttgggcagcatcactgatgctatgaatgtgaactcccaccaactctgggagacagtgagggacagggagacctggcacgctgcagcccatggagttgcaaagagtcggacctgactaagcgactgaacaacaacaatgaaccataaccaatgtctaccatctatgaaagtatattggcctcaaaatatgcaaagatcactactttgccttcatccaggtctgaatttctaagtcacttttattgcatccttagctttgttttttaattctatccttgctgttttgtaaaatgacattcaaatataatctactgtaatttgcatttatgtaagagctttcacctgaagttctcaagttatttaaaactatgacagcattttacaaaatacacatagaatttcaaaaatgcctatataaatgtcctcaacaaaagtgcaattctctctcttttttttggtaaaaa

SEQ ID NO: 25845 - DNA, 1033 bp, Bovine  19866881410350
aactgatactcttcttagtatccagtactcagtttctaaatgtatgattacatatttttctccatgttaaaaaaaaaaaggaaaaagaaaaaccaactcaacaccattcagcatgtggttttaattttatcagactgtaggaattttggacattgtctttgcctagatgttagaagaaaatattttttctacaacagccaagcctttcatactttaaccattggatcagcttctccttgtgaagagcctgtttctacaaaagaaagagtggcaactgtagaatttacataaaacttttgcagtttgccttattgagcaaattgcctccttagcagtagaatgttggattaaaaatagttgtgtctatgaccagactcactgcctaaagaggaaatggatcttgcttcctcactcttcaaagccattgctatatcatgcgagggacattcttagaaaaacttctcagtttccagtttttctccagcaggagcatgtcaggaagtggaaactaaactttcagcctggatacatattttcaggaatggcttcaggtctattcatggccagggacaaaggtgtgaatcagaaagccgtggaaagcaaagaacatgatttcccacacaccctgtgtaattgtcattaaccttcagtggctgggtacaaagcacagttgtttactttgcacttctgatccaaacaggttcttgaaacaaagacattcagaaccaactaagggaaccccctgaaggaatgactcacacaacggagagacatgccacccaagtgaagtctagctagggagatgatatttaaaaatataaaaatgagaatagcacaagacagtgtatcattagcacatgccgtaaatgctacctggaggcaaaaagagaagtctctgtgggctataaagttgctgcctctcctgcaggcgtgcccttatcagggcagtgcctttgtgtgacatggaaaaggccttcctggggagtggacccccgtgtgtctggccagcagcacgtgggcaaggctttcggtt

SEQ ID NO: 25846 - DNA, 1716 bp, Bovine  19866881835113
cctttcctgattaagtcgagaatttttaccttttcttttaaagaaagtaccttatggcttctctttggcatatttaagttgccagcattgttactcttgcgtgttgggtctattattaagtaaaatgagggtgacttgaacatgagcagtgtgataactggacagtcaatctgataaacacatagctgctgagtgactaatggatgggatatgttggataaaggaatgactcacatcccaggcaggacagagcaagacagtgcaagttttcatcacactgctcagaagggtgtgcattttaaaactgaagaattatttgtttctggaatttcctatttcgtattttcagagcatggttgaccacaggtagctgaaactgcacaaattcacttcgtgaataagtggggggcggactactgtacttacatctgaataaaactcgtttcatgttctgccagtatggtgagcaggacttcaagagaatgattgtttaaccatccaaagtggacgatagtgcattgtactttgaaagacctgcagttttgggattctctatgcttttattcttaaccggaacctgcatttaattacactagtatccacttttgcttcagtatagtttaatttattttcatctaaatttatctttggggtggaggaggatggatagaccagtgggccaggtactctagttactggtgtttcagcaaaatgctttggtgtttggaaatggacaccttgtctccttgcctgctcttattgaggcctgaggattttaagtccatcctttcttcttgtcagctctcgttttagagcttctttctttccctttaagtaatttttgtctttgctttattccttctccaattatttttcaacatgagcaaacatcaagcttttcttagataatccataacttatgtaggaacaggtttctgactttagattcatctctgtgttgactagtctgggtttatatgactcctcatatcctttcagagattgagaatctgagtcttatcagtgcccaggtggtgttatttcttggtaaacatttctgtaagaatagaggaaatggcaattttcaggaagagccatgaactggaagattctaaaatcatttatgaaaatgcttacagtttgtctttttaaaaagaaacaattttgagtcagaatcatacactagaaagtgatctcctaactgtccttagaagtgaaatgagctgtacttctaataggattgctaatattttagctataagccacaaagattatttgaatagttttctccctatcctttgtgtggtttattcatttttagggaaaagtaattgatgtcctgggcattttccaaaatagagttttgccattaacaagcatttgattcttaggattctgtatattttattacttttccaaaatcttatacagatgagctattgatacagaatgagccaaattgtataactctttgtagaagtgttagaatgtttcgctagtgatgaagatctctgaatcatgttgactacatacaggagatgcatgtcaattaatgacagctgtttcctgacttaaagcagttaatgctaaactgaatatttctattgattttttaatgagtaccacatttatagcaaattatagaaatttggctgtataggtagatagctcaaattaattttgagcaaaaagtagccttatcttcttgcatttgaa

SEQ ID NO: 25847 - DNA, 2103 bp, Bovine  19866880474019
tgattccttattttagagattcgacattcctggaattcagaaatgattatccatctctggggatcattatttaaataaaatgtgtatagaacagcatgaaaagtttggaaaaggaagttaccagcaatactgtaacagaaagcattaagacagcctgccagctgcactggtttcaaaacttggcttaacaagcgatgaaaagtagctcccgagttgcattgtaaaaaagcagaaaaaaaagaatatattggaaattggaattggaatctgccccgaagtccagatatggatataattaggccaaaggtaatagaaataccattcactgatagtctcacttctctcaagtattggctcagatgtcatgttttcagtgagccatcctacttcttctctgaaaacagctctttcttatacccctttcttttacttctgtctcattgtcaaactttatttttgcttaaaaagagccttttttttttgcttatttgattataactatctctataactagaataaaatttctatgaaaataaagacttggcttatctacttcaaactatcaccaatatctcgaatagttttggcacacagcagatgctcagtaaaataaaggtaaccaatcattttaattccaaaatcagaaacctgggagttatttggccctctcaacttctccttcttcaccttccatatcaaatctatcactttttattttctcagttgaacaatgcctccttatctttgcattcttctttctccttactttcactaccttgattctaaatctgcatctgaagcaacacaatatctcctgctaacttgatgcatccatttagcagccaacacagtaaaattaaaatatgagggtattggtttgttgttgttttaaaatcaccaaattggctgtacagaagatctccttgaccctacattttctacaagcctaagctttccctatttctctctctacttcattggtgcctttctctaaacccacataaagcaaaagcagattatataaaactaattaacggaaacagtgacagactttattttgaggggctccaatatcactgcagatggtgactgcagccatgaaataaaatatgcttgctccttggaagaaaagctatgaaaaacctagacagcatattaaaaagcagagacatcacttttgctgacaaaggtctgtatagtcaaagctatggtgtttccagtagtcatgtaaggatgtgagagttagactataaaagaagttgggcactgaagaactggtgcctttgaactggtggtgttaaggaagacttttcagaatcccttgtactgcaaggagatcaaatcagtcagtcctaaaagaaatcaacccctgaatattcattggaaggactgatgctgaacctccaaatactttggccacctgatgaaaagtgcctacacgttggaaaagaccctaaagctggaaaaattgaaggcaggaagtgaagaggggcaacagaggatgagatggttggatggcatcaccgactcaacagacatgagtttgagcaaactccaggagatagtgaaggatgggagaacctggggtattacagttcagggggtcccaaagaattggacacggcttagtgactgaatgacaacaacagtctcactctgagtcttcatcctggccagccaggccctttgtgatcgtccccattgtctctgactcagcctctcattattctcctcctcgctcactcatcacctgaccacacaggcttctctgctctctccacagatggcagcatgttcctgcctcacagcctttgcacctgctggttcttctgcccggggccctcattttccagctatctacctgcacggatgagccctcactccctttaggtcctgtttaaatattatcttctcaaaagcacaatttacctactgctttcccttgaccaggcgccccccactccttttctgctttattttcccccatgacagttctttccatacaacatactacagaagagcacttcatttatttattgtctgtcttcttccgttcaaaagcaagctccataagagtaagaactttggctgatatatattttt

SEQ ID NO: 25848 - DNA, 1157 bp, Bovine  19866880539853
tgtaagaaaactgaaatattcacaatgaggtatttttcaagcaactgtttaatccatttattttacatcttaaaagccacgtaataaaatggaggtttccttttttattatatgtacacgttgcatgtttattgtggtcttggggataactgagggcaactccatttaccagatggcactccataccaggaattacatttcaaactagagagaaaaagtcttcacccagctgagtactgcttttgcgtgaatgtgtatgtgggcaggtgggtgggggtgctttttgcttatactatactgtacgtagctcatctggtctattgactctacttatgaattacttaaagagacatctaactaatgctatagtagcatagtcccatataacatactaatggtaattttttttaaatgactgaatttctatctaatttagttgtaaggcaatacagtttcggttgttaaataagcttacccttaaattcctaatctatgagcctgggacttatttctctatatggtagggtccttggctgacttgcctctctcaagtttggcggtattgggacccctacagactttatagagccaagggacaaccaaacccatcagaaatatcatttttcactggccacgcaatgttgaatgaatatgtggaggcaattcaattcatggttcctaaaactatctatattctttacttgtttaatcttgctaaaatttacatgctttttcaattcacaacaatgtttgggggaaatagcaaacttatgtaaaatgccaggcttaaagaacagatgaaggatgttactggatgttttaatctaatactgaatgaagggagaaaaaataattctagagtgaaccaaatgttgtcaccctgaaactctaaaacagaattctacctcaaatattgaataggtgatgacatttagcagaatacccataatggagaacactagattgcagttactttaaacttttattctttatgaataaccttttaaaaataaataaaatattttctttattccatctaccctccccaaacaatatatttattttaacatttcttatggttaaatattttatttttccagggtttgggttttggatttttttttggtgggtttttttttttttcctttctttttttt

SEQ ID NO: 25849 - DNA, 2020 bp, Bovine  19866880560747
ttttgtccgagtggcatattatgcaaaatggatacacaaaaatcatattaacgtataaaggcaccacagtcgtagctggtataactgtctgaagcttccaataacacaagtctcttttacatgaagattttggagtacatggaattaaaatgtaacttaaaaatcctgagacaactacttgagtgtcatgtttgttaagatactcattaatatttatgggcgtttgctgttgttttgtttgtcagtgttattttgtaaatgttgaagtgaattaaggtacatgcaagtgtagtaacatatctcctgaagatacttgaatgaactaaaaaatgcaaaggtataattgctggatgctaaagatacaatggaaaagatcaattaatttctctcagctgctttccaaggttagtttcataataataaataaaccataagttaaacattatttcaacctcacaaaaacaatttatatcttgtgtccttaaactgtaactctatattaaattatattacctttaatatgctatacattatagttcattcatttctcctcatcatgtatcctgtaatactggtacatatactttttacaaaaacatatgcctatatgcaaatacatgggtacacatgtgcatacactacagttcaaactgtggtgtatctaatgtaatccctaaatatgctgaaattgtatatttatagtttttccttaagaaaaatattaaaagaattctaaagactagtaggaatattaaggaaaagtgcaagatagaagtgactagatcatcctccatataatctgcagatggcctctactccttggcaattgaggtgtggtcatgacacacagagttaaataacacctaacctaggtgcttacgtatatttattatccaagttattttagatagtttctgattcttaaagggaataggctatttgtttattagtattctttctttcaaatttagggacacttatttatgcaaggtatttttagatcttttttcctaaagtagttaaaatcgtgagagataactaattgaaatttaaaagtgttatggtccttaagatgtatttaaggatctaagtctaagacttgctgctgtgattggcttctttctcatcttctttaacttaaaagcaaatatttaagaggaaaattcccatgtctctaaaatttgtaaatagcctttcaccaaattatgcattaaaatatatattgaagaaagaaataaaaataactttgtataactggaggtgttttagtctaatcaaactttactcaagtaaaggaaaaaatgtaaaaggaaaggaactagtttgtctaaactctgtatttgattattttttaaagtacagttaaatctgctgaatgaggtattttatcaaaatacctttattttatcttacttaattttacatagatctttcctaatgcatgggaaatttcagattttgtattctgtatgataataaccagaccatatttattactgtattagtcatgattagctaaagatcatgtatttgtcaagaaataacaaagagtaattattatatgttctgaagtttcacaaaatattcctgtataagaattctttaaaaataattatttgaacattttgaatctagtatgttcatttctctaacttgtttcttttggatgatctcagttaaggccacggatccaaatgatgctctaaaaattccagaagacactgttcaatcttgagtaaaatggttttaattttactcaagaacttagttcagattatgggcagcaaatccaaaattcttttcaaaattgtgccattttctttattttttgtaataatatatggtgctggtatcaagaaacggtgacagtgaagagaaatccaacaagttgctagtacataacagtgtattgtatttttctctcccttatgtaatataccattataatcaaacagaaatttccaaggtaaattgtctagatattaaagtatttttcagtttcttctcgctaaatgacaaa

SEQ ID NO: 25850 - DNA, 2498 bp, Bovine  19866880705041
tattactatctcattcaaccaaaaggaggataaaatggtggactcaacttgttgacattttaaaaatattgcttgcctctaagcagatttatttattgcctttttgtttgtccaatttcagtgcttaccatacctgataaagatcctgaaaatctcagtaagaaaatatttaaagtacaaaattaaacttataaaacttgagctctctctttgtcttaaaatatactcacttatacaaaatataactcaaagcattctggagcaactaaaattcatataccttctcaaaacatgcatgaaaatgtttatgtttccatgtaaactcaccagttacctttaacctaaatggttattcaagatgcctctggataaaactcaagttgacaccgtctaggatagtttaaaaagtgaataaatgtcttttattcatctattctggaatttgatgtatcatttctccaaaggagaggtcagaattagacatgtcttcagaggctagggatgtgtataaaaatgtaatatatttaacagtgtaaatactttaaaagtggctctttagcttcattttgaatctttctttcttgcaaataattattaccttatgtggctgaatgctttatttcatcgagttccttgcaaaggtagtagagcctaagtttggagttgttctatgaagctttgtgaaaaataaggattaattaatgaccatctcaaccactagaacattttttttttccactagaacattttaaacacaaattttcacaaactgctgatttagtaatttttcttttaaaaaaacttcttcttcagctcatcttaaaatgtgttatttcttatgcatctgctttagggaatagaaatgcagcttagaaacatcctaaattaaaaagaaatccaaatggacatgagaaaatgtccacagattgacccataaaatggacattgagagtggatgacttagaaattagtatctgttgatattggcaatgtatattgattcagagggcttccctcatagctcagttggtaaagaatctggctggaatgcaggagaccccagttcgattcctgggctgggaagagctcctggagaagggaaaggctacccactccagtattctggcctggaaaatcccatggactgtatagtccatggttgcaaagagttagacacactgagcaactttcacttcacttcattcattcaggaagaacaaaaattttgaactgagaaagtacttgtatagaagtttatactatttaagttcattatgattttaatactaccctgaagttctttgatgaaatagaaaatattaaatttcatagattctgagggttagaactatatttcattaaaacaaatgctactaagctattttttctgataatttgagtggattgttaaatgatttgaggagattgggtatgtgcccggaagtctttaaagggtgacaactctaaaacaggtactgacatatacatctaattataaaactatgatgtgaaaaaagacaaaaggaatgtccccaggaatctgtcacttcattagcttaacattttaagaagaaaacttttgatcccccacttcttggacacaagctcctgggcagtaaacttgtgacctcagtcaggtctcagattactgacaatggcaagaaggtcagagttagggcagccagagcaaaaacacttcctctactctcatggacttcattgcctgacttgggtactaccgctctcttactttcttagttatgtgtgtgtgttgttttgagtgttagtgatccatccttctcagtatcattttggcactatgaacttgcaactgaagaatccaggcagccagggccacctttggctagataatgggccttgcacgcccatcagaggttaacacactctactccttgtactccactatgattgtctagacatcaacctaaacaatgtaaaaagaggaatgataaaatttaaaagctagtaaaagataaatatttttctaatttgaggttaagttttcaaatttttggagtcctggtgaaaagaattatctatattacaaaaactctaagtcaaagaaaagactacctgtataagaatacggaggaaaatatttctttgctgatcaatgcattaaaatttcagtgtcaagttcagagacctgaactgttttactgaccttgcacctcaactgcagaggttcccagaaagttttaaagaatttgttttcactttaactatcataaaatcctcatttgaacaattatgctaaatattttttctgaacttttattattatattttaaaaatgatataaacttattataaggagtcactattggacagggaggcctggcatgctgtgattcatggggtcgcaaagagtcggacacgactgagcaactgatctgatctgatctgattattcactaaaagacagtgtaatttaaaatggttagattaaaaactaaatttttggattggattaaata

SEQ ID NO: 25851 - DNA, 2248 bp, Bovine  19866880712906
tgaagtattattgggaattttcccaagtagttacatgtctaagtgtgttcaaggagaagaggatttcaacataaaattatcatccaattcataagcacttattgttctccattgggtcaaaggggtgtgtgtgtatgtgtaaagctttgtaaagtattttaattaaagtaagtttagagttaattggaatagtataaaataattacattttaaaaacagttaaacatacttttttcaatttactgcaaaatgataaagactctgaaacatcttctgttagttaatagaagattcttgaatctgtacttgaattatttcacatcattcaaatagatatcaggaaaagtttttttcggtgcagttatgttaattataatttagtttttaagttataattttaaattatcaaatatgccactataatggcagaaagtgaagagggactaaatagcctcttgatgacggtgaaaaagaagagtggaaaagatggcttaaaactcaacattcaaaaaacaaagatcatgacatccagtcccatcacttcatggcaaatatatggggaaaaagtgaaagcagtgacagattttactttcttaggctgaaaaatcactgtgcaaagtgaccttttgaaattaaaaaccacttgctccttggaaggaaagctatgacagacttatacagcgtattaaaaagcaaagacatgactttaccaacaaaagtccatatagtccatagtcatagttatggtttttctagtagttatgtatggatgagagagttggaccatgaaagatgagctctgaagaactgatactttggaactgtggtgctgggaaagattcttgagaatcccttggacagcaaggagatcaaaccagtcaatcctaaaggaaataatccctgaatattcattgaaaggactggtgctaaagctccaatactttggccatcacatgtgaagaactgactcattggaaaagacactgatgctgggaaagactgagggcaggagaagggggcaacagggcatgagatggcatcatcgactcagtggacatgagtttaagcaaacttaaggagatagtaaaggacagaaaagtctggtatgctgcagtccatggggtcacaaagagttggacacaactgagtgactgaacaagaaaaagtactcaatctgaagttccagtactttggctacctgattggaagagccaactcattatacaagaccctgatgctgggaaaggttgagggcaggaggagaagtgggtaacagatgagatggttggatagcatcactgactcaatggacatgagtttgagaaactctaggagacagtgaaggactgggaagcctggcatgctgcagttcctagggttgcaaagagttggacatgacttaatgactgaacaaaacaacaaggttaaaaaattatgctgttataacaatccaagaaaaacagtctttttatagaccaagataatataacattgaatgaaaataaaaggatcaaataaattaaagtacagttttcattagtggcaaataaattttctgttaaatttttctgttagtagagaggaaagaaaatgtatattttcttgacacttggtgaaacatactcatgggcactctgaacatcccttatgcctacaggttatttttgaaataatatgaaaaaaattgacttaagccactttcttctgtattgctatgttgttctccatttaaaaatgaaaaagattaaaggcataaaactctggtatctcccagtttaacattgctgtgggtaagtggaatgtgtcccttagtgctttgtaacttttaaaaatattgctttcctagataacacctaatattttggttttacttctctattttaaatttaacttctcttgttctttctaattctttttgtgtctctttttttaaagcttctccatgggttgataacagtagaactccaaacaaaattgacctttatgatgtacgcaggagaccatggtaagaatgtttgggtaataatgaaaagatgaaaaagacaaaataagttttatttctttttctttctttttttctggtgtaaaaggttggagggacttgttctactattaggtgttaatagttgtctgattattatagagctcttgtgtgtttttttttccttctatacatttgcattttctatacacttctacttttaaaaataaagttaaatgaaaatgatgagttcagtgggcactgata

SEQ ID NO: 25852 - DNA, 2282 bp, Bovine  19866880760031
aactctcccttcctgtactataaacatagcatactagttcattttttgggaaccgtttaggttattttgctccctttatagtttatccacatgtcatccattcttcaaggtctaaggaaaatccattctctcctaaaagctattactgccaaacactaagaactttcagaattgaacagattatctacaaacttgtcactcaatgtgaggtccaagaaccagaagcatcagcatccactgggagcttgctattaatgccccaaccctgattcaccgagtcagaacttgtcctttattggacaagatctcaaagtaacgtttatgcacattaaagtctggagaaggtctgatctaccactcatgctggaaagtggtcatcttatagaatcacctgtttcatttgtgtagctatttttcctttagaaatttaaaaattctaaagtttcaggagaaacggtcttttaataatgctccacaacaatttcccaaaaaataattttattcgttctaatttgaaaaggatatactcttataaactgcattttctaatggacacaaaataggtgtattctgattcttaagtactattaaagattagaaattgtacatgtgtatatttattccttatctgggattggaggattctattatatgctttcattcaatacaaaggagcaaacgacaatgatcgatgatacgtgaacctatcaaaccttacattcttttcaaaatggagactaagtaagcttgtaatcctattcagatggaaagcggaaatgtgatgatccgtaacctatgcagatttgatctttgccagccagagcacttttatctacatgctcttggaccccctcaggtgtttaccgactgttgtctgggggagctcagtatcaaatgagaggaagctgaatctgtctcttttcttacttcatagattaacttacatgaaaagaagtagatagatcaggccaaatggtttcatgttttagatatttaattgttaatgtcctattagattataaaaattaaagtttcaaaagtgatgattctaatagtatatcccaaactactataaatactcattagcctagatcccagtggataaaatgaaaccctgatatcttttcccacttcagctaatgttagatgatcagtaatcacaagatacaaatgatgtgtttggggaagtttgccggattcgtaggaaagccaagcaatgatttattccacagggtgcctgctgtgctacatcaaatcaacctgtccatttgagaagtctcattttcagctagttgatatgattcagagttttcagtgtggcctaaggtgccagccagaaaactattaattaacctcagagaatcaacagtaatatttagcatagttagatcagtttatagatttttaaaaatagtgagtacaagaagttcaatagtaggtcatattccatcctaagctttagataagaatgtaagtctgctcggttattcgatgtggatgctcactaatagaaaggaactgtgattttttgttttaaaatatttgtattctttaaatagtactagattactatttgaagctggtctctcaaatctgtgtggtcctgatctttgcgttaacggtagcagtatgatgtgtactcatttcaaactgtgcattttctgtgtatgtattgcagggtaagttgaaagaggagcactattatgttgacagtatagatgttgagatccctggcattatagaccgacacagggaaaattcccaaggacttttcagtttctaggtacctttcagatagttatcaaaaattaggaaggtagtatcttggccctgtggtaattttgtatgacactaactacaaaaattccatttaaactgtgtgaaaagttctgtagggagtattttatgccactgttaatggacattgagccctaatttaaagttaaaatagtatataagttttcctaaaaatatccttgctgtttaggtgatttactgttctttaaatggaacagtggtgctcttgattttgctgtcagaagcaattaatatgccatgctttgattttattagttgaatgcatgacctgcaatggggaaagttaccgaggtcccatggatcacacagaaacaggcaagatttgtcagcgctgggatcatcagacaccacaccggcacaaattcttgccagaaaggtaaaataccaccaaatcacgtttccaagtgatcctctttacaaactgtaatttgtcccagacaaattacaggaaactctctttctat

SEQ ID NO: 25853 - DNA, 2250 bp, Bovine  19866880779742
aagacttgggtctattgtctttttaagtattttcctgtggaagcttccatatacatgtaaaaatgtatatgctttcatcttgttgatctgttttatgtctaatcccaagacctagacagagactctaaaatactagagtaaaattttttcttccttacaagtgggtacacctctaacagccttttttccattttgcaactgaacattgtataaatttgacagcacaaaggtctgtgctgtcttgtctttaaatgtgcatagttgtcgagacacagcacactctagaagatgaccatcagtagatggtggcagaggttccagtaaggggtacaagatgtttgaaaacagtagaacacagcagttgctaagcagataaaaagtggtgtggcagtagtggatgtgttcatgtagcctatgacacattttcagaagcacatttgagggttaatttataggtagctgatattctttgtgaaaaggagagacaaagttcagtgaccctgttctgatatgtgcatgagatataatgaaacttaaaatgctttcttttgatatttcaagagctttctgtttaactccattcctgagtacagcagacacagctttgcctttaccaaaacctgtatactgtatgtcctgctacacaggtagatgacaactttgagacttcctttcactaggtatggccaataagatgtggacagcttcagacctagcatgggaaaatatccagcatactttttaaattctttgattattcaacatagaaaaaccttcagtagtctttgagccctacagattggaagaaccacttgcctgaaagaacctagatctaaaagacaatatagaaagctgcccaccaaccggaaacatctgcattaaacttgagtgagaaagaaacttctactcttcttcttctacttctactttaagccattgttatttggggattacccacgctaacaaacggtctttcctggtggctcagatggtaaagaatccacctgcaaagcatgagatccaagttcaacccctgggtcaggaaaattccctgaagaatgaaatggcaacccactctaggattcttccctggagaatcccatggaaagaggggcctggtgggctgcatttcatgggatcacaaagagttgaacatgactgagtgactaagcatgcacgcacactaacaaacttagtcaatcaaacagtcttagatgctctctcttcacatctttttagctgattatctctctgtgtcaatgtaaaaaaaaaaaaaaaaaaactatctgaaaccagaaaccacaagaagtctttgtccacaaataaggagctatttgatctgccccacaaccatcattatttcaatccttgcattgtctacctgagaactatcataagcactgtgtgtcatattttgttccttgtctgggaaaaaaaaatagacatattcaaacttccatggccattccagtagtattgtttaaaaaaaaatcactgcacacttataaatctgtactttccttcttaaaatagggtgttgacctcaaacaaaaacagttttaagctacatctacatgggtgaccatgtgtggcataaaatagattttccagcatgcgtttatttggcaatgacttaaaagtacaaccagatgtttttatggagaatagctcttttacccacaaatgtttccaatttaaatacgtttgttttgactctattttgctacagatggaaagcatccattttctttctttccagtggggatagacagtgaacactggcaaatatcatagagaaagattaccggtgtagacaaaacttcagtgaaagcttgtatttccataaggagaatttttaaaagacaattttgcattttaaacagttggctttttaaagaacatttcccttcctctaatttgtaccataagtcttaaaccttgtatgtgtttgatccaaagggaactactttacttttaagtgataagttagacagacctatttggaatgacagcatagcttctgggtgtgccatcagtggctactgcaaatacatatttcagaatctcttatcaaaaggtgtgtaataaataaacttcttatcaaattttatttgcaattcgcaggctgaaaaataacagaaattttaaatatcattaaaaaataacagaaaaagtttttcttattttttttcaaaaacagactactgtgtatgtgacaaagtaaaaaataatcttggcaaaagtatagtt

SEQ ID NO: 25854 - DNA, 2465 bp, Bovine  19866880825120
atgtacctttccacttaatttattttataaagcccagtgatctgaaaggttcttgcaagtctgcaaagatttgatggcttagtttaatccattttagcttcttaaagctgtgggaagcatgttccttagtcgtgaaatcttgctatccaactagaaggaaggatcctgggtgggcaaatgatgactggcatggccccaaggctgccctagagagagagatgcaggactagccagcacactccacatgaggttatgaaatttggactgcagaacatttaaatgattgattttgccacttagtagctgtatagctttcagcaagctcgttaacttctcaaattttggttttcttatttccaaaatgaggatgatgttgatggtgataaaaacctttttatcatatggctattacaactgtgaatgaagtgatacatgaaaagcttttgtattatatggaaaattataagcacaataaatattagctgcagtaataaagatgacatgatgatgatgatgactacaatgtcttctatagtcaaactatcagaattcaatgaggtaacattttccattttcatgcctcaaaaagaacataacttgaaataataccttcccagagggacaaatttggtttgctttactgcatttaagaataaactccaaagaaaaagatactgtctaaatgccgctgtgtccatataagatatgcctgtatggaatttcccagggcctgacaaaagaacaaatttagtaagtgaccagtgagtttgtttaagtaaatcacaccaagcaactttaaaaaggaaatcgaaatgcagtagtttttgcttacatgatcttaaagacctagctgatatttctcttacatgtcttgcatgtgggtatataacaaagatacatgcccttgggattatgttggtgtttaaaaatgttaacaattacaatgaatcatccttgcatattaagattataagggagtaagttcaggttccccttctatctgcatgcactgacaggatttgataacagaggaagaagctatggatacatttcatttctaagcaatttagctctgcagagactattgtcagcggagaggtcacaacataagtgatatacttatttcagctgttcctcttgggtaaggctacatacttcactgacacaaataatgagaatactcatgaaaaactatgtgttggactgattagtatgaaaggagaggtgccatcagtacaatcattttttatatgaacttgctgctgctgctgctgctaagttgcttcagtcatgtccgactctgtgcgatcccacagatggcagcccaccaggctccactgtccatgggatttccaggcaagagtgccattgccttttctgttatatgaacttaagtctccctaattcttacagtgacatatacaagggtggaacattaattttactctacattccctttaccttctcatactgtttatggggttcaaagaatgttcagactaccacacaactgcactcatttcacatgctagcaaggtaatgttcagtcctccaaagctaggcttcaacagtaagtgaaccgagaacttccagatgtacaagatggattcagaaaaggcagagaaaacagagatcaaattgcaacatccgtgggatcatagaaaaagctagagaattccggaaaaacatctacttctgcttcactgactatgccaatgcctttgactttgtggatcacaatgaactgtagaaaattaaagagatgggaataccagaccaccttacctgcctcctgagaaacctgtatgcaggtcaagaagaaccagacatggaacaatgaactggttcaaaattgggaaagaagtatgtcaaggctgtatattgtcaccctgtttatttaaattctatgcagagtacatcatacgaaacgctgggctgaatgaagcacaagccggaatcaagattgtcgggagagacagcaataacctcagatataaagatgatatctttatatggcaaaaagcaaagaagagctaaagagcctcttgataaaagtgaaagaggagagtgaaaaagctggcttgaaattcaactaagatcatggcatccagtctcatcacttcatggcaaatagatagggaaactatggaaacagtgacagactttattttcttgggctccaaaatcaccgcagatgttgactgtagccataaaattaaaagacacttgctccttggaggaaaagttatgacaaacctagcagcatactaacaaaaagacattattttcccaacaaaggtccatcatagtcaaagcctggttttttcagcagtcatgtatggatgtgagagttggaccataaagaaggctgagtgctaaagaactgatgctttcaaactgtggttttgaaaactcttgagagtccgtaggactgcaaggaaatcaaaccagtaatcctaaaggaa

SEQ ID NO: 25855 - DNA, 1667 bp, Bovine  19866880840188
ttttgcctccaatttgaatgaaaagagtgaatttgattctatttattctgaatttaatgtatacattgaagataaattctaaagtgattaactgatttataataccctttgtaatatatagtaacatagtaaaggaattcagatgatcattcatgacaacttgtatcagagcatcactctagcaaatatgaagaatgaataattctattttgcagtggaaaaaattgaagtccatagaaattaacagtttactgaagatcactgatattaccgtagatagaagttgtaacagaataataacttttgtcttggttctatacacaagttatataatctttcttgcaattaagcatatataatttctgtcaatgagatcattgttgtttgttttctgcattaaccccagagcagattcaaatatgtccacttatataactaaaatgaagagagcattttgataaaatattttattaataataataagcatggttataaaaataacaactttattaactacagaaaatttatatacacgtcataaccaccagtgttcccctttgggtaagcatccagctataccactcaataggcagcttatctatttcctatttacatacaagacaaacagtaataacatcccacagtattccattttcagtttcctaaagacagaaactttctgtgcaaatgggaagtgaacctactgaaaaccacactgtcaatatttatagggtccagagaattttaactttttttatattagcaaattcttagttcaaaattgttgaatattgaaagataaattcttttggattttattatgaaacataatttattcacataaagattatatttcattcaaattaactttatttctcaaatgagtttgtctatatatatggggtataattgattgaaagtagttcttttttggacttatgtcaatttaaaatatttttagtgtgagtttattaaaattcttcaccacatgatccttatattgcaaagccagtattttttttttaatgtttagaaaaagcaagaaaattcctgacagcaatttcttatttcttgacagtgtttttttcaagagaatgttgtggctataacattcactttctacagtaccattggtaccaacaagaaatattcacaggaataagtgaaatacaattttgttatcacatgtcattattgttatttttcttgccctccagtgtctcacatttcccatagtttgaaacacttagatagcaagcaagagcctgttaatactagagattcactcaatataaaccattttactgaggacctgcccacagcagataggtaaaagtcattacacatttcacaataaaattaaagaagtacacaaaaggattatcattccttctgcacggcagaggcattatgacaaatattttaattttacattactattcctggtagacataagaaaatgtccacaattataacagcacataaccattattcaaacagccaaaataaaaatatcattgaaaacttctaatttaaagatttttttccatgactcaaataaaatggatttttacataaattggattttttattttttattaagaaaaaagaatgcccaggaaatagtatttttcaccagagaaaaatgacatggttattccctgttg

SEQ ID NO: 25856 - DNA, 2113 bp, Bovine  19866880881493
aaactccaatacgttggccacctgatgtgaagagctgacacatttgaaaagaccctgatgctgggaaagattgagggcaggaggagaaggggatggacgacagaggatgagatgggtggatggcattatcaactcaacagacatgagtttgagtgaactccgggagttggtgatggatagggagcctggtatgctgaagtccatgggattgccatttccttctccaatgcgtgaaaatgaagttgctcagtcgtgtccgactcttctcgaccccatggactgtagcctaccaggctcctcccggccatgggattttccaggcaagagtactggagtggggtgccattgccttctcccaaagatccactgataattgcttatagctaaaaaaaatctaatgtaagaataagtgcataacagattaagaaatagtggcacctctgtgcaatcacatatctctgcaacatccacatatgacttcagttcactaaaatatcatatatacacatctgaaaacttttatcatccatgaagattttagaggaagactgaagtcaaatggagtccaagatgtttcagtaatcctctgttactgctatatcaagtatatcaacagttcagtcttatccccttggacgccatgaagacacatatttacaacagcaatattattgggccatagcttattcttcccttcgtttccctatctcttgactttttcttggtgcttttcttgacctcaattttcaacttaaaatttatgatctctggtctaatttatctcttttcagttcatcactttatattatttttgtattctgaaaggttattttcaaagttaatctaacattttctgcagtgttctaaatgtcaagtggttgttcctgatgagatcataaattcctacatcacagaccaatagagtggatggactgattaagtctccatagagctcaatactagagaaggcaatggcaactcaccctagtactctagcctggaaaatcccatggacagaggagcctagtaggctgcagtccatggggttgctaagagtcagacacgactgagcaacttcactttcacttttcactttcatgcattggagaaggaaatggcaacccccactcagtgttcttgcctggagaatcccagggacagaggagcctggtgggctgctgtctatggggtcggtcacgactaaagcaacttagcagcagcagcagagcttgacacacattgggctttaaagtattataaacatgtgctcatttctgaactttagagtctgctaggtaggatataccttttattaaaataaggataacacaacggtattgaaaatcctctgttatattgaaataatgtgaatattccaggtgtatcttagccactcagttgttcagtttctgagttctggattattatgactttctttttccttttctttcctcgtagggttactttgctacctttttattgatgtttctctgccatatttgtgaaatagcataacttctcatcatgttttagagtgttgtgtacttgctaaatgtgtggatgagagatttttgtagcattcttatttttttaaatagctgtttttgaaaatcattttctatttacctcagcaggtctgtgatcacaccagtaaagtattatttcagtaggatatgaaaaacaataacaatgctgatcaaaagagtttgaggaaagatgtgattacaattcagaaaaacaaaagacaaaaaaagcagatgaacagatataatctattataactgcagactgagaggtcactatagctggaatgagcacagaataggtgggttttgaaataacattgttttattttttttcctgatttgtaaaagtaacacatggatatgactactagagaaaattttaaaaaaaagataaatatgtaaaaagaaaaaaaaagtggcatctagaaaaatacattttgacaaatgaatacctcaaaaaactgtggtacataattttaacattattttattgatattttactatcaattaaaaatcatttaatataaaggctttgctgctgctacttagtcactcaggcatgcctgactctttgggaccccatgga

SEQ ID NO: 25857 - DNA, 1655 bp, Bovine  19866880913123
atttatttacggcctataccacacaggaggataagaatatatagagagttttagtttctattcctctctatgagttttggaacaatagataaacagctgttgttactaagaacttagatttaaaaggaaaagagtactttttaaaaaaagtttatactacactgatctggtgaaaaacagtttcacctacttctccaaagatggcgacttcaaaaggaagtctcctataagtaagaataaattcaaaagtatttgccttttcttctggagtaatgagatttgcagagatcctctaattagctcaaagatgtagattattggaaatttttctacagtaaagaaaataccaccctcaaattttacagccttcattatgtcttcacattgcatgattaatattctggtgagttttataactctattttagttactaccctacaattatcagcataaagatttataaaaattgatgttaattccttgaaagaaagacacactaagggaactctaggtcattttctacttggtgtataaagaatataaacttcatgcttattaagaattgacttattcattgaaagaaaaataaccagtttcaagttgtccctattctactttaatatcactgtgagttaattatagtaaaaatgaattttattcctaaattctaggaggctagagttaaagaaccaggggaaggtttagaaaaaaaggagatattccagtttgtatttaaaacatacaaattttgtaggcataaaatatggaggaagaaagctccagcagcacaaagggctggagggagaaacatggagggtcttgaaaacaagggaaaatgcagctagaattcaggtgcactttggggtatgtttcacgatgacattccaatagagatagatatataaaaaaaaaattttaatgttctgattaccatacagtataatatgtgtagtatatagaaagttctaaaatcaggttttaaagctagctcctattttcagtatttacttcttataataaataatcttaattttgtataataatacatttttaaaacctattttacatagaacatggcattgatttttacactaagcaatagacatgtcttgtcatatcaaatattataatttcaagactgttaaactatcagtataatttatacttttcttaatgataaaatattctagtattttaaattattgccatttttcattagaatgacaatgaaaaagtcagaaattaaaatcaaatataaatttttgctatgattgtgcataaacatgctagaaaataatctcataatatccttaattgggaaattaacataagtattacaactaccatggttatagcaaggtataagtaggttcctgtgtagttgtcttttgcttaacaactaaaatgtcacatcagggacaatggcaacacatatgggacctttgtaaacatttaaaacagctctatctctggaggcacaaactgcaaaacccagggatgtttggcaagcagaatgtgattcgtccctcttgtgtccccctcatatgggtgtcttgtgcagggcacaaccttcacggctgcacatggccatactgctgggaatacaactatttgcaaataacccaaatatgtgtgatttgtgtctattaataatt

SEQ ID NO: 25858 - DNA, 1165 bp, Bovine  19866881025041
gattgaagatttatactaccaaaatccagtataatcttgatgagaatccaagaagtaagctaccaaatgctatttatcttttccttaaggctaatttactctgaaaatcattctcagtattattttgaggctgtctgtacataagaaagaagtgaggactgaaggaagtttgttgctaattcagaaaaagaatttctctctagaaatatagaattcaagaaggaggttagggtaaaaattattaacataattctagcaaaattttcccccaaatgagagtagtgctaatcgtggaaagaggtagacagaagtagtactcataactattaagtcagtttcataagctaaatctaaaataaaaataacttgttcaccctatgctggtgaatatctgttaaatgactatacattctagggggaatctagggggaagccatacatatttttaaatgcttaaaacaaatattggtttcactttaccgagaagggaaacactgtcttgcagtaagaatccaactttcctttatcaatgatcctccgcagatatgtttatttctaaaagaaagaggaaagaaaaacaagtaacatctgtacagaaagagtgcttgccaattaatgcaaaacctatggctccatttgttaagcatgaacacattgagaggaaactgtagatattaacccaaatagaataaatgagtattttttttatcagaaggatgatacttgatgatgtagcattagaacttgtttttcaaaatgtgattataattttatataatcaactttactgattcattagcaaacacatgttcacatgtgtgtagtctatccttataaaagaaagtatgtgctataaacataggattattagacctaatttaaattcaatgtttgattatgaaaatgacaaatttgagtgtttatttaaattctgaaaaccatcttgtggtaaccatatataatatttatgcactatttgcttctttcattaccattatttagttctgatacattaacaggatataacagtaaatttgtttgtccagcttaatatcaacaatataacattttacttatcaaattaaaacagtttttcaagatatatcatctaggaaattataatatatttgtaaagaataataaatactagaatatttatttgatg

SEQ ID NO: 25859 - DNA, 1565 bp, Bovine  19866881064898
gccctttgtgaatgttttgggactataactctatgctaatttaaaaatggtcacaaacttacatcatcaattatatgggtagtaaatactattattaagactaaaaataattcaaactgttacacaacactcagttaactactatttacattaaaaaagatgaaagtagctgtgacttaccaatgcttagcagatcatgtagatcaccaggagtgggacctgaatttggccctgtgttctcatggagttgacactaagggatccagagcctaagcagaagcacacaaatcaatacaacaggtagtacaggaacaattacaaatgaggatgctgggatagcagggaaacacaacagccagattctttgtgagatacaagcaacttaccatttgtctaaaggcagtaatagcatcagttactgtgctagggcttagggtctaggcacatgttttggaatggcaaggttccaagcaggagcttctgcacaggtaaataaatatgcagtgactcagttattagaatagagattcaagtgagaataaggtaaaagctgagttatctgaacatagctgtgggtgattgcaggggtgacttctgtttagtctgatagttagctagagctccaagtatccctctaggatgtaaggaagtactgagcctgcgggtggtttgcaaggaattccagctgcatagagattactgcttcagccttgagaattttacttgactgtgaattcaatataagctaattttggatacctaggaatataatgtagttgtcatataagaatatagcatcataataagagtggtctaaaaagttctgtattgtgcttagttctggatgtaaagttttatgagggctagtgacatacaatttaggaacaaatttaattgcttttaaggtaccaggtatgtattgtaaagaagttaagtggacctagaactgaaagaaagaagaaaggaaggcaggaagggagaaaaggaggaaggagaaaaaaaggtggagaggaacaaagagaaagagggagccagatgttaaatggcaactgccgtttggccaccctcaggaaattagaacaggcaaagcatatggtgagctgggtggtgcatgacccgtcaaggggctaccactccaggggtctttgatcttgggatcttcaagtatttaccaaactgtgagatatatttattagtgtctattatcttctgatttttaatcccggcagctaattttttttagctatgtaatgggccaagaaaaatattctgcacacacgggactgttcctcagggtagcctctgttcctcagggtagcctctgttcctcagggtggcctctgttcctcagggtagcctgttcctcagggtagccttattcctcagggtagcctctgttcctcagggtggcctctattcctcagggtagcctctgttcctcagggtggcctctgttcctcagggtggcctctgttcctcagggtagcctgttcctcagggtggcctctgttcctcagggtagcctgttcctcagggtggcctctgttcctcagggtagcctgttc

SEQ ID NO: 25860 - DNA, 1416 bp, Bovine  19866881147120
agaaggcaatggcacccccactccagtactcttgcctggaaagtcccatggacggaggagcctggtgggctgaagtccatgggatctctaggagtcaggcacgactgagcaacttcactttcacttttcattttcatgcattggagaaggaaatggcaacccactccagtgttcttgcctggagaatcccagggacagcggacgcctggtgggctgccgtctatggggtcgcacagagtcggacacgactgaagcgatgcagcagcagcagcagcagcatctcaaattaggataccacactcatttagccccaattcacatcacattgatacatatcatctactaaacataaagatttttcatctggctaatgctttcataaagtgatacatgttttaaagtaacaaatgtccccttctttgtgctgccagcaaatcagataatccacacatttctaactgtagattgagataagatatccatggggaaaaaaagaatatacaaacttttattgaaaacatgtcatgtaccagaccttatgttatagagtttctcatgtgttatcaaaggctgcaaagcatattgtaactgctctcatttgtacaaaattcacggtaatgcacttggtttctaacatcacaaatacacacagaaaagactaaaactaatatatatgcttcaggattgttttcaagcagaaatccttcaatatttaaaatcaggtaggtaatttcttacaacaggaaagcaattaatttagatgacatttagatgaaaactttttctttcctgactttgagctacttatagaaaagaaaccctttataaaatttatcttagatgaaagaactaatgctaaagcatcttaaactaaattcatcataaaagtatgttccagaaaacattttatccctaacatatcaatattttagaacacaaacatttccagaattttcttcaggtgttcacaaatattttttccctttttaagttagtttactgttgaaaaatagtatccatacagaaaagtgtatcaagtataatgatttgaacacgaaggaagtactcatgatgcattcacatcaaaaccaaatcaccagcatctcagaaatgtcccttgtgctctaacttctaacaccagagattagttttgcctttacagatattttttaatctagcaaagctctgataaattctttgtgacctttattgaagtattcatttaatttctgctagctctttcatttcttcactgaagacagaaatttatcccctgagatcaagtgaagcagacctgatgaaaatagtaatatcaaattggcactgatcgggacagcctttgaaagtctctcattggcacatactatacacttggcaggttctatttttcccttccactcttacaatcacagcaaa

SEQ ID NO: 25861 - DNA, 1449 bp, Bovine  19866881181338
aataatttttaaactattttaaagagtaattttgttaaaaatgtagttctgacatgaaatatttgtaacagaaatataattgttgcagatgacaatcataaaatgcaacctatgacctgaaaaatcagtttttttccaactaatctctgtggattcatgtaacatatgaaattatctacatgctgattaatactgtgtgattatttttactctactgaactgcttcatgactggactttcatatttgattactgcacttgtctgcatcgtttcagtttgtcaaaacgttcattttggagagcatatagaagcagtgttgcttcttttgaacatcataatgcttacctagaatatcctagaaatgtattatcagtagcatgttttttctgtttataattattttgctacacatctgtgatttagcctgaagcctttggcttggggcatgaaaaaatttaagaatggagctgaaaaaaaaagcaaagttaaatcatttgaaacaatattttaatatcactctgttcatagtggcctctgatattaggtggactcactgtggaaaaaaagagtagatggacagggttactacaaggcttagtgtaatttgacttttaaagttattgcaatgctctcttgagagtgttattttagatgttgcatgcttaaagaactgactaatagatactactaatttctaaggcatttatttcattgacttttaaataagctttcaaaataaatttctaatttttatgactgtttataaagcaactaaaatacagtgtcagatatccaaaaactaatgcataatgacaaagtttaaattgttatttgaatttgacttttttctgtgaatctatttttaggaactgggacttgtcattactggaactcttccggtcttcaacataaccggccaaaatgaaaataagacaaacttaaaggttaaaagttaattgataaaattaataataataaatgataaactatgacgttgaagctcattgtggataagatatttctataaggaaataatacaacgtaactgtctcatgaggctgaaagtaaaagtcagcagctgtctatgtgataaccacctgggaaaaaggaaatgcaggacaaattctcagttcccccagagacaagattcaacttaactctatctaactgtgacttgacaagaacacaagttcaggatctgggagtaattattgcttggaccagaaagttcatttgggtttcccgtaagatgttacggaatacatgataaatgggcagtactactgtgtgcacatttttaaatgcatctaagatacccatggagttcaggaaaaaaaaaataacatggtaatgtttgtatcagatatatataggtacctttttaggatcgctcatcctcccagtcccatacaataaattattttttttttaattatcatgtaacttaag

SEQ ID NO: 25862 - DNA, 806 bp, Bovine  19866881246396
agagcagaaggggatgacagaggatgagctggttggatggcatcaccgactccaatggacatgagtttgagtaaacaccgggagttggtgatggacagggaggcctggcgtgctgcagtccatggggttgcaaagagtcggacacgactgagcgactgaactgaactaaactgccatctaaccacatgtacttttataggaagtgctaccaaaccaaacccattttaggcatggtgttgttacatctagaaataataaatcaattaaaaaatattattagccatccaacatataacttaatgctgacagattaattttcaataaattcatatttaaatttaacttagttggttttagttattcagagatatatgcaaaaattaatttgttgagttgaaaattcaggtatcttggaataatgcttgctatcaaaggaggattttaactattaccaaaacgatcttcctatttatttcacagaatctgtatgttgcattgtgaatagcaaaaaaataagatagttcatactctttgtgattaactttatcaagcattgaataatctctaagtttttaaaattttaagttgattccctattaattctattaaaattctttgcccttgattagtctgctttgaagagacttactataaaagaagttttccttttcttgagactgtgcttccttttaccagtttaatgaactggttatatcctgagcaatgtattctttagttcttttacaggttgtgttttattacattttaattatatgcatatttatcccatcactataaatacaaaa

SEQ ID NO: 25863 - DNA, 1084 bp, Bovine  19866881424843
taatacagcttcaatattgaaaataaggataaaatcttgaatgtcaaaactatgcactaaaatgatgacattctccctagagttatcacttctcctcactcagattttatattaagtgtcttcacacattatgtgtccctcacagggtcctgaagacaactgacttcatgacttcttttacagaaagaaatttacaatgtcttatataatttaaaaacacttctataaaaatgcttgcaaattctcagtttttccagaaagatgaaaaaagaaatatgtgtatgtgtacatgcaaaaatactctggtttttatgatataatttataaaataaaacacctagctttttatcaatagttttctgtatttaaaatttaggtctattctacagcagtttctcttgagtttgacctttccacgacttcttgaggcaggtatgtcatagctcagatgctatcataataacttaaaattttctttttgggtatgctgagtgtgtgtgtgtgtgtgagagagagagatcgaccatttaacatttttgtaggttaaattctttttgtcacaactttcctaatgccttagaaacattcctaggtcacattgatttctgttttgcagctgttatatattcaaattcatttattctaatgagagttaatgggtacctttaggagctgccactgtacctcatggagtaactagccaattatggtgcctgcccttatactgattgatttgttttgctctttgagaaatggaggctctgggagacccctcataataatgttctttgttttccccacagttgagatggaagatgatgactttacggcctctctgtcaaagcagagttgcattactgaacaaactcagtattttttcgataacgacagtaaatcatttagtggtgtattagattgtggaaactgttccaggtaattcatttcttcaattctggactagtcttgcttccctaagaaattgtactcacttgtataatcattacagaaaataacagagattgtcatttgagtatgagagagaggagtaactactttacatgaaaacgccacagatcttcagttt

SEQ ID NO: 25864 - DNA, 1307 bp, Bovine  19866881581167
cctgctacttaacttgtatgtagagtaaaacatgcaaaatgctgggcagaatgaagcacaagttagaatcaagattgctgggagaaatatcaatcacctcagatatgcagatgacaccagccttatggcagaaagcaaaaaggaactaaagagcctcatgatgaaagagaaagaggagagtgaaaaagccggcttaaaactcaacattcagaaaactaagatcatggcatctggacccctcacttcatggcaaatagatggagaaacaatggaaactgacagagtttattttcttgggatccaaaaccactgcagatggtgacttcagccatgaaattaaaagactctttcttcttgggaaaaaagctatgacaaacctagacagcttattaaaaagcagagaccttactttggtgacaaaggtctctctactcaaagctatggtttttccagtagtcatgtatggttgtgagagctggaccataaagaaagctgagtgccgaagaattgacgctcttgaactgtggtgttgaagaagactcttgagagtcccttggactgcaaggagatcaaactcatcaatactaaaggaaatcaatcctgaatattcatttgaaggactgatgctgatgctgaaactccaatattttgaccacctgatgtgaagagcagatgcattggaaaagactctgatgctgggaaagattgaatggagaaggcgaacaggacgacataggatgagatggttggagggcatcaccgactcgacggacatgagtctgaacaagctcctggagttggtgatggacatggaagcctggcatgtggcatttcatggggctgaaagaatcacaactgattgactgaactgaactgaaggaagggccaatattcatactcagacagttcttgcctttgcattttatcgcatggtgaagcataagtaaataggattagggtacattatcttcacaaattaaaactcgtgattactgggatggaattgggcaagacttggaacataagtactaagccacatttacttaaaaaatgtaaattattacatggttccataacactagttacaatttgaataattatcagtctttcattctgttgtagaaaaaattaaatataaaatggagagttttcaattgctaagagatttgtatggtttttcacagttagaaattgaatatttaaaaatataaaaccttctttaattctacatgtaaacatatatgaagcattccaattcagatactattttcagatatgcaaacttattttccatatttgaaaaaaaa

SEQ ID NO: 25865 - DNA, 965 bp, Bovine  19866881590252
tttaggagctgggtgacttttttgtagtgggggttgttttgtgctttgtagatgtttacaagcatctctggcctctacaccctagatgtcagtaccatgttcccagttgtgatatgcaaaactgtttttagatatcatcacataagccctggggagcaaaattactttctgctgagaaccactgtgatacacaaaatttaaaacaggcaatagtcaagctctgctggctgagaggtggtgggaagcatttctccaattgaggcagttctaaagaaacctacagggcaccttaggacacagtttgatgactactttcctcaactattgatgattctctgtgatatactaacatggtttgatctgttacttgagttaaaaaaaaatagatgtctgtcattgagaatagcttattaactatatttctgtaacaacaaaaatgcatacatgttgataaagaaaaactcattcagaggcttgacaacatcaataatagaagtagatgtagctgataccttattactagctttatgaacaataattttcttttttttggttagttcaactaacaattagagtgtggtgctaacaagggacaggtcattgattttgacacctacttatactgactaactgatcctgcataggtatcacaaacatatgccagtcattataatgaaagaggaacaattataatgtaggctataacatgggctaaatataattaatgttaattgtggctaataaatgttaattatggctctccatgatcatagcatcctatgtctaacatgataaaagtttaatcagcttagaatattattttccctttacacaaaaaagatgacatatgagataatctaatttttcttggagggtcttaatatatgtaaaatatgtaccatgcccccagcagattagcagattgggaaatcttgcctttgagaatatatgtccaagcctaaata

SEQ ID NO: 25866 - DNA, 1299 bp, Bovine  19866881608341
ttttcaacaggagcaggtatactacaagtctattttattgataacattcatgaaatgaaagagaaaaaaaacaactagagttggtgtgatttaaaataacattcaaataattgtgtctttatgtggcagactggacataggaatagttacaaacatattttaagtttatcataacatatgagttaacaggcagcttcacaatattaagatatgtgaaaatctaaattataaaatacaacttccatcttctaaattgaccaaggctttaagataattggggggaaaggcagtgctgactaagtataaacaaattaacacaatgcagtactattcagacataaaaaagaatggatttttacatttgcagcctatatggatagacttgcagagcattgtgttaggtgaaataagtcagaccgaaaaagacaaacattgtataatatgacttaatgtggaactggaaaaaatacagtgaatataacaaaagagaagcagactcacagatctagagaacaaactagtgtccaccagtgggaagagtgcagttagagaggagacaatataaagggaagggatttaggggaacaaattagtaggtataaaagaagctacaaggatacattatacaacatggagaatatagcaaatattttataataactataaatgaagtgcatgcgtgcgtattcagtagctcagttgtgtctaactctttgtgaccccatggactgtagcccaccatatttctctgtccatggaattttccaggcaagaatactggagtgtgggtttccatttcctacttcacaggatcttcctgacccagggatcaaacccacatcttctgtctcctgtattggcaggcggattctttaccattgagccacctgggaagactatgaatcactatattatatacctgtaacatataatactgtacatcaactatacttcaataaaaaagaaattaacacttcataaagcaaaattttgaatagcaatctaaaatactatttcagttcagtccagtcactcagtcgtgtccgattctttgcgaccccatgaatcacagcacgccaggcctccctgtccatcaccaactcccggagttcactcaaactcacatcatcgagtcagcgatgccatccagccatctcatcctctgtcgtccccttctcctcctgcccccagtccctcccagcagcagggtctttcccaatgagtcaactcttcacatgaggtggccaaagtattgtttagtaactgcttataaagagtattaaaattattatcttcatt

SEQ ID NO: 25867 - DNA, 1589 bp, Bovine  19866881856528
aaatcattatttatgtttaaccaagttgagtgccatttttatttttaggaaatacttatttccgtttcaaccttctcttagtctgttctgtttatataatcacatctctaacacaaatactttttggttctttaagtaatggcattgattataattgtataaaatagtcctaaaataatttgaatacttgaaagttgtatatataatctatgcacatcttaaaatttcaaagttctttcaaataagtcagaacttaaatttatcattgcagccctttgaagttggagttctttccctagctaataaatgagacgacaaaacaactttggctgtatcaatttactcgtttgctgccacagactaagaattgaacaaaggaatagaattctaaaagtgctttttagatgctttcgatttgtggtgccggagaaaactcttgggatcgccttggacagcaaggagatgaaaccaatcaatctcaagaacatcatatttgaggaaccgagcacggtccacagaattccttttccctgtccgttgtttaaaaattttgcacaacagatgaaatgcattatactccttaggactctgttgagtcttttggattacttgagaatcttttggattgtgactttcataaattaacattctaacaatcatacatgttttaattagagatgttatatctgagtcactgaacagtttgaatttaaaaagctctttgaattatgacttaattaaatgcaattactaaaactaggctaatgaagtatatgctactaggaagttttttgttggtttccaaagcagttatgtattattcagatggaatggagtgcttcaaaatgtcagaaattatttcatttatttcttctgcagtaacctttcttttttttactgtgagcaaaattattttcacagagaagtagctcaaattatttaagctgtaatttatcccctagaaaaacactgatttctactccagtttaaataaaactgaatggcattccattatattaatgaaaggtagcagcaattgatctagagcagttcctttctaccgtaatgaagagagtgccagaatagttgtgctaggaggcaagtggttgatttaagctagtttggggatgcttctatctcaaaacatccatcctcagaaacaggtactgattttcagagatgaatgaatatactttgacttgacgtttcaagacataaagaaaaataacagtatagaatcttcttatgcttttacatgtttctacagaaatatgtcagagacatttccagtgtggcggggaccggggtggagaggaggggaagtgggggagaaatagctttgtctttgttttaaagaattaaaagacaattgagttttgttggctattcaaatgagaggagaagcaaatctatcaaagcctcattgaacaaaatagatggaagacagctactgggtcttgtgtaatctaaagaaaaatagttacttagtggacacatcaaaatatatagatgggagaaatctagagaccatggctgtccagtgactcatttaaaattgaagaaggaagcctcaggaagtcacaatgtca

SEQ ID NO: 25868 - DNA, 1011 bp, Bovine  19866881972690
ttgattttttggggcacacataacccaatgtttacatagtgcataaaaattacatgtgatactctcaatgcacataggtaattttaactgaataacttaaaataactctgttaaatgttaggatatcatttgtttattctaaacttttgattcaattcctttctcctttttatctgcaaagcacaatttcagtcccttttaaagttaacatgatgtaaactatccacgtggcagggatatataataatgcaaagcagatgaatttcagccccatgggaacttgcagggagtgaaaaggggttttagtatccatctaggcaattgtgcagatgactgttagaaaaggtaataattttaagctcataaataagaaaaaaaaagtaagtaaacaactttattacaaacctctttctagtgatggaacaattttcgaatgacttaatatattcaatgcttcatatcatttgcctacaactggaaaacaacagacagttgttttaaaataatgttataatggagaacagcaaagagagctaaatacttggttatgactgcaggcatattctcaaatagaaatcttattaataagaagacaagaagaccctaaaaaagaagccagcataacagagatcccagtttataaagtacttgctttggaatagtcagttacccttactttgcttctttcctaatgaataaacaggtatgtgaaaggaatttttagtatacagaagttttaaagagatttgtatgcaatcttaaagagctgatgttaaattttcctttttttactgatgaataaactaaagttcaaaatcaaacagccattaagtggcaaaatctatatttgtttaatttaaaaatgttcgtgatggttgctgacatacatcaacataaactggccagaggtatacctgtgtccccaaccctgaaccccaccctcctctctccccctacctctgtctccaccctatccctctgcttggtcccagagcaccagctttgggtgcc

SEQ ID NO: 25869 - DNA, 1032 bp, Bovine  19866882015270
cccattctcaagccctggaaggggtccctcttcttgcaacacctgcatccattaaaaaatgacattaacttcagggaataggaaaaacaagccaaatgtaattctgtgcgaggacatacatgctgtgacctctagcatgtagcagtaaaagtataacagtatacagaatgaaaatcacctgttcatgagccaatctcacgtgcaaatgttaagtaagttttatatgaaatatatacactgctgtacaatgcaagcttttttcatcaagcagccagttgtctggtgctaccaattaagtcacagtttaaatttattacttcattaaacattaaaatttacccaagacctacaagagctttagctctgtcacctagttccctgaaaagacctggaaacaataccgcatttgaactgctttcccaagtaatcaaaatttcaatagcatctctacccccatttataatacctctttaaattctgtccagctcagagccacatatccagcagcatgtgctcattatttaacactttctttaaacttccctgatattcctaaacagagggcacagctgtgcccccaaggtgagggcggcaccccctatcacgttgctctctgactcaatcagttgccaaagcagctctatcattatctctggacggggtctttctgcagagagcgcgcagtttgtatacgcttcccatacacttctccagtgcggcaaatatcatctagcctggttttacactgtcatttccattgaaagcctgtaattactttccacaagcaacacttcatcctgccaggctgattaaaggcaatacacactggaaggcaaagatcaacagtgctcaagcgatgtatcttgtgagtgtgtatcttgtaaagcaacagtgcaggggcatgcacacactaagcactaaataattgtttgagaagatagaacatttgccctttgacagacagggtaattactgattttctgctgaaacataatagatttttaaaaagcaaattccccagatcataatggg

SEQ ID NO: 25870 - DNA, 1300 bp, Bovine  19866880168731
catcctctgtcatccccttctcctcctgcccccaatccctcccagcatcagagtcttttccagtgagtcaactcttcgcgtgaggtggcctaagtattggagtttcagctttagcatcagtccttccaaagaacacccaggacggatctcctttagaatggacttgttggatttccttgcagtccaagagactctcaagagtcttctccaacgccacagttcaacagtatcaattctttggtgctcagctttcttcacagtccaactctcacatccatacatgaccactggaaaaaccatagccttgactagatggacctttgttggcaaagtaatgtctctgcttttcaatatgctatctaggttggtcataactttccttcaaaggagtaagcgtcttctaatttcttggctgcagtcaccatctgcagtgattttggagcccaaaaaaataaagtctgatactgtttccactgtttccccatctatttcccatgaagtgatgggaccagatgccatgatcttcgttttctgaatgttgagctttaagccaacttttccactctcctctttcactttcatcaagaggctctttagttcctcttcactttctgccataagggtggtgtcatctgcatatctgcagttattgatatttctcctggcaatcttgattccagcttgtgctttttccagcccagcatttctgtaagaccacccaaatcttccttttggcttaacatattattaataggttctatgttgtatagtcaaatcaactttgattaagacattgatcttttaagtacagaggtaaaagcaaggttccaggcattgtcagaaaatctgattgtcttgtcttaaaattagtatctaatagtgcatatgcggttgttcaaaagaactgtatgatcttaggaaagtcatggtaacactgaatctatgtttctttacctttgaaataaaggtagaaggacttctcccatttgacagtaagacagattagatatcctgaataacctgtttgaataaaacaaaatatcagataaaatatttgaattattcttaaatacatcactgagataacaaagaagtataaagatgtcaagccttaaaagtaacttaaaagtaaaaagaaccaaggctgagttttgacctgaagatttttattgaacttgtgtgaccttgagcatctatttgacacctgcttagaaagtaggggctttctgacataaaggccagggcacctcaagatgggtaattcaataagtggtccctgctgcactcacgtataagggga

SEQ ID NO: 25871 - DNA, 1495 bp, Bovine  19866880501299
atttcttggggaatcttgtataattaaggtaaatcacttcctgaaaaagtacattgtttctagttaattcagctactcacaagtgccaaattcatttgaaggtaaaactattcccactagagaaagatataataccaaaaaaataaaaaagtcactgggtcaccaaagccaaggaaaatctgcacacttttctgggggtacattaagtacaagtggagtacactacactctttatgctaggtaaaaccatcttaaatgtgcttcatcttctaacatttccagagcataactatacaaagagattctgtacaaagaatgaaaatgtgcaccattcccagttggcaatcagttagttgtgcaatcactttaaaaccacatgtaaagactgttttatgtcctaaaattattgtttttcttctttttatgtccattctcttttcctatttttatttctatggaaggtagttcctttaggaaaaccaattgtatatgagttaactttttgagcagactcctctctaggaataccacagtgtttctgctttggtctcctttcattggagaataactggttcatgagtcaaaagagtttggtcctggttttgtaggctaatgaactgtgcagtcctgccacacctacctgcacaatggagagggctgcaatggctgatttctgatatctcttccatctgtatgatgggaaaagagcagagacagtccttgcctgtgtttttcctggtaaatattaatttctaagccatcttttctactttcactgtgaaataatatgcacatttctcctaagagaagacacagaaacaaaacataaaatggatcatttccatttaaattgcttaagaaagatggagattactcacttatttaagtgaatcaacattttcttttggaatccagtgtgtcatcatgcatttcttaagttaatcacttcaagaaaatggctctggaggtgagtaggccaaagtttgcaaaacaaggtactttaaaaaagtaatccctttaatgtatagctgcttaacttagtggtttcttgctgaaatgagctttgtcagcatttcagaacaaatcatctagaaattaagaacttacatgctcttaattctctcctgccccttgttctttttttgacaagcggcctcaatatttttgaatatatgcatctatcattaaaaaactcagtatgcattccccaatacatatgtatatatgtatttatatctatacatgtgctgtgctcagtcacttcagtcatgtctggctttttgtgaacccatggactgtagcctgccaggctcctctgtccatggaattctccaggcaagaatactagaatgggtggctatttccttctccaatatctatacatacaaacatatatatatatatatatatacacatacaagctgtgtagcaacatatatatatatatgtttaaacatatatatatatatatatatatacacattccctaaactat

SEQ ID NO: 25872 - DNA, 1918 bp, Bovine  19866880509394
cggtaaattcggaaggttagccctctacaaggaaaatatgtatcacatttctccaaggtattgaagggtccctagatttaaggtcagttatgagttctcaaagtttctattaacaaaacaggtcacaacagactaaaactgaaaactatccagaaatccatcaacactaccatgagtaaataagctacaatacattcacacaatggaataagaaagaaacaagaatgaatgacctacaaccacccacaacaatgtaaaagattcctaccagtgtgctgagtgacagaaacaacagtttacataatgtacaaaaacagacaaaactaatttgtgatcccttttttgggagactgtgactgaaatggggtccaagggagacttctgcagtgctgacaaattctgcttttcatctgggtgctggctatgtaaaggtgtatggaaactcattgagctttataattgcatgtgtatcatatttcaataaaatgtttttcttaaaaagttcattaaagtatgcatctttatcttagaggtttgctttcagtgtatcacctaaatgttaaaatgacttaaaagcacatccatatttggaaaatttatcttttagataagagattacatatatatgaaagataattccaaattctatgaacatgatattctaaagtttagctattacaatatatgtattgtatgaaatttcagagggaaaattaatttaaaatatgtaactctttagcaagattgttatcaaactgctgaataaatatgaactaagttaactgacaattttctggatggcaagtaaaaaatacgcactgatggatctctaacaaaatattaatgctgtctattgtttatatgacatgtccaaattgttaattatatgttactaataatcttagtacagaggtaaagagacatcattcacattttatggtatttcagggcttcccaggtggcactagtggtaaagaacccgcctgccaatgcaggagacatgagacatgttccattcctgggtcaagaagatcccctggagaagggaatgacaacccactccagtactcttgtctggagaattccatagacagaggagcctggcaggctactgtccgtggggtcatgaagagtcagacacaactgaagcaacttagcacacatgctagcatgaaaacagtctacttaagtagatctaaattattttcactgttttatatttgaaaaaactgaggcaaagaaaatctatttgttttattaatagaatcacaagttcaactgccaataagatcataaaaatttttagactttcaaatacagaaagatcatgaaataaaaacaagcagttgttttacttatgaattacaaactcctgtccgaagagtagctgcataacataaacacttaacattgcatttaagaaaaccttggtagctattaggcaattcaactaatacactgagatatatcttctattttaaaatggtggaagtatcttaaaagtatagatatgaatactaagagcataacatattacagaagaaaaatgaccatttagtgcaatgcatatcacagaataaatgggtaattactgagtatgtaaaacaccacacacatgataaaaccacaaaaatgtttaaacagaaaaatgaaaggtgtctccttccccatttcagaaggcgtactagtacttttattccaagaaaaaaccagattaaaggtaatcaaaattaccttgacagccactccttttccctcaggaaattctagaagatggaaagtcagttcttcaaccctattaatgcagagccttgggtcagttgttcttcttaatgcttgaactaacgcccgagttctgttatcaatactcactctggcaatgatctgcaaagacatattaaaatatgtagattcaagt

SEQ ID NO: 25873 - DNA, 1695 bp, Bovine  19866880540143
tcatcctataccaggggacagtgacatcctttcagttgttttcctcaagcatgactacttatccatcttttctctgcgcaaaggctgttatcacttgccaatttgcattccaaaattccctgacataaaactcgactcagaaagcattttatgaagcatgtaggactctctaagcgggcaggtttttttttttcccctggattaaataaaacaagtgtattcactaaaatttgattttcttaaatagttgtgctcaagaaaatcaattttaaatgaaggaggataaaacaagcaaatgattttggatcttttctctacagctatagaaattgatgtcccttgttctttttatactttttatgttggaactacctgtaacatatggggtccagggtattttgtgtgaatgtatccttggctccagtctcaccaaaagactcagaaaaatctttccatgacatattccagaaaattgccacaactggtagcctgacggacagttgtcaactggttgtccaactggcaccagttcattcgagattgagcatgagaggtttaaacactaatacctttgagctgctgaaacactgtgtcatactgagaggaggcttgcttttagctgtaaatctgatcacaaagttacattttcctccaaaaagaatgaacagaatcaaatccttccattatcacaaggtaactgaagaatgcaaaacacaatcgatgacttccctggtggtccagtggttaagaatctgccttctaattcaggggacacaaactaagatcccatatgcctcagggcaactaagccccctgcgctgcaactgaaacccagtgcagccatggagaaggaggtcttaaataggtagggagtaaagtgaagctaagcctggcctctgtctcaagaagaataaaggtatgataggagggaagggcttgtgaaccaaactttgagactgaccttgaaagtactaatgaatttggactaatagcacaatgcaaaaatttactgaagtgaaattttgagcctgaccttgaaagaacgtatgaatttgggtgagtggataatcaaagtttggaggtaatgatgaccaagaagcagaaatctgcagcatttccctttgtgcagatgaagcaatctccattattatggttattgcggttattgctttttggcatctcagatggttttaacttatttttagaaatactgtcacagctttatctttattgtgaccagatgtgagcagattcaaagcatttggaattgtttggaaatattagagtttgtgtaaaaaagacacatcagacagaggtggaccgttttagattttaagcaagaacagaacactttttgcacaaaatgacaaaaagaagaaacaaaaatacttataagaataaatgtaatttatgtatctattaaatacagtattattagcttattaagttgcttcaaatgcctattttctataaaatcatgaacttgtacgttaatgccatctatttttagtcattagttcacccttctctatgagaggtgagagcctcataaagcattagcgttacatggacctaagaagtaattgaattcaagctttgcattctgcaaataacaaagcagagacttaaagaaacaatgatcttcccaaggtcacgcaactggttagaattctgatctgacgcttaggtcatgat

SEQ ID NO: 25874 - DNA, 2556 bp, Bovine  19866880567374
tattctgggctggagaattccacggactgtacagtctatggggtcacaaagagtcagacatgactgagtgacttgcacttgcactgtctacaaatactgcgggcctataatgtatctagcagggtgttagaaactgtgagagctggaagcagcaatgtgaccagctgggtagggaatgcataatacagatagaaataaagaaagctacattatagcaattatttgttgcccaatgagaattttctttttctctcatgcttcataaagaagcatctatgatagttctatttacaccttttaaacttgtcatcatgacttttcaggggtttcaaaatgagtgcagtgcatataagatggtgaaaattactctaaagattaaagttgaagtcttactctgtgagctgatgattatatttgtgatgggatggatggtagcagtatttttccacacactattacagacacctgggatgctccatcgggagatcaggacatagccactcacccatactcaaaatatgagagtagtataagcctgtatcacaaaattcttaaccaccaaccttcatcaaaacctctgaagtgtgtatttctttgttatacactataggcatatgttagtatatctgcattacatactaagcaaatagtctagagtttcattacttctataatttctgagtgtcagcattggtacttttcacataattcaattcaggaaatggaattcaacatgtttagatgtgcatggattaaccgtatcctgatagcaaacaagttcattcaaaattagcaaaataacagcacccatgatttacaagatatagttttaacatttgagacacagaaaaaatgtggttttaaatggctcttaattctactagtattattttttaaaaacatgcttttaaggccaaatctgaaaggcagggagaggggcaagttaccctagttttatttaactttttaaatttgagggacttttaagaattccttagattgttcataatactactactactaagtcgcttcagtcatgtctgactctgtgcaaccccatagatggcagcccaccaggctccactgtccctgggattctccaggcaagaacactggagtgggttgccatttccttctccaatgcatgaaagtgaaaagtgaaagtgaagtcgctcagtcatgtcccactcttctcgaccccatagactgcagcctaccaggctcctctgtccatgggattttccaggcaagagtactggagtgggctgccattgccttctccgagaaggtacttagggaactgctttcaggaaatacagaggaattaaatcagctatttgaatatgtgagtttctaaaacacaaaacagcagtcctggggacagtgttggcacacacatgtgctttgttggcctttaaataatttgaaagagccccaattaatattatgaaagaaatttaaaatgtgtgcttttcgtgaaagttccaaacatctggcagaacgaggcccccatttggctggagccgcagtgagttatacagcctctcttggtcaatgtctgcattcaagctcggccaccctcccactcccctttctgtccttactggtctacttcacacattgacttttcctgctgccctttcttcttctgaggttgtgaccccctgatgatcccagaaagaagaccccagaaagttgaaagaaagggagtgggtataatacagggaggtatgaagtggatcgagaccgaatcacataagacccagaacacctgccacttctgccttcagcccagagcacaagtggccttcacccttgtgagtttctcctgcatctcagcttggttccaggccagccctgtccctggcccctcccagaaagacccctgctcccagcactccccatacggccactgcctggacagctgttctcaggctcttgaattgcagtggagcactaactgcagcctgagattctcagggctcttagaagggaacatgtatatatatgcaatctagaaaaatggtaccgatgaacctatttgcggggcaggaatagagacgcagatgtagagaaaggacttgcggacacagggagggaaggggatagtggggatgaattgagaaagtagcattgatatatatattcaatggtatacatggtagtgtatttatatataaatcagttcagttcagtcgctcagttgtgtccaactctttgcgaccccatggactgcagtacgccaggcttccctgtctatcaccaactcctggagtttactcagactcatgtccattgagtcggtgatgccatccaaccatcgcatcctctgtcgtccccttctcctcctgccttcaacctttcccagtatcaggggcttttcaaatgagtcagctcttcacatcaggtggccaaagtattagagtttcagcttcaacatcggtccttccaatgtacattcaggactgatttcctttaggatggactggttggatctccttgcagtccaagggactctcaagaccttctccaacaccacagttcaaaagcatcaat

SEQ ID NO: 25875 - DNA, 1215 bp, Bovine  19866880585615
aaatgaaaagctgaatcagctgcagttggaagggttgaagtacatagaaagaaatgaagaaaaaatgaaaaaacttgcaaaaatattaagtcaagaaaaaacaactctgcagaaaattaatgattggataaaactaaaaactgacatgtatgaaggccttccattcttttcaaaattgtgatgagtgtgtgcgtgtagtctcctaactgaatgcctgttagagaagatccacagaattcaataaggaatcgtggggttcagcatgacttatcatcaaaatgctcttgaattctggggaatcctgaaaagacagtgtttggaccagcttgcacagtacagagagagtgtacttggttacacaattcatatggaaattaggtttttatgatgttaataattaactgtgctttaggaatcttactgtattagttggttttagtacatatcgatgttgtattgtttgatgtttgaaaatttattaatatatgtgccaaacaagaactgaaaactatcacattatacttggtatttttactttagtcaccataatcatgttaaatttatttaatcattgattttctttcatgtggaaaaactaatttcttcttcattactttaaacattacttaggtttttgatagctacattctatgatccaaatattgcctcccacgattgtcatgtgatctaaacagatgcagaaaaaaaatgaaattctctctatcaaaggacttttacatttgaaatatgaaagagccagataccgttttctattccaaatatgtttatttcaacgttgtttggttccgaaagatagggtgaagttccagtcaaccacttttcccccctaaaatttcaagataatgctgtgtgtcaattttctagctctagcttatcattcactcatataaaattaattatttgaatttactgaggaaataccccatcattagcaaaaactaaactgttgaaataatctgttaaaaggctgatgtcatttttaaattatttattatttataatgtagcctgtcatctctttgtagctttgtcaacagtatgctttaaaaaaatgtcaggcttggtttatcttaactcctttaaccatctagacttcacagagattaataacatatacagcaacttgcatcattgtttatgctaaccaaattcatctttggtgggttatctatgtgccatgtaaatcctttaccat

SEQ ID NO: 25876 - DNA, 3142 bp, Bovine  19866880626272
ttctttagtggctcgtggtaaacaatacacatgctggtgcaggagacgtgtgttcgatccctgggtccagaagatcccctggagaagaaaatggcaacccactccagtattcttgcctgggaaatcccatggacagaggagcctggagggctacagttcatggggttaccaaagaattggacacaactgagcaactaaacaaaaacaactattactggattaccccttaggtagtttacatggaaaaatcattaaagaacagtaaattattttaaattttgtgaatttctaataacagaaatgatcagtagtagtgtgtatttatcaatagaatttcaaaattttgattctgctaaaacactgtcttattcactttgcttcttaactaaatcttttttttttttttcaaatcagaaaaatctcaacatgcttgcaaatcttcaaaggttcttccttattaaggcaaagaaattcacagcattgcagttcttcatatctcagtaggtattttctagtgacatctcatcaaatgatacttcatgactattccattgtcccacctgatcaataggaattctctttactttttaaacaacaagtttagattgtaggatctttggctcaccaacagtattttatattaaggaagcaagaaattcattatttttcctgacccattttttgactggtatctctcatgtgtaatttaatctgtttaacacatttttatggagacacttcaaagacagttcatgtcaccttaagaaaaaaagaaatgaaaatttagtgtcctagaatttgtttcttagggaaaatcagcaaactataaaacaatgaaacaccatgatgtcagaatccgtagatagatggtagcaacagtgactttcaggtagcaaggagatgtaggatcagactattcactgatattttctctaaagaaaaaccaaaattaagtacctttgaattatgaagtaaaatttgattgtttcatgagttaaaggactcaatttaattccatttaaatatatagtgacccatgatagctgataatcacagaatatcacatgagaaaatcttaaaattgtgctttttatttcaacattgaaatggagctgcagttgatatttggcttaaatatttgatctaagtatgttgtaaaataatgattgtcaaaataaaaattaccagttttttaaaaacataaacttgcaaaatattttcatttctatgtactaatcaatgcttagaggcacaaatatgaatctcagagagtctggtttttcttcttttcctaagcaaaataagatttcacgtaacttttcctccattacatttgcatctgttttctcctctcttgtcactcatacccaaactacatacaacgtagcctctacctctgtcgtcttttggccaggatctccaaaaccgtcttaattgcccaatttagaggattcagtttttttgatatcttctaagatttctcagctatatttcgtattgttgacattatgctccttattacaattctgttttctgggagagaatactttgcttgtaatcttgccacctctgtgagatttttatgtttggctttcctatcgtctacatcctcttcctgagtcattttagccatctctttgtcttcagattctctgtagaagcagattgctactaagtccatatttccattacagacatatggagttggccaaaaagttcattcatctttttccataagatataaaaaacccaaatgaactttttgaccaactcaatattatattatggacttttattttcatctccagtcctaggtgtcatacacagcacgtgctgaactgaaaggctttgtttcataagcatttcttcagaaatgttcttcatttctgacctctgtcaattaaaagaaccattattcatttacattctaaagtctgaaaactgcgtatttcatgtatctttcaccaccaagttctgtttttctggattttatctcatctttttgccccttatttctcttttgtcatgtttcatttagtctgcttattagtctcccaacttgtggttttctatagttttgcccagtcctttctccacattttccctaactgaatctttcaaatatcaagagagtaattcatcttaaattgaatttgatgtatgaaataaaacatctattgattttcttaaaattgcaagctagttgtttcagatttgcttacaaaaatattcctcatttgatttgtggtgtctatattactgtaataaattctaacacacagttgcatctctttctgggcaatcttttccaatccgtattgttcatgtagttgcttgtccgggaacagctgtcctatatgacatattatgtctttataatgtactgagattttttttaaataactagattcttcatattagtctattctttctgaattatctttgatatagtcacctattgattttttcaaaccacttttttagtgattcccaaagaagtccatttaaattgcattgaattatggcatactatgagagagaattaacgtttttatatatacagttgcatttgaatgacatgatatatcagcccacttattctctcaaagtgttatatccttgaataaaaatttgtagtttctttatagatttcacacaaagaattaaacaaaaagattaaaaagccctcttttgtcacttttttccccaagggaatagtgtagcaaaaaatgttctcatctaagaattttatgtaatttaggattgtccctggaaagttattcattttcacccctcctcccaatagctcaatcacattatttgtgaacttgtcagatcatcactcccatacatctaaagagaatgattaaatcccaaaatgggcagagatagctgaaagagcattacaatttggtattcaatagaaatgtggccatattttgtagtaacaataagtggggttgggatagtataattgcagtttaatttatttaaagatggtgctgtaaatcattattttctatattcttctttatgtttttgtgttccaagaaatgataaaattcactaaagactaatctgtaaaccaaatactaaattattgtttaaaacactatatataccaggctttcctggcaactca

SEQ ID NO: 25877 - DNA, 790 bp, Bovine  19866880627002
atttataattcttgattatttccattagcaaatttataaattcatcaagatattatatagaaagaattactgataatatattctgaagcagttttaaagtattttatgaagcagagttcatgtaagtctctgaaagcactttcctttaaaaaattttttaacaaaattttaaactgatttatttaaattctgttcctaaagagaaatcaataggtattatttttctcctcttcagatgtttttttgtccctaaatagttccttagatattttttcatactatatttataggctttttttttctttcctgaaggtaattttacttatggacaagtattctttcccctagtagcctaagaagtcctaaaaagcaaaacattactgtgccttacctaaaatgtctgttaagatgtattatccatctttgatttctcccataccaatgaacttattttcttaaaataaatgtttgctggttcactttaacatatagacttgtactaaattttccctgtgaagccataatgtttcagacgttcaggggaaaaaaattttaaagagggtatataacttttcaaagtcttgaacttgacctatggcatcttttggagaacatgctatctgataaataagcaatcttacttgacaattttatagcaatgaaaagtaagttgggtttttttaagatttcctaacagactgttaagatttaaaaattcattccagctgtctgaaaatattcagaaatagaatcattcattctgatgggactgtgacccttgttttctaga

SEQ ID NO: 25878 - DNA, 1746 bp, Bovine  19866880695166
tgctagtggtaaagaacctgcctgccaatgcaggagacataagagacacaggttcaatccttggattgggaagatcccctggaggagggcatggcaacccactccagtattcttgcctggagaattgcatggacagaagagcctggcaggctacaatccattgagtcacagagagtcagacatgactagtatgcatgcaaactataacactttaaccatttatctcaagtcagttcttcaaatcatgttttttctctcttcagaaccttcacacagctctctaccaccactctagcaccctctgatatttgatacaccaattcttgcatgattgggtccttctcactttccatgcctcatcctgaatatcaccttctcagggaggtcttaactaattattctttttaaattaggttcctcttcccttattctctaacacagcatcttatactatagcaatttgcaagtgtgcatttgtgtatttatttatttttccttcacactgcattatcaggactgtgaggtcaggaccacgaagacttactcatctttggatccagaacctagcacagtacttgacacttcagtaccttctgagtgaatgaacaagccaatgaatgaataacacatcaagatatttgggaaatgaaatcaacagaattccaccagatggcatggtgaattgagtgtgatgatttagggagcatgacacctacaatcctatatcatacattagggtgtcaccttttgagatgcttcataaagagaagtggcttgaggggagtagaaagaacgtcatctaagcctgattcttagtgattaataaatatataccttatcccctacaattctgagaacaagagatgtgccagacatgcctctttataccttaaagccaacttctcttttaataggcaactcccataacttttggtatcagcaaataccaatccaccccctttgctgcttgctttctttctctgcattttacagttcttgagaactcctcaacctctgaaagaaagtaaagtgaaagcgttatttgcttaatcatatctgactctttgtgactccacggactctagcccatcaggctcctctgtccataggatttcccaggcaagaatagtggagtgggttaccatttcctcctctaaggaacttcccgacacagggattgaacctgggtctcctacattgcaggcaaattctttaccatctgagtcatgagggaagccccttcagcctctaccacatacacacaccaaactatggctgctcttaaggaagaagcatgagaataagaaatacagaattagaaagagaatgaaggaagctgaatatggaaagggacaaataaaagagaagtgctgcctaggaggaaaataaacccttgccccatgaaaagcaaaagacgaagacccaaatctaatctgagagtgtagaccacatggaaaacagtcaatggctttaccattattatctttgaccttcagtggatgctaatctgcaggcatatattctaagggaaacaaaaataaaaaacatagccatctctgcagtattggaattccagcattctctcatgtttcagcttttcattggttccaaatacttgcatttaatttcatatcacaaagctatagcaggctttgtacaaaggacatctgtgtttatgtcagcttccaactaaccttgctgtgatattatggataatcccaaatggtgataaaactaaaatcacat

SEQ ID NO: 25879 - DNA, 1446 bp, Bovine  19866880695167
atgagtaagtcttcgtggtcctgacctcacagtcctgataatgcagtgtgaaggaaaaataaataaatacacaaatgcacacttgcaaattgctatagtataagatgctgtgttagagaataagggaagaggaacctaatttaaaaagaataattagttaagacctccctgagaaggtgatattcaggatgaggcatggaaagtgagaaggacccaatcatgcaagaattggtgtatcaaatatcagagggtgctagagtggtggtagagagctgtgtgaaggttctgaagagagaaaaaacatgatttgaagaactgacttgagataaatggttaaagtgttatagtttgcatgcatactagtcatgtctgactctctgtgactcaatggattgtagcctgccaggctcttctgtccatgcaattctccaggcaagaatactggagtgggttgccatgccctcctccaggggatcttcccaatccaaggattgaacctgtgtctcttatgtctcctgcattggcaggcaggttctttaccactagcaccttctgggaagccgtgattaaatgtgtcctcccaaattcgaatgttaaaatcctaaccccaatatgctggtatttggaagtaagatttgggggcaatggttagttcttgagaataggccttcataaatgggattagtgctcttatagaagagaccccagagaacttccttgctgcttttacactgtgaggacacagtgaaaagatgataatccatgaaccagtaagtgtgctctcctagagactgcatctgccagcactttgatcttaaacttcccatcctccagaactgtgagaaatacatgtctgttgtttatcagccattcactctacaagttctgttagagcagcctgaattgactgagacacaaaggctcagaaagtagtaaacccaagcaggattaggagttggttttttattttcattgcagtggaaagtcattgaaaattggggagtgacataatcagcttcacatttcaaaaagatatttctggttatttggtagagagtggatttgagggtatcaggagtaaggacagggaaatccagttcagagctaacacactgtcaaggtgaaagaggtcaaggtcaccatcgttacttgtaataatgctgggagcagtaaaaaaggaactaaatcgctttgatatggagtaccctgtgccatggcacccagatgccccttccaggactgaggtgctctcccagtgctacaagtattggctgctgacagcttagagcttagtcaatctccaggacttgtcctttgcccaacagaaatgcctcactcaagatcatgcctctgagttagtgaacatccagtatctggtcagtgagcggggaggataaggttcttgctttaaattgggataactctgaaaggccattctgagtttcc

SEQ ID NO: 25880 - DNA, 1123 bp, Bovine  19866880713339
atgaaattcaagtcactttgccaatctaaatccaatttacttttcaaatgttaaatctaagagcatctttataaccattgattataaacagttttgtcacctccatgtccctgtacaaactagcttcattttcatttggcctgcattgaaaatgccttcttttcacttctatccattcaaatattacctttcaagatcaatttcttattatacctcatcacaacattttcctaatgatgaatttgtggcatttatttacttaaccattcatctggatcttgacattgttctcactcctgattgatatgtcatataccttcttagtatattagtaccaagattttttcaggtaaataatgaattcctaaaagtgaggagatgagttgtgtctagaacctgtaatattttgcattcttgtacatttattgaaggaatgaacattaataaaataataaatcaattcatatgatgaaatcaaagcattaacttggactgagaggccaaagcagattttgacacagtagcataagttcactgaaaactctgaagtattaattattataatacctaagatttctatatattgagcagtaacttgggtctttaacataattctccaatttttccttatattttatttcattctatctctttataaaatttgtgatggctgtgtatgctctgagtttttttctggagtgaagaaacttaggcaagaatcctgtctgaattcagcagtgacattagggtttacactgagggtcaggctattgatctgtgacaatttacagggttcgtggcttgggtgacattgaaagatgagtcattatgattctcctggatgatgaccaatggtgaagtcaacaaggttcagatgaagcaacccaagtgaagctgttgattttcaaatagtgtattcttatatcttatacaggaggtggaataaagaatgggacatatttggaagctcagaaagtcacaaaataatttccctgccactctaaatgactgccatcttcttgcatgctgtgacaattttctattctaaacacatagttcactaaccattcatactacattcctgagggatttgttttgagggttcccttttttcttttctttt

SEQ ID NO: 25881 - DNA, 2523 bp, Bovine  19866880785756
aatgttctatacctggaggtccttagacaccagacacataagaaagaccagcaccctcatggagcagaaatattattaataggtgagggagtgaagacttctcacagccagagtcattgttaaagactcagggaaattctgcaatgaatacatggttctttatagtgtctatcaccatgttctccaagtttattgaacacatcgaaacattgtggaaacagctatggcacatcagtttggaaaatcttttagcaaattacagtgccagaatagctaacagccatctggctgagagatggccgataacctttgccctcatagaattttggtgagaatgagatgaaatggttggtgtgaaagtttctagcacagaaggaacagtgagtaggaacaatgagtacagtattagaagaaccaaaatatgaatcaaaatccttatgaagaaacaagacactgaaaaggtgtcttgataaatatatcaggaatgccaaaggaagtgaggcctcgtgtatcctgtgtgtccaaaagcagggtagtggatactgatgagcaaaatgggaggaaataaaggaatacctcagcttcctcacagtgcaacttgtggtagaaccagttttaacctctgattttcctgctctccctgcttctgacttaatcctctcattctcttatggcccactccaaaggccaaaagcttgcacaaggcacagatgatagctaacaattaaaatagagcaatggaacacagaaggaaaaagaaaagcccgtaggatgttattcatttttacaacacactgcagcacccaggcggtccacggcttcaaagcaaagcaaggcctccatctagtggaaaagtggaggtgtctgacattgcaaatgttacttgcaaatgttatgaaaccctcctccaccctccatattaaatttggcagctgttaaagctatatgccaactaaatcatgcttgacaatcatatttgtttctggctacttaattcattcatttagtccagtaatagatattaacaacattatattccctacagcaaagcaaacaattacaaacatttgtaatgttccagcttctgctgtatcacaaatactaatgcatcagagaaaataaatgaaaaaaatttctccttcaggcagtaggttaagtagaataaaggtaattttttcctcgtttctaataatagtgggaaaaaatgaaacatacaatcattttgaagaaagtcttttcacctttggatgaaatatattttttaatccatctaattaaaacaaagactacattttaaactacaattcaatcaatatatttaaattgctttttataagaaataatagcaagaataaagactgcagttactctatatgttacagtttaatgtggaaaatattgaatactttaaaatatatgaaaaatagcacctgatcacccaagacacagtcaataagtaaaattaaatgtctgagagttcctatcattactcaaagtatttgggaaaagaaaaaagatgtgacctggtatcaccaatatatgagcttatcaacccaattggtaatatgtttccatttgaaatgacattgaattgcttttgcattttaattatataacagaaactgcagaagctgtttcaaatagatttaaaaatttgagaaactgatagacaaatgatgcatacatgcttggtcgcttaacagaagaaaattaagtaaaggtcagagaatgggtgggctttaaagaatatgaagactagttagaatcctaagagaggataaattcatgatctttcatgatgattagtgccttttaagataacaacaggatgtcttcagaaatgaggatggaagagggagggtttgggcctaagagcattcactgaggtgggagagacaggccaagaatagaagaaatgagggaattccctgctggtccaccctgcttctggttaagacctagcacatctactgcatggggtgaggggttggatccctgggtggggaactaataacccaaatgcttcaaggcaaaaaaaaaaaaaaatagaagagatgagatttgtaactagtaggctactgctcaaagtgggtgcaagttgaaaaaggaaaagaaggaaaatgaagtcactcagttatgtccgattctttgcaaccccacggactatagcctgccaggctcctccgtgcatgggattttccaggcaagagtactggagtgggttgccatttccttctccaggggatcttcctgacccaggtatcgaatctgggtctcctgcattgcaggctgactcttcaccatctgagccaccagggaaaaaacgaactcataaaagtttggctatgattatcaacaaagatggaatagtgctgctgccgctgctgctaagtcactcagtcgtgtccgactctgtgcgaccccatagacggcagcccaccaggctcccccgtccctgggattctccaggcaagaacactggagtgggttgccatttccttctccaatgcatgaaagtgaaaa

SEQ ID NO: 25882 - DNA, 1451 bp, Bovine  19866880816025
atgaaccagcagagcaaatatgatctggtggccatggcaacatacatttctgctttgaacttgtcaatccaccacaaggaaatcacattaacgggatgtttttctgctacacgtagcttttgtcttcacattttaattatagaaagagatttttttgatttctaaattcttcaaagacctgggcaaaaaggaaataataataacaataataatgttgtttcaaaaatattttttgcaattccaattagccttttagttgaggaaggaaaggtagagaaagagaaaccatctatttgtccctgtttttttccccaccatataacttggaaaatcagagatatagtcagatactctctaagcaatttgcttcttggtctttttaaggtcatttcctcatctgtaaaaatagagtaaacaatatctgcctcacaaaagtgtataaggtctagttaatgcttgcaaagtgctaaggataattgctaggattatgaattaatgttgctggttaatgctggatagggaacccttggtttcacctggggcccttagctacttcattcagttattaatgccagaaaatgctcatttcatctaagttttattgcttaaatgtggaccatggctgtagaagtttatcaacacattttatgagaagttagtaagctcataaaaagggctaatttaggactaatttctaccattgataaagctgaggaaataggagatggcacctatgtgccactgtgctcgataggaagacaaaattggacaatgaaaggaaaagaatccatgaacatttatgttgcaggtttcagtagtcttcattctgaccacaaaactagccatatgataaaagaagacaaaaactaactgcttgcaaatgaggattgataatttctgagttgtgaaggtctggctctgtaactcttcccatcttttcatactgatttttgagaagaataagaaggacaaatctgtacaaaataaataactcatttgcaggccttggttttactcactttgctcacctgtaggcacagaagataaaaaatggtggaatatggcccagagctctggccctctgcattctcagttgttttttttttttttttccctaatatttatttttattcatttatttgactattagttacagcacatagaatcttccatcttcattgaggcatgcaggatctttaaattacagcataggaactcttgcagcatctgggatttatttccctgaccaaggctgaaaccctttgaattgggctcttggagcctaagccactggaccaacagggaaatcctttgttcttagtttttaaggagaaaagccagtgcctcaggattttgttgatggaggaaactgaaccagcttcagctacttcctgattgtcagtgccatctgactgcttccaaaccaggccccatagggtacagagagcagt

SEQ ID NO: 25883 - DNA, 4394 bp, Bovine  19866880836652
atataatattaatttcaagaatttaacattttaacattttattatctataattttgcagaaaaatataaaaatcatagctctctttttaaaatgtttttcttaatgtccaagtgcatagctaatttttcacaatcttctaaacaaacataataaatcaatattctaaacataataatctttatttaagacaaagctctccctgtctctctctttatatatggctctaaaaatcttataataatgacagactacactagtcatacttaatatgtgtgcatgtacaattctattcatccaagccttttggcctattacaatagtctaattctgacagtaacatgaaatctattattatacttgtgatttatttttaatcattttctctatgctcttcaaagagattttttttcttgcacgtatttagttcctggtttttgatttgttcttggtttgtgtgtttgtgtgtgtgtgtgcactactctttgttacatttttattataaattgtacctttttgtctttttttcattatgcaatgcccctctatattatgtttagtgctttaattcttcctcaatataatatccccatacctattttcctactgttagtgtttttccagtgtttctctacccccacaccctattttcaacttttattaaatatttggtttttgcagaaatatactttttacattaatctaatctcagtttatttacatgtaacataatggctgacatatttcttgatgtccatcttatttatacctatcacatattttgcatttactctttcttctcttacaacttttttactgatttggcagagttaataccggttacttattaacttttagttttgccccactttttgatgccatgagtgaatacctttctattattgttgctatatgcgtgctaagctgcctcagtcatgtctgactctttgtgatcctatggaccgtagcccaccaggcccctctgtctatgggattctctaggctagaatactagagtgggttgccattccctcttccaggggttcttcccgacccagggatggaacccacatctctttcttggcaggcagtttctttaccactaaaccaccaggaaagcccttttactagtggatagacatataaataaagattatacctatatatagtaaaataataataatatattctaattcatgtgatgtggtttatatgaaaggaggcatagatgacacagaagtgaaagtcgcttagtcatgtccaactctttgaaactccatggactatacagtccttggaattcaccaagccagaatactggagtgggtggccattcctttctgcaggggatctttccaacccagggatggaacacaggtctcccacattgcaggtggattctttaccaggtaagccaccagggaagcccagatggcatagggctaaatctgaactcaagtgatagaattagtttcattaacttctgctttatttttctgttgagatgatctcttagaaaaactcatgaaatcatgctgaagttcagactaggagcaatgtggaagagataaagttaagtgaaacactgatttataacgaaatctgatttatagagttcacacctgccatccaagcagaaaatgttaagtgctctatgttgaaaaggaagaatattttaattctctatcccctgaaggcatcagtttttcatttttattactctttggattaacattcagatttgagttgttctatgtttgctttgatatactcaaaacattgtctaataaataaatatatcatattgtggtgatatatggttagtgatatagtatataagtattatatttgttttataatcatttttcacaagctttaaattttatcatattctcttatagcaataaagacatttccattgcaaacttgtaacaataatggatagcaaccttcaggggatacatttctgagaaatttattttccctcatgttgctcagccacccaaagaatgaatttgtttccatgacagataaggactacactgatcatttttaaaatggtcttggggcaccacaaatcaataacagaaaagaaaaatgcaagataataatatttcttttcattaggttgattgatggcattctagattcatgcatcgaaattgtctctttaacagttattaaataacctaaagcatacatcttggctgtgtgggtcctcttttatactgaataatcaagacaaagataaattctatttgattgcaatgtggttactctacagaaatataataaccaaaaagcatatgaaatttaaaagacagaatatacttaccacaaagcataatattctacactaaaatctaaaacagccacatgacataattttaaattattttttagtataagatagttctgcaataataatacatttcatagtaatattgtgttgtgttgttttgttttttaaattctcacttgagcaatatgtaataagaacgttgttctaccaaattgtcatggaagaagacacacatttcataggctatttaattcagtgatggtaaaaaaaaaattctgttgcaaaagtgtgcctttaaaagtaacttgagataaactgaaattatagcattttaagggattttttccccctgattgctctcatttttctctgagagtgtgatatatgcacgaattacatataataaatagaaaagtgcttcttttagagaaagttccaaaacatttctttagaaatatgatttcaacattttctttatttgaatttgctatattccttcctatcattcaaatatcaagtcaaaatgtcttttgaaaaagtattacttttgggaaaattaccaatgactttgctgaaaagtgaaaaatttaagtaatttagtaaagaaaaaaaaaatctatttgatgtaaactccatttgattgtctgaattttttccccttcactggttttggtagatgcatgcgaacatatgtcttctgttttgaagagtttgatatagcacccatgaaatatgtcagtttttaacatccatatgccaaagtctcagaaaaagtttttctattaatttgagttctaataatatttgtatttctatacactagaaattaacaatccaagagaaaattaaggagaaaaatcatttacaagattatttttttaaaaaggaataaaatactggacttagaaataaattaacaaaagtggttctagccctgcatactgtaccatgctaatattttgaaaacggtaaaatattattgaaagaaattaaattaaaaattaatgtctgtgttgatgaattagaagccttaattttgttaaggtggcagtaatattcaaaatgtttaataaatttaatgcattccatattaaacttcctactgccattttgcagaaatgtaaaggctaatcctaaagtccatatggaatttcagaagactctgaacaccaaaaacaatattgaaaaggaagaacaagcttgaaggacttatacatcttgatttcaaaacttattatacagctgctacaatcaaaacaatagcatactggcataacaatacacatacagattaatggaataagattgagaatccagaaatgaacacataatatattctcaattgatcttttcaaggtaccaagaccattcaatgaaggagagcatttaacacatgctgaaaatacagtatatccacatggaaaagtatgaagttggacactcatatcatacacaaaagttaactcaaaatggataaaaatatttatatttaagagttcaaattgtacaaatcataaaagaaaatataggaataaatcttcatgactatgggtacttagatatgacaccaaaaaaacaagcaaaaataaataaataaattgaactttattaaatcaaaattaaattttattgtgcttcaaaggacactaacaacagagtgaaaaaaaaaaatccacaaaatgggagaaaatatttgaaaatcttaaatctgataagagcctaagatctagaatacatgaagaactaaaaacttaacagctaaaagataaacaatggaattttaaaatgggcaaaggattcgaacagacatttcttcagagtatagacacatgaccataacagtgagatgttcactgtcattggccactgactccatatcaaaacccatgagataccatttcatacccactgctgctgctgctaagtcgcttcagtcatgtctgactctgtgcaaccccataggcagcagcccaccaggctctcccgtccctggcattctccaggcaagaacactggagtgggttgccatttccttctccaatgcatgaaaagaaaagtgaaaggtgaagtcgctcagtcgtgtctgactcttag

SEQ ID NO: 25884 - DNA, 1987 bp, Bovine  19866880973277
tgaggatgaatggcataggctgggcctagattgtcagtttttccagtcctgttcagagataaagtttatctgtcaagctgataggaattatggagtaagcctccttttctacccactgacagaagttctgtgtagtgctaaagggacaagaacttgggggacaaccttcctgggtttgaattccagaatcaccatttattaaaatgtatgactttgggatatttcattaagctctgcaccctggtttccccatccaacaaggagaacaattgtacctatttggagggttatgaggatttagttaaatatgtatagtgcttacaacaatgcctggtatttagtaactgctattattcttacatagttccttaagttctgaaaattataggttggtatattcaaatttctgttaaattgtttgactagaagtgatagaatcagaacagttctggcctcgtgtacatattcacatgacccccagtgcactctgtactgtgaacaaggttcatttggtcagctgtgtagtgaagatctcactctgttagtaaagagggacataagctcctttgtcaatgcttcataatgagacacctctgcattaaaaaccccaagagggaactctcaccttttggagctgttgtaatactttgcaattctgatagtatttgctacctgctttcactccacatccaggctttacacaggttttctccaaataggtatctttacttaagattttgttccccaggtgtgtgtgtgttcacttttctcagttgtatcctgaatttttttcctgtttttttggttcaagcctctgagctcccttaagcctttgtaaactatctcagtctgtagtgttctcagcatcattatttggtgctagattgtaagccttattggaacatctctctgccggatcattgatgatgttttaaaatttacatcccagttcttcttggtctttttcttacatcccacaagcctttctctacaaaatgccactggctgacctggttctctttctctgttccctctcattcattctctttctcccctttcttttgtccttttaagaatgaagggaaaatttgttacccaagtaggtttcattccaagatgacttgtctcttagtgtatttgacgcaggtatataattagtatagaacatatttgtatgggatcttttgttttataaattacagccacaggctcatccgtttttctctatgttccctttttttccctggtacctaaggtaaccagatttatgctgctgtttatgttgactccctattgttcttgtgatgtgtgacatctgttattttacagcacttcactcatgtgcactggcagccaggaacctactggaaataacaattaagggcataaataacacacatctgcatgagtttggctccctctcaggtattaactctgcttaccaccttccagagtttttctcttctgcattgtgataaccatttgatttttaagactttagttttcctccctgtggagattttggcgtacattttatgtaattgtctgtttttgtggattgggacttgtgtgtactgtgtgctctctgataattgaacattcaggaaaaaaagacactccccatcatgttctcgtattgcagtgttagccttcccacctgaatagtttatacaacaacatcaagcatgactcactggtaatccctgctcacataaaattcatatgcctgtgtgctttcttctgaaggcagcgatttgcatttctgtaggggtctgaaagaataggagagagttattatcagttattatttgctgaccacccagagcactcacaatggggtacaagagacagaaaggggagaggtcagttctttaaaatgtatgtgtaaccagctcagagccaatgcaagcatcttggtggcactttaattagcagtttccagggtgagaggactccaaaaattttcctaacatctactttgagtcca

SEQ ID NO: 25885 - DNA, 1205 bp, Bovine  19866880994806
ttgtgcttttgcaccttcaaaatatatccagaatgcaactaattctcatcaccttcattgcttcactgctatcaccaccttcaagccaccgtctctctctcctggataattgcattacccctaataggtctccttacatttatgatgcccaccccatcactgtcattctccacacagcaagttgtatgaaccttttaaaatataagccagatcccattacccctctgctcaaaacccttccatggtggcccgtgtcagttgagtaaatgcaaaagtccatataattgcttacaatgctcctcatcatcttgcttctctttgacatcatttattatcccctctcatgttctctccattttagtcacactggtctatttatctcagccaagcacatcaagtgctgacctgcttcaaagtctttgcattgctgccccctctgcctacgtatctgtaggactcattcgatcacctctcttgggtatctatacaaatatcagtgaggtcttcccagacaactctaagtaaaaagtatagcacttactgcactgcctatgcccatccttgcttaatttccccccccacaaatttatcaccaaatgacacagtatatattttccttttttccccattctcctcatcgaatgtaagctctatgagagcaaggttatttgttttgttcgctgctatagcaaagcgcctcacacatagaggcagtcaatgaatactattaaataggtatgtcaatgtataaataaatggctatcatgttaatactctaattatttgtttgataaaaggcactgggtgatatcatgttgcacaatgaggaagagtcagatgtatttcttacaaaattttaaattggtgatgataatgagtcacaatttttgaaatatggacatatttcgatctatgttagatgtttaaaatatactgggttacatattttgatctttagacaatttctatggatacgctttttcaaccaaacaactagttaccgaaataaatatagaatcatgagaactctaagctttttctttatttgtggctatttagttcaattaaaaaagggtctcagtagcacatatgctttagaaattcctggaggctggaaatcagcttattgatacatacgttaaatattttctcagctcctaaagaggataatcaatgagaataaaatatggggacttgggggtttt

SEQ ID NO: 25886 - DNA, 1121 bp, Bovine  19866881053348
ataaaaagtaaaaacaaaacccagaattagcaatagaatgagttttccatgtacaccataagtgaacaacagtggaacccaagaagattcctgttactcaggtgtgcggtgcttctttgggttgaagcattctgttgtacaggtttcatcatcatcacagtcttcagctcctctcataacacctacatacagctgagtactgccctgggcctctcagcatctgccatgcatgcatcactgatcagagccaggctttcattgcctttcagttcctactcctcagttcagcttgggaagggaggcactgtgcacagaggcagcgagtaaacagtgtttggaggaaatgctggatcaaaagtcctgtcatcctttgtcttcacagagtatgaatgacaagggcaggctcacccaggggttacctgaatttcccagtccatgagtaagctggcatgcactcccagagatgaactgtgcttcttttgcagagcctgcacccatcactctgtgctgtcagcgatgacaccaattagtgtcacttttaatggtggctcttgagacccaaaggagaccagtattttggctactgaaatatgtctgattttctattcaaatattaagaaaaacagacattcttattgagtttgctgatgtggatggagagtgagtgagtcacttgactaccataaacaatatttttgtccatacatggttaatactttatttttttgggaggggtagttttataggcttgtagacttctatggtctgtatctgcatatgagctaaagtgcattctctcactttttggtgcaaatgatggcactcatttggaatacgtttccaggagtggtactggattatgctgagcagttaactcattttagaccgatcattttccatattatctggacagaatctatatgaaacctgtaaccactggaaaagaggctttatatttctgtgcctccttagaaagctattctaaattacagttagctgatgtgttcttaatatggcctgattctctttggtaaaggaggtccttggcctgcacgtgtttttttttcatgtttcctttcctttaattatccttctgtttaaggaaggaactgagctgccca

SEQ ID NO: 25887 - DNA, 847 bp, Bovine  19866881066619
tcttctggtagcaaaatatacattttataatagtatttatttttacattacagttaattggtttattatgccaaattataacattacattgaagttctaagaactgcccaaaattccatgcctaattgacttagacaaaaaaagttaacgtttttgcacacttaattttattttattttatattttctatttcttgagtttatttgtgtctttgttttaaaaagacacccaatccactgacaagattaagtacaaacatttttgttacgtgtaaaattaaaaattttagttaatttgggatgggaaaggacagaataaatctctgtgcctgattatgagagtctaatctatggattagcacctcattcagtgcttcttggaaatctaacagcatcttcaacaacacatcatcaaaaatatttaatatttcttaaaggaaacaaattaagactttagaattttagaactgccttatgtctactttaaaagtatattacgatgttgactcactgaaagctaacttcgatttgctaagtgggtaatatttactttgtagtgacagcagtctaaatttcaatcaatttttactactagaaatgacttactgattgggcttagatatcatcatgctgctgctgctgctaagtcacttcagtcatgtccaactctgtgcggaccccatagatggcagcccaccaggctcccccgtccctgggattctccaggcaagaacactggagtggcttgccatttccttctccaatgcatgaaaggaaaagtgaaagtgaaatcgctcagtcctgtccaactcttcgcgaccccaggactgcagattaccaggctcctc

SEQ ID NO: 25888 - DNA, 734 bp, Bovine  19866881076249
caagaggaattctttgtgcattcattgccccttgttccttgttctttttttttttttgccaagtttaaatacaactgaactgttcacttaatcttactttttggaccaaatctgtggcggttactctgtcgtgacaggaaggagggagatcacattaaaaagcagtttgttctgttcctggcagagctatccaccatgcgaaataggattcatagagtacagatggccctgaacgaaagtgttttcatgtgctggtccaggggtttgataaatgtgtgtctcgcaagagtcagactgattgccttattcattataacctttattcaactgatgcaagtcaattcacatattcattatactccacagatacatattattaattgagtcttttgaagtattgactgtaatgttgattcacattcatgatgaaaaattataataaggattaattccttacctctagacaatatatatggtgagttgtattttaaagatttcagtttgattgattgtaaacagattacatggtccaaaatggttgagacccagtaatagtcgtagctaacatttattgctatgtaatcttcagaccaaggtactgtcattatccttattttatattagtactgagatgatgatggtggtgatgagaaaagtcttacatttcttgcctgctattaagtttgggctctgtatctttccccaaagagaaaacaaataaccttttcattata

SEQ ID NO: 25889 - DNA, 730 bp, Bovine  19866881095167
ttcttaatatttgagaacttgctttattgagctaaacatgaaatcatttcattctgattgccaaaacagcctttgaaacaaagttcaagggtgacatatgaatgctcacttttctaagtcccttaggagcacaaatgctaaatttcaagattctaatatataaaccttggttgcttgtagagtaccagtgttacttgaagtacgcgcttcattgtggtctgtttacacttcattttgcttatacgaaatcctctttgtagactgatgtggcttatcctccaataatgctgaggtgggcctaagaaatacagttgcttgcttctctacttcttcaaaagaccatttgcattatgggatgcaggctgaaactgcttttgtaacagtggcaattctcctcttcctggcatcgacatcggactggagctggcttgcaacagctgagctttcaacgcaaacagaagagcagcaccctaagcaccaccagcccctcagtttccccttgtcaccagtggaagttaagttaaggttatttacctttcaatgtttccaaaggtatacactaagaactaagaaattacaccttgaaaatgcaattggacaggtatttctatgactggagtatgggaaaatggagtcatcatttttggaatctgttcatttttctttagtggctgggttactaccaattggagaaggaaatggcaacccactccagtattcatgcctggaa

SEQ ID NO: 25890 - DNA, 1151 bp, Bovine  19866881105249
actgtagcccgccgggtctcctctgtccatgggattctccaggcaagaatactgggttgggttgccacgtccttcatccagggaatcttcctgacccaggagtagcgcccatatctcttatgtctcctgcatttaccactagtgccacctgagaagcccatattctttcttttttgtcagtattaagaggcatgcagtgcttgcctgggtccctagtttctatctcacattgcatgaatgtacaagctacagtgaaccctgagagtgatttagggacttaacttcaagcatgtgcttcatatttcttctgataaaactgtttttaaatatataatctttagtgccaggaaatcaattaactttaaaaattgccagcgctgccaataaccagtaatatggatgtaacccttttgcatcaagagcatgaagaaattaagtgatctaacacatttagctaaatccagccctgaaagaaggttgcttctctgcagtgaagctcttttgaaatgagagatggaaacagcaatgaaggaaaaagcatctgagtaattgtacaaagtcttccaagtggcactcagcccagaagacatttttgttctgtccaaatgcacagaaatctgcagagacccatctgaccccagcatttcagggtatatatcagggctttttccacaaaagagcccttcttctgaaaagccaaggtttgcgtgtatttgtaataacagttagaaataaatatgatcaagatatgttgttgttggattctaaaacagatataatcttgtaatataagatctaaagaaagaaatgttgcaaatacaggaattaagaaatttatgtcatttctatactaattctgatactgaataggaccaaaccagatgcagcacagagagataattgcatttttaaatttttttttgaagtctttctttgtgatctagactagtggtcagcaaactgctgtctgtgagccatagctgctctgccacctgttcttgttaaaaaaaaaaaaaaaaaaatttacactatcctttaaatctcatccatggagctttcacactatagcacctcactaaataagtgcaacagagatgatgtagctcacaaaccctaaaatatttcttcctatccaacctttcacagaaaaa

SEQ ID NO: 25891 - DNA, 1110 bp, Bovine  19866881126825
ccagtttattctagtcacttttgaagcatctttcatttccttaaatctgctaaatctccaaggcaaaataatgtagaacagaatagataactaaatcttgctaggcattaactagggtaaatacatttggagaactgcctctcagtttaaaccagttgaactgtgactataccatgcttttagagagactgtctcatcatgtcatggtctgtcttattagagtatggtttcagtcccttgacaacttaaaaataaccacagtcaaacagaagctaagctgctgggatatgtgttaattgctccattgtcgtacagagagataacaggaactgaggttcccttgagatcaagaagaattgtgaagtgtcaatttcaaaatgagttttattcagttggttaaaaatagctcttttcttgagcaatataaatatatttagcattgtttgaacatcattaagtatgctaaatgtgctaatcattagtaagaaatgcttttgagtatatgatttctactcattcctttttttttttcccttccctgggaacttttattgtataaagtcccttttatacatagatttctctatgaaatagagggtacacattcagcatactgatcctgtgatgacctatatgagatgaactgatgattatcaatggcttacttgatgtttttctcaatgcctgtctgtggctatgatcttccataaaattccagaacggtattttaagataaagaatttaactcaaatttttaatctttattaattataatttttttactgttttcataaacaaggatcaaatgcacatttcacatgaaaactcttaatagtatacacataaatagtaccaaaatagatacaagaaaaatgagagatgtcaaagctgaatttatgatctgtgagatcaaacgtattcactggattaacattataaatgcaagattataaatgactcacttcattttccgataactaaagtggcagattaccaacgtgaacaaatgaatgttgttagtttggatttaggtatttatttttgaataaagtttttcctttcattcaaaatgggctaaaactgctgtacactttctagaagggcattttt

SEQ ID NO: 25892 - DNA, 922 bp, Bovine  19866881193229
actattttttttttatgtaattgcctcatatatccttaagagacatcatatagaaaactaatgaaacatatttaccccagatggcaatgctaaattttttaagtgaaattcaggaatcagattttacatgacacagttatataaagtggaaagaacattctatgttggtttctccctcatgggaaatgtccattttagatttttatctcatgttctcttccatctaagattccacttagatgtaaggcagtaaagaaaataaataataatagattactgaacaatgtctaatccttggtctgatggaacagagccttttcacaaacatctggctgcttcattctgtgtaggtgatcagacacttcatgtatggtcaattgctcagtcgtgtccatttcttttaagaacccatggactgcagcctgccaagctcctctgttcatgggagtttccaggcaagaatgctggactggttgccatttcctcctccaggggatctaccctcttccaggtagatcttccaggtaccctcttccctggatcctcccgacccagggattgaatctatatctcctatatctcctgcaagtagattcttttaccactgaaccacctgggaagccctatggacacttcaattattagaaaacaaaaaggtaacatttcctctgatgattaatcatttgggcctttgcaagcatcagagaaggcctttgagacattttttctctaagagctcctgacattggctctaatattgtattaatacaatagtcccaatgttcttggacttcccttgtggctcagacggtaaagtgtctgcctacaatgtgggagacctgggttcaatccctgggttgggaagatctactggagaaggaaatggcaacccactccagtattcctgccggagaatcccagg

SEQ ID NO: 25893 - DNA, 1306 bp, Bovine  19866881221279
ttgctttatttcatacttaacatcaaaatccatcaggatattctgtcacccttatctccaaaacaaagcaaaaattgaatcacttttcacatcctctattgctgttgccctgatccaaaccattatcccccattgtctggatatgaactagcttactacagcatttctgcattttggcaccttgacagtttttcttatagcatccagactaatccctttaaaaggaaataagatcacttctcacgattatgactttctattcactttcatctcactcaaagtaaaagccaaagttatataacggcctccaaggccctagaagatctgactcttcccacttgcttgctgatatctgttactttcctggcagtaaaggtctccttgctatctctggagcatactcctaactcaggacatttgatcttactcttccttctgccaggaacactctgccaacaaatacaaatatggcccatttgtcccttttttaggtctccagggtggcttccccaactgcaatatgtaaaatgctactaccatccacattccccattctgttctgttttctttttccatagtacttactgctacttgacacactacatcattgtttattgtatctgttcctcctctagaatccaaactccactaagggaagggctttgctttgttctctagtgtgaccccagaacctaggacaacaacagccttattggaggtgatcactgtatatttgttgaatgaataactacataaatattaaaattattaacacgttaaaccatgttcctttatatttcaatcacatcatgactaaaaatataattatgtaatatgccaatgaaaggcttatttttgtcatgtgagattttattctgagatggctgattaaacatttcatttctgaaatgaaatctctatccttgggtcacttattttcaaacaacctttcagctcttttgaaagaacctcacatagattattatttactctttttattttttcatgacattctcaaagatcaagtgaaaaacacatgtcaaagcaatttctccctgctctttctgattaaaatcaatattctccctgcttttagcagcagtaaaaaccaacacaacagtttccgttaactcaatagaatgtcaagtgatatcttagtgtattgttaccagcaaggatatcaacagagaactaccaacagcctataatcactgctgttttattatctacaaaatgtcatctgtgcatatggcattttacaaaacaacacagtgaaaacaaagctcctgtctcaagtaaaccttat

SEQ ID NO: 25894 - DNA, 1069 bp, Bovine  19866881288064
tgcagaataacccagcctatcctgactgatacatagatgcagaaaggaaactgatgcaaataattaaagtgtctccctcatcatgcatcaccagaggaacagttgctctttggtccaaagattgccttaatagaagagagctgatcactgagtcaacctcccatatacccagaagagtcttttgttaagattttcaaagataaagacgatagaataagtcccaaggtgtttttgactttgaccttttcctaaaagctccgattattagaattcaagtcattatgtaaattcagatcattgaagaactaggttcttttaccagaaaaagtcattcaaaggatttctcagctttctttcctttccaatggtaataaaaactttttccttgacctatttatttcatatagttgccagaagacttatatgagaagagtactttgaagtagaagaaagcttcatacaaatgcaaggtgctaaaaaaatgtatcttttatttatgatgaaattaaccctcataggatacttcattttctaaaatatattcattcaaggaatattggagcatttaataaagtaaattcaaactattagcatttaaatttgttagctgaatagtttcatcctgcccttacctaaaacagcagcatttcctcctttataattaaaggaagtcacagagtcaaaaacccaaaaaattacctaatgccctcactggcagtaacttggttgaagtcctctattatctcacatggaaccctggccttgcccaaaatgaagctctggttttatgcgtagattttataaccctagaaactgacttcccattaaaataaacctgtgacagaaatcatatcacagaaaataggaagaaagaaaattctacctcatatgatgaggtgttaccttatgaatgagactgcagtttaaattaagaatacctttagtggctttgaaaatcttttctgttttttaacttttgaagtgacccgttaaattgatctgtgaaggtcatagatacccctggaaagtggtgcttaaattctttttcagtagcagaaagtccctggtt

SEQ ID NO: 25895 - DNA, 713 bp, Bovine  19866881322644
tttttactaagtgtatggcacttatatgataggtcagtactgccatatttttagaaaaacttactactcttcagaatatatttaaccatttgataggttaaagaacatgtgctttaattttgagagaagagcattaaaaaaaaaccctattgactgcttgctctatgaatttctgtgctcattcaaaaagtaggctccatgttgttgttttttacctcttactatagtctttatttcttttcataacttttgttggtccttcttttcttttgtccttcctacccctctctctctttctctaagacaaatagatatcactggaaatactttttaaaatttgtaaaattgtgcttctgagataaagactttctgttgactttgatttacaatttggaggaggtttatagtgcatgtcccccttaagttacaaaatatttcctcttcaatgtgtaaaagaaagaaaaagattgaaactcaacagtggcttaatatttttctttcaaaacacctggtttcttgttccctgatattagacctaagtagttcttatgatggaaagatttgttttttccctttcttttctgcctgctttgatttatgctgaattaatacagtacttggattcagtagtgcctgcattaatgaatgcactaaaagcaatgacacttaacactccataacgtaagatagaagacacagaaattcagtccagt

SEQ ID NO: 25896 - DNA, 886 bp, Bovine  19866881518541
ctttcctctctctatcgggttttgacacaatgttttaaaacagagtaaagaaataatgatagtctgagatcaacttcctgggcataattaggccaatatatagcttctgaatgttgagaaaaaggattctgataagccaattaattattaagttgcctttaatcatccttggcaattttcctagtaacatgaaattgctttgcattgtgactgataataaaacacatgctcttaagttatgcttctcatatgaaatacagtttgaggaaatgataattcagttgtttctaagctaacagagtctgaaatgtatgtccagaatttggtctataattttgaagtcataaagtgactgcttcctgaaagaagcataaaactagaactaatttaagagtttgactattagaggtagggctcatcactcaggaaagattttgtgtggtttttctgccatgtgattctctcttggggttttgttcaacttgacctgtgagaaatcctaagggaaatgaggctgaactagcttaactatggtgaaggtgctgaggatggcatgtgaagagagaaacctgtcatgtgtatatgttagcagaacgctcaaggttttctggagaatttatcaacaactaaaatggttttctttgatggtggtcatctcaaaacaaaacaaacaaacaaattccagcctaacttctctactacttgccagataattattttactgaaaaaatgcaaaaatgttttttctcggattaactatagttattgttgttgtttaattaccctcacccctctctctcttttaatcttgattttttcctttgtttcttggctcagtctaccaagtctccccaacatttgagtgtacaattttccttccaaatga

SEQ ID NO: 25897 - DNA, 1582 bp, Bovine  19866881592372
cccagggaatgaactcgggtctccagagcaatgtaggcagacgctttaccatctaagccaccagggaagtccctgttatttacctggggccaaactatggtggaggtaatggagataatggcaacctccttcaaaactgctacactcaggttgtccccaacctgcagcaggccacggccaaccacacctccaccggagactcctgaacactcacaggcaagtctgggtcagtctcttttgggctcactgctcctttctcctgggtcctggtgagcacaaggttctgtttaagcaaagaaataaacaaataattaatagttaatagttctctacatgtaatagattatcaactaatatttgagtgactaaataaaattgacctgaaaacagcttctatctaaaagtaatgtcaaggttctgtttagatgcttcttgcctgttataacaagaaaacactgtggtactccttttaggtcatttattatcttctaattagctaaagcagctaatttaaccaatattttatctcagggcatgcaccatatactgatgaacctagaatacataagatagaattttctgcatccaaagacatgataaatacagttttgtctcttagcttttctgatatttcttcctaaagtgtgttaaaccttgtaaagtggttcagtttttagagccatcagagccttaccattgtttgtatgtaaggcagttctatatcatgtgtgatatttctagcaccagttacactattctccaactttaaaatctacaaccttaaaaaaagactgtggtgcttactgtttatagtcactttgctcaatcgtgtccaactctctgtggccccatggactatagccagctaggctcctctgtccatggaattttctaggcaagagtactggagtaagttgtcatttcctacttcaagagatcttcttgacccaaggatcaaaccaagccctctcatgtctcctgaactggcaggcagattctttaccaccagtgccacctgggaagcccttgagatttcatttgatccacaccctgagtcagtcaatcaaaatctgatggataagtcaatcctaattgttaaggtagctagaaaagcaaatttcacagtgtcccatgacaagttattctattttaaggctttcactacctagaaaagacatacctaatcaatgacaatgcagaggaaatgaggagggaaagaaactattctttaataattgcattcagtattcaaggcagagtgctaatggttttacatgtgtacattaagcaacccttgaaaaaaccaatgtgcttaaaattgtcactgttatgcttatttagaaatgagagaattaagaactgaagaatgcatgcatcatgctcaaaactgcacagcaaataaagaacaacttaaattatctaaataagagtattagattcaaagaaaggaatagggtagaggccctcacttcacttacatttttcagaaacgacttgagagttctctcttctgtaccaaaaagcaagtttagacaagcattattccctcatattctctacttttccttagaaaacctatagc

SEQ ID NO: 25898 - DNA, 1075 bp, Bovine  19866881730061
gacagcgtaaggactcttataaaacggtgctttaaaaggcaattgtgttctgaacagtcagggctgaaaggaggagagacaagtgtgattatgcggcttgactgaccgagcctaatcaggattatttcggcacactgcttccctacagccgtggacccattaaatgctaaacgcttctgcgggcccacttcccgctctgtctcccactgtgacccgctacttttccacactggttactcactgggcttctcaaaacattttttggtaaacggaggtaccaggtttaataggctcctccaaagtcatcatcaaatctgtcatttttatgacaagagtgggtactgtccccattttaaaacagcaccatttggactgttacacagaagggtgcccttggaagtaattctgttaccttccaatatatttttattaagcaaagtggaagttgacaactacaactctttccataaaagctgctctggctttgaaaacgtcattttggaatatctcattttaaactcatgaggcgatgaactcttaccaccctgtggaccacatcattctcaaaatggtggctccaatttggggaccaggcgttggtaactttgggcatcaaaatctacactctgctttctgtttccctatcctgtcctccatggacagacaggagatcaaaccagtcagtcttaaaggaaatcaaccctgaatcaaacctgaatcctcatactcattggaagaattgatgctgaaggtgaagctccagtattttggtcacctgatgtgagaagccgacttattggaaaagtccctggatgctgggaaagattgagggcagaaagagaagagggcatcagaggatgagatggcttggatggcatcactgatgcaacggacatgaacttgagcaaactccgggagacggtgagggatggggaatcccagtgtgctgcagtcccaggggtcgcaaagaataggacacaactggatgaccgaacaacaacatcctgcaggtggtccagactcggccattcctggtgtataactgattttctacacgtatgacgtggtacccatt

SEQ ID NO: 25899 - DNA, 667 bp, Bovine  19866881789382
agatttgagaaaagacttgaaggagatgagagattgaacaaagagactttctagggaagagcattccaggagaggagacatcaggagctaaggctccaagggcaagacaagagcccttctctgttccacagactgtagtctgccaggctcctctgtccatgggattctccaggcaagaatactggagtgggttgccatttccttctccaaaacagaatagcttcatttaaaaaaaaacaaaaccttaaaataagcaaacaatatcttatctaaatgcaaaaatgcattatttatgattggctttcatctatgtaaagctttcaaaatttagttttatatagtatcctttgaatccatcaagaatattaggaagtaagataatcctgaaggcactatcatttataggagaaatatagcattgagaccttgaatattaacaatttatatacctggcattttctttattaaaaatttcttcttagtagctgactagtataatccagtactagttggttgaattaaaatttgtatatattcatgataaactaagtgaagacactttatacctaagcttacattggttcttgaaataaacatgtccaaatatgaatctccaggacaatagttttcacatttggaagaggaattatgttaggcttttcatata

SEQ ID NO: 25900 - DNA, 1290 bp, Bovine  19866882119227
tagaactatttggtgacaaatggagagaggtttttatgtagaatgtgattctgattccctttctcattttattcctttcttttgctctggaagtagaagcttatttattttccccttccattaccacaagtgtggcaagttcaaaatagatggtagcttcttttcccaggattaatttatctttctgaaaatcacccagattgatgcctctggatgtatttgggatgtccatggaaaaatcagatatcaaaatgaaaaaggcataaaatgaacgagcttcttttcatgttgtgacttttaagaatgcaactatgatcagccagttttagaggtagaatcttctaggaatggcagaggagaaaaatatcacagcagaaatgccagtgctctaagtgtatgtattggtagagtgagcagacatcaagggaaaagaagtaaagaatgacaaagtattctgagatttggtttctgtagcgctgaaactgcaaacagatgaaaggacaaaatttcattttttttttctgggtgaatcatgttctctaccgtggctctgtaacaaatcctgcatccaatttctatttgaaataaccacctagtgaggactttgctggtatggtcacttgcttaaggctctcttacatgtagcctgcaggctggtaggaacaagacaggagcagaaaacacaggcagaggggtctctgagacagaaggggcagagccagacagagtgggtagagaatgaagcatttttctgttatcaccttataagaacttacattgctgtaattctgcttttgttgtatctttgaactttattttttatattctgagaaaaatacagtatattttatgtggtatctacaatgattgcaatatgataaatgcactaagaagcagctgttaatatttaatttgggacaaggctaaaaatgtctggcagccaggcttgcctgtctatttagtagtccttttcattatcaaaaatgcttcagtatgggacttccttggtggtccagtggtgaagacttctacttccaatgcagggggtataggttcaatccttggtcaggtagctaagatcccacctgcctcatggccaaaaaaaaaacaaaaaaccataaaacagaaacaatattggaataaattcaataaaacctttaaaaatggtccatgtttaaaaacatctttaaaaaagccctggtttgtacagtaaattatatggtcaccctaggtcaaccttattgattttcaatatggacttgggactcaatgggtgattgttctgctaaa

SEQ ID NO: 25901 - DNA, 699 bp, Bovine  19866882186250
gtaacagataattattacccaagcagatactgccattttaaacagttggatcaatgataatacatgtgtcctctgaaggaaagatgttaaaaggatgaataaactctattagtgattctgcatcctcaataatgtttctatccttaatctttcctcatagaatttattgtctaaactatattaaaaagacataattgcctcaggatggttcttgccaaaagaaaactacaaatacgtatactaccggggattgaagaggaagttctgtctcatttctcactttataatgagaacaatcaaacatgtttttaaagtttaaaatcaaaattatgtattatgtattgttctctatttgcccattatggagaagcttttaaaaagctagaaagccaacaactagctggaatggcttactagggcatgaatttgaaatagatccccaggggataacgaatccagcttatattgtggggaaatgtgaagagtattaattcatattatgctgctttgctattctattaataaatgcaaaaagaaattctcgcggcaacgttctcattttaacatgagcagcaagatattagtacagaagtcagagttcaaaaagttaataataaatctgagtcaagaatgattctgaaaggattcagatgacaaaaggcagtggagagtgaaaattcaaatgtagcaggacattat

SEQ ID NO: 25902 - DNA, 1015 bp, Bovine  19866880395334
atttaagcatctaatctagtaggtgtaccttaggagtctaatgttacttaacaggttgtgggttattcctaattttatttccaaatgccagctcaattgctgaataatccatctttccctctctggatggaaatgcaacctttaaagaaacatgcaattcacacaaacatgaggtaaatcttggaaatttctattattttctaatgatctatctgttgattattatacctgcaatatgctactttaattactatagctttcagtaaatttttatatctggcagaccaagtcctttctcattattcttacaattttcttgcctatcttcatgtatttattcttccaagttaaaagttattatcaagttgtcaaggttttagaaaaaaagtgattttgatgtgagtggcaccatgtttacaagatgatttagtagaaattgacatctttacaatttttagttatcccatccaggaaggcagtattttgtcagcaattcaggttctatattatgcccttcaggaaggttttattgtttatgagccttacatatctctagttatgtctagatattttacagcttggttgctatcctagacatgaactttcaaaattacccctcttaactggttattaatttaaaaaaagaaacctaatgcattatatctggctaccttatgatactcttttggtagtaataattttaacaaattttcagttctcttggaaatttctggtatgtgaatgtaaggtatgtaattactaatcactttatcttttcctgtttaatatatatttcctgtttttcttaacttatcacatttttcaaaaatctgaatgctgaatggctaaaaaagaaagtttaagtgaaaaataaaaatcaaatctcacaaacacatgtggttctccaccaatgcattataacaaaagtattccatggtttaataagatgaatgagtgttggcctccataatctgtgtttaggcagtgccatgcactgctcgggtagggatttctt

SEQ ID NO: 25903 - DNA, 1064 bp, Bovine  19866880449964
ttaaatttccaagcagaaaacatcatgaactgggaactccagggtaccctccagatagtgcattgggtattgcttatcttatcaaagttaaatttgctttcattggggataattcccatttaaatgggtgacctagacaagctggtttaagctgctacaaatgaaaatgcaaataaaacatctgcttctaactaattttcactcattattttaacttccgaagaggaaaggttaggaagtttttagaatcatttgaatgccaattgctttgatcatctatgctgctaggatcccatgaggcaataggctgagtttttaagaggtaaaatacttcagagctttaagacaagtagaatacaaacaagataacaagcttaagagactggacagtccaggtagaaatgtctagaaagcaaatgagaaattggggagatgtgatatattgcagcagagggaggaacgaatgtgaggcataactcaatgtgagagaggcctgaggaggcagaatctcactcgtgtcgaatatatcttctttagagactcagcagtcatgttgaaataagtgagtcaatgcaagaaagcccgttgatttggagggtgcttgacaggtaccagaagccaaggaaatatggaaggacagcccaacctaacgatacgtacatagagaaagcacagcactgttctgatgaggtgggtcacgtcagacactcactgttacttcttggtccttttggcccaggtttccaaaattttcaagtgacatatgaaagtttggaacaatatgtcatctctggaactggcaactctttcatccagtgtagttattccaccaaaataagattggatggagcagagaatcagatatatacgcgctccaatctcaggcctgacatttttgtccatatgactctgggcaacttacttaaaggctctaaagaatattcgtcccattccttagaaagaagcaagtgtctgagaggggagttgttctatgcaaagtgcgtgaaacatagcagttaatcattaaacatggctattggccttattattaattcttctacaaa

SEQ ID NO: 25904 - DNA, 3770 bp, Bovine  19866880509018
ttacatgtaaagtaatgctagacataagctttcatattccaccaacatatcacttaaaacatgacccctttagtagattaaacagaatactaaattgggtactaggagacaaatatagtaactattatacatggggtcattttaatgactgaggaatgaaggagagacacacattattcacatacatccctgggcaagtgaagtttgtttggtcaaataatttaagagacaagattttatgctattgaccctaaagactttagataattacagtctgtttcaacacattagatcaccaatattggcttaattttttaaaagctgtccacagaggaaatattggcagtaactagtagctaatgggctttttctttgcaaaataactagtattggctctattttgtttggcattataaatgttcagtttcagggcaacaattacagacactgagttctgtttttttcattcaaatatgtttttagcttaaaagtgttggttttaccttccaggacgccaaatacaaaaacaccttatagtactgttaagttctttcaagtatttttttcagaattaaatcatagatctcaactcaggagatctacaggacaaggcacacactgactgtcatgattttatcgttcacctagctttacttcttctgtaacttaaaggggaagtctttcccgtcaaccagacaagaaagaaagtgaaagtcgttcagctgtgcccgactctttgagacttcatggactatacgatccatgggattctccaggccagaatactggagtgggtagcctttcccttctctagggaatcttcccaacccagggatcaaacccaggtctccagtgttgcaggtggattctttaccagctgagccacaagggaagccctcaaccagacaaatgtgtcttaaaatataatgggttttagaaaacagagttcttgctcttatagaatattttaaattatgtggaaattctattttaggattgatatacataccgcagacacatatgaataagaaccaatgtatttggtaagaaaactagcatgtccaaattaatactcatcacattgagcgccagtcttgttggggtaccagcagacccttactggagaaaggatagagttcaggatggcaagaatattactataacatcccctagagtttcacagagataacgaagggaagatgacaaatagcctttcaaaactaccaggaaaattaaagaaaaaggacccaatttttaaagaaacataagttctgtgggagtgagaccagatatgaacatgtacaactcacctagaatatgccccaagcttcagctgatggtgaatttatttttaaatcattagattaatacccattttgatcggtataaaaaaaatcagcaaataaacctgttaatgtaatagaggttcacagaattcatctgcttgctacagaagaaaaagaaaagaaattggagcaaaggaggtttttgtctgagattcacttgctagtctacggcttagtagaccagcttcctacaccaaagtaaaattaaatgtgtgtgtgtgtgtgaccacatcgagtgacaaaatggtagctgtcataatgtgccagttaacatgtccaatacgagctgatcgttgagtgtcccctgggaaaagaaagacagaaacatgacaaagaacaaagaacgtggatcaataatgcttggggaaataagacagagaaggttatttacttgcattgatccgtggctgccgccgcgtaaacttggcctgtttttcttttgttaacctttaagcctgagtctactcagaggcaaccagggagccaactaacaggtgtagattaaggatcgaaggaggtcaccgtacctctgtcaccaccaggcacccgtgtaacaacatccctgaagaaatttaaacatcaatagccataataagggcaaatttatcaagcccagccagctctagctgggagcccgcctgcgtccagccggtttgcccttgctaaaagctcaattgatttggacattcttttactagagttgattatcaattgtgacatagcaaatttgttaccttccaagtgctgagcgtatgggggctagtggagtctctgaagtgaaaacacctggagttaagtcacccttcactactgaaaagagggaagctggggatagccttgctctcagaggggccagaaggatccgccttccctttgcatgcagtgcaggctggtcttggagaagaaggtcctcagaagagttgggaagattttttgaccagacagtgtgagtatcgagttgaaaatcagatcatcaagctcttactcatgctcttccctctacctggaaaactcttaaccatccatcctcatttaccaaaaccagacctgtctccaaggtatcatttagaagctctgtcctttgaaatccacaatgtaaaggtcgttactctctacactgataccctggtggattacactaatttctctagtgtctcttctcttcccaatgagatagcaaattccttgaagtcagaaggttggtttacattatttctagatctcctcaatcaccaaccaccacaccacagtttaggaaaacttgctagcaagtgagtaaagaaatgaatgaagaaatgcaatcgttcaaatttagatagtaattttaaactgagtaattaaataaggacctttcagaggcaaaactgctcacttagcccgccatgtcctatagctcgattttctatcaggggctattttccatatctgctacctcttttccttcctctctccagctgtaactatgacctctcctgggcattgggactctcctgaccactgctggtagtcacattgagccatcaataatttatatttcagtgtaatttcagtatcctgtctcttgtgtgtgcatgctaagtcacttcagtcatgtcccaactctttgagactgtccgattctttgagcctgtgtccaactctttgagatgctgtggaccatagcccaccaggctcctctgtccatgggattctccaagcaagaatactggaatgggttgccgtgccctcctccagggggtcttcccaaaccagggattgaacctgcgactcttttgtcttctgcattggcaggcaggttccttaccactagggtcacctgagaagcccagtaatcacagcaatcatgtgatataagaagaccaagtattattacctctcagggaaactgaggctcacagtggttaatgaggagccccaggtcacccagctaagaaatagatatctggggctaaggcatagcctgacgccaaaccctctgctcttacatatcctcttttttttttttcccccttgttgtttgcttaaacaattttattgagatataattcaactcccttcagaatgtacaattcagtggttcttagtaaggtatcctctgtttctaatccatatcctcttcatgctatttcaggcaaaatagaaattacacaaggaaaagtaacacttatccctgcgaaagagtgtagatggaaaaagcaggggaacacacatgcattaaagaaagaacaattgctcactgttccagaacagtgcttctcacctgctttcccacaagacccataagacagactcaaccgagttcaggaaactcactccgacccttccctcctacggtatccataaaggataagtcgtttaaacaatgtgtagccatcccagctttacaaccagccgtcagctgtttcttaccactggctgcggggg

SEQ ID NO: 25905 - DNA, 1308 bp, Bovine  19866880531308
cacgactacgccaggacctttgcatttcctttacccacaactggggagattattaaggagaagaatgattttattttctctaacatattatccccagaattttaccatcgcagatttacagtatctaactttctaaccccttcacaaaagaaatttgagccactgaaatactaacacgtaaggtgctaaggtggaaatcagaacatttttctaccaagaaaggggttcttcaatgccatttggtctgaattgtttgtgcaaggggactagcccatttgtaattgactggttggaaaacaatctgaaattaatgtagaattatgattctaattcatgtctgattaaatcaaattttaggagcaaagaaagataatcatttccgatgggggatctttgaaattcagtctgtcctcctcagtcaagattcagctctgatctcataattaacatctttctcagaagttcagcattcctggtgccaggagaaacaaactgtgtactcttcagaaaaaaaatgcattctcttcctggatatagctctctgtctgtctctgtttctctctatttcacctttaaattttaaagtgaccatagtgtatggaataggacacattctgattttatatgtagactggctcatttgtcactaccaactgtaatctgccagtgccactgataataattgtgaacatttaaatgacaagaaatttggtcaaaaatagaaactccctattaaacacatttaattgaggaaaatcctgcttaatctactccattttatttttaagttgctgtttcctttccttttccctcataaataagaaaactttggctcggaaacttggctcatgagattgtgaagagagtttatcctacacggaactcaacacacgctgatcagggaatctcttttgtctgaggactttctttaggaaagaagaattggcttcttaactgctttcaaagtagccttgacaagcttctttgtgtcactgtatctttctttttgagctgaaggtttttcaccagcccttattatagatgacctaacatttcactccggggctgataccagaatccttttcctttagttccaggcaaggttactgccatttcctctgtctctccttcctgaatttacctaaactgaagttccagccttttgttgaaatgcttttctcccttccgctcttgtgtgccctgtgtcacagtatcagcaaaagtttgcaaccagcttcccttcgctgtggacacaggaaggggaagggaagaggagagaagttactgatctgcttctagaggtcaagg

SEQ ID NO: 25906 - DNA, 1161 bp, Bovine  19866880540233
tcttaactctttctgtacatatgaagctgaagaaatattagggaaagcacaatacaacgtgttatctatggatgcactataatgagagcaaggtaagaaaagatgatgctgtgagatagtgtcaggatcgtcgaacattgccataggaaccacagagtagtaggaagaacttgaaatagttcaaggacctgctttttctgttgataacttccccaagtcatccaggagttactgcaaatatttacaggggagaaagggctgcccaggtggctcagacagtaaagaatctgcctgtaatccaagagaccctggagaagggaatggctacccactccagtattcttgcctggaaaattccggaagagattctcatgggcagaggagccaggggggctatatatagtccatggggtcacaaagcgtcagacacaactgagtgactaagaacgaacagggaagaaaatggagacagaatattatcttctctaccatattggcccttgatccttgatgaatagaaccaccagctagtcaataatgacctgtgtctaggatttctacttttgttaaaacacacactcatccacatcatggtttaattcagcagaggtgatgaagagaagttgattttctttcattctaacttctaagtctcaaaaaaaaaaaaaaaaacctgtgttttcctaaaagttcataacagctctgaaatggactttattttctatacaaatttccccctttggggtttttctgtccttaagcatttcataagcagaatgctgatcttgctattggcctgtaaccctggcatttggccagtgattgctatttaggggacagaggacaaaattctgacctcacaggtctcccaaggtgtgagatttcttgccctctgagttccaaggtgaaactgttaggaagagtcattgtaaaaaggagacaatcgtactcacatccaggtgagttcatttttcttgtgaacttttcacctaggccccaattagtatcctattaacctccttaaatatggaattgctaggatcttagaatactacaaaatggactattagcgagcccatttcctggctccgtcagatgaaaatgccaaagtaggtcatacaacagaattaccttgattaatttcagctctctcccatgggg

SEQ ID NO: 25907 - DNA, 1395 bp, Bovine  19866880599274
atggggatttagagatgaataatgtacccaaggtgtctgtctcatgattctgctcactcattaagtatgatatactgaaattctcagagaaatgctaaaatccccttatttatgtttttatattcctcagccaaacaatgttctcaaattaagatcactagatcggtttctttaattaaaggttaaaaacctgtttcaatttaggtgcagtcgattagagacagaatatgaggaaaatgcatggctccatatccacgaaaagactttccccaagtacttttaatacatcttacttggaacctagaattccttttcctctgggaataataccagaatgagagcagctaatacactgagtgtgtttggtgttcataggaacctatcgcttatgtattttttattggcaataatcacgtgtgtatatttggacatgcaaatgtattcaaatcatgctttgtgtcaaaaaaaattaatagtatagtcaattagggtagtttaagtttttcttttcttacttatttctaaaggcacatagagcactaaaaatacagatgtgtgcccagaggttccaggcagcttatgtttcagcatgaaattcgatatttgatggtatattattttctcattcccatcaacattttttgcatgaactgcattatgcatagcctaggatttggggaggaggtgtacaaattaaatctcattgctgtgaacaatttgcttccaggtacaatgccaaaaaaagaaaaaaaaaaggacttttgcagtaaagtcatttcaatgtaaatctattaaaatctattgtagtaaagagctttgaaaaactaaacttttttaaaacattattttgaatcaaatacaatattttaaaataaacaaatatggacaagctctgtcttggacatattactgcatatgtaggattttcttatttcaaaagaatgggaccttttttgtaaatgctcttttctaaaatgtgggagaacaatgtccgttccaaagtagattttgcacagtctctgcattctcaaaattattaacttggtgaatcagtgcatcccttcacagatattgtgaggaagactggtcccactccctgtccaaagtttcacacaagattcattagtaaattttttattttttagatgaaatcaataaacccagtcaatgctcaattgtcttatgtaagatgtatgatacaaacaattataacccccccaaaaaaagtggtatatttcattacagtttacacaaaggagtttggtccatacttctaccacatatacacgatacgcattttgtaactgaacagttctcctctccaaaatcaccataataattttttagatgtataattagagcacctgcctcaaattcttgaaaggtttttagttc

SEQ ID NO: 25908 - DNA, 1201 bp, Bovine  19866880606524
aaatagtcctttctccctgctactcagatcaatgattaaccacttaaatgacaaggataatgacagcattttggaaggcaggttaaagcttatcattttgatacaaagcaagagagagattgttgattgtacaaaaacaggttagtggtttctcttcaagtatttctactcagatttgcatttaaacttgactctagaaatggatcgtgaatgaactgaaaatgcaatttgctcttagaagttcttcatttgggtctttgttttaaaagcagaaggggccctattctgtccctttttgggggaggtacttggactctttcaatgggaatcttctcatttctcctgaggctatagtttattgactttaaagagcagtagtttaattaacagaagaaatgaagcctattgcataattaactagacatttacctaaaatcaataatctaattgccacacctacagaggggataatgtttatcctattgaaaacaattcatttgtatctacatgttaacaaggtgattggtggtttgtttaacagactaacctgatctgtaaagtgataatttattgaacaatcaattaatctttttagtactacaaatataaacaagcaaggaagagccacagtgtgtctgcttatgaaaggtcaagtttaacagacccccaccttgagctctttctcaatcagcacaaagatgtaaaggcaatgaatataaattttagtttcacactatccccttggacctgacactttcacagggagacagtaacatgcaaaatatttgcaaatacataaagtagtttagacctgtatcctgtctttacaatgaattcttactctaaattacatttaccttacgacagatacacatcagcctgtcccaatgattctggtatacccagctgtatattcttacatattctctagacttatagctcaacagaaggaagaattgtttcctatctagaaaaacagattattacatttatctaagactatgggtcaatgtcaaaaagttttaagttgaattaagtagctcacagtctgcatgcttgtccaaagtttatttcagttttttcatcctgaataattgaatggtgaggtttcccaagatgtaaggtactccttgttttataactgttttcaaagcatttcatttcttaaaatagtcatagcctagtatgaattctcttgcaa

SEQ ID NO: 25909 - DNA, 1306 bp, Bovine  19866880625794
tagacttcggagcttttgttttttcctttgaagatttagatcctgttccctgtaaactgccaacaatacacagtatgggatctctgaatactcagagaagacacatgaattgtactcttactgagcgatccctgcacttatttatctgtcagtatgtcactgcgcgtttgaaacatcagctctgagccaaagtttcagaggctcccgcatgcttcccaatggttttattaaaccatcagtgcatgttctttctctactttctgtgtagctcccttttaaaaatgtcactgtcgtgattaattttctgttccctttcacgttcagatgacatttggaaaacaattctctctggagaaccaacttccccgattcctgaccactccatggcacttgaagtcaagatgaaaattagactcccttcagaatctccagactcagaaaagggtaagatgctttaattaccgtgttgtgagtaccttgtaatcacatgactagcactatggtcatgtgttaacaaagtgagagaacattgaaaacaacgctaaatggtatgttcgtggctctttacaagaagaatcactctcctctccctattgtgggagctatagaattgaatgcaatttcttctttgaatgtaaaatagaattgtactgtaaatatgcatatctggtgaaatattttggaattttcactggttgcccttactcctacctcccacccctctcaaggttatgatttaaccctgaggctggaatctgaatagaggagaaaatttcatgagggatattaaagaaaagtgtgatcctgtaaggcaagggagggaagataggagagatcagaaggaaaggggattgggcattgatatcctaatcttccttttcctaaaaaaaacaaaaaaaaacaatggtaaaagtgttagtcaatcagtcgtgtccacgtctgactctttgtgaccccatggactatagcctgccagacgcctttacacttaagccagaaatggaagtttatatgataaattgagcagaatatcaaggatggaggtccttttcccagctcagtgtctggacctggtgagaggttattcagagccttcacacacagcatctcagggctgtcatttcacagtgaactcggtggtagcagagttagagaggaggagggcacggtttacttttcccaccctaccttcccacacacctggaatggacctaatctagagaagcacccacacgcccccggagataaactgagggacagtcagcctgctgtgcggtgctctgggactccaaggccatgctgcaac

SEQ ID NO: 25910 - DNA, 2106 bp, Bovine  19866880649614
aatagttctcaaaatatcatgaatcttttggagagaagatcatgcatggtggatttaaaagacatttgagacagaccctagaaagggtcatactgagtgaaggaagccagacagagaaggagaaatatcaagtaacatcccttatatgtggaatctaaaagaaatgatatggatgaacttacgaaacagaaagagattcatagacttagaaaaacgaacctgtggctgctgaggggaagagatagtgggggacattggctaggtcatggtcacattgctgcatttaaaatggataaccaacaaagaccttttgtacagcacaggaaactctgctcagtgttacgtgccagcctggatgggagaggggtttggaggagaatggatacatgtatgtgtatggctgagtccctttgctgttcactcaaaactaccacaatattgttcattggctagaccccagtacaaaatgattttggtgttaaaaaataggaataaagacatttgaaagcattctgggtgttccataatgaggagctatttggaccagagcatatatctcagggaggttacttgttcagttactactcctacgtgggaagtttgacttagtatcttgttcctgcttctcttgaggttacctggaaaaagagacttcacttcgcttttaaaaattttatttaacaagctttctccatgtgccagcctgttttctaagcatgttcaagcattaactcttttaattgtcgtgacttagggacccttaccatctcagtgtaacaggtggggaaactgagaaattgaacgatgcggccaagactgcaaggcttatgaaaaccacagccagagtttaaaccttcactgtgcagctccagatatgtacctgccttccatgccgtgttccttcccctctgctcctgggtcttcaaatcagaaactcatatggcataggtctctctagatgggagtttaaaaactcagaagctagaagacaggagtgtagagtggaagcctaaattaggaacagaaactccaaaactacagggcaataaagactatggtgaaatggagaaaaactgacctatctacacagggaatcgctgtttttctctagatacacttccactggaatggaagctccatgaggacagtgactttttgtttgtagttgtttcctccactgatttatgcccatcacctaaatggattatccaggaaacagcatcactcaagaaatatttgctgaataaataaatgtagaatgaaagaatgttaatcaagtataactaggttcttcattttttaaaaaaataaaattctgggtatccagaatttatatgaaatttctgtatttatgtattaatccattaaaaacaaacagctctgtggaaaatcatagtatgctcgtggactgggtttgaacaatgagaaggatttggcccttgggtggctaatttgagacctaatcctgcagtaaaaacccattaactctttgcaaatggcagacacttgaaatggtgggatactgatttaagcattgttctggaattcgatttaacactggagaaaatctccagataccaatttaaaaaatccatgcagagtgcatgattgggtggaaaaaaatattgaagctgtgtagctgcatttccaagttataattccagttcttgtacggctctgcttaactttaatttgtttggcatagaaaactacttccatgcctttgattatataagtagtttagaagatatatttaaagagtactaatatcccttgagctgtatcatcctctttttaatttcaaatgccagtggcaagggaaggaagccagtttctgcctgaaacaccaagttctagaagcagaactggaatgtttggtgcaatttatcaccccaatccaaccagcaggagactgcacagccttgactatttttctaggtcaagtattttgacagtgtccacagccttgaactttagagttgcagaggaacaaaacaaaaaattccctagaagctgtgggtttacttcatataaaagtaatggcaattgactaataaaccaaataagcatgaaagggaaaaaagaacatccaacttcagatgaacg

SEQ ID NO: 25911 - DNA, 1603 bp, Bovine  19866880686501
atgttggtttttttaaggtatattttcaagattctttatcatggctatccctattttaaaacaactctcatctaaacacagagaatagccatactattcaaagaaatagggactgggtgaagttttcctggaaaggatgtgtcagtttaagcaataaatagaattttagcctgtttgttactgtttgttcagcacagctgactaacaatggaagatttagaattagccattcatatgaaataattgattttggcatacatgttaagcacagggagaaggaaacaatcaagatagaacgtcttctaagaagacattccttagaaaattgttttgcaaattttgaaagaggtgttggcagctttttaatgggtgctaaagataggagtgtcagaatccacttctcctaggctcagaacattattatctgcaaaaacctgggttaatattaagaaactcacagtgaaaattttgtttctctgatcatagaactgtgtacctttcgctctggtttcattttcttacttcaatgccaagagcagaggagagaacccgatatgcaaattgaaaccaaaacataaacaaggattcagtcccagggtacaatcctcagaggaaaaaaggaagtttatgaactctacgttcagtggaagcaggctacaaaagagtttagttgtccttctagaaaacaaaaattaatttgctttggccaaattaaaattaattaaaattatgcaatgttgcccttgtgttaattttaacggtgaggttgttgtgatttaaggctacaattagttctagtgtttgaaagagaagctctgtaatcgagacaggacattttaataatcctggttataaacatttaatacatcatctttagggactcacaaacacattgtaattaacttttacaactgaaataaatcagattgcattagcatattgcaaaggaaaaaatcatttacatgattgaaaacagcttcagaaaattatgtataacaggcttcatgcaaacaccagcataacttttaccaggtttcttatatggggattctttttaacaagtacaggttaggattcttcaactaattataactttcaccataaaaggaaatatcctggttttgaagaagcagcaagagtcattctctggtcagtagaactatgtccagctttattgtaaactaattaggaactactcaaataaaaatatgatgacttggtctgtagctacttctatgctacaagcaagtaatttggtcaggagaaaagaaattttattcatgtgttattcacctgtctaatgctaaaatctttagcaggaagagagatgctgatattggacaaatagagtgttcctttgtccagcactcaatctgcttcatagaattaccaatgccttcctgactggttgagctgtgactgacatgcaagctgtgagagtttgcatgttcactttggaactgagccaatagaacaagttcttattaaatattggctattatttttaccagagatttcaggtcagttgtaccagttggatgccccattcatccttgggctttggtcaattattttgtctactaagtgatcactggggcctggt

SEQ ID NO: 25912 - DNA, 1088 bp, Bovine  19866880743284
cgagtcctgagtacatttttagcataaaggcctcagtgtgcttgggaaggggcagggctgcctcacccagaggcccggtacacgctgacctgctcactagccttggccagttggctgcttggcacttttcccagcagtcattgctctccaagcacgacatctatcacttctgcagtcagaaagatggcacttacctgatgggtgggcagaagcatcttctcgtaccatatgctgggaattgtcaggagctattcatgccaagactggcaactttgaatgccaggaaatgggcctttcccaaagcctgccagaaaaatacaaataaaaattttaaaagaaccaattttcacatatcaaattttgtgttggggagttgtgtaacaagctttgcagaccaggaaagtatggacatttttctggcgtaggcacactgaacacaaaaaaagaagagcagttctcatttgtgaaacgaaaagagatttaaaaaaaaatctctgacctacacaaacattaggttagaccttgcccagtacagaggacttccctggtggcttagatggtaaagaatcttcttgcaatgaagagacctaggttcaatccctggggcgggaagattccctggatctggcaacccactccagtattcttgcctggaaaatcccatggacagaggaagcctggtgggctaaagtccatggggtctcaaagagtcagacacaactgagcgattaacacatacacaccatcccatgcagagtgagaagagaggcttacctatccaatgtcacttaatgaacattgaaagccccacctgcggtgaaagtggaatggtcatcactggagtccttttggggaggttaaggcattacctaatgaacggtcctgcagacttcctatctgatcctttgcaggacagaacaacagtaagtcattgtctccagttatcatatttgtgtagatgagctgattagatgtagcaggtaggtatgttttgatgacatcacacataatagggaaatatttggggcctcaagtatcacttggagaagaaaatggcaacccactccagtactattgcctggagaatc

SEQ ID NO: 25913 - DNA, 1375 bp, Bovine  19866880824774
ttgtttgcacatgcattcacagacacacacatatactcttgctcagatacaccaactgcaatagcatttttaattgaagtgcataaatttggactgctaaatctattaacgatttgttttaattaggaacccagctgcttcctgagattttgcagtctgggtttcagaacttttgccatctgaaaatgagtctcaagtgggttgcttcagtctttcagatcagcatttttaaagacttgttggaagagggaaactgcaaatgctctctgctgtaaaattacagctccctttgtccttgggtgaggacgggactgctttgttcgtgtagccagcgccctgcccctgacctctcacgtgggcatgttaagtctagcaggctgcctgatccttggaccgccttgctttcagatcttgccaacttggctcacagagaagcagcatcatggtgattttgaggttccctacttgtcccactatcagtagggggagctgtgacttaattgaggttgaaagcattgattattattttttttttcaatacttcactagttgaaaagatagattctgtggtatttcagttcagtgaagtagggtctgaggagcattcactttttttttttacctcttttctggtgttcagctaatgtcagcagcatgtcttgttatttgggtaacattaaatggagtataatgctttctgttcttcagtcagtatggaagccattcattagtctcttcgctcactcattcatttgttcacgtgtttgtttaatccttattgattgccgactatgtaaaaatgcaccgtgctagaaataggaagattaccaagacagcacttatgcctttcaggagtttatagtctaacacatgaaactcagaaataataattactgcagagcataatcagcactaatagaagtatgtacaaagtgccctggggcaacagaatcactggtgtgcaaggaagcaggtcaggaaagactttgtgtcagtggtaccaggaatgctgtcactaaatacgtgttccatgaatattgataaaatgatggatgaaataaaggaatggatggagaggaaaatgagtggattggaaagtggagtggagaaaaccaagttgtcccagcaaagtggtgttaaaaaaaaaaaaagcttaatggaagagtgtgatgaagctggaaactatgagaaacctgatatgtttagagtggagaaccatggaaagaggcttgccaagagaaaaaaaaaaaaaaggaaagttttggtggtattctaaagaatttgcattgacccccaagaagtcactggatcagaggagagatgaagtcagcatctgtattataagaaggtaatttgggcaatgatctacatgatg

SEQ ID NO: 25914 - DNA, 971 bp, Bovine  19866880850012
aaaataagttgtagttcctaatacacattcaatattaaataagcatattcttgtttagtagaagaacaaagatgtggtaaaactaaacagatagcatcattaaatacattgcataacacttaatctctcctttcctgctatgtatttgagttaatatgaacatttgtcaattgcaccacgttttgaaatggaattggtatcttctttcccacatgggaacagaatttctaggtcaataggcccttaaatgtcatgaattgcaatatagatggcagatgacacttgtcaaagactcggtgatcagttcagatacaaatctgacttgaggactgaggagcccaaatcaaatcgatgtacgagataaagtccagatttagcatggtgacatggtgagtggtacctttcatgggacaaagccgcaggagctccactgagactgacactcttaggctttctcatttctcatcaagccagggttggatcacttctctttttctagcactgtgtctgctagactttccattaggcagctgggcagggggaaaaaaggaaggagccaacataaactacctctcaaaattctgtgacttttgctttctgatacaatttttcacacaaagggatgttggatgccggtggagaccaagcagtgagaaacctacagaaacaaatctctggtatatctataagcaaaatgggttcaaatgcagatgtagaggaacaactctagtgagccatcaatcactgagaacaccacggtaggtgacgtgttaagttatgaaaggagggctggataaaaaggtatgagcctgcagaacacaggagccatctttcccaagtgataataactatgtttagggagcactcactagatgtcatacataagactttatatcattaataagacttttatatttattatctcaaaacatatttacatagactccctaagttaggcattgttactattt

SEQ ID NO: 25915 - DNA, 1169 bp, Bovine  19866880856132
tccattgtaaaggagatcagccctgggatttctttggagggaatgatgctaaagctgaaactccaggtactttggccccctcatgtgaagagttgactcattggagaagactctgatgctgggagggattgggggcaggaggagaaggggacgatagaggatgagatggctggatggcatcactgactcgatggacgtgagtttcagtgagctccaggagttggtgatggacagggaggcctggtgtgctgtgattcatggagtcggacacgactgagcgactgaactgaactgaactagatagtatttagggtttccctggtggctcaggtaataaagaatctgcctgcaatgtaggagacccacgttcaatccctgggtctggaagatcccctggggaagggaatggcaactcactccagtattcttgcctggagaatccgatggacagagaagcttggtgggctaaagtccatgggatcaaaagtgtaagacacaactgagcgactaagcacacacacacaatctaggtagtatttattttgttatgcattgatatttatgtcaaaaacatttgtaatgcatacatgctaaataaataaaacatgcttgttattagatcaaaactgtcctcagtaaggaaacatgctttcacttgaccaaagatgtttaatgatacttcagaactgaattaatgattcacgaaatccttaaaccctgagacgttctccagtgagcaagtttccttagtttcacgtcttttgtcactgaaagatccacatatacacaccaagactatacgtgagacaaaacacacgggagggtctttttcacaccgtgttgtattcataaaatcataagatttgtgaaaccaagttttcaaatgattgctgttaatttcaaattgcctttcccattacccatttgcctcatttgtgactctgctgcaaacttgccagaataagaacagtaggaacaactacaataaaaagaattttgatggcccagcagaaggctcagtcaattctaacaggtatctgggcaatttcaaatataatcagtgaattaaaatctaggaaacattttgttcagaaactagaagattgcttttatttattggtaaatcaaaatgaacttctgatttttccaacacattcaactatggatat

SEQ ID NO: 25916 - DNA, 1480 bp, Bovine  19866880879484
acatttttacaggcgtttctgtttataatgtatttctggggttgttaataaaggaatccccatgctgactctaaaaagaatatcaggattatgcatttctccaaaaagagaggaaaggaaaccttagagactttaatttgtccaggttagaatttagacttcctgactgtccactctgtgctcaggatggatctgtcagtgttcaccaacttctgcccagaaatgtgtggaaccgtcttactgaggacaggctctgggtgttgaaatgagttcatttaggaatttgacatcaaatgcccttcagttcatgcacggggcagccatggcatcatcttttgtttccgtaaggaaaacaacaacaaaaaaggctgtctctgtgtgtaattattaatacttggggaaggtgtactggacagagacaaatattctgatgcatagtatagttttttctgtatctcaataaaatggaagaaaacatgatctagtggaattgtgacctggatttagggctgggttcaaattccagacaaattacttaaaagctgtgtgacctcgaacaatctatggaacctctttgaacatccatttctttagaggtaaaatagagattttaaaagatatccctatctcggtcagcatgctccatggattagagataataaatgggaagtgcgtggtccttcacagtttgggtgctcaaccaatagaatcacacagcatcattcaccactcgagtgatggtagaccagttgctgagcaaagaagttgattgaccctccttgctaagccaggagatgtaaggtatgtttaactcaccgctcctgtggaatgtcaggagcctctgcttgaaataagcaaattcaatgatcttgtgaggtagtggtccagggcaattcacttgatacggagagctatgtagtgaacacattagaaccgtttgcctatccagggacacagttagggcgagagatgaagaatgcacaacaaactccacaggtttcatcaatatatcacctctgagagcaaaccacaaagccagcctgaaagcacagggtggggatgggcagagagagagccctgggcatctacggctgactctggaggtcacgtggccctgacacataacttctactgagttgactatatctcacttcctttaagtgcctgtctctcatgctcactttcaaggacttggccaatctccttttgtaaatagaacaatgctttatatttctctattactctggagtgactctatcaataatgcaggaaacgcatctgtccagcacaatgagattatttttctgatttcggttgacagttatggtaatagtttggcaaacaatctactccaccatcaatggccgcagattacagctgtttttaaaaacctcagccccttctggaaacttggaagatggattgcacgttgagagggagacggaaagacatgccatgagcctttagggcagggaaaagt

SEQ ID NO: 25917 - DNA, 1165 bp, Bovine  19866880890167
aaatttaaatacctcgaccacgttagggctcacacacaatcccatcagcgcttaagttgaaattcacaactattccttctcttgctcaatcagtaatgagtacatttgatgaagcattccagggtcagggaacacacgttagtgatctaacttaacccgttgattgctgggccacaacggatcaaggcagaatttgattaaattgtaacaataatttccagtagcaccaaagtaaaagctttttctttttttatttaactattgcaattcccacaagctacgggaaagggatgacaataaaatagttttagattaggttcagcattctttgggaattgctactatacgtctctatgtcctacaaaataacctgtttaattctcctccaactatggccacgtttactctgttattaagaattgttgtgttctctaatttgagggacaccgaacgcattatttttgtttgagcaactaccttaattatgttatactttcctgacttgtgaacatattcccggcaaagaggcatccccaggtagtgatctgactgtctatagtatattctattgtagttgttggctgcccccggagtctcttggatattgactgtgtatgcgtgtgtgtgtttgtgcactttgatgctcggttgtgtctgactcattgcaaccccatggatggtatccccccagcctttctgtccatggggattctccaggcaaaagtgcttgtgacgcccttctccaggggatctttccaacccagggatcaaacccaggtctcccccattgcaggtggattctttaccatctgagccaacagggaagcccaagaatactggagtggttggcctgtcccttcttcagtgaatcttcctggctcaggtatcaaaccatggtctcctgcattgcaagcggattctttagcagctgagctaccagggcagcccaagaatactggagtggttggcctgtcccttcttcagtgaatcttcctgtcccttcttcagtgaattcttcaggaatcaaatcagggtctcctgcattgcaagcggattctttagcagctgagctaccagggcagccccatttatttttgtacgttaaagcaatgcaacacacgttaccatctgacataacagtaaaagcctcaaaaatccaattcag

SEQ ID NO: 25918 - DNA, 742 bp, Bovine  19866880909569
ccctttgatgtattaaaatatttaatcaaaatcaaatgctgctgcccctatttatacaagtgctttattatcctgtacattataccacaacctgcctggttcttaatgtgacctaaagagctagtcggcatttattacaaatgcgaggcagtaagcttctggctgagcaattaatcactgacagcaaggaatttcttctcttcaggtggggaacccatccaaaaacgaagaaaaataatcgggctaattaattcttatctgcaaagagcaattagataaatgacctcaaagaaagacttgtcacccctagtgagacactgactttctaaatagaatgtgtctgagcctcttttcactgagcaagtgatactgtgaaatggagatgacagaaaggagagggagggaaatgataggggagcaggttaattagaagaaaggctgaggagagagaggcagagacagagacagcaatggagagagacggagagatccggcttgatcccgtgtcctgtctctgcagactgatagatggttaacaagatgaagggaatgttcctgttgccaaacgcaggggacctcctgaggccaggccttgcttcctgccagtgagctgcacttccttcctgtacatactgctgctcgtggaagctacaaaatgctgttagcgctgacctttggtttcttcctttctagtttcttggttgggttttgattctctggtcatatccatgcctggcaatgg

SEQ ID NO: 25919 - DNA, 1425 bp, Bovine  19866880951045
aaaaagtgtgcaatgattttgagtcaaattgctcacttctgtcagatcatttttaaagcactgttttgtcaccttgaaaatataattacaattacttagtgaaaaggaaacaaacgccaggacttccctagtggtccagtggttaagactggtgtgtccactgcaggggcaggggttctgtccctaattggagaattattaataagatccagcatgccatgcgatgtggccatggcatgagataaaaataactgtacattttttaaaaggaaagcaaatgcctcttagaagcttaataaaaagaaaaaaaaaaaaaacaccctctttaatgaactaaaaaaaggggaggaaaaagaataattggaacctacattactttggatacaacgaatattactggcacaaaagggacaaggcaggaatcagcacaaaaccctacacatactaaaaaataccaaaatttccagccttgttcatgtaccatgttctctcattctgaaattctccaactcagttgtaatcaatttcagcttgtaatgatccagcagcttaagatctccataacagtttagcctactgctgttcagctgcctgtaacttctggaaaggaagacgttccagtaagacacaaagtaaggagggagtggatggcaggaggtcctcaggataggggagaagagtggggagaaacaatcagactctggaaatgctccaagtaataggtgatttcattagtttctaactcaggggtgactttaaaaatatttaacaactaatgggtgtctcagacagtaaagcatctgcctacaatgtgggagacccgggttggatccctgggttgggaagatcctttggagaaggaacccactccagtactcttgcctacaaaatcccatggacagaggagcgtggtaggctacagtccatggggttgtaaagagtcggacacaactgaacgacttcactttcactttcactttcaacaactagtcgggtacagttcagtttagttcagttcagttgctcagtcatgtccgattctttgcaaccccatgaactgtagcacgccaggcctccctgtccatcaccaactcccagagttcacccaaactcatgtgcatcgaatcggtgatgccattcagccatctcatcctctgtcgtcgccttctcctcctgcccccaatccctcccagcatcagtcttttccaatgagtgaactcttcgcatgaggtggccaaagtattagagtttcagcctcagcatcagtccttccaattaacacccatgactggtctcctttaggatggattggttggatctccttgcagtccaagggactctcaagagtcttctccaacactacagttcaaaagcaccaattctttggcactcaactttcttcacagtccaactctcacaaccata

SEQ ID NO: 25920 - DNA, 959 bp, Bovine  19866880965624
ccttgaagtttcccataaaatgttttatcttatgaaaaaagttcttaaccttgtggcggggcgaggggaactttcatgcttttaagatcatccctctcatgattggaattctaatacaaataaaactgtttttaaaatactagttcttgatacaaaaataaaaatagaaataactagaggcttttatggaagtgtctatcttttaaaatctggagacaatttcaagttcaaattcctctcctaaatctcaatcaacataatacatttgttggtctaattatttgatgtactattctgagaagaacttagaaaaagaactgcagggccgatatccaaaattctctggaataatctttaaaagttaaagtcagatattattgaaaccaactagattaaatgttaaagcaaacaaaatttcatctacctgtccattgatttacgctacgtgtattgttttctttcttttcaccaacaatgaaaactttgattgtgctccataatgttgcaagaaaaacttcgctgctgccaacagtttcttctaagtcagagaacctctattgtctttgctctggtaataaatgataataattaaaggcaaatacacaataattagtcacactaggtttatccatctggtctacctgtatcctatcactgtgtctttgaaacagatgacaagcaacatattgcagcacatcccactaatgggtctaagtggaaaatgaggaggtaaagaggtcattggaaaaaaaggtcagcagcaaagactaagagcattattcctttttaaaaatttaaagtggtcattgttcatttagctctgtatcctcccaaaacacatatgattccacaagatgatagtgaactattaagatacttagcaagcctagggaggtctatagattctattgatttcattgttgtttaatgttaaatttcattgtgcttaatcacaagaa

SEQ ID NO: 25921 - DNA, 1105 bp, Bovine  19866880973392
aatgcaggagacaagagacgtgggttcaatccgtggattgggaagattccttggagaagggcacagcaacccactccaggattcttgcctggagaatcccatggacagaggagcctgggggactacagttcataggacacgagtcagacacgactgaagcgatttagcacacacacacaattttccattttgcattactccatatatcttatatatgggcttcccagatggctcagtggtaaagaatccaacgcaggagactcaggttcgatccctgagtcaagaagatcctctggagtagaaaatggcaacccactctaatattcttgcttggaaaataccatggatagaggagtctggtgggctacagtccatggggtcgcaaaagtgtcagacacgtctgagtgacggagcatgcacacacactaaaatgaaccgtctgaactaacaaaattaagaaaaactgttttcattctccaaagcctggcataacccaggctctatctgaagagactgagccactgaacttccatcatcatggtttttgcaacctccagaatggccaaactccaaatatggagggaaaaaaaaatactcccttctgtgtgtgactaaattttccacatatctctatctggcttataaatatcacaggcagtcagtgagttactgccaggctgaatgatcctctttacaagcctctttctaggtttttgagtaaaggtttcccttattaattttccagcccgcattcacttagcatttgctttgaggcataattgacaggcagggtgacacccgcctaagagaaagccataaatcagaaataatttccaaaattggctgaggggctgaagtgttgaataggcaaatacaggtaaaaatctctttattagggctgacaaggacagcaaatgtcagcgaagtgtttcctaatgtaccgggcgagattaatttgggggcccttcctgagccgatggtgtgttgcgcgttctctaacaagtcacctcttggggctctgaaggaggagagttgttggggctgtaatgaagaaagagccaagtccggaaggctgggagagccactcccgctgcatcgccctcct

SEQ ID NO: 25922 - DNA, 1507 bp, Bovine  19866881053549
ttctattcctgggttggaaagatttccctagagaaggaaatggcaacccactccagtgttcttgcctggatgatcccagggacgggggagcctcgtgggctgccgtctatggggtcacacagagtcggacacgactgagcaactgacacaactgagcgactgagcatgcgccagctgcatcactgctgcttttacacgtgcttccagacatcctgggcctgaaataaagataccgaatactgtatggatgcagtcctgtagggtacacagaagcacagccacttgcagaggatgcacacatgtgacaatgtacgccacgcatgtgaactagcttacgtgactggaaatgcaaacacattcacatctttgaaattcacagcttgtagggaacttactgtttactatctgatattttaccaaacttttttttttccccaagcctgaatttaactacattctatacattgagactggaaaaggcaatggcaccccactccagtactcttgcctggaaaatcccatggacggaggagcctggaaggctgcagtccatggggtcgctgatggttgaacacaactgagcaacttccctttcacttttcactttgatgaattggagaaggaaatggcaacccactccagtgttcttgcctggagaatcccagggacagggaagcctggtgggctgccgtctatgaggtcgcacagagtcggacacgactgaagtgacttagcagaagcagcagcagcatacattgagacagtagttctgataagttttggaataatgttgtttaatatgtatccttattttaagatttccaaaacaatagtatttggaaaatctggatataaagtctacatttctaccatctataaggctgctatatacaagcagtcattcaagttctctgagtcacaatttccttacagtgaacctaggatagtagcagcatctaattctcagacttacagtcagggctctaagtatgccctagtctatttcactacaacctatgaaatttgagctgtcctaattttaacaatgaaaactcaagggtaatctcacagttccccaaatatattctctgattcttgagacaatcacttctacccatttttgctaaaatcctagatgttgttatctccaaatttaaataatatgctatttctatttcttcactgagcaacttgaatttatctattgaattcctgttttgatagataagaatttcatgcttcccactttcagtttatctttctgtaattctattggacacaattaaacctttacatcttgttctagctgctttttctttctccttttcacctatcaactcagtcagatcactattattttaaatttattaatattaataatgtcatgatgttataaaaatcattacagattattttttcaaatgaaaagttttttcatagggaatggactaattcaaatatattcatttatatgtcataaaatagtcacagattactatatttaatt

SEQ ID NO: 25923 - DNA, 763 bp, Bovine  19866881081370
gttgcatctatatttttgctgataactgacctgtgtaaaatattcccttgaagcctccattggttttgcagaatatttcaagtaaatagaaatgaaagcacacatttttgttcacttacccatattagaggttacaggcattagtaccgctttacaaacgagaaaactgcagtgagaaaccagtaagaggctatcccataatcaagacagggacgtgctggattagaggcttagaatttacagttctgatttcatgtcaaaggattaattccatcttcttgcactaaaccaggaaagaaggaaaaggtcagttccttgctttcaaagtaataattacgtaggaggagaatcaaaatggaagcgaaaaggagatgaacttgatgtaatgtcaatgccacttaaatattctctaaatgatgtcgactttagcaaactccattcccctgggctaaatctgaaaacagacttaagaaagaaggttactgtgagaactttaatgagtagaaacctctttgatcctataaaagcaaaagaatctatcacgttctaatcgagtttcagtcattggaccataaagacatctctgggtgtaaatgtgagcatgaaacagaaatactccagaataactctaagtagaaaaatacacccattttgactcagacatgatcctctctctgccccacattttcacattgtgaaattgcctacctttcatagtgaaacaataaaacaaagagttaaatgactacaacttgctggtaat

SEQ ID NO: 25924 - DNA, 1922 bp, Bovine  19866881085767
attaagtaatgactgcctggacttttaactgccctgcatttgcagctaaatttgatgctaagttggatacaggcagctctagttatctattcccactcatttgtccctccggatgcctcatttagaaaatatcaatgaacagttaccatctggtttcataaagaaaatgtctgcaaattcttagttgattctcttttacttagaattattttgttgttgttgttccttaaatctaaggagctagaggacatttaaaaacattaacgcttctatcctattccaggaatagttttcttcggagaagtctctaaatcaccaatggcttttgggaatttaccacatcaaagagaaggaagggatgctttcagttatccaatgggaactgcaggtgtgtgggatgggccccctcaagctacaaatttgatgagtcaattacaagtttataatctacctcatgaaaaaaaaaatgtatcttggggacttaacagaggttttgctttccattatattagaaagttgaactcagaagaataactaatggaatttgattttcttaattcagtcactcttactaatacacattttatttgtcctctcactttcgattttgtaggtagattccatcaaaatattactgaatgatgcttacaatatcagacttagaatatcacttaacatattttcttacatggacttctcatcaatcccttgatatctgtattggtaatataaaatccccacagggaaagtcatatttggaggaggtaaactcaatatcctcagtgaaacccactctaaactcaaaaagttcattttctggcctgcacagagtccccaaaagtgaattctgatgtcagtttctcctgggccaattctcttaatggttcaccctctctaatcaccttctttgaggcatctacttactttttatttcccaagtcatccctagcctgaccttgttgactaaaatagcaaaactctgaattattaccatatgccatcatttttgacagttctgtttcccattctctgtcctcgcccttcttataagatgataaaaatctaaaaacttgattgcacaaatattaccatatgataataccataattacccaactcatgttttatttgttttaagttctgtctagttctcctaaataaaaatcttaatctaatgattttactggtgagaacggaaaatacaggggtttgataacctagatgaaatggattaatttcttgaaagacacagtataccaaaactcacttaagaagaaacagatgatacaaatagacctgtatttgctaaagaaattaaatcaataatcaatagctttctaaatcagaaagcactatgacaagatgggtttgctagtgaattctaccaattaaggaagatgttttaccaggtttaaaaactcttaagactggtaaaatttcttaaaactcaacagtaagaaagcaagtaactaattaaaaagtgagccagaggccataacagttacttcaccaaagaaagtatgcagatgacaaataagcatataaaaggatgcttcacatcatgctatcagggaaatgcaaattaataagaaaaaatgactacacaccagtcagaatggccaaaatccagagaactgacaagagcaattggtggtgaggatgagaagcaacaggactgtgcatgcattgctgatgggactgtaaaaatagaacagccacttgggaagacattgtagaaatttcttataaaactaagtatactcttaccatataatccagcaattgcactccttgctgtttacctaaagaagcaaaaattttatgtccatgaaaaaacctgaaaacagatgtttagaagcagtttccttcatcaatgccaaaacttggaaggaaccaagatgccctttagtaggtaaattctgg

SEQ ID NO: 25925 - DNA, 921 bp, Bovine  19866881092455
aattcaaaaatgttatttgaataatttgtgttcttaaattaagcacatagatttttttctttgcaagtaggctgtaaattacattttccactacattgacagtaaatgggtaattaatatctcaacttttctttctcaatgttgatttcaaaaataaaattaaaaataagcacagaacataaatcagcacagctaccccagattagatgtgattgcccatctcctgtttatcttactttttctgaagtgtgttcatccgttttggagagctgcctgaccaaagagagcatgttacacaggagacaaaagttaatattatcagagaggtggcaactgaaacttgagtagcataataaaatctattaaatgattattagatttttttctactccaaatacataaataattgtcaaatcaatatggtactttatatttaatatgttatttccattgtgactcacttaaccattaagagaagataatttactgagaaactacaagtttcatctttaggttatactttctacaggttccattattttgatagagggaaacatgaagtgctattttaaaatagttctaggcaccccactccagtactcttgcctggaaaatcccatggacggaggagcctggtaggttgcagtccatggggtcgctaagagtcggacacgactaagcgacttcactttcacttttcactttcatgcattggagaaggcaatggcaacccactccagtgttcttgcctggagaatcccagggatgggggagcctggtgggctgccgtctgtggggtcacacagagttagatatgattgaagtgacttagtagtagcaggaggattttgtgtgttccaataagtgttgcaaatgctttaaacatactaattcatttaagtttgacatgaatcctggaag

SEQ ID NO: 25926 - DNA, 2282 bp, Bovine  19866881096774
ctttcaacctattcttcatatatcaacccaagtgatatcttaagagtctcttcctgtacttagaatacagctagtgcctcttagccaccgtgctctacaaagtttttatcaaggtggcaggatttggggctctcactcatctttggcctctctttcctttgcccatcacattccatcagtgacttttcaaactcgtgagagtgtcaaggtcccttccacttcaggaacttcgtatgagctattccctgtacttggagcacactttaatttgtgcgtgactccatccttatttccatcctatcaccacttaagcatctttaccagtgcacttaaaactatacctttgcccttccttttaatagaactatccctattttcttcatagcacttatcaaaactcaaaattatgttttatttgtgtctactttccatcttcccagctagactataagcgaaaagaggttatgcttcataaccattttattctccactgtgtccttgggcacaatgctgtccctagcatatattcatccatttgttctttcactcaacaacaacaaaaaatggccagcttctatatactagtcacgttctaatgccaactttttctttcttcttgtaccaggaattctggaatttatttatcagtccatatttcaatcatcttaagtgcaagtgataaagatttcttttgaagataagatttagcaactatattaaaaatatttttccatatacgtattgcattcaaggacacttaagtttatccatagcattaggtttttaatatcctaggttatataaaaaatgtaagtggaatctgaggaaaatgaatataagattataagattctttatttcaccgatgaacagaattatccatgccagaaatttgaaatgtgtataattttcagatgttcttttttctttttatcctgctctctaatttgtcatttcaagaatggatgtcctaactctactgatgaaagagaacttgcatagcccgtaaactcaatgagccattaaataggtgacaataatcttgatagaagtttggaatatttaattagtgcaaaaaatactcttagccatgcgctcaattacttccatggatactccccaaaatatcaaccaactattttgcatgtccatgaaatgctttggaagacatttaagactgaaaaaggagataatatttcatctattaattgaggctttgacatggttgtgcatgtccagtaataaagtttcaaagtgaattcagtttagatccttgagatatttttaaaggtgacatttttatccttaaggttacatgaaagtaactgagaggctataaaaacctcttaggctcaaaatgggaagcgtatcatctgtgtactcaattctacctttttttttttttttgcatattatatacattggccaaacaccagtaaaacaaataaaggaaacaagaaaattataatcttgtaaatcacaatcatgatggaaaaaacaacttttcagagttggtgtattagcacaagaacaaacagcttagagggataatacaatggaaagaaggtaataagaaggaggaagaaaggaggaggagggagtggatgctctaagaaagtgaacacatggacacattgacttatttttaaaagacatgatcagtatccctgttagtttattcaataggaaaaacgtgttatggtctcaagaagtggagcttccaaattggttatgtagttcatttcccctcattcaaattctaaaagatgatgctgtgaaagtgctgcattcaatatgccaggaaatttggaaaactcagcagtggccactggactggaaaatgtcagtttttattccaattccaaagcgaggcaatgccaaagaatgttcaaactactgcacagttggactcatctcacatgctagcaaagtaatgttcaacattctcaaagcaaggattcaacagaacatgaagcaaaaacttccagatgttcaagctggatttccgaaaggcagtggagccagagatcaaactaccaacatccattggatcataaagaaagcaatagagttccagaaaaacatctacttctattttattaactacaccaaagcctttgactgtgtggattctgtggattcaaactgtggaaaattctaaaagaagtgggaataccagatcacattacctatctcctgagaaacctggatgcaggaaagaagcaacatttagaactggacatggaaaaatggactggttccaagttgggaaaggagtacatg

SEQ ID NO: 25927 - DNA, 953 bp, Bovine  19866881145531
aaaattctgtgtggttggtactgtgattaacccattgactactctagactcaaacaagttttgagctggaaggaaatatggaagtcatttattccaataacttgatattaaaatttggaaattatgacctacataagttatgtgacctactcgaagtgtgtatgatggcccgcagagtatatgatgtctacaccagtacacccaacaacagaacccaaacttccccaatttcttttttaaagtacaatattagaggcagcacgtgtcaatggaaaacgtacctcttcaacccatacatgccaggcctaagggaatgctgacaaattaattttattgcaggaggctaaactcgctgttctaaattggtctgtccagaggaaaagtgagcaaagtatgcagttttatgcagatagattttatttttgttattattgcagctgctcattgatattttaatgcaagtttttattgagctatgccccaaggctttttaaattgagggttcaattatttctaaaatctaataattaagtaaattaatgagcctagtcagaaatctggcaacctgattataaggattaaacccaagaaatattaacaggagggagtttttttcccgctttacaggaagatcttttaaaacccttcagactgtgtttcatggatgtaaatgaagtctgacactgagatccatgaacaagtcagggcacaaacttggattatgaatatagcttaacagcagatgggggtggtcagggcagaccttgttatcaaagttttccctcccttacaagaataaattttgagtttcagtaagtatagcctctaaaaacacagaagaacattactgtgttcatgtcccttcatgtgaagatagcatttggtaaatcatgatattttcagaagaaagtgaccataatagaactcaaaaaccataaaataagccaagttaa

SEQ ID NO: 25928 - DNA, 2918 bp, Bovine  19866881148737
cagcagcgggctgcctgcccttcctattaggagatgacttggggagagggggcagtaaagagctaattagtggaaaatttgtttattcttggtggatttcattttcctatctagggcttactaatgaataataagccttcttcttcttcttcttctttttttttttttttttggctttctggcttatcaagtcctgtgagtcaagactggggctgaatctggtagcagagcagaagaaaaagccatacccctgcaaagggatgttgtaactgagaaagaaaaatgaggattctggcagaagaagcagtttctaaagcttgaaatgaactgaaaactttgcctaaactctgactctgggcccagtcactatcagtattaacagcagaatatttctgcagcttctccaggaatagaagaaggcaggacagtaacaggagggggtagggtgagttgctgtgcttcatgaacaaatcagggtctggtggtccaggactggatacaccatggaggtggttaggcaaaggttagctgggatttaagaaaagggtccattgctttaaaggccaagaaagtcatttgtgttttgctgctagctgctcagtcatgtccgactctttgcaatcccatgaactagatagcccaccaggctcctctgtccatgggattctccaggtaagattactggagtgggttgccattcccttctccgggggatcttcctgatgcaggtattgaacccaggtgttctgcattgcaggcaacttatgccttaattatacagtgtaggtccccagagaagggtgtgtaggttggtaagactatgatgtcttctgtcagctgcctggagaggaaggcagtgatcttcgaagcatggaaaactgagttcaggtggtaatgaaagtagacaattcttttgggttttacattgttcagcagagcaaaagttgtactcgaatacagccatccaaagatgtaaagtactgctctcaatcttgtagaaatgtgaagaagccctgaacttttctaaatcaaatgtccatgcctatcccaactgtacaccaatagaaaccaaccaatctttcagtgagtaggacttggacaactatggatttgcttgtttgttttaaactttcccaagtgattttaattgtaatcaggcttaagaaccattgacttaagagtctcaagagaaaaacttgcaaggagatgctattctattcaaaacacctttcccattcttactcgactgacagttatccaagaggatgtatcaaatggtaatttttaggagggaattattctggcaggtagaaacataccgtcttcttgggccttataaagtcaccacttgcttcctaaggttcgtggtctgttccacattaagaacgaggaggtagtggtttaagaacccagtatggtctgtttcatgggcacatgctgttgagttttatttctttgattatacaaagatggtcttctcccctctcctgataactgtcaattcccagacttaagtggctgcctccttttgaaattaacctgccaacctttctcactgatggctacagatggctactgacattgcataagctgcattgatgttccttctttgaatccacaggttgtaaatattttctgctggatttaggttatattggaatgctggacacaaaatttcaatagtgttggtggacacagtaactagtgttgaaagtggatactggacagttacaaagggatcaagaatctagaagatattcagatatttgaaggtaattaggacaagggagccatgtaatgatgacttgggaagattcctgttgctatcttttcattttctttatgttctgtgctaggaattctaacctctccccagtttcaaaagttaggagagacaccagtcaaagcagaattggccagaacctggcgttctgacagagtaccagacgctgatctggggaagaaacacacctctaaaaagtttagacctctagaaaggcccaagagtatttgactggagcctgtcaaagcaggaaggcacagtagtgcttcatgaaggtcttgcattgggtgtggagaaatgtctaagacagagagcaaacagcatctggtaagcacagcaaagccaatgggagccctagtcgggagcacaagagttatgaaaaagcttgccaggctccaggagaatttattctatggcataccaagtgggcgtaccatgaagtgagaaaggcaatgagttgaaattggactcctaggcaggaggaagtacattgaagagactgacagttcaaggcttgtcctgtgcaagaggcctggagtctggcctctagaaatggggaatagattttgtccggcagccaaggggacctcatgttggctaatgaacttctcgtctatggctccctgaattcccccagcccagggtaatgggataatttccagagtcatctcaggcctggctggacctgtaggttggggttaagtggttccagcttctaaggttagaaagatatagaggcaggaaaccaaggggatcctcaccatgggtttttttttttttaactcaattcttctttcctcccccaactacagtttagtgaagtgggcatgttctaagagtatgttcagaggaagaagactgacaactattcaagtcaaagaggggctaccgcactgtggccaaaacatttactgctcgaagcagtcaaatgcatttcttgttcttttatgttccagagtatctgatactatgtgggacacacatactttaagtgcatattgacacataccagaaagacatagctatagaagaggtatgtgtgtgtgtttagttactcagttgtgtccaactctttgccaccccatggactatagcccaccagactcttctgtcggggaattctccaggcgagagt

SEQ ID NO: 25929 - DNA, 705 bp, Bovine  19866881162349
ctctctttgcaagtaaagctttattacttttgagttcttgacaggcacttaaagaaaggtcacataataaaactgtgcttatttctcattgcagaaaaacaataagtcatgtctccatccattatttaccaaattgtcttcatttttcttcacctgctgggtttataggaagaaagataaataatattataaaactagcctagatattttcacaattatccagttatgtgatagtgagctagtcttccagagttgatgagagtaaagggaagaatttgttatccaagtaatttaccagaaatatgttaaaggtagttttcacagaaagatatatctggaatcacaaatgtatatgttgggggaaaaaaaaaacttttaaatagaaagtggtgcaaaaaatttcattataccattttctttcaaagaaattatattttttataggcaaatcttctgtttcaacttttttctcctttccctctcggtcatcgatagttactgtcctgtttaaactcctcattaaagcaaagaaaaattttaaaatctgttgtcaaagaaagcagggtatttaaatgtgcttccttaactattagaatatcttagtggttaagagcctatcctcaagcgccagagtacaaatctgtgctctagtccatgcatgcactgaactggtcatttaatttttctatgcctcagtggccttgca

SEQ ID NO: 25930 - DNA, 1002 bp, Bovine  19866881168755
taccaccaattaaaaaagagagcgagggaataagggggaaacaatctccagtcagttaactaacaagagcagtccagtgttggacacagataaaacaggggccaccaggaacgctgctgttaccgctgcttgctttatgcctaggtgcggaaagcctgcaacatttgtgagccaactgtctgtggatttcttctcatctgctttaaaatatttggttttgccgtatttccataataaccacaaccacactctcccctccgaaaagcccccacaacaacagatgtgtgttctaagaggaaatggagacactgatataatcagacactagttagaatgctttcatactaaattctccagcaaattcccaacaacaaaaaactctccaccactgatggaattaatctaagatccttgattatttgaagttctagaagtttgcattttgcattttgtttgtgaatgtatagggctttatttatcaaactgccgcgtaattttcccttcagtttgaggctgtgattgtgaaacaaataaattgaaacctaccagtctgttctctccaaatttagttccattatcactttaagaatgcacgctacttaatgatacaaaaggggtgtacttagctgtttatttagttgctaactcagcaatatgttggttcttttattgttgtgtgtgtgtgtgcctgtgaattatatggtagcaatatatcttccaagtatttaagattttgtattttaaagtgagaagataagaatgaggttttgcaacgacttaaataaaaataagacattttagataagggcacacttgaaaataaattgggatgggatagtagtggtttgggaaataccatattttatcagtattatacctcttttatgggcttccctaatggctcaaacagtaaagaatcttcctgcaatgtgggagacctgggtttgatccctgggctgggaagatcccctggagaagggaatgactacccattccagtact

SEQ ID NO: 25931 - DNA, 2248 bp, Bovine  19866881255077
ctgtgctctgtcagatcccaggcacttggatggagcaactcaacatggcacatgaactttctatcatctttccctttgcttccaacaaagtcaaacttccaccaaattaatctgttttggtgacctgattgcaccaaatcattttgtgtctctgtggagtattatctgtaattcccttgcccaccagaagataaggactttgcctttcatctctgtgttctcagaatctaatacagtgtctgctcttcacagaggatcaataactatttgtgggcggacacttgaaggattcacacttctatttgctacataaatacatatttgacaacaccttggcccaagaagtaaaggaagagagtctgggagtgtgtagctaaatgattctgcaattataactcaactgactactgtcatctttctgagatggggaggagatgctcatgactggtttggtataatttgtaatagatggtgatgtgggagtcgttacatgggtaacatagcttcttctccttgctggggggacatagagcagaggagaaattagtagtcatattttttattatcattaggactaaattattcaatattaatttatggttgaattaacaagacctgataaacataaaaaaatagacaactttggctaacaacaaaattgatatcaaaaaaagatttcaaggatctgctgttatatatagacttgaggtttatctaagatgtgagcagagcatggagcatcatatatctcctctgaaaatatcttaaatgctatgacattagccacttgcttataattaaagtatgttgccatttcaccaagctttcatttacagaagaaagtgcaaattccattccccttgaactttagctacttccaacttttttctttgttcttttctttaaagctttgcaacaaatgcatccccatatgcttatattagttaatctagtattaaacatattggctgtgcaaaatgttggcacccattaataaatgttttcattttttcattctctctcttttttttaactttagattcttcctttgactacataagcaacagctgtctagctgcctgcacaagactggatctaatgcctctatagaaatctaggtcaaaacacttggaatgcatgaatatcaaacagagttttcaaaacagcaaatgaatacatctttaactggtgacattttcctgtagcatatggttgcaagctcaggggactggatgcttttttgatgaatatgttccatcaaaaactaagggatggcagtaggcttttgccaccttctgttttgccttatgaaatgataatgcaaacgcatagataaagatacaatgatcgcaaggcttttaccttcagacctattctaaagatgcattttttcccttttggatgagttgctttgtctttggttgggtttgggtttatacatagctgtcaaaggtgacaaccagtgggagcagttgtctttcctgggcagaatttgatgggtagaaatcttcaaaaagttgaactcaaaggaaaattcactaaagagaggaactgaagagtttggtcacatgagtaacttatagtcacaggagcaagatgttgatccaaattctttgtcaaatgtcagcatggagaggctggataatcatttaccaatgaggaatgcagaaagaaaccctgagaaattgaaggttggtttctgaatcttggacctgtcagcaatgatgccaagtgtgaccttgaacatgcacctttatctctgtgacatcactgtcctactgtgtcagataagtggatagctgtattatctgtaaggtctttcccagtcctaaatttctaggtttgtaaaagtttacaaggctgtgttatggttaattgcatcctgttgattgaaatggcagaacagagaagattaggcttttatttcttttttaattgactggaagatgtgtttctcaaaaattatccagaatcttcgcttcccctcatctataagggagtgaataaagtaactgtgaagctgttctagttgagcagaagagggcaggaagaatgccgccatagcttcttttgtgttccacctctcaaggcagcgtctgaaacctatgtgtgaaatatctgagtcgccaacaaacctggtttggaaaccactagctaagaaaatgaatgtgcttggatgttttgttagtaatggtggggaaggtggaaagaagtgttggaaaggcactttttctttttgcgttgagca

SEQ ID NO: 25932 - DNA, 900 bp, Bovine  19866881263578
tttctacaaaactagttactgaatcaaaggctgatgttatcttccctagcattttttctataatgacatacaggcgctcctcattttatcgtactttgctttactgcacctcaaagatactgcatgtttgcaaactgaacgtttgtgcaactccacattgagcagatccaggggcactgtttgtccacttttcactttgtgtctctgtcacgtttctctagttctcacaatatttcaaactttttcattattatcgtatctgttgtattaatctgtgatcagtgatcattgatgtgactactaaactcactaagggcttagatgatggttagcacgttttttagcaataaagtattttttaattaaagtgtgtacgctgtggttttagacacaatgctactgcacatctaagagaccatagcatagtgtacataacttttagatgtgctgggaaattacgaaagtcgtgtgacctgccttattgaactattccactgatggcagggtgtggaacccagtccacagtatctctgaggtctccctgtataaaacgccctctgacatttggacagtctttaagatatttcgtttggcagacatcaatgaccccttcagtatcctaccctcaagctcttcctcttcccaactcaatttgctaatatatctcttaaagctgctttaaacatgaagacaaattaaatctgcccattgtaaagaaattgcaccaatatatgagatatgaaaacatacaatgaaatcactctatgccatttttaactgcatctctttacctgcagatctcacaaggtatttgtcagaggaaaaagagaatgaggaaagaaagaacaaagagacaaagaacaaagaataaaaggagcaacacggctatgttcactacat

SEQ ID NO: 25933 - DNA, 1097 bp, Bovine  19866881289935
agcctggcaggctggctataccatggtgtcaagagtcagacagaacacttcacttcacactttggataaaaaatgtaggacctgaattccacatttgatttcaatgaggatacaggagaagtttgagaaatgcccgagagtcacagatttgaattcaaacatcttgttccaggattgaatgatgttcagtaaatgtgcatttgagagaatgaagagaaaaaaaaaaaaaaaaaatcagcagctcagttaactcctgagatattctgaaacattctcatttctcctagaattgagccacttttttttttttttaaatcaccattttgcactttcccagtgaggttatgaaccagctgtctattgagcaaaaatatcaccatccaattaatattttggaagcaatgacagattctcataaccccctggctcagcagtctgttcagagtctgatcagacaggaagtggcataaatgggtggccagccagttcaccaggtctgtacagagagagcagaggccacggactgaagtctgtgactcatgggagactgcagcaggggattctgcatttgaattatgaatatttaaataggcttattaaaacagtgtccacagagaacgaaactgcatttgcttttaaaacaattaaaaatataagggacagtgcggaacagtcactaaaggcataaaatttggagtcggaagactcagagggcatccatagctatagcccatctctgctatctggtgtggggaagtaaatttgacccctctaccttttatctagactcccaccccttcacttatcctcagatgtttcatcaagaatcaacattaagagcatggtctctgtagccagactgtctgtatctgaatcttgggtctgttacttattagctgtttgtacatgtcacttagcttctctgtggctgtttacccttccctaagtggggataatactggactcttcaagggctagttgtgagattaaatgagtaaatttacatagtatgtttagaagagcatcaggtacataatccgtacaaaataaatgtcagatctgacatcaaatactatgtcattagtgtgcactagaaa

SEQ ID NO: 25934 - DNA, 811 bp, Bovine  19866881330407
ttcatgcactattcagtgcatttctgtttcagctttttaagaaaagaatcaatctcaattgccagtacaacacggtaattcctatccatatatttattcctatttatattgtagacatcacccaggaagaggaaaacacgacttgcttttttctgaatatgtaaaaataagactttgaaaggaccgttaaaaagaacaccatattaaagatatataattaagtgatggttttaaatgatcaaatactgaaatagctttatttatgattttcactgcttagaagataagtaaatctatgagaacaaaagaaccagtgacatcttagaagtaagataaagacttttaaggcatttgggcctaaagcttggaatttaatcattagacttggcatgtcaataattttagactgaaaagcacttatagaaacatacctgagagagatactattgtgtgtctctgtctttctctctcttttttctgcttccatcccatggaaaccgagctcccaagcaatctacttgactgacggacttgtaaggaaagaaattatagctgtaggacccgactactttacttcaccttatcaaatgcactcaccaatttatgctctttttccacagtctgacaagaatcaggactgttccagggcttttggagccctcttgtctctccggatggtgacattctatcttgacaactcagatccagccaccaggtaccacccaccagccactgatagcttttcaggctgttccaggtgaaacaagaggaggcatgatccagactgcagttttaactattctatgttaga

SEQ ID NO: 25935 - DNA, 1416 bp, Bovine  19866881333060
ggaaagaaatatgagattttaatttgtaatttcataaccagatacctttcttttaccatgtggagctcccttgattccttcacaaggaataaaagcaggcatgtggtgtttccttaaccaagatgttagacagaatagagaggaggccattcctggatgtagggagcccagcacaaggaaggcatgccgggtgtcagcatagttagcacataatacaggctgcttcatagaacttgtgagatgataatagatgtctgtcagcatcctgggagattctcagggctctgtacagtgttaaagctataggaaataattacttctcagtacaaatcctacagccttgcatgaggaccagctgccataggagcgaaaacgcttttctgcaaatcagactcaccaacagtggcttcaagatgaagtgcggagaagctagaataaattgatgttgaacatatagaaaagtaaaacactttcctctgggtgaaacttctcttcttatgaactttttgaaacttctcactagataatgctgtaattcatggactacccaactggaaaatgtagtagtcactaattccttctgtagctaagggggtggaagaaaatatacttgtaatttctggaattaaaaaaaaaaacaccagaagaagaattgctttctcattctctaaagctaaattttgattattaaaaaacaaaaaaaatcagctttcaaaaatgtgtaaaatggagcattgcggaattgcagactcagagaaattagtcaattcctgtccgtttgtttaaactggttgagattgaaatgttccaggtttgcctgtggtatcagttcttcagtgttttgtttcatttcgatttgtagtaagtggaaagagaaacaaataatgagggccatatcctattgcttctttcccagtgaccaccagaaaatccagcaaaacaaaaatgaagaaaatacctgctttgcctgctcagtttcttctgaactgagaggttccgagggaactggtgggattctggtctgttaagactctttcctaccctaatctcactcccactttctgatcttccttatcctcagaaataggtgttggcgttcagcaacccccatacatcacagctttacctaatatatgatgtgtttattcttcccaggcctcaggctgtatcactctcaaatgactgacaacaactctgaaatgaagtgggcccaaagtggcctctaataggtatgggatgcctctctagtcaaacataaagcaaattaatgtgcgcccctcctgcaccttcagtctggaaatgtcataaagtaataagcaaggagccctttgcgatgtggaaggctggatttcagtcgatttacatattaaagggacaagccacatttcattgctctaatatcaaaggtataagttt

SEQ ID NO: 25936 - DNA, 365 bp, Bovine  19866881712876
tttaggacatctttgatgctctactgaccttgccccaaagaatggacacatgtgctttatggatcagcatttcctcctgactaatgaacaaaaacctccctgagaggttgataagcaaacagacatcaacaggagaatggcagctaattccccacagaggctgacggaagtcatacttcccaagccaggaaaagaaaggcaggacgtgggtaatatagagaaaggtgcagagttccaggacagacaggaaacactgacatatggcaaccgaatcaaaggggccacccagcccctttgcaattgtctgagacacaaagtccgtgatccttaagccatctaatactttgaccattactttgagaaaa

SEQ ID NO: 25937 - DNA, 1386 bp, Bovine  19866880087338
tggcaatttgatctctggttcctctgccttttctaaaaccagcttgaacatcaggaagttcatggttcacatattgctgaagcctagcttggagaattttgagcattactttactagcgtgtgagatgagtgcaattgtgcagtagtttcagcattctttgtcattgactttctttgggattggaatgaaaactgaccttttccagtcctgtggccactgctgagttttccaaatttgctggcatattgagtgcagcactttcacagcatcatctttcaggatttggaatagctcaactagaattccatcacctccactagctttgttcgtagtgatgctttctaaggcccacttgacttcacattccaggatgtctggctctaggtcagtgatcacaccattgtgattatctggatcgtgaagatcttttttgtacagttcttctgtgtattcttgccatctcttcttaatatcttctgcttctgttaggtccataccatttctgtcctttatcgagctcatctttgcatgaaatgttcctttggtatctctgattttcttataatgaactctaatagaaggaatgggtcttccctggtggctcagcggtaaaaaatctgcctgcaagcagaagacccgggtttgatctctgggatggaaagatctcctggagaaggaaatggcaacctactccagtattcttgcctgggaggtcccatggacagaggagcctggtgagccacagtccatgggatctcaaagagtcagacatgactcagcgactaaaaaataacaacaacaagagaaggaatacaaggatggaccgttaccatttttgtatcttgttctagttaaggccttagtgaatagaagaactgctatctaagtaagtttacattggatttaaaggaagtcaaggaaacttcatcatagaaattagagtatcatgataaaaatgaccaaaggtctaagacagtacgtgtgtgcacaggtacacatctgtgtgtatacagattcagccacttaaaaccacagccaatatgagggaggaactttgatctacatcctgtacttaagtcaagttttcctaattgcattggctttcctggagatctctgctgttttatcactagagtagatggtagaggaattctcgctggtttaatggcatgggttcagttcagttcagttcagtcactgagtcgtgtctgactctttgagaccctatgaaccacagcacgccaggcttcgagagttgtatttgcctttcagatattgaaaactggatacgaattgttgtttaggctttaagacccagattgaatagcatcattctgggccccagtggggacacatcactgtggtcattcctcacttaactgcaa

SEQ ID NO: 25938 - DNA, 919 bp, Bovine  19866880394266
acccagcacagccaaaaataaataaataaaataattttttttattttaaaaaggaagcactgacttgccaaggggacagggggttgtatgtaaggatgcatttttcttttttggggaacaggggaggctatttattgtacagagagtggtgtccagatatagtacttttgtcttcatcactttctggaaataaacgcaaaactgtcaagcgtgtcctgctttggtacctggatggggggacacaggtggggactctactgggaactgcagctgtatccgaactgttctctctgctctagaacagaacttgaaattccgaagaccctcctagaaactagaggtgatttcattcaggggataaactgaattagagcaattctacatgtcctgccttggtgctcaggttgacggctgatgccacctcttaaggtaccttgggataccctgactgtagagcagggtgcgagggcaagaccagaggatgggggctctgcagaaaaaggtgacacttgatttttccgtgcatttctggcagcttgggatctccatcttcatcttgggattgttcaaagattgaggagtaaacgtaaataggaccacatgaaattgctgttttcgcaggtcaagaacagccaaatattggcagtttcattttatacaacctagtatatgtaatgagtttagaacagtgccagaaaaatagtaagccctcaaggcatggacagaggagcctggtgggctgcagtccatggggtcgctaagttggacacggctgagcaacttcactttcacttttcactttcatgcattggagaaggaaagggcaacccactccagtgttcttgcctggagagtcccagggacaggggagccctggtgggcttccatctatggggtcgcacagagttggacacgactg

SEQ ID NO: 25939 - DNA, 1543 bp, Bovine  19866880394315
tggaggggagtgagcatcatggggtacgaggcctggggaaagatcccggcctgggagtaaagagacacaggttccacaataactgcctgcacttcccggcactggctctgagcccagctctacgcccttggcatgtgtcaactcagtcccgacactcactctgcaaggtaggtgccattataacccccactctgtacattaagagactcagggtcacgaggccggcatgcagtacagccaaattcaaacccatatagtacaggagcctgggcccatcattagatccattaaggctcagtttccttatctgtgaacttgagggtaagaatcgacttcctcacgaggtcctgacttaaaagcgctctacacattattaagaaatgatctggatacggctgctgcctgtgttctgcaaaaggggctggagtttcaggtctgaaagcgaaccctgccttcactcctgctgagaaaggagggccccaccgtccacccagctcccacctcctcgggattgagggagctgaaggagtctgcagtggtgtcggaggagatggacaacgagtggaggcgcctcgggccggctgaagtctcagagacctgcggggagagagtgagggagccagtacaggatggggataggggaagccccccacacacacactgaaggtctgtcaggcagggcctgcctcaaccaacccccttcctggtccagccctgcgaccaccccgaggcctgcccaggcctgccatcttcaggccgctcctcccactgaccaccccatccccaggctcacccccagcctggatggctccgaacccgggtgcaggtccctcagtcggtcccgttcagcagtgagggcggccaggacactgctgagcgagctgtgcactgtgggggcagggccggccatcagactcccttcctctctctccccctcccccaacctgctccagctcacactcacccttctgggccagggcccagaagctgcgctgcaggtgggcatagtctgggggcggcagccctcgggggcccgaggggtctcgggactccaggtagcgagacaggttaggaactgagccatggagacgacccacctgtgggtgaaggggaagggtggaagggcccagcctccttcagtgcctcccacccagcgtctcagggaccaccctcacccgcccaatggtgtcgtccttggcaaagctctgtgtgcaccacatgcggctggtccgcttccccttcttgggtctctccgtcgtcaccgaggcctggcaagttgaggtgggtgagtttcggtctcagggtggagaagacccccgaagccaagagagaggtggacggccaaggaggaggaagcagaagaccgacagcctggcagctgcctgggcacagggggaaggggtcgctccaaaggggcagagagacagcccggaggcagtctggacacagtggggaggggcaactgggagacggtgctctccagtaagtggcagcatgtaagggggccaggggaccttctgggaggtatgagataatgcggcaa

SEQ ID NO: 25940 - DNA, 2044 bp, Bovine  19866880405609
cctaccaggctcctcagtccatggaattttccaggcaagagtactggagtgggttgccatttgcttctccaggggatcttcccaacccggggattgaacctgggtctcccaccttgcaggcaaacgctttaccatctgagccaccagggaagacacaagtataaatacatgcaaagtaacaacttaatttatggcttatatcaaacccagggcaagacagcatatacctatagagtcgctgtggggcctctgctcttgctgaaaacagtgctgccttcttatctgactcttggtctcaagaaatgctcctgagtgagaaaaccaggattaaaatcaaggatcctgtcttcctgtcctatatcatcgaaacaaaccaactgggtcactcataagtgtgttgttctttttgtttctctctctctctccctctttctctctccctttctttcttcgatcctctcttacatacattatttactctagagtctgtaccaaccctttgggggctgttagaatctattttatagtttgttggtcactgacctgataagtcataatcgctgagaaagaatcatcacaattttatcaggtaagagcagctgctgcacaggcacagtaaattcttgggcttaagatctgtgcagttatttttttgcagagaaaatggtaaatgaacgctttatgaatgcagtgaagaaggaatgtgtgctcttgtttaaaatttagcaatggtgttttggaagaaaaaaattatcaagtgtttagggaaagaattaaaaacagaatcttgaaattttacatagtcctaccctatttgactttgaaaccctaactttcccttttcttgcatttgcaacaaaaaaaaaaatgtgagggttgggggaagactatttgtgctttttgtgtgtgtggcagaaagtgggaagatggtacaatggaatttctaatatttaaattctttagaaaatacaagcacatagatgatttaatgttttaatcaattagctggaatatctttgaaagcttaaaaaaagacaacaacaagaaaattccaaccaaatgtcttaaattgctaaaatgtctttatcttttgaccaagatggacctttaaaagtctttaaacataagtaaaacttcatttccatgccaagctcctctatattaaaattttgggggggttccccaattttctccttgtcccttccaagttataaacttgtgactacaggctttgcataaaaatgctgagagacccttaactataacaatgtgaatggtactatttttgctttaatttaacttgatttaaatgaaaagaatgtggaataaaagagggtatacatttggaggtgattctgtatacttggttttaaccaacaggctttataagtgttcattaagaaactccactaggcatgtttcctgctgcagaatagactttaacggaagaaataaagctgtgaagattccgttttcactttgtttctcgtaaagacagtcaggatccaacataaacaacaatttacacccagcatttattctggaaattacagtatcgtgcagttaacgcgcacagataaataatgttttatgggattctgtggagccctttcagggtagcggagtgtttaaccaaattaaaggattttgagaactcaaagctctcattttaagcaggtttaaacagttaatattacaaaatgccagcacagaggagctggtccaaatatatttttaatacagttatattattttcatgatttcccattttgtttttattactatttggcaccttccgtttatactaagtcacttgtcgcccaggccatctccctcaggactttgcttgctttatgatgacatttcttcatccactttttaatctcctgtatatctgcaggtgtggaaatatcagaaatagaactataattcctgatagatgaacttatatcacagagatgattataaaaagagaattgtgattttaaataatgataccacaaaatcttttttttttttttaaggagagaatcacttattttgg

SEQ ID NO: 25941 - DNA, 2541 bp, Bovine  19866880435290
gggatcttccccgacccaggaattgaacccctggtctcctgcattacaggcagattctttaccaactgagctatgagggaagtcccaataaagcagaagtagatgtttctctggaattcttgctttttcgatgatccagcggatgttggcaatttgatctctggttcctctgccttttctaaaaccagcttgaacatctggaagttcacagttcacgtactgttgaagcctggcttgagaattttgagcattactttgctagcatgtgagatgagtgcacttgtgcagtagtttgagcattctttggcattgcctttctttgggattggaatgaaaactgaccttttctagtcctgtggccactgctgagttgtccaaatttgctggcatattgagtacagtactttcacagcatcatccttcaggatttgaaatagttcaactggaattctaccacctctactagctttgttcgtagtgatgcttcctaaggcccactcaacttcacattccaggatgtctgactctaggtgagtgatcataccatcgtgattatctgggttgtgaagatcttttttgtacagttctgtgtattcttgccacctcttcttaatatcttctggttcttttaggtccataccatttctgtcctttattgagcccatctttgcatgagatgttccaatagtgccatcattattctaaccacctaacaacacacaaaccaaatcttatcatccctctgcttgaaatcctttaatggcttaccccagtctggccctcccctccacagctcacactcctgttcttacacatgacagctctctctctgccggcacacttttctcttcaggtccctccctctactagcaaacgcccgatggccctttgaggctcagtccagtctcctgagttaggtgctcccccatgtacccccccttagcagcacctatatactggtccacaagcttcttgtctctttatgttcctgagccctcaaggggcagtagcacagaccttgctaaataagtgaatggaggtgagaagcagaagagctgtctgtgttaagcatgagtacagcactgagtatatttcagggcgcagtggagacaagtctgaagaggcaggcagaaggcaaggctttctaagcaacggtacagagtgtgaatttattccaaataagatagagagaagtgccctccttttcctctaaattactcatacaaaggtaggaggggaaaaaagagaaatcaaaagaaggaaagaaaatgaagaagagaaagataaaaataagtaagctttgttaaactaatggagaaggcaatggcaccccactccagtactccttgcctggaaaatcccatggatggaggagcctggtagtctgcagtccatggggttcctgagggtcggacacgactgagcgacttcactttcaattttcactgtcaagcattggagaaggaaatggcaacccactccagtattcttgcttggagaatcccagggacgggggagcctggtgggctgtcgtcaatggggtcacacagagtcggacacgactgaagtgacttagcagtagcagttgttaaactaaaacatccaaatgaagaagtttttcacctaaagcctggcttcaaagactaactacaaaatgaccagcaaaaatagacttcaaaagacacaaccaaatatacatcacagtggcaagaatccaatatataaatacaatcaatttgtttcctcattaaacgccttcatgaagaaaatgatttagtacaaatgctaaagctactgacacagattaatcaaaaaataacaacagaattctaattaaagacttaatatttcactcattcacactaaaacaaaatttggataaatatataaaaacataatctagaatgcatccttccatggtaaccactctaacagctacagtgaattgccgaaattaaaaaaacaactcttatccttaagtgtacactttcttccaattaagaactgagatgtacacaaaaattcagaaatcattttaaaattattgcacagtttgaccctcaacttgacttttttctaattgtacaagagtctatactaaaatatcattcttccccatttatttcttggtacagtgcctatagcagtcacagttaaacccttatatgaggtactctgttatccaaatcataaaagtagggaactggattagagctaaaggctaatgactatgtgaccagttctactgctgtatcaatacaggtcaagggtcaccagcagttcagccacaacaaccagtcaatctcaggacttacctgacccatcctggggccaggacttctggttctgtcccacatcaagggattccccagcatcaaaaatgtctccagatgttgccaggccatgcggaagcacttaagacagcaggcaaacatcaggacaaggaaagaaccaagactatttattctgaccatatctccatccctcatcctagaagctaattaggttgaaatgctgtcagctactggctggccctaagcc

SEQ ID NO: 25942 - DNA, 1436 bp, Bovine  19866880525838
tctgtctgcagtgcaggagacccaggtttcatccctgggtcaggaacatcccctggagtaggaaatggcaacccacttcagtattcttgcaggaataatccctacgcacagaggagcctggcaggctacagtccgtgcggttgcaaagggtcggacactgagtgactaacacttgcacttacttgcttctaaccttgggccagagagccctgaaagccaggagggtcagtgagaccccaggatgggagatcctctgctgtagaggctgtgttccgctccccacagccctctctcccacggcccaccttgcctctcctgaccttcagcaggaaagctattcctctcttcctacctctgattctaggaagggcagagccaagcacaggctcctcacattcctggcaaacctgccgcccaggctgcgtcttctccccctgggagtctttgaacagactgttccctcctctgaaaaacaccctgcacactctgcagctctcatctggtccttcctgagcccctcctgtaccggacaccagcccatcccttccttgcctgtccctgccctgagactccccagggcctgcaacctgagaccctgtctctcccctcggtccagggtgagtgtccagcctcccccatcaggctacgaagctgcgacctgtgtcttacttctgatccccctggaccatgcaggtcatccctctgggtctcagccatgataaccttttcccattcttcaggctccccatttttgatccaggagagcggcatagtcactgggctgcctgccacctctgactgcacctgggggcttggcagacagacagccacctgtctcaggaggctcaggtggatgccggcaggcagtggaggccaggggctccccatcagggactccccagaagcctgtccagcgctggaagctgctgcaacagatcacccagtgacagggtcaggacccagctaggctgcagcaagagcagaaaacccctctcccaactgttgtgccctgctcagaactttttctgccccctccccatcccctgtggctgctctgtgtctgctgtctcttgggtggggggatgcttgtgggtagggggtggagtgggaaaaaacgctgctagcctctggggggcagctgagatttatgggactggatttttacaggctggggagaggccccaggcgggagctgtggagcctgactgaggagcaaatgcataaaacctccaaacatgaaagtctcagctgcagcctccccccaccccccaggcctgtgggtggtgagagatttacagctcttgcacaaggcctggaggggacctggggaagttgtgaggacacttcagagccagggtaactccccaccaaagccttcacctttctcctactaggaaaaaaaaattactcaccacgagaacaggtggagctgccag

SEQ ID NO: 25943 - DNA, 1172 bp, Bovine  19866880540251
ttgatgcttgtagtactaagtccattatcaggaatattcaggaaacacattcttggggaattcaggatgtgtcaggggcctggatatcttgacatcacttcacaaagcaaccaccagagtcccaaaagcaggagagtccgtgcttaggggacaggtaactggaaagtagaaaaaaatttcccaccctgacccagctgggttggttttgaatagaagcagtttagaggataatacctcttactgctggattcagaaatactttggaaagacatcaatattaaacatatttagatttgctttattaatcatgtataatttctactactaagatattttatagtgaaaagaatgttaaaatatttccttggctagcaaaagttacaggcaagattttagatgtgttttgttttgctttgttcagccttccccagagagaaagggtgttaaatatagactcatccacatgatccctctgaggcgtgtgggtctgctttctgtgtcagctgtggcacaaatgtgcatgatttacccatacaactattgaaccagcattggcctattaagacttcatgatctgttcatgagctgtcaacccaaattgagcttgaagcctgctgtaaaagatctaattttcataattatccagaaccttcacaccctccttccttttagtaccacccacctccacacacagtacgcgaaggagtaaacacatacatacagacacagaggcacagagcagcactgtccctggagattcatcaggcctcttgcccgaaaatgcaccgagttcatccaggggtcaggcctggctttgacttcctgtttgaggagccccatgtgtggtgttccagcattgctagaggctagtgatgactaagtaacctttcacactatagcctcccactaagaaacaaggtcccttatgattctagacctggagtgattagggcacacaaatacctttttaatatataaggtggaattaatgcctgtagaaatagcacttcactgtctcatggccttgcatttatataaagaggagagagctgttgtctttgaggatgaagaattttaaacgccacctgatttagtctcagagtacaccagggactctgatcatttagctgtgcttaaggctgcctgtagctttaccgacccggtctccaaag

SEQ ID NO: 25944 - DNA, 1399 bp, Bovine  19866880545629
cactagcctctgagggttcaggagttgggttggcactcagttgtgggggtgtaagcatttaaattccaagaggaaatagtctgattttggatgagatggtacccattattatctgaaatcagtttatgattgcttgttgtcactcacttttacatcagtacacagagaaccacaaactgtcagctcaaaagggaagatcgtttagcccaagccctcccctccacacatgtgatctggctttagggatggggaaaactgaggcccagtgaagtctctgcttcagattacacagccaatctggacctagaatccaagcctcctgactcccaaacctttcctttatgtacgactttaggcaagccacttcctggctctggacctcagtttctctatctttggcagtggcagcattggacaggacactccctgagttcttcccaattctgaccttgagtaactctttagtgcttgggagcaactcctttttgttgcttctggggttctgtgggcatctgagtatagaagtcgctatgtgcatgcatatttgcagtatacatgaagtttgtatatgtccagagaagtgcatggttattcagactgactcgaggaaatccactggaatctggactattcctcctcctgaaggtgttcttattctcagcagaggagaagcccaagcctagagcactggagatagaacgcagtgggtggggctagctagctgggttgggccgtgattggcatttggaggggagctagggaaggaggggctcagcctcaaagagcagagcactttctctgccaggattcggagctgaggctggagttgttgggaacagcttttgaagtccctccaacaccagcccagggaccaaattatggtttcagaatttagatctgagacaggagaccaccatcaccactgccagcctcactttgcccccctgagcctttggacgcagggggccatggcattacaccaggtctcctcccagggaagccaggacagaagtcctgcaaggtggatgatccctgtcttcttgctcttattttccatttcttctcctaactgagaaaaaaaaaagataaaattcaaaagaggtgggggcttctcagaagtggcctggatgtgagaagggagatttcttgtaggatcagggctacggggaggctagcagaggaggggcggcttccagactgccttaggaagtgttgtcagggatatgaattctggtggaagaagtgggaagagaggagaaacaaattcattttggggggattctagaaatcagagctcctggaaatcagataatcctgagaggaaatagtctgtttttgcctgagacttcttaaagtctcaccccaaaccctatttagagaaagaaaaaaacgaaagggc

SEQ ID NO: 25945 - DNA, 1740 bp, Bovine  19866880555609
tgggtttaagctacttagggcctaacataaaaaagcctgtcactcaaagtcagaaaggcagtgtagagcataagtgtaattatagtttatgaattcaacaatcttcccatagtagacaataatattctagattaacatgtttcagcatcgttttaaacagcattactaacatttactttttacttgaaaagccagagttctatgacaaagcaaaagaatttatggctagaagaacaaagatcaccaaagcatgaagaaatcactctaaatatacacttacatatatatacaacaaaaatatataaaacataatgtatattaagtataaataaaatttatgcctatataaattaagtatatgtatctacatacttggcctgaaagttttatgcttaaacaaaattctttcacatttaagtgaatattaaactttgagataaaaatggtcaatggctttgcagcttgaagaagaatggtctgcctttgactcagttttatatatatatatatatatcagataactatattacattagcaaccaaaacactgtatatcattttgccaccactgtaatgaccacactaacaacttcaataataacatactaggactttcatattaccactacactcattgactcatttagaatttggagagaaacaaaaaatatttgaggcaatataaaaaagcttaatctcatcagccaaatcactcacttaaaaatcaactatttacattttaaaatggccactgttacttcactactaattatagtagaagctcaataaatgttgacctttcaaagaatgggcttttgctcatattgccagtgtggaaaaaatttctaaaatcacgttggctacagcaaaggccaaatcttatcctgactgtctttcaaactactgtaagtccaaccaactgtttttttttgtttttttcctgaaaactcagtccttcaaaatcagcacttgattatgtaccatataccttattgtgggggtgttcagtcttctctcttcaactagatgatttacttactaaccaaaggaatcgcaccttatttctttttgtatcctccacgcatcatctaaattcataactgaataagggcattcaatataggaattcaataactaactcttcattggcagtctattaaaatctataacatggacaaaaaagccaaaaaagataatgaattagttctctgtcaagtcaattcagaaactaattgtatgcttttcacaattgtaattgtccgaatttatggagccctttgaaattctttataaaatactgcttccaaatcattctgggaagataacatacataggccagagagacacacatgtctgaagaacttgactaaaacttctggaaaatagcttaatgcccatggtcaggcaaagctatctgggtccgcactgaaaagcatgctgagatcaggcaggtgaggaaagtacacggtatgggtcaggggaggctgtgcccaggtcttggttttcttactgattctgtcttgctgaccataggaccaggcacttcacctttttaaaatgtagtttccattttggtaaaacagagattagattgggtgattaccaagtctcttccatgtctaaactgccatggttttaatgttaaaatgtgggttaagtttgcaaggagtttttcctagtgaaagaggcattatggaagctatccaacaatcaacacatgcgagagtgctttactaaagca

SEQ ID NO: 25946 - DNA, 939 bp, Bovine  19866880575243
tattggagccttagcttcgcatcatcccttccatgaatattcagggttgatttcctttagaattgactagtttgacctccttgctgtccaagggactctcaagagtcttcaccagtaccataatttgaaaacatcaattcttcagtgctcagcctgctttatggtccacctcactttccacacatgactaatggaaaaaccatagcaagtctactcatagtacccctgatagattttatattcagtgaggataaaaaaatgtttgttcacaagccagtttgagacctcattgctgtgagttgtgtgtaaggcctgattttactatataaattatattgtttcacataataaataaactgcacttcttatagtacttatgggatgtgtgaattaatgatgcagtgattagtggtaagtgacccctctgattaggtaaaccttaggctgaatactgctgacagctttggaggaaaatgtgtgtgttttatggctgcttgacttggaatgttagaaagctattgcaagttcagtcattggtacctagtaggttgaaagagttaatggcctaaaaacagcaagccatttgcttccttctcactgatggggtcaagcacattacattcttcgtgtgtatttttcttaaattacataaactatatgaacatatttagggttgttagtacctttttattctattatatgatgataatagaaatgactcaaatagtccctttccatatatgattatataaataaacatacatacattcaaacaagcatttatctcattttatttttattcttcagttatttgcttttatctttattgcttgcaggtatatttttctttaataagacatatgactcctgtcaaacctaacagaagttatgtctgtgtatttagagtgtacactgcggaagagcacaaaactggtttct

SEQ ID NO: 25947 - DNA, 4446 bp, Bovine  19866880609678
atgtgccactgtgggaggggaaagagttagactaggagccctaaaatctggtctctggtctcagctctgcccctaacttgctgggttatcttgttcaagtcacttctctaggttcaagcccttctctagggcttggttcctctgaatgtcaaaggaccacctctggaataaagttcttccatatatctcagggccatctggtgttgttgctcagagacctctgagaccaccatccccatcttcatccccatcagctcccacccttccctgctccagttccacggagagtgaacccctaacccctgactttctcttcaaaatctcgctcagaatctgcttcaggaagcctcccctgattaagcctgctgaactgattgctcccttatgttggggcccctccgtctgtgaaaggcattgtttgtcccctaagtttggctgtgttgttattgttgctgaaagaactcctaagtaattttgagaatgtgtgtaatatccccttctgcccccgccccctgcccccagcacaggctgcaggcaaggactgtgtctcttccattggactagggccttcctaagggcctggacggtgtccttgggacagaggcccccacctgggtggaactgtgtctctaccatcagattaggaccttcccctagggctgaggactctgcctccctgacttgcctagagccttgttcaggaggggcccttctcaggggaggagggacccagacagtctgactctcccagctcttcactggctgatttctcaacttctccttcaacttcgtgccatggccaggtggctgattttgccatctccctctcctgcctgggggtcgttctgcttcttcctcaggaaactggcctggaatctgcctcataccctccctcctcctctcctagcctcctgcctccgtcatccctctctaagacctcagggcaaatatttgccatctgccttgttagtgggatcctggggctggctctcagtctctctgctgccctggggggtctgagaacacttctcattagaactgccctcaccactgccaaaatgcttggaggtcccttgttcactgccctcctaggcttcctggggccggcagtgtctgggatccgaaagtcctagtctatcctctctactccggggctggaaaacctgtcagagtaagcctgaggcggtgggggggccactgacgctgcatgcatcttcctgagtgtcgctcattcacagcttctctgccttcacctcagagagactccttacctgggaacctgccacttggtattaattcgtatactacatttatttgtccagcccaagaaaattaatgcaaatgcaatgcaaacctgatacaaagaggctccacatctgaaggagacttgcctctctttccagaggtggtgatttgcaattcagagaaaccgaggcttagatagaatgctttcctggctgggatgctggggcctttggaagattccagaggccactgacctgagatgtgcaacaggtatgctctcttcttccttggacctcatctagcctatggggcttctttcacagtttctattaatctgcttttccttctctatgacttgctccttctctggctcctgccactccttgccctctgcacaggagccccaaaccccaccatactccctgtagttgagtgacagaggatggttccccacgtcaactctgcggggcctcacctgccccagtgggtccttcccaccagtctgcccatgaacctaaaatccctgctattagagtgtttctgtgagtgccagtaataaatgcaggcgacatctatttaaagacctgtgaccctgaggggtccggctgacaggttaccacctcagcagaaagcaggaagtgtaggtttggattgttggagagggccagggaagaaagctggagtgaaagaaggagtaatcgctagaaatacattcacttgacgggcgtttattgaacatttaccgtgtcccaagaactgagctgggcctgcaggtgtggtaaggagtgcccgccctcatttagcacaagggggttgttctcaagcttgaattagaccagcatcacctgggatgcttattaaaacaaaaggtcccaagcccctcttgatttaggcagtctctgaggtcctgggaatgtgcatttagacaagcatttctcctccccttgctcaatgatatccatgcaagtggtctggggatagaaaaccctggtagggacttccctggtagcccaatggttaagactctacccttccaattcagggagtacaggttcaatccctggttggggaagttccacaggatgtggccaaaaatatataaataaaatttaaaaaaaggggagtgggggtttccctggtggtccagtggtgaagaatctgccttgcaatgcaggagatactggctcccacatgcctcagggcagctaagcctgtgtgccacaactactgaacccgtgtacaactactgaagcccgaggtcctagagctcatcctccacaacaaaagcagccacagctagagagtagcccccagtctccacaactagagaaacctgtgcaacgaagaccaattgcagccatcaaataaataaataaatacttaaagaattaaaaagaagaagaagaagaatctgccttgcaatgcgggggacgtgggctcgatccctggttggggaactaaatcctacgcactgcaactactgaacctgtgcgccataactaagaccccatgcagccaaataagtaaataagtattaaaaaaaaaaaaaagattaatgtttcaaaagtcttttataaatccctggtggtatgttttgaattctaagaacatcctggagtttcgaggcccctgggaggcagagagaggggaggaaggtgctgagaggaagaatgagcagggggtctgagccgaggtgcagggtctccttagggcggctcgctggtccctcacggtccctgtctcctaaggagcaggcctggctccctctcctgaggagggccttgctccaccacagcctgttgattcctgcccttcccctcccatggggagcagggcaccttctctggagtccaaggagggtcagcaccaaccgggtgggatggcagagccatctggcagagaccccaggccatactccccaccccacctgttccttcctcctgctctcagaggtcctcctggagtcagtgaccaggctaaagagaaaggggctgagaggaagggcttgaggaagcagaaacggtagaggtagagagcagagggaagaagctgcccccctcccctctgcgcctggcgtttgatgctgggggtgcggagacatctcctctcccggaaactcaaggccagacagataaacacagatggagggagagactcagctgctttatttatgggcccggtgacaggccctctcctgtctcagagtcactaatctaccaggcggaagagacatccccaccccctcgccaccgtcttccctccctcctaagactggggctcagccaggctccaagcctcccccgccagtcgggcgcaggcctgcggtgccagctcctggagcctgggggagaagcgtccagagctcagggtctacctccaacaaagtggaggacttcatgtcctgctcccctatgccccaccctgctctgaatggggcatagagaacctttgactctgccaaggagacccactcctatgaatgtgcctggggacagggggatggtttagacaccaccctcaggaggtccttcccatggagaggccacacagttcaagtgtctgaatttggaagtgtctggggagccccctgggctggcctggcttaggcctccctagagcagggacttatgggagattcctaatgtccccaaggggccagactcagagccaaagggtctggttccctgcagtatttcttcctccttctccttcttttttttttttttcctccttttttccacactgcttgtggggtcttagttcccctaccagggatcttacccaggcccctgcagtggaagcgcagaggcctggatggcctaaccactggaccgtcaggaaagtccctgcagtgtttgtttctaatgatctccctctaatggtaattaacacccacagataggggctctggggacccctgtgaactcttccctctctcccgtgacatactcccacccctggcactctcttaaatagagtaaattccactggaagttactggagtgggatccagcagtcaccaggtttctcagcagctggacaacacggctttttctggcctcccctgccctgtgcccatctgcatggcctcttcatcctgacattttgatccaggtctaccccaaatctggtcaggggggagaagtaactcagccttccagagagaacaggtccctcaggccccaggcttggaggtcagag

SEQ ID NO: 25948 - DNA, 1141 bp, Bovine  19866880625962
tcttactaaatcatatatatataaagacagatgtactgaacattaggatgaagaatacagtaatagatgaaaaagtcatgactatttctgaagcaccatgtattattaaattcaaaacaattcccctaaaatggataattatgtaatctggcagaaactaaccttccagtcaaaaagctggatactaaaattttccctaatgtaaccaaaatgtggtcagagattatagtttttattttacaactattccatgttattcaaacattccagtccctgtttctcaaaatatacaccctaagagctacctgggaggtttgtgatatcaacccccataatttttcctttgaagagatcttcagcctcagcttaaggctgagaaatgcagtcagttcactctaggagagtataagtcataacgtttgttttggaaacctattttaccctatatttctcaatgaaataaactgtataaatgaaataaaactgacaacacaatatttactaaattgctactgtctgctctcagtttaacaccctgactaccactagtttcccttgttgagtttagtaggcaaaagagcaaatgaaaaaagtcttcagcaaagaatgtatttttaaatcaacataaataagattataaaatagacttagcatagtttcccccttacttgttactcctatacatttgtcactttcttcatacccatgtatattcttccatttaccagactttgtgtgtgtgtatgtgtgtgttaggaattcacacatggacctagggcaataaagttcagagagtagaggaagagagaaatattcaaataaatcagtctcatttaaacaatggtctgatattacatgatgaaattaaaataaaactataaaaattaactttcagagttgaaaatgactatcaatgagaactgaatatttaaagatgaaaacacagcaaaaaaccaaaaatttaagtatcatgtttatacataaaaggaaataaaaatattttaaggtcccatgacagtgtatttttctttcagtctgtggtattacacagtcatacatttttgcactggagatgcaggccactagacctccatcagcataccagggctcctgctttctcaggagagctgtaaggcagtgc

SEQ ID NO: 25949 - DNA, 1227 bp, Bovine  19866880634380
aaacaagccaagatcatactgttgtctatgaggttgcacccaagtactgcattttgggctctttgtagactatgagggctactctgtttcttctaaggaattggttatctgaattaaattcactcattcccatccattttagttcactgattcctaagatgtcgatgttcagtcttgcaatctcctagacattttctcattaactaacttaattgccatacgactcgatgcgaacagtactatgattttgcccattttctgaggcatggagcgggcgcagggtcacatagccagtgactggtggagctggttcagcccaggccctctggctcccagctttcctactgttatttaacaaatgattttccttaaatcatttcactatttttactcttttatgtccagtgaaggattaacttttcacatcacagacttgagaccataactaagtgttttaatgtactgacaaataaatacaaaactataaagtagaaaaatgttcatccatctaccacttaaaacctggctgcctccagtggtccacagcacatgctttgagaactgctattctggcagatgctcccagtgagcagacacgtggcctgggcctgggacgcgaggccagtaggaggggcaggtctcacccaccctctgtagcctcagagtcaatactcagaacagtagctaacccagcccggttggtgggtgtgattcgggctgttagtgctcaggctggcaggtcagaggggagagggctttgagccggggttaggcagagggacacatatctgtgagtgacaggcatctcctcttcccaggggacaaacgcttcgagtgtgcccagtgtcagaagcgcttcatgaggagtgaccacctcaccaagcattacaagacccacctggtcacgaagaacttgtaaggccaactgaggcagaggccccacagatgcagacctgcctgggcctctggcagaaaggaggcccacgctgtcatgggcccgcctcaacccccgttcctattgtgcgactgtccccacaggaaggggctctgctgccccatatgcacctccttttgaagccccttggctccgccctggccctcccctctcaccacaagctcctggcctgcccaaaccatggacactggccatgcccaatgagacgttctaaatcaggacgagtgggaacccttatttccaaaggaaaaacataatttcactccgtcgag

SEQ ID NO: 25950 - DNA, 2520 bp, Bovine  19866880636505
cagaataggtttctggaaggagacttggggagggccaggaaggagggtcagggtgcttgcttggcctatgggtgccccagtcaccacctggtctggggcaaagcccacaacccccccacggcccatctgggactgctaaggaacttggggaatggaggattcagctcctgaaacaacagtaaccaccaaactgccttgctccatgagagtacccactgcttgtgccacttaaaatatatcactttaacaggtctctgaacttggcattcatgggtcttaactctccttggagtaaagggagccacttgtcagaaaaccacagaaagaggtcagagtagcccttgggccctgccctggagcctccaccatggcaccaaagtattggtgcctttggctcctggccttgaattctggtctctccaaaatactctctgctaggccttgctgtcccttctgtccaggaggacatgacacaccagtaagcaggtgtttagccctttaagcaaggcaaatctatggaaatctgaatgtgcagaacagatacattagaggactattctttgtttttcaaaacaagggggctacaagattcttttaaatagtgagctacctcaagattgtgtaaaatctgatttgttttaggaaaaaaatgtgacacaacagtcaaacttccccgatatccaaagttggaaaaagccagaggccaacagtcgcatgcccacgcgtagtcacaggaggctagagggacctgggggaggggatgtacttggaattttgaacagactcagcagctggtgatatacctgcttttgcagggcctgagcaggcacactgagggcaaggcccttgccccggggacttgcaatccatcggatgatagaaatcagccctgaagatgcaagttacacctccactgtttgcacagctcgggaatccacacggcctcacaggatagcctaccaccctgtgcctatggtggttagcaccctggcatgcatgtgggcaccccaggacagctcccaccatgccagctgggttctgtgaactgccctaagggccttgccagacagggttgggctccttctgagctggaacaagttaaccattgactggggtggaggtggaaggctggaggcatgggtggggggtgggggtggggttgaaggggtgagtcgccttcctgcagtaagacaaaactcagaacctctattccttgcatctctgcatggcccctgtggtacttctccactctgtgtgacactcaggtaccgtggagaggacagggatatatattcctaccagacagccagaaacatcctccagcgggggagggggtagcaggtggtaagctcctgtccagcaagagttaacagatcactgctctggagtaaaacttttccagaaggagctctgttggaggcctggattgactccaagaagccagtgggatgagtcgagctctgcctgcccatctagagatgggagtcggcatgcccggtcccccttcccagctgggcgtatcagccatggaagcagaactgagcccccagacagaggtccatgccttgttttcccctcccgcccaccctctgccggtacctgtgagcccgactgctgggaggctggaggcgagagcttccctagagaaggagctgagtgcaggagctgcgccccgggagactgggggaggtgggggtgcctccggactgccgcgccaggcaaggctcaggctgggagagctgggtaggagcagctgtgcagcaggtgcggagaaacaggtgcaggatggtacctgctccgctgtggctccgggagtcaaggtgaacctgaaacccagcccctcccggctaagtaaacagaggctggctcagctgatgaatattcattaccccagaaatccaatcccagcgcccctgcacccacccagaagacagggtcctccaaggaccgcctggccaggaagaagaaaccccaagggaagtcaggggtgaggagaacccgggagcctctcgcctcattctgccactctcaggggcctgtttgcaccccagccataactgaggtcatccctacctgttccatgccccaaagaggccagacccctctccagcatgaactgccacctagactttaccccaggcacaatccagaaagggttaagggccgctgctccggcggctggcgggagaaacgggagcacccagctgctttgaactcaagagtcgaaaccagtccctggtcaaactggttggcagaccggttcccaggctgcctgcttccaccccaagcctcaggcgggtgctgggtgggaggctgtggttccctcctgacctgaaggcttttcctcaagttctccctagaagggggttgagtggcaccagctcctccttaggccaggttctccagacccaccgcaacctcccgtgtctacatcccctcctccctcgcttagaagcagtcttcacagaccttgaaattctgccttccaccatggactgtgtggcccattccaggaacgag

SEQ ID NO: 25951 - DNA, 1036 bp, Bovine  19866880656589
cagcagggcccctcttgcctcccccaacacatctatccattcgtaagtcccaaagctgcatgcccacataatgcactgagttccaatttgggttgcaaatatattaaaaggagactttaacaacagagagctgtgcatccattccttttggacccagatatttctgaacagctcttttggtgcggggactgaactccacttctgcccatgcagggatgcagctcaggccacagcggggtgttcagcgctcttcagtggctccagattgtggtgctggtgcttgcctcctcatacgtaaccgatggctcctgagagcctgcctcccgtaaattacttcccacgatgcctgcgaccactgcagaattcaagtttgaatagagcaggaaaaaggtgtttgaaaggcctgttcactcagctgcattttaatttccttttcaatcttgtcccaattaatttcacagaattaatctcacagaagcaaacgcggcagcactgaagctgtggttttagtgtggcggtcgctctgcctgaacatgaaataggagctaatataaaaatccatctgctgtgtttgaaatacacaccggctgctgctcagtcctgtctgacattccaaacatcaacagcggggaaaagtgatttgggggttagtggccatcagtacttggcaggggttcaacaacaggtgtactccaaaaatccattcagcttgggcaccaggcatgacagggcaggtgctgaatcaccctccgtgcagtaacacaacgccctggcttgattccttttatctgagcatcttaaggcccttctggggaccagcagtgctctgggcatttattgtaagtgggagaaagggcagtaagaagtctctgttgagtcaagccacagtttgcagcttacagagaagtgactctgtcttcttggcttcaaggtctctcactagagaaccttcttctaaataataaaggtgtttgttctactattcgagataacttaaataaacacccatttaaaatttaagcctcctgttccagaa

SEQ ID NO: 25952 - DNA, 1735 bp, Bovine  19866880665718
gctgggtgggggaggggtgcactgcaaaccacttgaaaggggccggtgagcatcgtgggacaggtggagatccagagcctttgaactgggagggggtggggctgctgccagaagatggaaatcctgggccaggctggcagcgccacagggagagggacggggaggaagccccataaaaggctgacccacccctctctccagcctagccttccgttccacgccccttagtccagcctcccaagacaagagctggcgctgagacagctaaactgagtaatgtctcgggtgcccagccaggtggacagagactcactgccaggccccaccctgagtggtgggtcagcacccccaggaccaggccggggcacggtggggaggagacggaggcactgccagtccaagcagggcaccacttgaatccagcccaccagggaagaggttggggtggggagccccgtattcaggagaaggtggggtgcagctgtactgtccctcttggcctttctctgactggcaggcaggtgggcagggcagggaaggaggacaaactcaaggtcagcgctccagaagggaggggggagtcaaaggggaaagagggctttctgctcccttggcccctagcccccttcagatgacaggcccaaggaggagtgggtcgggctggtcaggacctgcctccagcctgccttccttcccagcaggtcggcaaaattactctcctggtactgctttttttttttttttttttaattttttgaagccagatcaaaggtgggatccagctgggcactccagtaaaatctcagcaatgcggagcctcggtttcagtcgggaaaccaggagctgggggagtcactgtccctgagggctcggggatgtgaccagagtcaggagtggagctggtgggtgggggccctgtcaggaaggatcagtgactggaaggatccaggccaggctgcggtcacccttgtctccactgctctccaaggagggacccacccacgtgtgactctcccagtcccagcatccaagctaactggaacctgtgttcacattggccacaagtcaccgcgctcatccctgtcactggctccagggcattcctttgtaaaccaggaagctcttagattagataaacttattccctcctgctgcaaaagacagcacattccccctttccattctgagttcagactagaaaaactcatctccttacttctctgtactctcctggtgaagctgagattcagtcagccgtgccagcagcagctctccctgccttctttgctgatgaccacagtgtcttcctatgtaggccaaataactgccattcttgtttgggagactttttccttcccctcaaggactaccacatctcttcttcctggagccgcactgccatccttaatattgtgactggatggggttaatggaatcctgcaaccatcctggttttccgagtgaacacgtccttggcactgtcagcggggcacttgttgtgcaagcagcccacccttctttcctcacgagtcctgaagcctgggaaggcctggttgtgactggcatgctgctagacacagatgtgtccaacaggacagaggcagatttccccagaaccttggctgaccctgagacaccctccttggtcatgacaaggatggccctccttgttgccctaggcaacaagcctttactcaggttccggtgtctcccagacgttgaggtcccggcaagg

SEQ ID NO: 25953 - DNA, 1744 bp, Bovine  19866880671549
ttgatttttgcaagctgtttggtgacaagatgtgcaatcaagctggatggcactgtttagataaagaatggaaagggaccataatgaaatgactgccttctgtgggtcttatgctgaccctaaattcttatttcccttttcgatgagcattccatattgctggcagagttctttgcttaaaatactgagctggtatcacttaactgcttcaaagtctttaatggctccccatcaccttcggggagaaggcagtggcaccccactccagtactgttgcccgggaaatcccatggacagagaaagcctggtgggctgcagtccatggggtcacacagagtcggacacgactgaagcgacttagcagcagcatcaccttcagaatacaaaccagactctgtggtccaagagcagtgggcagtggagtcagtcagaccagcctgggtttaaatctcacctgtgccctgaggcaaactatcccaaatcctgggccctcagttgtaaaaataaatctaacagcatctacttggtaagcctgttttgaagacagtaggatttctaaggaacacagattagtcaactcagtaaatggcagtaattagttagcatgccattcaacgctgcccttgatcccgtcacaacctgtttagtgaggagtttcaagtctgaacatatccaggcctccccacagagatttgcatcctccatttcagctacatgtgcctacccgcagttccctagacagattctcttccgctttgctttgcttacactatttctccctttacggtgtctctttctccaacttctttctgccaaatactacaaaacatagtctcttgtgtcaacgtttctaattgctttcaagatgaactggaacagccaattagtaaatgtctattgaaatgacttatttcaaaagaaacgttattttacttttattattattatttgtgttaatactgcttttcttactgaagagcctgttctgagggatagcccactggtctgtatgtacaatataaggttcacacatgtttcacaataactctcatttctgtggctcctcatggaagatattttccagttttagttgatagagatgaggaagagattaggaaacagatgaggaccatacaaatgttgatgacagggtacagtatggcagccatttgattaatttttcttttgtcatgaagtacgacttacctacaggaaagaacaagtcttaagcacaaactgaatttttaacaccattcagatcaaaataaagaacacaatttgattgcaaaaggtatttctaccttgaaatatctgtcatcccttttctcctttcaaacctccaccccaccccactgccacctctgggcccagtcacttgcctatcagtctctgtcctcttctttccctactgcctggctcctggcaaacactcaaatatttgagtgaacgaaaggaatgcgcgaatatcgttaaatgatggaggcccatggagtgaaagtgaggtccgtagggttgtgcccaaaatgctttgggtaaatgattcaattttgcctacatcaggttccggaattagagagtatctatgagaaatcaggggtaagatttttttttttttctctctctgtagagtttaaagggagattaagagcacagaaagtttgatcctttaacgcgatctccagctcattgaccaacccactcccaggcctgtctggtcctgcttttgccaaactgagccacgaag

SEQ ID NO: 25954 - DNA, 1354 bp, Bovine  19866880675406
accaagggtaaagttgacctaaaccactatagactatttcatttgaaatgattaggaaagtacagtatatggaacaaaagaaattaaactgaaaaatgtaaactgtaagttaggagacctcataattatagcaacatcaccttttctgcttcctaattcttccttaaaatgtgctttctggtatagactctgaagatataaagatgaataagacccagtccctgccttcaaggaactaataatccagtggaaaacagatgtgcacagcacaccctaattattgagatatattagtgttttcagcaaggtgctaagtagagggagaacaaaataaattttacctaagggaatccaggaagacttcaaagaggaggtgacatttagttgaatcttaaaggatgagtaaactttaacccaaggaagaaggaaagcagggataccttgaaatggggaaatatcaagaaacaaaagcaaattgtatagaaatactcagcagattggagaatatacaagaagaatgactggggaggtaacttagggttaattgtgaaaaatatgaatattcctcttcccttaacccactctcatcacctcctgttaatagtttagactttattttgtgagacattagggaaccaaaaaaccttttagtattttctggtcgggatgttttattgtttggtcatctgcaaccagctcttcacccttcctataaactcccttatcctttttgtgttaccacctattatatgtggtattaataagaatagtttcttccactatcaaatttttcttcaacaaaatctggtgttgtcagggtccaaccacctgatttaaggttgaccaaatgaacactcctctttgaatactttgaattttaatcaagtgacgcaaagatgcgaggacatctggcggtcatatacacaacagcagcagcagctacagttggtgcattgtgggtttttgttgtggtttctgtcccttgacccttgggagctcccctgattctaaccttgagtcattttctgccttgccagtaagagctatgtccaaacaatgtccaaaagcaaattaatcattcaaattcaaggagttatgcaactgggaaattagaactataggttcagaaatttaaatgaaagacttttaagagatagagataggttttattaaaacctgtatttctcttgttttaaagctaaaacttaaagcccaagagatagatcaccctgggagaaactacagaggaagaaaacaagaggatcagaaataatactctgggagatgccaatatgtgaagaagcagacagaggcgatagtaaagaaaagggtatcagagagttaggagaactca

SEQ ID NO: 25955 - DNA, 1625 bp, Bovine  19866880683297
taaatacagggttttagctttcttattttctcttcttaacataaaatcaaggaagggaaaaggtgtcccacctgtaccctcttcccctctcaagttccgtttgctcgtgcagttggtggctgttcagaagccgtcctacatataatgtggttagttaagtgttctaatgccccagttatccagttagtcacaggccgtaaggtggggatttggttagtggagtcaaacagagaagcggtaatctgattaaccagttgctttctgagactgttggctaagatggtggctgtggaatggagcagatctgctagatgaggtttagcttcaggcagactgtaggaatccactgctttctccttcacagagaatgccctttgtagatggtcttgaacttgctgtatcttttccagcatgtaacaaggtcagaaaaggccagctggctatggaccagattcccaattagtccatttgtttcttttagggccagtctactttctttttcctcttttacagctaggatgtgagtgtggggcagtagatggaggtgccaaaagacccttgtagtttggcagatgatttcctcaggtctgcaggtacagaaaggactattgcagtaagggggctttgttttaaaggtcatgccactgagtgtcctactatgtagagtggagaagtacctgaccttgcttctctttcatacctcttctgaccctgccctagatacctcctcttcctcttctggtttctccttttctgtctttcatcatggagcagtggtggtgcaacggtattctcttcttttagccaccagccttccagacttgggactctgaggattctccacagaggaagcaattgggtatagagtggtttctgtttgctccttctgttaaccactttagaacaatgcccattgtctttacctgtaggctgggattggtgcgaatgttcctaaaacggaaggcaattggttccctttggttcatctgcgcatctgctgccacctagcggttgcttctcctttggcacactgtgtaaggttgaggggctgtcatggacacttccgtagtgccttttatctctgtctctattttttcctctcccagacctaattgtcctcttttttttacatcttttccttttgttttactcctgggtcagaaaaatctggaaatgaatagttgacgtaggaccttttcagaaacctggaatccactaacaacagccctgtttgttcccagtttctctctccggtggcatgaagtggtatcttactgcagggctgtgagatggcgggatgaaggatactgccaatccaggacagctctgaacaggagaagctttgaagatgagatttccttagctgctcagttggccatctctcaatatttcttgtgtagagggtcaggtattagtaactaaaccttattgagcagttactatgtgtcagatggtgttccaggtatgctacacttattaactcctttaatctcttaatgacccagtgaggtggagtacaccccttctaaggtgaggaatttgtttccaggctgatcccagagtttctttctttcttttttttttttggccacctcacatggcttgcgggatcctagttcccacga

SEQ ID NO: 25956 - DNA, 1562 bp, Bovine  19866880697084
ccctggagaaggaaatggcagcccactccagtattcttgcctggaaaatcccatggcatggaggagcccggtaggctatagtccatggggtcgcaaagagtcggacacgactgagcgacttcacttacttacttacttacttaaatcattatagattacttttagtacaaaatactgtatattgctacaaacttgccttccagaataatctttcatcactgttgctcttacccctaacctttgtgttgttgcttccaagttagaattctttcagtttctccagctgaactaagatctgtcaccttaggacctgtgcacacggtgtttccatgctggtgccattcttttcctcattctaccagctcctccccaccccaacatacatactcgacctgctgatcttggggtttcagatgaaaggttaggtctctgggagatctccctaacttacttccctctagactaggcgcatctactatgggtgtgtgcctccctcacttttcttattataactcgtatcacagtttattctaattgtctacttaagtctttattctttggtagactgtaaacttttagtttggatctgtcttgttcacattttcagtatacagcatataataagtgctcaatgacaatatttatggtacatttctgattttgtcttttctccttggtgtgaggacatttatacccagtgtggtagtgctcactcattagtcatagatcttgtaccatcgggtattatgtgcggtgagggatgtgatgtcagaggcacctctggaatgttgtcactcagtggtggttttcactctgggctttgtagttacagatgcctaaggcattctgatttgataagacatgatatttatattagaagagtttttatttgcacaaggctgattgcttaatagaaaacccacctagagagaatggtgaacttggttaaaatacaggaggtggaaatctctttcttattcagtggtgagccgtgcatttctgagcagccttactgaggcaccttcaggtcataatcactgtaagtaacatcatcttctaaattgaaaggcaaatgtattatatgttggtctgtagttttctttccttagtatttttaaagatattttccttaatatctttaagttttgatatcagggttattctggcttataaaatgaattgggaagtgtgtaaaatactagatgcataatccctcctatagctcttgcttttgacttatttacattttattataaatttgttcatctagtgagttgtgggagtatttttagatcaggttaaaaaaaaagatgagacaggtggaagaggttgtctttgtgccatgttattcctctgagtagatgacacttgcagatgaaggaacaagtacttaaataaacacatggccctctaaagtgttttgcaatgaagcctgcaaaaaagtaattttaaaggtgaaacttaacaagtaaagtcataataaaatatcaaagtatcaaatatcccccaatgagttgggggataattagatcctgttgattcccttttaacaattttagtat

SEQ ID NO: 25957 - DNA, 802 bp, Bovine  19866880753770
tgaggaagtgcacgcagggctgggtggtgtcccggggcagcacagacaccatgctggccgtggtgcggaagcccccagagtccatacagatgccgctctccttgtccctgaggatgcccatcatcacctctgctgtgataccccctgccaaggaggacacagtgagggccccgagggcagaagggggccctcccgggcctcagagtaagcccccgaggctgtgggagggaagagagctgggccccacgctgtctactcactgaccttgttgttgctgcagcagctcctgcccggcccggaagcgggccttggcagcctccatgcgcacaggctgctggctcagggagaagacctgggcaaagtcaaaggtgccctgcccgtcccaccagccctggacctgggcgtggggccggagctcagggtgttctgccgagatgtccgagccgatgctcagctggttggagatgttgtggaccccctctacagaggagatgaggggtcgctcatatattgttgagcccctgtcctgtgccaggcactcagctaggtgctgagaacacagtggtgaagagaacaagacaacccttgtggaggggacagttaaaccgatcacatgaataaacgagagccggcaactgcagggagcatcatcatgaagggaccccggcttgtgtataagggagaagcctggccaccaggaagtccaggaaggctccccagaggaagatgcaggctgaagcacaaaaggactcaagcaagtgaagggggaggtgaggtactcgagagggctcatctcccgtgt

SEQ ID NO: 25958 - DNA, 1216 bp, Bovine  19866880765757
ccctattttgggtgcagggaggcttcactgaaaatctggtaaaaatgactattgtcttcagtgtgcgaagggaaaggaaattcacttttcaaacggatgcagaggtcgcctttccgtttgggtgcagaacaagatgccctggaaacacgcgattaccaaagggtgttattgtgtggggatcacccagactcctatccttagcatcacgaggatgtgagatttctgctcgctgctgaggcgcggcattaacggcaattagaacatctcgccgctgcggttaggcttgctccggtgtttctggaattagcaaattgctattcaacgtgctctcagaagttggaggttttttactccagtgttcatgttccgtgtgggaaaccaactcgtttctcccggcttgggccgcgtgggataatgggaggagtggagaggagaggggaacagacggactgactgacacagccaaactaatagcgcagctaaatgcgatttggaaggcgaggtctccccgaattagtgcatgaatttcctatcgatccgcccgtggttccattcatctctgacaagtccctccgtacacccgcctggttgctccgacgcctcttctttcactcactacccctccccgtgcggctgcagagaaaaggcccacgcttgatgcctcgttcccctgtgtgtgggttctcctctccaggcggagcccctagtccgcccctcacttaacttccctgcttagacgctgggtgcagatgctccatacccccatcgataagaggggccaagaccctaagggaggcctgggggagggaggcaggacgggaggggccacattcagagccccaacttctgaggggatccagggattgcgctccgcccagcgccccaacaggcccttaggtggcaacctgctcactctctctctctccctccctttccgcgatcccggagaggcgaggcgaggcgaggacgcggtggccccgcaggagccctatgtaaatcctggtgttgggtgggtagggagggggggtggagaagaaggggaaataaacctctttggctggagtagggtccgggtgagcagatttccttatccgggaatcgcaggcggggcggccattggctccgaggatcacgtgggcccctaactttgttcacttgacagtaagtaggagggctttcggaaacaggaaaacgagtcaggggtcggaataaattt

SEQ ID NO: 25959 - DNA, 1727 bp, Bovine  19866880780857
tgtgcagctgccctgtggggtccgggagaagctaagacacggggtgtctggggaggtggtcccagggccagaatagtccttcccaacctgccttgtctcctcccttctagggatggtaggggagagtttgcttctgccaagcccggggctctatccaccacccaccatcccacccctcacaggcttcctcaaggagctggagcagggaatgagcaggcaccgggagctcaggcagcagacagccctgctggagcaccagctgagggtggagactcagcccaccctcacagacctgcccccgctgccgggggcgcccatggctggggacagcagcccttccgtcacccccacacaagagaaagagacaaccccggagcccgcttccttgccagaggcctcctctaccaccaagagactgtgccctctggctcccaggggccagcaaagcactatgcaggcaaggaagggggccagagcggccacagcccccaaggcctctctggctggggcccccagcacaaccaaaactgtgaccaaaaaaatcaagaagtgaaatgcagcctactgctatcagcgaagccccaggcacacggaggaacaaggagtgggcctcccctcggcctgagagccctggcctgtggcaggagcctgtccccaataaagcatctctaggccctgcgtgtgtcttctgcatcacttggggcatctcaggggaagctgtcagtaaaaagcacccagaaacaatagcaggaatacagagcctgattctaaagaacaggatctttcaggaactgcccaagggactggtgccccacctcagggcccccacctggcttctgagctggcaggaggtgggcactgcctggtggagatgccatctcacagtagacacatcacataccaccggccccccaccagggactgcccttccaaggttcaagccaagaaccaaaaacgtgtggttgtaattctccccatgagcagccacctgctgtaccagccatgcccctccatgttcccacacccacatgttgggggccccttctcttcccaggttcctccaccacctaagtcagaagaatgtgctgcccagcaaggctcccagaggccctgcagccactgcagggctgccctttgtcctctcttggccctcccacccccactggagctggacactgaacaagaaaataaaacacatttattagagcaaaggccaacctggccactcagaacaaggctggggtgggggatgaggtgaggggatttctctagcctctaccccaggggtcctgtgcccactgcagccccctgcaccccaggccaagtcaggaggggtcaggctcaggcatatgcctgggtctccttctccacaaaggcctggaagaggccgcccagctcctgggcgggtggagcacactccctggtcagcagccgccgcacagccaccaggccttcctgctccaggtcccgctgcttctgccgaagctgcttcccccgagcctgcccgggaaagggggcgatgaatccccgggacaggcttccctctggattacggagtaggggcagatggctgccatctcacataagcaggagaaaggatatacacccaacattttccagggttgactttgaagggagagattcctctccttagctctagagtctcctttgctcccagttcccctcatatttccagagtcccagttggggtgggggaagtgcgtcat

SEQ ID NO: 25960 - DNA, 1335 bp, Bovine  19866880829435
acctacagctagatgggccttgatttcaccagataagcaatgaaatgggcccgataccccctgagagaagtcccttagccacactgcttaccaaggtgaccaaaatctgctgagaaaacctatcaaacccacttcttgtctcctgcagccaaacagcacctccaacatcccctattggccccgtgcagggtggagaaggccagtgaggtgctcccgagggcaggagcaagagcttagcaggcctgaacctagcctgccgtggtcacatgaccacagggttctccccaaagcccagtgcctgtgagcaaagagcctgtgtaacagctggtgactggatgagggacattagtgggcaagggtagcatgcctcagtgagctgatggcggccgcaaggggtaggtcagaaggccaggggagccagcagccaaacaggtggggcaggaggtagccgacattctctcagagagaaaagaccccagagccgcaggcagctccccagccgaggcttcacagtgcctgagggtgggacacgcccgctcaggccccaaagcccttctattccaaggacagttgtacctggacattccacaccaatgtctttcctttttcaattcctagacttccaatccccccaaaaggaggtgaacaggcaaagattggggggaagcgatgggctgacattaattgataggagcggcttcgagcagttcatgcggccttatctctctctcctctggatagcgtgtgtccgccggagtccgcggggtcggtgattaataggggccatcactcactgtccaggacggctgaaaggcagcagggagggggcggccctccccagaactgagataacaagcagcaggaataatgagtggtgtcactccacttttcattttgatggaaagtcattacgggagtcaacgccagcgacaaagagccatgaatcaactgctctgctatgaaattaaaatcgaattgctggccacccccaacccctaccttcctgggaaatggggatgggtaggtggccggggagaggggtgctggcctagtgtgggctgtacccaatcacagagcaggcagttatgggtgggaagtgggcaggcagctagcaaaggtgacagctcctgtctccaccttgttgaccagacccttccttcccaaactgcattttccctctgcctggaggtaagctgtgattaaaaggaaaatacagctttgctggctccaacgaggctgccacttgactgctccccttgggcttctggcctgagtggggcagtctgggccggccgtggagagaaagggccccggctgacagctaccccagagccc

SEQ ID NO: 25961 - DNA, 2659 bp, Bovine  19866880838849
ccccacacccccagatctatcaagaatggtctagggtgtgcctggtgatgggagaagcaggtccccagagaaaagacaagtggaagggcagtggaggaggggagacatttatttgacttcaaggaaagctacaaacaaataccaaaagcgaatcactgagacaggcccggcaaagacagatttcacacgtagcacagcatccactcgctcactacaaatggtcttggaatcgaaatgggtagggaagaggggataggtctgacccagactatccccatatttacaagctttgggccctctataccagacccatggattcacagagaaatacacaagacattttacactgaggattatttttgttttctgaggctcccagaccaggccttgtggggcctacccaggcggcaggaacttaaatctcactatgtacctttcctcttttcaacatcacccctttggtcccccttagctccctcccacctcaggaccaagcctcaggaaacttgggcctgggagtggggagagaggaggaagaggaaggaggaaagagacacagtcatggactcccggtctccgaggccagctcagctgggccccgcgctgcggcactatcccacctcaactgctgccccttttagagaagtttccagctgaaactcaaaatacagcgatcatccttttataaataagttataacacagatggggaggggaaagttcacattaaacatgcgagtttctttttttcctgggggaaggagtgcaaccacagacacgaacattcagaaacactggcggattgggggtgaacgcaggggagtggggagcatggagggaaaataataattatcattattattacaataataacaagattaaccagtccaggagagagggagccacaggaagacctaagaccaaacgaaaaatcgtaacacaaggcccgggctgaggcaggctcgtgggaaccggttcccagcgggcggcggcagcgcgaggaggcttggaggggccagggctgggggcggcatgaactcttgggccgcccgggctcctcccggcgggctcagggctggaaggcgctgccggctgtagccaggctcatacttttcagtttgttgtctttcttccacttcatgcgccggttctggaaccagatcttgatctggcgctcggacaggcagagcgcgtgggcgatctcgatgcgccgccgccgcgtcaggtagcggttgaagtggaactccttttccagctccagggtctggtagcgggtgtacgcggttcgggcccttttcccgtccggcccggtcatgtctggagcagacagagcagagcggcgaggccgcgttattctggttaagggagggggcactgggtgggaggggggcgtggagcaggacccaggcgtccccggcacccagctcaccgcagctccgatcctccccactccagatgcccgcatccgagcctgtttcctgatgcccccttctcctacagcccccacttctgcccgcagcgaatgcgcccggctttgtctcttgctccctccctgtgcctcacccttcgctgggctcaggcggccgctcaccccgggagggaggagaacggttgcacttttgccctggaaagctcgttttactgctcgcccctcctctgctaaaagcagtctcaaaatttcgggggcaagcaggacccttccccatgttacataaaccccatccttcatcctaaagctagtacagctgggcaaataaaacctaaggcgaatctgtgaacaaattattaaaaatactcctcttcaaccccccagctaagccctcttttggctctgtccctccgagctttttctccccctccgaaaaagagaaatctatatttgaggaaaagccaagctctcctcgccgactccccccacccacaaacgtggagaaggaaaagccgagaagacaaaaaggggagcgagagcgagaattaccatggcttgatgtgaagcttcctcatccaggggaatatctgcggagtctgcccctcgggcgcggctgtggaggtggccatgggctctggctgcgcccgagctaggcttgggctgcttagctggctcgccgcttcctcaggctccgaggacgcgctggcctcgtctatttcggtgaaattggcgctggagctggccggggtcgcctggtcggagggggacgaagcagagggcttggcgcccgtggctgtcgccgttggtgcagggcaaggactcgggcgaggacagggagcagctcgacgccgcttgcctgaagcggggctcctgggcgggcgcagggaaggcgcgcgagctctcgcccaccgccccaaagtggctggaggaggccgagggagcggttgacgctgaggtccatcccattgtaattgtagccgtaagagccggtgtgcatggcagcgggatccctgtaagagccgctcagagagctgccactgccataatttagcaactgatagtccgggccatttggataacgccccgagaaggagtttacaaagtacgagctcatttgggtgattttggagggcttgatttgtggatcgtggtcgttataaccctgtgcttcacgatttatgatgtattaatgaattatagcgatgcactgtacttcgttttgctatgtatg

SEQ ID NO: 25962 - DNA, 1290 bp, Bovine  19866880864035
tgaaggagtcttaaacacgaagtcagttatttggactctcttaatctggttggagaggctcttggcctggatgagcagattattgggggaacctgaaataggcacagcctttaccatcagcaacaatcaaaagtgtttatggaggcttgcacaccacaataaaaggatttatgctgctaatctccatcaacaaggaaaaaaaaagccctaccaaacctgccataaaaagaacagcaaattctataaacaaaaagcagtatggccaccaaccacgggcacaccgcacagcttgactctgctccagtggtttcctatcgctgtttatggtttcaagactatcacggccctcctcatgctcctcccgtcacagggccctgagtccctgtgtggtgctgcaaataccctgtcagtaggtgtcaggggatgtcagggggaaaaccagcgggcgcctatcataagccttaaaagagattaaatgcccctaccccatgattgctacattttaatttctctcctccctgctggttcctatttgtatacgctcttccatggctcccctggagtagcacagacatgacctggaatgaccatcctgtcttgggatgagaattcaatttctaggctcagtgaatcctaggctgttccagcaaaaggaaatcaccattctctagggcacagattcttaaactggagtctgtgaacccctggcatgtctggatggacgtgaagggatctttgacttccttgaaactggtgtaaaatctgtgtgcatgtgtacatgtgtcttgtcccttgggtgaggtcccggacctttcatcacgttctcaaagggttatgaaccctctgtttcatcagtcagcactttagcgggaacatgcatgatctttttggcctggatcggcactttggcccagtgtggccatcttcccgctacttccctcttttaaaacacaaaaggaaaggaaatcaagaatctcgccatgctgggttttcaaggcttcagccttccagttgccaagtctgttcctgcttaaaaggctgaccacgcttgcttatcctttctaaggccccatctctttaatgtgacttaaaagttgtggtgtcttctcgtagcttctgttcaaatccacatgatggcttttggagcaagctgcttgacaccctcttttcccctgagaatgttcctaatggaaacgttctcttttcacattgaattgagcttcaataagcctctgggaacaagattcccagaaaatgtctcatacttttgttcttttaaccatcaaagtt

SEQ ID NO: 25963 - DNA, 1273 bp, Bovine  19866880868127
agacctcttgtccccgtccttgcagttgggacacgtgcaggcaatgcggcgccgcttttccccaggctgggtctctccagccagggcctgttccatctgcagctggatctgggtggggctcagcccactgatggtcaggttgtttccagatacattctgcacagtcagctgctgctgtccgccagtgttggtgacgggcacgccctggacctggacaccgttgatgttgatggtctgcatggcctgggccgccgctgccagctgtgctgcgttcaggctgatgatgctcccagcaggagcgatctttggcaggggtcgttcttttcggagaattgcagccgagtgctttttgctggtcccactcagatgggcagcacgggacgcggggctgctacaagtggtggtggaggcagtcgcagctgttgctgaggggctgtcctggacaaggaccgtctgtacctcaccagaaggcgtacggatatagacctgagtaggtgacggctcagcagcctggatctggaagttctgggagggcttctgggggatggtggggagtgtggcggacgctgcctgtaccacccgcagggcctgctgtggaatctgcaccacctgctgctgctcggccttggggggcaccacctggacctgctggaccacggctggctggcccccgccggggctctgaacaatgagcaggttgtttcctgcttggataatgttgtctgcggtggtctcgatcagcaccgtctccacctgctcggccacagccacagggggctgggcggcaggaagactcttcttcctggctttcttgttagtcttagacagtggggcaggggggctctccgtgaggagctgagtggcggccccggggtcgctggtgttcacgaggttgttgacaggcagagtaagggtcacattgccaccgccacctgtcagcttcaccacattggccccgctctgtgccggagtggtggtcgtacttgacttctggacaggggctggcttgatggggacgggcttgtgactggacggggacggggtgatgatggcttggttggtgccagggatgatctggatctggttggtcagactgggctgcacctggatggtctgaggactgctggcctggatctgagggaccgcctggtactggatactggtgttcgatcgggtccctttgttgaccacggtgggattctggatggcaaacaccagctgccccccagggtaggacgtgctcagctgtgacccctgaatctgaagtatgttt

SEQ ID NO: 25964 - DNA, 1384 bp, Bovine  19866880870116
ctggatcctctggaggggtagtgtgttaggtgtccgactctttgctatccatgaattgtagcctaccaggcttctctgcccatggaattttcccccataaccaagttatgatttctgccctttctgagccatttctcaggagatactgtactctaactttctgaacacagggctggatcctctgaaggggtagtgtgttaggtgtccgactctttgctatccatgaattgtagcctaccaggcttctctgcccatggaatttttcaggaaagaatcctggaatgggttgccattcctttctccaggggatcttcccaacccagggattgaactgggtctcgtgcattgcaggcagattctttaccagctgagccaccagggaagctggagggatagggatgatccctaatccatcgagactcagagcagctgaggccggtctctttcaatcattctgtcagtgaacccatgtctctacatatgtccccatatgtccccaacatacccaccccaggaatccctgtcaatcactaagaagcttttcccagaggcagggacattgcccccatgactttcagagttttcttctatcctcaggtttccctggatgagggctcattgcacccaggagaataagatgtgtattttcaatgccttaaaaatcaggtgtctggacaaagaagcagaagcattatatgacatgacgttatatgtggaatctaaaaagacttgatgcaaacgaacttatttacaaaacagaaacagtctcacagacttcgagaatgaacttaaaaggttgccagagagaaggatgaggggaagggatagttagggagtttgggatggacaggtacagactgacactgctacatttaaaatcaataaccatcaaggacctactgtgtagtacagggaactccgctcaatgttttgtggaagcctggatgggagggagtttgggtgagaatggacacatgtatatgtatggctgagtcccttttctgctcatctgaaaccctcacatcctggttaatcgactatgctccaatacaaaataaaaagtttaattaaaaagtcagatgttgggataaagagaaattgtgggcctggtcaaaaggaatcagatctctcgtgccatttctttttctttcatttgatgtatgtctgtttttagagtggatgtaggtgagggtgataagggggcaccaaatacataagctataaagtggatttattatttttaaatttttttattgaggcataggtgatgtgtaatgttacagaagtttcgggtgtacaacatagtgattcacaactttgaaagattatactccatttatacttatgataaaacattggctgtattccctgtgctgtacaatat

SEQ ID NO: 25965 - DNA, 1877 bp, Bovine  19866880879791
caccccagggaggttactcaggacatttaccaaaacaaacagacctgtacaaagggggcctttgttagctggcctcacccaggccagaggcaactctgaagaagagggagggagcccagggactggagggagggaaggtgggctcaggtgtatggccttcccccaagcctcttcccccatcccgccccaccacatggaactttctagggtccccacaatcattcagtccataaagcctcccatggaggagctgactttccgccgactgcagctctgcccagagttagcacctgatactcagagggtttataatcagccagctctgtggtgagtaccccacgaagttcctcctgtaagcctctcatcataggtgctgtcattaccaccgttttctagttttccagctgcattagctgaggctcaagagatcaagtcaccagacctgggtcaggggttcctagtggcagagctcgggctgaggccagatctgtgcatatggctgctgcaccacacagcccccttccccctgggtttttatctgcttagggaagggaagcctggcatgctgcagtccatggggttgcaaaaaagtcggacaggacagagcaaatgaacaacaacaggggaagggaaactgaggctcagaacaaggaaaggagtacagtcaccttctgcagtgggaaggtggggagagagggtcatgcctgggccttgcggtcctgggaggcgagcatcctctgagggggccgcccagaatctggaaccagtgaggaaaagccaaccagcttcaagggtgagaccccaaaccatagggacctcccgcttcagccatcctgatgttccctgaggcaaggggtggggaggggtgagaggctgggccccaggccactgacctgtgcttctgtctcatacgggcaaccaccaggccactatcttctctcttaggtgagagggtctgtgggttcctcaaccctgtgcatgccactccactccacggccccaaagtgatggccacagaatctcccacgaaaactccacacatatccctaagttaagggatggacggacgggctgggggcaggcaataagagccaaaggagacctggctgcccaggaagtcagtgcccaggcagccgcaagtgttcaccaggccagaggaggaggaagcaagagtgcaaatatgaaaatatgagcaggagcgggagaggccacggttattgaccacagtttcactgggacgggacccaagaggggaaaggggggcaggaggggccaactagaactggcctgtgctgcctagaaggggccaaccctgggcatcgggctccccctgctggacacccaacctccccaagtggagaagcttaaggtacgaggagtcgcttaaattcttcaactcccctcaaacatgggggaggggcgggggacgagaccaggctagattgaatatttacatcatgcatggctgatgaacttttattttagacttggcacagggactgtcagacagaggaaaggaaaggaacagctgagaccaggctcaaagcaggggatatacacagaccccataacataacaggacaaggtagagaagggcactccagcaccctctcctgcaagtggccacaaggctagcactgtgccttcctgcaccctggcttaaggaagcccgtgggggttggggggggtgggtcaacacccagagggccgctcttggaggaggcagtcagtaacagacgccaaagcacacacccatacagtggaatgaagcggtttacagagttgcaagctcaatggccaatgtatgcaaacagtcagttctctgatcctggcttagtcacagcaaacatttgcccagcctggctcctctccgcagc

SEQ ID NO: 25966 - DNA, 1917 bp, Bovine  19866880913868
ctaggaacctgatgccagaacacacccccttccctggcactcctcctcaggccccctccctgtgttggcacccaggatcttctttgtcaggagtcccagccctgtgtccagctctatgtgcttagagcaagagccccaccatctctgtgagcctgaggctctgggggtagggcccaggagacctgatcagcctagaggcagaggctgtcgccccaactagacgggagctcccagagcaggaaaagaggtcacactttctcctccttgtgactgctgatgccaccgagacacaagagcatgggccctccccatgcaggccaggggtccctcaccgtgagagcagcggtccagcccatcactgtccctcagccaggaagacaccttctcccgaggtccaacccctggcagagccgaggcactacccgataccgcaggctgggcaccggtaacctgtggggcgagtcaaaggtcaagaaggcagctcctctttgaatctcaatcctcacgtgagcgggtcctgccctggggcccatcttaccttccagtgggcggtgctgggcagcaagcttcggggcacatccaggtgctgggctgagcggtgggcacgcagctgggccacccagctctggaacaggtcctgggacttgatctgcagaggtgatggagaacgagagggacgcatgaagggaaggattgctttctaggggcaagaagttggggttctggtccccaggcaggcaggatctctccctacagcacacagatggtgcaaaggcccctctctgtgcctgatcacataagaaccaacagggccagtttgccgttggctcttgtacatggtgggaactcccctctggtcaaactcagacggcccctcggcccctgcccctctctcctgcgtgacccagtgcctctgccagggggcaagccaccccctgcctcccacggacgtcacccttgaggtggtagatgttgtcttcagtgtcaaggtcaatgcgctgggcctttttgttgatggacatgaccgacagtcggacatcaatggagccatgggagcttccccttggtgatctgggatggagagaccaaagagggaaagggacgtgagttgaggccaccgggccaactcaaggccaccatccccttgaggtcatgctaggttcgaaggtcaggcagcaggttcaccctcaggctcaagtgacagtgtcagcaggacatgtcagtcgtcctcccctgcactggccagcctgctacatcatgtcacaaccagagctctagggagtcacagggcaaggaacacttcctaccctcgggagtctgcaggcagggctgaggacgatgaacctcctgcagagcccaggtgtctaggcctttagtttctcgttcttgcctgagcacggtacgaggacaaggatgataaagcccctcggtcttgggcactaatctgagcctggcactgtcccaagagccctcacccaacaaagactctacaagtgggtgatcaccctctctccaccttaggggtgaggagttgagacccagggaagtaacctgcccaagaccccacacccagaaaacggcacacctgggatttgggccttgctctaggggattccagaagccccctgcctgcccagggccccctcctctcacacccacagccgaggccccaactcacatcttgccgagttgtcgcgtagtgaagaatcccatcctcgagcacgaagtatctctgtgaggatgtccagagggaacaggaccggggtggggggcacggagaggaaagggtgtggggagagcaaccacacggaagtctctcctcacacacagacagcctgcgctgcccagcggccccacatcccttccggcccctgcatctggcccctccctctgccctgccaccctaccttgtgccag

SEQ ID NO: 25967 - DNA, 1513 bp, Bovine  19866880962666
tttctttggaggaggagacacttaagaccacaggtgcagtgttgctcagttcaatatctttgtccataaagcaaaagcagtatgaaatgatcccttgcttaaaactagccaaggttaagagagcctgtagataggttgatattcctttgtgaggcaatgcatttctaaagtgccaaaaataagggaatagtcttagaatataatattctgtgcaccactgaaactggtgtttttatacatattgatggtattcattttactgcaaaataagtatttattcttcagttttatttgtacttcccccaggcccattagtatagattaaattttatattaaattgctcaaataatcagcacaatatatgtaaatcaagagctttagcttcattggtactatttgtgtggatatatgtgaccatattcaacatagtcatttttttctttgcaaaaacaaggtttctttcctttttaaagctgtaatcctatttctaaaagacgaattgtttaccaaactacacacttaacgaactcaaaattataaaagaaatgactttgttcttgccactgggtttgccatttaaagaaccgaataaagaacttctgttttggggtgaatcacctcgtgatgtgcttctgtatctccttaaggtcctatcttcatcttcactggttgggaggagcaggggagaagatggcttactcaagcatttttccccagagaattccatagcaatatttttctaatgggagagtcctgtagttaagttgggcaaattagttataatctttgtacctgattacctaaagactggaaggtaatagtgtgtgacaagttacattttccattacagcccaggtacagtcaattcacagagtagaaatattctggtggcaatgtcccttcaagggattagagctatcactgaaataaaacctcatataaacatcaaatatcataaagccaagatttgatctttgatttttacagaagttcctccacaaaacatcctatccttccttctacagtacaggcccaagtcttggcatgttcaaccgactaggaaatccagtcccaaccatatttatccagtgtgatccctgagaataattagataggcctactagggaagatcctatcacaactgcaattttcttttgcgctacaggttaccaggtggcattcgtattaacaaaggttcaaaccacaccatcaaatggttcaaaccatataacctcttgtcttaggagttaagctagcttcctaggcttcccttgcagtggttaactctactgagaagctttctatcagcaataatagcttcaaggtaggaaataaaaaatggaaagtgtttaaattgttaatgggtttcatgttcttgtcactgttgagggtttgttcccttttataaactcatagtttttggttgacattgcttttatgcgagccatcagccagttggtgatggtgttgctgtgttagaccattactgccggcatagtatttgcagtaaag

SEQ ID NO: 25968 - DNA, 1887 bp, Bovine  19866880987078
cccccgaacctactataggcaacaccccacaaaggctcccactctccggtttctctgtacttggataggagacttggagtctcccaggactgccttagggctgccccagccaggcaactggtctcctatttcctagaaattctttgtgtctgtgtttcttcccagggagcgggggtcacgacgccaaggagaaagaatatgaggtggtggatcctcttttttttcccaggctgtcctcatctctcccgcctcaagtctggttgccagtggaggggagagagggctggggtcggggggaagtggcaacagaatcctgtgccctccaggcctgtattgcagcttctccctccacggttcctccacagaaggagcgcaggtcatatccagcaagggcctttatcaccagcctggccctgccgctgcctgatagagcccagccctccccccacagatctcattaaggggtcgccgcttatgcttcccagccgccccccatccatctttggccacggttgacagactgggccccggggctgatgtccggcaggtgacagggttaatggcagaagagggcagagggcagaggccagccagctcacaggggtgggagggcagcctggggaggccctgggtccattccagctgggcagcccctcaaattacagcacctgggggagggatgagtcctggaccatccatccccggggaagcaaggtggacggtgtcgaccatctagggagcagatggtgggaggagagccccttagcttgggaagaggaggagaaagaagcttattaatagaaaggggagacgggctagcaggagaggaaagagaatctctatctatgtgggcccagtgagaaaattgcttcctggatcccaggtggctccttggtgagaaacgcttatcttgctgacgtgaatggagtcaggtgagtgtttggagtggctgcctgtgacccatcttgctttccctctcagccgcctagtactgtggcccagcgctgtggttaggagcaggcttctagagtcaaacagagtgagtccaaaccctgtttagatcctccctctgggaggccaggtaagttacttaacctctctgagcctgatttcctcctgctgtgtaatgtatccagctcctgtgaggatgaaataacgtgatgcatggaaaacacagaacctggtccaccctgagtgttcaaaaaaattttagttgcccttggtagtaagtaagagtattgttagagtattgctatcacttctgtggcctcctccatccccaggcttttcccaggccttctgcctttgggagctcccctcgcgtgacctcctgcatgcccaggatcacctcctggcctgctctactcactcccagggagctcctgaatgctgctttgggggcagctgccccgctcacagctcccagaggagaggccctgcaggggcaagggttcgtccctccaggcctttgaagcctggggaggggaggggttgccctgtgctcctgacctggggggccaggatcagcccccccatacctcccaccgtgggaggagagtcaaggaacaatgggccgtggagcattggctccaacgccggccagctggcattcaggcgaggggtggggtgggtgtgggagcttgccctccccacagcaagcggaaagtccttcaggagagctggtggtggctggggtctccccacgggggccccggatgtcaagggtatggtagagagaggaagacaggggttatcgcagcactatgtcctgggttgaaattgtctagagtcctcccagagggggtgctgcaagcccctcctcagttccaggggccccctcaagtacacccagatctcagggtggcaaaggcaccaaccagcacgtct

SEQ ID NO: 25969 - DNA, 757 bp, Bovine  19866881009112
tattagaaaaatgaaagatcagtcctaaaatttttcagcttggttgccttccagctctagccagatcagtatcctaaacgtacagttatgcaaggacacagtctgatccatttggccataacttcagtgatgagaagcaatagccatggtgcgtgtcgtgtttgggtcatgcttttgcgaaaactacaaagagatctagaagaatatagaaacctgaccaggtgcgacagcataaaatgaaaaccaaggttacatgctaaaccatgcataaaaatgagagcatgttgctacctaatcacaattccttcccctcttcctttgtaaactgccctcagtctgagaatgtcaggctatagcctatggagagatacctacaaacaagagcataaccccataatcaggaatgaaaacttgctaacaagtaataaaatttagatttatagacttaggaagacatagtttctactgtattgaaggaaaaattttttagtatgaagcattcaatacagtaactacaaaagccagccaactatgaagctcaaaatctgattgctctcattgtgcaaaatatacaatggatatataattacaaagaacccccgtgtatatatgggacttcgcaggtggctcaggggtaaagactctgcctgccaaggcaggagatgctggttcagtccctgcatgggggaagatcttttgcagaagcaaatggcaacccactccagtattcttgcctggaaatctcatgacagaggag

SEQ ID NO: 25970 - DNA, 2204 bp, Bovine  19866881037341
cctgggcaaagtggggttgcccgactagcctgtgccggccgccgctggggccgcccccagcgcccgtggtgggtctcccaatggaagcggcggcccccgggggagggggtctgattggaaagcggagttgggaagtttcccagcgtgagttgagcgctgacggatttgtgatcggccataaaaccggcgcgttcagattcgtaaatcaatctcgcctttctcacagtataaacgttcgctttatcggcagcaagaaagctctctgcttgcgccccggcgcttgtttatttgaacatggacattcccaggatccgaaaagagtgtgggcatttgaacagaacctgcctggcgtgcctccgtgttaccggcttttctttagctcgttcttaaaatgaatttaccagttttgagattggtgtcttaccatgctcccgcatattctctcctctcttctctgctacccccgcccccgccctctattttccttttagactttagtggcctgcttttcttggggggagggcagttttaatggatttctctggccaggaccttgcagggagttgccctcgctggagccgggcgcgcggctgaattcaataccagtctgggttttgtatctgcacaatcaaagccgatcacccccctacagagcccgggcccgccggcgccccacccgagcgttaagagcggtattcttaggggaccaggccggcccagtgctctgcccgggggcccgcgccgccgctcccgctggacccagacaccacctgggttggtggtttcttcaggggtggtgagggcacctgggtcttcaaccttctccccctcgagtcgcttttggttgagacccctccagataaaccgctggcggctcctcggccccctacccccgccccaaaccacatctgttcttccttgtccgccggcccctgcggctgccccagagctgctgaagataaggctggaagtgtgggctggacgaggggctccttcaggaatgtcttttctgcttccctttgcaaccccatcccacaccgtggccaaagactccgattcgattctgggactctggtcgtatctggtctgctccttctggcgccaagctgtatgtgaaggtttggagggatgttttgttttgtttatatctgagatgaagaaatctgtgtgtgtttctctctctaggcagaggggatggatttcttctatcagcactggtgtttaacccctcaatatgaaacccctcatctttttcctattgatctgtctccattgtgtgctgattggaagctggggggccgggtactaacacctggaaaataggaactgggctgtcaggccaacttcaaagcctctttcttccctctgctcccctccagttcaaacctctagctgtcttcactggtgtgttgtgggtggggagtgactgaggcagggtgtgacataagtatccagagattaagcgcccacttcttttgtgtaggaatcttcttactccaggtctttgtctctagagcgtattctcaatagaatttggttccctctaacagtaacaacacaaggaaaaaaagtcccccttgtggttactctcaactctggaagctcctaagtcatctcttcaccctgtcccctttctgccctttcaaaaggtaccacaaaagatttttttaaaaagagaatcaaagccagaaacccccttctttatacacatataatctggatctatgaaatgtttcttttgaagctggtccctttagaaattttgttggtcatttaaggaagagggggagtatgccccactaaaatatcctaggagtaagggtaaaatagagttggggagaatgttaatgttaaaaggatgtagagagaggaactggatgctgagaaatccaggggcttggagaaggccttctgtggcccatcccaccccaccccccgagacgcccctgcagactatttctgcaccttcacaaactaagcagaagcaggaggagaagggagagaggagaggtgggctgtgggtaagtgtgtgtctgggggggatgctggttaggaagtgttagaaacatgctgttagaaacagcagatacagatatgaatgtgggaaagagaactggctactattccattggtgggttggggggaacctatttcgcaggaaaatttctcctcctgaaggggaaggtcatagtggtcctttgagc

SEQ ID NO: 25971 - DNA, 1334 bp, Bovine  19866881037477
gtgctctcttacctcttacagtgtcactcctgtgacctctaccatttgaaatgctttgattccaccttgcccaagggacctgtgagcaacggaaaaagggatgaaggatgcctatgtctgacctcacctttacattgtccaatgactgaaggtataaatcagctttccccttgaagactcgagtgtcagaagctcatgtgaaatgctggaaatattaaatgatgtccctgagggttttaccgttactcagttttctcctgtaactgggagagctgttcacatgaaggatactctcccccaggacctcaatttgtatacaaaatgaagtatgaaactccaacaacttcttgccactttggaaagaaaataaacaattagtggaggttgcccttagcctactggtcctgcttatatttcaatgatctctgtctattcccagagaacagttcacaccaacaaaggtgtgataccctcattataaatccttgtttccagggtaataaatcagtgatggttaaaaaaatctctgcagacaattcaatgcatttttgtaatgaggaaaaagaaaacctcttcgctttgtcctagttagcacaggaagtgtactaattataattagaatagaggatcaactgccccagggccaagtttccagtgctcgctcatcactgtgatcttgggctgtatctaaaactcccttccaagattctttctgcaaaattttaaaatctatggactgttaaatctcccaacacactttgattcattaatcctcactgctgctgctgctaagttgcttcagtcgtgtccgactctgtgcgaccccatagacggcagcccaccaggctcccccatccctggaattctccaggcaagaacactggagtgggttgccatttccttctccaatgcatgaaagtgaaaagggaaagtgaagttgctcagttgtgtccgactcctagtgaccccatggactgcgggcctaccaggtcctctgtccgtgggattttccaggcaagagtactgaagtggggtgccattgccttctccattaatcctcactactatctctataataggcatgtgtgttagtcactcagtcgtgtccaactctttgtgaccccatgtactctagccaccaggcttctttgtccatggaattttccaggcgagaatactggagtgggttgccatttccttctccagggatcttcctgacccagggatcaaatccaggtctcccgcatggcaggcagactctgtactctgagccaccagggaagcccataatataataggcataattatctgtaataagaaaaattatcattttt

SEQ ID NO: 25972 - DNA, 4142 bp, Bovine  19866881051752
ctgttggaaatggattctcattggctggggtgattggtaagttttctaattctggttcttccactaggttatacagaggcttaacctctttgtttaaaagcagcaacaatgagaaaaaaaaaaaaaagctggtctgacataattatgaaccctctgggctaggcttgtaaagacatggtctctttgtcaaggagacccaagtagagttagttcatcattggagcatcacttcacagctctgcagggagaactgatgccaggagaaagagtttggcctcactatttggcttcttatagaccgataggctcttttctctcagattctattaagtttgggcctctgcaggcctgtcagaggagagaagaagcgttaagaagattctggcaaatgtctgggtaaaggagcctcctggcataacagcagagaggacaattcattttgatatctttggccttgaaatttctagttcttctgttggtgaatagtagcgttttggagaagttgcacagtctcttgtagcctaaacagttgctttcgctataggtatatgatcattcacaagcttgctttacgcaaggattgcccaaccaaggcctttttgaaaacatttaagcttgttgcatctaaccagtagaccctagtgttggcttgggtttagcaatcttatagaccttgctcacccacatttctatgatgaaatgtaacatattcttctaagatgtaatgttacctcctttgttttctgtcaacacacaaattggaagctttatgtcgagagattgaaaaatttaggaattattttgcaggagatagacaatggccacagaatgaaaggtgcagagaaaaactgctttaaagggtgcatagagtatcagaaaatgtagagatatgagtacttctgagtttaaatgattacattgtccaatctgaagcttcgtgagctgcagacttagagcaaaatctattcggaggcactctagtattttcttattagtgtattgggtgttatatctggagtttccctttgagcagcttaactggatttgtgaatgtcttcccagcaagttctaaaccagctgggctggaggccaagatgggctaagaagtggatatcattatggaatgcatttgttgatgcttttttgtttttgctttgcttttgttttgaatccacatggatctcctcaagtgacttccttctattgaaggaaggaaaaagaactttttctttattcctttctacacagagtcagcacttagatctttgtatttctgaaacatagttcagagtcacttttctctgttaagaactacttcttcggttatcagatctttccttggctagcagcattctcctggagacctcagggcggggagggtctcactttgctgtcagtttgccagttgtctgttgaagctggttggaaagatgaatgaagaaggtgaaaatgtggggcagtgctaattcaagggcactatctgtttgagtaggaaagaggttagagattgcccttgtgaagatgctcccactggtggatttgttccagttgacaggattccgaaatggaaaacgggtttttgtattgcctcactcaaggtgagaagcgagcccagaagcaagctgaatcagctctggcagcttggcgacgctgccacttccactgctcgtctggcttacactctcctgggtattctgaggcccccactggcctggggggttgcttctcatcagcttggccttcaagctggcgtgctcttgggagatgagtgctgctcaggagcagaggcgtacaaagaacaaagtgctcagttttgctgcttctcagtttaccctctgtgagcaactccaagcaacgttgagacgtcagagctgtttggcacaggaagaaggtgcttgcagacccaacggaatcctccctttgcccatctcattcccctgagctacagtttgtttccgcatcagcactgcatgttgtctctagccagaagccccacctcactggatgcatctgtccccaagccatgattgaggctgttaggtggtctcttcatcccagccacgcagtgaaaacggctcagaaagcagcaggcactggcctgcacactcccaaatgtcctctttctagagcttcctctgtggagtgtttgttatctctcctaggggactcggtggaaccacaaagccgcctttcagagggtgtgaatagggaggaagagacggcaggcagggccgtgtgactggatgtggactctttctgcccccagctagtgtctaactggaagtcttctcagactagcctcagagcagacccaaacatttcccagccatcagaagaataaatggtgactgtctcgtcccaggggaaatgaagtcaccactaactttaaccagttatgtcccagacgaatgtacagagtgactcacaaatgtgtcaaagcagagaaagcatgtacaaaaagtttgtacataatgatattctttagaggggaaaaagtgtgtcttggtttcttctttcctgtttttggcagtgttctgaggcccagtatttttgtaccgttgcctgggactctttctcaccatcccctgctggctgtcccatgtccccactcacttctctagggtcctttccagtctgataggatgcgagctagcaaatgatacggtcccattttcaggagagagctgcagggtggagacagataagaggtcttcagacagcagggacccgcatcgtcttaactcacttgtgaaagaatttctccccagtacctgttcattgaaagaggcattgagatgcggcatctggtgtgtagtgatgaggtgcacgtctgaggtttctgtccaggagaaagactcgactgtgctggtccacacatagactcttgtccccatgtgaggtgaccggcagagttgagttccttctgcgattggatcggctgagctgacctggtgagtggatgccagcacctagtgccaggacatgcagatctgcgggttttccatatatgaagtgtcttccttgccagtaggtaaggaaggtacatctggtagaagacatgaagtaactagtggatatcagacaataagaagtgctaaggggaaaactgaatagaggacaggagaacatgaggggtatggtttacgtagggctgtcagagaagggagtttgagaaaaccctgaaggagggatgggagggattgagccaggcttaatctggggagtccatggggtcgtaaagatttggacatgacctagcgactaaacaacaatctgtggaggggagacggtaagaactcaagcagagagaacagtgagtacaaaggccctgaagaggggccctagctggcatgtactggaatagcagggaggccagcatggcctaagcggtgagtgagagagagtgacagctaagtcagagaggtcacatggaccccttatgtgttgtggtgtggactttgactcttaatttgactgggtgatagtatgcaatggcaccccactccagtactcttgcctggaaaatcccatggacggaggagcctggtaggctccagcccatggggtcgctaagagtcaggcatgactgagcgacttcactttgacttttcactttcatgcattggagaaggaaatggcaacccactccagtattcttgcctggagaatcccagggacagaggagcctagtgggctgccgtctatggggtcgcacagagtcggacacgactgaagcgacttagcagcaatagcagtagcagggactctgagcagaggagtaacaagattgcatttaagtttgatgggtctcgggatgctggttgagaataaaaccagcagggacaaagtcagaagcccagctaggagactttcacagttatccaagcgagagatgatggggacctgaacctgggtgataaaaagaagtggttgtgaaagcagtcagattctgtatatattttgaagatagagctcaagtgtttcttgacaagtagagagtgggcttccctagtgactaagacagtaaagaatctgcctgcaatgcggagacccgggttcagtccctgggtcgggaagatccccggagaagggaatggctacccattccagtattcttgccggaaaattccaggacagaggag

SEQ ID NO: 25973 - DNA, 689 bp, Bovine  19866881056334
cctacccctcataagaagggctctcttctacacaaacatatcccctcccccacccccaccccccagattccagccccacttcccaaaaagcacccagtccttggactgggctccagcatccccaaggaaaagatgctatgggccttaggccagaggaccttggctgggttgaacaagacggggtctccctggctggagaccccaggctcagtagagaaacatacatacacacagaaatacacacatacataggtacacacaacatgcacacacatgtcctaatattaaataaaataccctttgcttataacttaaaaaatcaatacacaactaacccttgcatagggctctgggtggagaaagaagggcagggaaaaaggaggtcaggggaaaccttaagaccgctatctggagcctgggaaagcccactagcgccagggtcctatggcccaccagacccttcccccatcagcttccttccaagtgcctggctcagcctctgctggcttcccccggccccacgttccccactccaggatcaccatcaggatgatttttagcatctaaagaagggaacagggatgtttcctggacatcacctcagaaggcagaccctttgcaacgagagaacctcttcatttgggaaggggagcctcctaacacacactacaggaggagcaaggctggta

SEQ ID NO: 25974 - DNA, 920 bp, Bovine  19866881089176
gagtgggtagcttttcccttctccggggatcttcccaacccagggatcgaacccaggtctcccacactgcaggtggattctttaccagctgaggcaccagggaaaaccctcagaagtctaatctcttgaaatagtcccagtgattttttttttaaaaagtagcaccaaatagaatcaatgctgcttaactagtgtatgtttaaggaaactggaaaagggtccctcttccaaaatatcttctcaactgactcccttaattcctgaaatactaccattagaagtccattcccttagttgaaagcattattctctactgaaatccaaatgcctctgggagaggcattcccatccacagtatgataacaaacaagtgcatcaaggatactgagagagggaggcccagagagctgtctcccagggacaaagcacggccacttgcaaccatgcatcaggccaccaagcagagataactgatagaagcatgtccagcgctgactcttatccatgggctgtgtgtggctgacgatgctgcattgagctattatcagtcattagtacctcagagcagtggttcttaactccgttgcacatcacaatcacaatcacctgtcagtctttcaaaaatggagatactcggacagtaccctacatttgtggaatcaggatcatgtgggagtatggctgaggcatgtttatttttacaaagctctatggattttcagatgttcttccagagttgaaaaccgcaaccttggagtgaatctgtcaacctgatggcttgctggtgggtcttggtgaggtgggaccccaggttgggggcctgaacactgagtaccagaacaagtggtgagaggcaagggaggttccataaacacagaaaagaaccgagatacttatctatatcacaattttacaaacta

SEQ ID NO: 25975 - DNA, 875 bp, Bovine  19866881098858
cacggagcttgcttttgtaagagcagcactgtattactgtctcacagtcagccatgcattttacaataattccacattgtctaccctgggttttatttctgcttaacttccctttcagctttctttttaaaagccttgtctctttgctccctttttacttatctctttctttgaagtggaacgtagagaacatgtgggtttcagggaaatctgccatcccaaggggccttctccaatgaaatgcaggtcagcctgagatttggagttgaaagctgattagtctaaatgctcacatcttagaaagtctaaccaatctgcccatcaaggctgctgattccatcctatcgtattcgctgctggggcagagtcagcaccagacagtgatgtgccaggcagaatagcatctttgcacagcgcctcctggaagggagggcagtggggagggggcagatgctgagaggctcatgggagccatgccaacagatgggtctgcctgggtgcccgactaaaccaacgaacccttcccaagccaattcgcatgcggggccagagcccattctttctccgtgagatccccagtaaagcaattggggccacggaggaattcattggtgggtgggagcggggaggtcagcaggggcaggctgggggtgggtctgctcggattagcccgtgggagctgagccagccccggcgggcggggctgctttggcactctcctacagttactgggccttcctgcccgcctggctgctggtgtgtggagctcagccccctccgcaaagagcccctgagaggggccgggaaggggggaaggccacccgtggccttgtgaggctgaagcacaggctccttcctcagctgccagggaagaa

SEQ ID NO: 25976 - DNA, 1675 bp, Bovine  19866881105135
tttaataaacgaatttttttaattggtagaaatattttagtttcattatgggtatgtcctagatgttagctgggctgcccaggccttttgaactctgctgtgtgtgtttagtcgctcagtcgtgtccaactcttgtgacctcatagactgaggcctgccaggctcctctgtccatggtattctccaagcaagaatactggagtgggttttcacttctgtctccaggagatcttcccgacccagggattgaacgcaggtctcctgcacagaagtcagactctttaccgactgagctatgagggagttcagaactctaggcaagatctattcctcattgtgggaacccaaatatctcctcaaaatctgaagaattctcaaggggtgtgcattctcaaggttacctttccttccaggttcccctgcttccatggttcccaaatggggtggttttgtccctcagggggcatttggcaacacttggagacatttttgttgttgtcacaactagggaaggtgctattggtagctaatgggtagaggccagtgatgctgttcaacttcctacaatgcattggatagccctacagcaaagaattatcaagccccaaatgtcagtagggccagggttgagaaactgtggccgtgacatatatccttgtcttcaatttccacaaagtcctgtccacatgaagtccctgtgagtgtcaaaaacatcactgcagagtcagggggtacagggagagggaggaagggtttccatggcagttatgcaaaatatttcatattgaatattaggcattcctgttcctgaactcccttttgccaatccagtcatgagacaatgccctctggcctttcacctgatgtagttctcagccttatgctttctcactggcactttctccctgtatcctgtctggagcaaaacaaacaaaaaaaaggtttttttctcttgccacacagaaaggtggtttcactgtctgtttattggtttaggctcccactaacacccacacacagaaagaaacaggttactttgccaaacaatggtgattctcttcctaagaggaattctaatgctgttaagagaataacgtttttaactcattatataagtgtaatacttaaacaatttttaatcactttaaatataggaaaaataagataaatttcaagttctaccatcatcggagaatcttaacatattgacataactataatagatctaatttttcacattatgaaccattacactgtacagaaatcctataatttctgctacatttattcatatttatttcccctgtgtttccaagttcactgcttgctttttctggtttaccagtgctgcattataggttaggtgattctaacagatggcttttcaggtttggagtctttgagttccactgtttaattttactatccagtttttacatggaagataggacagatgtaggctcagaaacagagtggtcttagtatccagagagcaagctttcctgaaagcttatggctttgataaaattatttatgaattacttaaatttcatctaggatctccgtctaacattggtgatattctaatattaagtatgttatgggggaaataaaatttttattcacataataggagctttgctaagatgtatccaatggcacatatttatacata

SEQ ID NO: 25977 - DNA, 760 bp, Bovine  19866881278259
tttcagcaaacatttagaagtaggtggggtgggcggaagaaaactaaaaactctgctgatgatacagtgcagtaagggaaacttgggaacctcagagaaaggtttgatcagaccaggagacaaccaaactgcctagcaaaaagcatgaagatccacttagataaagatactttcacagggaaaatggctcaagtaattagctaaaaattatactcattacaaacaaacagaagagctgaatatggtcagtagcttttgttcttggtcctagaacctctaaaatgctgcacgggttctttccatgtgttcatgcgtctggaacccagaccataatcacacaggagggcaacaggagatctctgggagtagtaattcaatgaaaagtccttgcctagctagaagttggaaaaagaacgtaccccttttacttacagaagttgggcacatggggaaggactgatcttctgacttccttgcattcaagcagtcttatgcttgggaaacaatctgtctgagggactcttagcagttccaaaattgtagaatataaaatggtagaaacctggaagagagtgggtatcttcttcctcaatttggctggagcaattgcctctcttgaatttctgggatatttgtgcttttcaaaagtgactatcatctttatataacgcagcccacaatctgattcttaaaaaaattactattttttaaatatatatatatatttgctgttgtttatttatttgtttggctatgccgg

SEQ ID NO: 25978 - DNA, 1237 bp, Bovine  19866881279263
accggatcgtctttcgacgaggcctactaaccggagactcccctctggggcccatgacccaccgaggcgaggaagactgggtctatgagagacttgcgccctgactcccaatctgttggcactgagtggagctggagccagtgccccagagagggtatgggatgtggggccagacccttctaaactcaacccatttcccttcctgcctcttatattcagggcccttcagtgtttacccttggaattctccgtagtcagctagtctagtggagtttaacagtggcacagaccatcacaaatggaaaatctcgtgattatcttctcaaccttaactatgatttattggactagctccctgtaggagtggggcctggtgtgacagggggtggggcccagcagtcttgtctgttatcacatgacaagagtctgaccagagcccattggtcccagcagaagcacccgaggcaatctagccagtcggtttttcttttctttcatatttaaaatttggaatctagagactcagagcataggagctgttatagccaagtaaataacggtggcctagaaacagcaacttctggctgctgctcttgcaattctctgaacgatccacggatccctacttcccacacctggggttgtccaattcctccttctacctcagaaaacccattgtctgtaaaaaaaaaaagagagatttattttttcttggcttaaaccaagtcagaattgatgtgcttataacaaaccttaactaactcatttactaataggatatttttaaacctcttacccaactgatagctgccctccattatctgaagaagagcaatatggaaaagagactaaatttattctctgtagctctaaaggacccataggtggaagttagatgaagttagatttcatctcaatatgggaagaaatttcaaacaattggagctgcctaagagggagtaggttagttagtgagtgttctttccctgtcagacaggagttttgtagaagaaactcatgctagtacctgtgggtcaggaagattctcatcaggccttactttccatatttgtttataaaaactgaatgtatgtgagggctttccaggcggtactagtggtaaagaacccacctgccagtgcaggagatgtaagagatgtaggttcaatccctggatctggaagagcccctggaggagggcatggcaaccaactctagtattcttgcctggagaatg

SEQ ID NO: 25979 - DNA, 727 bp, Bovine  19866881291566
gcctgggtgctgagtccgcgctgaagaagatcctcctcccgcagctttgtgtccttcgccgggtgaaggggcctgcagacggactgggcttggcctggagctggccgccggcgtgtcgcctttggcgccctctgccaagcaaaagaaacacgattaaacgagtgagggctgggaaaggaatccacagctaatcatggctccatctgctcccaacccccctaccccatccccgactctagggagccttccacagcccaaatctcctttgatctctccggaagccggttcaggggcagcgccagaagctttaacccgctcccataacttgcaaaagaagtcactgagtcccgaagaaattaagtggttaaccccaaatcagagcagctatttagaatggtgaaggagggttggaggacatgtcctctactccaaatgtaacgtttttattccaaactatgatggccccagcaaaaatgtctttcttgtaagcaaagttcatctccagaataacagactttggaagttgtctatattggaagtttggtatttcctggatttaagatttggggggacacatagggaattggagacagacataggaatgactcagctagcatcaggagccaagacaggtcctgccccttctcttctaggactggtcagctcaaagctgctgtcacctccctagctgtgtcgatcatgggcaagtgctttaggctttcgaagg

SEQ ID NO: 25980 - DNA, 1385 bp, Bovine  19866881316474
tgaatggaattcatggttgcctgttttctctcatttctttacagggttagggattatttgtatggaccaatggtctcccttttctttcaatggaagaataatcctgcattataatatagtaactgcaaaagaaagctctttttctatttcattcttttctttcttaattcactgtctagtgagtttctgattgactcacagaccaattaaagtaaaatttaatggaagaatagattaactccctgaggtttccctaccatccatcacatttttatagcaggagctgtgaggaagctcataacttcatgctgtgaatgtgataataaagagggcacggagaggattccgatttacagccgagctgatgttcgccaggacagaatttactgcccaatccccttcccctctttattcaggaggaggtcactagatctgccctcagcccaggtctcagatactgaagggcagattgtcaggttgagattctttccctttaattggggtgggtgaggagagaatgtgaatttcattgtccagagatggatattgtgttaaagtatatccgtccttaggaagctgttgtcactccaaatgttcgtatttttaaagggtgtacttgatttgttactatttactctcatagaaattcagaaatatcaggcatttgtttctgagtcactgagtcattgtcttttatctacaggcttttctgggtaactgaaaatatctctttctgtatctttattgccaacattaataatgtcttcttctgagcatctttcttttgaggatctcaaagcactttgtgatcattgttttagtctttctaataggtcccccaaaaccttccaaacaattcacagtttattaatgtttctctgattcatcttaacaatgaagtgtgacagtgcttacagtatgacacacccatgtctgggattattttgtatacttactaaaatttttacttcatgtagcaatttgggggggtcttgaatatttaataactatatcaaatttcatgaatatattagatattccttttttttttttttcagaagcttggtaagatagaatcagtattttaaaatcgtactcatttgactgtccttgaaatcaaaacatgtctgaactgaacttagtgtgtctcccctcactgacctgctcttctttttgtattaaaaaaaaatcttaaacaggacggtctatccttcaaagtgttgtaggttggaaacttgggaatcttcctagatcctctctctcctgcacaccctgtatctcattggtctccaaggcctgctgagtctaccacttcaatgtctctgaaaccatccccttctctcaattctcttgcttacttctctagtcttactgcaggtttctca

SEQ ID NO: 25981 - DNA, 865 bp, Bovine  19866881333110
tctgaccctttattttcctccttatcacattcaacatggaacaagtgcccagcccctggactgtgggtggggctgatggttattacatcctagccatgacaaattgaggttcagctgctcatgcaagagtgagagatgtcagcagccccttggagccaccttgaaagatgatccttgactctacattcaaatggatgtttactggcattcatctgccgacaagtctgaatgaaaaaaaaagactcatactggaaatgaatctatgaaaaatcaccaattccttatatgataatagaggaaaaaactagctcaatgttgataaaggaatgacgaacacaagtggagactaaacttatccaaaaacctttttttttagaggtcagtttctaaacagaagtagaaatatcacaaacgtggcattaaaataataatgcttagtacaaataatatattgaataaacttaagaaatcaagttatgcaataggaacaattttaaggatgataaaatgaaagtgctcaaagtttcagactaagcaaagtataatcctatacttagaccagtaggctggttatattaaatgcccataaaaatctccttctgaaggaaactcaaatatacttagacatgaataatttttcatgtaccaaaatttatataaaacttgaaaacaaataatagtaagcaagacacttaaaatttccagatcttattaacagtatcattacccataaattaaaagaactgtaataaataacttctttatatctcttcttatttgaattacaagaattcaagtaagaacctaactgagttttttcagggtgcttatgttaaactctcatgagacagtaacttagaaagta

SEQ ID NO: 25982 - DNA, 1024 bp, Bovine  19866881349109
tatacatataagtggtctctgtgtggtcactcaggaaatggtgtgccttcccatccctcccttccctccacttatttgtcaatatctattctgtcagtcctcccagcctttgtttgcataatcactctccctgaggaagttcctaaatgtctcccatggctggtacttaagaccaaatgaggaaaggatagaaagagagcaaataattttgtaagcaatctagtattaaattaattacaaatcattttataatagcaaatgaagctaagccagtgttcatacccatcctttagaaaaataagcaaagtttagaaaattaccttctaagttattaatgattaatataggataatattttgggtgtcaagcttaagaactcatttacagaactcctattagtaccaagtggtaattctaaatgtaaattctagtcatgtcaccttcaagccaaaatcattgattaaatgggcatgttcaacattaaagtgtgtgtgtttaattaaaattgattttggaagaattctccaactactttttcttatgttcagagttattttctgattataaaaactaagtaaaattgaggtattatttaggttaagttatgtatgttgagaagtatcttaattttgttttttgttttttttcacaaaggcctaatatcttatatatctactttatgtttgaatttcaacctagggtattcttttcagtgttcaaaattcaaaagttgaaatcttatctaaagaaaatctttgatgttttaggcacattcagagccctgagtatggggagagaggtggaaaacaaatttgagaaaaataattatttgattgctcttcatcacattattttcatggtaaaataatatggaacatgctaattctgtcactgctatattctgtgagggcttttcttagagcaaagcagtgaaagcatatgtttagtgttagtcgtattcacagtagaaagacagtttcgtgtgtattgaatatttccacttcatcccttaagaattctccca

SEQ ID NO: 25983 - DNA, 1778 bp, Bovine  19866881383443
tgaatttgtgtattgattctctttccttccagctgcgtgagagtcttctacacctttctgagcttcagtttcaactcctaaaggctagactattgaggccattctatctgtatcagaatcaaagagatgttgttaaggaaagcactttacaaacactaaataaagggctatccaaatgtgaagcattagtattatcatcattactattataactggtcagggaagcctgaatttcatgctgcctcccatctgctttgtaacactcaggcaattccatgattagaggtggctttccaaaaagacactgtagttctttttttcctctaaaataaatgattccagaaccaatctaccttagccatccaatatgtgcagcctcttttgttcatgaacaacctgaaggtaataaactggtatgcccctgtgacagagaaagatgttggaaggaaatgggtttccatcttgggtttctaaggtgctataccaaacaataacaagggaaaaattattcagctaaatgtacctgacatgcattggcatccaatatgccaccctcctcaccaggcattattacttatatacctgcctctgagaaaggctgcttggaagagttactctgtttttatcggacatacattttagggagttttaaataaactcatatagccataccgagcagcatgtcttctaaacttcgctatttcatccgtctataccaagcaccgtgaagcaaaatggatgtgccttcagctttctacaatcctggaaaatgaaccagtccacttaacaataaatggtggttggttcaaacacacatgaccggtctagtgaagaagaaaagaaagttgagcttaatgaagtccagtgtctgtgtccctgcacacggacaggaaaggacaagtgttttataactgtttattggagttaatggtaataaattcctcacttgtgatgcattaactttaatgttttcattacttggtgatttaggttttcccttttcacattgtaaatcacgttgtcccagtagcaaagcaggtcgagcgcctgctgtaacgttcagaatactcagtggagaaaggaatgttctctttttctctccagcacagtctgacaaaagatgctttgcctcatcccaacttgctgcttcccacataaacagtaaagacagacagacggatgcatctgacaacagcctaatttagatcctagggaaagacaggtctccacagtaactttccaaatgtatttggtactgaaggttttttcctttatttttttcccatttgctgaatgtgagcccttagttaatgagctgtgcaaatagatattgagatttagtgtttttattttgcaattacagacttggtgatttggttggagacttttgggtctagcaacatcatcctcattttcccctccctaatttttttccttgcaaaattcaacttacttcaaacttgcttgagttgtgtcagatgaaacagaagaaccaaaaaagatcttaaatctcatatgtataacttaaaagaaaaggcggtgatttttgtcctcaaggttccttattgcagccatcatttttctgtcatcaatcccatatggttgcacagagacacccagggagctggctgggagcgaggtctggcttgggagtggccctttgtccagcagctgatacatcccaggtcaaagccacgttgcggagatcactgcgttcccatcaagttcttcatgatggggtatgagagttctcattagatcacccaccctgaaatacc

SEQ ID NO: 25984 - DNA, 922 bp, Bovine  19866881402022
ctgccattcccctctccaggggatcttcccaacccagggatcaaacccccgtctcctgttgcaagaggattctttacctgctgagcttttgagggagcccccacacactcatgagctgggggccaagctaaaacccctgagggatttacctcccttctcagaccatggcagggactctgaatcaggggccacctctagccaaaacaagttcaggtcaacaatgtcacctgaggcggccagaacgggcaggctgagctgtaaaacctttctgcctgagaattgctggacccacacagcacagctctctaactgagcctaacaccgccccctcctggctgtctagagaaaaccaaaaccccacaaacgccgaggctcctgtctccctttgtcttgcttaagcacactcaggaccccagaggcagatctgagttggagagttccgggggcacctgagtgggttgcccagttgtgaccttctcttagctaattccatttccagaacccaagccaatggttctaatcatttcctctcgacatgcggtttgtacctctgcccaagcaccccagagctgcacaggtcgattcaggatgttttccactcctttgcaaagattcattaaagcctaagccactgatttcccccaatgtggcagtttacatgcgcagcaacatcgcccactccaacaaggggaccatgaaggctgaggcacagggttactcaagtccaaaggggcccatgatgtcaccttctgttaaaatacagcactaatcttgttactcctagaaccacttcaacagcatccactctggctgctgcctccacccccttctcctctcttaagagcggaacaataaggtttaatttccctttccaatttaccttgaaatgaaaactgacttcagccaatatgtactgccaaca

SEQ ID NO: 25985 - DNA, 923 bp, Bovine  19866881405329
cttgggataaacgtgtgaccttggtctattagcaccatgccctatctaactgagctaactggctatacaattcaatcgccagacgagtgagaaacacagagaaaggaaacaagtctatcagatgatatagggagatctgatgggaaaacaaagcagcactttacttttaaaccatcctagaagtaatgtaaacacagttacagagttaaacagatttcttgtattttagactgcatgcttctagaccagtatagttctgctttgtattctcagatctgtcacagactgggaggtactgacatacctggaaccctagagtcaggggaaagtacgtcttttcattgatcagaatcttttaaagctcatctcagcagaatttgtatgtgaaataagtatttctcctacttattgatagctagtgtggaaatccatgaccaggtatgctgttctgctcctgacagattacagaagttgactccagggacttgggaagaaagactgaattcagatctttcattaggcaagaggtggactttttggatcgcataactccaagaggaatcgtaagctttcagaagacaaaccaagcacttcatttatttgaggcctctgttatgatgcctgggccacagataactactttcaacaaattctcactcttcattagtggaaaacagtttcctctaatcaccacaaattactcaacacctggcattaagcagtctttgcttaccacactcatttgctctctttccggtgggatagtctaggttcataaggtgaccgcctgtacttgtttcgctgcatgcacagttcctggtgtggcttagccatctccccttctctgtctttctagatgggctcatagctgccctgaacagctccctgcctccttaactccctaacaactagactcacccggg

SEQ ID NO: 25986 - DNA, 1090 bp, Bovine  19866881507702
ggttttacagtccattaacctggaaaataaaccaataccaccctggactgtgtgttgttggattttacggactcttcagtgattgtagttacctgaatttatgtcccttactgctcttctgtttagatcatagtttctttggatcagagtggcagaagcgatggtgtgttgtcagcagaggcctcttctactactatgctaatgagaaaagtaagtgttcttcatttgcacagcagcacctcactcctggatgcaagcacttcgtaaattctcaagcacttagatctaaacttagtagtccttaactaacacccagaaagagacatgcttaggaaagaagcttggctaaataataccttgctcatcaccaaaaactcataccagtttagaaataatagcccctttaagcactaggatagtgtggtcagcatatcaaaaggctaccttatgactaataacatattatcgaggtcaaatgccttggcatttgttaaaaaagaacctcaaacactttataggcatcaataatataggttaaatattgaaaaataataattctgagaaggattttagcagcttaccaacagcccagaaatataacctttgagtacgaactctctaagagcgtgcttcaaactttatcctactgactcctgggatgtaatccaatggacatccctagagccatggagtgttgagaccccaatagttgatgtgcccgagagacacccttcagccagatggcagcagcagcaaagtgttgacccaagccagaagcagcttcttatgaaccacctctgactcaatcaatcacaacactcatgagctatccctaaaagacctcccatcctggcttaacactcttgcttagttcatgagaaggaatagaggatataagcacaaactggaggagctacaaataactacaagctaaaagttatcactgtaggtgaatgcaaactttgaaacagggaattccttcctgctggatagactgctgcaggagtaatgctgccatgcaagaggaagataaagtagcaatcttgcggggatttcttttgggttctaccaccttacagaggccagtggt

SEQ ID NO: 25987 - DNA, 2542 bp, Bovine  19866881533633
ctgcctagtatagcctgggcacagagaatgcattccctaggctggccctctttttcctcatttccattctcttcttggaatgttctgagatctgggggtctaatcagtacctttgcttttcttctctaagtatccttgcttgatgatattatcaagctcttgagctcctctttcgatgtcttccattcctaaaaggaataagagcaaaatgttttgttgaaatctgacagaattttcattgatttgggctacttgagataatctacattaatgaaaagaggcagacgggttattgcttaaatatgatacagaataaaacaatctccaggtgactggaggggagtaaattttctttctttctaactatatctaatgctgaaactgcttaaaatgacttaaacataatattagtctgtacaagggaggttgtttaaatgtgcactgattggtaagaaaaggactccaaaaacctaagaatttgcttaactaaacacacactcacctttttctaacaaacagaaagtcaccttagtaaatatatttttattaagttcacacaaagaaaggctatgcatagctgaacttggcaataattgccaaatcccggttttgtcaatgtcaagggaaaagtctaggaatggtagaagcctttacacagagaagatctggtctgacatcagtttttaattgtatgctgctaacactcttggctttcaattagcctcgttaggtacaaatttattgagaagtcaagatcctaatttgtcttccaccactagggtttatactcattttacagaagggaggggtaaaggtcagagacaaagaggaaggaatttagttctcaaaaaaataacagcaaaaacaattaaaaactctgtacttcttaattaggagaaatgaagggagtgggctagcatagtcctaatattcattctttttaggttcggggactaaactttttgcttctacgctgtttccagcttagtttcaaaaatgtagatcagaagagctctttcttttttagctgagtgcctgactctttttcctatttgttcttattttcaacttcttgttcatgggctgtttccatttgtgtgttttgcagttagcaaactccgtggctgctataaatctcctggatgggtctcagggtgcacacatgagatgaacagcagcaaaggaaagttcatctgtctaggattctttcatttctcccacccttctgaaaattctaatgtctctttgaaaatgctctccaagaaaagagaagcagatcatgctaagggtgaggacctggtgcagctaagcaggcccttgaaggagaacctatcctctctgcctgctgtcaaaaaataaattgctcctagaggcctaaaaattaaatgaaagacacaagggataagaaaaacagggtcctttaagcctggagtttccatcttttcttcccaccatttttttccccctttttttaaggtcttgttaaacttagagacacaatttcttgttaaggatgccaagagtctgaatcataaaagacatgttaaacgttctattagaattcaaacctccttttttaatgcaaatctaaatgccattttatggaacatctataattatgaaaatgggaagacattgcctcgtgttcggggagagtctgtcagtatgaatattacattaatgggcccacaccagctcactgatcctgctggcaggagcataaaaaatgcttgagtgaaacttttatttagatgttaagactccaggccccagcggggtgacagagacagtccctgtgagttgccatccgagagagagcttgaattgaattacccaggggggaaggaagtagtgatgagcactgcttcgcttatttaatttcatttactttcagtacattatcagcatgaggcttttctctccccaccaactgaaacccaagaatgccaccaccaagaaaacaaagacataatgcagcagagatgtttgaattcaaagttactaattttaggagactagggacagcaccggagaaggcgatggcaccccactccagtactcttgcctggaaaatcccatggacggaggagcctggtgggctgcagtccatggggtcgcgaagagtcagacacaactgggcgacttcactttcacttttcgctttcatgcattggagaaggaaatggcaacccactccagtgttcttgcctggagagtcccagggacgggggagcctggtgggctgctgtctgtggggtcacacagagtcggacacgactgaagcgacttagcagcagcagcagggacagcaccatcactgccttcttaccttaaaagtcacacttggtttgctaaaattgggcactgaatgagttgctgaatttcctctcttggtcatctatcaacaagattctgaagaggaagagagctggaaatacagtattttatatgctgtgtttttgtaagatgtgtatgttgctttcttattagagggaatctgtactgatgaactctcttgcctgcattcccttatgggcagtgg

SEQ ID NO: 25988 - DNA, 902 bp, Bovine  19866881540278
ccacatgtgcacctcagctcagtacacaccccacacatgttctggggctccccaggccctgctacattttctaaaaccagaaagcacttctgaactgcctcccctatcttttctgggggctttctggggccctaacacctcagtcccagtcagatcaaacactctccaggtgtcagtccctgacccaagcatctgtcatcataaaaggcatcaaaaccggaccaagcatccaccataaaaaccctgtgaagatagttgaaaaagaaaaagaaggaggcgagagagtatttcttctttcccttgtaaaaagagctcataaaacgattaaaaaaaaaaagccaacccaggcgggggctttattacctttgcgcctctcgcctcctctcgcctgaactccacggatcccattcatgacgaacagcttcttccaaactgagagaaaaaagttttcaactttatggttccaaattttttcccccttgcagatccgggagtggcggctaacacttttttcccccaacagccggtctgcggagatttgctgttgaataataacaaaggagagaggatacgtatttaaagaaaagaagtgattaatggttttctgtataattctcacatttttcttagctcttgtctacacagaatggctgtgaactttaagctccatagaaatcttttttttattctattcataccttcctaagggcagctttgatttggttctatagagacattcctggggggggaggtggaatatgctttttaggaactattttccccctctagaagggaaggccggctgcatccctgggcagctaaacatcacaccagcgattctacgaaaacaaagctccgctctcaacctccaggtccaggcgattgctagagtctccccacag

SEQ ID NO: 25989 - DNA, 2409 bp, Bovine  19866880540323
tttctatgtctgtgagcctatttctgttttgtagataggttcattttgccatattttagattccacatataagtgatatgatatggaatttgtctttttctgacttacttcacttagtgtgataatctctagttgcaaccatgttgctgggaatgacattatttcattccttttatggctaagtaatattccattttgtatatgtaccacatcttctttatccattcatctgatgatagccatttatattgtttccctgatttggatattataaatagtgccgctgtgaacactgggggtgcatgtatctttctgatcctgaattatatttttgtctgggtatatttccaggaatggaattactggatcatatgataattctattatcataattctattctgttagaattagttttctgggaacctccatactgttttccatagtggctataccaacttacacttaaggtaggatccagtcttaataagttgtctctaccactggttggtcaacctcctcaaagttcttctctgaatctagccatagctccatggcccttattctgacattctctgtctttctgtttccaaaactaagtaagctctacagaagcattctatttataattgaaggggagagcagatatacataacagatcaatgctactgaatacactggctcttaaaggacatagaacatatatccctgacccctttaacggcaccagaacttaacttgcactgtttttgcaactacaattgaagaattgtaagttatcataaactcagaatcccagagaatcaaatgctggatcttatcctttacatattcacattcaccttcactcaagagactctcttccccccaagtctggggttagcaggtgcaaactattatacaaagactggataaactgtacagctcagggaactatactcaatatcctgggataaaccataattgaaaagaatatttaaaataatatagggactaccctggtggtcctgtggttaagatttctgcaagaggtgcagatttaatccctggtggggaagctaagatcccacatgccttgcagtcaaaaaaccaaaacattaacaacagaaacagtactgtaacatttcaatacttttaaaaaatgatccacatcagaaaaaaatttttttgaatattaaaaagtatatatacatatgtataactgaatcactttactgtacaggagaaattaacagagcattgtaagtcaactacacttcaattaaaaaaaaaaaatcagctacagctaatcccaccatcagtccaggccctgaacatttagtgcaaaggtcagtcatgtaaaagagccagacagttaatccttcaggctttgcagaccatgtatctctatcacgactactggactctgccattggagcataaaagcagccagagacagtacctcagtgaatgagcatggctgtgtaccaataaaactttatttacaaagtcaggcaagaggttgactttgacctaagaactgttggttgcccacctctgatgggaagcatcacaaacctcaccttctgctgcagctcctcgatgatgcggaagtggctctgatagtccggacacacggtggactcagggcatttgctcagctctcggatctggctctccagctccgcgttgtcccgctccagccggcgcaccctctccaggtagctggccagccggtcattcaagaactgcatggtctccttctcatggctgttgaagaagccttcgccgaaggtcccgcagattccgatgttgcctggaatgtcgcaggtgcccggcagagggcaggcagcgttgcagctgtggggcagacagaggctgggtcggccgaggggggttgtgcccactcggactcggttggcgtgtgccagggtggccgagaggcccaggggggcggccccggcctgtgagagcggcccactgaggagagaactgcagctgatgaaagtcatggccaagactcttgctttgtccacggttggatttgctcgagtttgaaacctccctctttcctagaccttatataggcctatcgtgggcgctggtacaagaaaactggcgttttcctcatgaatatgtatatggattcttaaacaaccgctattactcagttgagcttgtcccctgtaaagagttaataagctcatgaaagaggccatgacccacacagcctcccctgaccgcagggtcctagaaaacagggaaaatgaggtcgtctttgagctgccacctcctgcggcttttgtctctcacccctctgtccactgatccctgtgaaggcacggagaaccagagcctccaacaatgtcctcaaaattgctctcacttccatactcttttcctgccactgaatgttcccatcaggcaagttt

SEQ ID NO: 25990 - DNA, 3443 bp, Bovine  19866880422314
ctttgcattctccttgtctgaaatgcctttaaaaacagtttgctcttaactgttatcagttgtttaacagattgtcccgaacctttcattataaaatccctttatttcatgtttgtttccactggttgctcagatttcttctcactaagatccatttgtaaattaaacataaaaatctccaactccaagctaacatcctattcaaagacaggatggcgtcccattgtttgcccagcatggggaacaccaacttctgttgtacaaatggtgtgtggtcatctccgtaggctgtgaaaaaaaaaaaaaaactgtttaattcaaggattacctccctgcatgcttttctgcagaactgaatcagataatagttagtttccatgacttccaaattgaatctcccagaaaacttgcagggaaagaaaaaaaaaaaaaacaaaaactaatagcaaatatgaataaatgcaaaatcaaaattctttttttcggtaaacttagagttgagtcaaaagagtcagccatttgcctctttgcagtaaacataaaaaaaaaacaaaaaacaaaaaagcttgagtagttttacattccagaaaatataattaatacacaaatactaacttctgaaaattccttaactctgtttgccttgagtgatgccacagatgattagaaaccctggtaaagtatgccaaatgtatgcacactttattcactgggagggttatttgagtagctaagttatacttaacaagctagcttccttaatacccatcttttaatctctgtaagggtatagtgtgaaatgcattaacaataccaaacaaatcttggttggagcagaaaataccaataatgattcagttttaatttaatgtttaatcatcctaattggcacaggattcctctgcacattcaaggtgctgttttaagctctgtctctcgccttacttaaaaataatgtaaacaaaatattaaacgaaattcgctaaagttatgttgcttaactggggacgaaaataatgtgacaaaaattctgtttaaagcttcttattttgacaaccaattttaaatgatgcatccatttcagatgcttattttaaactaggaaatgcaattcctaatatattcaaccgaaatgttatttctttctctttgcacatttccatatgtaatggttatgtttccatctacttttacagccaattatgaaggaacaaaagctattctgtttgttcacacattttcaacaaaatgcattaaaactattatgtcagcatgttctattaagctctgcattcagtggaaaatacttttcaaccagctcacatttatcaaaacataaagccactttaaaacacagttttgcttggtcagctgggcttagacaaataatgacagattcagaactaaataactagcaagggaaatcagaaaactgacttcatcaattgtacacattacaatgtagttgcttcaaatatttagcacatctgtgctcacgattaaagggcatttttaattctttataacttgcaaacatctgatattctcataatatagagaaaattttaaaaaggttactttactggatttagctgattattactttcctgtgctccaattctgcatttgtgctgcttcaagactcacttgagaattttcaagtttttcgacctgaacatttttatatttagggttgtgctaactggaaggaaaatatagacacttaaaaataagtgcctgcttgcttctaagaaagagactgtgttaaaaaagctgcccatattttagcttagattttcgcaacattttaataagctgacatttgatctcactgtagagtcaactaatttaatttcctgatgtttatgaacaccaaaaaaaaaaaattctgatacctattttgatttatttcaaaagcaggtgtcgctacattataatagttcttaactttaaatccatctgccttctgaacagaattccaatgaaacagctttatatgaaaaaaaagaaaaggacaaaacatgaggtctagtttgaatctttaactaccaaagggaatattttaagttgtaataagatgcacacacacacacatagcaaactaacatattctaattcatttttttgaccggctggctatcttgtatctctctcaataatctgttacacaagattgcaactggtgaccccattatagtaaatacagttgccttgttccctgtactatagtgaaaacaatattctagttcctctttatggattatgcatacaaattaattttgtcatcataggtcgtacaggaaaatttaagaagaggtggttttctaagtatgtacacacaaaaagatttttggacttttctgggtttcttttaccccctgtgggccagaggaagaggtgatcttctggctttatccaatttatatgaaaatcccagatgttttagttctcattgtactatttaggttcttgatgcccaattcaaatatgtcagcttttcgtcatctgaactaaacactgcagaataggaggcagaaaattgaagtgttccagtatatctgtctgctgagaaaacaaaaataaaactatgccccatgctgaaaggtttagccagccaggaaaacaaaacaaaacaacagccctactgcaccacactgagttttctttttttggagcttctcagaaagacccttcgcttgacttcccagtaccttcaggtcacattaatgtttttaagaaaaccccgcaagattatgattttggagcctatagttttaactggctgttccttttggtagaccagtttcgaaaggctatcacaaacatttctgattgattgatttttctctttttcttgcacagacctgggaaaaacctgcatctgaatgttcagcttgagattccaccgcaatttaaacaccgccacatatgctctgcatgttttctgtaatgtcttaagtttcttctgtgagatctgtagccagatgacacattttactggctcccttcaagtcccctcagtgttctgactgggattagcgtgttctcgagtggaagaatacaaggggaaatctctgacaaaataacaacacggacaagacagtcctttgaaaatcgtgataccagcccacctaatgtacacaataaaggaaagggggaaaatatcttccccttggatgaatcaaactgaacactagatggggttccagttgcaagggtttgttcaaaaacttctttgtggctctcctcttccagtgacgcgtaaaagagactgcttaaggcgagatctaaactttgactacataaacattggcaaaggcacaagaaactaaatccctgttgtttgagggtaaaactgagctatgggaactacctgtcaatcttcccctttgggggtctggcatctcagggtgacaggggaataaggttaggaaaagaagcca

SEQ ID NO: 25991 - DNA, 3195 bp, Bovine  19866880446367
ctgtcatccccttcttccccgtcttcaatctttcccagcatcggggtcttttccaaaaagttggctttttgcatcaggtggccaaagtattggagattcagcatcagtctttccaatgaatattcatgactgatttcctttaggattgactgctttgatctccttgctgtccaagggactctcaagattcttttccagcagcatagtttagaagcatcaattccttggctttcagccttccttatggtccaactctcacatccgtacctgactattggaaaaaccatagctttgactagacagacctttcttggcaaagtgatgtctctgcttttgaatatgctgtctaggtttgtcatagctttccttccaaggagcaaacatcctttaattttatggctgcagtcagtccccacagtgatcttggagcccaagaaaataaaatctgttactgtttccactttttccccatctatttgccatgaagtgatgggactgaatgccatgatctttgttttttgaatgttgagttttaagccagcttttcactctcttctctttcatcaagaggccctttagttcctcttcactttctgctgtttgtagttttatttgtttatttattttttttagcaaggaacaggatttattagcgagaaggaaagtacaaagttctcagcatagacactgagagcgggtagagtccctcaaacgtcgatatacaattgctgtaatcctcgatgtttgtagttttagtaccacgaaatatccaacaaaacgaaactgactcaacatttatttactttttctatatcaaagtgcatcctgggatcatcctgacaaacttcaactatcttctttttaaggagttcagagggactagattatcaacataactgtttaaatcaaaccaaaccagaaccagtgaagatgaagctctcctttcagtagaatcctgaacagagaagaatgaaaaaaaagccggggcaaggatgcctgactcacaggctcaatgcctgggtgaagccagactgagttccctggtctggataatgggggcaccactcaggctctgggaagccaagatttggggagtgcagcttgggatggagctcttgtctgagacttgagttaaggctctcgggatgggtccccatttctcatcttgtcttgctgaggagatacatgccctgtgtcatctaattcaccagggtttcttcttaaatgtctttcattaacacacagtacccttctctgctttagaaagacattctccatccatatctaaattaaggagcaccttgccactctgagacctcaggtgtttgcttttatcctgccctgacaacctacagttttattttgaagctagaggagaatctggcttttatttctttattttgaacctcacagctcctctaactgactctcttccccaggcagacagagccgatcttgccctgcccattgggaaacaccaggccacttctttgtttagtccttacggtacacagcatcgtgcccatccacctgtgttctccctggagcccctgaggtctcacagtctcatggcccatccactttgccttaggaaacaaaggacacactttattgaaatgtcatatgtcagcccgcgtccttcaattctattaaaaccccttcttttttcctctttcttcttttttatttaaaaaagaaaacattatggggaaaagggagagaaaagattggggagagcagttcacaaaaacgtagcaaacccaagcctactttggggagttgtaacatctgcacgttctcagcagtttgaaaggaaacaaaaaattgccaagtggtataaaatttgaagaaaaattacccaaaggagaaatggacgttaaccacgcttcaattccccactatgggttgaccatttgaagtactttcttctctcctctttctttctgattcacagtgtgtctaaagaggtgaattgggcgcacaaaacccaacctcctcttgccagggtgggtatgaaatatgaaggcgagacgattgtctgggctcagtgcattggaataacattggttaaattatggatagtttttgaatagtgtcacttttttttttctctgcagatggttgttcacacaaggagccgggtctgcataattgtatcactaatcagcagtaaggcaattagttgtgtaagtgtgctataatcattctaacagaagagatgacgaaaagacaaaaaaaaggaggggggggaccaaaatgtcttttctgaatccatcaactgacagccataattagatatatataattgaaaattccacagtaggggggcaagcttatacaaatgaattttctctgctgcccttacgcatttttgtctttggctgaacatccccctaggaaaaggcagaaaactcgtcattccaagagagtgcatactgtaccgggtattcagtctgaccaatgatgtcagaattacaattttttgggggggagtgtggggagggcacaggctgggagactgggaggttaggctgctgtaaagacaagtgctcagcgtgggctaatatgaattgcgttgctgtgaattatgtcaccgtcactgttattctgaacctgtacttagctggcaccctaatgtccctcttctggttcatgatgggaaattccaagcagatgactaactcactgggcacagtgtctagggtccagtgcacttttagggactcatgagaatgtttgaattttcatttctttttggtttggaatgaacgtaggcacactactgtatataaaataggttaacaacaaggacctactgtatacacatggaactatactcaatatcttgtaataacctagaattgaaaagaatctaaacaagaatatatgtatgtaaaactgacacactttgctgcacacttgaaattaatgcaacatggtaattaactatatatcaataaaaaaggaaaatcaaatgaatgtgataataaagagtgtgtacaaatgaatccagcccggattataattacctccataccaacacagttgtaaaatataagttttaatatctttttagggaggaagaataccacaaaagcaaaagtactcagagtccaaaaaacttataatgtggcacgatcatgggctagatggtattttctaggaagaggaaaaaagtaggattgaaggcacttc

SEQ ID NO: 25992 - DNA, 2208 bp, Bovine  19866880490919
ttcatcaggaggtgatcattaaccaacatggagaactgctgtgataagatggctaaatattggggggtgtgtgtgtgagaagggaatccctgaatggcaagtcagggcacctgtgacctggaaggaatcttgctactttcctggaccctaggctcccttgcgtccatgaaggtggtgctgggtgactgctcggctccataatgctaagttaggggccctttgaaggtctgtgggcagcacaggtagaaatgctacttgtggcagagaaagcagatggtttatgctgacagccccaactcggcaaaccacccacctaggaggtcagcctgcagacactgttcctccaatattataggcctgtgtgtcttgcccttagtcatccaaataaagcatccccgccgtccacttccagaagcctccacgcaccctgccccaacacactgtcactggctcgcagctgtgagtccattttctaacatgcttttctggtcagagacaagggacaaaagcaaagacctccctgaaaaagtagtcaaacccttggtctgacgtgttctctgaatttttttttttcatcctcctttgcaagttcccaactgcaatgtctcccattgctcacatttttccgatttgaaagaaggaggaagtaaaggaaaaccccaaccctaagtcacaaatagcccccttcaagtcatcttgtgtgtatttataggctgagtgacttgggcaaattcttcaatcgcctgtaaaaaatggagacacctgccctactcatcactggtaggatctgattagatggaaatgttttgctatgtgcaagacactctatgggcttcccaggtggcgatagtggtaaagaacctgagcatgcctgccaatgcaggagatataagagacacaggttcgatccttggattgggaagatcccctggaggagggcatggcaattcattccagtattcttgcctggagaattccatggacagaggagcctggagggctacagttcatggggttgcaaagagtcagacacaactgaagtgacttagcatgcatgcaagacaccttataaatgtaatgggatagggaagagtggaccacaattaattctgctttgatttttctgaatcagcatgtgtgttttttatcactaaatcatgagtgaatttccacaaacagtgacttaaaacaagaatcatttattatcatacagttctgtggagcagaaactggggtggattcacctggcattctcaatgccaaaatcaaagtgtcagccaagctggactcttgtctgggagctctggctggaagaatctgcttttagtgccactcaggttgttggcacagtcccattccttgtagctacaggtgtgatgtccccatgtatcagctggctgtcagctggggatcactctcagcttctccaggtcattcacattcctccccatgtggtccccttcaacttcaaagccagggagtgatggaacttcaagccttctcaatctttcagggctcaactgattaggtcaggcccacccaggtcatctccctgccatgaggtcagtgtaggtaggacttgaattacacctgtgaaatcccttcacagcactatctgcattagggtttgattgaataaccagaagaagaaagtcttggcaaagggagagcatttttagaattctgcccatcacacagtgattctgaaactaggtttcataagagtaagatgatgctagtcattctgtgaagaaaggaatgcatagccaaataattttgggaaacactaattgagcagagtgaaacccattttgttggctagcttttcacttcagaacgtatccgagcgattgatagaccatgtgactcttcatgatatatagttcccagatatgtcaggttatggtaccctttcctgccagaatacctgttattcctcataaacaagattgggatatgattatatgatttttaaaatgaattttagctatttgggtagccattgacccaggaattccctatatccgtattcatcaatttttagagacttgtgacctcatgattctcagtttactcattacctcttaagtgtccttcaagtcacagtctggaatgaccgcttaccagaaggggttaattatttgtgatcatccaaagggcctccaccccccttgcctcgaagggtgaggtccacagtgttatgcctca

SEQ ID NO: 25993 - DNA, 1600 bp, Bovine  19866880516447
atatatagactggaggcctagctcagtctcactaacttacccccaggtaatgataaatctattgctgagcctgggtttgatgtcttctggttcagaatctgacttctgtaagctcagaggcaagataaaccaattggtttctgatctgcagcctcagtagacagacaggcatccatcctggccaaatctgcccttctgcactttggccatgttgtgaaaactcacgaattctggctggttggcagtgaggtacaggaccaccttggtcccacagctcccagtatctatcacaccacccaggctgggtgcagagctcccaagagtgcacagagtgagagggaggtgggcagtgggctggctgagcccgtgtgtaatgagcacagatcagagtccctcaccctgagcttggccaaaatcacaatgcatttggccctgggcccgtttccccttaaaattttaagcccatgagtgttttcaggtggatttaatctaccttttttgtattcattgttatttatttgcatttagctcataaaaatgttgtttctaaagagatggtgggtggccaagaatactttattattatttttaattcttttccttcctcttctttataaatcttctttcttaggaaaagaaattatcctctcctcctttttatttatctgaatatttaagaccaaatgtctcagcttgcttggaggttggtatccattgatcttactatccactaagtgacttctttcagggcaaaacctgaagcaattgttctatttcaacatttgttctgttgatgccttcacagggtacatttaggataatgttacttatcagagtgtaatattagtcatctggatgactcacactgagggtggggtagagcagatggctggaagggtgctctttaacatagagtttctggaaatttggggttagagtgcatgtcttcagactctggagatcctaagaggctttcctacagacttcatagccctggactcaaaatgcaaactggcccttgtgactgtcttctggaccactgcctggtaagagcacctggaaactgatcaaggctctcctgtatgcatgtagagggtaagaattaagagaagactgcaccccctcctagccccaccctgcccactgcaaggagtggaagggaaggcaaggctgagcaaagtccaatggctaacatggtaatcacatcctccaataaatggcatccttcaattgccttaaaacaaacaaacaacttctctctccactgggaaggagctaggaaggaagagaaagacaactaaatgaaggatgcccatgaccttggcacagagtgtggggagagctctcctctcccttgtgtctaatcttctaatgtgttttcttttccccagtgaagacaagactatactttttttcctcttctatcctcacagcacatagatccaggtcccataaatgagatgctcaatcaaaatttgattatattgactatcacttgagtccagggatttggactggtaccggtccatggcctgttaggaaacaggctgcacagtaagaggtgggcgagagaagcttcatctgtatttacaggttcttc

SEQ ID NO: 25994 - DNA, 880 bp, Bovine  19866880525245
ctgttgcttctgacctgcatataggttaatcaagaggcaagtagggtgggctggtattcccatctctttcagaattttccacagtttattgtgatccacacagtcaaaggctttggcatagtcaataaagcagaaatagatggtcagagagggcttctttgagggacagcattcaagttgatagttgaatgatcagaaggaattaggcataaaaaagactggggaaatgctgtaggtagagggacaaaaaaatgcagaaccactgtcatgggaataaacttagcatattctaggaactgtcagcacattagtaagagctgtgcatagtaagtgagaggcaatgggctccccaggtggcccaaatgataaagaacccacctgccaatgcaggagacacaagagtcatggattcagtcactggattgggaaaattccctgaagaaggacatggcaacccactccagtactcttgcctggaaaattccttggacagaggatcctgaaagccaatagtccatgggattgcaaagtttgacacaactgaacacacaggcacaataccaaataaagttagaaagtcaaacaatagcctgattttactgagtcttaaaactagaattgcaagataattctatttaagatgcccagttatatttgaatttcacatgactaatgtctttgtatctatatctcaaaaattgcacaagacatacttgtactaaaataattcattgtttatctgaaagtcaaatttagatgagtgtcctctattattatttgctaattctagcagccctacttataattcatgataaccagggtggaatttcaacataagtagtacaagaagctacttttttaagtaaaacattttaaaaag

SEQ ID NO: 25995 - DNA, 1427 bp, Bovine  19866880540067
tttgttgaacaaataaatggaatactcagaattatggaatgttagcaaagtgcaatgacggcatagaaggggaaattaaaaattctgctaggatgaggaactgtgaaggtttgggaaaccaggggctgggggttgtatgtgagctgtcttgaaggatgtgtaagtgttaagtgggtagaaagagaaggcaggatgggagtccagaggcaagtgcatatgtaaatgtggggggcataaaagggcatggtgagttctggaaaccagagtagttttataagatcagatgagggtattagagaaggctgggagaagaggctggtgagatagactgggctgagtaatgcaaatagagaagattaaatatttacataagctcattagtgatactgtgcgcgtgtgacaagtatgatttagtttaaacctccaaggtttaaatactctaagtgcaactgtgtctttttgaaattgattacatgacattaataggctctttctcagcttcagtgatgatcatattcatgatttactcccatctctcatccctggggtcaggaacagtccatcctgacctccatccttccttttacaccttccttaggaactaaagattaactgctagaaacctcctgggttttgtcctctaaaaaggtaagcaattttgcttccaaagttttaacaggcaaattcctcttattatgaggaatagtaaataaaaggattctgtgtcacaaagttatattcttgatcctctgcatcatccgttacacacaattcaacaagaattatttaagaacttgtaaggtgccctatgggctccccaggtggctcagcgataaacaatcagcctgccaagcaggagacatgaggttgatccctggatcgggaagataccctggagaaggaaatggcaacccactccagtattctttccagagaaattccatggacatagaagcctggtgggctacagtctatggagttgcaagcagttgtcagtctctctcccacacgtcttcacgtttgaccttggacaggatcacctgacctatttcagccaatgagatcggatcagaaaggaggtagtagaaatagaatgggtctatgtggttgagaatatacacttgcacccaccatcactctaaataagtcatgcccaggcaagcacctttgggccaggaggagaatgagattggccaacccacaggcacttgagctgaataagtgcttactgctctatgccaccaagattctgtggttttgggttacacagatcaacaagtaggatagctaaagggtacagcagtgtgtgctaagactatgtcaagggttggagaagcccaccagaatcaggccaaactctctttcctattttgttccaaggtagcctagagattggccatgggccataatgttctcttaagaatgaa

SEQ ID NO: 25996 - DNA, 1135 bp, Bovine  19866880541201
ggacacccctaaagcctatacctatctgtgatggacccagggctagacccacaaactgccttctcgtgaaaatgagtttttgttttagatttgagaaggtcaaatctctgattcaaaaacccaggaaaagaaccagcctctcttgactgagttattatggagtaaaggaagagggaacaaatccccaagaactccaaagccatcaagttgtgctttttcccagcctttccattagatgtggtggtgtggaggcagccagcttgctgcaacaagtctgtacaacaagttttaaagcagtgtgaatgccagaaatgttgagtaatatcatgttttcaactttctatatgtttaatcaagacatgaagtagggttcaaactcatttcccccaaaagaggactttcttggcaatccaaccaagtcaagaaaaatgttagaggcccatttgagcctcagagatgactggacatcagaaagcacatggccaggatgcctttgagccaacttggcatgacaattctatcagagtagtttttccatagtctttgactccttctaatctcacatctcaaggcttcatcgctgaagacttaggtttccttccctagaaccagattaaaaagtccccggtaggcctgcccaacatgggtcacttgcctatgtcatttctttgatgagtcttttttggaccagttccgggcgaaggggagttgttgattagggagcttcaaccatttctcacagtccctcagtgttctcatgcttccagagcccttcatttctgaggaagccttcattcatatttaaacattagaacaggagtgtggaaacgtttctcacaggtctattttggagagttctatgaacgggaggaggttgagtgcagtgattgattagtaatgtcttccacatcctgggaaggtggagcaacaacaggcatgccacccatgtgtcatctttgtgtaaaggaccttaaaggatcccaacccaaaccagggacacaaggtgcatcagatagagccttgccttcagagtcaagtgaaaaaggcagataattaagagatttattacaacagagtgacaagagccgacactattgatacatacaggaagggagcaaacacagggagaatgaac

SEQ ID NO: 25997 - DNA, 956 bp, Bovine  19866880546924
ttaagagaatgttacaaagcacattctaaaagttgaaaaggcaactaactacaaagacaaatccttagtattttatgacctgggtggtacactgtccttgggcaatgggtgtgcatacactaaaatggtaagcctgggggatactgcaggcattgaaacttctgcaatactcaagtcataaaagagattacattccatgaaatagaaacacagagtataaaaaggaacatccaaagaacaagagaaagggcaaaaatgtggagaagagcagataaaggatgaaaaacaggtgcattgctacaagtctgctatctgaataacagaccttctagagtcaaaagaagcaggatacagaggggaggaaattatgaaagaaataatacaagaaaatttcctagaaacggaaggctttcattttcagattcaatgggccccactgaggatccaacaggatgaacaaccgactaccccaaaggatatcatcatgaaatttcagtgacaggaataggaaaaaaacctaggatattgaatcatacgcctttgaatcactcaatatcctatgataaaccatgatggaaaagaaaattaaaataatgtgtatattgtataactgacactttgctgtacaacagaaattgacacggcattgtgaaccaactatacttcaatttaaaagaaaagaaaaagaaacaaagaaaagcctaaactcttccacagaggggaaaaaaggaaacaaaacaaaacaaaacaatagcaaaaccaggtcccatatattaaggaattgggaatggatgaggcaatggacttttcctcagcaacactagaagccactggaataatacttttagaattccgaaagaaaattacttcagtgcttgaattttatacacagccaaactatcaatccaagggaagggaataataaacactttttttttaaagggatgtcagatcag

SEQ ID NO: 25998 - DNA, 1373 bp, Bovine  19866880573933
ccttttctccttactacacaacttcctttttctgggtttataaggaagaagtgagtagtaaatggtgggtttctctcttctgtcccactgcaagtaagtgtcaagaggatgagacccccacacagggcacgggaggacactggtgtccagaggggcaggacagattcacagactcaggataaatgtgtcgtaaaagtgtgcatgacatgggtgatgcctggttcagacacaccccctttgtttctgcttctcctttctcagatatatatatttttttcatttatctctttctccccaatcttaccacctcctataaaatatgattttaggcctctctgtgggcatatgcgtgctaggccctctacatggagcaagcacccccaaccagccagctctgagccaggagacacgtggctgatgcccaggtgtagacgtctgggtggggggcggggggcagggggaggcagctggcagatgagctccaggtgatccccagagaagggctgtctcaaaagagagggtgtcatcttcatttccaggatgggaagcctcttttgtgttttgagtatgaggtgaagccccaaagaccccttaccatgcgcgaccagcagggagacccatcaactacatcaacagagagagatcataaacctttctgatctgagatagtttgtattacctgagttttcccctaaaatcctacaggagggcaattgccagcttctaaatttaggcgctcgtgggtgcctgttggcagggagaagaaaggcttgcttcagtgctgtggtttgccttgaaatccagtcaagccccaaattctaaacacaaagcagctgtttgcccagaaagtgagccgggatgtttcgtatcgatggctcttcccatcaccgcctccccctgccccaaccccacaaccccttctctttcttccctctctagtttttaattacgatagtgccaaaaaaactcagtgtgaatgaaaatggggaaaggatgcacattcaagccagcattatctgccatagacgatcacggatttgggggcgggccgtgggcaagccatccaggcagacctgcctcagcgccactgtttacagaagaaaggaaaaaatagaaattgatcttcagcgttggtacaggggccgggtcaggcagggcaaaggattcagttgccactctttcagccacacgaaatgccagctgatctctatcgggccccaaccggatatctttaaggtaaatcttctgttccacactcggagccagggttctactttccgatgcctcgggcggagcggtccaccactgaatccgcccgatcgggtgacagctcgggtacccgagcaaggcgggcattctacaccccctctccc

SEQ ID NO: 25999 - DNA, 3886 bp, Bovine  19866880607589
tttgtggtgagcaggggttactctcccttgtggtcccagggcttctaactgcagtggcttttcttgtggagcatgggctctagagcgcaggctcagtagttgtggctcacgggcttaattgccctgtgtggtggaatcttcctggtcaagggactgaacccatgtccgctactctggcaggcagttccttaactactgggcaacctggcaagtccctgcaaagtacttcttgcaggacaagtagtatttataaacaggtataggatcctcttctgtcacagagatgataacttcttagaaacacaccaggcaccttttaaatgcagtctggctatacttggaagagaatccccaaagaacagccttttcagttacagaagctttttctctctggtataagaatttgtgtaggcagttcagggccagtgtgatggctgcttgggtctctccttggagatgaaatcttgtaaggaaactttctggaagtttcttccacacttctactccagttaagttctgctcattagacagacttaactggagggccacacttagctacaagttaagccaaggaaattgtgctttgaagtaaactaaaaatcaagttttgttaataaggaaaagggaaagaatgcctagttgttaggtagctagctatttctacctaagtcctctttcaaggccagagtcaacagagaaattatgagaacttaaaatttgaaaatattagagtctttgatactaaaatgctatttttggtttcttaaaatgaaattaaactaacaagtgttatttcaaacagctaagtcaaatttggctatttgaatttagggaggaacagaaaagttggaaacttttaatgcattcagaggtcatatacttataatatgcatgcttttctgtgtgtgtatttacctcaataaaaaacttcaaaaatttttaataaataaaagtcttttttgaaaaaaaaataacagataatacagataataacagaaaaggcattatttagctcctggcagattttagagtgattatgtcatgcaagaattattaatatcagtattatgagtaaagtaactatcttttgtatgcaacataactatttccattttcccaagcatagattgttttttctgtccttttggatcatatttgtcatatatataacaatttattttgtgcttagaaaataaataatgcagagattgatattatttcattttgaatacaataatagtaacagtgcatattattcttcagtaacattatagttttccctgggaaatggtctctccctctagttttttaaacttgtagattttaacgttatcctaagatataatttcaaacgattttctatttttagtaatatcttccattttcttcaaagaggatttcctatttgggagaagaaagaaaggcctggagaatgagatgaaacgtcaacagtcagatcagataagcttcaatacattataagtctttattttgttttatgaacaatttatgtgaaagaagcaggccctgaaatatgacctggttatgaactgaggttggaatcacgttgctaggagacttctgattgactttggatgacgtcatgggcacagccaggatgcccataatacctagttaatacattgtgtctagcgtttcttctaatttttatgtatacatttcattttgtaaatgtaataaaacaccccaagcaacacttttctgggtaattactacacttttagagccccttgggatcagaggtgtactagatatgaattaggaaagtatttcaactcgtaaagaatttctcttgttgataaatctctgttgagaccagcaattcagataaataagatataggttggatctgaaattacttgtggttcttttagagactcactacgaagagagggaaaggggacaattttgaagatactccagaacatcccctgggtcaagatagtgctgaaaaatgagtggatatttgaaagcatggaactgactcaggtgtccatttcacttctttgtgggtaacagtcaaagactgatctcaaagagaggtgagcagagtcatctgtgggttgcaggagctcatctccttccactgcatttaaagatggctgaatcctgagattaaagtgaatcaaaattcctttggtatgtactaaacctttccaactcaatccagagaaagtctaactctgcaatactgttttgttgttgttttttttaataagaaataaaatgttccttactgttaactttttgaattcaccgagacaatctcctaaactcttgaggtctcaattttcttgatggctgtcatcacccccctcccttatcccccattcctttgctttcacttatttgtttgacctatctatgtgttaagttgttcaggaagaaacatttaacatctaaaatccatttcaccttctttttttaaaaaaaaaagaaaaaatcttgaaacatcatttgttttttcttcattagaaagaggaagtggtgttttatcaaatgtaaatagttttgaacgctgatgggttagagttcttctcaccactcaaagaccgtgaagtttgattaggtactaaacttggcaccaagaatcctacattcatcccgtcagccaagtcacgccactggtctccacgttctgaaagctaattacctgcaagttgcttgtgaagcctgtgggcagttgctttatttgatcgtggcttaagcaaataataatcaactcttcatcaaattcagtcaaaagtaacttggaagcaaaacctatcaactgccattttaaaactggatttgaagaagaatgtcttaaatagggggcttcccaggtggcacagtggtaacagatgtgagatgaagtcttatggttagaaaattagaagaatgcttttcgtattagacccatgtatttgtatcaattaaatccttaagtccccatactctggttgttttgggaactcaactgaggaggagaattcaaatcaaattcacctataactatagattgcaaagtaatagtatttcagtgtgtaggtcaccataacagagattctatagacaacacataatttccaaatgataagcccctgatttacaagggagcttcccaggtggggcagttgataaagaatctgctggccaatgcgggatattcaaaggacacaggtttgatccctgggttgggaagatcccctgaaggaggaaatggcaatccactccagtattcttgcctaaaaaattccatagacggaggagcctggcaggctccagtctactgggttgcaaagagttggacataactgagcatacacaaccagccaacttaaaaagacaccaaggtactcattctgattatactgtacgtgcataaattgttcacatctgaaagcagaagtgcaactacactgtcctgggccgatcctggcacctggtggctgggcaaggtaacgccttttcttaatacattgccttccaacctagctccttgtcattactcctttgattcccccaatcagagatattgcacttgtgacctcatgctacttttcctctgccttcacagctcagttagctaccatatcctagcatctttttctgacacatgcacacttaactttccttcttctcactcaatttcttcatctctgctgccttccaatgtttgcccatgatcaaatctttctcttccttttctatcactctgtttttcaaaactttctattttatattggagtataacctattaacattgggtgatagtttcagatggacagcagagggactcagccttatctatacatctatccattctccctcaaactcccctcccatccagccgagcagagttccctgtcctgttcagtaggat

SEQ ID NO: 26000 - DNA, 1244 bp, Bovine  19866880636058
acgctgtctgccctttaccgtacttggggtcagagaagccagcctttgacaaaggaccccccggaagagccacttccgtccctgccacgcccccatcccttgcctgtggtctggaacctctgtggttgctgcccctacctcctgcatcttccatctccctagtccccctcctctgccctcaacccccatccccaccattaatgagaatcagaaggagggagaggtggggacttgaaagagtcattcctttcttatttataggtctccaccagaggaccaggggcgaggagtgtggtctctaccctaaagcgaggagcaaagctctcataggggccagggtcctggctgggcttggcctgtgacccctagtgccttaatctccccagctgtacaattaggtaaaagttgggctacaatgaaaaccagatgttacatcaggagcaaagtctcctgggcaaacaaattaaataataaataaatgctttcggttttactagcgactggccattctgtctttcctcccaggctccaattagagtactcccgttgtcttgtggagttttaaaacccaagtgtaaataagaacgggtcctgcaatggcagaaatgcttgctagttttgatttttatttttgtcgatggtttgcctttggtttggttttctgcaatgttgtgagcctgtttttgcaaatcctcctgagtatgactttacattcaggtttaagttgggggtggggggcagcaattaaccaggttgtacttttttttggtcatttggggatcactgatcttgggacagtctcatgcatgaaggactctgaggatcacggagacatagcgtgcatttctcttctctgccaaaaacccacaccaaacccaaatctgcaggactccagctctaggaaaagcaacactgagcttgccggtttaactacagccagccgttcacttgagagtctctctacagtgtttgtatctgcttctctgccttggcatttagagaaccatacttggctgaatatagaacttaagaggtctcagacacattacgctcattcattctttgccttgtgaactcattcattcatttaggaaatatttattgagcacctgttacgtgctcaacacttttcctggagctgagcatacagctgcaaaccagcagagtccctgccaacagaaggactaaaagaaaaagatgctgattgtaccaccgatttcagcattagggctcggtcattccta

SEQ ID NO: 26001 - DNA, 1480 bp, Bovine  19866880653866
tggcagtgggagaggaaggctcttgtgaaattagaagctgtaagttcaacaaagaccatcctccccatcacttggaacaagcctccttggtattttaactgccacagaggagagcagaactgagacctggagagagacacaggttctaaaggatagaacctctggatccagccatgcctgaagatcgcatcaggctcccagttagataagccaatcaacttatccttttcatctgagccagattggattagattctgtgactcagcccaaagagtcccaattagcatagagtcacacttggtgccccttcctcctccatccatacaccagtcatcctccagggtcatctccctccttaatcttgcttctctccatcccctggtctttcagtgtagtttaagcttttaacctacttctttccaatgatccctcaaagtaggggatgaaatgagagaaaggaagacacagtggaaggagaaaatggaacagaggcagcaatataccatttgagtcaagagagccgaaggaatgaggatccacctgcagcaaccccacagatttccacacccccttggatttgtgaagctaacaagccactttgatacctactggatccctgtggtgactctgcaattaccctgcttatttctttatttttggcttcaccggatcttcactgtgggatgccagcacttcgctgcagtgcgcaggattctccagttgtggtgcatgggctccctacttgcagtgcttgggcttagttgccctgtggcatgtgggatcatagttccctgactagggatggaacctgtgtcccctgcactggaaggcgaattctttttttaaccactggactacaagggaagtccctagcctgcttgttttaagagaggagaaaaacctgacacagagagggtgagtgtcttgttcaaaggtcacacaggtagaaagtggcagaaccgggatgcaactgggtcttctggctttaaacttcatccttacaaaacctcagagcatcagaaaggaaaggcttccaaagatgtagataagagagactgagatgcagataagaaagagactgggtggatgtctgcctaggagagtggtgatttacgtgatgcatggaacgggtgcgaacgtgtattgtgtgtgcacacacacacacacacacacaggcaacggcccctctcatttacgtgcccagggagtgactacaaccactcagggtgatggtgatgaagcagagccactgccaggagcataaacaacagacatttaagacaatatttcaaacaatgaaatagtgctggtcggcttcctacgcaaagcccagtctccctcctttcctggtggcgcaggccttcttcccagagcctccaggctcactcccagcctggcctcctgagcactgcccatatctctcaataatgtacgtctgccactatttcctgattcatcagttttagacattatctatcga

SEQ ID NO: 26002 - DNA, 952 bp, Bovine  19866880694561
agcctggcacaagagcatctacattccatggtgtcagctctgtaacactgagactttgtgttctagggactagaaccttccagattcctcaagttgaaagtcagtagctcaccgatattccagtctccatgaatatctaataatttacactgttaatccaccaaaggggtctcctattacatttacaaaaataaaggctgacacctgtgacctacatttttttttactcttttacatctgagtgtggaaaaaaaaaatatttttgaactctgctcttgagtaagacttcattacagctgatgaatgacaaagcagttcatcttatctggaaagcttttccacgaaataccaagggagaaaaaagccagaataaagatgtgaataaatatattgacagaattcaaagacaagataacggatttgatcatgttcccggcatcatggctgtgtggggggcagggggaaggttgccagagctgtgtttggttatagattaataatccaaggtacaaatggttcggaacacattagagaaaacataaactacaatattcaacaaactggggttcaaaggttcctggaatttgcaaaatgttcttggtcatacatttttgaaaagtgatgacacaatatggagtttttgaactttgccacacaaacaacaagtggatttttgcttgaatcacattaaaaagtagtgcagttattaacacacacacataaaaaaaaaaaaaagagagggaggaagctaaatggaaaagtttgaaagagccaactatcaagttgctaataattgaagaataatctgataattctattgtagaaaatgtctcttagcttatgttcctcactgcacagtgattaagaacctggcttcgggttcagtgtgtggaccttgtttgtctctgatacttattggctctacagtcccaggcaagtgactgagctcatt

SEQ ID NO: 26003 - DNA, 1153 bp, Bovine  19866880718774
ccatggaattctccaggcaagaatattggagtaggtagccattcccttctccaggggatcttccccaatccagggatcaaacctgggtgtcctgcattaaaggcaaattctttacaatctgagccaccaggggagcccctttaatgatctgctgctgctgctaagtcccttcagttgtgtccgactcttagcgactccacggactacagcccaccaggctcctccgtccatgggattttccaggcaagagtactggagtgggttgccattcccctttccgctttagtggtctaatacatagtaaatactcaacaaatatttgttaaccaagtgcatgagtgattgttgaatgaatcctgttagggagactggacacataggtaaaacaaagaaaaatgtcacccaatagttgcaataggacagaagagattgcaatactctggatggtcagatggatctgaaggtgagggaaggtcatgagtgagggggaactggagaagccttgcatagagtgtatctgtgtgtctggagctgaactgaacaggagggagaggcaggtcttggcctttctctggaaactccaatgaaggagaaacttagtgaaaaaagtacggggccgctttgtgtacagggcgttctatatttcttctcttgccatctagaaaagaatgactccctgttttcattgggaaatacagagacttttcctacgatgagagcagaggctttgtgtgattaattttagcttggattatggatatgtaataataaaggccatttaaaaactgattatagatgtttatttttaaagcactaaaatgctgaaaccccatgctcaactagagtaaaaagcttaattaaaagcagaacctttctaaagggcaatcggacctagtatccatataaaacccccacactgggcataggagacaccaacaacccaaaggccaacaataaatgcaccccataaaaccagaaataaaatgagctctgtctgaggcatgcagcaaggggaggggcggccccgcggctgtataattgtccagccctcacctcattgaggccaattacctaggggaggattagaaactgacctggaggtgaccacttgtgctttaaagtgaaatccaaagtgaaagagctcgcccaaggg

SEQ ID NO: 26004 - DNA, 1185 bp, Bovine  19866880736417
ctctgatagcagatttaattgaaatatgacgggggaggataatggagattaaattaagctctcagataatcatctgacacagagataattgagccagcctctgccacgttgatgaacgcttcggagatgctgtgcggggtggcatttcgagtatcttatccttcaggcaaaatggaattcttctccctccacccccccttcctctctctctcttgtcattcaacatttgtatcctccaaatcgataatgtgaacagcagcataattggaaataaaagatgatctgaaatccacaggaaattaggttgaggtgcgcagaggagtacagttgtgtcctagacacaaggggggcttttataagctgtccataagaagaatgtgcctcctccctgaagtctcactgggactgtttgtccaatacctctgtcctcaacggaaagaacttctcatgtttgagacagggaggggaccagacagaagtgacttcgtgctctcttgactccacagggaacattgccatgcttttcagggcaaattcagaatgtagtgtgcgctgaagatctggtacccagtactggagggcatggagtcatcctatagaggcagctagctcacggtggttattagtgaatgtcaggggttacatgtgatgaacagttaaaagcaagaagtggggaacagagttctggttgttgtcatcacaagggtcagccttcaacagtcctagagagtagggacccaccctctttaacccaggaactcctgcctctccaagggttgtgagtggcaagccaagtatagacaataagatggcatgcaaaagggggtcttcaccctttctccacccaaccagtgccccagctactcagagtttcaggtctgggattttagaccaatgtgatttacctgctttactgatgtggagctgggagaatgtggtcacatcttctcaagagtccaccgaaacatctgtatcacatttctctcttattcttctcttccttgccatcaccctgcccatgaacacaccaagaattccctgccctggccactccctgtactgtaacataattcaggggcacccctttggggctggaggaagccactgacacaagtacccctgggaagtggattgcctagcagacaaccaacctcccagagcaaagctaggcccctaaacttaata

SEQ ID NO: 26005 - DNA, 1272 bp, Bovine  19866880764575
tggtgggaacaacatttcaagagggtaagccttgattgcaatacctgtgattgcttatcaattctctgcttgcaacatttttgctgatgtccaatgggccagaaggagaaggaaatggcaacccactccagtattcttgtctggagaatcccagggacagaggagcctggtgggctgctgtctatggggttacacagtcggacacgactgaagcgacttagcagcagcagcagcagcattggccaaagcaggtcaccggccaaaatcagtgttcatgtgagaggaagctatgtgaggatgtgggtactgggagatgtaaaccattgattgcttcatgcatgggggcattagactatcaatctacgacaacgtttctccttttctcatctagtctggtcatatggttggcctccatgtagtataaatggaataagtatccaaagagctgattatagatattatttttttagatgaatcaatacttattatattcttggcatatattatgttatgtacatgtgctatttacataccatttcccaaaggactaaaggatggttgcaataaaaaacagatacaattttaagcattagaaatgttcgaaatccttgaaagctaagtttgttgttttaattaaatattcaatttaacatggagcttcctaggaatcaaggcaaaagtgtagaaacacagtaggtcaattgttcttcattacttactaaaagaaagcacattgtctttatgagtgaccattttttcttgtctctaaatacacagagtatcatagagaatggggtattccacagagcatagctgagtttgaagaagcattattttggtaataaacaccaatggactttttaaaaaataatttatattggagtataattgataacaatgttgtgttagtttcacgtgtacagcagagtgattcacctataccaaaaaatgcataaaagtttccagttataaaaagaacaaaacaaagcaacaaaggtctatcattaaagtgagcttcagtgaagatgtttctgacatgggattaaactttaggagaaaggaaggtttctggtatgtttacataggacaaatttagagctctgaacactcaaagttatcaatgcaacctttgaccatgggggacaccaccagagacacctgggctgtatgcatccactgtgggaccccaatccttcctgtccactcattctagaatgttctgccaaaacctttcatagttttctcttcttccctcattcaggtctctactca

SEQ ID NO: 26006 - DNA, 1068 bp, Bovine  19866880785218
ggataaatcgagtctaatgcagcctaaccgcagcaaatatccatcaggggctacacacaatcacatctctgggcagttttaatacataaaccataacagcctggagctgggcgtccagggcagacgctcagaaaattcccgctggcacctcatgcctcttgcattgtctattgagggtgatcgccctctgctaaagtgaacatatttcactacaataaagctgtagcaaaggagataaaaatgggatctgattgtgtttcaaggctagccagtccatcttcttcccctgcaccctcagaggatattaatgggaattaacataatgccagccttttcttgttaactgcctgcacggtcccagagagaaacattttcacactcatgaattcaccccttcgacactcagaagtatctgtttttatttttatccaatgctttctggacatttgttatggaacagtcatggggcatggcattttgattccctatttgatttggtacttagatatgggtttccttggtggctcagactataaagaatctgcttgcaatgtgggagacctgggtttgatctctgggctgggaagatctcctggagaagggaatggcaactcactccagtattcttgcctggagaatccccatggacagaggagtcgggtgggttacagtccatgggatttcgaagagtgactaagcacacagcacacacttcgacataccctaggaggatgttagtcctattgtacagaagaggaagtaagggctcaggtgaattcagcagctggtcccagatcacgtggctggataagtaggaaagctgggtctttgggctgcacaccacagccaggtgctcaatgcagggcatccaggagaaggcaaagggaccagattcaaaccctggatgagcttacatctagttgggaggcaagcctgtacacagttcatagtgagacaaagcagcatgacataagtgctattatcctgcgggccaggagttattacggcacacaaaggaggcagagagaataaactttaacttagggaatggagagtcagaaacatcag

SEQ ID NO: 26007 - DNA, 1075 bp, Bovine  19866880799801
ttatcattctccattttcataaatcggggtgttaatcccttaatggcttttctcagtgcttaaaaaaaaggggggggggcggggccggtgggtgtagggggaagagaagaaacagggggaaaaaaaaaaaaaaacgcccagccttgctaatcctccagtagacaatgcatgtttacataggcggccctgcagcgtgtttactcaaaaaagcgggtctggttgcagattcagccccttctgtttgttggctaaatgggaggcccttcgctcccagggatctgccttttccccaggtagagcccgcctctgctccggctccaggttccttgctgtatcttggatgaggcctctgacctttgccctgaaggcccaggaaggccttgcatgtgaggcacaggatgggaaaagatgaagtagggagatggtccttcctcgacttcccaattcacaatcccagtgacttcttattctcctttcacgggagcagcagttcttaacatggggttcctagacagcagggttagcatcaccagggaacttgttaaaaatgcagatcatcagatccccctcaacctgctgaatctgaaactctcggtaagggttcagcaactgtgttttaacaaatcctctgggggatttctgatgcacctttgaaatgtgagaaccactgtacttgggaatttaattcaaaggttaaaaggtaaataagtgaaaataaagatcattttatacaacaaacattggctgacttatggtgccggtttggtaagactttggagtccaagcattgattgaatcagagtgggaacaagtctccaagaagattgcagtctactgagtgggctccctatatgttagagccctgcccagtcttccttttaaattctcaggtccttgcactggcataaagttctgggtcatcaaaatcattaccattatcatcatcattctcatcatcaaggggggcaggagtgagttaagagccttgcctcagtttcctctgcaggaatcaggatttcatcagaatctcatgttccatcatcctgtctgagctcttgttctaggcaaggccttt

SEQ ID NO: 26008 - DNA, 1310 bp, Bovine  19866880841142
atttattacttgtcttttgctctaactctgaggtgcctctgggcctaggctgtgttgattcatttctgaagcacatagtaggtatatggagttcaggtgacacagtaggtttctgggatggatggacgttttgtgctttttataccattgtcaccctcggattaataaagactccatcactggtaggcgtcaggtgctcgttctaggggtaatctgaagaacatggcagtcaagggaagggcctcgcaggacttaacattctagtgggagcaagctggtcagggtaggtgtgccataaataaatggataggtgaatgagagaatttccaggaatgatcagccctaagaagaaaatatttaaaaggccaggaaacagtgatgggagttggggtgcctgagactgggtggtagggaatgcctctcttacttagatggtgacatttgagctgtcacttagggaagaaagcaaaggtacttatgtaaagtatttgaaagacaacgaattagtgaatgtagcaaaaaagagacagactcacagagagatcaaactagtggttaccagtggggagaggcaagacactgttaggagagtgggtggaacaaactattatagataaaataagctacaaggatacattgtatagtacagaatatagccaatattttctagtaactcttaaatggagtacaacctttaaaaaagtattcttctttgtgttttcacccatggctcctgcttgatactttacaggtcctcagtcaatatttgttggtagccctcatgccccctctggactctgcttgtggagtccgcgctgcaaatcctcattgccctttgaattctagcgtcagttctagaattatcagccagtggggtgtgagtgtacactgtttgcgggcaaagtctgaatcgagccctgaatcctcctgtctccactcggttctgttttgacaaagagagtttctttaaaatagacgggacagtaatcgcttcagatcaatcatttaatcgcacatcaatcatcgtcgtcgtcatttaaaacctgaaaccgcatctgggcactcgggccatttcccggtccaggtgtgaacccaggaccggcgagggggaaatatgtgagcttcccacccaggatctaccttgagatcaaatgccccaggaagggaggatggggtaatgttaccattgtgcccggataagaaggtccccattccggcctccaccccacagcaggcaggcggagaggtggaggagaaaaagagcttaatcattaataacactaacttgcattttctagagccttgaaaat

SEQ ID NO: 26009 - DNA, 2681 bp, Bovine  19866880847191
tgaggtggccaagtactggagtttcagctttagcatcattccttccaagaaatcccagggctgatctccttcagaatggactggttggatctccttgcagtccaagggactctcaagagtcttcttcaacaccacagttcaaaagcatcaattcttcggtgctcagccttcttcacagtccaactcccacatccatacatgaccacaggaaaaaccatagccttgactagatgaacctttgttggcaaagtaatgtctctgcttttgaatatgctatttaggttggtcataactttccttccaataggattggtttttctatgggaattttatgggaataaaatgagacaaagtgtttactgcatattgagtgtccaataagaatggtaactactatgattttttccattattcttaatcttactctccctagtatgagtgctcactgtccctagggagacagggtggaatggtgtggtaatctctggaggtgagccataggtcacgctcatctgtgctaggacccaggtggagtttcaaagtgctttcctagcaaagttgaccatgcttttggatgtccccctacacttctgacgggcaggggctttcactccaacctggaaggcaagcatgagggctactgtgtgtaattccagacaccattcatttgtgtgtgtgcgtgctaagttgcttcagtcatgtcagactctgtgactccatggaccacaagcccaccaggctcttttgtccatgtgattctccaggcaagaatactggagtgggttgccatttcccctctcaggggatcttccaatccaggggttgaacccaggtctcttatgtctcctgcaccggcaggcaggttctttactactagtgccacctgggaagcccattcatttatgccagtggttttcagacttcagcattgcttggaatcacctggagggcttcccaaagccgagattgcttggccgtgtcctcagcatctcagaattgtgtttctaccatgtttcccagtgatgttgaggtggccggtccagcactttgggaactgttagcttagactatctaccatgtggcaaggaaattatgctgaggaggggtggttagaaagatggatcctcgggatgtagggaccagagagggtcttgctctccactgtctgtgccaatgggctacacagataggtgaaggtgcaaatgcccctgattctgcacttagaaccccaggctcctctattcccccagttggtttccctgagtgaggctggtgcaggcattaaggaatacagtctcataccaaggactgatggctgatgactagggtcgggggcaggggtggggagcagggatagagacgtctccatggggcaggatctgttcctgcgacagcagagcatggtggggatacaatagggatggtggctgtagatgtgatcttcttatctacccaaatgagcacatagctagcacccagcctgcgtatggaggcgggggggggggggggtccctgcccctctaggttggtcctgcagaaaactgttagcagggtcttcttttctgggtctaaggatgctccccatccttggttagaaagggaaagatctatagatcagacacccctcatgccccacttcaaaaccttcattcccacctcccactcaagccactgcttcaggagccaggtccataaaggcagcaataactttgcacaggtgcagcctaacaacccctcaccttggccagcatcctgtttgtgtccctttctgccaaagctcctctaacaccatcttatgggatgcccagtactcacatatgcccatccaggaagtgaatgcctttgaccacaggggacggaaaccaatgaattattgcttccccatttcatcctctgggtggcagctctgataggtacgccctaaagctctcccaaaagtgccagggtatcaagtccagtcagccatattggtggccagctccacacagtagccttgctttggccttctgaccttctctgtttttcacctcctgccctgcatgccgacttcctggaacctttcttaatgagcttcttgaacacaaacctctgtctcaggctttgcttttgaggggatctctggataaagagcttcctgagaaaagatctgaggtcccaagtttttaagagatcattcaccagccaaccactcaaaaaatgctctgaggttaggactcacacatgctgggtcctagagatgcaacaacagaccagatgatgaataggtcacaggtcttgcgtcaagggctcccagtgcactgggaaagcagtccactagctgccttaagctttgaaggggaataaatgccataatcaggagaaacagagcaggcacccaacccactctgcccagaagagtggcatctaaactgagatcggtcgctagaccaggacaaaacccaaatcggctcttgagttttcaaagtccaccccaggaggacaggagttagatacatgtgatgagtataactttctgtgacatcctttctagaacatactagaaactcctgacttgccctcagctctcccttgagtctaaccagagcctgctgctgctccagtttgtcccttttctcccactctggtctttaaggaggtggagaggaatgttccagtaccaggagaatagaatgcaatcaatc

SEQ ID NO: 26010 - DNA, 1566 bp, Bovine  19866880870997
tagccacacactatctaagggaagagggttctagctgaagggagcagcaagtaaaaggccctaggtaggttggggtggggtaggggttctgatatgtttgagaaaagcagctagataatgactgcaaagggtctggtagatcatattcagggctttgagtttgattctgagggtgaagcatgtctgtgtatgtgtgaggtggggtagtgaatggaatgagggtcaaagaagaagccaagtaggaaagctaaacattcatccaggtggtagatgggccttcatctagcgtgaaagcagagaggagtaagaagagatgagctatattttatctacaaagaggagtagcagcacataccgttcatggttagaatatactaggtcaaaggcagctcagagaggtcaagggtattgtatcattttaggcctctcccttgagattaaggccaacattctggataatcttacatgccttgctttcaaaagataattttttatttttaataaacaatacattattaaccattattttgcctgtatctttataaccctgtcccataatttctatagaaataattattaaaagtagaattattagaacaaatgatataagcaatttaaattccaagtagatgatacccaatcaccctccaaagatgtgaatgatataccatagattttattttgtaggtgtcttcattaaaaaaatttttttttactttttttgcagtactgtggggcatgtgggatcttagttccctgaccagggattgaacttgtgcccgctgcattggaagcgtggagtcctaactgctggaccatcaagaaagtccctttgcaggcatctttagggcagaggaatggcgtggacagagctatgtcattctttcatagagttgtaggggaagtgatttcattaaagatagataggaagtgtttaggggatgtgctggcaagacggcaggggaagtgccagcttttaaagctgatgcaaagtctgaatctgcctgtagctgggcaccgggagcacagagacgccagacaagcagataaagtggaaaggattcttcaagacgtgcacccacacacacattgctccggaagaggcccatattgctagaagcagcagcgggaagccattatgagagcttgcacaatctattctagctgagaatgtttcccaatataatttacaaaatttcagttggaaatgcattagcagctgagcagtgaggaacttctatggggtaaataggaaaactaaattaaaaccccagcttcgaacacgatcgaaccgtgtgagcagcccctgcagtcttctctaaccttttcaagtccaaagagcccttttgttctacccagtttatgggttggttttcatttgatttggttgcaggaagtttttatggaatccgcgtaaatgactgctgatgagcttgcatgcaaaaccatccattcacacattcctcgtaaaagggtctcggaaggaaagagagagacagacattttaaaacccacagcacaaaagagagatcaagcgtagagtaataagacagacagacagtcagg

SEQ ID NO: 26011 - DNA, 906 bp, Bovine  19866880882537
caagatggagaccccctttattcccttcatctctgccttccccgtgtcccttgcaaatggctctgcagaggaaatggctctgctcaagaaatcattccttttggcttaataatagtgggaaggggaaaccagaaacacactcaatgactatctctcccgtccacagggcctctctgttggcctagctccatcctctttccccaaagcctcatctgccaataaggagggcccctgccctccagttctattgggaaggtttgctttcctggacacttttcatggcactctttctacacaagcacgtgtgtgcctgagctgcctgtaagcctgaagaatcaccccttgtggctccctccccaaacaagctccaattagacaccacttaatggcatctccaatttgactgtctgtccaagattccacaatgcatgggaattctcccagagattattcctggatttcccatcctcaaaacaaggaggggggaataatgcatgattgaaaactagccaccaaatggtaaaaaaaaataaataaataaatttgcagttgtgttgctttgaaaacttattgcacagctgggggcatgtaaagaacttaattaacaagctttggccgcaatgtgccccctctttgggaggggaaaaaaatcactgttaagatttgtccaattaaattataggagagttggtgaattcaaagagagagagaggttgggggaatgtgctttcagtttaaaaagaagatatttagtctgctgggagacctatagtctgattaatttcagtgctaagcttttctgcacagtttccacaaattcataggcacttaagaatttttaacccaaatgtaattataggttttgataatcaggcttggttaaatacagtcccctctttcttataa

SEQ ID NO: 26012 - DNA, 819 bp, Bovine  19866880883999
ctgaaatggttaaattgaagatgccaatagctcatttatatcacaattaaagactgcctatctgactctgggtctaaagacttaggtaagcaaaatatttcacattatctgtatttttcattattttaattttgatgctgaacctccatctcctcctcccttagtctctaagaactacgtccttgatttgaggaacttccttgatcttcatgctgttggctactcaatgagccaagattttggatttctgggctctgccagaaataacctcaaagccaaggaagcacagaaactacttcctgcctaatggggaaagagaattactcaataacaaacacaaagctcaagagaaaatacagttcaatacaaagagataccccatgaccactgcttcagaaaattaattttatccaacaaagatcagcttgaatgcagcaagttggccatagattctgcaggaaaaggtgatggtaacaccctgggagaaagacaaagacatttgattcttattctaaccttgggcacaatggtcatgttccatttctgggtgtcagttttgctatctgtaatgcggggataaacagatcaacctctccaaaaacatagcaaagatacaagagctctgttactcacaagtgttatgtaaaaatttgatccaacagccaaatcaaataagtctcccagactggttcctaaagagccatattttgtaaagctttccaggtgattctataaaacaagtaagtctgagaaagacaagaaagtattaatgctttgattaaagtagtagctgtcaaaaagatctaaattcaccagtga

SEQ ID NO: 26013 - DNA, 1152 bp, Bovine  19866880893933
tgtacaaagtctctttttatttaggaaaatctattttaaattaaatatcataagcccacgagccatagcaaacaatatttttgaccatatgctccgaattaatatgccaaacattgcaacctctattttcttcatagaaaggggccccaccctgatgtggggatggggagcctggagggtaggaattttcaataagggcccgaggataggatgatggcaaggaaccagcaccagccttcccagctttatccttcttctgaattatctcaacacagacccacttcccttttaagaaagaaattcccttcggtccatttttctcccttgtctggaaacctcatacccaggaatcctagcaatgctggccacagtttagatgacttggtaaagttgctataattcctttcatctgttgcttgcttcattcctgggtgatagggtttgaaaaccagttcctttcatcaggtgttgggcagaaatggaaactcggggctgaggtcctagtgtgggctacttcgcccactgcccccaggggacctcccaacttgccctcctccaaattccttctgtaactcttccatgcatgacggtcaaagagtaacaaggcttccttgggagcctgagccccatggccaccaagaacgcgacgagctgtttggtccttgacaaggtagggaaattaagaggattcatgtagaagggggctagctgccttttgtctttgcaaagggagcatctgattgtttggggactggtttcctgggagctatggtgccctaaacccaagcataaaaatctgatcttttataagatcctagggctgggctgcacgtggctggcacctcttctgcaggggtggtcacaccaggagttgcttcaggcactggaattgttttttgtgtggagacttaaaaatcctccagcatgagatttgacttttttgttcctgctgcccatgttccctccttccagtaactccttccccctgtgtccctttctcccatcttaccctgtttcctctgttttttacctgcttttctttcccctcacttttttgagtctctatctatacaactttgggtgttactataattattctcaatatcaagaattattggtgacattttatacccaccaggcaccatcaaattt

SEQ ID NO: 26014 - DNA, 1291 bp, Bovine  19866880899400
aaacacttggcgtattccacacaacacccccctcgcgttttgttactgcagccgtcagctttgaaatataccctatctttcctcccccggcccctcgctttaatgtaccctgcagctgctaaagatggtgttgtaactttagaaggacctcgctatctttctccagctctttaagtaataatcataattttcattgtggttttttttttcttcctcaactttcttttgcattgattaattattcaaggagtattgctgggccagagataacatgtgggaacgtgcaaggtcagcccgtgtttagatcagaagccccaattctccctttgattccaggatgggcagcaactggcaggttggtatggtacatgggaagagagatggttctgtgctgggtgcaggaaatgggaaagggggggtggggttcaggctttcatggttccctgtttatctattgtggggaacaagggagaggcacccaaaaatcaggtcagagggagtggggagcaggctagaaaaccaggcttcagacccagagagtggacagagctggggatgggcaagatggcagcatgagggcagtggagtggtggcgggggggaacccagggagataacattgtaatcactccagctgagagcatttccagacgagaaaactggagttgcaattttcctctcataaagaggtgaagtataatatcaaataaggagagtggggccatggtttgtggaggaggaaggacaatatctccttgtctgcatgacgtagtaataacaggccagattcctttcttctcaaacagaatagaagctccagatcttctgggggcacttacaatatgaacatcttaaggatatatgaagtctggattagcttcaaagtaatccaggctggaaaggggatgggcagggctatagatgaaacaaaaggagccctgcattaataatggttgaagcccagtcatgggtcccgggggaggggggtggtttatcagatgattctctacattttgattatatctaaaaatttccataataaaaaaaatacatgtcaagtttcagaactcctttctgacgtgagccagcgaacaacttaccttctcaggactgaggtctatgggaagaaacccagagtggaagaccagtattgttggttgactaactagtttttgggactctgtactcttatccagcccatgaaaacttcttccataaaatgctgatgaaaataatgtttcatcacgctccctctcaggcgtccacagggcttcctatgccccctgcaccag

SEQ ID NO: 26015 - DNA, 1808 bp, Bovine  19866880936754
agtcgccaccccagtggggtgtcaggggctcagggtgagggaggaaggggacggatggagaagagatccaagattggaagcagccagtcaataggattttacaaggctgacacattttaatctaagacctggagcacgtgcccagctttgtcccaggggaatgggccttgctacctttggggtttgtcttcagaactgaagatgctgagatgagaggctgcccgtttctcccagaattagggtgggtggaggttagttccaaatagtgcccagatcaatctgactcacattcttggctttgcctcacttttttctttcctcataacatggggagcaagaacattcacctcataaagttataacagcccagtctatcatagatgggaaagtgctttgcccattaaaatgaaatctggtattgcttgctattacactttccaagcttttactctgaaaattgcttttaattatttgcaaatatatctagcattgagtattactcttcactcttatcacatattacctttattatgctttgctgtatcttctcctggaccaaatgtcttgttgacagtcttttttattttttaaaacttctaactttgttatggagtatagctgattagcagtattgagatactttcaggtggacagcaaaggaactcagccatacaaacacatgtatccattctcctcctccaagagagcttctctgatggctcagtggtaaaaaaattcacctgccaatgtaggagagcagattcaatctctgggtagggaagatcccctggtaaaggaaattgcaacctactccagtattcttgctgggaaattccatggatggaggagactggggggccacagtccataggggtagtaaggagtcaagcacaacttaacgactaaacaacagcaattctcccccaaactcgcctcccatccaggctgccacataacactgggcagagttctatgtgctatacagtaggtcgttgttggttatccattttaaatatagcagggagtacctgtccatctcaaactccctaattatcccttccctctgtctttgaccttggcaaccttaagtttgtttcctaagtctttgacagtattctttagaacatcttttaaacattttttacttaaattcctcggctaaatttatgccaaggcaaacatccatgaactcagagatttttatgggctagtagtgtattttctaaaacagatgacaagaaatatctattatcattaaacatactgttcgtgaaatttcaaacccacatgatgatgtttgccaaactagtggtgccggaggagtagtttctcttctttcagctcactttggtggaggcacggtccacttcacgaggctaccatgcagttcccttgccaccagaacaggttttatcttgtttgtagaaatgagtccacagaccaggaacttggatattgtgtcatttccaaagttactgacaattccaaaaacattttctcaatatttaccttcagtttctatacttgacatcaatcaataagaaagagttcatggccctgcagtgatcgttggccacatttggagcagcccaggtgtgcaaatactggaacacactgatcttggggagagagggtccagagaagaatcagcagattcggtcagcagggacttagaatttctcagcctcagcttatctgtctataaaatgggtcaaactgatgtggctcccagactgctgaccttccttctcctgcaccaaagaatttattcatcctgggaacatccctcctctggccccattacaggg

SEQ ID NO: 26016 - DNA, 1414 bp, Bovine  19866880953602
cagcaacgaagacccagggcagccaaggaagaaaggaaaatgttcacgataatatcaggtagtggcgggtgccacagagaggataagccagggtcatgtgagagaaagtgttggtgaaggaaaaaggctttatattagcaggctgggtgaggctggcctgagctccgtgtgctcctggtctggagaggaggacagaaggtctggaggtgggaatcaaaggcccccgccagacatggtgtcaggaaggaagcatggtgggtcacttaggaccgagactgggagttctacagactcatgtgaggacaaggaagtgtcacaggagggttttcagcagggggattaatctgattttttttaaaaattgaggtataaactggattcagggagtgcatcagtgtgcacacaccctagtgaatgtctcaatgaatgttcacatgcacacctgtaaaaatacagggtagttctagaaccccaagcatttatgtttttaaaagatccttctattgctcagtggagaatgcattgcagtgggggtgagagtcaaaagagggagaccttagaggtgaccatattcatccaggcttggatcaaggtagataacattgaaacagaaaaatgctgcaagagtcaggatgctttttgttagaagaatcaacaacatttgctcttggagggacaagggtgagtcagagcaagaaaggaattgagactgacatctcagttttggatttaagaatgtggataggctgggagtttgggattgacacgtacacactgctgaaataatcaccatgaacctactgtatagcacagggaattctcctccatattctgtaataacctatacaggaaaagaatggatagatgtataactgaatcactttgctgtatacctgaaactaacacaacattgttaatcaactatacacagtatatataaaaaaaagaaaggacatggtagatcatgtggccatggggcagcctggggaaggaaagagaagggggatggcatggggcaatccagtcggatgacataagatggtcccttgaactggttcatgccagatacctttggccaccgtctgcttccccctgagcccagagcagagctccctagaagatgagtcacaggatggggagatctgacagccaaagtccctgatgggcttaaggacagaagaacacagcccctgacttgcctgagggcatcgggagaggtaggggaagggcagctttgggtgaacactgtgttccatggaaacctgggtcactggaaggagaggtgacaagtgggaggtgacatctgcttctcacccaggaaccatctgctcactaatgcaaacagccctgtctgtcaggcgaggtgaggaaaaatgactggggcagccccactgtgtagcccaaggagaggggt

SEQ ID NO: 26017 - DNA, 999 bp, Bovine  19866880957158
attgagtgaaatgaatggatgttgattcactaagtgtcctgaggtgaaggtgcttgggagagcctattatgaactttgaatcatgacaaaggtccagatctttataaaggcaccgtgacagccagtggacaatgaaggtctctgtcctcttaaggaaacacacctgcaccagtggtagcttgtgctcttctggtcttgggagattccttgggtgtcacccgtcctgatttccaggtggacccctggtaagggcaaccagtcacaaaccttccatccaagccccgctctggggtaggcacccagtctcccagactgagccagtgagtcccttccagaggagcccccatcaatatcttcttccagggacatcaccaagggcccctgggatgcaatcaagccaatggcccccagcatctctgagggcactatctgccaaatcccccacgtgagcttcatccctccccatacataaaaacctacttttgcagctttcccaggaatctctctgaggcagccagccaattaaacaacaacaacaaaaatataatgtttccaaaacctcatgggtccttcaatacctatgccagggtagggtagtggggaggggaaagactgtgacaggatttatttccaaaggaagaattgatctgtgagggtgatcttcactaagtacaatgaaaaaaatgcaaggtaacaatagtcagagatgttgtaaattaccatggcatcgcactcggaggcaaatactcatgtacaagtgagtgaacataccaaccataaacttagagtcgggcatagaaaaggcagctgctccgggcctctctcctggtagacaaaggctttttcagtctgcttttctccgcctggaggtccctgggcatttgtaccatcagtaacacttcacggagccttcagtcctaacaaataattagctaaaattgaaccagggatttcttacatgcatgtcataggtcctatagaataatgaggcagaaggtt

SEQ ID NO: 26018 - DNA, 1509 bp, Bovine  19866881010179
gaattggtacattaatctgataagtgataatttgcaaacaattttcaatgtttggccttgattacaaagcagtgaagttttctggcttttgttaattaaaaaaagataaatcaggtggtggtcgataataaaagctaaatccttggtggtgcagtggttaaatcaccttccaatgcagggggtgcaggttctatccctgattggggagctaagataccacatgccttgtgttccaaacaccaaaacataaagcagaagcaacactgtaacaaattcaataaaaactttaaaaatggtccattaaaaaaaaaaatcttaaaaaagaaaatgatggctcatatatcttggaaagaatgttgtaccaccctcctttactttaaagccagaggtagttgagaaaagaaatgcaaattaaatgcaaatatactataagggaccttccctatttcttagagctaaattcagcttctgggacaatgtaggagaaaacttcaagtctgtatttgccaggagttaactttaaaagttcggaaggcctaatagaaattgccacatttcattataaaacaaaatttggatttttcaagttagtcatgaaggaagtatctccatgtgaggatggagggtgaaacttacttagcatgtgtgattctcaggcctaagaaccacctttccctgtggttatccccaggtgctagtgtgacccacccccccacccaggttggcccatggggagttgaaaggggtgacactgatcactactgctgtccttccactgggagcacaaacatttcccttaatccctcatagcattaagattaggtgggaggaatagacacagagaaccataaaataagtttgtttggcttgtttagtttggcaaattctcactttgggcagcaactctgatctgcttccagataccagggaccatcctgggttctagccgcagaagcatcaagaacctcattatgttaggggcagaatactgactgaaaccgcccaccctggccaggccctttagtaaccattcgcatgagttgtttatgacaggagatcctggtaaggaatacggaactaataagccaccaccaaccggaagagttctggaaaggtcaaaagaagacactgcgtgtccgcccacttcccagaatccctctcgctagcatccatcttggctgagtgatgcgtgcgccaccaggaaagactctgaattagaatgattagccaaagacaactcggaaactaatcccatcaccataaaacccaagactgtgagccatgtggcagagaagttctcctgggttcccttattctactgctcttcacccgggtgccctttcccaataaaatctcttgctttgtcagcacatttgtctcctcggacaattcatttcttttctgagtattagacaagagcccagttttgggccctggaaggggtcccccttcctgcaactattagagctctccaaaatagtccataccaatcagattaaaaatagactg

SEQ ID NO: 26019 - DNA, 1149 bp, Bovine  19866881052887
tattgtaggttctcattctcgatggcacactgggcttagctggagaattctgaaaaataaattctatttatttatccaaattgcaaaataggatttggaaaggcattggggattttcattaaatccactctcttgctggagactctccctagtgcagagataaggtgagttccctagatggtgggagttcgaagtccctacccagagattctgacatcaattgcctggcatcactggcatcagattgtttaaaacttccttagtgggttctaatttgcaaccaagtgtaagaactactgctttttagggtctgtccattccttgtgggttttttccacacacattgggcttccctgatggctcagacagtaaagaatctgcctgcaaggcaggagacccaggttcaatccctaaatcaggaagatcttctgaagaaggcaatagccccccaatccagtattcttgcctggagaattccatgaacaaatgagcctggagaactacagtccatggggtcgcaaagttggacacgactgagtgactaacattgacaattagaattcatgatctatccagacatgtaaaaacttcagtgtattttctttttgaggcttcttagattgggggtgttgatatccatcaaagacctcccctctctcccattccctaagcccagggaagctgggtggggggattaattatgaaaatagtgtaggtgctgagatggaaacggcgaccttactctgaagatccagctcttttaacagaatgtactgtcttctcagattccctgaagcctggatcaaaacccaactcctcaaacgctgtgatgagattttgaatcaacagaagactcccttcccaccatggttcgatgcctcagctctgatatctagtggcgccattgtaagaagtcccagtctttgtcagcctgcaattaaatccgtgccgaggagtcttcgcatttaggacctaagctctacggtgttttgagaaatgactgttcaagcttgatgggagtgggagaattctgaggtttaattgcaggaaatttcacaggaaaggcattcagtgaattcatcaagccctgccttcctgaaagtctcttcttaatgccaggtgcaaagggctttaacactcagaggctaa

SEQ ID NO: 26020 - DNA, 1254 bp, Bovine  19866881177480
tttccaaagcaggaagtaagggcaaagaagggggaaagaaaatggagggcactttaaaaagaaaaaataataacttcacaatatagtcaacaaagactcaactgccctctgaataacccctctaaatagggcacattttgcattataatacagcattgctttatggaaatcaattaaagacagtttcttcatcagtttccttaatgtatcccaattcccttactttcaaagacatcaaagtcaacatgatgaccttgaagttttgactctaggatgagaattgtctgagacctcatggattttatgtgagactcgaaagtgtgaaagcctccattgagggacggtccctgttaaccaatacgtgtccccaccatcccatggggtggtcttgaggaattcaaaatgataggtaaaaaataatagtatcatctctcacaagttatttaaattctcatggcagtttgccatcaaacgtcaaatttattcaattcacagtgacttcaaagagtgtagaacaacaacccgagggctgcatttctcaaaaaatatgtcagcagtaagaaagggggaaaaatgtttccttaggtagatataaaagaaaatgacactccgtacctacaccctcgtgtttgccagaaggtttgatttacggataagctctttttttaatgtagcatgttcctaattcttattccatcacagttgaaaatttggcatttaggtgtaaaaagaaaagacaggggaaaagaattagagagaaaagtaaattagaaccaaaaggggaccagagtaggtgagaggtgtcagaggctgtgaaagcagccagaaatcttcccttatgtccttagtggaaggatagtcatcttaacctagcaaaatgcaagagaaaattaccttggcttggtacagagttggcactgtcaggatgagaatcagagaagcatgtgctggaatgactgagatagcttcttatgaggcctctcaactacctttttgccccttccagtcaattcccatcaccacatcatgttttcagtacactcaccgggtcagccgcaccccactgctcttcacagaaaccgtgatctagaccctgcctgcctcaccagcctcactaccttgcgctcttcccagcccccagtctacagtctagagtctacagcccagccataggaaactgtccccctggccttcttcttctggtaaacccattcttctaaaacccagttccctaacctctaaaacgaatcaaaa

SEQ ID NO: 26021 - DNA, 2526 bp, Bovine  19866881200418
gagaagcattagaactatacatatgatttcacatactatgatgcaagcaaggataaatgtatgcacaaagtattacaatcacacagaagagaagggggtagttgaggaaggccttataatggaggtaatggctgagcagatttgaaagatgaagaggagttagggaggtgagggtgggtaagcagagaaaagtatttcatgccaaaggaaactctgtgaaaagacacaaaggcacaaatactcagagtttgtgtgccaaaccgtaagtaaatcagttttggaagattatggcttatcttaatggctaaacattccatatgcacagtgtggaaaacaatgtgaattctgctttggttgcatagttttctataaattgaaaattagatatagttggctaatggttctcttaaagtcttttatgttcttactgactttctctctacttgctatattgattattaagaattattgaaatctccaaatgttactgtggatcttttttttttttttttacagttttatcagtcttgtttcatctattttgaacatctactactaaatgtataaactcttaacatcacaaaaatattcctgatgaaattaacttctttatcattacgaagttactttcttgtgtttagtaatactgtttgctctgaaatctactttggctggcattcctattcttttgcttttagcctatttatgtctattcagtggctcagctagttaagactgcctgcaatgtgggagacttgggtttgatccttgggtagggaagatccctgggttgggaagatcccctgaagaagggaaaggctattcactccggtattctggcctggagaattccatgggctatatagtccatggggtcacaaagaattggacaggactgagcgactttcactttcattttaaagtacagctattgtaggcagcatatagttgggttcttgtttgttcatccaacttgacaacctctgctttttaattagactgtttagaccatttacatttaatataattattggcataattaatataaatatattattttactagttgctttttactgatttcatttattcatattcatttttccttctttttccaagagtttggtattaagtactttttattactccttttttatctccttagctgattttttaactataactgtttagttattttactggctgctttagaatttctgtgcactttaaacttaccactatcttccttcaagtaatatttaccaactcatgtagcctaaaagaacttttgaataattaccttcactcctcctttctcagtcattgtgttattgttaccatacattttatttctatatatgctataaactttacatcacgttattaaccttatatcacatagtatcaattctcatataaagagttagttatactttaaagatacttaaataacaacaacaacaaaaacttacatatatatatccatgtggttatcatttctggaactctgaatttgtgtgtgtgtgtagatccttattcccatttggtaccacttctatctgcctgaaggacttactttaatgtttctcacactgtgagtctcctccaagattttgcttttctggaaaaaaaaaaaaaaactttttttactttacatattaaattttatataacagtttcgattcacagaaaaattgtgaagataggtgggaggtgagatagaaagagagagaaactagcacttagaggataccatttgagttgcactagctatagtccagaaaatacatttcagacccagtacatgggaatgacagtggagaggaaaggtagacttcaaaaatgattaggaagtgcatgtgataggaattgtgggttggcagccaaatgactgtggtggtgatgagcttatccatctatgtcctgtcaggaaaacatgaaccactttggatttttaagccaagaggagtttagctcaaggtattagttataatattttggggaaagctggaacatcaaaacaggaaatagatattatctggaaactgcaaaacccactactgcctccgggatggaacccaaaaaccccaattcactgctcctgttactggaagcataaacttacggtgctaaccagtgatctatgccgttgaccctaatactagtggagctgttgctgagatgctgctggaaacccagatgctgaagctgtgtgagagtcacctctgctactgtttgcagaagtgtcaccaaaagtagacaagcttctagcttgtctctgccttctaccctgtcaagaatgctgcctcctggaaccaagtaggcaaggagatttaagtaaaaagaatttgcagactttcacattaagaggtacagagcaaacagaagaatggatatgagatgagaggccacaatatatgatatatatttggcatagaaagtaatagatgggggtatgctttctatttgtgctgaagaaggagatactggaaagttatcccagggatctatcagttatatcatgttt

SEQ ID NO: 26022 - DNA, 675 bp, Bovine  19866881210046
aatgaatgtgtaaataaacattttaagtgcctaagcccttacagctaggggctggcattcaaacccacatgagtttgactccaaagtctactctcttaacctctatgctgccttctgtaatgaattcatcaaagaaaatcccactttgtcaggtcaggactgcggggccagatcacattccgtttgggaccacagctctgcccctttcgtgccttctttgaatgtctgcacctcagactaaataggaagcctatataagtggttctttccctgtaacctcaagccttgactaatttagaaaaataataacacgaaaacaacccatctttccaactcttccataacagagaacttactgtatgtgaaaagccagctgtccaagctgacactgccagagtctccaagcatacagaaagactgtctgaactgatttatccttgtgaagacattaataccattccatcattgagcagctgaaatccccaatagatctccatttaaaggcaaacttgtaaatgcctaagtgtagtcataataacagtactgaaatttctactgaacatgttcagggcagtgaattatttatagtcatattcaacgttaaacattcagaacacaaattctaagttcttagagttggggagaagtttatagacataaataacaacagaagta

SEQ ID NO: 26023 - DNA, 1675 bp, Bovine  19866881230174
attttctgtgtcaacttggctaggtcatgatacccagtgtttggtcaactccaactcttccccgaatctccagcctgccagcctgccctgcagatttcacagttgccagctcccacaactgagtgagccaattcctgcaaataagtctctcctcctgtatctatatctgttgttgttgtttagttgcttaagtcacgtctgactctttttgtgtccccccatggactgtatcctgccaggctactctgtccataggatttcccaggcaagaatactggagtgagttgccatttctttctcctgggcatcttcccgacccaaggatcgaacccaggtatcctgcttggcaggtggattctttgccatggaaccaaactggatagcttgtatctatatctgtatctgtatctatctatacccatcctgttggttctgtttctcttgggaacgctgaataatactaatgttaataaacaactctaactcttcattaaacagaaagaggtactaaaactcagagaaggcaataaacttacctaatgccacacagcagatgaataaccaagcttagatccttcaaaaagcctcctaggctataattcttgccctctactgaggggctggggtccaacttccacatttccaagcctctcagtcaggtggagggcaaagatcacaagtgtttgaaaaaaatttagttcctcaccagcggtgggtgggcgaggaatgagaaatcaaaaattcagtgtgaaaatacagaaatctagccgcagagccaattttccatcgcacttagcaactccatttgatgtgatagtttgctaataaaacatgagcattacggtaacataatattttaagtatccattaactaatacgtaaatataatggaaccttatggaaatatacttaagctgtcaccaacacccctaatgtaatatgcatgatttccaaggctatttataactccttgggttcactctctccccagtgacttcacgggctcaatcaaaagaggatcttgttttctctccccagccctgtctccgtacactctctacctgctggcccctctcctcatggtattgcgtggacctggccaatacctatttgccccacaagggccagacacatgagcagggcccagcctgccggcctggagccagtcatctgggggccccacgatacgtgggtgatgagagttgtcaaagaggagtggcaaggggttgtgagagggcaaagcagggaggcttctcggaggaagtggtgcttgggctgaggaatgggggatggacaggagtcagctagatgatgcagggcaaggggaggggagaggagggaggagcatcgtgagggatccaaaagggcagaggcccaggcacgaagagcagggaacattccttctgggaatggcatggagtccggatgctgatgcagagattataagaggcagagacaagaggttggaccagtgagcaggggctgggctgcagaaggccagacgacagtgggggatggtcctgaagagggccagagcacacacccaggtgcaaggaaacactcacaatactgtttccactcacactggccattctgacaccaccaagccaccagctcactgatgattctccagacaccagctgggtgtgtgacaagtcaattctgacactaagta

SEQ ID NO: 26024 - DNA, 1912 bp, Bovine  19866881264407
aaataaataaaatattatatatgtggtagatggaattaataactctgattctttacctttccctcttccaccctctttgctctgtgactttgaagttccttcaacaaaagagacagtacttccccccaactttggctcttggttttgttatgtgacttcttttcttagtttggtcaataaaacaagacagaaaaagatagtgtgtgaagcccaagctcaggctttaagaggactcattgtttctgttttcttcctttcacctctgctaatgccataagaataatatgcctggtgatgctttggagcagaacaacttgcagtcccatagcctcaatcagctgatttctaagcatgagaaataatttctgattattgtttcaagccactaaactttggggtagtttattatatagcaatggacttcctaggcggcgctagtagtaaagaaccctcctgccaatgcaggaaacataagaaacataggttctatccctaagttgggaagatcccctgtaggagagtattcttcaggtattttatactgaattttatactccagaatactctggagtattttatactccagaatactgaaggactgtagcccttcagtattctggagggctacagtccatagagtcgcaaagagtcaaacatgactgaagccacttaacgtggcatggcacgcattacatagcaatactactgaaataaataagacaatcagcagtgacaatcatgcttatgttgacttagatcacctgtatctaggtaacaagcttggttgctggagatcaagtgttcagctttagaattgtgatttctggatactggactttcaagttcaagtcatgaggacatgtattgggttggccaaaaacccaagtttttctgtgaagttgtatggaaagatcagaacgaactttttggcccactcagtaattaggcagtgccactgctaagtgtagagagtcgtcaccactgccctccttccttttctcctctcacatcttcactacatacatccagatgccttagggatgaacattgtgctagctggatccagaaactgagaccattgatgggagactgcattacctatagctgaaaccaaaacctttcccatcaagtgacggaaagaaaacaaatcatgctttggtatttgcatttgttgctgtatttcctaccacttatgagactgaacaaagttaatttgacagacatttatttatcttctctaatgaaattgtaaagaatggtgtgactttcttctcgcaggccttcaagaacatcattttctaaatgtgtgtgtgtttttttaatcacctaaaatgtttatcttccccaaggttttaggaccaaaggacttggcattccaaagcatcatgtagaaaccataataaattcactattaattggagaagcaggaaagtagattacagaaaaatattcaaactttttatccaccttgcaaattatattactcatatttcttatttcacatccaacattttttgaacactaataatatcagcactttgtttactattaggacttcctttttggtcttagtgaattaaaaaaaactctctctggcttgcatttaaaatagggacatttaaacatattaggatatggtgatgtttctgaaatgattttctgatgctttgagttcaagaggcaagacttttaagagtgcagtcgctcaatgaaggggaattagagcaaaacccagacaggtggggctaactgacatttctcccagatagtgacattaacatagataaagagattggaaactggacacagcatgacaaaagaaaggctccttctaagattatctatgatagatacaactgtcaaactttaacatgctatgcacatgtataaagagtgtttttttttttttttt

SEQ ID NO: 26025 - DNA, 801 bp, Bovine  19866881297792
agacgtgactgggaccctagaggcgcaatcgaagatgctcgttagcgcgctgaaacgtctaggggattctccgcagcgcgccgcagcgcacagcccagtgcctgccctctcaaggtttgggggcgctggtccccatatggcgcccaccttttggcacgcccctcctgggccccagaccatttagcctgcggaggctcgctccaagtggccatggagtggcctgcgccccgatggaaacttcttctggaaggtggcccggacgcttctcccttacctgggcgcggggccactgtctgccgacggtttaccgccgccctgcaagaaaaaattcgccgacccctctagccaccaactaccacccagtccatttgctgaccccaaaatagtgctctggaggaaaacatgttctaggggagaccctataacaaaaggagagaggaagaaatcagactgaattctggtgatgcaatattcaagtcgactcgacatatcctttgtcatggactttttctttcaaatatgcgtgtgtatttaaatgcctaaaagactaattaaataaagaccaagttgacctcgctgggttgaggcccagtttcagattatataaccccagctgccccgggaattctccagcaatgctgctcacagccgcctggaaaatgactgaattaagggaagtgaaaccaccggaacaggagaaataaagccaaagtctccaagggcacggatgtcctgcttaaggaaacttacctgagccgacggaacctcctataccaactgtttatttcacaccattttttt

SEQ ID NO: 26026 - DNA, 1341 bp, Bovine  19866881311465
ccaattccttggtatcccctcaactccatcatgtccaactcttccatcttccattcacacatcagtcatgtaagtcatctaaactgctttgaagcagtttcttagacactgggtctggaagggacgcagaaggtcttcctgccgattctgatactctaatcactctcctatccctggcatccatctttaatgtgaaagcctctcagggccaggttcctttggaagataagttgagaaatttccacccaagcagaaggccatgctgcttgtaaatggcatttctgtttgagacagggtgggttctctccacaggcaactgtagattctgccagcccctagagggcatgcctgtgtgcccactggacaggatctggctgagctgtagtgatagggcttcatctgctttgggcataagtgaccttatccatgggcttccccagtggctcagtggtcaacaatctgcctgcagtgcagaagctataggagacacagatttgatccctcagctgggaagatcccttgaaggagggcatggcaactcgctccagtattgttgcctggagactccccatggacagaagaacctggcaggctacagtccatagggtctcaaagagtcggacacaaccgaagtgacttagcatgcacgcacgcaaccttatccatagaaatcgtttctcaccgtagttttatctggagagggctccagaatcacctttccagatgagtcaggagcaatgtgggctgtgtctgtacctcattcactcctagaaagcagaaagtgttccaacagaagctggtgtaattggcggggaaggtggggtttaggagctaagacttccctagaagaagagtaaaactgtgcccagtgcaggcaagttggaaaacttcagtgtatgacttgttctttcccccagattcctcttttccccgtatttcatttttttccagaaaacgtgtgattttatatgcttttctctgcatgtattaaacaaattgcacagctgaatagcttttcttaaaacctggacattcaccaaaaataagtttgccagcacagacaattaagctttcttctttgaacaatggagtgactgactggcacatttgaaatgcaagcctgttttttttattcaactgttcatccttcaagctgataaacagcaacaatgggaaacagctgggacaggaaaacatttgagtttgtattttcaaagcaagcaagaaagaaacccgtcagtgtgggccagatcccgtcttccgcctgagggcgagccggcatttggggagggaaaaatactatacatatttctaatcaaacattacatatttattaatgtg

SEQ ID NO: 26027 - DNA, 1355 bp, Bovine  19866881346413
cagagccccattcattctcatccaacttggctctcaggcccaggatggagctgcactgccttttaactccttaggggtgggaggaggggacagtcagctgctgggatgggactagagctttctggaaggagggccatattccaagcagggcagaggatcacagggaacgtcccatcagtgaagctagacaagatctctgctgtagattttcttgcttctgcttcctcaaaccctagaacacctcctgtttgtgttttctatgtctctctgtggtgccaaatgcaaagtcttctatacaggagattctcagtctgtgtatacaggacttctatacaggaggttctcagtccgtataaaaatggggagtctgcctgtcacaattactctgagctctgttcttcctataacagaggaccaagttttggctggctcattcagctgtatcttactcagagaccacagtgattggttcaagagcagacatgtgactccaactgaaccaataggaagtcttccctaggattttaaaaattagcacagggaaggaagtactcctcttctctgatcatgaggttttaagaaagggaggccctggcctctcgagccagtgatgcctggagtatgaagaaagggcctgggcagtgtgatgtgctttggtccaacctgcctacaaatcattccccaaacatgaattggactagaatcacagcaggatcatagtagcagttaccatctattgagcctttagggtgggtcagtctgtgcttaagacaccctcattcttgacttgcatgtaggctatcttttcactgacctctcaggggaccatgcttgcccttctttgatcacaccttgtgttgagtcattggtacacagtcatttgctgagtaatcatttaattagagtgtgagtgcttatcatttctgtattaagcaagtatatgctgaaacaacctgaaggaaacatcctgacatttttaggggattataaccgtaagcatttatttcttgctcacatttcacatccacggtgagggggttgaggactctgctccacatgaccttcactctggctaatgaagagccagttgtggcagaagaggaagaaggcatgacacactgactcttgagtcttctacctgggaaggactcatcgcccatgctcacatttcattggctaaaacaagtcatatggcctgcctgagctcagcagaagaggaaatgacaacacctccaagggagggataccaaagccttgtgagcagtgcattgtctaccagccctccaggatggccagccgggtgctctgcacctagtaagccctcaaggatcatttgcactgtttccttcctgcca

SEQ ID NO: 26028 - DNA, 772 bp, Bovine  19866881492868
caactccacacatgatggaaaagactctaggttcccactggctatattggcaaagtgcagaatgagttgccttctgtggggtgttaccattctcatgttggattttcttttctaaagtaggtgagttcatttatcttggacccacattcctccagactgagtagggatctggtatcttcatcaccacaagaggtagtacaatctggacacgccaagtctcatggatgcctgcgagcagttttaaaaggttttggttagctccaattttattagaatgaaagcttttcacaagtaagaggttttatgggagttatttttaaagtaatgtgtttttattggtttctggtaagatcagtgaaatcacatggcattttttaaagaattttaaaccaaaaaaagatgttcaaacaacttgcctgaaacacaaaagccagaagagtaagaataaaatattgaacacaagggggttaatgctaagataaaacaaaaacgttctgaggaagcagaagaaaggggtaaaggaggacgcccaaccagaacaaagatgaactgcgtccagtgtctgaactgttgctcccgtgttgagatgcaagtacttacatctcttttggaatcagttgtccccacaagtatggagattgccattcgttgtccatgaaaattaaattcattagtaaagagaacatacttttagttacctagacctcaaaaataaagtaaatggcacacaaaaatccaactgggggttatactatcaggagagtatcagacg

SEQ ID NO: 26029 - DNA, 1421 bp, Bovine  19866881510580
ctgtgtttgtgtgtgtgcacacacgagtgtatgaaatgccatgtaagccataatgaggaatgtcatttctgatgcgatcactctgaaaacattttaaacgtcccaccaatcaatgtggtgaggcagtggaatggtgggggcattcttacatccctggtgcaggtataagttggtaaaatcatttacaagtgcaattcgctgttctctagaagaaccagagatgcacataccccatgacccagcactcccccacccccagtgtcattcagtcagttccaattctttgtgaccccatagactgtagcccgccagagcccaccggattcctcagtccatgggatttcccaggcaagaatactggcataggtcgccattcccttctccagaggctcctcccaactcaggaattgaacctatacctcctgcactgtaagcagatactttactgtctgagctaccaaggaagccccacctgcatgtatatgctcgagaaatgttttcccttttgcataaagacacgtataagaatatccattgctataaagtttaaaatgcataaaaaagaaaaaaagaaaagctccaagacacagtctggagaactaacaaaaaaaaaaaaaacagctcccagagattatccacagtgaaatgacagtttttgaacagtttaaagccatctaaacatatacaagtgtagtaaaattataaaagcaggtaaggggaagtgtggagcagtagttagccctagaggaaaggagagaaatggtttgggtaagaggctttgactgcatttgcgatgcatcctgtattcatctgagtgttgggtaccctaatgtttatgaatatagtctctggggcttttttttgtcatgcctgacgtgtttcagcagaatacaattttaaaagggggagggggagtaagtgtttcagtttctacaagaaatgacattgggagggtaaggctgagaccgtacatgaaactagaaaaagcttctaatttcccattgcttggccagaggcatcgtgtcattggcaggtggtccagccagacccacagccccacgtggtgatgcctgcaagcagtaagtgtggcaacctcccaggatgtccccgtcagccctctgcaaggcagcgtgcattccctgggaagtcatgtttcctccaggtgaaggatggtatcgctccatctctgtcacctgcacggagaaggaagtgctgcagggagacagatgaggtcatctattatcaagtaggcaaaagagagaccaaagaggcacctgcagcttgccagatgttctatcaatcatcagagtcagaggaagggagcttacttcttcccccctgtcctctcccatccagcctctccagagaagaatcagacaagagatggctcatggacccaggaccagtcccctcaaaaccag

SEQ ID NO: 26030 - DNA, 853 bp, Bovine  19866881562688
gaaaagctggagaaagagaaatctgaaggggattagaaaagctctgacatattcctgggaatctaggaagactgtgcatatatcctgggctgtgagcttactcaggaaagctttgtgaaggttctaagctctcagctttagctgaccttgaagctctgtgcaagcaggaaaggaaggcaaaggcaacattgagttgaaggagctccttaacacacatatgcagcccctttgcaaaaactgggaggtactgatgcccgggcctttaaggaaacctctgtctaatcactagcagaccaccaagctaactgaatagagagtgcagtggccacataagaagaagatacagactttgtagaattagttcagaaaagtcaccagatgaacagcaatgataacaataatccagggtggaacagaggtggggagaggtttagaattactgtgctgtgctgtgccatgcttagtcgctcagtcatgtccaactctttgtgaccccatgaactgtagccctccaagttcctctgtccatggggattctccagtcaagaatactggagagggtagccatgtcctcctccaggggatcgtcccaactcagggatcgaacccaggtctcccacattgtgggtggatttttttatttttaccatctgagccaccagggaagcctgagaatcctggagtgggtagcctatcccttctccaggagaacttcctgacccagaaattgaaccagggtgtcctgcattgcaggcagattctttatcaactgagctaccctggaggccctcagaattactatattatattattttaaaattctgatttcctacagaaaattatgggacattca

SEQ ID NO: 26031 - DNA, 701 bp, Bovine  19866881622751
gctgcatttctagcttgatgaagactcttgagggtatgggttgtggaaggactgagcctatacacaatcaacatttcataatcatttacttgtacaatacaactaagtgtggctttgctgctggtttgtgctttctcctagagaaatggctctaggagaaaattctagagaaatttctcaaatatgtaacccacttctaagtgcccttctatcatgggttcttctgacacttattgggagcggggtttctacacagaaccaatcaagtaaattcccaagaacccacctagacaagtaaacatccatccgcccacccagctcaagggcttcccttgtggtgctagtggtaaataacccacctgctgataaaggagacatcagaaacccgggtttgatccctggctcaggaagatcccctggaggaggcatggcaacccaatccagtattctttcctggagaatcccacagacagaggaacctggtgggctacagtccatggtgtcacaaagggtcagacatgaccgaagcgacttagcacagcacacagcagcacttagctcaaatgctagaggccctttttattccttccaagacattgcttttcctttaggggaaagcaggccttggtggtgccagtctatttctcctggctctcttgttgacactccaggcgccatcttcaaagggcagtgtttctttt

SEQ ID NO: 26032 - DNA, 1082 bp, Bovine  19866881626677
acgaacagcattagaggccgttcccacaaattactatcagttggctgtaatataaatatgcaaattccctgggcttgaactttaacaccctctgtagagaccattcatctctttaaagtattaatttaagttgtaaaagggcccatacatcaccgcgtgtcattttgaaaacaaatattaatcaattttaccctcggaattgcgggcggtggaggcggccccccgttactgcggcaccaggcgacggcggggagagatttacatattcatccgagcttaaggaagccggcgataatgcaagaacaacccccgaaacttgggcttccagaccttatctgcgcgccccgccgcccggcgctgcttgggcattcgcggcaccgccccgccatgcaaatgagccccgagctatctgataaccttgaaagcccgaccgcaagcacgcggggccgctcccgcttctctcctcccagaaacgacaaagtattgggaaaaggttggattcgcccgccctccccaagcagtgcaggaactactttggcttgtgggatgctggttaggactggtaagggcgcgaagttttctcttctgccaatcttagaactagaaacagcaggaggggctgtttctagttgtaagaaacagaacttcggcactgcgttcggcagtggggagcatctcaagggtgggcttcttctggggacagaaaagagctgcggagtcctagagtcctgggtttcagcactgattctgtgtgtccacgctgcataaactttcatgggttgatttggcgtctctgagccgcaattacatcatctgaaaattgaatccggatggatgctaaagataccgactcacagagtggctgtcaagattagaaattatctctcagaagcacctagcacagaaatggatatatagtcagctctcaaattgcattatggacaagtattatccccaaatattgtcatatccccatcagcccctgcttccacttctccatccttgccttggaagtgggtgtagagggacaggagcccccgcatccccaatttccacagtgtgtgtctaagaaaatctccggc

SEQ ID NO: 26033 - DNA, 737 bp, Bovine  19866881816909
ggacaaaggagcctagtgggccgccgtctatggggtctcacagtagtcagacacgactgaagcaacttggcagcagcagcagcagcagggctgctatttctttctgtttcaattttcctcacattacacttgtccatgtgttggttgctgacaacgtttttcaggagctggtcaagaggacactgtgttgaagacactttttgcctgtatttagtgagatatatttttgcccatggagagtaagctattgatggctgccccagggtaagtgtgggttcaggcaagctgtgagttcagctcctgcccctgggccagctcactgcattgtgacaagatggtgcaaagacagacactgtattgagataggagcatgtctgtggtccccagtcctagaattaggaggacagaagaggaaggaagaaacacgtttgaaaagcagtgagtcagaacaaggttatgaaaaactctgtactggtcaaatgtgcaaacttataagcagaaatttctgttcacattaattcctagtcaaaatagaagctctttcctgtcagaatataccaaatagagcagcattttattgacagtataattataaacccaccatcatttatatgaacatctcatgaaatataatttatcagaaatattgtgtttgaagggttcaaacctgtatctttcagtgaggacttctctcgggggaagttacatgtttcacacagcccaaatatcatgtttta

SEQ ID NO: 26034 - DNA, 2840 bp, Bovine  19866880095657
ccagtggtcatgtatggatgtgagagttggactgtgaagaaagctgagcaccaaagaattgatgcttttgaactggtggtgttggagaagactcttgagagtcccttggactgcaaggagatccaatcagtccatcctaaaggagatcagtcctgggtgttctttggaaggactgatgctgaagctgaaactccaaatacattggccacctcatgtgaagagttgactcattggaaaagacccctgatgctggaagggattggaggcaggaagagaaggggacaacagaggatgagatggctggatggcatcaccaactcgatggacatgagtttgagtgaactttggaagttggtgatggacagggaggcctggcgagctgtgattcatggggtcgcaaagagttggacgcgactaagcaactgaactgaactgagtgcgtggaggagcagctgacatttcaactgggctttgaaatatgaacggaagcttgccagagagaaatgtttgggagagtgtgagtgagagggcactccaagcagaggtaacagcctggacaaaggggctgagtatttgtaaataataattttttagagtcaaaggaagagccttgctatgttttagaaattaacatttaaagaaaaaacattgatgacaaggaggaggtccgggcctcagctctgcttcctgattggctgtgcacccttagaccagttatgtcacaagttatatcactttggttttctttttctaagtatatttacttatttgcccataccaggtcttagttgaggcatgtaggatctagttccctgaccagagattgaacttggaccccttgtataaggggcatggagtcttagccactggccaccagggaagatctgggactttggttttctcatctgtaaaggaaggggtttgagtgacctctgaggttctttctaactctgatgacctatggtttagtgtgtgtgtagtattcctctgatcagagagagagaaggaggctcaggtgggtgtgtgcaggggctggcagagagctggacctgcaggctaggaggccttcctcctcatgtcttccttcttccctctccacccctctgggactgactacactacttccctggggtcaccaggcagtgcagacactctgagagttgcagtgacctttgcagaaaattgctcatttcagaagatttaattgtatttaaaatcaacgtgggaggcttttgagcggggactggcaggagtagaaagactggctgagaagtgtcttggagaccccctctgcctgaggaccatgctgagctgagagagtagacttaagacagggcagttacgctttctttctctcaagaactggctgtaggaagtattattaacactcaggagaggaaggcgatgagctgggtggaggaagggcttgtcctgaatctccagggcctcagcgcgtgtgtactaagtcactttggtcgtgtccaactctttgtcactctatgagccatagccccccagactcttctgtccgtgggattctccaggcaggaacactggagtgggttgccatgccctcctccaggggatcttctcgactagggattgaacccgcatctcttatgtctcctgctttggcaggcaggttctttaccactagggccgcctgggaagcccagtctttcctaaatcagcccagcttatgtatcaacagagcagggttctgcctggatgcctcttctgtcccagcaatgagttccttctcttgactacaggagtgtcccagaaagatgagaaaggtcatattattaacactggagggggttaacctcatagcctcttgggaagccactataaaggaaagacagtgagggaccttaaagagagacaagagacccccaagatgggccgctgctgtgttcagaccacttgccctgagacccctgggcagccctctcaccaccaggcagctggcctcgtggaacccactgaccctgcctcagcctcccacgaccatgactttccatgcccttcaaggcctcagggacagggacactcctgctctgacaggagcagggagaggagcgcttgacctgtgccccgtcccccagggtggtcactgcttctgggtccaaggctttacctctccaaagcctatcctttaatgggaaagaagtgtaatttatttgtcaaatcaaaggctccttagctgtgcagaggctgctaagcccagcacccttgccttgggcagagcaggggcttgatgacttgccatgagtgtgcttgtgcatatttaatttaatttgtatttatggagcgctgggttggctgcctatgcaggcctgtgtgcttgactgctttcttttcgggcatttctgtctgcaggcagacaggcgtctgtgtgtgtgtgtgtgtgtgtctggcatatatcctcatactgatggactccagcctgtgttcacccaccttgtatgcacacctggctggctggttctgggcagtgtgcacctgtgtcaggatgcaaaggggatgcaaaggtgggatgagagccattgcagacctgtgtgtgggagggtgtcctgcagagcgcccaaaccacaccaggatctcagagaagctgttgaagcctggggcctcagggcacagagggcaggaaaggcccaggtctattgcaatccagcttccccagtcttgggaaacttcaggagaccagggtgtctctctgccctccatccaccaaaggctttcccattgcaatccctcatgccccgaccataaaccacgccagcacttccagcctcctttccccatttgagcggtgacttgtagctggttggggaggg

SEQ ID NO: 26035 - DNA, 3024 bp, Bovine  19866880346502
taatggaatcccttaaaattctggaccccatggtctcggtgaacttccctggttggcattattccaagtgtatcatcacgtccatggcagaaaagtggtgcattgtagggagagcacattggaaggtccaagtgtggtaactttcctggactctgtactttctctcatggctgatttaaatctgtatcctttcctttaaaaagctatcaccttaagcatcacagctttcagtgcattctctgagtttatccaggaaatcatcaaatctgagagtgatttggggacctctcataggcttgaagaagcaagaggagaaagaagttgttagaatctggagagatgtgcttatacttaggagaagtgggagctgtggccttgggcataggaatgcagatcctgccagcctgcagcccagcaggaaggaaaccacgagaatgacagcctcagcctctgtctcctctcacctcttgtctcccacctctgtccattgaccaaacccaatcagaaaggagagggcaggctgtccaggtgatgtggtctacacaagcaagcctgcagggcacagggcagggtggcggaggatggagagtggactggaagcagaaatgaagacattcagcacagcaggaccacgctgtcatgctctctcacccctgggtccttagtatacagcctagttcctagcaccaagttagtacttaaacagtattgctgttgagtgaaggaatgaacccatgaaggaataaattcgtccctcacctagagctcagggatattggaagatcaaatgagaccaggtacatgaaaatattctatgaaccatcaagcggcaaatacatagaaaagcttatcatcttactctgattcttcttccatttatgagatcaatcactgaaagagaatcagagctttcagaagaagccaactggctacatttaccctcatggccagagcatctgcccctgagagccctgttgatctgagcactggaacaactgaggcatctctgcagaacgaattcaccctctgtccaggagtagcttctggggagaaaaccacttcaccacaagggcacttatgtttcctttgctgagctgaaaataaaataatgacattttccagcagcaagatgctccctgtcatacctggggactaaaggtttattgcaactttattaaaatatatgagataaattgaagagccatgctctccagccagctgatggagccactgcctgcctgtagatgttttggtttttgtattaagaaagttgtcacaagcaatttggaccggagcatgtacttatagactgccaaatgttgattaattaagcccatgtttggattagttctgcctgatagtttcattagggaaaaatgactgaaaatgtggaataaaggagcaagggaggaaaagaaagcatcatcccacagtgagacttaatacgaggcaattcaccctgtattcatggatgtgtgcatatggatacacacgggtgtgtcttttcaagtgttccagcaaaggatggatccatgactgcaagaattacaagtagctaatatgaattctacccttaaacgccttcagctcctattctaataccaccattgaccttgacctctctgtataaccacttccacagtgaactcaatgttcactgaacctttagccactgagccagaggctcccaggcttctgtgctgatcatccatgaaagcctgagggtagtcaggcaaagcctgacagggaagactagggggtacatgtcacccacccaggagctggcagaaatgctgggtaaagggcaagactctcagagagacaggaagatacttttccccagtctcaaagatggcaacagtgatgaaaatgtgagctgacctcaaatgtcatggtgcttttaggaaattgtgtttgagttaatccctagcccatagaatgaaggatgagcacttttaggagtttataaggatgcctgtggtgttttgccctcataaattcattcatgcaagcattaacagcaagcattaatattcagccctgagctgttcaactcacaagaggagcaaaagacatagtccttgccctcaaaaatcttcaatatgtacatgaaggtgagtcttctgtgtatgtctcactagccccacctaccccaaccaacatgcttgtgttttctgaccatattgtacttgtttcaattccttaaatgcatcatgctctatctcattgccaggatttctcccacgctcttctgcctgcaacgtttttctcccaatcccactatcgcatctcagttctcctggatgattcatacttactcttcaggttttattgtagtttaaatgtcatttcttccaggaagcctgcctggatcacagacgcacagagtagatacaaagtctcccttccacctgtgcttccctgattgtaggactcaccacatcacattgtttctgcttatttcattgtccatcttccatccgtatcataagcatgaggaagagaaggcatttgtctggatttcaatatcttcagtgcttaacacaacatgtcataggagctaatatgtggagagaatggaatggaaggaacttaaaccaagaatctaaatgatttctaccagtgcagttcagttcagttgcttagtcgtatccgactctttgaaaccccatggactgcagcacaccagacctccctgtccatcaccaactcccagagcttgctcaaactcatgtccacagagtcggtgatgccatccaaccatctcatcctctgccgtccccttctccttctgccctcaatctttcccagcatcagggtcttccaatgagtcagtttatcacaccaggtggccaaagtattggagtctcagcttcagcatcagtccttccaatgaatattcaggactgatctccctcaggatggactggttggatctttggtgtcttctctaacaccacagttcaaaagcatcaattcttcggcactcagttttctttatagttcaactctcatatccatgca

SEQ ID NO: 26036 - DNA, 1527 bp, Bovine  19866880470150
acttctgtccctgtcctgtgcaggagccctttcccatcctaatgaattcatggtcaacacttagcccaagttgtgggcgatttcccacaaagcctgcaggtgtactctccctgctgaaagcctgtttctctggggtagactttagtggacaccagaaagcttctggggagtcctggggagatggcactctcctctgatcccctcgagttctttccatctccctctgggattgctggggccctggctgtcctgccctttgggaggatcctgtctttccgccactgcttgtgttacactgagtcaacattcaatgaataataaattataataataataacttgaggaaatttatgccctagtttcaactaggtccaacgcataaagggaaaactcactgtaaattataccctgggacttgcaagtgaataatgcaggcgcccttccccagagacctccaaatcaactcatttaaatcaataaatcccactctcctctgtgcccgaataacaggcttatttatgtgtcttgaaattggccgaaatatctgagcaagggaacagagcaattagattccttctgtatacagagagctctttgagatgcagtctgagcttgctaactcttattttggctgaacgtaggaagagagaggggaatagaaagccacactaacattgaattcagcccgaccagtggattatttctaaatgtacaagctgccaagtaacgaaattgactgaatttttcactttccagtcaattcttctgtcttttctagcctaaaaaccctgatttagaccagtctttcttgacagtccttgcagaactaagactagaaactagtttgttctgacaggtctcctactgacactcctggaactgtggactgaaatttacaatatttaaggaaatggggggctctggcactgacccgtgggagggggtgtggcatccccgctaccccagatggttaactctttcatttctatatctcagggcagtaggtgttgggaatcctgaaggagaggcagggttggggcgctggagggctcgacacagccatggggatgaaagcattttaatatttcagtagtgccaaggactgaccatctagcctgcttctacatactgtgaacagctggggagggggtgggttctaagctgcctttgtgagtcatttgttcctgttctttccctctcacctaattcttcttgctcagtcacgtagtcgtgtccgactctttgtgatcctatggactgtaacccgccaggctcctctgtccatgggattttccaggcaagaatactggagtgggttgccattctcttctccagggcatcttcccaacccagagatcgaacccgagtctcctgcattggcagatggcttctttaccactagtgccgcctgggaagcccagttcttcttagactgtccctggtctgtttgttgtctccactccagctcacacagcactgctgctgctgctgctaagtcgcttcagtcatgtccgactctgtgcgacc

SEQ ID NO: 26037 - DNA, 2075 bp, Bovine  19866880476010
actggatttgtcacataggagccattctgtagaagcctgtggaatgaatgaagaagtgattggcattggaggcagagttggtcacccaaggagggtctctaatcacccagggaggccccagccagactcggagaactgtgagtgcatgaatgtgtgtgtgcacatctgtgtgcatgtctgcaaatgtgtgtgcatgtgtacaagtgcgtgtgtgtgcacacatgtgcatgtgtgtacgagtgtccgtctgtgcttgagtgtctgtgtgctgtgcatccgtcctgacagcgctggaagctgtcagactgtcgggctggctggcctgggagcagcctaatcatgcctgacagattgattacaggagaaagttgctgtgtctctattgcaacagacagggggagcgtgtctccacttaacctttcccttcacacagggatggagggggtgcaggctggggcagggcggaggggccggggtgggtgtccgtgagcaggactgaggagagtcagcggcgggagggggagcaagcccagggcagggagagagcgtggaaggaacaggaggagaggagtggttgactgaggctggaagacaagggaggcggacatccgggctggcgtggcaagggcagggcttgtctccacgacgtgatccaaggagccccagggccatggatgtcccccttagagctaagcttctccctctcttgtcctgagggatagatgagaggggtgatcctacagggaatctggagactctaaagcctggctctgatcatgctcaggagggttgtgaaggcgtgtggtcaggggccttcagagcagagccgggcccacagcaagggcgatgctgagggtcctttaccctcagctaggggcagagaagagtgctcagttgacaaggctgcagaggaccttggaaaagaaagcagctgtctgcccctcctccctctatggaggggggaagcagtccagtgcagagaaggaaccctcccaggtcagtttctctcccaccatgggtgggatctattgcctgctgggggccgaaccaggtgaaccctgcaaggaggtggatgatggatgagatgggctctgaggaccattggtgaggatcttcctggatctgttccttctgtcctggaggcctcacaggaggggactggaagggtccatgataacacagcagaccctggagaaggaagcaccttactccacctaggcctgaggtctttcccacaatcccatcagggtcacagggagcaaaagagatgcctgcattttcattcagtccactcttccccgggtaaagtggccctgttgcttctagcaaccagaggactaacgttctgaatcattatactttttaaattaggaatatctagtggcagatattatgtgtcaccgagtcactctttatagtatctttgtgtagaacttgtaaatgttactggtgactcaaagttaaaacaaaaactgaacatatagtagtttaacctaaaatactttattttagaatgattagggaggaaaatgaaactggacagatccaacagagggataacagtggttgttgctggggaatcagatctgggtaacatttatatacaattttctgcatcccttcagttttatcattacaacaacaggcattgctctccaaacagcagtatgcctggttttgaatacacaaaggatcccagttcggtaaatgaaacacacatagcaaaacgtctgaaaaataaaatttaaaaaaagagaaagtaacaatgtctgtgtttttgaggctgggagtgatttcttttatttttctcctcttttcatcttcctaaagcatctgcatcactaaaactgagggtgcagggtgggcatcggcctagagggaaagagaagaacagtatttcaaacaaataaggaaaccattccagtcattcctttcactggcttcgagaggaagagaggaagataattgctgctttgggtatggatcggaggcccttggaataactcactcaatgccatcagagcaacagtgagcagatttgctaatggccttctcaaatctgttcccctctttgt

SEQ ID NO: 26038 - DNA, 1517 bp, Bovine  19866880541228
ggattgaacctgtgtcttctgcattggcaggcagattctttaccactgagccacctgggaagtgattagagcaatgaacagaacagacaaaagggcctgccctcctggaactgacattctagttggggagatagaaaatattccataaacataattaataagaaaatcaagtaagctgttccaaggcgataagagctaaggagacaggaaacattagaactgttatcagcaggattgctagaagagatcactcctgcatgagctgatgccattctccactgctccctagggcagccggtaggtgtgagagtgggcactgcaggtgagggcattaggaagtcgcctcccaatcctgaccttgtgtccctcccttccaggcaccacggcctgagtgaccagaccatggagaccctgcttggcggcctgctggcgtttggcatggcgtttgctgtggtcgacgcctgtcccaagtactgcgtctgtcagaacctgtctgagtcactggggaccctgtgcccctccaaggggctgctcttcgtgccgccagacattgatcggcggacagtggagctgcgtctgggtggcaatttcatcatccacattggccgccaggactttgccaacatgacggggctggtggacctgaccctgtccaggaacaccatcagtcacatccagcccttctccttcctggacctggagagcctgcgctccctgcacctcgacagcaaccggctgcccagcctcggggaggacacgctgcgcggcctggtcaacctgcagcatctcatcgtgaacaacaaccagctgggcggcatcgcagaggaggcctttgaggacttcctgctgaccctggaggacttggacctctcctacaacaacctccacgggctgccctggggctctgtgcggcgcatgatcaacctacaccagctgagcctcgaccacaacctgctggaccacatcgccgagggcaccttcaccgacctgcagaaactggcccgcctggacctcacctccaacaggctgcagaagctgcccccggaccccatcttcgcccgctcccaggcctcggctctgaccgccacgcccttcgccccacccctgtcctttagtttcgggggcaacccgctgcactgtaactgtgagcttctctggctccgcaggctggagcgggacgacgacctagagacgtgcggctccccggggggcctcaagggccgctacttctggcacgtgcgcgaggaggagtttgtgtgcgaaccgccgctcatcacccagcacacgcacaagctgcttgtcctggagggccaggcggccacgctcaagtgcaaggccatcggggaccccagccccctcatccactgggtggcccccgatgaccgcctggtggggaattcctccaggaccgccgtgtatgacaatggcaccctggacatcctcatcaccacgtctcaggacagcggcgccttcacctgcatcgctgccaacgccgctggggaggccacggccacggt

SEQ ID NO: 26039 - DNA, 1733 bp, Bovine  19866880553553
taagaatttgccagggagaggttggaggctgacacaaacaatcaaaccaaaagcactgcccaaagcctcctaaaatgataaaaagaaacactgccagatattctcaaagaacgaagagtagtgtctggtctagctagctgaactggaaaaccccataatataatttcatgtaaattatatagtgtactcagaaggatcttgcctcaaaggtggggaataattagccctagactaaacactgcaatggctctatctgacaaatctttaaactaagacctgaaaggactgaactttttccaagtaacttaactgaaacccagaacaaagctcaggaatatttataggaatacagaaatatccaaaacacaataaattaaaattcctaatgtctagcatctaataaaaattacctgatgtacaaataagcaggaaaatataacccacaatgaagagaaaaaatcaattaaaaccaaccagaattggcagcaaatgttagaattaacatgggattaatacagaataaacattagagaagattagtaaattttttaagacacagcaatagaaacaacctaaaacaaaacactcagcaaaatcataataataaaaaaatgaaaagagcatcagtgagctgtaggacaccttcatgctgcctattatacctatgattggagtccccagaggtcaggatagagagagaccaaaaaaatctgaaaaaaatactggctcaaaatattaaaaatatgattaaaaatactaatccacagagtcaagaaggtcaacaaacctcaagcacaagaaacacaaagaaacaagactaagtcaaatcataacaaatttactcaaaaaccaaaggtaaagagaaaagtttaaaacccaccagataaaagtcaaaaacaatacaagcaagacttgaagcagaatcttcaaaatactgaaagaagttaaatgtcaacctagaattcaatacccagtgaaagtatcttttgaaaactaatgcaaatgaagaattcacgccctgcgggaccacactgcaagatttgctgaaagaagtccttcaggctgaagaaaagaataccagatggaaatacaaattacacaaaaaattgaagaacactgaaaatggttgctatatggataaataataagatgtatttattatttaaatccctttgaaagataatcagttttaagaaaacattgtagagtttataatatgtgtaaaagtgaactctgtgacagagatatcataaaaccttcaagtagataaacggaaatatgctattgagagatttataatatatatgatgtaatataaaatcatttgaagataggttgtggtgaggtaatgatgcatactataaatcctaaaacaaccactaaaatagcaaaacaaagaattataaaccacatgccactgaaggatagaaaaatgggagtaaaaattcaaataattaaaaagagagcaagaaaagaagaaagtaaaaataaagtttatggggaaaaacagaacagattgcaagatgatgtacttaaacctaactatatcaataaccacattacctgtaaacaataaagaggcagagatcgttaaaatggataaaaaagcaatccccagtattgctgcctacacaaaactcactttaaatacaaagacccaaagaagttaaggtaaaggaatgagaaatgataagaccaacttccttatcttctttccttcttttcatggggaa

SEQ ID NO: 26040 - DNA, 2085 bp, Bovine  19866880556908
cccagggactgaaccctcatctcccctgtctcttgcattggtaggcgggttctttacccctagcgccacatgggaagctcacctgggtgtgcgtggtgcggcaatttgcttcactgtgaattggaaggacaatgcagaagctgaaactccgatactttggccacctgatgggaagagctgactcatttgagaagacactgatgctgggaaagattgaaggcaggaggagaaggggacgacagaggatgagatggttggatggcatcaccgactcaatgggcatgagtttgagtaaactctggtagttggtgatggacagaggcctggtatgctgcagtccactgggtcacaaagagtcagacacgactgagagactgaactgaactaaaaaggagaaaacaggcacgagaggggaactctggcacaaggggaggactttgataaaaatctagggtcccagttccaggtctgggaaagtagctcaggatattgggaaagctgtgtgactcctaagcctgtttcccctcctttcatggtgaggatgacactccctgcctgccctccacacagggcttggaaagctactgtaaagtgaggggttttacgctccagcaacataaaaggcacacaatgcttttagagagtatgaagctcagggtcaaagtgaaggttgaaggacctgtggacagactcctcccaggccgctgttctcagcactgatgagtccatccaggaagggcaagatccttcaaggagcaacttccacgtcccagccacaggaagttcttatccaggaatcgttatcttcttctccaagatcttagtcctgtgtttgctgatatgcttgtctaaattctctccctcagactggggctccttgaggcaggactgtgtgtgtctcttattcccaccagtttcaacagtggtcctaaatatggaaaaaatgttgccaagacccttaagctcggaatccccagatcaggtccagggctctttgagcaggtgtgggaactggcagtagggatcctgacctagactgccatggagcagagagctcatgttaagggaggttgtcctaattttgtttgtgtaactttccacttgacttatttataggtgtccccactgagtgagtttactggcagtagatctgcaaactttagggatctctgtgctgaatgaggtgggggtacagggtggggaagcaagaggagtgaggggtgacaggaagaagaagagggcatttcagggcagagccagtaaggggcacaggccctggacccaagctcccagactcccacaagaagttatacgggccaatctgtgctatttcacatactattttttttcagagattttggtacaggaaatattcctgggaagatgaaatttatttctgcctggaggcctggcctggcccaaatcagaaatgggtaagacaagtttttggctgcagaccttacctcgctaggccttccatcttgcaggtttctacctggctgagctctttcatgtcctgctcaacctacttgccttgtgtccccgacctcaggaccctattctcttcacctctgccactttatgctaatgctgggtcctccagatgacaacccccttgtgaggacagcccgggatcaataccggaggcactgaacacttctcttccagcagggtctgctctgagaggctcacagtcattaacttggttcccctcataagctctttatgatggagcagccaatgttataacccattttacagattaggaaactgagggacagggaaatcaaatgacttgcccaaggtcacaccatcagtggcaaaggtggtttaatcccaagctgtctgctcccggtggcgagcacctcccagaacttgggggctcagagtaattcctgcaacttgccctaaccccaactgtgttcgcttttccttcttccaaacaagtggcatctttgttcatgatataattttcctttgtttattgtttacccctgatcctttgtgttccctgccagaccaaaaatctccctgagagtaggcacttcccggctcctggaactggtttgtcacataggagccatt

SEQ ID NO: 26041 - DNA, 1534 bp, Bovine  19866880665008
gatctggagcaagggagggggcatgatctgccttgtgtggtcagagattgttgcttacccattctccggagcctcatctattcaagctggcccattgcctccccacaaagtctcctgtccctctgtgggaccccatggacccctcttgactcatttaacaatgttcagtgggtgcctatctcatccccatctcaggatgttcctggtgggcaggcaaggggcaagatgtgccctggccttgtcaaggccaccatcgaatggaagagagaagattccctccccagcagtgcctacgaagaatactgggtgggactctggtgtccctggccctgactctactctgccactattacgctgtgtgactttgggtaagcagcttaccctctctgaacctctaatttcctctctggaaaatcaagggtttggagcctgtgatctgaggtgccttccagccaagccactaattctcctggatccgaggaggaggaggacagttagggcaaggtttcccacgggagctctcatctgagtcccagaggtaggggaagctgggaggtgaggttccattccttgtctgtcctagactctcttcttgctcagctgtcccctctgcagctcccctcggctccatctgtccagccccagctctcctgccagccccatctctggctctgagcgggaagcacattgaagctgccaggtcaaatcagatcctcacacgcaacaatttaacaagagatggatctgacgtatgtatgcggcttttaaacagaggttcctaggagccggttatttcactcagaatgaaaacaattgattttctttagagccacttactaaggcttatcagccttgatacaaccggccaggtgtttccagaggtccagtgctgctcacttgccctcaggtgaggccctgctcccaggaagcgggtgagcatcacagcatggcagccagggcccccacctctgctgggaggaacaggactcccaggcaggagggggcggatggggctggacagggaggtcggcctccctgcagacctaagctcagacccagctctacagagcgtgaggcattgagagtgggggtggctacaactcaaccgtgccccgggagctgggaaagcaggagaggccacagggcaccccctcccaactcactgctgagtcggcccctcgtcctgggatctgaatgacaaggaaacccagttctgaccttgggggcttcccagtgtgcaaatgtgcaaggtggacaatagcagtattcacatgcattctgagatgtccggtgtagtatgggcttctgagaacagagagtaggttcagggctgggagaggaaggggctatgaggcctgggggtggtcaggaaagacctctcctaggaggggacgtgtgaggcagctgggtcttgctggagaagagcttcagggcagaggggacaccctcgagtcctctgtgcatgggggcctgaacgaaggctgggcttagaggtgaagagacacccctgctcccgtccacccgctggggcttc

SEQ ID NO: 26042 - DNA, 3051 bp, Bovine  19866880690139
gagatgcagagatgcagtttcgatccctgggttgggaagatcccttaggaaatggcaacccactccagtattcttgcctggaaaattccatggtcagaagagtctggcaggctatagtccacgagggcacaaagagtcagacacgactgagtacacaccacagctgtccacagttattttgcataattgggctctaagctccggtttcattgggaggtgatagtccagagcaatgggaaataaatctcagctgcttctatttcctcaacagtcagagcagaaacactcacactcagactccttatgctaacagaacccaccccttccccagggctccaccgggcacaaagtactagccagagactatttctcagccccttgtagggttaggtgtgacagtgtgatcttgtattttcaaaggaaagtgtgcagaagtgatgagtgcagcttctgcatcgcttgctctaaggaagagcctttaagctcagcttctctttccagtccccacgtgttagaaagcaaatgtgccagcctcacagctccaaccacgcaaatgagcacaatgcccaggggagagttgagccacaagatggaaggaacctgggtctgaacattctgtcaatcacagtggtcccaccagcctgaaccaactagactgttatatgagagtaaaacacactttcctcttatttaagccactctctcaggactctgtaacagcaacttcacctttatcctgacatactgggtgaaaagaggctgcagtgaatgctttagttgatttcacacatgctttccaagaacccatagggccaattgcaacagaagcaatctttcctgtttatggaaactggctaaacattgcttcttccctaagaaggaaagccaggttcttctcctaggcaggcaggctgggggctctgaagagtctagtgatctgttgcccccatcatctaacactcctctttccctattaatccaaggaaactgtatctccagcttggctgccacattctcaacaaagtggacagagtctatgatgggactgtcaaaggagtaaagtcttagatcagaggagctgccatggaaaaggcccagctgacacaggctgacacaggccccctggtatccctgcccaggggtgatagatgggatcgggtaagagacttggggaggatgtgagtaatgtataacttgtttgtaaatttcagtgaaattgaaaacatttttcatgtaaatagagatattttaggtacagatacaaacatatgccctttgtcttgatgcacagcccaccatttcttgcttcctaatggcctccatctcctctctgtcagtcttatctatcagtcttgtcaggcccagaacaaatgctacctctttcccctgaaaaacctgcatgttgtccacacccagatcaatttctcccttctccaaactggtaaagcatttttatctgtgtttccttggggacccttggaactctgtgccttgcagatgagttggtgaaaacacataatgaaggcttgcagagtggctggagagaggtccttttaatgagagcatctaacatctgtctctggctttctgctaaaggactcaaatatatgctcacttgattttttaaaattaacttttttatttttttggctgcactgcgcagcatgtaggatcataatttcccgaccagggatcaaacccatgccccctgcattagaggcgtggcatcttaaccactggaccaccagggaagtccttctcacttgatttttatgtcaatcctagacagtgaaagtgaagtcgctcagtcgtgtccaactctttgcgaccccatggactgtagcctaccaggctcctcagtccatgggattgtccaggcaagagtactagagtgggttgccatttccttctccaggagatcttcccaacccagggatggaacccaggtctcccacattgcaggcagacgctttaccatctgagccaccagggaagtcaatcctagagtcaggtactattgttacctccacttgaaggatgaggaaactagcaccaagaggttaaggaacccatggtcaccaagctaacaactggtggagaagagatttcagcccaggaagctgcagtagagagctgacagttagggtcattgcataccgctgccctcattcatgagagggacaagcagatacccaagaagctgggcacaaggaaagtgttcgtgacagaggaggtgctgcagacaggaacaggcacccctgtgttcagaagccccttgggcttgtgtgtggagccatcacataacagcaggcttgagttttgagctactcagctgagacagcaaaacaattctgccaattaagccaaacatctggtcaatgtagtgaaaaatcaatcacgaggggtctggccacagaccccagggctcctcccaggtcccaggtgatggaagcgaggcttccctagttcccagaccctagttcgcatgctcccctttgattgactggggagattcacacctaatgcagacctaaggacatcaggagagcaaaggagggacaaatcctgtgggctctaaaaagtgcttcagaatggagagccgcattcaccgcagatccaaaaagcacattcccaagccgggtggtaaattctgtactgcctgctgtagaaatgcaaattgccataataaatgccgattatcccaattacctctaattgtctggcttgtgtagcaagagcattaccataggagagaccaataagggacccggtgtatttagcagaatatcctatcctgggagttgggttacaaatgaagtaggtgagctgggccaggaagccccctctgcggtccctgggaggggatgtcgcagaaagacacgggggcttcacagtctcccagctgcttggggacagcactgatgcagtgacatctttatgcaatggtcattaaatgctattttaaaaattggccgtgtgctggagagataagggcagagaatatatgcttgttctccatgcttccttccttctggccagctgggtctgcgg

SEQ ID NO: 26043 - DNA, 1569 bp, Bovine  19866880780727
caccactgtggaaagtgaagtgtgtgaaagttgctgcaatgtccgactatttgcgaccccatgggctgtacagtccatggcattctctaggccagaatattggaatggctagcctttcccttctctaagggatcttcccaacccggagattgaacccaggtcttccgcattgtagatttgttatttaccagctgagccacaaggaaagcccttgtggaagtacatcgcagcaatgtctttagagccaaatagggctcaatgcgggctttcctggtagctcagatggtgaagaatcctcctgcaatgttcaattcctaggtcaggaagatcccctggaggagggcatggcaacccactccagtattcttgcctggagaatccccatgggcagaggagcctagtgggctacagtccacggggccgcaaagagtcagacatgactgagcgactaagcacgcatccacagggctcaatgcactgctcaggccccaccacatccccaccccagcagcagccagtattctgaaacccattctagtttgtactgattactagtatcattcccgaactgtactctcccccaggaggaagtcagcttcacgtgccgaggctgaaacgctaagtgttctggaaggaactggaaataatcctgagaccaggcagcgggtggtgtatgtggctcatggcagatgggggagaaggagactctggctccctgagaaattctccttgttacaaagtcctaggctgagcatgaggcttggagatggaggctgtccatctggggtagcagcgttgggggcagatggggaggatgcgggtgaggaaggtgggccctggcctggcctgcccgcctctctgcaggttgtgggaggaaggggctaaatatccaaggtggtgtgtgggggatgggagatgggcaggcctgcggtgtaagaaatagtgagttaaaagaatcattcagtgcgtacagagaaatatcaggaatcaaattgcagggaagatttcaagtaatcataaagggtttttcaaatatattcactgctaagagctacagatgtcaggagagaaaattggttcacttaccaataatagtcgtggagactgggggagcaggatgcagacaggaaagtacttaaccaggcatccccacctccttctctcctgggatgcgtgggggtgggggaggaggggctggagcccctcgcaggtgggcgaacggccaggccagagcaagctgagtgggaagacagcttggaggggagacaggaggaccaggtggctccagtggccccaccactttccctccagacccttgcacaggttatgtggcggaaggactgtgcttggcactgagcgggaggcttgttgctcttgtcactgagaatttattgatggtttatgatgagcagagccagctgtgtgacagatcggagacactcagacacgtggtacctgccctgggctcacaacctggttagggagacaaaaaccacacccaggggagaatgagagagacctcggccccacgctgggagcaagggactaattgggattgggggtgagagg

SEQ ID NO: 26044 - DNA, 2133 bp, Bovine  19866880786954
catcaccgactaaatggacatgaactttggtaaattctgagtagatggtgagggacagggaagcctggtgtgctgcagtccatgaggttgcaaacagctggacatgacttggtgattgaacaacaacaaccatgcggaatagggaaatcttatttttccaaccagggatggaatctgaacctcttcctttggaagcgcagtaaccactggaccaccagggaagtccccttgccccagcaaagaaaggcactgctctcacacattccattccaggggcctagagatccctttctagtagctgagggcaaaggccagacctctcctcgtgtgtgtgtgtgtgtgtgtgtgtgtgtgtgtgtgtgtgtgtgtatgctaagttgcttctgctgtgtccaattctttgccaccctatggactgtagcccgccagcctccactgtccatgagattctccaggcaagaatactggagtgggttgctatgccctccttcaggggatcttcctgactgagggatcgaacccatgtctcatatgtctaaccagagttggcaggcaggttttttttttttttttttttaccactagcgccacctgggaagcccagacctctccttaggtatatttaattcttcactgcacatgagtccttgtgcaggaccctgactgctctccaggcccatggaaagccttgttcagactgtgagctttatggtctagctggcctgcatcagtttatcagatggtagataaaggatctagaggtatttaattcaatttttaaaagcatatttgttgtcttgctttattataaaattaacaaatgcacataataaatttttctaacaatacagaaatgtataatatagaaagttccccatcatataacataatccagaagtgtatataaaacagaaatttcctcataattcaagaaataactgttcttaaaaatttggtttatattttccattttttctatgcatattttaacatataaatatgtaattactttgaaccaaaatgatatactatacctagcgtctgtaacttgctttttcttcttaacagtacatcatagatacgacatggaaatgtcaccacgtataaatgaacctcattttttttcaacgattgaatagtattccagtgtgaatgtgtcacgatttatttaaccaatcgcttattgataggcatgtaggttattaccagttttttttctaatgcaagcaatgctgcagtgaacatccttgtacatatataattgggctctgtgctaaaatttctgtagggcaaattcttaaaagaggaattgctggattaaaggataggtacattttacagtttcatagatcttgccaaattgtagtctgaaaagctgatccaatttatactcatattaaggatgcctggaaaatcccatggacggaggagcctggtaggctgcagtccatggggtcgctaggagtcagacacgactgagtgacttcactttcacttttcactttcatgcactggagaaggacatggcaacccactccagtattcttgcctggagaatcccagggacgggggagactggtgggctgccttctgtagggtcgcacagagtcagacatgactgaagcgacttagcatagcatagcatagcaaggatggatgggagtgctggattcctgtcccccttgccaactggttgttattaatcctttatgtaaatccaaatgtttaatgtgaaaccagaattatgctcttcttttcctgaactggatggctgcccatttctcttcaatgtccccatggggtagatggctctcttggccccagaccagacctatgaagattgggtggtagggaaagtagtgaccctggaaaggtgaactctggagtaaagcagttaaatggggcctttcttaacattttgttcatgtagacacttgatttgaaatcaaacatttgaaacatattcccctgggtgtgcctagtgccccactggataaagtaacctaatcacttcgagtgactatctcatcctatttccaagtctgacccaccatcaagcagaggggggttatacaggcatgaacagcagtgcatggggatattggaagggtgctctggatttctgcttatcct

SEQ ID NO: 26045 - DNA, 1645 bp, Bovine  19866880859222
taagtgaagtaccttgatgtccctggcctcagtttcctcatctgtaaaatgggttcaacagtcataaccatgacactggtttgttatttaacagcattttccagcaatgttcctattcaatggtcagtcctattccatccagagtccttccctcatttcaaatgagaaggccctgaggtttctagattctgtggagacgtccagacacagcagccaggaccctcagacatagaagcaagccctttaaggtctctgcagcggctagagctacctgagtgttcagagggcagccaggactccaccaggcgcacctggaaatacccagtgtcaagacaggggaggcacacagctatctagctttaaatcatgcattcttaatttcctgatttaatggacaggtgaacaggcagtccgtgggggaagagacagacaacgcagggtggctaaggctcactttgggaaacacggtttccctgcttggagagggtcaccatcagataatcccatactagacatgattggggaaaaggaggcacaggacatctgggtgggatcataagcagctgtcacagccaggactccccctggcagcaccccagccctgaggctccttcacacgctcctctcttcttgttcgcgctctgtcttcatccccagctgtcaattcgcgtgtctcaaaatgacatgagttaaatatcttgaagaactagggattcatcatacggcaacgttgacccagaaatcagtgcttcctcgagcctgtcacaaacccaggggtttttatctcagtagtggatgattacagggtccttggtgctattaaagacctatattcttaagtgttatcgtctgataaatagattccagtggcccagtgggtaaagaatccccctatggtgcaggagacacaggagatgctggttcgatccctcagccagaaagatcccctggcggatggaatggcaacccactccagtgttcttgcctgagaaataccatggacatggggttgcaaagagccggacgtgacttagctaccaaatgacagtttcagtgctttgttacaatagccctagaaaatgaatatgggcggaagtgcaatatttcagtggagacagctgaggcatggcaagaaggaaggtatatgatttaagaggtccctggaatctcttctctttgtctacccagcaggttctcctctcttttctttcctctacgtccctgctcctctgtcaccaatggatccgtcgatcaatactgaacagggtcagcgacccgccccatgcacctcgctttgtgctgaaggcggaaatggacacagaagcatcgcagctgaactcccatccatgacctcctgggcgcctgtggaggtggtaaaaggtgtgggctctggggtcagcaccctctggcacgaggccacaagttattggccgtgtgacttcaggcatataattaaactacctgagattacttcctcctccatgagatagggaaaaactcatctgcttcacagggtccttttggggaattttgagataatatacggtaagcgattagcccaaacaatcaatcaatgctaattattattagtggtgggggacttgatgtaatacagggatgaagtgtgatcaatgctggctcacag

SEQ ID NO: 26046 - DNA, 1662 bp, Bovine  19866880883128
gcttactgatgtcctgccctagacagcagctctgaccgtgtgcagtctgagatggatatttagaatcagactcggaaggaaacatgggattttgtgaaatcagttcccctggagagcttcatgccttgctctcacagctcagtgctgctgacacttggcataggagcatgtacctaagacctgtttgttgaatgaatggatgaatgtatgagtggggagtgagagaacaaatgaaccggcttcctcgtggatgacgtcataatgcccttaaccagagtgctcagtggccaggcgggctactcctgaggctggtgtgtcccttctcctcatccccatgtggtcttcctgaagctttgatgttcatctctttgcttctccttgcttgttcccacatcttggtctttgcttattcatttgcctaaaagattctttcagagtctgaaatctgtccccattagtttctacaggaaagctttgattccctccaacaagctctgaaaaccctgagcaagtggaggagctgctccccctgcctggaaggggcaggcagggtacacgggttgggctgcagccaccagagccaggaggaggctgggtctgctgatgggacggtgcaggcccccaccaaccctgaccgaggggtcaggaagaaaggctggggactgtgctgcaattctctgactgcccaggactcgatgaacaggttactccttagagacccaggatctcaactcctggccaggaggaaaacccagtctttcaatgatgtaaatgtccaaaagtggttacctgctcacgacatcccaaagggtcagccgcatccttactctctgttgcccagaacatcgcacccagggctttgaggcttcattcattcatgtctagagtgttgggatttggagagcggtcgcagaggctgttggccaacccatcctgcagccccatgtgctgcaggaggcctccagaaagggaagcagcgagtttccagcctcagagctgctgtctgtgcttagcgttgccctgaaggcgccatgcatgctggttccatctcccctctgcttgtgcctgccctcttttctcctctagcccaagccttctctggcagcagcaggcagggagaacgatgtcacaggcaggccagctggaaggggaccggctgggctgggaaagagtgtgaccactgtccactggtgctcgaagtagggtatggctttctcctgggcggctttatgtctgcatatttcagctcccacatctgttcgcctccagggagtcccgaggcatgtaccatgatccctaagagagggggatgcactggcatgtttgaggaagatccaggaggcggtgtggatggcaccaggggccaaggggaaggatggggagatgggaccagggcagggctgaggggccaagtgtggtttccagaaaaactctgcaaggcactttagcacactaccttgtgtaatcctctcgaaccaaaacactcagatgtgagggcgattattatccccattttccagatgaggaaaccgaggaacagggaggttaaatacgtttcccacagggcacagagccaggattcccacagttcttacccggattctgcactcttgacctctttgctaagtggcctgtaggagtgactcattagctttagagtcg

SEQ ID NO: 26047 - DNA, 1240 bp, Bovine  19866880896577
tatacacgtgttccccatcctgaaccctcctccctcctccctccccataccatccctctgggtcctcccagtgcaccagccccaagcatccagtatcgtgcatcaaacctggactgacgactcattttatatatgatattatacatgtttcaatgccattctcccaaatcatcccaccctctccctctcccacagagtccaaaagaaggggtttctaatacagcatcttatacccagcgtcttataccaggcagtggttaactggagagagaaacttttgatatccttacaagacacagctcataggcagacactccagtccagccctagttagggctctccactctatgacaaaagcagactgaaaaggtggcagaggggagcctggagctggcagttctgggttctccgtgtggctccacactcagcttgctgtgtgatggtggggaagccatctccctctctgagtcttagcttcattacctgtgaaatgaaagagttggacgagatgttcttttagggtcctttcagctctctgattctctgatgagttgtcatctgtctaaacccaataagctgctttactaaaaaaaaattaaaacgggggatggtgagagctaaagttgggggtggcggatgggcaatttattccagtgaatgcctttgagtcaccaagactggctgagaaaaattttttctctatagaaatggagcaggagggtttggaattgtccactctcccagagatcaggataggatgaagtttgggggaactgcttgctatgtttgtgcagtgaatcggctctgcacaccagagagaacactgttaccctcatttcagggcaggggtaggggtgggggagggcagacgctcaagagtcagctgctgtggctctttgaaccctctggctttggagatggaacagcagcacccactctgtgcagctagaaatagtggatcgctttaggctagaacgtctgccttacattcaaatccaaagcagccactagactaaactttcagttgtaaaatatttattcacttccttcttatctttcttttgttcccctgcccttatcaagctcttggactcaagtttcctggtttaatgacgcttggaccaccccttactcattcccacctctactactctactctggatattccccccagcctgtcctctctgaatatgctctgaaattgccttttcctgctttaaattgcaatccacccatactt

SEQ ID NO: 26048 - DNA, 1002 bp, Bovine  19866880908329
ttactcctggctgatgagaattactccaggaatctggatcatagtggaacaggtctttactctcctcctgggttacatttccatctctgggtgggtccctgggaaccccactcccctgagagttccctcttcagtctctgacccccaggcttgggatttgtttgttactgctcctggaatgttctccagcaagtcctttttccctggtcatcatctcagtcttcagagtggaatttgtcaatgactagcaaggctctcttgctcatatgccatatgtcgttaggctaaaaggccccatcaccattagcaatgagctaaggaggatcacaggattagcagggatagacatctacatcttactccagaaaataaatacaaattcatcaaaaggatgttttatggtggttcccctggcaaatgaccatgcctacaatagcctatctctgatgccagaattttcatcttttggggttaaagtactgtttcatgttaaactaaagactctttccacccatctcattaaattatgatcatatattattctcttaatgggaatgagtttgtgtgggctttcaagtgtgcaaatgacaggaagtgggagagactgattaatcagaatatgctgatagagtggaggggtcccaaggatcaggatgcctggaggttgctggtgggaagaatgtgaggaagcagtcttcagccttgagtttggagtgaagggtgtaactgagtcatggaacctggatcaataagcctcattcctaccttcctttagttactcaatacacattcaccaagcgagtaatggggtggatcattttacagctaaactgtggcattttttagggtgaaagcagtcactattaacatctatgctgggataacaggcaaacctagatatacagtcaccttttgtgacacctgcaagacttgatgcaggacagacaaaattacctgctgcatcaagaaacctgtaaatgagacggaaaaatatgacatggt

SEQ ID NO: 26049 - DNA, 2051 bp, Bovine  19866880925314
ggtcagtttgactgtcacttctaaacacactcccaagtggtctatctgaaggctccctttttagctgaaaaaaaaaaaagatagcaaatattgcattctatgccataatttttaccagtaattattttcatttgaaagcaaagtttcgaaatactatccaccaaatgaaaatgttggtccaacaagatgcacaatggtccccctgtggctttggtccttccagcacaattgctgggtgtccctgggtagtcggggaacctagctggagaatcagagggttaaagtgttgtcgccagaacatcactgcacaattgcacatacggctcctaggaggtgaaaaccaactccctcagtcgccagtctgtacccaaaccttgtttaagacaaaactccacgggtactcccagccagtcggtgccagggcacaagcctaacagggtcatttcccgctcctccaatctgctcacgcctttctgtctcttgctgtttctgccagcggggctgctctttccttcagtgcaggcttcaaagtcaagctcaaagctacatcatccccctccagagcagacccccaggctatcatctcttctccttccttgttttcttttcttttaaacctatattgtggctcacaatcctttctattcagcattagagttatttatattgatcttttgaactcgactgtgagctccttgagggagggaccatacagagttgaactttttattctgcacagtatttagtgctgtactagacatggtgtgagcatgcagaaaatgtttgttcagtaactaaaggacaacattcaccttttacatatcaacattggttaattacattttcattcctgagaagatggagagagcatgaaaagggaaagtgaaagtcactcagctgtgtcaactcttctgcgatcccatccatgggatctccaggaacatctatgggatctccaggaacactccggaatactggagtggatagccagctattcccttctccaggggatcttcccaacccagggatcaaacccaggtctcccacattgcaggtagattctttaccatccgaacccatcagggaagccttaagaatggtgttaaggaaagtcagtgcaacaccacagaacagactggggctgaggcttctggtggagaaggcaatggccacccactccagtacgcttgcctggaaaatctcatggacagaggagcttggtgggctgcagtccatggggtcgcaaagagtcggacacgactgagcgacttcacttttacttttcactttcatgcgttggagaaggaaatggcaacccactccagtcttcttgcctagagaatcccagggatggcggagcccggtgggttgccatctatggggtcgcacagagtcggacacaactgaagtgacttagcagcagtagcagaggcttctggatctcactacaagcaatttgggagtttcaaaaagaaaaagaaaaggcaccctactccaacacatgcacgtacacaacttgggtacaattaagagacaacaaagaggctggaggctggcctctagccagctgaaacataatcacctgtgacacttgtaccaagcctatgaaattggaatttttttgcatggaacccaggtatcaacatttctaaaagctcccttggggatttctaagtaaacaaaactttgaaaagcactacaagatacccatgaggatgaaattccataaaaatggccaacaggtacatgaaaaacatgttcaacatcactagtcatcagggaaatgcaaatcaaagtcacaataagataccaccacacaccttgtcagaatggctatcataaaagacataggtcgtaagtgttggtgaggatgtgaagaaaagggaaactttatgcactgttgatggcaatgtaaattggtatagccactatggtaaacattatggaggttcctcaaaaaattaaaaatagaatgatcaacctaacaatcccatttctgagtatatatagaaagcgaataaaactaatatcaaagcgatatctgcactcct

SEQ ID NO: 26050 - DNA, 2877 bp, Bovine  19866880930254
ttgagccttgcagggaagagagtcgaaggtactaaggaaccctgggcttggaaagactgtcttcaaaagcccatcatcttgagaagcttagactgaaaaaaggaacaccaattaagagttgggcgtcttggcaggagaaagccttccttagaactgatgattatcttaatgaggggataagaagtattgaaaaggccacaggctgcatgggaagcccactactgagcccaagacttaaatgagcatgcacaaaagacgggaggaaaggccagccccccgcccctgcatgcctactgcaccccaagcagacaggcccctgcgattcccacatgctggagtcactgcctgctgacatggctagctatttattagtctttaacaaacataacacttaccatgtaccgggcactattatgtgcattttatgaatactaactcatttcatcaacactgtatgggttatttttcccctcatcccccaaagatgccaaggttaaataacttgcccaaggtcatcactaatgtgggccagaacctctggctccttcacaacaagaacatatatttatctgctcagcaacagacaatagtaagcactcaagagatatttaagtgctttctaaatgaatgaatgtgatcttatttccctctgaggccggacagccagggtccaattcccagttccattgcttactgtgtgaacctgggcaagatattcacctctctccacctctgtttacccacctataaagtagggctaataataggctttatagggttgttgtgaggattaaacaatttttaaaattaataaatgtaaagaataacaatccctggcacaaggaaacaatcaataaagtgtaattgttatttcacatgctatatcatatctcatcaaaccactagcttctgtaaatacacattaaccatttcttttcattcttgtcactatctagaatgtgttaggtggacatttctaaatatcctagaatagagaattgtcttagttgtctattgctacatagcaaagtttagcaacttaaaatgatgtgcattcattttccaaccatttctatggcttagaattctaggcattacttaactgggtcttctattatatgatctcttataagtctacaacctagatgttagccaaggctgtggtctcatctgaaggttcaactgaggaaggatctgcttgccaagttcagtctatgtttattggcaagattcagttcttccatggctgttagatggagggcctcagtcccttgctggtcattgatgggtcgtggccctcagctgcttgccatgagggcctctccaactcactttatcacagcaagttcatgagaagaggagccaggaagagagagagttggtaaaatggaaatcactgtcttttgcaatttaaccacagaagcaacatggatctttcttgccatatcctattggttataagcaatgactaggtccagcccacactcaaagggaggtttgggggtccatgtcagaagctgctgactccaggctcaaacgtacttactgactgaacccaagagtcagctctgcttcagatgaaggtagggaacatggagaggctgatgtgggtcatgtaaattccaactagccctgcctctagggaaagcttccttgaacccttttgggaccttggtgtccatccctatagaatgagcagctttgactagaagatgcctcaagtgccctccatctaaattctagattctttgaatttaacagatcttgattcaaccaaactgacaaagttaagagttctctgcattcttggaaagttgccaagatcatgcgcatccctcccagccccccaggtgagggtggatcactgtctcccttccaccacccatgctgtgccgtcccacacacagccttggtagatggaaggaagtgggcgagcagagtcctcagcaaagaaaaagtcccaagtgttgcacttgcttcacccacctccttgccctgaattgctctggaggctaaatcattgcctggcccaattggccgggcaggccagcatcaaaccctcagtgagattaaaggccctattgaggtgtataaatcagagcagcacaccctactgagagcatgtgattagaataaatgtgtgtccctggggctgaacacaactctgctgcatgctgggcacctgcgtcctccttgggatccttcctatatattgtcccactgctcctgttcttcctcaacagctcagcagcagcccacccagcagacagtccctttcgaacaacaccctcctttccctatacagagagtgccacatgagcacaaggagcccgagaaatactgtgggggatagggagtctggagaacctagtgtgggtcctggctgtgcccctcgcctgcagtgtggccctgagggggtccctttctttgctcagcatcagtttcttcattccatcgatcaatagattggaccagatgactccgcagatctcttcgagctttcaaatcctacagttctgatatttatctcaagtgatcagggaaaacaggatgtccctagatgagagaggatgagtttggctctaattagctgaactgtgacccccccataaaagtggcttctgcgtgttatctcaatcagagggagagagagaggagatttcagggttggcgcagtggttcagcaatgttactttcccatcttcctctgttgtcaacaccaatgagagatgtccacacgcccctggggggagggggctgagatggccacatctttcagtgtcacatttttctgtgatggtgtcagactcaggagggagacagagtggtgggctctcctgggtgctatatgttactaggagaaggcctttcccaaag

SEQ ID NO: 26051 - DNA, 2337 bp, Bovine  19866880975885
tcttttgactgtgacatttattagtggtttttacaagttggtttgactcaaattatatttttcaaaatctagtctgtgcttgaacacttgaaatattttattactaggtctacagtacataacacagtaattgtgtaattaagagataatgttgatgctatggaacgatgttgacaagataatagcattctgaaaccacatgaatgtcaaagcaagggaacacatttataggtggaaaaacagaaaaacaagtgacaaatggcccaaagactctttgtagtccaagttggttcatttgcttcacagctcagtttccaccgggatactcaagtgcggcccatatgatgctcctgagttcctattgtgtgacgccccgccccaccgccaagcatatgggtcaacattaaagaaagcaggatcatctacagaagccggtcctcctactccacgtgcagacgctcagaaacttagtcacgtgattgccaggcttggtgagactggagatcctcaggttcaaacactgggaagtgcccaccattgacagatgaagaggctgagatgccaactgaggaaggattttctcttggcaacctctgagctggttcttggaaggaggatggagtcctggaggcttttcccagtttgttgcttttccttattctaaccagaatgcctgccttaaatcaggtttctcaagagagcaggaaggagctagaggtggaggagggacaggacacgtgaccttgaaacccaggtcatggtggcttccaggagcagacaaagggtcaggcatcggactgcctagaaagatgaaagttggaaagggtggaagcatgaaggtcataagtggggaaggaggcttgtcctccacaccttacagccttgggaaagagctgcacacccttgacattgaggaaaagaaaaaatggagcaaccagagagctgatggtcatggggggaaatggtgaggctcttctccacaggaagagtgacatgagtgtaacaacgagcactggctttgcagccagaagaactgagttcaggccagtaatttgcaaggtgaatcaccagttcccctccctaggctataatttccttgctcctgaaatgcggccgatgaaccggattggtaactccaaaatacctggaacagaggcaaacgtctatttccaactagctttctgggtgatggggatgaccagaggggctaggagctccacgtggcttctccccacactcacatccacagagcttatgaagctatcaggtggattcacacagttctgataaatttctgaatgcaggggctataatggaatcctaaatatagttatggggttgaggcacccctgacccatgggagtaacgtcagcggtacagtcccttcacctccctgttggacacagaactcaagggcaggtggaccagaagtccaaagaggtggcgccctgttctcccacatctgtgcctttgtacacgctggtccctccacttggaaccctcttcccctccaactgagcaccttccgactcaaccagtgggttaccaattagggaagcgttgttgattcccctcagcagagttaattgctttccttgtcacactgaattatttaaattctgacctgtcaagattatttgttttcagattcatctctctggttagacttcttgagggcagaagctgtcttttctcctttctaaatcaggtaatgagcgtagtgtctacacagtgcaggagctcagtaaactactgttgaatgaaaggaagggaagattggaagtggcagggcgggagggagggaaggagagaaagggagaagagcaataaaagaaggacaagagacgctactattttcctgtgttggttcacagggatgtggttttgattagttgcaatcactatgtgatccaattttttatgctgtttttccatttcatattaatctgtaagcattttccattttgctacacaatcctcataattatccctttaatggctgcttaatatcccatcaggttgatgtgccataattttcttaaccatgtccctctttagaacatagccttttaaaacattaaacagaaagcctgacaaggttttaaaatagatggggaaggtggtttcttggcaacgtgtgtggcatttctgaggtgcacgtgcttagggaaggaggcaaactggcctgaccagggtctggagaagcaggggtgggtgctggggcctggctctaggtgggtgagagccaggaaggagaaggcgaggtcggggggagcagtctgctcccagccccaactcttccctcggctgccagtctgcgccttagtcactgatgat

SEQ ID NO: 26052 - DNA, 3769 bp, Bovine  19866881077511
agggaaatcgtgcacatccaggccggtcagtgtggcaatcagatcggtgccaagttcctgggaggtgatcagtgatgaacatggcatcgacgccaccggcacctatcatggggacagcgacctacaactggaccgcatctccgtgtactacaatgaagccacaggtggcaaatatgtccctcgtgctatcttggtggatctagaacccggaaccatggattctgttcactcaggtccttttggtcagatcttcagatcagacaacattgtttttggtcagtccggggcagacaacaactgggccaagggccactatagagagggagccgagctggttgactcggtcctggatgtggttcggaaggaggccaagagctgtgactgcctgcagggcttccagctgacccactcgctgggtgggggcactgactccggaatgggcaccttgctcatcagcaagatccgtgaagagtatcctgaccacatcatgaacaccttcagcgtggtgccctcacccaaagtttccgacactgtggttgagccctacaacgccaccctctctgtccatcagctggtggagaacactgatgaaacctattgcattgacaacgaggccctttacgccatatgtttccgcaccctcaagctgaccacaccaacctatggagacctgaaccagctcgtctcggccaccatgagtggagtcaccacttgcctccgcttccctggccagctcaatgctgacctccacaagctggccgtcaacatggtgcccttcccacacctccacttcttcgtgcctggctttgcccctctaaccagctgtggcagccagcagtattgggccctcactgtccctgagctcacccagcaggtcttcgatgccaagaacatgatggctgcctgtgacccccgccatggccggtacctcaccgtggctgctgtgttccgtgggcagatgtccatgaaggaggtagatgagcagatgctcaacgtgcagaataagaacagcagctacttcgtggaatggatccccaacaatgtcaagacagctgtttgcgacatcccaccccgtggtctgaagatggcagtcaccttcattggcaacagcacggccatccaggagctgttcaagcgcatctcggagcagttcatggccatgttccgccggaaggccttcctccactggtacacaggtgagggcatggatgagacggagttcaccgaggctgagagcaacatgaacgacctcgtctccgagtaccagcagtaccaggatgccaccgcagaagaggaagaggatttcggtgaggaggccgaagaggaggcctaaggccaagtccctatcaccttaggcttcttaatcccctcagccttcttcctcaacgacccctttcctctccctcagaatttgcattttctgcatctatcttgtttttcttttttgggggggattctagaacagtgcctggcacataataggcgctcaataaatatttgttgtttgttgaatgtctcttctctctttccacttttggggagcctagattttctgcattctgggtaaccctgtcaattttctttctggtgcccactcctcccatctgtccagttaacatttccctctctgttttcgagatagctctccaagaggctggggttcctcaaatctcatttagaaccgtgtgctgaaaacctggattggtgactgccatcctaggccgatgtgctggcccaggggaaggaaactgagcgagtagaagtccctaccagaaagggttgggtttggagaggggcatccagggtactgaagtcctaggtgccaggtatctccccgctcctctcagcttgtgcagaggtgttgacagtattatcttcattttcagtctccttccaagttctgtcctaagctattacctttgcaagtttctggcccccaccctatcaagtgggaatcccttcctcttccactttatctccttcataataacgttgaattccctcctttctcctgtttgagaaagggggtcaagagaagcaagagatagccttggtctcttaagtctccagaaagcccctccccaccccatcttatctataaaaaaaatgatacgtatcaaccccttctgtacttatatggaaaggtatgtgctgccacctaaacgtcattccccagacagggggacagaacaccttccatcttttggcaaacatctcatctctcctgctactgcttccccacttcttgattttgtcctattctacacttcagatttctattgtgttgaacttactgctttttttcatattgaaaagatgacattgccccaagagccaaaaataaatgggaactgaaaagaaaagaaaaaaaaaaagagtgtaaacttcattatttggagaactggaaaaaattaatcaatcaagagtcccataagtaaaaagaaagataaataagtatttcactgaacacttagaaaacatccttttatatatcttcaaagtcctgcctgctgcttttagtttctctgaggaaacctttctcttcagaatggaagagctactgcaaaagattaaagcttaagaatttaggggtagtgtgtgcttaagattcctggtcagtacctggtactatgtacaaaattatttttatagtaggaaaaacaatgataaggaaggtcagaatagctggggtttgggaataattgcttggttgagatctataaaaagctattaaatcaatgcactagaggatgacacatttttgttattctatatgagcatgagcataatagttcaactccgggagatagtgaaagacatggaagcttggcatgtcgcagtccatggggtcgcagagtcggacatgacagagcaactgaacagtaagtatgcagactgattctgggcttcagcatattatcacttaatatatttctgttctagagttgcaaatccactaactaaattttaacgtatttgttgttcagttgccaaattgtgtccagttcttcgtgactgcagcacaccgggcttccctgtccttcactatctccatacaataaactactagagtatgtgtgtgaaataatattaaaaatccttactttccaggctgggtactcatgaaccagcaatgaaaaagaaaagattttttaaaagcctgtgttcaaaaagcacacctgctacttgaaacattttaagaattaattcttccagtatgggttatttcattctcatattgtgatcagcaaggtaaaacttggctttgataatatacaaacaatttacataagacacgtatagctcagaccctatgatatgtttgcataaatgtaaatatcattttaagatcccttcttccttgcttcactgataattttcccaaagacagaccaacaatgttcctacattaattaatccatttataaaaacagacggagcaaaacaaagcccattgtccttgccctcatggaactcattgaaaattaaataagaatatcctgccatagttctcctgcccttagcagaggaagagaggtgtatcaatcagggacccagtaggaaacaattgacaagttctaaaaggtggttgaacagagtgtgaagaaggaaacaccttgcaaagattagaggcagttaacggagaccactgaggagtgatgaagaaatctgaaggccaggaatcaacttatctgtgtcggggactgaattaatgtcatttctaggctaaaatctctgcagagaatttaaatccgtgctcccaaaagtt

SEQ ID NO: 26053 - DNA, 1352 bp, Bovine  19866881131451
tccctcatttgacattggaggaaaaatgaggcccggaacagtaaagtgacttgtccgaggcccgtggcgtgtcattaaatccccgtgggcttaacatcagaaggtctgggtctggctggggtctcatctaactttggttgtatcctctctgtccactgggatcagcaaccagtttccagaaaggtaggaccaggctctgccttactggtctttccaagaggttcaggtacctttcccacagaaagaactgaaaatttgagattcctgcttgtactccagctgctaaatccagggagaacgtctcaatccctctgtgctctcctagctaacacctcccgtgcacctgtcccagatacccacagggaggcacatagggcatgtggatgtgtctctgcagcccaggactggctcagctgcttaaatctgtaatctgaaaccctgcctcctctgtgcactgtgaagtggatgaaagtctgcccaagtccaggcacccagactccccgtgtgcggcactcccgtgggcactcagggaaactgccagatcatagttctgcggaccctggaagacaggcacttccttgggggaattctagaaaacctaagggggaaagggcatggtcaggatgaaactcaaggtacatcagagtgggcaagaaaagagaggtagaaacggggtgggaagagatgtgtgctatgcttagttgctaagtgtctgactctgcgaccccatggactgtggcctgccagggtcctctgtccatggggattctccaggcaagaattactggaatgggttgctatgctctcctccagagggtcttcccaactcaggaatcaacccaggtctcccgctttgcaggccgattctttacctctaggccatcagggaagggaagataaatgatgaaagcaaggaggaaggagaggttgagtagaagaagtgggggcagaaataggaggactccccaagggaagaggtgggggaaggaatgaatggggggaatcagcagggaggttttcttccttgtttacctttgattttgcattccataggtgggaattctaagaggaggagttaggagtggaaggacgtttagcttagattctcctctctgaattcccctccaagggtcaagggcatcagactagattatccccttcaccagtcacccaggagaggaccggaatctagcggcagggataagatgagactgggaccagagcagaaatgaagctgcactcagaaaccaataagacattaggatggcatgaaggccagggatgctgggggtagcccaatgcctgctccaaagggaacccaatacgccatgaggaagttgtcccaggacttc

SEQ ID NO: 26054 - DNA, 795 bp, Bovine  19866881169783
gccctgtaaggacattctccccaagtctctggctttcctccagccccagggattgtctttccatgacctaaaatggcatcctgcttgcctttcatctatctgaagccatggacctcattaactttttaaaaagcagtgtccattcgcttccctccaggtttaatgatggcttcttaaggacagcacatgtctgactctttgcaaccccctggactatacagtccatagaattttctaggccagaatactggagtttgtagcctttccctttttcaggggatctttccaacccagggattgaacccaggtcttccacattgcaggcagattctttaccagctgagccacaagggaacctcaagaatactggagtgggtagcctatcccttctccagcagatctttctgacccaggaatcaaactggagtctcctgaattgcaggcagattcttttaccaactgagctatcagggaagcctaaagagagcacatgcccattcaaacagaagttcactgtggacagagacctgtcttgttcatggcttaacagtgcctagcatatagttggtcaatcaatgtttgttgaatgagtgaaagaattgttgacttccttcccctctagactgtagccttgttgtcttggtttacggcagtacttgacatatattagtcactcaataaacatttgttgaatgaataagcatgcagattactgattttttgacaaataatttttcttacagtgtcaccagcacgtattcaatgaataattgagcctcttctacatgtcaaacc

SEQ ID NO: 26055 - DNA, 781 bp, Bovine  19866881170452
cttgagggtgcccccctaaccagccctgacagacaaaagcgtacagccacagccctccaccatccttgggtccacgttcctgcatgctcctgcagttttaattaaacaccgcgtatggcggctcattaaagagaaaacagttgttctatttctaagtagcctcaggactcctgactatttttactgcttgaacaacattgcagagaattttacagtgtttgaacttggctttacctctgagcccagcaagacctccaggccagggctaagagaccattctccccgctccaggacacctccctcacggcaccagggatcccccacaggcccctcctcccgccagcagcatccttctcattactggtggtcctgtaattactggaggttcgcctcacttaggagctccagtacacaccattcggcggtttggttccctcttttgttcttagtgcttttctgggaagcagcccatcaacagtattagcttatccttggatagcacttcctgggcaccaggcactgttctaagctctttaactgcataaactccctgaagtctcacaacacaactgtcagctaagtagtgtcattctcccagaaactgatggggaaactgaggcaaagaggggttgggctccttgcccaagattataaactcttagttggtgaagccagggctcagacacaggctctagaattggtactcttaatcactatattatgccatctgctaataatctcccaggtttggccctgcttgtgtctacgacctgcttcaggg

SEQ ID NO: 26056 - DNA, 1365 bp, Bovine  19866881185787
gcacttgccttactactgtgggtacagcaattcccgactcagtgtcaccacctgtgaccaggacaggctaatcctcactcctcctctcccttccccatcacctctctgggatgctgtgagataccaggagaggacaggcgctgtgatgtttgaaatcttgtaaatctcccccagtgcagaaacagtgctagacccagggtcagggtcatgttgctggcgtggccacagacaatgcatgcttgctaagttgctttgtgaccccatggactgcagcccgccaggctcctctgtccatggggattctccaggcaagaacactggagtgggtttccatgccctcctccaggggatcttccccacccagggatcgaacctgcatctcttatgtctacctgcactggcaagcgggttctttaccactatcacacgacatgaggcctgggcacagaccatggagcactggcaaatgagtgaatggatgctgaatttgacttggttcaataccagctcaagcccaccaagtcccaggaacttgagaaaggctctgtgcctcagtttcctcatagagtgcatggggaaaacactacccctacacctgatagtattactgcaaataaaatactcagaatagtccctggcacttagcaagtgctgcggacatgtgggcgatcaggagcttgctgggtgaccttgggccagcctgtgcctcctctgggttgcaggtgtttcatctggtaaatgaacaggttggacctaagctcccctctggactccgaactttggtagagcatcttccctctggatcggcagccctagacccttagttagggtctgcccactccccatctctgatggcacagaggcctggagcatctctaggtgccgtggctggggaggaggagacagccagagaggtcgtggatgctgcggttgtctttgtggatctgctgtgactggcagcatggggaaggaagatgtcgcccaaggggcagccagctgcctctgctgagatattgctgagagcagaaaacgtaatggtatcttcattatgaaagggaagcttggagtggggctagccttctgcagagacatgtgtttctttcctcctttgctggagggcagctcggcctggtggtggagacggcccatgggcctggggaccaagagacaagtggacccgcagaggcccaaggggcatactaggggcctgcggagcccagagaggcaaagctctccttgatggaagaggggagctggcaaatgaagtccttctccagcttcttcttggggctggaaagagcctgcctggagggtgcaggaggcccctgggaaagagggaaagagatttctccccaggaaaggagg

SEQ ID NO: 26057 - DNA, 1045 bp, Bovine  19866881191244
cttcagtatttaaatctcccatgtgagtctaacatccgggattgagaacctgcaccagctgacctttgagggaccattcagtgctcacatttggccttctaggaagtactgtgctacatcactgaataagttggaaattatgtcagtaggactctgtttgttgggtttctaagagaataagaagtaaacgacacaatacgagaacatctatgatgcaatttgtccatttgtctatatgacagatatcgatgagcagtatgcataatggaagctggtagaaatcaatgaacacaaagtgcagattgcaatcttttctcaaccatgcctgcaactggtgactgtagttgtaagtgataaacatggtgggtaacatccattaatcactctctggcttacagaggctgtatgtattgggaggtgggggcagctccagtttgtaagaacctcagtctaagcagcttaaagacattgtgaccacatcttcagggtccagggtcccttctgaagcaaagttggagcccagatatcattaaagacatcatccttgttcagttcagttcagtttagtcgcttgtagtcgacactaattaacagggctccccagtgtctggctctgatgccagaaatgggcagaccttcaagggccatgtctaaactctgtgattttggccccggcagtctttttttccaagaggtttcttgggagaaattccatgcttccgactgctgatatccttggcatgtttctgttatcagcccatcatgcatccaggttgttgggctattcttttgattttttgtgagctgtcccactatccttcacacaaaatttcttctttatttaacaatttctatttcttgcagccaaaagaatcttaactactgtagcccccatccttaaatttcccaacccagggatcgaacctgggtctcctacattgcaagcagattctctaccatctgagcagccaggaaagcctttaaatagtaacaacttccacttattgaatatctgatattcatcaggtatttaactatactatta

SEQ ID NO: 26058 - DNA, 762 bp, Bovine  19866881283662
gcaaagaaaacagttgtctgtttttcttgaaggctgatgggaaaacttcaattctcatctataggaacctgatcccaccctctccaacccctcgtcttcccaggggcctctgaatttccctaaatccttcacaacagagttggttcccaaaggacagagggagatcttccccttttcactgtctgtcattcattttggatctttttctcattaccttccttccagttctaatttagtccctggtgcctctctcgtcctgaatgacagaaccagatgaaaatcagaaagagaggaactttctgcagaggtgagagtcaggtgctttggggatatctctctttcctctagggatgaggctgattttcctaaatctattattataagatgaacaaaaccatttcaagaatttataactctcataagacattccagatgggaaatactcctctgggacttggggtgagctggctcttttttggtaaaagcagagatgcatagctatcatactgagaaggtagcagataatgtagacccagtggagaaaaggaaaccttcctatgccaggaagcctgcaggggtggaaaaagcggtcctttcatggggtagagtgatgacgtaactaccatttagtgtaaccacaggtgttgtgctaagtgtttcacatgtcacccacaccaccactcacaatgtagctcctattattaggcccattttacacgtgaagaaatggaggcatggaaggcaatgtgcctaagaccatag

SEQ ID NO: 26059 - DNA, 1064 bp, Bovine  19866880461164
tatagtggttaggactccgtgcttccactgcagggactgtgggttcagtccctggtctgagaagtaagatcccacatgctgtgtgtagtgtggccaaaaaaaaaaaaaaagtttctggtcagagatgtctcctcttggcttcctaacaccactgctcatttgcctttcactgaacttagttaagtttccctatgcattatggttcggtattctaggtttgctgaagatagagtttgcattctgttatttgccatccatttttgttttgaggtgatttctaagagaaggtagaactatttttgctctgcctttctagcattggagagtgagccagagttcactccagttccatctaaacactttgaacatttcttggcaagtgcaattgcaaataattacacaaatgtatgatttgattttctcatttttaacaaaattggggctgtaggaaataaatttggcaggaaattatctggctcactctcctatgctaaaattggcttccaaaaatcaaattaatggcaggagctacaatcacaaaattgtagagttgaagattgatcctcaaaactattttctgattttaaactttatgaataagaaccaacattgcttagttcacttttctaaattaataggaatgtgaattaatagcaaatggaagatatttatctgcacagtattgtggtattaaaaaccaagttgtgtaatattggagtatccaaactttacaaatttctctgaggtgtagttgcactaaaaaaaaaaactattataccaaaattccatcaacattcaaaagtacctacatttgtgaagacctatttttcatcatgcaagtgaataaaattaaactcttaaaacactaaaattaaacacctaaaattaaactcttaatgaaaaaaaatctagactgattttttttttcttttggccacacctcaaggcatgcaagatcttggttccctgaccaaggatcaaacccatgccctctgtagtgaaagcatggagcctttctgctaaaccgtcaaggggtccctgaccccccaggatctaatgcctaa

SEQ ID NO: 26060 - DNA, 6659 bp, Bovine  19866880541860
agatgaggggttttaaatttatatcgcagagaatccggtaatcattcaccagagtgaaacccagttctttgatgttgaacaattcgaaacacagccaggagggctgctactgctgctgcctttgctgttactattactactactccacccttaccggcctagtgctactaaataatgtttatgaagtttttacagccagcaattgtgccatgcattttagagacgttaatcagttttaatcaccgcagcaacccagtggaggtatccacattagacaaattaggaaattgaggtttaaattgctaccaagtcacaggggttgtgcatgactggtctagacctgatttcaaaggtctttgtggtgataaattttcttctccaccactgccttaaacttcctttgcatgcatgtgtctgtgagtgagtgtgtgtgtgtgtgtgtgtgtgtgtgtgtgtatagggactaaaactctgtagggtaccaagacgtcacctccaaaccttgacaaagtaaatagagttccctgggggagaatttctcaaggccaaagagctgcctctggagtattccaaagcagcttccacatcctgaaaacagcaactacaatcaaagatagcaccttacgaacatacttcctttatttaaaaaaaaaaaaaaagctactaccaccaacagtccctcctaagatcagagatacacacacggatctggcaataagcccagacgtatcaaaacatgtattgtctagagccaagacctgaatcccactgtccgacagagagagaagcatttatagagacaactcattccccgaataggtacgctcccctgctgaagtgacagggagctggaagagcagcatacaacaaagagtagttacaagcaggcagccgaaggcccccagcacacccaccagagcaccagcccacgtcctgctcccttcagttcagccgggcagtactccggttgactctcgttaaaagtccacatttagtcagcttccagaatatgggcagaagctcctgtgagttatttcctccccatctctggaatcccttttggacatgaccaatgagttgcagctggtttttaggcagcgcggcatactcattaattggccgtcaggaacagcttacacccttcgatccacgatgaaatgaactcagatctggattcgccaaacacagattccaaacaggctgggaaagcaaaaaccacctatgaccgtctttataataatcgtaaaactgcaatgtgtacagtctacaaagaggcctgttcttcttctatctcctgtgaaaaggcttgacaaagacaaaagctttttatgcactagagtaggacaaacagggcaaagaaaactcttgtgcaactgatttcggagttaagagggcacttcttgccagcgctcagagacagagcgaaaagcacggggaagagtaaaatactcaaagccaactgattgctgttatagatccagtccctcttttcctttgttcacagtgaccctttccttgctcaggggtaagtctgatttgtcagagcttgtgggcaattccattcctctggcaggaggagagaagagcagtctgcttgggaccataggaaagagactgtctctcctcctggagacattgactttcctgcaagtgccaccaggagcagtcatactggtcttgtaactctgggggagatacactgagaacaaacataaggtggcagagcagaaggttagaaagaacctgatggcccaaggattttaccaactgaatttaacctgctaaattaaccagttctgaagaggcatcatctccaggctttctgttcatcatcataacatccttgggacttccctggtggtccagcggttaagacttcaccttccaatgcaggggacacgggttcaatccctgatcagggagctaggatcccccaagcctcagggccaagatagcaaagtgtaaaagcagaagaaatattgcaacaaatttaataaagactttaaaactggtgctcctcaaaaattttttttaatccttaaaaagacagttgagttaattcagcaggttaatcccctattgtattctaaagcatgtccctctcctccttttccttggatccgtgaaaaaaaaacctctctcatgtcaactaccttgtaggagccttgttggagggaagcattgtagtttaaccattgttttcctatgatgatatttctcagagtaccagccagaggaccatgttgcttatttacgaaacaggttactgaatctgtcctgaatctaggagtggagtcaggaatctgcatttctctagcattcttttatgagatctatgaaaggttattacccaccacctgaggaagagaagctagaagaggaggaggacctccttcaggcaaagagaaggcgtagaagtcagtcgaaaacctttgttgaaggtttactccatgcagaagacaggaagtatgctaggagctgagtcaggtgggtgggcaatttccctgggaattttccattggtggcgtgatctgcttagcgtttgcggatacacatctcaggttggagcatggatggtcaccatagctttgactagtaattgtgccttaatgtaaatatatataaatattatacatttatatgcggctttaaatggagtgttttaaatgactccttctgtatggcaatgtgtatttacatatatcatgggtaaaaaattcatgccacgggtggtcacattccaaagaaatgaacacatgcacaaaatcacccaccagtgaatgcagagaccatacaggacaggggattaaagggagatttcttgagcagaaagccacagggaggaggttcaagagagaagagacatacatatacctatggctgattcatgttgctgtatggcagaaacacaatattgaaagcaattatactccaattaaataaatgtaaatattaaaaagagaaagaaagccataaggaatgaggagagctgtttgatgatatagatgagaagctggatggaaggacctagcatctgatgagaaccaggcatctttattcttcctcacattttgctcacagacaataatacatgaagttgttaacaccatagagacaggaactgtgtctattatttcctatatcgtagacaccatggaatttatagctaatgtttttaacaccatcacataatagagcatgtgataaatggggtaaaaaagcaatttattagcatttatcacaggaatcttagctttcacagttctgcctgaaatttttttccataaacttttcaaagagaataaaggaaataaaagggtaaaggaaagtgtgtgtatatatacatatataggtatatatatttatgtacacacacacacacacacatatatatatatatatagcagggcaggatttcaacttttatagaaatctagtgaaaaacaagctgctatttatatttctaaaacatattgagacttttaacaaaacttttcagaactgaaagtagttttctgatactgacttctcctttaagaacattagaagccttcttttgaactaagatcttttaatattgttacattaaaattcagtttttcctcttgtttgaccatttttcttctcagtgaagtcatagccccagaaagctaggtctttatgatctttttaaatgtgtgctctttttatggatgatggttgcttatagcactaatttttaataagaaaagaagcacagaataagcagattgctgcagcagtgtgggatgatagaaagagcaaaagatctggaaccacgtgacctgccttacagttgtggcttcgttatgtactggctttgtaatcctttgtaagtcactgagtgtctttagggttctacttcctcatgtataaatctgaacaggggcacttttccgcagatggctgttgtggagtacatcagaaagtacacattaaatcactttgtaaaatgtattatttttgttattgttcctctgtgatcaaccaaaatagaaagtgcagcatcaaatcaccttaccctgaattgtaatgaaagaaagtttgattcagtgggtatgatcatgaagtaaagttcggagagacatttctggaatggtcaaaacaaatacatagtttttagaatgaatataccgatgctagggtcatccgttgtagagcagttgggctgagttaggtagtttagggggtcggttgcctgaaactcccttaagtttcaaatagagactttggagacaagcccaatgaaatgtgaggtttttctgaagaaggaagggagacattttaatttacagattctgaagaaaggaacattaatccagagaaaacctccagggaggatccaggaagaaggtattctctggaaagacgggtgtgctgggtacactctggaagtgtgagaatgtgaaagaaagagagctcacttctacaactgtttaaaacgttaaaggatttaagctaatgttcgggaatagttaacatttctcggactgaatatgaaacttcctccaaggaaaacaactcaactgctaaagtcagccccaggctaatgccaagaaaatactgctaaattagggttctaggagagatatgactcagttaagtatcgtagagctctcaacccataaactatccctttgtagtccttgagagcataagagattacaaataaatttactgactctttccttaaagaaaggaaatgcctaaaatcatgattcagctttttaaattcggtttccatgtgtaagtagtatagctgctgggaaatgctggctcctcaaatcattttgtaaaaccatttaaaaaaaattttattggagtgtggttgatttacaatgttgtgtcagtttctgctgtacagcaaagtgaatcagttatgcatagacatatatccagtgttttgtagattcttttcccatataggtcatcacagaatattgagaagagttccctgtgccacatagtaggtccttattagttacctattttatgtatagtagtggtaaaccatttttaaatgttttatcctacaatcccaacagatgttctcagtatcaaagaaggtttctgagtattgattctaaatctcgctcattaaaataaaagtaattagaactacttaaaagtcacatgatttctatcctatgctgctgctgctgctgctgcgtcacatctgtcgtgtccgactccgtgcgaccccacagacagcagcccaccaggctcctctgtccctgggattctccaggcgagaatactggagtgggttgccatttccttctccattctgtcctgtgcacatggacaaacacacaagaaaaggtattacatgtgatatgaaaaattgtgtctctagttcatcaagtccaaatccaatttcatgtaatcagactgaataatctgtcaaatgttaagaagacgttgtgtcttaagtagacattcaagtatgtctccaacagattgggagtattgattattgatcatctcctcgcgaggagtcagacatgactgagcaactaacacaaacacacaatagaatcctatagtatacagtttaatttccattatctcatagatgtctacgttatccattattgaacattagtcttgaactgtcaggataaagttgacattaactaaagtttgaatttagtccatagcatctacgcacatgtgtttgatttgtcaaaacccaacagcataatgtttcacatatttattcattctcctttgttgctgttagccatgtgtgcatttgcaaaatgaactagctttgtgaatggttatagagagaaaacaagaaatatgtaaagagaataaataaataatttgcatctttaaaaaatacgtagttagtgtttctgtctaaaaatattgtgtgatgaagaaatagatccgaaacaagagtaattcttttcccatgaagcaacactaaccttgcaatttttactcagctcctttgcgtaaggatgaattcttccccccaaatcttggagaattgtaaaaatggaaatgaaaagttgactcttgagacgatgtattcctttaccccacctgtgtgtaactgtctacttcagaatgctttatatccccaaagtgcagccatcttctctaagataacagtgcttgttaaatgctgcaacttaggagcataccaaagtatcatttaaaaattagtcataattttaacaacactcctgccattgctgcattttgttttgttttctgattttttaaaacttaattctaatctttacctttccaaactgaaagcaaagaaaatttacttctatctgtatttttttgtgatagagatgaatgatattttaactctacatcaagtcttcaaatttcttgtgttttcttttcttcagtgaacttacctctgctttctcatgttccccattagaagggaaaatagctcttctttcttataattatccttttttgtaatgtgatgaacatgcttctctatgtttgattgcattgaacataggagaaaattaacctaaaatgcacattatactcttaatatctatttcctcatttgtctcccagttagactctaggattcttgagactaggaaacatttcttatttattttgtacacccagtccccatcttgatgtatactttatca

SEQ ID NO: 26061 - DNA, 1444 bp, Bovine  19866880567251
ttgcattagtttcccaaatcccagttacttccggccgcctattattaatggtcaaaatcttttctttccacagttacatcagttttatcctgtcaccaaaacaaataactgctctttatgttttcaaatacatactctgcaaaggtctatttgggattgaacataaaatgcaagcaccttatgaataaaatagcatgaatcattgttaagaatttcaaaaagcttaaaatctacgcttgagcaccaactgaatacagacacacccaaatactttaataaacataagtgaaagtttttggtcattgaaatttaaccttaatttgactcttcggagaacagtctgtgttgctgttcttactctgaagactatgcattttacttcttgcagtgattgtataagtctgcatatatttttggcaaagagttcacttttctttacaaattttaaagaataaactttaactttacaaaggtgtttatacaatgagggcaaattcaaggagaccacttctacagcttctatatttaagcagcaaccacggaaatgttgctttgtaaaacataatataatgtcacttgtcccttggttttgttacttgagcacttcaaacttattaaaaatttgttttttcataaagtctcccagaaaatgtaagagaaaggaacatttcccaactaattttatgaggccagcattaattggcctcataaaatcagaaaagatgtcactggcaaactacaaatcaagattcctcatggatacaaagccaaaaattcttaacaaaaaattatggaagcaaactgtcagctctcatatgattagattctgaatcaatcctcaggcaataaaaagaaaaccaaatctatccctgaggtaaaaaggtactatttttttgttatcacctaccgctgttataaaaaatatttctccgttgcagagtcgagtaccactttcaaagtcatgcttatttttagcaaaaccaggagtaccaccattaaagtctttaccaccagcttttaattcattatttcgttgactgttgaaggtattttcagggagtaactctgagagatatgcattcttggtacaacaaattttatcaccaactccaaattcaagtctattctgatggtttctgggatagaaaattagaatacagtatgagagtttggaaaaccttaatttcattttctttatgcactgactcccactcagatctgatccagttctcaaaataatttccacagactctttacatcacttttggtctccaaaggtcaccaagaaatcaggaggctcccacagctgtggtctgattacctacactcactgaagcacctcaaactcaatgacatttcccagctgactttttcccaagccagaaattttggcataaaggctgaggtctgactttcccttcacattccaaaagttagcaaaact

SEQ ID NO: 26062 - DNA, 897 bp, Bovine  19866880570678
gatcggagaaggcaatggcaccccactccagtactcttgcttggaaaatcccatggacagaggagcctgttaggctgcggtccatggggtcgctaagagtcggacacgactgagcaacttcactttcacttttcactttcatgcattggagaaggaaatggcagcccactccagtgttcttgcctagagaatcccagggacgggggagcctggtgggctgccgtctatggggttgcacagagtcggacacgactgaagtgacttagcatagcatagcatagcatagcatacagaaaggataaagtgtatgaggactctttatactctcttctgaatttttctgtaaatttaaaactgttttaaacaataaggtctatttgaaattaaaaagaaaaaagacatgtagaccttggagtttgataacctacaacttccctctatgacttcctcagggtcacaaatattgctgtgttctttcagctgcatctcacagcctccctaaagtacagccacttctgccatgaaagaaccattcagtgagccatttcaaacacatagccctattttcctagtagtggaaatcaatgaagaccacccaaatgagaacaagcaaaggctatttattcaaagcaagggagtcagcccccatcgcttgcatttgaccgagaggcaaaggcaagcagagaagtggaagtactatagctcaaaaagagaaggcttcaggtatgccccgaatggaggctgttggcacggggaagctgcacacaggccactagaagtgggacattgtgtgtgataagggcttccctggtggctcagacggtaaagcgtatacctacaatgtgggagccccagggttcgatccctgggtcaaggaaggtcccctggagaaggaaa

SEQ ID NO: 26063 - DNA, 1209 bp, Bovine  19866880641206
ttttaagctagataagaaattaaaaatccttaacacagtcccctttgtattaaagataataaaatgtataatcagagaagataaattacttgttttaaagttgcattggctaggcagtgtggagggatgagagttagaaataggaggttgctgtttctgagatggctcagtggtgaagaatcctcctgccaatgcaagagacgcagcagatgtggattgatccttgggtcagaaagacccactggagtaggaaatggtaacccactccaggattcttccctggaaaatgccatggtcagtggagcctggtgggcttcagtccatggaggtcacaaaaaatctaatgcgactgagcatgctcgcacacacagactatacagagtgaagacctcattaatacttcctgggaaatgcttactttaatgtttaaggatttctcattagtgaagggaccaaggaatctaggtcccagggtttaagtttcttttaaaaaaattcactggtaaatcagcatccacttaaccttctggtagattgatcaccagatatatttttgagaaatgagaatggtcataaccagctctaattatctttatcacagggtgaaagataagatatgaaaagctctttgatagttcctagcatgattctttcacatcaagccactccataaacattaattgaaagaattccttcctgtctacgccattgcagcttgttttctgggtggtgtgcgttgtaggaagaccccacgtcataagagtatccttgtgaaaaacggacagacagcttaccaccattcacacgtattagacgctttgggcatccagctttcctaacactgtgcccccagagtggagagagtgaaagaaaaagagaggaattggaatcagaatcacgtgcatctgagcccctacctcagcagctccttctggtccctgagggtctccaggctcggagagttttgtgtagtgttggcccgagagacggttgtcctttggacagctcagctgtgtctgtctcctcaccgaaacagcatccgattttattcagatgtagcatttgccttccctccgtgacatccttgggttaatcacgtgcttgctggccaggatatgtaaataaaacttggctacaaaacacttaaaggattatgaagcaatcttgcttaatagtagtaaacaaaacaaaacaccactccagcaaatc

SEQ ID NO: 26064 - DNA, 1532 bp, Bovine  19866880659420
gcattgcacgtggattctttaccatctgagccaccacagaagcccagattcacataaaattacatgaaaaaaaaattttttttaactgaggatttgatatttttaactgagactctattttagcagtgtgttccttaccaaaagattttaaggaaactcataaatctgatagcatttaactgatctatactgatgtatggggaaaacgtttttctctctcaaggaacagtttgatttcttcttcccttcagatagggcagctgaaagatatccccaccagtgccatgttgatgcaactcactcagcaatatccgtgaactcagttagtaagaccatggtctttccagtctttgagacatttttaatgccctacagtgtctttctgttagaactggcctgacttggaggccacaactgaaagaaagccagatccaaaatgaatctctattttgtgtgtgagatgaaggggagggagattctggatccaaatacatgtgtatatatataggcttcccaggtggtgctagtggtaaagaacccacctgccaatgcagaagacataagagatgagggttcaatccctgggtcaggaagatcgcctgggggagggcatggccacccactctggtatttgtgcctagagaatcccatggacagaggagcctggcagtctacagcccatagggtcacaaagaattggacacaactgaagcagtttagcacagcatgacacacatgtgcgcacacacaaacacacacacacacacacacacgtatgtatttgggcttcccaaatggtgcaaagaatctgcccgcaggagattcaggttcaattcctgtggttgggaagatcccctagaaaagaaaatggcaacccactccagtattcttggctggagaatcccatggacaaggagggctacagtccataggattgcaaagagttggatatgactgagtgactgaacacaccacacacacaatgtatataaatggatatatacatatacatctggcaaggtcttaaccaagactgtgcttttggacagcagtttcacaggggctcccgacagtaccgaggccgagcaagaggagaacttctgggcccaagcgctggaggatctggaaacctgtggacaatccgggattctgagagaactcgaaggagcctcggtcctgccacttactctcattgtttctacattcattttttttggtccttttgagttggcattggtcacaccagttcatttaaaagctttaacccctttccacaggagaaagctgacaggcgtgtgtctttgagaaacatgaatctcttggtagctaccctttctgtttatatttttgcttgtgaagctgccttccctgcccccttgcctttcggacagtgatttgattttatccaatgcagttaaaagtatttctttcccctttctgcccccaccctgagcttactgacctgtggcttctctgccatcgctccttgctaaccctgactgcccctgtttgccaccggatcgctcaggcga

SEQ ID NO: 26065 - DNA, 1022 bp, Bovine  19866880701003
ccccactggggaataggagctcacattggaaagagctgggatcaggttcttgtggaggcttccagtggctgggccatgagaggtggttgagcagaggagtgctgtggtcagaggtcgttaggtgcccagtgttctggggaatgggttaacaggagggtggttagagggaaagagaattcttgaaaggctatgggtaggccaggtagcaaaagataagcaactgagctgatattctggcagaggaaacagagaacagaagtatgttagtaaaactgtgaaatcattggctgaatccttctctgtcacagattgtactctgggaggggaggaagaaaaacacatgaaggaagttttaagctggatggtgatctggggttagaaaatgggttcactgaacaccagagaaaatgggggtggaggggaagtacatttgtttgcctgggatgtggtggcaatggaagaggaaaaatatgtagcctgaagtgatgagtgaattagccagggaggcagcagcctagaggctggggatgcttcccaatttctcccaaagctcactgatgcagaagccagattgaagtatacatttccattcactgtgaacaccaagtgtacccagagaattaatagtgaaaactagacttggggagactcttaaatcttaaaggaacagatagttttctagaacccacttattagaaacaattgacttgctgattgcaatttattctcaactgtctcttctattcatgaaagagtttccttcaaaggattgacttagaaactttattagtgatgtttcaatgaccatatatccttaaaaggaatccagatgcatttctttacaaatagtcttcgattcagacattttaccagtttcagacccacctgatttctaatatgtttgaataaataaggctctgctgcaaagctaatctgtttcctgaggatttgagaaataacttggaaatcaattgtaaaccactgttttctgggaaaacccaatgctctgtagcctgattctc

SEQ ID NO: 26066 - DNA, 1158 bp, Bovine  19866880708534
caggctacagtccatagcgtcgcaaaaagttggacacaacttaagccacttagcacacacagagccatggatgaaattttaaaaaaaagtctaggggaaaagtgtacttttcaaaagagaaaatactcagatgcaaggaaaagaaggctaatgaccaatgatgaaaaccctagttccaaatactatttaggtatttatacttagacaaggttgtaatcacacaaggactgtattttgtcatcaatggaatctttaaggaaaataatttccttctgaaaaatcatgattgttgacctggagtggcagggagagggagggaagaaagtcagaagtggtagaattgttctttttcctgaaagtaaaagaataggcccaaggtggtttaacacatgtaactcaagcctctaggagctacactgaagatgtcaaggagcactgtgatatcttagtggggtgtctgtgggaggcaactggactgcatccaggcagacagtcccaaggagatgaaggagaatcaaactgggagggactgggatgtaccattaaaagtcctaaaaaatttaaaaaagtcctacaaagtaaagaaaaaaaggacactgggagaccatgtatagggcatcttttctgcctccactgggcacagacaatacagaaagggaaactggactcagaggtggatacacaaacaacctggaaagaatcttcaggattaagttaaatgaagacatttagcacgtgggagagactaaatggttcttttcgtcaccagacaacatggaactgaaatattagtccttagttgtatatggtttgcgttaccaaattctttggacacacaaaagtcatacaaactctttgtaaaatgcattttccaatgtgtacaaaactatacagaattattatgtaaactctggatataaactaaaacataaaattctacatgactctttcctgattccatcacttttcccagaggcagccagtgttaatagttctacatgcaccaaacacacacactcttttatttcatatgtgtgtgtgtgttctgcaattttttttacagaaattttaaaaatttatgtatttgtttcatttgtgggctgtgctgggtctgtgttgctgcaacgcaggcttcctttagttgttgagggggtgggg

SEQ ID NO: 26067 - DNA, 863 bp, Bovine  19866880764594
aattattctttggttcttcctattacaatttccacagcggagcggctttcaagcagctggctggatgttcgtcacattgaaaaatatgtagaccaaggtaaaagtggaacaagagaattgctttggtcctgggctcagaaaaacaagaccatcggtgaccttttacagatcctccaggagatggggcatcatcgagctatccatttaattgcaaattatggtaagcatttattcaaatgatattgctcttgattcattttatataaatcgtaacttgtaaatattgtattttatccaagacattgactagtcatgttgtatgtcagtgattacttacctacggcttttacctgaaggggagtttgcagcttcatatttttgtgacactttcttttcttattgcctaacttatacaacagattcctttccaccactttatagttgctttttaaaatttatttacaagttatacttcttaaaatgttcttacttagttaagagaatcagctctctttccaagaatctggaactgagtcataaacatgatcagaaccacaatatgagtaaaatgaaaataatgctgtaatttattttaccctataataacaaattaaaaataattgaatttcccctgtgtattttagggctttcttggtggctcagtgataaacaattctcctgccaatgcaggacacatgggtttgatccctgggtcgggaagctttcctggaggaggaaatggcaacccactctagtagtcttgcctggagaatcccatgggcagaggagcctggtgggctacagtccatggggttgcaaaaagttggacatgacttagcagctaaacaacagcaaccatctgt

SEQ ID NO: 26068 - DNA, 1289 bp, Bovine  19866880776462
ttaaattgttgccgaatctgagggggcgccctgagtgttgtggcagagaagtaaacattacctcatgattaggcctttatttttattttttccttgaaaacatcagaatgtaagataactgtaaaatgttgagccccattttgtccaaagttcacaaaagaagaatgcctgccattgccttttgtaagtctgttcctccacacctaataccagctgcagctggaagggcattttggtgaattccccatgtaaaataaaatattgggaacaacacacttcattaaggcaacagaataagagcgaaagcagagaaggctgaggaggaagcctgggggctagatgtccagagccctgcagaagagctaaccacaggtcaccagcagagcctggcaggggcgggggtggggaccttgtgcacagggccaggtgacctcctagaggatgttggggcttaaaacagaaacagccgggagctcacgtcccacccttgacactaatctgctgtgtgacaagggacaagctatttgttcagcctctccatgtctattctttatgtataaatgcggacttagaatatttgtaaaataattgacactctcaggggaaaattactgtattgctgtacaattaagatcagtgttgtaaaattaaactgatctggttctaattgcctcaaaggccgaagcccaggcatttgaaatggaaagaagcagagagggggttgacttagctgattggtatggaaacagttgggccaagagccagaaatttttctttgtagcaagatggctggttttactctaagaagcttggctcggctcggttgctgtataacattgagtctggtgggatggatgtcattgagcacagtaaggtttttatggctctgagcaatggtgatacgcactggtattgccgccaggtgtgaaggtacagtatatgactgatatatattgtgtttgtagccttagtgctaagcccaaagtatagcttttaaaaaataatattttgtaaatttttgaaagcttatgaaaactgacatctttccttatcagcaccaagaccaaaaataagaaacagaaaacacgtgacaatcttaaagaaatgaagagaaactaaaatgaaaagttgtgatcaatccaagtgtcagtgcggtcatgcccacatccttctgtgtctccacatgccacctggtgaggccctgacctcctgtgatcttcactgtcactcgggccacacctttgccattccaggcccatcgtgcttcttcctccctcggctcccagatg

SEQ ID NO: 26069 - DNA, 879 bp, Bovine  19866880794505
ggttggatctccttgcacagtaatgtttgataaaagaataaatgaatgaatgaaggatgaacttggatgaagttgacagagtttttaaactctcgtatcctggtacttccttagtggtccagtggttaagaatctgccttgcgatgcaagggacgcgggttcaatgcctggttggggaattaagatcccacatgctgtagaacaaggaagctcctgcgtcacaactgctgagcccgcgcaccacagcgaagtcccagtgcagccaaaaggaaaaaagaaaaaaacctcttctgtcatcttctagaaattatttcttcctctgtcccccattagattctctttgccacttcctcctcccttccctagccagtgctcctaaatcttcctgcagcatcaaaatacgtctatcctgtcacattcccacagggactccgccctcttctggccagtatgggaactgactccatttcaatggcgcttgaggatttattttccttctcaggtatttttatcttaatcagcaacctctggaacatcaagaccttgacgcaaaataaagaccccaaatccatttctatttaataatgggtataaattcaagtctgttatcaaattcgtgaatgatgaattcctaaatataaccatagcaaatgtcatctatcagttcaacacttatttattaactatctacactggctgtgaaacttagaactcttcaaggagcctcggacccaacagtggagaaagatactgtaagtaaattaatgaaactgtcccttctgtagatcatccccatctcatttcctccagggggaggaaggatgagccctgggttaaaattttcatcagctcctatacactacggcacgtgtatgtgtg

SEQ ID NO: 26070 - DNA, 1240 bp, Bovine  19866880845972
cctccctctttcaacttcaaggctcatataaactctacagtctttatcacaccaatgactcttatataaccccctgacatctttcacttttatggatgttagtcttaccttctcaactagactctagattaatggttacgtttcatgcctcattatttatctatataaaatatccgcttggctgggacagagattctgaataatacaggggtggaagataacaatgtaaggaaaactgggtccaaatcatggaaaaccttgaaagccatgttaaaagattgactttagcctttaggcagaggtcagagcatgttccaccgtgtccatcagaggaaaggcaagcatccttttctccgtagatcaccgttactagccaagtgcttaccaatcattcattacaaagaaaagccctgcagaaggaaaaacttaagggatactgtctctgattcttaacatcttgattttcattttccacagtttcctaaaagctattatgtgtgttaggtgagaagttaattaaatatcctgcacttgattatgcctctcttttttattggaatagattgaatctggtggtctccttgagatttctaagcagctgtgttccactcagttgaaataggtgatgatattactctggactaaattggaaaagcagtcatccagtagcatttgaaagaaactcacaaaagaataaaaaaatcaagtattacacttgtagaatcttttgtttaatgagctcttatcctgacaggcaaaaattttaagaagttagttaaaattaaatttagaaagtctgaaaataaatgatctttgtaaaactcctcttctatatgaaacaatgctataaaccaagagttgtgcctttggactcagagaacttaaatgagcaaaaactaaaggaatgtatttagtcataatttggtttttttttttttagtcaaacatttaggctgaaagaacaatgtctcatttttctgctgaaatgtagtatttctttgcctggactagcttaatacctatgtcaggagggagtcaatctacactattcatagattttgtaattacagattttccaatttgctacaatttatttgtaaccctaaaatcaatattcagagcattcggcagtcattcaccatcatagacagagtggcaaaaggtttgatttgttcaatacacatattcccagctgaggttaaacaggactatactctgcaccttctgttttggctccata

SEQ ID NO: 26071 - DNA, 2095 bp, Bovine  19866880854269
agtcaactcttcacatgaaagtggccaaagtattggaatttcagctttagcaccagttcttccaaagaacaccccaggactgatctccttcagaatggactgcttggatctccttgcagtccaaggccattcattcacaggaccacactgcatgtatttatccagtgcctgccctgagccaggcacctgtagtaactatgagtctacaactgtaaacaaaacaggtaggagccttctctggatggagttcgtagttctggaggaagtcagaatataaataggcgataaatagatacatgatagacagatggacaacagacagatagaaatggattagagagatgagtggatggatggatggatggatgcttgaatggatggattggatggatggaaggatagatggatagattgaatgaatagatggattggttggatatactggttgaatggatgtgtttaatgaatatattggatgtatatataaaggtggaacactgaagaattgatgcttttaaattgtggtgctggagaagactcctgagagtcacttggactgcaaggagatccaaccagtcaatcctaaaggaaatcaaccctgaatattcactggaaaggactgatgctgaagctccaatactttggtcacctgatgcaaacagctgacttgttggaaaagacccctgatgctggaaaagattgggggcaggaggagaaggaggtgacagaagataagatggtaggatggcatcactgactcaatgaatatgagttcgagcaaactctgggagatagtgaagaacagggaagcttggtatgctgcagtttatggggtcacaaagagtcggacatgactttgtaattgaacaacaatgattgggtatggcaacagagcatccactacaaaggccacagttagatgcagggactagaatggtctctggctgaaattatctaacaggtgagagtacagtattacccagcagccattatttgatctacttttgctttgtgttatcaacaagggagtcacaagtcagccagccaacaagcatttgtttaatatggaaagggtacaaaagagcctgaggggtgtgggtatgtgtgtgtgtgcatgcgcacgtgtattcagagagaaaataagtgataatatgataatagtagttcaattctaggagagtcagaggaaatttgtcatgaaaagccatgtcataatgtcaatcattacttcttaccaaagcgatgggagactagaaggactggttgcttctccagtgtacagtcttcacagtgatgatgtttgggaataaagctttcatgctgccgagaatcccacaggcctagaggtacagacattcagttcttgctaaggcaatcaagggaggtctgttgctcccagagctgacctgatgttcaccatattgggaaatgaaggccagtttcctctcttaagcatccttatctttccttaggatatccttgttccctcttccatctttctcaatagtgtacagagcctcccgtatgccagcttagaatgcaaagggggagccccttttcttacagctcttcttgctgagaaattctgcttcttgacttttcagtgctcttatgtggaaatgtgttacttacaatgcctgaaatatttggggtggaaggggtggaagcagggaaagtaataatattggcaacacatcataaatcctcagagacagggatgctgaaagtggcagaattaaggactttggaaagcacactgggtcagctgtgaagagggcactattgtgaaacactcgagggctgttttcttaatcctggtgtgcaatatggtacagagagcattcaggagttacactattagaccactgatttcacatgagtttagtatttcatgttaatcgttttgacatttccagacattggctaatattggtccccattctgtaacagcctatttccctcttctccacatgaaaggcaaagctgttgagtgttccatccccgttgggtctggatttttaccaattgtttgttttaagtgaagtagatttttaggtataaaggagaactaaattttctttctagccggtctttt

SEQ ID NO: 26072 - DNA, 3263 bp, Bovine  19866880868851
tagatctctaatccagtaaaattaattaaaaaaatagtgatgtgttaggtacatagtttttctcctccaaatttcattgaaacacatgtcttctagaacttaaaaattattaataaatgccatagttttcactgtaattctcgtaatagttatcagtctttatcactcttataaaacaatatgaactttattttcttaaagataacctacagagaactgaagcttttgcgatgtgaagcaaattggacgtcatttcgtcaatgcaagtctcttttccagttaatgacagatttggaaaagaatgcattaataatatattctcacctgaaacagatatgtagagagcaggggcacacgtgtgttgaagaagctgacttaacttttcaactgtcggacctcatgtcttttcacgatgcttggcagtctctgaagttcttgaaggatattggtgtggtgacgtatgagaagggctgtgtctttctttatgacctttaccaggctgagagaggcattgcctcttcagtctgtgacttgatgaccaggcctccatggcaattacaggttgatgtcaaaaaggtgcttgcgtctatttgcaccacaagacctgagaattcaggaagtggtgatacactgaataaaagtaaacctgatgaaataagattagaagatcttgtggatattttggacacgcaagacagcagtgaccatatttgggatgatggtgaaaaggaagtgaatgcagaaatgagtgagggtcaactggatcaggaccagatgactgctctggacatgatttgctccaatgctgtgacagtcataagtgggaaaggtggttgtgggaagaccacaattgttagccagctttttaagcacatagagttgttggaagaaaaagaagtgaaaaaagcttgcgaagattttgaacaagactggaatgtaccagaagaatggatcaccttcgccgagcaaagtcagcaggaactggacaaggctatagaagttttacttacggcacctacagggaaagcagctggcttactgagacagaaaactggttttaatgcttatacactatgtcaggtaaaacctcttacattttttctacacataaaacagttaaagatggacttaatggttttatttttcatttcttcccgacaacaattagtgggcatttattgaatgttttctagacccttaccttgtggtagctaatcatttagatcagagatgccccagcttccaggccatggactggtgcctcctatctgatcagctgcagcattcgattagaaataaagtgtgcggtaaatgtaatgcccttgagtcttgaatcatcttgaaaccatcacaccctcctcctgcccccatctgtccatgaaaaaattgtcttccacaaaaacagtccctcgtgccaaaaagggtggagacagctgatttaactcaatgcgactcaaaacagccagtctataaactgttactgtttacagggaaataggtgctcatgctatcactgtgctgcttccttctttaagacagtcttattatgataaaaaaaagtcaactaaagtgtatgcttaatgctgtagttcggagaaggcaatggcaccgcactccagtactcttgcctggaaaatcccatggaccgaggagcctggtgggctgaagtccatggggtcgctagagtcggacacgactgagcgacttcactttcacttttcactttcatgcagtggagaagcaaatggcaacccgctccagcgttcttgcctggagaatcccagggatgggggagcctggtgggctgccatctatggggtcacacagagtcggacacgactgaagcgacttagcagcagcagcaatgctgtagttagttttgattctggcatatggccctgttctcattgcgactggttacaaacatgtcagagtccacattctgtggaatgaaagctccgtgaaagtgaaaacttgggtcatctggtttagtgctttatcttcttctgcctacaacagtgcctggcaaatagtggttgcataataagcatttcaaatgaattaagatgcttaaaaaaaatagctgtggctgtagttgagagttatgaagtttcgaacttataaaagagttggagagtttcctttagctctgacctgccattttatagatcaaggaacttagtccttggaagatttctgaaggaaaaaataattggagtctaatggatggtgaagctcaggtaaaagaatgttttatttaagggaaaggccttcccagaggcattgaggaaaatcatcaagagggtgtagagattttgaggggactttgttgaaaggaatgaagtgtgtgtaaaataatggagattgcacttggtttagactgggaatttgagctttaaagtttgtattttcctgtttcataaagtcgttgacaaaggagtgaagtgggaaaatgatgttacctgcattttacagaagagccagtagaaatttgaggatgtcaaacagttggccccaaacttaaccaagggcagagctcgccctgggcttcatgtttgtaacctcccagcttgctgctctttccaccgtgccacgattcctttatttactacagactttgaacacctaacaaacaagcctggacttgattactggggagtcatttaggttcccaggcaaaagagtgaaatggagaaagcagctctgaggaaggctgcctagaatcatgggattccctggtggctcaggtggtaaagaatccacctgcaatgcaggagacccggttttgatccctgggtcgagaagatcccttcatagacccacgcgccatctcagaaattacttttgcgttacatttatcacatgagtgagcatagtgctagagaagttcaatgtagctcattggtgggggaatcttcttatcagtgtatgattttgtccattatgccttcatgtctggttagtctgaaggactgaattagaagaggagaggccagcgaaggatcattactgattttcatcttatgttccaactctgatcaattagtagtatcttaatattgggttggaatgctgggaggacatttctgaagctacatttaggctcaggagagccctgaggtggttgttatatcatttatttatcatttttgggctagggataccagcagataatgcagataattttttagtgacaatgagcatacacacacacacacactgcacatatatatatgcacatatatatataaacaacatagaaa

SEQ ID NO: 26073 - DNA, 1538 bp, Bovine  19866880877624
taaatacatatatatttaaaagtaaatgactttattaaaaaaaagtatttgttgaggcattctttcgggtcaaaatactgaacattctttgtatgaaggttagagttttatgttagacttgttacttgtcataacgtttttagtcttattaacccgttaattattagtcctaaaagaatgtattagtgttttctactatgattgtatgtttgtcagtttctccctgtagttttattggtttttacataatacattttgaagctatgctgttgggatcttataaattcactaatggataaaaaaagaagtaacagtagctgaaagagtggaatcacacacaacccattgtgggcataaatgtgagcaaacagtgagaatagccaaatggtagacaacagaggaagaattaatgaaaatacggcttatacccattaagcaactaggctttgggatttaaactataaatggttgtgtgaggaagctctttgctgtgagactgacaaagatggggacccaacttacggctgtttatctggtcttcccactggtgttgctcaggtcttccatcacgtgcctgagaatttagaagcagacactaacattatttgacaggaaaagaaggggagacaggagagcagttaggggtgtctgggagactgcgagctgtgaagttcggcggggaggcgaagatgctggcagcagatgtcgttagctgcagcagtctggtgtctgacagctcgctgtgcaaagccccctacagatgctgccccacttctcaaccttctcaggaggttttctcttgatcagtagacccccaggagactcccaaatcatgccatttcgcctttgcgtatgcttctccttttgcctggaaaagtcctcatcctcctctagaggacttgctgctcacacatcacttcctccataaagccccccttcccccagcatgccccaacgcaccccacgtggcagtgtggctgatctccaggcgcggtcgtatattgtgtgttgtcaaccaacatccacctcactatagctgtgatcagcggtttacctacctctgtcccactgtactctcaagtctagcttgtgttggattcctttatgttcaatgcacagcatagtgcctggcacattgaaagcccctaaattgtaccttaaaataatggaatacaaatgtaaacaaagccatttgtatttgcattttaatatcattgctttataggagagctcaagtacaatgaataaccctgtaggaaattctaaagctgaacgctgattggaagattaaaaaattaattttcaaatgtgaaagaatgacatagagggtcattatgaggcgcttcttgaaaaaagttttcttgggattcaaaaagttgaaatgtggggttcagcaaaattaaaaatgctgctgctgctaagtcgcttcagtagtgtccaaatctgtgcgaccccatagatggcagcccaccaggctcccccgtccctgggattctccaggcaagaacactggagtgggttgccatttccttctccaa

SEQ ID NO: 26074 - DNA, 1037 bp, Bovine  19866880885285
ttgatgtaacttgaatttctaatcctatttagatggtgtttcttgaacactttctttgtgttgcaggaaattttaactatggttttactatggtactcattcattctttacaagaaaaagatgtatatgatttaccaatgtatttatgttgttcacagactaaaatttctttagtttccttcttcctctttctcaatttttcagccttcccctaagttcacttcattttacagataagattccagtttctgagagaaagtgataaccccaactgaacttaaaatttgacttttcacttaattccatgatatataacaccctactaaagttcttaaagacctttcattggctaaaatgttccttgtcagtgaagttttacttgaaatgtaagactgaattgctatgtttctttttatcagcaaaatacctatcaatcatcttgattttatatgcacggctctactaaaactagaaatcatgattacacagcactaagtaaactgcacagagttttctttgataaaatgaaatataaattatacttcccttttctctgctaggcaaaacatttttctaggtcttgacttatgattattccccttgttcttttctgttgttgtcattaataattgaaattgctttaatacctgaagcatgtgcacttgaaaatcatattagtctaaggacacaaaaaacttactgtatctttaaacattaaaatgatcacttttcacacctggaggttattcaagtccccttcaagtgagcattttttttttttttttttctccatggggtaatatttcctactgaaaaatcttatacggattaagtatccagtagaattatcaataattgtgttaataatgttaatgaaagtgtacagttaaatgacagagacaattagttcacaccatttggtttatttatttagcagggagtattgtttaacatgtcagtcccgagaaacagaaacagccatgaagaggcttaacattactaataaaacaatcagtatcaaaatattttgtgtaaca

SEQ ID NO: 26075 - DNA, 1375 bp, Bovine  19866880905420
taataggttatagataatttttcccctgtttattttataatcttgaatcctatttatttaaatttatttatgactgtgctggatccttgctgctgggcaggcttttctctagttacagcaaggagggcttccttgtggtgcagtggcttctctcatcgcagtgggttctcttgttgcagagcacaggctcaatagttgtggcacatgggcctagttgctgggcgggatgtgggatcttctcaaaccagggctcgaacccatgtctcctgcattggcaggtggattcttgaccactgagccaccaggaaggcccaaaatgtccagttaggagtcattagcatataatggtggactagtttgaggagacaccacaggtagaagaggagaccttaagactttttttggttggatactcctaactttcagagatctggcagagaaggaggaactggcaaaggagactgaaaagaagtatgagtgagagagaagggagactgaagtggtggggaggggacgaaagcctgcctagagtggcttggtcagggactaggaggtgagggagtaacgggaaaagtagagccagggctctagaagaaggtttctatgaaaagaagcagagagagttatatgtggatggaggactcatggtcaaggaaagctttattggtttaattatttttggaggatcctggaatattaatggaatggttcaatggaaaacaagaaattcatgattgagagagaggggatcattgcaggaatggagtcctgaagtgggtgagatgcggacagtccagagcgtgagcagataggattgggaacaggggctccttcttccactgcacttgaagggaaggagtgcagtgtgttgttgggctgtgtggagggaagatgaagcagttcttgtcgggttgccttctcccgtcctttctctttccctcgcagagtccagctcagtttctggtttgttcctaaagtggttgggcggcacagtacgccccctgtgctgcacttggagccgctgtctgcttgactcttgaggacagcgtttgtatcacatgactgctcatcacatgataacactttaaaaatgcacagcgattaaaatgtaaactgagtatggcagggaagcctcttttaaaaaaaagaaatcagacctccagcgtattcttttaggttcatgctcaaagtcctacttgttcttgtagtgctccctccttgctttaagaattcctttgagaatcacttttagagacagtaaaagatccttttgaatgtttataagggaagcaaacttctactgagacctcttttggtttttagaaataatccaaaatcatttgtttcctagttttagaagttagacgatccaagt

SEQ ID NO: 26076 - DNA, 1139 bp, Bovine  19866880911493
tcataaaagcaatggacaagttaaatatacacttacttttgactttaatgctgaccagtaaggattctattggtaattattttcttgtatctaaaggggaagggagggctctctgatttatagttcacttagtaacactgctatcacaaagtcctgcaggtcagctggccatcagtatgatcagtgtcataaataatgacaaaagcttctgaaattgctgaaatatatgcccataatttcactttgatctctttttccttaagacatgaatgacaacatctactttaggcaccaccactcaaaaggaatataaaagactttgaggcgtttataatggaatgacccaccctgtgggcaggatttataagctatgctaatatggaaattctccatgagtatccagactcatattcccattcactggtgtgtgtccagtcttatgatgttggaatgcacttaagtttcccctcacatcccaaggtgcagtggacaatttccacactggctgtgatgctgttgactttgccctttctcatagtaacctttatttttaactatgaagactgttcgtggggctcaggtctttgatgagagagggggagggttgagctttgggggtataacagagatatgggtgctagttcagaaatcaagaaactggatgttaatacacaactgagtaaaatttactaagcacctagtttaagctaggcgctattctaaacatcacactaggtaaactcttcctgcattcttatagctcatcatctctagtagactttcccaaggcttcaaagaattaagaaggtgctggaaggaagagaaaagattagtacctaatgaaagaaaggatttttgatgttgcctttcttatcctttgactaaaggaattgcaaaggttgccacacgaatagatcaacagcaaaaccacacttttaaactactaattgctctacacaggatacaggtgtttctaacaaagtctttagactactagaaacagttatcaccctagaagactaataggtccagctttgttgacaaaccgttagaactattaccaggtgtttagtgctgtctttgagttgagcagctctaaccctagcagactcaggaaagtgttaatagctcccttccca

SEQ ID NO: 26077 - DNA, 1370 bp, Bovine  19866880940558
tgaacactcttaaagagaaaggacatgctctctgtggtgaagaaacaggagaactttcagtcgtcccactaggcccgtgttttcccggctctgcagcactcttgtaaatttgtaaatttgccacagctcacttgtaaatttgccagggtggcagggacacatgactcttagctgggaggcctgccagccatcagaagcccccaactcttaggagggagtcgggggcgggtgcccagagaccaccctgggttatatttatttggggggatacttgctggttctgatagcaaatctccctagacagatgcagcccacattggaatgtctcggacagaattccaccaactccccagtatcagacctagcaccttataaaataaatctttacactataccaaaggtaaggacagacgtccctatgtagcccgagatgtcacctgatctttcaggttcttctgcgcctgagtccatctcagcagaaaccccttgtgtattctccataggcagaaacccgtaattcttactcgttttatcgattctccctctgttcacaaacctccctttattcctcctcgttcctggttacctcattgtcccttggcctccaaagaatcatctcacacccgcaagccagacagattaatgtctctatttcccaaggtgtgtgtttggtctgactccagctgaccactgggattctgaagccacgatcctaccctgaggggaagcgccttcccttttcataccaaatgtatgcatattcctgattctcagtttcagcctgaaaaaaaaaaatgtaacttctcaaacatttctgagaggaaacttaacactctcttatcatacacaaacctcccttgaacctttgaaccctgaaagaaagacaggccctcttagcagtctggaatgattcacattatggtctaattttgaatcagtatctctcaacttgggcgatttaaccagggggggttgctgaactcaggcactgatgagatgagctggcctgctcatccccgctgaactcaccacctaggatctgcccttacaggaactcagaagcatgcccttcgcatcgatgcctggaagacgggcctagggacgcagggacctcaagaagtgctacgtcctcttgaagaaaggaggggagaaagagaaaaccttctagaacagtctactagcacaacttttactttagagatgcccctccaactatcatagttttattggcttatttcgccacagtttttgaagaagcagagttatgtgcttcttgcttacaaaaaaattacttttggtcattatagtttttaagaattcagtatagttttcagagagaaagttgaatgaacatattctatgttagtttt

SEQ ID NO: 26078 - DNA, 2523 bp, Bovine  19866880968169
taaagctctttgtatgtatttttaaaaattacatgtatatgtgaaggtatgttattttatatcaggttaatggttctcaatttagctgcatatccaaatcaactgggaagctttaaaaatacagattcctgggctcctatctccatatttttttgaatgagcatctttaggtcagtctaagggatctgtaagagagactttttaaggtattttaagagagcttccctaggtagttctagtatttgagaactatggattgggttcactattccctgaccccttccaatctttcacatactaaggttgaaataaaaaataatcagagatttgtccaaggtcacaaagtagttagtggcaaatcttggcctaaagtcagttctcttctttttaaaaaaaatttttatttatttacttgtttatcatttttggctgcactgggtcttcatttctgcccttgggctttctctagtttcagcaagcaggggctactctctagtcgcggtgctcaggtttctcactgtggtggcttctcttgttgcagagcataggctctagagtgtgcaggcttcaatagttgtggtacacaggcttagttgccccgcagcatgttatgtcttcttggaccagggatcaaacccgtttccccctcattggccggcagactcctaaccactggaccagcaagacactccagatctcttgatgttgaattcagttcagtggcttttctactttgctttaagtcacttaatttagttattaacatgaagaattttagctaatctttaattccttctcatttcaaattctataaagacaatgtgttagttgctaagttgtgtccgactctttgcaaccccatggactgtagaccctatctatgcgattctccaggcaagaatactggagtgggttgccattcccttctccaggggatcttcccaacttagggataaaatccaggtctcccacattagttaaacttatttcatgaaaaaagagaatattccttaataggtagacagaaaaaaaggttaaaggagaggttattgagacttcattcagtgtgtgtttgtttcttggttattcaggtcctaaatattcttgaaagtactcaagccagcttgtattttgcggaagatcctcccacatccctcaagtccttcaggagtccttctcctctgttcttcgataatgttccgagcattccagtggaagatgacgaaaaccagaataatccatcgccgcctcatgatcaaagtttgagaaaagatagaatgactcagaagactccctttgaatgcagccagtctgaggtcacattcctgggctttgacaaaaagacgggtagtagggggaatgaggactcttccagtaggtccgggtctccttgtgaggaaagctggtctccaaagtgtgcaactccatccctggacttgagggcccccagtgtgcatacagacacttctgcagaagctccaggccattcctataggagcaggccagtggagactagctgttcctccatattttcatggaatgaatgcaaactgtacaaaaaggcatcggtttctgatgaggataaagaagaaagcaagaattgctgaggcactgagtaaggtctcatctggggaagccactgtcttcatcagtagtgctggaggataagggatgatacatttggctgatgcccatcaacagtgtgaccaatcccattccattccttcccttccaacttgtagaacagagtggcttaaaagtttgttttagtaggatcattgcctcatgatccagcctgggctaaattaaaaccattcagaattgtttaagattgtggactctgacttcagacagagcagtcaaaacctactagaaaggatctggattacagtgtcttctctgtcacatccatgtgagtccttagagcctccaatctgcttccaagtatgttcagttcagttgggttccattgttttggtttagcctgcctgcagaggttgcaggaaatgtctgatttgtaaatgttaatagaaatctttttaaagaattgcctttttgcttatttcgattgactcttagtatgtttcttttatccctgtcaagtctgcatatgtgaaaatgagccagtttcacccttggtcacttacactgcccaagatctgtatttctgtatttaaatcttagattatttcatataatatagttgttatatgactagtattataattttttacatacttagagactattatatcctgagtagatgatgaaattttaatcaaataattcttgttcctaagaaactggctggtcataaaagcctcagtcagctttttgtttgattccaactctatgcctttactcctagtgtttaccagatctctcccttttgaaattctagccagtctttcagggcccaccataattgcctcctccaggaagctttcctaatctttccagccaatattacttactttatcagcatttccatagcaatttctctttttttttcccatttgtaaa

SEQ ID NO: 26079 - DNA, 1210 bp, Bovine  19866881001719
ttttctgaagaaagggtcttaaaatgttaacaggcctctgggccagaagatgatgcaaatcacctaaacttttgcatatgataagtttgcaggaagaaagcctggcttattgcatgactctaccccttcccccattattctctatgcataacttaaggtataaaaactactttggaaaataaagtgcgggccttgttcaccgaaacttggtctccccatgtcattctttctctcaccttcaggcagaattattcagcctcttttctccaaagaatttcctcactgagctatctttatttcagcctcttttcttcactgaattttcctactgagctatccttattctattactctttatatccttaattaatgtttaattaagcagttgtttcctgatcctcgccgacgctgtcccctcttcgaattccctggatccaccggggctggaccccggcagtatatgaattattttttgtgacagttacatcgttaaaagcagagtcatacataaaagaaacgtacagtataatgatttccttgaaaactcctacaatgttagattcagaggcaccttcagactatttgattgggggaaactacttgctgagctattttaataggtaataaatccagagaagcagcttgtatatattattaatactttgttcacttgcatttgagtttaaaataagccccaaggaaaacaatgaaatgtatatacaactattagttttcttacttcatgatataattatatcaagataatgaatttaactgctttaacataggtatattacccatttttgttcactttaatgtttctcttgaaatagcatccctctcctacattttgttttcttactcaaattagatattaacctaaggtcaaagcaggaaagagaaaccactgagatgaatgtcttcactaaaatatcaataaatttgttaagctctaataaataaattaattaaattaaatataaatgaatgtgagtcacccttcaggttgactggccagcccagttgaaaatataagaatttaaagaaaaaacattcaaaagttgccaaggtaaccagttagtttgtttataatagaaaacagtgatagggcaaccacatgagatcacatttacaaaggtcatatcaaatttgtctagacattagcaaagccagaatcaactcttgtttctgtgggaagtccaagtaatgg

SEQ ID NO: 26080 - DNA, 683 bp, Bovine  19866881047501
ctggttgatgctgacacggctcacatgactggcgggaacactacttaagtgttcggtgtttgctctctatttatcaatagggagatatttctctgagaaaagcgtatcctttgtcttctgatgaaaagtttgtccttccaatggggaatgatctagaaagcaaacaaactgatcattcatttcccatgtatgagtcccatgtgtaagttttcattttaaaggtttgaatccaaatataagaaatgaactgtggccctagaaataccagatacttaacttctttcccatagcaatatgatttttaatagctgaatatgccatctctccttgagcaggttgcttttatcaccagtttaaagtatacgttattgttataaatactattaattatttgaagataatatcaccctggaaataatttttaacgtcctcagtctcaaggtataaaataatgcattgctgggtttagtatgttcttttaggcaaagtgctttcctatgtggctacatggacctagcttgagcctgcagactctgggagacagaaaagtggaaaatcagacactaataaagtatagagaagggtcttctgattttctaacattatgttggataatataaaaaatgtaatttttttatacctctacctaaaattaaaaactcccaagcgctccttatgctcct

SEQ ID NO: 26081 - DNA, 1103 bp, Bovine  19866881085511
atgaatcccggaaaatgtttatgcacaagaacagatggtttaatatctcaacacatcattgaaagaaaaagcaaacacatataccaataccttacccactgagttagtccacagtaaatgttaatgggacttcatccaatcattattcttagcttctagcaaagaatgcaaaacattctgttcactataattaattcatgatttaaacctctactcaacgatctgctataatttcaccagagaaatataaacactcagcagttttactcatgttatatttcagaacagcaaattgttctgggcatagagcacaaaaacaaaaactttgaccagtaaatacagctttcctaccatctgccaatgaatttatacagtattttcccaagctttagtgaccgtcaaagagcatttgatatttcctttggtttttaaaaaaattcatggtccactgaaatgggctaaaacaaaataatagtacaggcaacaaaaatacatcaaattcatctctgtcatccttctaacagaggaaaataacactgacctctggacaaacccacacagcttggcagagaggtttgaaacttcaaatgatctacaaacatgtattggagaaggcaatggcaaatccagtactcttgcctggcaaatcccatggacagaggagcctggtaggctgcagtccatggggtctctaagagtcggacatgactaagcgacttcactttcacttttcactttcatgcattggagaaggaaatggcaacccactccagtgttcttgcctggagaatcccagggacaggggagccagggggctgccgtctatggggtcgcacagagtcagacacgactgaagcgacttagcagcagcagcagcagcagacatgtatggaggccatttcatgtttactaccttcttctgtttctcttttaatcaagttccaacttgaggtttgaaaggttcatcagggtggatgtccactggagtgatgaaactgaacccagaagtgggcccaaatctgtaagagcccctgacacggtcactaccatgcttaccatgcatgtttaaaggggccagggatttggggctttgagggctcagt

SEQ ID NO: 26082 - DNA, 1222 bp, Bovine  19866881099757
accccgctgcaattttatttggattatttttcggaggtggggggcaattagcagagtttgagaaagctgggtggcgggtgggaaacaagggcggggggaagggcagtgacttcctgggaggtgtaaaacaggatcctaacgcggtgtaaagtgtcgctcgggcagagcgggaaaactctggggcctctagattggcttgtttcctttgatgatttcaaaaaggtacaacaaacgcaatggcaagcaaacattgttcggtttccccaccttgctctaggtagctttgggactccaggattattttctactcggcctatttgccctgaaagaagcgctttaaagctaaagaacgcagaagtagttttaaagcccgcggaagcggagtttaaatgttctcaatagacaagtcccgctcgagccctacccgcgaaggcttggaaattgccgcgaacaaaacccctccgccctgggcgctgcgcgcagctctgcaagcgcctgctgcacgcttaattggttgcatccgcagacaaaaccctccactcggcggggtcccgggcgcccctcgatcgtcccctcccagaccccagccactcgttctggaagggtacatttaatgtctgtagcgctgaggcgcgggatccggaggcaaaagggggactgggcgcctggcgaggaagtgaccctagctaccgtgcaccctcttggacactactttccactgcgcccttagccaaactagttaatcttgtcccgtggggacgcaggatctcctgcagcccctttcctgggacaccctcagcagcggcggccgcaaatcggacgccgcgccgcatttaaagagccctaacagaaccgggcgggcccacgagttctttgtcgggagggcgcgagtctcaggccaccgagaacttggggagggcgccaagggggcggctgcggcgcgccagttcccggccagcgagcagcccgggttggcgggagaaagagcctccgggtccccaagacttcagcccctccaaccctgaaccgccagaggacccctgcctcctgggccactgtgaagcgactaggaaagtgcttgtcgagtcccggtttgtcggacccggccgtttcccgtcaccaggagacaacgcgccactcgggccgggcacaatagcgaaagtccgaggacgcttcgcccgaccccacctcctgctcgcacccggccggccgccgctgctcc

SEQ ID NO: 26083 - DNA, 1159 bp, Bovine  19866881106021
tcccatctttagcagaaatgtctcagatgtcattcattcgttagattctgaacatcccatcagtatggcctcatgtcaaacacgccagttagtacagagatgtaaaatccatgctttttatactcaaggcttaaaatcaagtggagaagataagaacctagttgtattaatctagttgtacaatacaagacagtttaaaggcacattaaatcctttctgctctaagcaaagtgttagtaggaagggagtcatgtaaacaaataaataacccatttgcagcactggattaatgcttcacagggagtataaacagagagccccgggagttcagaggagggcaagatggtttccagcagggctttcctgcttccatcccctccacgcagccccaccagatcaatcttcctgcagcaacgctttgatcatgccactgctgttctcagaaacctcctgtgaccctccattacctggcctatttccccatctgctgtagaaattactgtggaggtcattgtgatagggttgaaagcaccccggagttgttccaaacctgggtgtgaaacctacttctgtcacttctcagctaggtgaccttgagtaacccacacagctttcccagattcagcttctttgttagtcagctgttgatactgcccatctaatgggtttgatataagaattaaatgagataatatgggtgaaaattctttgttaactatcaagtgttttgtgagtccaagatatatacgtctatgtgatatacagatttacaaaagctctggataatcatgtatttataaatatggctaggacttctgtgtgctataggggcttccctggtggctcagatggtaaagaatcttcctgcaatgcaggagacctgtattcattccctgggttggaaaaatcccctggagaagggaaaggctacccactccagtattctggagaattacatggacacagaagcctggcagtctacagtctatagggttgcaaagagttggacatgactgagtgactgacactctatgctatctgtgcctataaggaaactttgatgtttggttttgactctgaagggttgatggcatttttgagaatggcatgaaagtacatatagagattggaaggcacataatgtgtttggggaacagaa

SEQ ID NO: 26084 - DNA, 1700 bp, Bovine  19866881108897
cagttttgtgggtttggggtttcctactaaattttcagtgcctcatgtttcctatgactgatggatggatcatcacctgactcatagaatcttttgctatggatcaccatagtgtagcttttcaaattcagtaatgtggcacccagatgctcagagttttaatatggagggagaaacactgggaatatgcaatcagtgctttgaaatggacttaactgagatcacttctttccagcctttggcaggattacaattaaactggtctagactcatttctgattcttatttttaaaagacctacaatgcccactttttcgtctaagtaaagtagacatcttagtccattgaggttgctgtaacaaaataccatagactgggaagcttgtaaacagaaattcatttctcagagttctggaggctgacaagcccaagatgaaggcaccagcagattcaatgtctggtgagaatctgcttcttggttcataaatacccaccttcttcctataacaccatgtggcggggtgagagagctcatttggggctcttttataaggacactcatactatttgtgagggctccacactcatgacctaatcacctcctgagagccccaccttcaaataccatccaatcactgggattagatttcaacatataaatttggaggacacaaatattcagacaatagcagtcaggatacaataacatctgagggttttttcccccagattaaggtcatgccaccatcctcaacttcagtattcctaaaggcaaatctttatttattcattcattcaatgaatatttattggataaataagtgtgtccacttattgagacagagagaggaattaagatgaggcccctgacctcaagaagcttaaagatgaggggtgggaaacatacaattaaatatggcacgtgccatgacaggcaaggtcacggagtacaccaaacgggtaaatgacagacctacaaaaaggcatgtctggaggcaagatgtcagggcagaagatggctatgaaaaggtcagttaagcttgagaaaaatgcagattgtgagcagtactacggaacgtgtaaggtatgcaatcagggagagaagccaggagctggatcttaaagagctccatgacgactttctacggtgcccaggaggagccctgaaaggtttcagcagaggggtgacaggagactgtatgcagaggtgcttaggagagattagatgagggcaaaggaaggttgtaggtaagcagattcgttaggagccttatcttgataacccaaagggaaagggcattgagccggaatgaaaataagctcagtgggaacagagagtaagtaaaggaactagaagagggacttccctggtgggaagtctagtggttaagaattcgccttgtagaggatgcaggttcgagccctagtcaggtaactaagatacgacgtgcagcagactacaaagcccatgtcctgcaactactgaagtgcccccaacaaaagatctcaaatattgcaagtaagacccgaagcagccaaacaaacaaaaaaatttttaaaaaggaaatagaagaggcagagcctggggatggactctgggctgtggctcagggtcccgatgatcagactcttgttgttggagcccaatcccctgccccaccccaagggcacaatccttggtccttttcttttttctctag

SEQ ID NO: 26085 - DNA, 1659 bp, Bovine  19866881109693
attataattaattccctctacactttcatgtagatattacagacagcctaaaccctaattacttatagctgcctatagttacacatggactgaggtgacaattatgtatcaaactcaccagggaccctttgtggtgtctttaatatagctgctgaatatcatcaagtttaagaatagcttataaataatactaaattacattttaaatctacttatagttagggaaaataatttaaattgcagcttataagcctgctaatctagaggtttgatgtcatatgttgttcatcaattcagaaagtagaatttctgctgtttgcctcagtaggcacatgcagagctgttctggcttcttagaacctatttaggtatctgttagtcaatccttttgccaggtgaaactaggcatttcgtgtttatttgtatttcttcattttggccttagaaaggagcccatcacacaattgatttactgatggaaaatatttggcaaaagttttagagagtggagctaaggctcaagaatacatggcaataataaagatgttaaccttgtgtatgaaatgctccatccagatgttgctttgtgaagcagctagtgcttctggaggaaaagaagcaaggacaagataataaagaataaatcagtgggaaccagggatgtttttaggtgttttgttttcagagtatctttatgagaaaggaaattaacaacgggagggaaatactccccaatatgaattaatggtttgtaaagggaaaaaaaaaatcattctggagatactgaaattgacctagaaattgacccaagtaccagatgctgaagcttaacttcaattggtcactagaaagttactaacaaaccccagctgttttctcagattgctgattctcttcttttggtaatggggtgtgcggtatgttgatttaaaaatatgcatttccattccatctcttttgagagacagttgtctttcttttataaaagaacttgtaatcacgagaaagtgatgtaatttcatttgttagtcaaacattctagataggtggcaagagcttttgtttttctgagtttgtagaaatctagaaacttaaattatgattttaaaatcaagtgggaggaactaaatcagagtaaaacctattacaactagactgattgaaactctttgggtttcttctaaatattccaagcattgatgtattgaagaacctggaaatctactgttgaaaacattgggttttcatttccattattttttccctccagatgtttcttacttttttttaaacttttagccacttgtaatttaatacttgcttgtttaaactgaaaatatttcttctatgattagaaagaaatatccaataatgcatattgcaaataattgtaacattttactgagggaaagaaatgactttgatagaacatcaaaaaccatctattaatggagtacgtgaagataaaaccatttttcatttgaacatgtaaaaacaacatgctttaaaaacctagagatgcttcctctaaaacacatgagtttttgacatatgctcaataattataatacaaattttctgatgcttataaggtgttcagtattggtaaactatattttctgaaactaccttctttgcagtatttgtaataaaatggag

SEQ ID NO: 26086 - DNA, 1068 bp, Bovine  19866881137809
tcttgcctggagaattccatactgaatttttcaagacttagtacaaaaaatatagaatatctcagtaataatttatttagatagattatatgttgaagtagtactttgctacattgggttaattattaagattaatttttttagaaaaaggaatttgaattttaccccagaagccaatgggaagccattaaaagataaaagagcagaggaatgaggccatagtattttgtcagtgaccagtgcttgcaatcacttactgaagcattaaagatgcatttaagagagtccgaattaactctgtttctagctcaggctgggggaagcagtagaacataatgactaagaacactagactgacttcacaagtgacaagctggcgaacttgggaaaattaatttctctgagtattagtgtcctcatccataacatctattgaatgtctcctacacaagactgttttagggatcaaaggaggcgatatatttaagcactcaataatgtatggcactaagtaaggcccagtgaatgctgactaccaacagccattattaggatgttttaaaaattaattttagctttattttactatagccaaactttttgaaacacttgggagtatagtggttcccctccctatattctgtggctgctctgcctagaggagcttttgcatttgtcatctttcactactacagagaataaatcaagtagagtcgatgatgggtgggcttcccaggtggtggagtggtaaagaatctgcctgccaatacaggagacccaagagatacctgagttctatccctgagtcgggaagacccccagaaataggaaatggcaacccactccagtattcttgcctagaaaatcttatggacagaggagcctggcaagatatagtcaatgaggtcacaaagaggcagacacaactgagcgatggaacacacacagagccagtgggtgcttttctgggtctgagcattaaaacaacggctgttacctaattaccaagacctcaaagatgcaataacccccttgaaagaaaacctatagccttgtctgcatctagat

SEQ ID NO: 26087 - DNA, 678 bp, Bovine  19866881159127
tgcatggaggttacttatttttcacatagctactggattaagctgtaagaactctatactcaagggtctaagattaatagtacacgtgggagaaacaaatgctccttactgctttcctggatggctttgttttggagagatcattgttggctgacaccttccccataatagttgaccatgacctcacattttgagaaaaacgactttcttatatctcgcacaatggtcttcaaaaatctccacctgttatttctttgctaaaccatacaactgtgaaatgatgggggtaagcacaaaactagaggcttaaaaacagcacaatttagtctcacccatttcagctcaagctccaatgctctggccacccgatgtgaaaaagtgactcattggcaaagaccccgatgctgggaaagattgaaggcaggaggagaaggggacaacagaggatgagatggttggatggcatcaccgactcaatggacatgagtttgagcaagctcctgaagtcggtgatggacagggaagcctggcttgggcagtccatggagtcacagagtcgaatacaactgagcaactgaactgaagtccaaaatgggtgatcaggactgatttcctttgggagactcgaggggacagctcatttcttacacatcactccaacctttgtctccaacatca

SEQ ID NO: 26088 - DNA, 1180 bp, Bovine  19866881176510
tcagacacgattgagcgacttcactttcacttttcactttatgcattggagaaggaaatggcaacccactccagtgttcttgcctggagaatcccagggacgggggagcctggtgggctgccgtctatgggctcgcacggagtcggacacaactgaagtgacttagcagcataatagagaagtgatggaaattttgctctacacagagatatgtgcacatacactcaacagatgaggtattactatatctttttgcactgctaaaatggtcacttgaattaaaactcatcaattttaattttttttacaaaaacagtagcaattgaaactgttgttgtgtgtgtgtcactaagttgtgtccaaccctttgcggctccgtggactgtagcccgccagactcctttgcccacggaattttccaggcaagaatactggagtgagatgccgtttcctactccgggggaatcttcttgacccaggaatccaaacccgtgtttccaatgtctcctgcattggcagaaagattctttactaccagtgccaccttatatcttattgtgctgctaaaatgatcaaaacacatcattgtttttttttttacagagacttagtaagttgaaacttttaacaagcctaataataaaggccaaaagcatcaagtatttatcaattctaatgaaaagttaagctttcactgattatacgatggacttttcttagtttgtttatctaataaccttttgaaaaccagagacttctttaaattatagataatgattttaaatcttcttaattgcaggcaaaaagcaacaccaacaaaaaaggaggaactctatctacttgttttaatcagaaagtgtgtgtgttgggggaggatttcttctaaaatgaattgctaatgaaaactccaaacagataatgagccaggagacctttagttagttcttgaagttgaaatttttatacttaaaatggagaagaaagagtaaaaatttagtcctccaaaggatgcttagaggataatatcattcaaaaagttggtgccaacaacaatttatacacagcatgaagagcaacaaattctgcttctgtggtttatatctggagagcaaaacaagtcaaaaggaaaaattccaaagaaggttcaaatttattctccaacctcagagcctagttcagg

SEQ ID NO: 26089 - DNA, 754 bp, Bovine  19866881218855
tggtcgccgagagcccggttcctgttggcctgcacactgactgttctggcaggcagaaataggtgctttcctgtgtccattgggtaagcatatgtattttcactggtgcatcttagctgctgatgcctgaaaatttggcctcaattgtttatagaaaggaaaagcaatctgagctgtcagccttgatattacctaaacctgcataaaatgtggaaaaataatgcaagatttgttttttaggcctgtttcatattttccaggcaatagatcaaatcagttcagggttcatttttagttctttaataagctgacacagtatgttggcagtaaaataagaatgcacttttaacatggaagtgccatagagtcgaagttgctatttgtgctgtttattaataatagcgagccctcgagaatggagcttagtgctttcagtggggaaactgagattctagtcctttccgttgtaataagcaccgtccttcacttctctctcatcgtctccatttggtatggagggacagaaaaccccattcccttgtcaagcccttctttctttccctgcagtttataagtgttttatacaccaaatgagcacagtgaaaagaattaataaatcgtctctatgcctcttctcgcatattcttccctaaatcttgactcctccatctgctggaaatgttctcccctagatctgcttcttcacttcctccaggttcttatcccagagttgccctgggagaactgccgttga

SEQ ID NO: 26090 - DNA, 1563 bp, Bovine  19866881268063
gtgctaaacaagccgaggatagacccaagacctgaccccagcccgaggctcttctcaccacggactcagcagcagggtcgccaaaggccaaatccaattcagtaaacacagacttctgggaagcaagtgcgcttgctttccttcggtgtcagctggaggttgcatttgccttgagcactaaaacattctgcagagaggccaagtgcagaaatctgtgtctgagattttctacttttacaagaagaatgaccatgtggggcgctcagccaaggtcaacctagaattggaaggctgagcccaggctcagcagagccagagccaaggtggaaagctccaggcgctgggagggcagggacggggcggctagagtaaagggccaagtgtgggaatgtttattgaaaagaacgtgctggggagaacccagccctcacacctcggggactggggagctggccgtctggagcggagagccctgccagataagttcagccatttccacttcataaagttcgtggtacaaaaatgaatggcaaacccagctatgaatgtgatttctgaaaggagattattgaaaagatagtttcagtttttcagatttctcttctggtggtcaggagcagggaagtagggagaaaatttccaagacacttgcagacatccccgtcccattccagaaaccacgatgtcctcactgcaggacgagggggcactacatcttccaaggtttttcaagagaaggagagggctgaaacctgggccaaaatgaacccatgagtctggatctggttgccagaagacagtgggaaaatggcaagggtgatcctgaaaattatatgaccccaatttgccctccgggtgatggaacttcaaggcttacattagacaggcagctcaaggaagagatacactgattacatatctaatttgctgtcactatcctcatgacatcactgtggctttctcagattactcttgaccctgaatacccaaatctattttccctgatgagttggtttgaatttttttcttggcactggtttcagtttcttacttcctgtcagcctcacttcttagatctttgctggtgtttttggtgtctccgaaactcccaaatgtacagaaactttttctagactgcagtcttctggtcttcctctctcctgatcactcagatgatatatcaaatcgtctggcatggctgcttctggatatatatagctcagcttttccccccttgatctttctcactgtgttcagggctagggtaaagtgaagtcatcacaattgctctttcaagcttaaggaatttgataaatgaagtcgtgtggggtcctggcaggcgatgtgcttaagcaaagtacaatgaccatctgtggaccagtctccttatccctttattatggcacatactcaagttcaagttgctttgtgaaacttctttgtgtgtctctctctttttgtatttcagctttatacaattattcccaaatcttgcaaactgacagtgagggagagtaatcgaaaagactgctcaacttcagtctttgaacattgcaccatcgc

SEQ ID NO: 26091 - DNA, 981 bp, Bovine  19866881346882
aataactttattgacaccttacaatagtattatgatagagtaatattattatccttatctacagacagggaatcagaggcagaaagaattgaaataaaccacccaaggtcatgagagagtaaataggggagctgggatcagagcccaagtatctggctccacagtgatgccaacccttaactactacgttccacttctactcaagtactagtctgtgcaaaccgaaccatagagagggcctacctagctcaaaggactgtgcaacttatgggagacccttgcaaggcaactgtggtctctgggtttcagtgctggagaacggtctgcccatgtgctgttcactagaggacatttcattgctttgatgcttaaaataattacttccaaagatcagttcaatctttatgggaaaaaaaaaaaaagttgcttccaggataaaataataggaaagctttcttttcagtgatggctccactgaagaaaatcatccttggttgtatttaaagcatataatctctttttttggctttcgaacatggaccctgtaaatgaaaccagacagatgtgtgcatctttctcctttctctgattggttttattttaaagtattagatgtcttaaatcttgtttttcaatattaaatattgcctctaagaggaaacatgagaataaaaacgatttccacgatgagtccactcagactgagggtaggagaagccaattccgtcatttgtcttctgtgtctgccttctcgtatttgtttgttcaaatgaattcaatttcttatactcctgtctggtccagtgggatgatgttttagacatacactgagtttactgactgcaacatctgttttcagaaatctcagcacttctcacctttagttggaagctgctaagttctaccccaagaacgaggtacactttgagcagttaggggaagagtttaccaggccctcttcaacgttcatatcttttatgc

SEQ ID NO: 26092 - DNA, 1437 bp, Bovine  19866881358063
tccttccttaccctgggcctaagagggcaaatctctatcattagccttttctgcaaaatgcagtattattcaccacttcctcccttcttttacccctagagcaattcctcagcttgtaggaagcatttttcagtcagaatgtaacttcgaaggcgactattctaaactctcagtcaggaaggttcagaattggctttcacaaaggggataaaccctgcattcaggaagtctgaccggcaacaattccagggctctcacattaccggcttcctcctcgttattacagttgggctcttcctggaagggggagtctgctgcttgattaaacattccaatcacatcaacactgagcaaaatcacaaaatcagcctggtcttaatcaaatgtgcttacctctccttgggaaaggccttcaaaattagaaaacgtttcacagatcagatatgtaggaacaattcccctatctctctttcttgcttcagtggcatctcaagtccctgatcataggataccagccaacgtgtaccgagcacttcctaacggccaggcacgccaccaagtgcttttgcttacacttcctcatttaattttcagagcaactcggaggaggagggaggatctagtctgatccccattttatagatgagatgactgaggtccggaagactaagttgtccagggctgcactgtcaaccccagagctattaaaatccaacagcagtgtggataggtcctcagcagacctggttcagccactgcccagatattgctactttctctctggcctcagtttcccttcttggagacgatgtggccactctgaaagttcccttttagcctgacattccacagcctgctgctgctgctggcgggcttctttgtttccacgctcagctgctctggccggggcctcccccggctctgccctgttttgtttttgctgctggacctactacagacgcactcctggcagagcagcccggagcatagccgaggaggcttcctctttcgctcagttcctggccgctttagtatgaacagaaaaggtgggcaggggccaactggcagaagccacagaaatagcagcacatgattctcctacgagcagcagaaaggtcggcacgcaggaccccgccatctgctgagctttctcattgactaaggttgctcttggcacgcagagccacctggggtttccacgctcgtttccctccggtcagagtagacagctctgctgatagacaacttggagggggatgcttcgtggtcccgtgctagcaaccggccagggacaggagatggacagctttaactgcaaagccacacaggaacacccccctgccacaggcacacacatctgaatctctctttctgcagactgcaacctcctggggaggtcctccctgggtccaggccacctctgagcacacaggaaaa

SEQ ID NO: 26093 - DNA, 1242 bp, Bovine  19866881424330
ataccaattcaaagagaactgacagatcagttacaaactttgcagacgcaagccttcagtgaaaaccctctggttttaaactatgattattcttcctttacatttctttgaagattgtctttgtggagttaaatgtcagattatgaaatgtaaatttaggacaactgattcaagaagtttgacatagccttccctcagaatcctgggggcacgggtttgatccctgtgctgtgcttagtggctcagtcatgtctgactctttgcaaccccatggactgtagcctgccaggctcctctgtccatggggattctccaggccagaatactggagtgggctgccatgccctcctccaggggattttctcaatccggggattgaatccaggtctcttgcactgcaggcagattctgtaccatctgagccaccaggaaagcccatgaacactggagtgggtagcctatcccttctccaagggatcttcccgacccaggacttgaaactgggtctcttgcattgcaagattctttaccagctgagttaccaagaaagccccaataccaaaatccaagaatgctcaagttccttatacaaaatcactttatgcagtcggctctagggaatccgtggttggttgaatctgtgattgggaaccctcggagagctgtgcttgaaaactttacactggtgtgtgcagaggtgtgggtgcacagtgtgtaggaggtgcaacaaaatgacttgtgactgtctctctccttcacctgttttgaccaaactttattactcatttaatggagtcatgacaaagaggaggaatcaaaacacagggggatcacagaggctgttatgtttattgtgcagaacagacagtgataatccactagagaaatattttcaacaagcaagcgattcaaagtacaatcatagacagcaactctacatgaagaacaaagttagaagacactcatagaaacaggaagaaagtcaactgcagttcaacgtcttgatacttttctcctggaaacatacctaacttcagaaatggtagaaaagttaaatgtccagtcttatttagcctgagaccaacaacagcaaagaacagtcctataaaatttatctcccacaaaaataaactatatatataaaaattttatgatgttcttactgttccattggccacaagctttttttcagtatgaaaaatgaggtatactggggcttaagaggtagtagtgtgttttgat

SEQ ID NO: 26094 - DNA, 936 bp, Bovine  19866881600569
gtttatttatggccttatttaacatgaccctgttttacttcaatcgctgtaaaaggaacacgatggacctcagacaacctgagttttctgtgaccagaggtggtctgtgagatccatgattctgagtggtttgccatttttcttaggcacagagttaaagtctgcctcctggaagctggtgtttgggagaaaaccactcagtttatggatgaagggagccaatacatcgccaagagctccatggcaatgcaacctggttattccctaattgggatttatgtagtcattctcttttaaagtgttagttgttcagtcacgttcagctctttgtgactccgtggactgtggcccaccaggcttctctgtccatggaattctccagacaagaatactggaatgggttgccattcccttctcctagggatcttcttgactctgggatcgaacccaggtctcctgcattgtaggcatattcattaccatctgagccacaaaggaagcctggtcattctctttaggaagactaagcaattgtttgtttctttgagaaaataaccatcatgtgagggattactcctgggtaaaagttagaaagggagttcacctctcccacaggaaaggcttgcctctcaataggaatctagatttaggagcaatctccaaacctgaacacaatatttcctggattcccaaatttagagactgaatttgggggtttgccaaatcctcaaaaacatcaagggtctactaaaatataataggaaatgatagagaaaagggaaaaacacaagcaaaatgtaaaagattttgcaaaatgtgtattttagatccagtgcccctcttgctaaccacgtgggcttgggaaaggtctgaccatagctatagatcaaaaggaaactgctcctcctcagtaactggtgtgccctaagaaggggg

SEQ ID NO: 26095 - DNA, 1551 bp, Bovine  19866880347894
ttttcagcctcttttgtccactaaattttctcactgagctatccttatttaaccactctttgtatctttaattaacatgccgtctccccttggaaacccctgactccacggggctggaccccggcagttgccagtgctactgtttacctgttaatgtagagtagtgtgtatctgttaatccctcttcctaatttatctttccccctttcccctacataagtttgtactctataaaagattgtcattcttaaagcagtttggtcttaaatagctctaccttttttttttttttttttggccaaaggctgaaatccttcagtagccaggctggactactgcgacattttgagatttccgtcatgtggaccttgttaggagtgatggacgacgggcactttcagctgcagccagatgtccccagggcgccgttctcagctcagcgtgactgtcctcactgaatcacaagttaaacaggagcctctgacttagagaaagtgaggttaagttcccaagaggaaagtgaggtaccaggcagagaatctaggaggagctggaaggggaggggtttactacgggcagtgccaccactggaagcatgtcacaaagtccctgagttccccgtgagtcactgggtaaatgcccttgcaggcgctccattccggtgagacactggcagggtctgggcaccagggagatttgaaagatgagacctcctgcgctaatgttgccacacagctgtgccgaaggaaatttaaaaaaggttaacaatcacgtcaggtcgtcactcactttccttacagagctttcccatgggagagcccttaacttaatcattgttaggaattatcaagtgtcagcatacttttcatgaccatttaacccatgcattgtactcccccagacacagtggaacgcagggatacgatgcaggacatgctctctgacctcaggcagggtgtcggggagaccttttcctttttataatgaagtaaaccccatcccatccccaggtgaccacagagctgttttctgtcgctgtaagtctgcatcttctaaaggttcatatgaatagaatcacatgctgtgtactttgtcttctcaggcttctctcactcagaataattattttgacatttatccatattactgcatgtcaataactgtttatgccttttcttttttttttactgctgaataatgttccatggtgtaaacatatcacaatctgtttattcattgacctgttaatggacatttggattgtttccagtttttaactatcacaaatgaagctgctttgaacatgcatgtctaagtctgtgtgtggacagatgctctcatttctcctgggtaaactcctgagacaggaatggctgggtcgtgcatcagacgtgtattcaaactttttacgaagctccttagaagttccccaaaacggttgcaccatttcacattcccgccagcagtgggtgagaaccccacatccttcacatcctcagcaatatgtggtataatcagtcttttgattttaaacatcctgatacagtggtc

SEQ ID NO: 26096 - DNA, 1625 bp, Bovine  19866880360784
cttggctgaagcccccaagtccttctcaaatccccggccgggatgcctcctttctagccccacagccatcagcctccgtagccctcagctcctgctggaagatctgtcatatgctgtgggtgctgggccccccagggctgtcattcccaccccgagacattgctctgaaagcctggacaatccccactcccttcctaccaaataatgcacacgagggacttccctggtggtctggtgggttaagaatccgcctttcaatgcaggggacatgggttcgatccctggtcagagagaagatcccacatgccacggggcaactaagcctgcgtgctccaactactgagctcgcacaccgagcctagagaagactgcaggccgcagcagagacccagcgcagccaaaaaacaataaacgaacacagcacaccagggctcgttagtcatcgcttaaagacctcccatttggggctcgctctttgcctctgtctcagccactcacccgtgtccctcttgccccagatcacggtgaccagcctggcctctcgagtcatcctataatctggtctcgggcctgacctaggaagtcctccccaggacctgtccctctcgtgcatcgtcccatggacacggacgctgcccacttcaggatccctggcctgggccttgctccttccagggccggtgccccactgctccctgagatcctccgggacgagggcctggcctcaaacatctgtgtccccaggcgacacctaggtcactaggtcactaggcgctcagttagggttgtcagctccccagcagcacgaggtctggacagacctgcagtagccattgacgatccttccagagaccaccttccggaaaggctcccagtgcttggcttctccgtccacaggtgcgcccagcaggacgacgtcctcaatgatcccttggcaatctggagagagaccccagaaaagaccgtcagcgcccctggccacagtgggtcctgcgagggaccgtccaacagccgtggaagaaatggatatgagacccacgagaaggcacatatgcactcactattgttcagtcgctcagtcacgtctgacaattacgactccacaggctgcagcacgccaggcttccctgtccttgcaggcgcaaacacattcgtgcacacattcatgcaaacgcacaccgtactgcggcttctgttcacagaggctcaggccctgggtcaagccctctggtgcctgatccattcctacaaagcccgcacaccgagcctgtgccccacaactagagaagacggccacagcaagacccagcgcagtcaaaaaggaatgaatgaataatccaagcacacatcatccccgtttcagagtttaggaaaaccaaagacattttcaggatcacatggccagtgggtagcacagtccaagtggggacccacatctatttccaccatccgtgaagctcacgactgaccgtacactcagatgggagtgtttccctttagaagggactcatggtccctggcatgttgcatgtgccaggcaggagataccacagccttcctctggcaacagtccctgggggcctgtatggcctggcggtaaggcgggagtgcagaggagagggggg

SEQ ID NO: 26097 - DNA, 2270 bp, Bovine  19866880365991
aaggatgaaggatggttttaggtggccttctctccctgctccagcgtgagtcagccacctgcatctccagctggggtcagactacagtctttcccaattatcccccaactgaaagcccatcactgactacactgttcagtgggcatttattgtgtctgtgggggtgtgtgtcgcgtcagacgctgtgccgagggcacaggtgtgggtgctgctccgtggcggggcaaggtggggcagatggctgcttacctgtgagtgaccgctccatactccccggccaaggccactcgactggctgggaccagctcctggctcattgtgctaaagatggcttcgctggatgagcctgcctggaacatccataacgggtccagaattacacgggtccgagaagcccaggccctccttgtaatctggaccgggacaactactgcctggaactggctttgactttcaagctcataacctctctgagtggcaagccaagcctagtttctccagggagaaaggaggcagaggtgccattcatgccaacccagaggatgctgcccacgcctcaaactctcggcagctcaggttcccagggccggaggagatgttgagacgaccacggcaggggctcctcttcctgccacagaggcctccgggcaccaccaggctcagacctgaccaccgagcacgaacactcacctgtgaaggctcccttcagcagacaggctgagcccgacaagcccaccctggataaactcgcactgaattacagaacagccctctatcaaccagcaaaaagcaacaaacaatgaggaaaagccccgtattttcctcatttcattatgaacagctctcaggactggcaacacctataaagaatcctttaagaattaagtcttttagcttttgtgaatgcatttgctgtcatgccccaaccagtgggagttttgatgttaagactggatgtttcctggcagtgggcgtggggtggggggttggctacttgttagctatcagcccagcgtggaagcacagtctaacaagcttcattccccaaatcaaggcacaaaccacatccttcagggcccagcatgagctatgtggctgtgtccccctcagccttggaaagaggctctgggcagcagaaaataccatcaagtcttgatgaatttcctaaccctcctcccaccatgtaatggcaagatacagaaactactctaaatggacagaaatctttgtttttgggtgggaaaaatactcaacttgccaaagtcttgagttctgcaagggttaagagcagagagctggcacatcagtcttgggtctggagtgtggtgggaggcgagctcagaggaaggcacgtggctcctccttccccacgagcaggtcaggaagcgagaggacagagcacactgcagccctgaaatgcgctcatccgcccggacgcaccgggccctcgccactcagtgtgggtcgcagcccagtggcctgggagcccattagggaggcgggacctcaggctccaccccacaccggcgctcagaacctgccttctaacccgccctcaggtgacgcatgggcaggttacagtctaagactgcaacaccgcttcagactgctgcacgagagcgtgaggcacctgtcctgtggagaatcttctggttcctatatacctcctaggagaaagtgccgtctggttacccgcccaacaagaaggggattttgaaaaaggatgactttagagatggaaggccccactcttaccgagatgttccacatcatcttgatggccaaggggaaggccggggcccgtggggctggcgcctcctctcctcgtggaaggatctctgggcccttccctggaagaagctggcccaggctctctgcctcctccaggctctggggcaacacaggcatggcggcctcatagacggcggcactgcagcccttgccaatggactgcccgatcagatactcctccagccggaaaccctgccagcgtcgggtgtccagtgggtctgggagcagcttgtttttctgggtgaaaattgcctgtgaagaaaaccagcaggcaccatgagcttggcagccccgtgaggcttcagtgaagggatagagtggtacagcgaggccaaatctccactggcagatcgagcgctaataaaacaaccaaactgggtgctactgttggtcctgggctcaagccagcctctgttctctccttattaagagtggttctcaaactgccacttcatggcagtcaccgcgacagtccaaca

SEQ ID NO: 26098 - DNA, 1874 bp, Bovine  19866880367471
cctgatccgggtatgatgggtgtccttattcaaaggggaaatttggaggcaggcacgtacacggggaggatgctgtttgaggatgggggtcatgctgccccaagccgaggaaccacccagatgccaggagaggggtctggaagagatccttccctcagccctgagaaggagtcagtgctgcagacaccttgatgttggacttatagcctgcggagctgtgggacaacacttttctgttatttaagctccttgtctatactgcctttaggacagcctgagttcttccctgactgtatccccagtctagagtgctgctgttcagttgctcatttgtgtctgactctgcaaccccgtgaactgcagcatgccaggcctccctgtccatcaccatctcctggagcttacccaaactcatgtccgttgagtcggtgatgccatccaaccatctcatcctctgtcgtccctttctcctcctgccctcaatctttcccagcatcagggtcttttccaatgagtctgctcttcacattgggggcttccctagtggctcagatggtagagagtctgcctgaagtgtgggagacctgggttcgatccctgggtcagaaagatcccctggagaaggaaatggcaactcattccagtattcttgcctggaaaatcccatgaatggtggagcctggcaggctacagtccatggggtcacaaagagtctgacacgactgagcgacttcactttctccacatcaggtggccaaagtattggttttccagtttcagcctcagtcctcccagtgaaatttgggattgatttcctttaggattgactggttgatctctttgcagtccaagagtctcaagagtcttctccagcactgcagctcaaaagcaccagttctagtccagaatgggctcagcatttagtaacacagttgcttgtggctctcgaatgaacgaaccttgctggtgacatgcagtgaggaggaccaggtcccggatgaccatgtagctggaggagaggaccttcaggacaggacagaggtgcagggcagaccatgggctggtggctccatcccttacaaagcccatctgcccgccttctgttctgctttccaaagaggtgagctcttaccgatcagattccatctgtctcttgcccagtgtgccaagctcatgggacttgagggcagctcggatgcccccaccttgggggcgtgggggaagagaactggccccggtctgctcaccgtctgtgaacagagtcccgaaacaggggccatgggctacacaggagttgcctcagagagtgcaccatccaagggcggagacagagccctgtttgggaaacaccctggtctgatggaggaaatgagatctgtgcccttggagagcctcccacctgatgtgggtgcacagccgctgccccaggggaagagattttcaaggacgatgggggagacatacacgcataggtgcactaataaagtagcccattagaagctgctcccgggaggcctggaaaggtgtcctgaaggaaatgggtttgcacagagttggggtgggcaggagggggttctccgtggtggggagggggaggcgtgggcagggcagggagggaccaggttgttacctctcctttgcagtcccaggtgagctggtctggtgtctggacacacgggtgaatacgtggcctgcacagcctttcagtgggcttcttggccatcacgaatcacccatttttaggagagaaaaaaagactgttggcaggggacaggaatagcttctaaagcctcccttcatccctgctgctcctcttttcccagatgtctccgcaggcctggggtctggaaggcagtgcatgcccacagcaccct

SEQ ID NO: 26099 - DNA, 1556 bp, Bovine  19866880407752
aaactctgctcatgttatgtggcagcctggatgggaggagagtttggaggagaatggatacatgctatatactgagtcccttcactgtccacctgacactgtcaccacactgttaatcagctatactccagtacaaaacaaaaggtttttttaaatgaaaatttactttggctaaagtgagagactggagtgggtgagcctagacccaaagagagtagtgaataacccatgaggctgtgggggtggagagaagtgagcagacatgagaactcattaaaaggtagagtttaagagatctggcttcgattggatggggaggtagtggggagggctgaacaaggaagacgcttgagttgctgatttgagcaatgtgatcacgaggattcttggatggcaagtgacagaaacagaacctgggcaaaagggcaaatgcattacccacccactcaccccgccctgaaaccaactgagaagaggccagaggtggagctgccttagaagcaactggaacccgggcctcaggtaccttcaggatgccctcttctgtcttggtaccaccctctacccaactgcaaagagctcaggactcttatcgttagagccctgttgtcatccagggaaggacattttccctaccagttgccattagaaaaatcccaaggaagagctcgactggtcaggcgtggccccaggtccgtctctgcacttggtgctgtggcctgaggcctgggcaaatatgactggcctaatcgggatgcttcccacccccacaggcagaacaggcagaatgataacaggctggttctaccagaaactaaaatggggggagggagggggcatccctgggcgttcagtggttaagaatctgccttgcaatgcaagggacgctggttcgatccctggcctgggaagatcccacatgcgcggactaactaagcccgtgctccacaactgccaagcctgcgctctagaacccgggaaagacacagctactgcagccctcgtgcctagagcctgtgctccgccacaagaggagccaccgaggggaagcccgtgcaccgcagtgaagagtagccccactctgcagccagagaaagcccacggaaccgcaacaaagacccagcccggccaaaaataaaatatgataaataaatagataaaaaaactaaaatgcaagaacagttatgcaaagagagaggtgctgttacctaaagaaacggggaaagaagaatggaacagacaggcaaaaggattagatggtgctgtcatttccggagcaagagagaagggcagggaaaaaccaagtggaggagatgacgcagaaagcaaacgggtttcgttctggctcgggggagtttaaggtgcccgaatagcattaggtggaaacccccacacctcaggaggaaattggagttcctctctgggaattccacatggcttcccgtgaactttggaagagctgcacctcctttccccaaagccccagggacttctggggccaaacgctctccgccttgattggtcctccctggcccgttagacacactgactcatca

SEQ ID NO: 26100 - DNA, 2330 bp, Bovine  19866880417661
tttgaatgactgttaccatgacccagcttcagttcagttcagttgctcagtagtgtccgactctttgcaaccccatggactgcagcacgccaggcttttctgtccatcaccaactcccggagcttattcaaactcatgtccattgagtcggtgatgccatccaatgatctcatcctctgtcttccccttctcctcccaccttcaatcttgcccagcatcagtgtcttttctactgagtcagttcttcgaatcaggcggccaaagtattgcagtttcagcttcaacatcagtccttccagtgaatattcaggactgatttcccttaggatggactggttggatctccttgcagtccaagggactctcaagagtcttctccaacaccacagttcaaaagcatcaattctttggcgctcagctttcttcacagtccaactctcacatccatacatgactactggaaaaaccatagctctgactagatggacctttgttggcaaagtaatgtctctatttttaatattctgtctaagttgatcataactttttttccaaggagcaagcgtcttttaatttcatggctgcagtcaccataaaaagcctttattgagagcctactgtttgccagacacactggggcggtgtggtgttcctgttctttttggaggttggggagaagcatttgaagggtgtctcctctgcacacatttcctcacttcctggcaatccaggtgggtgtgtcttgacgggccacgccccctccctgtggtcctgccacctgtgggtgtggcctcaggccccatcggccctgaagacggccctaaacttgctttttcattggtgtgtgtgtgtgggtaaaactgacggtaacagcccccagctgtaacagctggggcctccttgtcccggcctcaagggcccaacctgctgctacacacagaggcagagccctctctctgagaacccctcatccgaggaaaccaactccagatcccaggaaaactgggcccctcacgtaggcagacttacactggacttggagataagtagcatcggtttccagccagcactcatgcttcccaacctgtcccttacctgtggaccaaaccaatgtcaccgactgtgctctgctactgtgactgatgaaaagaggagttgattcccaaactagctgctggtgggttttcttccgcttctcagatgtttgagaaagccaggttcctcctcctttcttcctgctttcggaaagtcctctggaagtttcctctaaatcctgacttgccccaggttttgtccctacccttatttggaggggtctcctgagatctgagtgcagcctaccccaggggaccagccacccagctcacctgcctagctggaaccttcgtgacactctggcaacttccactgtggggtccaaatactgcctcaagatatttgcatattggaatgtaggtggtccccagacacaaatgcattcttcgcccttatggtgccctggggagggaaagagaaggcagccgctaccccaggaagtaggttgtgtgttcactgctatggcatttggaagatctttttttaccaccccccccccaccaacctagcagggactagagaaaacaaaaaaatgggcacatggctcagctgtgccacactctgcggagccagcgtaaaaataaccagggcaggggcgggtgcagcactttgcagctggatagtctgatctacagagatccaccccaaggtcagaaacttggcagcatctcccggccaggcctccagcccccacaatggagctccctgacccacgtgttcacccagcccccagcctctccacagcactgccttccaggtgacctgacaaagtgggatttctcctgttcatgctgcaaatctccctggctaggagccagctgtctggagcctacagccgcttcccaaggccaagcgcctcgtctcactgcggctgaacacaggtgcactgcagtccagtcactaatcgcccagacggcttcagctcaagtggcatggccggtgcttgtccccccgaccccagagcctcaagtgcctaccgcgcaccaccccacccctgcctgctcacctgtaatatccccacacttctcaatcttggaccacgtctcacctttctgcctggtagccagttctgtagacactgtggaatcctggacaccagcgtctaacgtccaccaacagttagtgcatcccaccctggagctgtatgcctgtgcctgttcccagcagaatggcttctatgtatattacacagtggctactgttctcttaaaggcttttagctcataaaaactgtt

SEQ ID NO: 26101 - DNA, 2190 bp, Bovine  19866880424609
cagcttcagctctgccggaggtcacccatgctctttgtgtttcctcttttctggcaatgcggagttttattatttctgttttcaatatctttaaaaaatgtttttgattgcatgtttggcatagaagatttggagaacttgaacaactagaagcaatttaaaatcatttgtgaatccattcatcaccattaattttttcagtgaaattgacatataacattgtgtaaatttaagtgtacaatatattgatgtgatacatttatatatcatgaccttgtgttagtgcagcaataactagaatttctatcacatcacataattacaatttttctttgtggctggaataattaagatctagtctctaggcaagtttggtgattatgacacaacattgttgtctatattcactgtactgtctaggacttatttactacttgttgcaagttcgtacacttatacaatacttatcctagccccccacccccgaccccactttctgtaaccaccattttactctctattttaacatgtctgtacacacacacacacacacacacacacacaaatggaatcttctttacgcactcatccattgatgggtgcttaagttgtttccatcattaacattttcgtgtcaatgttatcctgattctattactctctgtatatatattctttttcctgaccaaattaggtaaagattacaggtagtacattgcagtctgtcttttcatttactaaaataacttaaacatatttctatgttgttaagtcatctcttgcagaaacattttgaaaggtagccttgtatgccattcatttaaagaatcccctattgttgagaatatgggttatttccaatatcatactattctagaccacacagcaggacagtgaaaaaactctttgagatgaaatctcgtccctgcctagaatcgtttctatagggtgtactcctgaagtgggcttgctgagtcaaagcacacctacaatttgaaggcaattgacatgtgttgacaacttaccctgcagaaggtctgccccagtttaaaatgggactcctaatgaggcaaatgacgtggacccagcccaactagggtggaggtgctgatggcaagacatgcttgacattacaaatgggtagtctgctgcaaacgctctaccagtaacccctaaggtttcccggagagtccacgagagcagaaactgagcttctttggtgcctgtcagatggctgttcaagagcatagagcacaggctgacctctttgctgccagctaactggtctacccaaaaaaagtcaggtcatggctgggtgatctccctctccctcttccctgtctctttaaaatctaattttcctttattcctagactcagtcattaactgatcatctcatacatgaaaaagcaatctgcatgcaaaatactaagcagcaaatacatgaagtctcttctggcatagtcttgggcatgcctcccccatgtgtgctctgtagccatatgctctttccctttatgctctgaccactgtgggaccttcctgtgcactcttctaggcctgtggttacccttctgagccccagcttccccctgagttggtctcaatcaggcagaagcaaaagtggccaggacttctgctgattccagaggtctttgccctagtgggagagaagacttgatagatgctgcaaaaagtcttcaaaatctgctgtcccagacattcccataggtcccagggcacagttcaaagggaacacattcaaactctagcttcttctcctaccatcttgggaccctgggaaagtcatttgacctcaagagccttgctttcctcatgtgcagaacgtggacaatgtggaggcaaccgtccctctctcctctgatggtcgtgggctttagagaccacatgcacacaacacattgcgtgcaacacaccctcagagagaatgccgttatggtgaccgcacacagattatgtagcatcacatggagacaaagaggccggcgttccagatgcttcccgggagaaagctgctcagctccgtgtcttccattttctcacgtgtgaaacagggtggtgagaatgttacggaaccaaacttgagtccacttgcccagaaaagccagtctattgacttcaagtcatgggtgaagtaaagggcattggttattgcagggcaccaagcaa

SEQ ID NO: 26102 - DNA, 1990 bp, Bovine  19866880450241
tggctgccaatctcttatctctgtcctcagcaatggtaaggcaaataccctttccacagggaagagagatccacggtttgttgcctttgccaataacgaaaatgtttgagagccatgtggcaaagctgttgccgttcacatctttcacatgaactacatcaaaagaacctggatgtctctcccggtttgtaatcacaccaattcttcccaggctagcacctccagtcaccatgcacaggttaccagtgtcaaatttgatgaaatcagtaatcttgccagtctccaagtcaatctgaatggtatcattcaccttgatgagtggatcagggtaacggatggtacaagcatcatgggttaccagatgagggattccttttgtccccacaaatatctttcttactttgcacaatttatacttggcctcctcaggtgtaatacgatgaacagcaaagcgacccttggtgtcatagatcaaacgaaaattctctccagtcttatcaatgctgatgacatccataaaaccagcagggtaggttatatctgtgcagactttgccatcgatcttaatgaaacgctgcatgccaatcttctttacttcatctccagttagggcatacttaagtctattccttaggaaagtgattagggggagacactcccttagcttgtgggggccggtagatggacgaggggcaaacacaccagtcagtttatccagcatccaatgttttggagctgctacgcatttcaggggcttcttgggaccccgagccatggctgcgctaggcacgaaaagaagtagggttttgctttggatctgtagatcactctgggtaatgtgttagaagaacagatccagtggagtgtgtgtgtgtgtgtgtgtgtgtgtaaaagaattgactcattcaattatagaagctggtgagtcccaagatctagagggtgagtttgggtagctggagacccagaagagcctgtggtttagctctagtcccaggttagaaggcctaagaaccaaaccagtagagctgatattttcagtttgggtctaaaggcaggaaaagaagctgatgtcccaggtccaaaggctttcacgcaggaggaattctcttacatgaggaaaggttgcctttttgttttattcagcctatcagctgattaggtaaagcccacccacgttgtcggggggaaatctgttttacccagttgactgatttaaatgttaatctcatgaaaaagcaccctacagaaacacccagaataatgtttgactaaatatctaggcactctgtggaccagtcaagctgacacataaaattaagcacctcagatagtatgggctgcttgacaatatttagtattccagtctgtgcagacagatgcctttccatttatttgtctttttcagtttctttcagcaatgttttgtagtttgcagtgtacaagttttttgactccttgcttgagtttattcctcagtattttatccttttttgctgctaatgtcaatggaattgttttcttaatttccttttcaaattgttctttgttagtgtatagtaatacaactgaattttgcttttggattttgtgtcctacaactttgttgaatttgtttattagttctaccagttgtgtgcatgtgtgtgtgtgggcgcatgtaatcttttgagttttgcatgtacaaaatcacgctctcttcaatagagctaattttacttccttctgatttggatgccttttatttcttttgctttcctaacagctctggctatgacttccagttgttgaatactaacataatggtgagagcaggcttccttgccttgttccttatcttagaagaagagatttcagtttttcaccactgagtatgatgttagttgtggcctttattatgttgaggtaatttctttctactcctagttcttttactgttttatctcatggagtgatgaattttttatgcatctatagagatgttcatgtg

SEQ ID NO: 26103 - DNA, 3677 bp, Bovine  19866880490421
tggactgggagtcaggaagcccacctctggcaggagcaaagtcatcaccaagcaaagtgactctgacgagttccctgtcctggccgggactcggatgcccacctgtcaaatgcctatctgtgtgcatgtggggagggttgggtgagatgatccccaagctggataaaactgctggctgcctcctatagctaagtgactgcatgaccagttcccaggagagggtgaaaaaacagtccaaagtatattatcaaaagctctgatttggggattccccaggtgacccaggggttaatattctgcctttcaatgcaggggacacaggtttcatccctggttggtgaactatggtcccaactgccccaaagtgtggccaaaaaataataataattttaaagccctgtttctattctaatttcctcaactagagatcaggatagtattagtccaaaggaagccaacgaccctcatgagttggtctctctcagaaaacaactacctcccttgtggtgctaggaagctttggtcctcttcccatcaacccagccctaaaagcagtccatcctttgagtcagtaacccctcttccagaaatctatgctcagaaaatcacttaaagtatagggaaaaaaagcttgaacacaaagaaatgcatcactctgatgcttgctacagagaaaacttagagtctattcaaatgtccaaatgtaagagaataacttccctggaggcttagatggtaaagaatctgcctgcaatgcaggagacgtgggttcaatctctgagttgggaagatcccctggaggaaggcatggcaacccactcccgtattcttgcctggagaattccatggacagaggagcctggcgggctacagtccatggggttgcaaagagtcagacatgactgagcaactaacacacaacagcagaagggaatggtgaagaaaattagggtacgtatccccaaccggaatattgtgactatcattggcaattacccttactgagagttttcactcacaggaaattgctttctctctaatgttaagcagaaaaaataagatgccagcagagtgtgttgtatgattttttttaagggcatagaaaaaaaaaattggtttagggtaaattttatttcttgaactctactttccaaatctctacagctagcatgcattattatgttctagaaagattcataaatcatgtttaaatgggccttgaccgagagacaacagggtttgacagctcttggttcacaccctaactctgacaccctccagccgtgacttccttgacctctatgcacggggatgacacccagcgtgaagctgggatgagacagcaccccctagggcacctagcgcgggactggacacgcagtgagtgcacaggaaaatagctgggtgccgtgtggccgtcgccccagacccaggctggctgaggcctcgcagccgttctgaatcttggcctctgccgctcaggctgctgtctggatttgctcatgctctcctggctccatctctggccccatttggagattctgcccctgccccctggctcaaggccattccaagatgccagccaccccagatcctgctcaaggagctgctctaagggttcctccaggatgcccagctgagtccaacactcccccagcctcctgctgcccgccagaccactccccagccgtctccagcctggtgggctggggtctgccgcctggccaaggattccccaacccagctgctccagagaaattctccagccctggggactcttctcatagcctttggcgctttctccggggcctctggggaagatgcagtcgggcctgagtcaccccgagcccggggcagataagcatcttccgatgaaccagccgggagcagcaccccacccaccatgcctggtgacagactgttttacctctgataattccaccgctttttggcacctatgaggcagggagagacggagcagagcaggcaagagaacagtgaatattttgtgggagccggaggcgactgaagatctctgctgatggcagacaggagcaggctggggagacgtgtcggcgctgcggggtggggaagaaggggtccccgcgggacatgagcctgaaacccatcctccccacctgcctttcccccctttcactccttcttttctccttctgttttcttccctcccgtctttccttctccttttccttcccttccccttccctcttttcctccttctttctttccttcatcccttcttttgctcattcactcattcctatttttattttttttaaactttttattttacattggagcatagctgattatgttgtgatggtttcaggtggacagcaaagggactcagccgcacatacacgtgtgcccactctccctaaactcccctcccatccaggctgccacatcacattgagcagagctccctggactcatccctactttcactcctcttccctctgtctgttaaaaggacattccttctgctcctgctccgtgctgagtcctgttgctgggcgctggggacacagatcaaccaaacagagcccaggtcctgaaggacacagagcccaacaaccccaccactccagagcaccggggagggcggcagcagaaaagcctggaccaatgtatctggaaaggcttccctgaggaggtgcccgtcgtggagagccatgaggcctctgccagcgggcaagccagggcaaggcacccgggcagagaacagcctgtgcaaaggcacagaggaggaactgcccgggcgtggccagacgtgagagtgtggcctcatggcgaggaaatgatgccgctcgagttacttcctgtgggctgggcatgtcggtaagcactgccccttgtgcaatggggaaactgaggctcagagagtcgtgggacttgcttaacatcacacagccagtgaatggtagagctgggacttgaattcagacctgggtggttcagaaggccatgactgtgcctcttgaccatgacaaacctcagctcagtagttctcaaaggtgccagtgacagccatcgggtgactggtgaagcccgcttctgcagccttggggcacacatggtacttttctgctgtccacagaggtaaggagcctgtgccctgcaggcaggagccctcctgccaccttcaaccactggggagaaagcagatctccccatttggaacatggagcagggtctggctggaaggtaagcccaaaatggctttgaagggcagtgccctatcctaagcactttcacccccttcaggctgggcatcctccctgacacctccaggagtgaggagcaggaggaggcagcagctgcttcccctcaaccctgccctgagcctcccggaatcacagagttgccaaaggtgagaactaggaacaggccataaagaaggctaagcactgaagaattgatgctttcggactgtggtgttggggaagactcttgagagtcccttggaaagcaaagaggtcaaagcagtccatcctaaaggattcaaccctgaatatgctgaagctgaagctccaatactttggccaccagatgtgaagagctgactcattggaaaagactctgatgctgggaaagattgaaggcaggagaagaaggggatgacagaggatgagatggttggaggcatcatcaat

SEQ ID NO: 26104 - DNA, 2160 bp, Bovine  19866880542132
gtggactccaacgagctactgcatatgcaactgtctccaaaaaagtgttctcatgtgtcccttcttctcccacattttatttatttatttgtggccacaccacaaggtgtgtgggatcctagttctctgagcacagatcgaacctgggccctcagcagtgaaagcacatgtcctaaccgctggaccaccagggagtcctcccagtcccacactttaatcatatacttacttctcgctgacttactccaagctgccttcatcacacaaccctgagtgattcaactcaagcctcttagttctgcaccccagtattcccattctgtgcatattactatcactgcctaatttgagggtgtctggccttcctcgctactaaaaccacagctaaaacaaacacgcaacattcctatgtattcctgaagtcctactcagctcaaagtctgctctgtcttaactccaaggcccttgtgtgtactccactctgctcacagcctgagcctttccacactcccaagttcccacttcgtctttcacactcaatctggctgctggggagtttgggagccttctcggcattaaaaaaaagaaaaaaaaaatgcctgcccaactccttgttaatttaatctattttctgatcaactgtgaagaatgtggggttttttccccttcaattttaaagcctttcgcttgtaattaagcagctctgcagctgaactcagggcggcacaggaaggtcagaactgcccaactgttctgccaaagagaagctcaactgggaagctgactccccctctctgcccaccctcccccactcaaggaagggctattaattcgccacagcttctacagaattatcacagacttggcttctaactcccacacatgcctggggaaggtttaactgtcagtaagtttggtaacttagaaacctcttccttaacaactttgatggggaaagtcatgtgttctcgcaggctctctgctggattatttttaacagtaaaacttgactgtgtgcatgcactttctataccttttggtgctatataattatccatgttcagggggtgtcatagtcaagacaccctggtcataagataacatgactttgagctatctcagagggaaaaaaatcctcaattatgactaattcctctaagcccactcatggttatttagagattaacacctccttcaggtaaaagcgttccatcgaacctgctttcataaccctctgcctcctcgcgagtgcagggaccatctgctacgtggagggaacaccagctctccccagcttcccccgcagggagaggggaggtgggggagacaggtgtctggggacctgggccagcggtgcctttagagtctcaccttgggtctcacactctacctgggaggcttctgccacagccgtcgtcaaccctgctcagctcagctcaccacctctgggcctggcacattctcaaccacaaagtgatttttgacaggatctaggcgtaggcttccgtcaagctgccagctgaataggcaagtggcctgtttacttaaaacataatagctgtacccagaggcctgctaggagtcagaaaacaaacattgataactgttcccaaggaaccgccaaaggacaggtgcccatttcttaggattaattaccaaatcagctggaaagaaggagaattttgactggagaagctaaagtcatattcctgcttcccaaaggttccgacctccccctagcaggtcaaaccaccctatatcactcacaacccaaatctaagcctacgataaatgcaataaaataataagcacccacataccatctgctggtatataccaagaatacatacatttgttttgaattggtcttctaaaaatgtttatcagttaatactctcccctgccaattcccacccctccttgtgaagatttcaggatgaaaacactcagaagaatcaggagaggacagttggcctgaaaatgagaacactttggtaccattcccagttctgcccgggactaatgattagaatacactgtcctgtgcagagagccacgttcaaaaggggggagtggagaaacaggaccacagggccaccaagtgatcaaaggtttggaaaaggaattgggggatgattccaacagcagtgaggagcaggg

SEQ ID NO: 26105 - DNA, 1650 bp, Bovine  19866880560181
ttggaggataattgttttataatattgtgttggtttctgccacacatcagcatgaatcagccataagtacacatgtgtcctgtgatgactggaggggtgggatggagcgggaagcaggactcggggccttggggtttgaagaagcagagtcccatggacagaaagatccatatcaccctttacagaggccactctggcagctgcttggatggtgttttaggggcagggggaacctggaggggcctggtgagtggtcatgaagggagaacctgcttgccccgcccctagacccttcccccagtacccaccgctttgccccaaacacacacaccccctgtcggctccctggccttggtttttcctaagatctcaatccaccctcggaacagacagcctgggagattcagaaggtccaagaggcaagtggtagctaggggtgaggccaagccccttcctcttccaggagtgctttaaaggctccaggcgggagtcggggctgtggccagtggtcctggggggccttccccagagctcaagatgaagggggacaggctagagtctcgccctcgcatctggaaagatgacgcaggtgattcttgtaggtgttcaggttccgctgcaggcagaaggccaacgtcttgtcacaggcgcacagctgctgctcacaccagctccccttggtggctgcgagggagtgaaggagggcacttaagcggtctgccccttcccgtggtagggtgggtcgtcgcccctggaggggagctgctgaaggcagctcagccctcatccaaccctttggtgcccttcccgggtccttggactctggctctgtgaccttgggcatggggtgtgacctccctttgtgccattggtccttcgttcattcatccgttcagtaagcaactgagcacctgtccttcgggagtcttaggagggagaggagaacagaatggacacctgagtttacactcccctggggcggggcgggggtgggcaaatgtcagagaagcgtgtggtcgttgttgttcagtggctcagtcctgtctgactctttgtgaccccacggatgccagcgtgccaggcctccctgcccttcacagaagtgagtgcaactgtgcttacccggaagtaaggaacaaggcaggggctctgagctggtgactgatgggactgactgagtgtcaaaagccatttgagctgagatcagaagagtgagctgttgctcctactctggaaagccagggtggaggagacggattgttcctggcagaaggaacatcatgtgccaagaccttgaggaaagacggaccatggtgcttcagtttcaccatctgtcaaatggggataagaaagccggacctactgcttagcgtggggacctctgctcagtattttgtaataatctataagggataagaatctgaaaaagaatatgtatacacacacacacacatattcagattaaaataagaaggcaaagcctttagcacatagtaagtggtcaataaatgttggccatttcagttgttgccactaagttctcagttgacagggacagctggtgagcccattcagcttctagccccgggacttgctgccttttctccgtgcgtggaccctgcggcttggtgacctgggttacagctcagg

SEQ ID NO: 26106 - DNA, 1560 bp, Bovine  19866880562937
gctttcaaatgagggtacaggttcatgtacagactatttcatgaatttctgcactcattccatcatcaaacagatattgagtttctaacatatgcccggcctttgtccaggaagcagggggacaggtctgagtgagtggaccccacaattgcatggcttcgggcatcattctctgtggctttatgagagtgagcacccaccccctccctggggctccccagagggttcagcggtaaagccatgtctctcccccagtgcaggagacatgggtttgatccctgggtctagaagatcccctggaggaggaaatggcaactcacttcagtattcttgcctggggaattcaagggacagaggagcctggaggcgggctggctacagtccatggcgtcgctaaagagtcagacacaaccgagcatgcatgcaccccacccccacccccaataagtgctccccaatctcctggagctcaaactccaattgaggggagagttgatccataagtaaacaaataactgagcaagatgagatggtggcaggttgagccagattctaggaaaggaaaaggatgatgcgtcagtgagtggaggtgttgttgtgagcagtaaactcagcaaaagagaaagatctttgcaaactaaaaactccagtggttacctggttcaccctctgccttgggcagagggcagaatcacaggctcagagatggaggtgacagaggggcctcgggctggaactctggctctgccacccacggccgggcccctctctgcccaacagatgcgggcacacatgggtggagggggcatcaccacttaaaatccctcgcgaattccaagtgcttatgcaagcccactcaagacaggactaacggcctccccgattgcctgagggcagccgtcaccactccgcaagttggccccagggcttgggttccaggcctttctctgcactgctctcccactgacatttcgagacatggacagaccaggctgtttttctcctttcccttcgctgctcacaccaaccacatccaggagcagccgctggttgctaggcaacctggaactaggcttgggtgccagatttcagaactgggaggcttgggaggtgattaacccttgcagggcagttctttgaactgcagtgtaactgaggattgtggtgggggcagggggagagctttcatcctataaggggttaatgacattagttcaaggggagaccaatgcagaaatctcaacggtaataaagaaaatcccagtgcttaactacgatgtaaaggggaaaaggaaactagggttaaaaaaataaaaagaaatctcaacttctgaaaggaaaggtattaattacgcacccgctctgggtcagacctctgagttggggagttttggggagtgctcagtcttttgcaaccccatggactgtagcctgccaggttcctctgcccatagaattttccaggcaggaatactggagcaggttgccattcccttctgcaggggatcttccagacccagggagggggaagtctcctgcatctcctgccctggcaggcag

SEQ ID NO: 26107 - DNA, 1039 bp, Bovine  19866880666930
ggtatttctgtgatgatggatatggaccaggagcaggtaaagcacttaaattctttctcaagataactaagagcctgggaaagcatgtaactttggcttcaaacagcactaacagaaagatatgccaatcacaagtaaaacagacacaaagctggcttaaataaaataatggaggttttctgagaaatctcgatttagtcctaatttaaccctactcacatgagattccacactacgttctttcccctcgatgcggcaagttccttgagagcagggcacatttcaaaaccattttctcacgtcttgagggcttggcacaatgccttgtccaaactagttttgtataaacatgttttaaactagttgaaaataaaattatactatatgtccacaaatggaacactgagccttgtgaatgaaaaaaaaaaaggaagcaaagagaatgccaagggtgttcttcctattagtggatttttaatcaacccagaggggaaagaaagagaaacggcagccaaaagttccatttcaacatctacggttttcaacttcccaaattaattaggagatggaagtatattctgaacatgccagagaattacacttacagcagttacaaattaccaactcactttagcccctttgaagtagtaaagaaacactgcataggaagggcagaatcagtcatctatttgcacagggagccaaccccgtcctcagctcttccagtgagtaactggatgcatttgcaagaaatctggccagggaaagtggggtgacctgaggccaggaagcagcaaagcttgacctctttgttaataaaaacaaactacaaacagaaatgtgagttgctaagagctcccatttataacgcgcttaaaagcatgccaagcgctttcacttccatcatctcatttgatttcctcactataatcttgtgattaagtagcacttcctgccttggtaaaagccgcaaccagtatgctcagaactacagccacgtggggactcttcgtcccatttcatccctgaggaacccagg

SEQ ID NO: 26108 - DNA, 816 bp, Bovine  19866880695967
tgtttttaagaacccatcaaggttaaaatatttcctgttttgaaactgaatccaatttatgtggggccaccctgcagacaacacaataaatatgaaggtggcccacgaagcatcacaacaccccataagcggctccctgattaacccatggcacactggtccagcccacatgcaggctacattacagaacaccagctggtttattcccaagcacccaaaggttctagcacgctacaaatgccacactgccaacaatgaatacatttatatagcgagatgctatctcgggctattcaatattcttatcagaccagaatggaaagtcagaagagtgcagagttgattattttttcattacctaacttcatatttcaccaagagtactcaagaaatatcaacaaacaaaataatccattgatatctaccaacccgaacaaacacaggaagcaccacccactgcacggtgataaagcctgtcttcaccatatccaaaactgacaatgctgctgctgctaagtcgcttcagtcgtgtccgactgtgtgtgaccccacagacggcagccaccaggctccccggtccctgggactctccaggcaagaacattggagtgggctgccatttccttctccattgcatgaaagtgaaaagtgaaagtgaagtcactcagtcgtgtctgactcttagcgaccccatggactgcagcgcaccaggctcctccgtccatgggattttccaggcaggagtactggagtgggtaatactaaagaggactaaacagcccactgcatggcacccatgggaagaacttgtgaacg

SEQ ID NO: 26109 - DNA, 2070 bp, Bovine  19866880730775
tctaagtccagctttgtaggtccagctttttgaaaggacacggggtaaacagatgggatagtaggagggagagaatggatgatgggaaggaaaaacgaccccaggaagagggatatggatccaggagtgtggaggaaagaagaaaaagggaagggagaggggaggagatcagttagcatccccattgtgggggtaggtaaacgggagtctggttgcaggagtgtgcactgtggaagaggcagtattaataacagcctggctattgtttcttccttcatctgggggctcagctaggcaaagaggcaagaaagatgaagctgaagaccgtatagaattgccttagccttaatcgtggaagaggagcaggaaaacgttttttggattacattatgttgcaccttattaatcaagactgtttatgacctggccttaatttacctttcccagttttcctacacggagaaggcgatggcaccccactccagtactcttgcctggaaaatcccatggatggaggagcctggtgggctgcagtccatggggtcgcgaagagtcggacacgactgagcgacttcactttcgtttctcactttcatgcattggagaaggaaatggcaacccactccagtgttcttgcctggagaatcccagggatgggggagcctggagggctgccgtctctggggtcgcacagagtcggacacgactgaagtgacttagcagcagcagcagcagttttcttacatatgtgcagtgttttaggcagattggatttagagcttgattgcaatttattcgccaccacctaacacactgcctggtacattaaaggcattcactgcttttttgttgaataaatgatgataagaatatcatagaggaaggctacctaggcccttagcagggcccctcaaagaggtgttttcttagtggagtcgctacagttcaaaggttgctttgctgggtcttgcttttagcctaatagcttgatttttgtcaaatatagtttattaaatattctgggcactagccactcataagcacaagacattggtatataaaccgaagtactagttgaatttggtgggtctgagctggtgtctgactcttccttacaaatgattggattgcttgtgtctgctatactggggatggtattcccactgtcagtgtgtccaggaaactgacatactcaacagaaggttgcttatgagcaggaattgcggcacagggagttgtaagatcttgagggagttttcataatgctgtgggaaacttggggagtactgcttctgctcccctgcccctgaagagagcgtatttctttagttaattcggcaagcgttggttgaggaacgtgctgggaatacattgcctagtaagagagagacaggacagcacgtctcaaacattctggtcttaggatccctttgccctctttggaatgaatgaggactccaaagagctttggcttatgtggattacggttatcagtgtttactatatgagaaagtaaaatagagtaaaagcatggtatgcaaacacattatattagctttcagagtgatagcatcagatattgtatatcaagtagcctctagaaaactccagtgtacacttgtgagagaagtagagtgaaaaggataactgacattggttgcggagtcagaactctgaaaaggcctcagagacaccctcccttcccaaactgggccgtactctaagaatgaatggtataaatacttaaaatacaagttgacatattctttacagtgactgattacagcatactatcgagaagaaagcggccagcactccctgaagtggccagggaggccgcgtccattcagcacacgttcatcgcaacctgccctgcgctagatgtctctcagagaaggccatgctcaggctgggtcatgaaggccaatagaaatacgccaggagagcgttctggactgaggagtaatatgtgtagaggcacaggagtgctttatttttgagagatctgcaaagtgttgagtatgacaaggccggaggccagcttgactgcagtgctcacgtctctccctt

SEQ ID NO: 26110 - DNA, 2161 bp, Bovine  19866880734675
tgcattgggcactgcgctaaattattcaaatgtgcaaagctttcattctcccaacaactgtataaaatctagaactcaccccacccctgtttttgcagatggaaaatcaaggcaccaaaagctttcagaaacctgctccaggttataaagccatcatcaagtggcagctctgggaccggcagtcaggtccatcctgtgcccaagcccggtctgaccgcctgtgttaaattagagacggcatctgtctggatgatcttccggctgcccagactgcaaacctggagggtggctggtgtctgccaggagccgctctgtattgtgagtggcagccctctgccggggctggactagacccgagatgagaagaccccaacttggggctttggagctcagagcggaccccagggacgggctgcagtctcttccactggcctcatctcttgggccacagttttcctccccaagaatagccatccctctgagcagggcatctgaggatagctccccttcagcctccccaggcagaagcctggcagaaggaacgctcctccacccacttggtttcctatcccgtgatggctcttccgtctggctagttcattcacatatttattcaacaagttaatattgagcctcactctctgctctgtggtgatcaaggtattgaagttcagttcagttcagtcgctcagtcgtgtctgactctttgagaccccatggactgcagcaaggcaggcctccctgtccatcaccaactcccggagttcacccaaactcatgtccattgagtcggtgatgccatccagccatctcatcctctggcatccccttctcctcctgcccccaatacctcccagcatcagagtcttttccaatgagtcaacccttcgcatgaggtggccaaagtactggaatttcagctttagcatcattccttccaaagaaatcccagggctgatctccttcagaatggactggttggatctccttgcagtccaagggactctcaagagtcttctccaacaccacagttcaaaagcatcaattcttcagggttcaactttctttacagtccaactctcacatccatacatgaccactggaaaaaccatagccttgactagacggacctttgttggcaaagtaacgtctctgcttttcaatatgctgtctgggttggtcataactttcctgccaaggagtactgaagggggcggagaaacgaatacaaatctaggaagcagtatgagacgtgagacgcttccatacaaacaggagcccgaggtgttacctgatgaggacgacgagaacaacacaggccccgttccgcgtgaggccgataggagaggtggccctggatctggcaggagtggagcatggctgcgcattaggaaaagttccgaggaggtgggattgggcctgtgagagggtaggactgaacacatgcggccaaaggaaaggacattcgaggtggtgagaatggcagggcccgcgcctggacgttggtgcacacggcgaggtctggggacctgggagcaagtctgtataagaaggggaagaacagaagtcaggacagcatgggtggctggagctgtgagctgggcccagtcactccagtcatggcccagcccctcccgagtggggtcaggagagcaggaggtaaggccccagaggtcccgggaagaggctgggccctctgggacatgctgcctgagttgtccctggctgcgtgttgtttctggaaagccctctgtagccatgttcacatcccagcatcacttctcaggcccaggtggttaagactccatgcttccaatgcagcagacacaggttccatccctggttgaggaactaagatcccgcatgctgtgtggtatggccaacctccacccccaccccccaaaaaagaaaaatctgtagggttccatgaacttgggcaaactctgggagatggtgagagacagggaagcctgacgtgctacagtccacggggcagcaaagagtcggacgtgatgtggcgacgtaagctcccattattcaactggaaccccataaaccccaaagggaaaacagagaacacgttccagttacagcaggttggggcgccctccccattccatctccccatcactccccacagcagcttctggggcacacctgg

SEQ ID NO: 26111 - DNA, 794 bp, Bovine  19866880775386
ttatactgagaattaaatgagacaatgtctataagtgcctggtccagagattggagcagatcaggtgctcactattgatgacttatgaactctacgcttcctccaaggaccaggtcaatgctacctcctccatgaaatactctctctccctccctagtcaaggatcatgtcctgcttaccatgtgttcttactgtatgttgtttgaaatgataactcatctagttttccttgtcacccactaggctgaaggccagagacaaattcgctttaacctttgtgtccctgggttgtgggtgatagtaaatgttcactaaacattctttgaacacaccaatgaaaagaatagtcctagccatggtcttgcctcttgtgagtgtggaaagttctgtccacttcttctcaccctctaggacaggctcatctgtgaaccaggaactgccttgagggatttgacttaatctgcaggcaggcaggactcttgaatttaagcaatcattctcaagtttccagagactgatccatgtttttgtttctctgcttccccagtgacttgcaagatgattttatctcaccctgtggggcttgcagacaggtcatgagagaggtaagcaacttccctttctttctggaatggatctcccctcctcttccctgctcttccaggccctgggagccaagccaggccaagtgaagagacacagtgactgtcctattagctgggttggctgactcctaaggccttcccaagcttgcatgaatcactggaaattattctttcattcagcaaatactt

SEQ ID NO: 26112 - DNA, 2121 bp, Bovine  19866880842172
tgtatgctacctttctcctgcgttgttttgtttttttttaaacatagactcttctccttttctccatctctgtgcccctggcattgctgtgtgagtgttttaaggaaacgagcagctgtcctgtaacttctaacgtgtgaggccctagctcttacttcctaattccaggatggtggatagaaacagaacagctacttagggagcaaaggagtcaggagaaaggccatcatcctaacaggaagtaaggtgctcgggatgctaggcgcgtgatgactggccctgttgtgctctccaccagctacccgtgtaccctgcgccagtaccttcgcgggaacaccccgagcccccggctggccactgtgatgactctgcaactcttggaaggggtggatcacctggtccagcagggcgtcgcgcacagagacttgaagtccgacaacatcctggtggaactggatgcaggtagctgcccgccccgccccgagctgtccagggtggcctgcacttcagggcttggggacatttggggcgtttgggtcttttctggtttctatgttctaagttgtgtcttagctctgcccacagagataagcactctctccttcaagatggatggttttgttctttggttctggtctttgtattgtaagaatattttcagcaagtactgcttgaatgtcagcccagctgcctctggcaatgagctccccatcattggaagcattcaagcaaagctgggtggctacttgcctgggggttctgtaaaggagagtcattgttttgttcttgttgtttagttgctaactcatgtctgactctctgcaaccccttggactgtagcccaccaggctcctctgtccatgggatttcccaggcaagaatactggagtgggttgccttttccttcttcaggggatcttcttgacccagggatcgaacttctgttccctgcaatacaggtggattctgtcatatggtcagttttgaactaaaaagatttaagataattcaatatgcgattaaattctagaggaactggcttttaaaggaagtctgcatgaatccttttccagataactaattgataatgtgctgattttagccagttcttggctaagggaccttgatttcctggaggcatgtctgtatttgtgttgctggtcccactcagctctctggtgagtgggcagctgtccaggccttgctggcctgtgttcctgggtcagcatgtcctgagagtggcttttgttgttgttcagtcactcaggtcatgtccgactctttgtgaccccatggactgcagcatgccaggcctccctgtccatcaccaactcctggagcttactcagactcatgtccatcgagtcggtgatgccatccaaaccatctcatcctctgtcgtccccttctcctcctaccctcaatctttcccagcatcagggtcttttcgaatgagtcagttcttcgcatcaggtggccaaagtattggagtttcagcttcaacatcagtcctaccaatgaacaccctgactgatctcctttaggatggactggttggatctccttgtagcccaagggactctcaagagtcttctcccaacaccatagctcaaaagcatcaattctttggcactcacctttctttatggtccaactctcacatccatacatgaccactggaaaaaccatagccttgactagacagacctttgttgacaaagtaatgtctctgctttttaatatgctgtctaggttgatcataactctccttccaaggagcaagcgtcttttaatttcatggctgcggtcaccatctacagtgatcttggagcccagaaaaataaagtcagccactgtttccactgttttcccatttatttgccatgaagtgatgggaccggatgccatgatcttcgttttctgaatgttgagctttaagccaactttttcactctcctctttcactttccttaagaagctctttagttcttcactttctgccataagggtgatgtcatctgcatatctgaggttatgatatttttcccagccatcttgattccagcttgtgcttcctccagccttacaaggcatccctaataggcatcaaacctgggtctc

SEQ ID NO: 26113 - DNA, 765 bp, Bovine  19866880863458
agaaaagagctacttttcattcaccagcatccccctgggtgggggtgggagggagtcttcccaagccacctgtgtcataggcccttcatcacacagtttcctgttcctctctccaggtggcctgtagcttcccacattaagaatcttgctcatgggaacttccctgctgctccggtggttaagaactttgccttccagtgcagggggtaagggcttgatgcctggtccaggagcagagatcccacgtgccttgcggccaaaaacaccaaaataaaacagaagcagtattgtaacaaattcaataaagactttaaagatggtccacatttttaaaaatcttggtctactaagatgggtgtgttacgctcctgaggttcgtgggcaggaaaacgatatagtacccactgaatcaggacagagcagtggtttataaacttggattctgagtttcaaccccagctctgccactcacggggctcactggactttggaatcttcttactctcatctgtaattagggacaatcgtggcaccaacattaatgagttaaaaactgagacgtttgttgaggaacagggcacagagtgtgtgagtacacagagccacgccgacaacattccccaggggccccaggcacccccatcctcatttttgtgtctgatctttaggatacaagatgaagaagcgtgttggggccattgaggagttcacatttctgcccctgacggaaggcaggcagctgcacatcaccatcgccatcacggg

SEQ ID NO: 26114 - DNA, 2163 bp, Bovine  19866880936423
caggacctgatcatgcaaaggctatgcctttaagcaaaataagcattagacctattctcttaggccctggggagtatcagaaacccttttcctccttgccccaataaacaaagcaggaagtaggagacaaatttcagcttaatacatgattttcttaacagagttgcacagtggcagactgaaataaaatagtaagctaaaatagtaagctgtcacaggaatgtcaattggaaaatctagtgaagatgttcgtttggttcaacaactagtcttctgctaagccctggatatatgcacccagcctcaaataggggtttggactaggtaatcactaaaggttattctcagtctaactaggactccatctgaattctcaggatcaactaccaccaatgcccctttacagaaaatcatacttatggtacagccattttctctttccagacaggcaaacctaagggggcggggggcgcaacggtgaaggaactgttcatctttcttatcaggccctttaatggagaaaacccacttctcagagtagcagagccaggagttctaaggtctgcaacaacacttgatcccacagtctttagctctgtcttctggtaaggacatatcctctcctaagcccagagtgaagtgaagtgaaatgaaagtcactcaatcgtgtccgactctttgtaactccatggactatagagtctggaattctccagcccagaatactggagtgggtagcctttcccttctccaggggatctcccaacctaggtctcccgcattgcaggtggattctttaccagctcagccacaagggaagcccaagaataccggagtcggtagtctatcccttctccaacagatcttcctgaccgaggaatcgaaccgtcttctgcatttcaggcagattctttaccaactgagcgttagcatttctcttctctgggagcagcagcgcccagggctggcgacccattccatcccaggaatgcccacgatcctaaagacagctgataaatcagagttctggggcgacccgcagcccttaccttctaccgaaggggagaaaatgatgagattgtcataaagaaactccccgtacttaatgagggacaggctggggtcatctgcggtcttgaatgtgagtacaaagccgcgatctggaaaaagagaacgagggagctgaggcacataggaggcaaagaggaaccaccactgcagagaccatgaccgtcatgccccacccccgttcccccaccagccccctggcggcaggtcagacctggaaggccagctcgggtgggagggagaggggtcggtgtctccgggctcagggaccttgccaatccatcgggccccaatctcacccttcaggctccggaagaaaagcgaatgcgtctcccggaggttgaggttgtccagcagtaccaaggtgcggggaccgctggcgccggccaggccaagcaaaggcagcagcagcagccaccagccggaccacacacgggccgcgcgggtcgccatcttcctgttccaaagaaaccagacgcctgggcaccggaagtgccccttccaccgtcgcccaatcgtggctcgttgtcttggagtgtcacccggaagtggttcgaaaacgccggagccgggcgtccggaacctctgcttggacggcgaggcgcgaggaacccggccggaaatgtccctgtgagaggcgggttctcggcacactattggtgaaagcggcgcgcagtcccgcccccccgagaggaaaaagctcaatcctagagagacagctgtgcggccgcggccagtcagtagggccgagagcccttgggttccgcccattgccgactcccgccggagtcccggccggctcccgcctcctcatccgattggtcttggactcggccgcggcgttcgggtcggggtccgggctggaggttcgctggcccgggacaggttcgactggaaccaggccccacttccactctctccagggaggagatggttggaaaaaggccggggacgggtcgcgggcgtgggggctgcgggaagagggccggaatctctcccgctgctcatgggcgcagggccttggcgcgggcgcggcccacccgcaggccggaggcagtgtggactgggcatacattcagaacctgtagctgggcg

SEQ ID NO: 26115 - DNA, 1634 bp, Bovine  19866880939959
aacgtgggggcaaaagtcagaacctccctctgcgcttctcttcaaccaatcctgctctcaatccccaatgactgctccaggaactcctgccccacagcccagccctcctgcccttcagcccatgattgccacatcagtccacttctcacttagacccgatggtgtaggcagtcactgagcagttggccacagctcacagaatccagaggctcttcacgcaggtctgcacctaaactcatctcggcagccttatctcctctcggtccctgctcagggcttccatggaacaggtctcctcccaccttttacataccctgatcttcccacctcctgccttttgttcacgaggaccactctaccaggaaccctctccccacattcccatcttaagggatcttctccatccttcgtggtagccccacccactgctgctcccttcacaaggacactattccccatacaaacctgattttgcattctcttgctcaaagggtgcactgcagcctgcctccccttaggctgatctctgggtttcctaagcaccttctgccctggcttctccagaacatgagctccttggcccaggcaagtagcttggggcaggtaccacagtagttaatacaaaatatgaaggggaggactggaggactaacagcacctgctatgcagcaggaactctacacactatctcatttaaccttcacagtaaccctgtgagggcttccccgatagctctgttggtaaagaatctgcctgcaatgcaggagaccccggtttgtttcctgggtcaggaagacctgctggagaagggataggctacccactccagtattcttgggcttccctggtggctcagctggtaaagaatctgcctgcaatgcgggagacctgggtttgatccctgggttgggaagatcccctggagattgcacaaagaactctatacactatctcatttaaccttcacaataaccctgtggggttggtattatccccatttcacagatgctcagtgtgaaatgaggctcaggacagcaccaaagccttttccctcagactgggcccctcccacagagcaggcctgggatacaatgggcaaggggatgggtcagtcttaggcaactgggatggcctggattcatttctagcgatgttagcacgcacggttccaacacagcccctgagggcatcaagacctgggtcttctctggacctcagccagatgtggcccctatttcccaaaacaaggagtctgctctcctgggtcccagatccttcaagaatctaacaccggttcacatttatatgctctctgctgaaaaagctgcacttatactcaaaattgcagggagttgcagagacctggagtctgcaggctgttaagaacccctgctccaggcttccctggtggctcagtggttaaggattggacggccaatgtaggggacaccggacagatccctggtccaggaagatgccacatgccacagagccactaagcccatgaaccacaactactgaagcccgtgtgcccagagccctgctctgctacaggagtcaccacagtaagcctgtgcatcgcaatgaagaggagcctccactcaccccaactagagaaagcccgtatgcaggtg

SEQ ID NO: 26116 - DNA, 1234 bp, Bovine  19866880979375
ccctggctgagggggagacacgggcccacaatttacagaacttaggaactatcaactcaccatccttgagtgagaagctcagaagatcctgagggaaaagtaacaggaattagcgataggttgatatgtaaccagcctgctcactggacatacatttactgactcttaacaataagtgggaaaacaaggcagacaaaatacctttgccctgcatttgagtggcaaggcagaccaacaagccagcacataaccaaacaaatgcgtgagaacttcagggaatcagatgaaggagggcaagggctgttttaaatctgctctgctggcaccgagagcccgggtcaagcgtctgcctgcttcaaatgcacacggagcaggtgagtgacacacccaacggcacacagcaaagctgatgcttccgaaaagaggcaccgcagcttaacggctaggaacatgggcttctgagtcagatggcaagcttcaaatctgctgtgtgacctcgaacaagttactaaacctctctgtgcctcagtgttctcatctataaaatggggatgatcactttacctacctcataaaaatgctctgagaattaaatgagttcatatgagtaaagatgctggcatataagaagcaatgtttaagtaataaatcaatagtaaatattcgataatgataattcaacactagctacaatcatcatatcatcagatattatgatgcaatatttaacctttgaactccccccacacagctagaagtgatattcaggctgactttgagaggaagctgtctgctttccccagcagctgctacctgggcagtgggtgtacctgagtgatcaccagtgggtcatctttcaagatggggtccttcaacaaaacctcagcaaacacgtctgctccttcgcctcccagaccactggcaaaagcagtcatggtaggcaagacggcttcagacaggtccagccacttcaccaggccagccacaaagtctgtgcagaaggatctgaaagacaaacacagctgagaccctggaccatgcaactcacaagacgagacatgttaagggatgtgaagagctggcatctacaaaaaaccatggcaactgtggcccatggaatatagcgagagagccaaacctgatttcaggagagcggatctgagcttactccaccaaaactttaaccacaaagagctgataaaccataggaatgagggcaatgagcagttagtta

SEQ ID NO: 26117 - DNA, 994 bp, Bovine  19866880991597
ttcccttttgaagcctgaagcctaacccactaatgggaagtcatgcatcacacctgtttgtggacgtgtggcccctgttccgggggtgggtgcagcgtgctccctgtgatgattggtcctatcccaccctgcagcacgcagccggggacgtgcccggtggaggaggcttcgtgtatttattttcctatcacggtagcacaggaggcccagagaggaggtgacgccgagcagcagggacaaagaaaatgtgtgtgttctggcaaatttggggaattaactctgaggttgttccaaggagaaaatgatgttttgaattgggagttattatacatttgagctcactgctttttaaagaacaccttgtttacttaactgttctgtttacagatttatttatacctggctcactttgaaaaagaatgtgaaggggcaaattatttaattagatcgtgagtttcttaagggcagaaactaccctcactatctcccctcttctgacaggctaactcctgattgttgctgccctctgcccttcctagctgcattttctgcctctctatcgttgtaataatctgtctctgtgtctttgttttccagtgaactatgatgtattagacattttggtgtctcatccaactacctatccatccaacaagcaaacatgcatccgtgtgtgtgtgtgtgtgtgtgtgtgtgtgcttagtcactccgtcgtgtccgactctttgtgaccccacggactatggtccgccaggctcctctgtccgtggggattctccaggcaagaatactggagtgggttgccatgccctcctccaggggatcttcccaacccagggatcaaactcaggtctcccacatcgcaggcagactcttaaccagctgagccgccatggagttcctctctgggaattccacatggcttcccgtgaactggaagagctgcacctcctttccccaaagccccagggacttctggggccaaacgctctcc

SEQ ID NO: 26118 - DNA, 2725 bp, Bovine  19866881001702
ccccagcagagccctgctcactctttaaggccccagctcagcggccagcccctctctgcagctctccttaaaggccaggctggcagaatgaattgttccttcctctgtgactccctgtgctccattccacactctgttacagccgctcacacatttgcttatctgtcccctgggatcagcatgaatcttttcatcatggcagtcaacggtgttagaacctaaatgtttgctaaactgcgtgtgttggcttccttctctctctttgtagggacttgggaaccattcatttacacctcttttgagtatctccaggcaacatggggagtgttctgctgctctagcagcttctgtctgacttctggcagctccttcatctgggtcttgagacttgctgagcacatcagagccgcattgctttgtctttgagacgtgctctttgttcctgcatcttacctttccagtttttcttcctaaggttgtcatttctctttgtctaagggcatcggattgttgtgtcttctggctgacagggaggcacctgcgtggtccttaggatgctgacttcctggatagaacttgtgcatcttcccaaccagttagaacagcaaaatttatatctttacattaagactctagggcttagggcagatatctccagaattacccaaatcctgttggggttcttctgggtttttctctaagagtagtttcagctccacaattttattgaatcagtttggatttagtattttgccccaaccacacaataataggcccttctctctgctgctgctgctaagtcgcttcagtcgtgtccgtctctggggtcacgcatctcctgtgtcccctgcactgcaggcagattctttacttgctgagccatccgggaagctcaatcaactgttacaaaatagctacaaatagctcagatgatacagaacctgcctgcagtacaggagacctgggttcaatccctgggttgggaagatcccctggagaagagaatggcaacccaatctgaagttcttgcctggagaattccatgaaccaaaaagcctggcgggctacagttcatggggacataaagagtcagtcacaactgagcgaccaacactttcacactttccctttcttcctcccctcctagtacataggttcctttgtaatgggactctgtcagtcctcccattcagaggtggaatctgtttctccactccctgcatctagactggctctgggacttgcatcgactggtagaaaaggctgccatgggtgggtttcaggacgggagccttaagagggagatcagcttctgcctttgccccctgggaatgccaagactaacatggaaggaagccggtcaagccaagtggagggtgagttgctgcatctctcatcccgatgcagaaagagagtcgaggtgtcccagctgatggctggtaccaactcccagacctgggggtgaggccgtcttagacctccccacccagaggaccctccaactggtgatagccccatgagcaagtccaggagaaaccagtagaggaaccacacaatcaatccccagaaatatgagaaagaggaaatcgctgttgctttaagccacggtgttttgggatggctggtcaccagcaacagatacctggggactgatatctttcacatctgggattttcctcgctaagagtcccaccaggtcctgggccacggcacaggtgtggtttagaactgcaagaaaatggaacagattaggaattccctggaggtccaacggttaggcctcagcactttcacaccgtagacctgggtccaaccactggccggggaattaagatcctgtaagccttgaggtgtggccagaaagaaaccaaaaacagataaaaaattagaatacacggaagctcaggaagagcggtgggtttgtggcagaacccgaagcctcatttctcacctccccgcctgggattcttccctccagcctgtcattcagctgcttaatgtccgaaggagtaacatccctgagcgccagagcagtggtgacatccagtgatggattccaggaggaagtttgcagggtttcaggaactccagatcacaaaccaagaagccccaagtgttaggttttgggtacctggctatctccagggagggcagaatagcaggctctggaagaccaaagcacaaagggtcagaggaggcggctgaagtcagcttcaaagcattcgctcccaccgactcctgagatcctgagtttggggcacctgagtgagcaagggacatcagccctgtccctaagctcaccatggggaggcagcaggagcaacagtgtcagagccgcctgtcgtctgagccagcctgtgaacgggagccttggctgattactaccttggcaggatactgagcctaagttctaccgtctgtgaaacagaaagaccaagacccacgccacagggctgtggtgaaggtcaaatgtaaagccactggagtgacataggaggtgctgaatggacatggcatcaccatcagccctgactacctggacaggcagaccaaggaggccctgcccagggccccacgctctagagggctccacgtgtcacacacacacataaccagatgcacacaaactcatggacacagagggacgcacacagaggcacataggcacacagacacacgtgtccatgcccgcatgcacactggcagagggacacacacgcacaca

SEQ ID NO: 26119 - DNA, 767 bp, Bovine  19866881040450
ggaactctgaaactgtgtctggcagttggtctacttcctgacagtcttttccgtgtctagttctggccttttgttactatttgaatacacttatcttatctgctttcatctgttcttagatcacctttgttctgttatctcagcagttaaggccttgatggacaaattatttcagatctcaatctgaagatgttttgtatctaacatcaaagtgtaacaaggtgatcctgggtaggaaaagacttgaagatgttttaacccttggtgaggaaaaatgagaaagggatgggcctgagcttgtcggtgtttcacgcgtggtgtcatttaacgtcgagcagcatacactcgggaggtgtgatgatggggatggtaaagatggatgatgatgatgctgaagataaggaggaagggggcaggtcattaacatgatctttcccatggcacttaagtccatgaaatgtcacattgctttaactttccaaatgaaatcagtgcggctcacctgacccaggttggtgggcaatttaagtcatgttttggaggcatctcttccacctcccttggatttgtcccatagtcctcaggatttattcaggccagggcatttgggaaagaaccttggtacaccacagctgtacttcctagtggtcacttggcccatatgaaaagctgaggcttttctctctccaagccatggctgagcccacacatctttcttgaggtttctaacctctgcacctggtgttcaatctcacctccatgtacca

SEQ ID NO: 26120 - DNA, 1509 bp, Bovine  19866881160878
cgtgagctcgtgagctgcgcactgttatatgagtgtgtgtcctggactccagttctaatgatcatgcgtgagctgcacactgttatatgagtgtgtgtcctgggtgtgggggatgtagtatctgccttgccccgatgcgcctggttttgagcactgcaggaggaataaggtgcttcctgtcccaaggtgggggtggggaggagcgtgtgtagactggagatggccagcctccttgctgcctgagctgcctggatcccaccgcaggagttagggtctggagtggagggtaccataacgtgggcagtgaggttcagggcagcccgccgctcaggccggcagagcccgcagaaccgcctcgggtcagggcacagggtacaggaagtgcacaaacaaggggtcctgacctggaggacttggaatctcggcaggaagaggaccgctacaggctgatgctcagtcgcagtgacagtgagaacatagccagtaactacttccggcccaagcgggccagccagatcctcggcacggaccccatgaagagcctgggtgagcatcccgcctgcctcctgccctccagcccctccctgagcgctctggagtcacacaggccgggccaggaacccctttccctctctgagcctgtttcctccactgtaaactgaggggagctgcctcctcatgtgatcggtgagacgaggtgggggagtgcctcccatctcctgtccccctccatttcctggggggcgaggtgccaagttggatcctctatcttcctgacacacagcaggcccttagcacatggccgggccccagcctgggcttgcccaggactcggtcagttcctcaccagcttcttcagatggcaactcattcccaaagcagggcaatcaggaccacaaaagcaaaacacgattttacaagcaagagttgaaagccactttgctcttaaaactgaaaccaaagacactgagcttccaatccaataccaattaaaaagcaaatctcagatctgtcctgaggttgtttgagagacagagtgggtggaggtgaggagtaaggagaggaaagctggactgtgaagaaactcacatcccatgagtacctggcatcgtgcctatgttgcagatgagaaaaccgaggctgagagaagcagctccccaaggttaccctcccatgaagtgacggagcagggttttgcagcaggcttgtctggcttgacaccccaggctgcacagtctgaggcttgaaaattcatgcacccagaccagaccctttgggcagagatgcagtgctgggcccaaggcctcagccagagcagctctcagagcctggggtcccagggcctctggctggggtggggggaccagactctgtaccccacacacagtctttcctctccatcccccgcatcctggccaacagcgtgtctcccttctgtgcttttccgcagcacaccacagctccccaccaggcctcagctccccgctcggtggcggctctgccatccca

SEQ ID NO: 26121 - DNA, 1904 bp, Bovine  19866881230325
atagtacttcagggcgggctttccagtcaccttctcaatcatcgacttcaggtccagcaagctcccctgggacagcaggcacacctgaaagacagccatgtccccggatgaaacccaggcatgcctgctcccactttcctgcatgctcccaccctttctttcaccttggggcttggagggaccaagatgacccttttttatccttcccactcgtgagaaaggaatgagaaaattgaaggcaaacagtgtagaggaggggttagaagtctggatgtggagaatgagccactgggttcaggtcccagctctattgctaatgcagagtatcacttcatctctcagagcctcagtttcctcatctgcaaaatgggggccctacaatgaatgcctaccttttggagacaccatgagggttgaaacaaggtaaggtatgtactttccaagcacagtgacagacacatagtgagtgaccaaggaatattggggataatgaatatggtatccatatgcagtaggcagaaggcacttcctttctctcctgatgacacacccctccctccctgaaacgaatactatttgaagcaggaggcacagaatcctagaacagcgtgggacctgcagggatctctgaagccagctccctcatctcacagataggaaactgcagctcagaggggcgggtgccttgcccagggttttacagtgtgccggaggccctctccctgcacctggcctcccgctcctcctgcagtctctagggatctggaaaggcatcaacaggacagcctgtcagaggctgtgtgcttggtaatgtaagtcatgtatgggttgtaggagagacctaaagccgagctcccctacactgggctgtcacctctaggtgggaggtaggagcaggtggggtgtgcagaaaacctggacaggcctgagcagagaatgtccaggatcgtggaatggagtattgctataagagtcttgttttctgatagctttatttttctttttatttggcatcaaagtaaaatatctgcctcccacatctacaagccccatatcctccacatagcaccatctatccacatctcctcctgggatcctgccccagcctggcctgtcagcaattatcctgtgtcaaggatgaggaaacagaggctcagagaggtgaaggctctcgctgaaactgacatgttcagggcagagccaagattcagaatcaagtctccaggccctctgtgactggtctccttcccactaccttactgtccacaagttcagggctctcagagcaagcacttactacaagccaggaaccaagccagcatgaggaggcccttcatctccagggttctggaaaagaaaacacagcccatgacatgccaatcagcagaggtcctcatggcctattcagaccccgctcctggctaaggagggctgctccgtggcccactaggccccaccctctcatgctgggcagtaaacaggcaactgaagtttgaaaagatgaggcaaaaacctcaaggagctgacccaggagatctctgggaggagaaggggcacccgtggggtgttgtccccatagagatgggagagaattttcccatcagaaatgccccaaacccaattgttcctccttgaaaattgttttccaattatattttatggctgtgttggtataaaaacaaatgcaatccaggctggattcactcttctacattcatgatattatatttatttttttctcctgactttaaaagaatttaaaattgaaatattcttaggacttccctagaaatccagtgttgaagactctgagcttccagtgaaaggggcattggggtttgatccctggtcggggaactaagatcccacatcatacagtgcagccaagaaagtaaaaaaataaa

SEQ ID NO: 26122 - DNA, 910 bp, Bovine  19866881239250
attttcctgacccagggatcaaacccacgtctcttacatcccttgcactgtaggcagattctttaccagtagtgccacctaggaagcccctcatcctccacaaagtatttcttcaccttcctaagccacctgagctgtctctctcttacaatccttggacaaggagcccctatttcctgccatttggttttgtcccagttcactctttgagacccggctccatgctattttgcagctaatgttgctgttggcatattacatttgggcgatgctgtgatgtaaagatatgccaggagatgtggagtcagacaagggatcaatcttaatgttatgggtgaaatactgtgtgatcttgagcaagtcgccggacctctctgaaccgccgaggtctgcagtgtgggttcctgaaatgatgcctgtgagagtctggagtgctgaatggacaggagggggccttcctcggctcaggctctgccgtcctgtgtgctgcctggcctggtggtcctgaatgactgctgccagcttagggcacagacattcttccctattccgcatcccctttggggagcagagtttcagggctgtttccctagagaggtcttgctaagcagccttttctttctagtcccttctctccaggtgagatccaaggcagtggtgcggggtgggagggatatctcttttctcccaagaagactcatttcctctatcggttgaaggtgaacggagtccggactggcctttgagtgtttctgaggggctgtggcttccttggggactacctcctgtctgtgaaaacaggaaagcaccttggcggtgccttgatttccaccctgtgggttcccgactttaatcttcatcatgtttttctttcctgaagtgtggctttaacactctctgggggcctgtg

SEQ ID NO: 26123 - DNA, 1167 bp, Bovine  19866881316767
gcagtgactgataccgactcatgcagaagaaggtccactggcttgggagtgaggacaccccttccaggtagaaccttccctctctgacctccggggtgcccctctgccaagggagggctgtgaatcagatgatttgagagcctcttttcactctaagccagatttctaatgggagggaattgaagcctgatgacatggtgggggcaatgtttttaggttggcatttgcgtgcttttcacattacgccatatggccagaaatattcctgctagagactgccattattatctcggataagacggtaaaatgttagaaaaaaagagaatcacaaagactcattgtaatggaaaactcaaaggacagagtgttggagctgcatgcaggggccgcccgagccagacccacgctatgtccccgtgcttagcacatttctgggtgctcgagaaacaaaggcgtgagtgaaaccggagactgatgaaccctgcgacacaatctgagggccagtgttagaatcctgggcgaacagtattcacatatcagaagaggggactgagatcccaggggacgggttgtggaatcttccgggtgtttcaggagccccctgcccccggtctggctctttttgagggcgctgtggccagggaggccagggacggtccagggctgagtctggggcctctcagggaaggatgggcttacgggaaaggagttttctggcgggagagcctttggtgctaaccctcccgaggcctggggccccggcagctggaggcctcagcgggaggcagagcgcacccttagcagggcggggtgggcccagtgcacagcttgttggggtaatgggcgtatttgcggttgtaggtgcccaggttgcggcgaaagcagagcgcggccttcttgtcacactcgcaggtctgtcgctggcagctggttctgccggctggatgggatgtgggcagtcagggcccgggaaccttgggcccgccactcccagccatgtgcagggggagcgtgctggggtccacgttctctgcccggaagcccacgctcaccagggggatgctccggggggatgctccagggttgggtgagagaacgggcagggtgctgaggccctgctggggccagggatgctggaagcctggagatttgtccttgctgtccctt

SEQ ID NO: 26124 - DNA, 665 bp, Bovine  19866881509764
ttggaaaactgagatcctacatgttgtgggacaactaaacccaagcactgcaacgagagagaaaacccacacactgcagctcagacctgacgccgtttcgtcactgagctgtgtgtctgactctttgcgaccccacggactgtagcccaccagactcctctgtccatgggattctccaggcaagaatactggagtgggttgccatttccttctccaggggatcttcctgatccagggatcaaacccatgtctcctacatggcagggggattcttaactgctgagccaccagggaagtccaagacctgacttagccctaaataaatttttttctaaacaaagagattcctgggatggggtggtggtggtggtgattctaatatatcctgaagctcacaagcggtagtcctgcgggcaatcatgacgcacgggcctcaacaggaaaatcctgattcccgcactggccctccctgcccccatggcccttctatcaggcaattcaaagtctccgggcggagagttactgattaaccctaggtttcaaggaaagaaataataataactgaagggacaacgtgagccaagaaacaagctgagcagccctgggagagtggtggcagacggctcaagactagaaggaggagaaggagactcgagccagccagc

SEQ ID NO: 26125 - DNA, 767 bp, Bovine  19866881961019
gacctgcggggcggggcctgcctgggggcggggcctgagcccggcctcaccttcctctgcatcttctccagcagcttgctcttggccctcacttcctcctggatggagtcgtagacgttgagcagtacccagtccccgctgtcctcgtccgagttctgcagggccgccaccagctgcttcttgcgctcgtccgcgtaccgcttccgccgcctgtgcttctccttcaggtccttgttcttggcctgctcccccccgaccacctgctgctccaacagctgcaagctgccggcggggaggagaaagcaaacgtgacaaagtctgccgatcactgagcactggctgtccaggctgatctccccgactccttccaacaaccgcgcttcacagacaggtacactgaggcccggggaggtgactgctgttggctcggggtcagacccagcgttccttctgggcgagagtctccctccgcccagggctgccccacccacttcccggggctggtggtcctgccacagagcaagctcccggctgtgctcccagggcacctgcagatcagagtacccctaggttgtggggaatgacggtcagtgcataatgtttcatcagggacacaaacagttcttttttttttaatatttatatctaaaatgctttaaaaaattatagagttttgccttttaaaagcacaaatttgaaataactacaaaggctcaggtggaaatccttactcaactaaagcaccacagaagtgtcttggactgtgc

SEQ ID NO: 26126 - DNA, 1599 bp, Bovine  19866880482922
actgagaggggtgtgaatgtacaatattaaccagatttccaagacttggtcccagaaagcaatataaaatacccacttattaatactgtttctaattacttttgaaattatgttttagatatactggcttaactaaaatgttaaactctacttctctttttcttctacttttaaaaaatatgattactgaaaaaatgtaaattacatatatgcttgcatgtatggctcaaattatctttttattggactgctctatcctggggaataatcttttaacactagagatctccctggctagtcattgtattattctttgttgatagtgttaactccctaagcaactagaatttagtttcttctttgcttttgctttaagatataaacttaattattgaatctccttttttaaatagaaaatcaaatgatctagcctgtatgaaccaccccttttattatttaaaatgagaattttatcacaaatgccattttcacaaatacctcactatgcttctggatatcttatttttctactacttattttaatattattgttattggaagttcccattaagtagttttatttacaaatttcatttgtttgtttataatcacttgttcttccaaacatattttgattctttgtcatacttataataaaatattacattaatatattgtttgattataaattaacttaaaaatgacactgagatagagtttacatcttttggaggcttcccagttggctcagtggtaaagaatccacttgtcaatgtagaagatgcaagagaatcaaattggatccccgggtgaggaagagcctctggagtaggaaatgacaatctacaccagtattcttgcctggaaaatcccacagacagaagagtctggtggatagtggatgggggtcacaaaaaatctgacaggactgagcacatgtgtgtgcacacacacacatattacattttttaaaatattgatccaatcttctgaaagcatatatcaatttcccaagcagtaggtttagttttatatttttccttccaataattttatttcttatatttatctgattaactcctatcctttatattatagtctcttcattaaggactttttcaatttatgttgagagaaatatccaactatattagaaattagattttaatagcatattttttgctataaaatttgagggctttttttaaaaattcccattacaaactcataattggtggtttatttggacacatttacaacatttatgatttttattttataatagctttttatgttaatttacctgaatcttttaaatgctaagcatctaacatacatgggcttccttggtggctcagatggtaaaggattgggaagaacacctgcagaagggaatagggaatgacaaccagcattcttgccaggaaaatctcatggacagaggaggatgacaggctacaagcacagggtcccaaagagtcaaacatgactaagccactagtgaaagtgaagactctcagtcgtgtccaacactttgagactccatggacttccaggccaaaatactatatgctactgccaatttagaagatgcaggag

SEQ ID NO: 26127 - DNA, 2039 bp, Bovine  19866880504883
tatatggtacataacacaattcaatctatctgcccagactgttttttgaagcttctaactgataaatcaatttgtctatatcaaatgaacaggacttggttaatggataaaggttgccactatttactgatttcatagaacttaaattccaactaggtccagaattaaatttctttttatgaggtggtagggctgccacccagcttgtggtgggaccttggttcaccaactagggatcagtggaacctgggccctagcagtggaagcagtgagtcctcaccactggaccactggggaatttcccagaattaaatttcttaacagagaattctgcctgtgatctgccaaaagaggatacaatgccacactcaacagctcatgctatttgttaatacgatagggtctcagtatgaactttcattttatatctgccatggcttcctagttaaacaaatgaatattgaaatggctttacctatgcccaaagtagcagataatcaggacaaagacaaaagtaagcaaaccaattttcagaaacatgtggaacagagggatcatgaataaagcatttacatacagccagtgtttggtaaatccttgctgagtctatttattcatcaaggcttgacttacaccatgttaaaaaaaaaaaaaagttcttatgccaatgccaattatacaatgaaaaggacaaaaatacaaaatacttttaaaatcttttgaatgtgtctgattactacttcataagaacaaacacttaaaagttctgatttgtgaagtaaatctaccatgtttatacaggacaatcaaatatgatttttactaagctttcatttatacctatttcagtttctgtcaaaaataaatcagattcaattttatttggtactgtcctttacacaaaaccattctattactgtctgttaggtaaggatcatgataagggatagaagtatgagaaggttaataacaaacaaagctacaccttcattcttttattcttactgaacttttcctctatatatacaattctaaaatttatccagctcagccaataattaaaaacagaagttatctttttgaattgcaatgatagtaatttttttgtctcctaggtgaagagtgtgtggaaagacatattttttggtcatctccatgcaaataagcattgaactataattttagtttgtagtgctatattatttaccagttctgggaatacttgtaattcatgcagtagataattggagcattatcttcttttaaataccattaaaaaagaacaggtgcagcttctgagcagtaaggacaataagccaatctgtgtttggggcagtctgtctcatgtgaagaataagaatgctactgacataaagatttttaaactgtagttaatgttagcagacaaaagtttgtttcagttgcctagttagcagcctttctcgttcctttagcattttctcccaaaagtcacagaggatttacagtgaaactccatatactgtaatgaataacacagagatgatatttgcatgttatacttctcaaatcaagatagaataagagctaaataatgatagtaagaatgtgaatcagtcagttttcttagttgtctttcttttgttgtttctttttaatgatctttgtaagagaacagaggcattccttccttgataatgttaaatttgtaattattgggtgatttatcaaatcttttacaagatttttctctcaaagtgttgaaaaactattagcaaggatcatggtgtaatgaaacgtaatgttattcctttaaaatactgaagtatgtgtatagagttaagatgctgttatgcatttataatctgataaaagtatcatttttttatccaattgtatcacagccctcactattcatcttacttctccctttctcagcaaaatgtttagcacaaatatttaatgttatttacagaatcaaaaccagaacataataaaacatatttattcagagtttacaagatatagggctccattatgatctatgggttttgtggtgt

SEQ ID NO: 26128 - DNA, 1679 bp, Bovine  19866880542241
tttgtacagttcttctgtgtattcttgccacctcttcttaatatcttctgcttctgttaggtccataccatttctgtcctttattgtgcccattatacaacatggcaaagtcctccggaataccagcctactgtttgaaaaacctgaatagtacatttagtgaatcaaatcattcacaggactcaatcacacctaacaccactagttatttaggggaagtaaaagaacaaaaggggacttccctcgtggtccagaggtttaagacttcccctttcaatgcagatggtgtagatttgatccctgactggagagctaagatccccgatacctcgtggccaaaaaaccaatacagaaacaatattgtaacaaattcaataaagactctaaaaattatcagcttcaaaacaaatcttaaaacaaaaggaaactaaatttccttttaaaaaaaaagaaaaaaggaaagtcatacccaaaatatgaaataaattttattcaattatttgtgcaggtaatgtaataattttgaagatatttgtaactttcatgtagtaactctttccaattttcaacaacttgtgctgtactttttaaatgtcaggcactgtactaatcacttgatccatttcaatttcactagcattggtaataacccagtgagggttaatgaaatcaatatttcctttatcctcaacacaggtagtgtaggtatctcttctgtgtatatatttagaatattgtgagcctatttctctagttaattgggtatacattcagtgatcactggtatattcataaattattagaagggcaagagcacttggtttctttctcaagaggtagttcaggaactttggagatctataaacctccagcaagttaaattatcctacatactacccataggtactattagaacacaaatgttcaacctttatgaagaatacacatttcactaaatctgtaggcagaattgttattttacatagtctactatgtgatttgcaagaattgctgttacaacaaccaagaaagcacttgaaaggtatctgaaattatttttcacacagggctatatatttctctatctaatatgacagcatgccattcatataaacatatttatggctgtgtcagttcatatcaagcacattgggacagtgaaaaaaatgtaatctagatgaaaaagaatttcatctgattctcaagagtccccactcctctgtaatgcattagaaattatgatcagaatgatataacttggacaccatcacatctcaggaatcatccattattgtaacagaagtgcctgaagcttcttttattctaatactatccttgtaaagcacctaaataaaaggctggttagtgtaaatatagtttgggacttgctaattatgatttctggaaaaataatactggtagaacagagataagcttgacacatgtttctgtgccaaagatgaatgctgacatagatattcaaaaggagcattattatttttcagacacagtgtaactttgttctgttatcgacgtttagctttttcatgtttggctcattgcatcaccttcactttcttgttttgcaacctccttatatcttcttcagtgtaatctgaaaccagccctgttattgagatgggatgagaaggggggtgccgtgaagggaagggatatat

SEQ ID NO: 26129 - DNA, 1418 bp, Bovine  19866880813809
gtttattagtcagaggaaagactttttattccctaagttcatctttagaataagtggtaaaaatattccttccagattctgttattattgtgtatggaattttatttttacagttgtgaattttcatgttgttctgtgttcctgttgatattttaagaggaagtttggaaagactgccccaaggactgcttgttgtatgccatttaaagccagacatcctgaattatttattaacaaaagaaaaaaacttacatccaggtgctactgcatacctgctaccttgttaatgtcaatttagggctttgtcatttgactgcatatgtgtgactcatgaacacatttacaattatgtgctcaaagggatcatgatcttctacccagtttataaactcttttggcatatttcttaaataacacttagtaatattgtactcattttgatgatacttacagtgaatattctggctaatgttgcttattaattatgagacagatactgtttttttctctttgcttacacaatttaacccactgtataacactctgaaatatgcagagataagatttaaatcaatgaccatgtttttgaatctgtggttcttattgtgcttttctcagtgagtaagctcattcgtacaaatatcatgctgcatttaattcgcatctatattacaaatatatgttcagtgcttttcccaggaaggcagcttgcacatgacaatagtctggttccaaaattatccccctaaaactcctttatcttagtttggaatattttaattggagaagtttgggaaaagcagaagaattgtaagtagtagagctaccagtggaaagtatgcagtgaatactaggaagggaaaacatgataaaagaataaacaatgggattgtgatggaaaactagctaacactgcctgtattttcaaatatcttcatatgatttagaactagagctggatttttgcagcagccaaagccagtattttctcagcttgtcagtactgtcagtttttacactgtacacaggaattcatgtgtatgaatgtgaatatgtatctgtgggtgtttttgttggattttttcacccattaaaccccttggattttcccttttagtgattacaattgctatttctttttaattttcttgtgttgttataacttcctaatgtgatgagtggaaatcatctagacttggaaaatataaagctgattgtatacatggctgacactcgatccaagagtaagtaagaagttgtcatccctaggggtttccccagaggcttagaggtaaaatgtctgcctgcaaagcacaagatgcaggagcagccgtttcaatccctgggttgagaagatcccttggagaaaggcacaacaacccactccattattcttgctgggaaatccccatggacat

SEQ ID NO: 26130 - DNA, 769 bp, Bovine  19866881188922
atgttcttaattttaaaacattttagtcttacattgtggtcattacattatcattgtattttactagtatactctgcatgccttctatgtgataatctattttaatgttgattgttattatatttaaacaacttttataaaatgggtcctggtgtgttttatattaaaaatattcatattcttaattactcaatgctaagttaattgagacattttagaattccctagatcagaattaaattaaatttaatttctacaaggtggctaaaaggtcattagcattttattgtactatctactatgctatgttactcttctgccaaatcaaataccaaacaatggtgccacgcaaaaaagtcaatatatagttgcataaaatgcaaaataataagaagttataaatacataatttaaatttaatctcatctattaaaaacataaataatgaacattcaatcacattttagttgtggccatataatagctgtttaaatgtttttcttgcaaaatatacactactatatttaaaatattaagaaataaccaagaaggataatgacctactgtgtagacagggaactgtgctcaatagtctgtaaaaacctaaataggaaaaaaatttgcaaaagaaaaattacatgtgtgtgtataactgaatcactttgctgtcacgtgaaagtaacacaacattgttgactacattccaaaggggggaggagaacctcaagaacttatctcacttctgaattgtttgatggatatttctgat

SEQ ID NO: 26131 - DNA, 1088 bp, Bovine  19866881270504
attattatgactgtattgatgatatagctttttattttttcttttcagtcaaagtcacagaaagaatttctaaaatgattttttttttcttgccactactttgcagaaagcaatacagacagagaagtcaaataatacccttcagactgaggtttatttgatgtttcaaaccctggaacacctttagaattatacctataacagtgccatggcatttaatgttatgttattttttccttctttctcatctgttttaaagtaggtttatagactagcattcaaagccagttaaacagagagatgaaagtttacagagatatagaaagaaggaaaggaaggctttgttgatagcagtaatagagggaagagattgaaactagtcaaacaggactgaagggagagaaagaaaaccaatagctgaagtaaaagaaagtaatcttgagaaaataatagtactactataacagttcagttttttactgagagtgtttaaaataaacttaacattggatgttaagaagttttaagtcaggagaaagaggtttttaaaaaattgtttttgatattatattcacaaatattcagtgggacagggctctccctttctctcctgctgtttgccttcaggctatttcgctgttcattagcaccttcaccagacagtgggctggaggaaaaaatgagctgaaacaggagtcagtcaattacagttctcattaggggcgctggcaaaaaaaataatgtgtgggtgggcggagtctgaaactaacagctaaagagaggtgtggggattatccagggtattttcttgtccaaatcattctgctccctgaatatcagagataattgcatgttgactatattataatacatttccatagcaattactgacatgtttgcagaagggaaacaaagcgaaagggtgaagtaattatctaggtcagtggttctcaaatttgagctcatattggaatcatctgcagagctttatgtaaaaaggcagattgtcaggctccacctatagagtttctgatggaataggcgtgggtcggtgcccaagaacatgactttcagcaagttatcaagta

SEQ ID NO: 26132 - DNA, 775 bp, Bovine  19866881784403
tgtttttcctattttgattcggaaccttctcttatctatacacaataatttttagatatttacaattgcaccttcatattttaaaccaaggagtgttttaaaaccacatggggaagagcacaacaaaaagagccagctgttggcctttcaattaagaaaacaataagcctccacatagtgacaatgaaccaacaatccaatttcaacaaagcagtgaacaaagcaaaaactgcaacagatgctgttttcaatattatcaaacactctatatagaataaactcccttgaaaatttagcagagagatcatgccaatttttgattaattcaaatttgcctcagctctcgagagctcaagcagaaaactgacttgcccctatggtactagaactagaaacagtgatcagtgattcaaaagaaataaaactcaaatccagatggctatagggcaaaccataaacctttcaaggaaatttttaagtgaacgcattaaaaagcctttctctacatacaatgagacaactttttactgcctacccagcaaacaataactttcagcatcatctctaatgctttttgatttctgcctacttagtagaaccaacacgataccatagcagtgattctagtgggaatggttcacctacttgctccttcatttaatgcaatctcttttagcacattgcattgtgtgtatgtgtgtgtgtgtgtgtgtgtgcatgtgtacgtgtataactattaaggatctaattaaagttaaggttattcactacggag

SEQ ID NO: 26133 - DNA, 1076 bp, Bovine  19866881838216
agttctattttgatatagcttgttagaacctggggaaaattcccaagattttttaattgaaacatttgacggttcctttcaaaagcctttagggaaaacccaactaggtagaatgcctagcattaatgtatttttatggttaacagcataatggcaatgctttattacctatacttataaaccagacacaatcattattaaaatagacaacttatttctcaactaaatatctaaacatttgggcaaacacacagaaagtcagtgtgcttataagtacacatggagaaagtaaaggcttcatttcctcagcaacttgctttgtcattctctttctacattctaataaccagcaatcagcatactctacacacttattttcatttcaagtattaaaagcctagttattccagtactttagcaatgtcaataagataacatttctagaaatcataaattgtaacgtgctggcttaaaataaatggtcaaataactaattcaagtgtaaatagacattttttcctctcagagaaactagtatcattaaaatacattttgcagtgcaaattctttcaatacaaactattttagtccaaaatatttgcttgaaattccgtattaccaatatataatattagatatgtgggcttcccaggtggcactaatggtaaagaacctgcctgccaattcaggagacataagagacacaggttcaatccctgagtcaggaagatcccttggaggaggccacgacaactcactccagtattcttgcctggagaatcccatggacagtggagcctggcgggctacagtccattgggtctcagagttggacacaactgaaggcacttatcacagacaatattagatatataattaatgttttttatctaatgaacttaagttgcatttttgtttagatatatgaatgtgtttgtaaagtatggtgatgcttttatcactctgctcttgtttaaatatttcataaacatttcttataatgttaaccaatgcactgtccagcccaggtttcctgttgaggtcatgaagttatttctcagagcacaaagaaggga

SEQ ID NO: 26134 - DNA, 1569 bp, Bovine  19866880517605
tcagggggagggatgcagggagaaggggatgcagggaggaggaaggggtgcagggaggaggaacgggtgcagggaggaagagggaggccttgccggctgggaggctccttgcccatatggcccccagctgctgggtggctctctggcgagtccctcacccagatgtttgctcagcacccaggccaggctctggctggctctcaaacatcccaataacggaaaccatctcagaggaggctgtgttttcagccagtggccctggctgaggttgacaatggctctgacagtccagatagttactggacaggcaggaggcacagacagccaaggaggatcgaaggctgattctgacttccctccagacagactgtgagatgctgggagtcaccccacccttccttctggactgcacttgccacttgtaactggggaggatggtagattccacacagggggttgagcttcagaaagttgaacagaggacaagctcagctacaagtgctgtggccaagtgggagtcgtggttctccctgggtgatgggttttgtttgttttcattagttgatttacaaagttgtgttagtttctaggtgatagagttttttaaagtatttacttatttattcggctgtgccaggttttacatgcagcatgtggggtccagttccctcaccagggatggaacccaggccccctgcagtgggagtgcagagtctcagccactggaccaccagggaagttccacaggatagaatttgaagtgctgtttcttcccgtttctaattcttactttctagtatttctgacagtgagcatgtagtaaagtaaaacccaaaagtttcttttaatgatgcaaatgctaattgtgataaaaactttaacatatgtagtatgtcctagaataacaggtgtcttacttgaatttggtcaatcacaccttcttggtgtgttgatttttgtttgtttgcttttgttctttgtgcttttcttggtgtattgaaagaaagtttggaatgccagttgttagaccaatgttaatagttactgttggtggtgacacataatctaaatgaaagggcaacgtccctggtcgctgcgaccccatggactgtagcccaccaggcctcctctgcccatgggatttcccaggcaagaatactggagtgggttgccatttccttctccaggggatcttcctgacccaggaatagaacccgcgtggtgctaaagctgaaactccagtactttagccacctcatgcgaagagttgactcattggaaaagactctgatgctgggagggattgggggcaggaggagaaggggacgacagaggatgagatggctggatggcatcactgactcgatggatgtgagtctgagtgaactccgggagttggtgatagacagggaagcctggcgtgcttcgattcatggggttgcaaagagtcggacacgactgagcggctgatctgatctgatctgatctgatcttgcatcttctgcattggattctttactgctagtgccacgtgggagactctcaaactgggtaggagaaagcagagtg

SEQ ID NO: 26135 - DNA, 1796 bp, Bovine  19866880542916
gcccaggggctggagtactattttcctccgcaccagctccttgacttccttgggggatctttccctcggtcccccacagcatggatgaaggcctcacgctgcttatcctcatggcatcctgtgcttccttacatgaatctattcatgattacacattgctgagtgtgattaataaatgattgtatctttgtgtggactctgagcgcaagggcagtcgggaagcatgtatgtctgtcaagccctggtggtataacacagtgcctggcacatgggggaggattaagtatctggatcggggaagagaagggagagaaaagaaggatagaaagatgcagaagtgggcctgggaatgctccctggagggatcgttagatgcagtcatggaaagctgtcctaggacttttttggacgctgatgccctacggcagagctgcagcatctgtgcacgcagtggcacctcactgcctcagttggaatcccagctctgcctcctctggctgtgtgacccggaatgaggcacttgaacctgctaaaccccattccctcttcggtagaactgaggataatattaataccacctcataggatccttgtgagaatttaatgagacaacacatgtaaagtgcttagagcatttcaaaggactcaaatagtaccagtcactattattcttattgtaatagctgtaatggttccatattcataaatatgctggtgtatgtcttaccacagaagtaccatgtgttggccagaagaacatactggaataaagagatttcttatataaatgctagcataaatctcttgggaattctataaattcaaattctcctgtgagtactgattgtgagacacctgcagcagttcgttaggagaagttagtggaatgtgtacgtgtaggtatgtgtgtctgttctcattcatgcttcagtcaggcttctcaactcaggagctaggtgacttttttctttggtgattgtatagcagagtgagtcttaatctagaattttgttgaaatcaggaaaacgagtggacttgccgtgtgaaaatctgacttatcagtgaatgcctaacctctaaataatcttctttttgtgcccttccttttttcttctgattattttccttttctctttggagacttaggccgcttatcttcccaagaaattctgacaagatttttcagaagcatcctgaaaactgcagacagcgttttgctcttggttgtgggaagcgtggagacagctttgccagccccgcggcacccaggctctttgctgcctagggaaactggcccgtggtgaagccgtaacttgttcccttctgattctcagtcgaagtttattagcttgtgatttaagcaaaccatctggtgctgctggcactgcacactgtccgcctagagctccctacttaatgtcttagtggaggcagtttaggttacatacttgaatccctactctggtctggacttttttttttaatgtcttaaaacatgtgcttttgaaaatcgtactgtgacccgaagcacattttaaaatcgtggagaatttcttcgttgtttggtgtggtgtgtattacttcttttcttctactcagctttcattaccttcatgtctgaattcttgttcagtcgctaagttgtgacttcaaggactgcaacacgccaggctcccctgtccttcactatctcctggagcttgctcagactcatacccattgagtcggtgatgccatccaaccatgtcatcctctgtcactccctttctcctcctgccctcaatctttcccaccat

SEQ ID NO: 26136 - DNA, 1698 bp, Bovine  19866880721771
tgggccgcttccagggccgccagcccgtcctccgctgcccccctgcctctccatcccgcccacagggtcctgatctgtctccccccatcagctctgctctctgacatggaaggcagcgtgggagcccacacggtctccctcacagccagcctgtcgtgacgtgtttttgtgggttgtggggcatcttctccctgccgttcccttctcccttgctccctcccgtgcatgttgctttgagaatccagattgagttgctgttgcatttgtgattcttggcccgagtccctctagaaatcatattactactctgaattcagcgagggctggaatagctactaagaacagaatacattatcataacattcagcagacaaagccagaaaatttgtgccagaggcaagcttggtatcctgtatgggtcccacggtccatcttttgagaactttaacagcgtgggtgtctcggtgatcggttgacgcgtcgtgctacaaggccatcgccgtcagacagtcttgacttggagatgcttcaagtttaagaggtcttggaaaagttgcgggtgttccccctcccccggggttagcatctgttccttcagttcctcctccagttgtttttcgattgtctgctctgtgcaggctgctttgctcagcagccttggtatgtaaaaaagaattcattgaggaacttgctgaagcacagggggaattaaacatgtagccaactcctgagacaggagacaaaatgaatgcttcaacaacagtgttcacttccgacaaggggcgtctccatgacgaaggataagttagatgggaagcggcagtgtcggaggtaagatggtccatgtcccagggtgagggacccgcatcagagcgaaagcacagaggatgaccaggatatactagagatgaaactgggaaagtgggacgggacagatggtggctgctgtgccagagggactggactctgtttgtagggaggaaatcatttaaggtcttggaagaggaggagcaaacttaacccaagccatcttagaaggggttgagatggtgctgtgtgctcagtcccttcagttgtgttcaactctttgcaaccctgtggaccatagcccaccaggctcctgtgtccatgggattctctagttaagaatactggagtgggttaccatttccttctccagagatggttgtgaagctattgcaataagcagaagatgctaagatccaagagccggggtcaggtttgtgaccaggagatcagagaggaagaaactaaaccaaaagaaaggtggcctgaagaggatgttcacaggaattcctcaagagaggagatggccttataaacatatttttaaatgcttcgcctctgtttttggcttcactacgtagaactgcgaatgaaaacagccctgtctcattggcaaggttgcaggggaggtgggtgtgaccccaggggacccggaggatgggaaatggccacccttatgtgttgactgaaagttagcgcggctgttctgaacagtttggtgacatgtccagagctttaaaaaggtgtataccctttgatgcaggattctaagaagacagccgtagatatgcataggtttatgtttagaaaatttcaacacactaatattaatagtagtgaaaacagactacatttctaataattgaattcgtgaaataaattagaatacat

SEQ ID NO: 26137 - DNA, 949 bp, Bovine  19866880842090
ctcaatagacatgagtttgaacaaactccaggataggggtttgtgaagtgaaggacagggaagcctggcgtgctgcagagagtcggacgcaactgagcaacaacaatgtgagaaagtttggttgtcagcaacgtaaacggtgcttttaaagcagttcactgatttctgcagacttcatcattcttcatcagtgcaaacactgaagatgctgttgtcatgaaacattttattgataaacatatggaagctacgtgtttaacattcaagggtctgaggagatgtgacagttaaattcgcagccgtgatctcttcgccgtgtgtaatcattccagcatttaaattaggctccttcaagatgcacctagtaagtttccttgtagatggttgctctggtgtcagagttcgggtctcctttgttatggtgactggttatgaaatgaggcgcttgacagactgaagtgagactgctggaaatacgtcatgtctgccttcacggtgacagctggctacaaggcaaaccccaccagagcctctctgcagttgacagggacttcaaaggccaccggtgctgccacttcaaaggagggtcctgccatctctggctggttgaaagaagcagttaaatggccatacccagccgtagcagaaatctctgtgtttagacttctccttttgatcttagagagatgtatgaaatgcgtgttaagttaaaggaatgatacagtctgcagtgatggcaacccaatattattctgcatttcaatccacttgttagtggaaatcacccaaatatgttcaaataacagcaagtctaaagactcaagtgtctcagcgaacatttgaaaaagagttgaaagtgtttgaatgctgtagtcaccttcacaaatgcggaataaatcagatgtaaattaaaatgaaactctgtgtgttttaaaaactgtccttcagt

SEQ ID NO: 26138 - DNA, 4639 bp, Bovine  19866880858627
cgccggccagaggaagctgtgccaactctaccaggagcacatggcctacatcggggagggcgccaggacgggcatcagggagtgccagcatcagttccggcagcgccggtggaactgcagcacggtggacgacgcctccgtctttgggagagtcctgcagatcggtgagcggggcgggcggggcctgcgggcaaggagggcgtctccagtggcgggtggtcagctggccctgtttcccacccagcgggcaaggcctcgagctaggggtcagggtccgcattgagtctgagcacgttgagaagcccactcaccaccagtgccccagtttcagctccagggcctcctccggagctgtgggcagagaacacagaattgcagccctgactacctacggagtttcatctcttccttttggactctgggagagaggctttgggtcagattggcagtggctgtcattaacccaacccagatccagtcctggccttttcatttgaaagagaatgtgtgtgaaagtgggggatgggcagactgaaggaggaagatgggcgcccaccggccactccctgaagccctcagcctcccccccacctggattcccacatttccctctccagctcctggcccaagattctttggctgccccattgcttagatggaggtgtgatctggggtctaattgttttaggtccttttgaaatgcagtcctcccctccctggcaagaaattgagaaatccggccctattctactggctcttatccccagggccataaaagaaaggtgttagagcctcaggtcccagctcacattctcccagaacagcttcccccctaaaggcgacattctggagtccccctcggctgcgtttctggcaggcagtgggcagagcagctcaggcttctctgcctctgttgtcgagtcctacctggcccacatggagaaagtgaggttggggaagcacacttggaaccttgcttctcttttgaatatcagcttgacatctgtgaaaggaatgctcatgagttcctgtaaccctcccactgggcaactttcccaaaagaatggacctgggggtcaggcggggttcattcatagtttatccttgttcagtcactccgtcgtgtccgactctttgtgaccccatcgattgcagcacaccaggcttctctgtccttcactatctcctggagtttgctcaaactcatgttcattgagccagtgatgccatcagcttctgcatcagtccttccaatgaatattcagagctgaggtctgttaggattgagtggttggtttgatctccttgcagtccaaggcactctttatcagttcttctcaaatagtcatttcttcctggtgggtatctgggtcagccgttctccctgcccactgtatctcaggtgaggaaactagaatggcccaggtatgttgtaggccaaaatcttggctttgtctgcctaccaaagctgtataaaaaatacggagaaagagtttggaggaaataggaaggtggctttaattctcagccggcagagaggggaacacagtaggctcatacctcaagaattacgcccccacatcaatttggtcttcctcgcaaaaggtatagagagtggcaccccgtagtcactgccagggaactagtgtttctttgggaccaagtgaatgcctaacattggccagattctgttcagttcatgtagttttgtcacgtcacgtgaagaccaaaaaagtgaggctttgctttagagacgaaggtgtgtcgggaccacagtctccgtggagtgtgccagtttgcgtggggagggcttcccaggtggtactagtgataaagaacccgcctgccagtgccggagacgcaaaagacataagtttggtccctgggtcgggaagatacctggagaagggaatggctacccactccagcattcttgcctggagaagcccactgacagaggagcccggcgggctgcagtccagggggtcgcaaagagttggacacaagtgagtgatttagcacgcacgctttcaccagtgaaagcggacaccagtctctgtgccctgttctgtcacaaacggaaccctgctgttgtccttgttgtcactgtccctttctgcaccttgcctgcaggcttgtgctgcctgggaaggtgggcggaggctgggttctcatgggccctctccctatgactgttgcggaacctccccttagagccactgcaagcatccaccaccagagggcagcagagcgccccagagggcaccaggccccttacctggaggcacctaccgggtggctgggcagctgtgggacagagggcgtgatgttgtcctgctgtctccctgttgggtggagatgcaccatgtctcaggagttccatggccgctggtttatcagcctttatcctctgaattgtttcccacatgggcttccttggtgtctcagatgggtaaagaatctgcctgcagtgcaggagaaccaggagaatcccgtggacagaggagcctggtgggctacggtccacacaggtcgaaaaaagtcagacacacctgagcaactacgcacacacacagagatgtccccacactgctcctcccctccaaagtccccagttacctgctcgctgagagcagcacgaggtccgttccgaggctcccctgagactctcgtgctgccccagtagggcggggttgcctgcattccaggcccagtgatgctccaaaacaaaggaggcagagagattggaagagatgccaggtggattcaccagagggtgatctcaccagctacatggtgggctgggaccctcagagccctggtgtctgcagtaaacgctcagctgcagaaacattgtttttaaaggcagttctgagaagggtgacctcagctctgcaaagtgtgtttactaaaaaaaaaaggaaatcagacatatgtaacttggaaaagagaaaacataaaaagcatattcgttgttttcaaatactgaagggctgtcagatggaggagggattagctccagcagagggaagtgataggaagtcatctttcagcttgttctgggaaagaacattctggtgattagtgtcatttaacacagacagactgggtggccttgggaacccaacatgattctccaagtgttagtgctagatgctcagtcgtatccaaactctttgtgaccccatggtctatagcctgccaggctcctctgaccaggggattctccaggcaagaatactggagtgggttgccgttccattttctaggggatcttcccgatccagggatcagacccagggatcaaacccaggtctcctgcattgcagacagattctttaccatctcaatcagggaaggccccgattctccaaggcaggttgtaaaagcaatgctcccgacagacagagtgtaggtctggtccagcttcagatggtatctgtcctgggatgccaggtagggtgtcaaggcctgttataagaagatttctcagacatgactccctcaaagggggatccaggccccctcctcccaaagagttctttgccatcttaccatcctgggtgctgacacagtctgattccctagacccatagatcctgactctggccgaagttcacaggggctcaaatgtcagtcccaaccactggtccccgtgtggcttcctgtatcacctggctttcctggtgctgttctactccatatctgaccagaagtcggcccctgcttaaaggagcaaaactgatgtgccccgtgtgttctggtggcaaacttcactgtgtcctgcctgaccatccagaagtagggccaggtgggagatcacactggacgtagcagtgacttcagaccgcctgcctcaccacctgccaagacaaggttatgggatggccatctttgaccctggaggctcagaagagggggacatggggagcagaagagtctgcccaattaaaaaaaatttttttttaaaaaggacttccttggtgatccagtggttagggcttcacgcttccactgcagggggcacaggtttgatccctggtcagggaactaagatcctgcgtgcaatgcagtgcagccaaaaagaagaaaaaaattttttttaattttcaaaaatgttaatttttttaatgtttaaaattttttaattttttttaatttttaaaaagttgaaaattttatttaattttcaaaaagaagattctgcccagtttcctcacggaaatcaggactgaatctcagttccttgctaagaacaccttccctgtttccatgtctgggtccatacgagtatgatttattatttctcataatgattttactgaatataatgcacattccatacaacacagcattttaaagtgtacagttcagtgtatattcagcaggctgtacagccagccaggatgttgttacagccctatggagacaccgagctcctgttcgtgggcgtgctccatgtcttctccctcctccccaaaccccagacaacactcatctttctgtctgtatgaaagttcatactgtggacatttcatataaatggggccatacaatatgtagccttttgtgtctgtccaatgcaggataccaaatgtgaagtgctcacttcctgttaatacctcaaggttcatccatg

SEQ ID NO: 26139 - DNA, 2505 bp, Bovine  19866880864163
ccctgctgctaagtcgcttcagtcatgtccgactctgtgtgaccccatagacggcagccccctacctttactcaaattcacagggatattctctgtgtaagttttcttacacagtaagttttcttctagtacttttaatagtttacaattttatatctttaatgtacatagactttattgctctgtactgtgtgaagtaaagatgtaacttatttttttctcaggcaccagttgttcagactccatttattgaatgatttatccttttcttactgttttgaaatgttacttttagcatgtactatatgctcatgtataatttagattctattcttgggccaggtctgtacagttttaatcactatagctttaaaaggctttgagtccttttgagaaatcccagggttcagatgtggttttggagtccaggttttttctccacgatgtccagtgggtgttatgcagtgtcctgtaattgtgcatgtcattttctcagtgaagtgtatgaataattacactaggtgaggtacttataagtgataagtgacctcatataagatcatgccagatattgctgctaaatgagttaaagagggggaaaaaagacttattttcagagtttaaaaaaattttgcattgtaaataaaggatcatggacctatagtgtatcaatatcttgctatctaggggacatcttcctttgtttttctgtttcagattgtttctgtggcggttgtgccttactcccccatttgaattatagagttagtctgtcaggttatgtgaggagtcttgtagggattttcattgacacgtggaggagctggaggacaaacgacacatcaacagtgtttgtcttctcatctgtgaacatggataactttccttttgttcagcaaagttttagtttttacaaaaatttcatgcacatttctgttagatgcatgtcagagcatttttatggttttgctgctattgtgaacggaattgaaaagttatattttccaactgtcattgctgatggacaataaagtgtccgtgtttatgtgttggtctgtgggtgagtagtttgttgagtcttgtctttgtcagttgatgaccttggattttccagttagaaaatgatatgttgaaacattgagttttatcttcttcttgccagtctttatgccccttatttcttttttccatttgcttggtgtggtttcggtgttctgttctgagacgtgctggatgttttaggaatgatgcttactgagaagtaagttgtgctgtgaacaaatgcaccagtcagcagatgctgaaaggggaaatcctcaagtaggggcagtgaaagtgtctgcgaggggagatgtttgctcctgcaagagctaacgtgcagtactttccgttacagataatggcatgagctgtttcttctgggttggacagcgagggcctgatacttctgatgagccttaagccgacttagagccatagcacagcctcccagagttccgtgttttgctttctgctgcatacctttcccggctcctgaacccatcttgcagccatgtatggaagtgcccgctcagtggggaaggtggaaccgagcacccagagcccggggcggtcccctcgacttcctcgttcccctcgcctgggtcatcggcgaaccaacagcaccggagggagctctggaagcagcgctggaggtggcggtgggaagaccctctccatggagaacatccagtccctcaatgctgcctatgccacttctggccccatgtacctaagtgaccacgagaacgcgggttcagagacacccaagagcaccatgacccttggccgatccgggggccgtctgccttatggcgtgcggatgactgctatgggcagtagccccaacatagcgagcagcggggtcgccagtgacaccatagcgtttggggagcaccacctgcccccggtgagcatggcctccaccgttcctcactccctccgtcaggccagagataacaccatcatggatctgcagacgcagctcaaggaggtgctaagggaaaatgacctcttacgcaaggacgtggaggtcaaggagagcaagttaagttcctcgatgaacagtatcaagaccttctggagcccagagctgaagaaggagcgagccctgaggaaggatgaagcttccaaaatcaccgtctggaaggagcagtacagagttgtgcaggaggagaaccaggttagttcgcgtgtgttctggcataaatgaatcagagttcatgcaaatgaaacgatttttctcttggttcatttcttttcgtttttcctgtttttcttagtactatattttgcgcccccatttcttggccttttccagactggtcctgtgccttaatttttttctggttaccgtgtctgcttgctcatcattctttcccgttttgcttctctttctcttcctgtcttttctttcagcacatattttcttttttctgttcttgtgagaatgtacttttgccacgt

SEQ ID NO: 26140 - DNA, 980 bp, Bovine  19866881010880
ttgacagtaccggaggacggaaattaatttaaaaagttgatgatgtaaatatttattaagtaccaacagggagtagcagttctttctgttgacgtttataagaaagtataacttctgaatcttttttaaagaaaaattctttaactggtcaaatttgaggattttaggtggaagaaaagcagcttggtatgattggttatgtatgagatataaattagactttcgtagaagttgaatgttaaattgatgttattgaatttatccttgagttaactagccatcaatatacctttctgttggtgctgaaaatatgcccatcaccaagatggtttttatcatcaaccaacctgaaaaagtccatatttacgaggaaaaaaattatcagcttacttctctattttcaaataattcaggcagctaattgtgcctgtttttaaaagctgtgtggataaaaaagcaaatgacagtaacctttctaattatcaagctacattcagaggcaaaatcttcgaatctttcgaaatgactgtggtgggaacttggcacttgagtccagtggacgtgaaacagtgcacagggctctggtgccaaaaataccatatgcgctgaaggagggtgaacgccgccttatctggattccgccccttgccctaattaaacacccgtgttggcaggaacagattcttcctgcacccactataattaccacacaatcctaaaattgtatgactttgctccaaaaaacgaagggtgcaattttaaagtaaagtgaaacacagcaatgagatatagagaattgagaatgctaatgaatagattacagtgagccagtctgggccctaattaaactctgcattcatcacaccctctgcagtcctcagaggtcagagatttccactttacaaagaagattggtttaataggatttacagtaattaaacaaatttccccatttcagtttgagattggggatttagata

SEQ ID NO: 26141 - DNA, 1711 bp, Bovine  19866881163163
aatactggagtgagttgtcattcccttctccaaggggatctttacaaaccagggatcgaaccccttgtctccggcattgcaggtggattctttactgcctgagccaccagggtagccccttttgatacattaagctgggaatttatggtgaaacatgacaccatgaaggaagacagcaccttcaggtgagagtctcaggcctggttttctacacagattttgcttgttagtgagctttctctccggtccagtgtagacatgattcctgaactctacctgatgttcacctgtttccagagagaatgcatacaaatgaagaatgtgtttcacctgatctaaaatgaattgctgttcacaccacaactacggatgctcgtctgaaaagaaaaacaagcctccactgactgactttcctctaaagctgctgtgccttccttctccccatcctggtcacactttttcagacttcagtacagtactgcagtcctgatttcaagcgggcagaactaagatctgtcagcccccactcctcctctggaaaaccgtcccagaacaccaggacaacaaaatgcagagacaaaccctacctttgatgatacaaggcttatgacacacacaagtacagcacatacagagaaaacagacatgcaaattctcagcacctgaaagtcgacccaaagtgcctgctgagaaggaagcagatttacctgtagaacccaaaaagacctcaaagatgctcaagtccacagctgtggaaaggtgtatgagccaaagaagtatactgggcttgctttacaaacagtggttctcaaacaacagaaatgactactgacggaaggctgttccatgctcctgacccgtgggatctgaatctcaggggatggctttctagactttcaagactctttcaagaaagtacttgagacacactatttctacaaagaactgacttaaaagaccaacagtagatccacactcttgccaagactgcgtttttaatatgtgtatttgcttttccaaattcactaagtacatcaaaacctttcaattccattgtaaaaccaatcagctattttaaactctaaaattctgatgacactgtagatccttgtaaaatggaccatcactgcacttgaaaatatcgtggactcctgtggtgtggctctagccaacagatggtctggaaggcaagcatcttataatgtatttacaggcaaatttcctccttgccattttgatggcaagggccatcacaagacaggtgaacttgaggatcttctgctttctaaatctctgcctgtaaaaatagctggcaagctcagggatttttttgttggggatttactcaaatcctaccaaaatccctagtgaattatgtcttaaagccaatgatttgtgttggaaatctggggttggggggtaaaaacagcttagcatgagcctcaagagatgaagttaagtagtgggctcacagtaacatctgggggatggatgtgtacaaaaagatttatatggccttttctttcattttgtctttactatttcataatagtatgtcctttaggcctgcctcatgtttgacggtataatgcgaacagaacattccagaacatgaacctcccttataaagatccagtcccttcaaaataacggtctgctggttatcatcacattcttactttgggttggatcatttactgtgtcttctttt

SEQ ID NO: 26142 - DNA, 781 bp, Bovine  19866881217231
tatgcttcagatataaacatgcaggaactccatttcctccagagctgcttgctgggaggatgtggtgggggcttgtgctaagctcactgccggctgggacacctggacctgtcctcctacactgcccacaggaaccaagagactggattccacatagggctgcaccattgcaggaaagtaacccggggcagccagcgcctctgtcggcatgggaggggacaggactgcagaaggcaggcacacagaagctgcgctggaggagggggcaatgtttgagtctcctgggtactgcgatggcagtcgaggtgggaagccctgtgacagaaacgaggaagggaaattagtgcaggttgggtcatcaaatgagcaaaacagcaagacatgcaagggaaagagaaaaagaaaggcaagcacacagcaaagaaagtagcccaatctctaataatttaaagaagattttcaaatgaaatgattgactgatttcgatttagaggacaggacagtacctaactgaacttttaaactgctacttttttccgagatcattttaaataggaagaataaacataattcctccaaaaaaaaccacctactttccaggcagtccaacatgaaaatgcaaaaactcttgaagggtatcagtcatgccagtcacataacgacttgctagtattctaaatctaaaccctggaaggtttccattgataccatgttggctacccattactcctcccataaaaaaacgcagcctgatacaacctactggttgagtcataccgag

SEQ ID NO: 26143 - DNA, 1665 bp, Bovine  19866881261174
ctgcatgtctgcacctgttctgtccgctcgaccgctgcttctatttctgacctcccgggatgcactcctgttcagccttcaggaacatctgggactccccccagggtgacacaagcatcctcctgtctgcctcaccgcgtgttcaggcctcggtcaccgccctttcctggctgggtcatagtcatctgtgtacttgctgggctcaatggtcaaatccgtcgcatttcagcgctgagcacagagtaggccctcatacacgctggtgcagtgcatggaggaatgtcagaaagtgtttaaacaataggagatacactgtaaacaagcttggcttctctttggctcagtggcctgcggtagggagtctcgtgcactgagcagaagcacgtggcaggggcggggccctcccttgggcagggaccagtgtgcacgatcctgtctgatcacacatgagccccgccccctcttgggcctgaatgtgacggcgtggcctggtgggaggacacggtgagagcaccagggtgggatctcagctccacaggtcaccctctgggggccttggaccagcctctaaccttcatcttcaagaggagacatttgataacttctatactttcctaattgttaattctgatacaggaagacttcacatggaaactgactcttcttcatcatttcttttttctttttcttttttagcttcactgagctaaaatcgacacactagtaatatatttaaggggtacacctgatggcgtgttgtacacagacatcgtgaacagtttctccagcctttcggttgagttaacacacgttgtgtcacgatttcctctttttctgtatgagaacccctaagccctgctctcctagcagatttcagtgtgtgacacggtattgttgacggtggtcaccaggttgtacattacacctcagacctcattcatctcggaaatgaaagtctgtgcctttttaccccccacttccgtttctcacacctccagcccctggcagccactgtccctctctctgctgctagaatctgacttgacgtttctccctccgggtttccgtgtgtaggtgataccacgcactgtttgtctttctgggtctggctcatttcactgagcgcgatgccctccaggctcatccacatgtttgccagcgtccttccttggttgatgaaggataattctgaactcagtgcgaacaggcttgatttatttcacctgaatacgtctctcctttcagcttcagagcgagcaggagaaaggtgagcgggacaacaccgagttgcaggagtttgccaacgccgtcctgcagcaaatcgcggatcactgccccgacatcctggagcaggtggtcaacgccctggaagagtcatcctgacccctcgcgggaacagccggcccagcagcccgagcgttgaacccgggagccaggagaggaggcattcgaggaaccgggccctaggctcctggcaccagacacactacagaccctgtcccgtctcgcttaatccctccagtgaggcgccagcaccatttctcgtctgtcttctaacctgcttccttctttgggtgtcgtccccacactaactgtcctgccatcccagccaggcaagcagccgagtctccgtggagagctgccctccggccatcagcagtgaca

SEQ ID NO: 26144 - DNA, 2274 bp, Bovine  19866881261758
ggcaaaagcctctggacgggatggggagtaagagatgaaggagaggcaacagggctgcaggaccccgtccctgaagctgctgagctgcagataacccgggggactcaggagtccaagctgggtaagatgacagcacgtgcaggagacaagggaacgccactgcgtgacctcagccctgccttttaccctctcatagctgagagtggtccacagacagtctctccttagtccttctggtccatgtgtcaatccaagtacaaagaggtgtcaaaaaatgatacagggattatagagtaatgcatatttagagttatttttgataggcagctttcactcattagcccagggtgtcctgaagtggacacctggctattccttagtataattagtggaacagaagtacactccaaaagaaggctgaaattgggatcagaatctaaattagctgctgtgacttatgatctcacatctcataatgaattggctctaacatcccagagaaaaggtttgggcccctgaaaacttgcagagaatgggaagctattaggcctgcaagtgctgtccaatacagttaacatgagaactgaagagcaagtgccaagtgtactggagtataagtatgtaagtgtgttacagctgcttttacttacaactagttatctaacattaccataacttcaccgaaggggaaaaactctacataatagagaaaaaacaggcaaaccacaaaaataagagattatgatttaactatttttttgactataaatactagcatgttctttattcccatacagctaaataaaacaaaactttaatcaaggacattatcacatgacatacccaaacacctatatgaaatttacattcatcccaattgtgattatgaccactccactcattaaaaagagagaactgacctggactttactaaagagaaaacagtgtgttttcttccagctgcctaggagtttggggacatgtgagttctatgagtcaagaacaactacacatgaaggaaaccaccagacagcaatacaggcaacacaggaaaaggccacagtactaccctgtcttccaggctcaaaaagaggttctataaacatggggagtgaaggcaaggaagtgagactataggaaagtcaaactccttcacaattaattcaactcaagtagccaatattcaacagcttctacacacagatggagacagaaacacaagacaggatggccacggctgacctggtccagggcttttattccccaaagagctgctgcgactggacttgctccctttgcttttggtgggtcgcctccttctccctgcaaggggggctgctgggggaatgatgacagcaggaggaaccttgcccagtttggtgtataaagactcaatttcgtgcttctggcgactctgcaggtcctgaatctctttaagatgtctacaaaagataaccaaacaattaaaaaatagaataaccacctctgttccaaaaagaattaacatgatttcaccttcacgcacaggtttacttactaatgaatctgtccctcaaatgcacttaatctaacttctaccagcttgagattctcgtctgtcagctcttcttgctggcctctaccacccaagccaattccaaaaagctcctaagtgaagtgaagtcactcagtcgtgtccaactctttgcgaccccatggactgtagcccaccaggctcctccatccatggaattttctaggcaggagtactgaagtgggttgccatttccttctccagaaaaagctactagccaaccacaaatggctgatgatgttccagaaggatttcctgactttgaggctctatacaggatactgaactggcaactcaaatccagtttgtcaactgtgaccaagaaaacctgttcaagtattctacaccccagtgccattaccagattcattcagtaggctaagaaatggtcaagattaggttaataacgctgaagtgctagtgttaaaaaccacatgtagcagtcatgcacaggtgctgaggcagttctgtaactagggatgccctgagtccttccaagaactacatccagaggccccgctcctgtgtcacctctccagcaccaggaactgggtcctcacacagctctgccggccaccctcatgggagaaacacactcacttttcccgtagtcggcgaagctctaactttaagtcctcgtcttcaatgtctgactcattgtcgctgctcatgtaggaagagtgaaggaattgctgaggctc

SEQ ID NO: 26145 - DNA, 1435 bp, Bovine  19866881324174
tcgctgggttctgttctgacggctgcctcccaccagtgtgaaacagaaggatgaccttattctgtgagcaggacaactgtgaaaggagctgtgtatgtgaaagtctgtggaaagacagagccacctagaatgtccctcccaaaccagtcagcagaaggtcttctgcagggggctcccaacagatccctgaatgccacagcaactccaggggcttgggacccggggactctccaagccctcaagattgctcttgtcgtgctcctttccatcatcaccctggccacagtcctttccaatgcctttgtgcttaccaccatcttcctgaccaggaagctccacaccccagccaactgtctcattggctccctggccatgacggacctcttggtttccatcttggtcatgcccatcagcatcgcctataccaccacccacacctggagcttcggccaactcctgtgtgacatctggctgtcttctgacatcacatgctgcacggcctccatcctgcatctctgtgtcattgctctggacaggtactgggccatcacagatgccctggagtacagcaaacgccggactgtgggccacgcagccgccatgatcaccgtggtctgggccatctcagtctgcatctccattccacccctcttttggcggcaggccaaaactcatgaagagatgtcggactgcctggtgaacacgtctcagatctcctacaccatctactccacctgtggggccttctacatcccgtccgtgttgctcatcatcctctatggccgtatctacatggccgcccgaaaccgcatcctgaacccgccgtccctctacgggaagcgcttcaccactgcgcacctcatcacaggctctgcagggtcctcgctgtgctcgctcaaccccagccttcacgaggggcattctcattccgccggctcccctctcttttttaaccacgtgaaaatcaagcttgccgatagtgtcctggaacgcaagaggatttctgctgctcgagagaggaaagccacaaaaaccctggggatcattctgggggcctttatcgtctgctggctgcccttctttgtagcatctctggtccttcccatctgcagagactcctgctggatccacccagcactttttgactttttcacctggctaggctatctgaactccctcatcaatccaataatctatactatgtttaacgaagagtttcggcaagcgtttcagaaagttgtccgtttcaggaaaacctcttagtcttatttgatggtgactcttgatatcttttatgtcctgaaaaccaactggaaattgtcttttttatttttcctgagagttgggttagttccgatatcttggggtttggtccagttgatagaattgtctggtgttttttttttgctgttgtctgacttctgagccaccaaaa

SEQ ID NO: 26146 - DNA, 931 bp, Bovine  19866881361735
cagaactaactaacagactctcaaacaagcaaacatcttttattccgctgtagggtaagagaccagaacaagcagaagtattttcttaccagagaaacgagtttcattcaatgaagaacaagagttccacaaatccagattaaaagtttctgagacagaggggcaatctatctgcctaaagatctcactaaacaagagcactgtagtgaccagttattctcaattccgtcctgaggcagaagatgcatcttgttcacttctgaagacttcatggaaggttgaccaaagaaatggggtattatctactggtctatttgaacattctctgtatgagaagcaagagtggctaacgtaaaacatgggtagtaatgtgtgtgtgtgtgtgtgtatatatgcataggtacaaatgcacaatatatacatcaggatataattgctacaaattaaatctgaaaataaatcagtcataaaacagataccaaaataaaggggagaagcaaatgaacatatactggggaaggaacttgtgtccaacacagactttaaggcaagaacacgcatagcaactgatgattaaacacaagcgctaaattaaatggtcattccttttctcttgtgtactcacatgcagcattctataatggtttgaaggtcttacctgtgttttacacaataagacatcttacagaaaatacttagtaattctttcaagtaacttgaaaaactctccttgccccccacccccaaaccatttgtatgtctaacttacattgctttgaacagtttcaactttaaagtgctagagagcatgatctttaatcaaatgctgattagtttaaatcctgtgaacagtgtcttcacagagtaatgcatgtatcccaccctgcctgaaccactccgacggcactctataataaataacctgcctctt

SEQ ID NO: 26147 - DNA, 3338 bp, Bovine  19866881385217
cctgcagtcccctctggctccaatcattccctggaaatggtcctcggtttggagagggacttccagcacccggcgctgttaggactaggaggaaacattaagggcctaaagctgtgtacctgccctaagtgagtgggggagaaggcaggatagcatctatctccgcggggagcaaacactcagggggatttggggaaagagagtcaggaaggctccaggggagggacaggaatttcagtaaaacaaatctagaagggagggcgccactgagccccgctattaacacgttcattctccttcctctaggaagaaagacatcacagagacagtaatgcctgtattttacatatttcactgttgctcatatatagacacgcctcttgcaagagaagggggaggggatttttggccttcctggtaactgaaaaagcaatagcttgtttttaagcttttcttagtgctctatcttgcccccagcagagcccccctcttccacatgtaacagtgtggctgagctcagttactggcaggatgtcacaggatggggggcagttttcatctagaaaatgctcagaggccctgcagggacaaggacggtatcaacccactgctctggccttcagtatgtaaaatggggtttggaggttctcaaaggcaagagaaatttctcacagtgtccctgaggtttacattgcaccaagatctcagatcctagatagcctactttaaaaaaaaaaaaaaaaatccagttgtaaaatagcagtccagggacttccccatccctgccagtactcagtccttcctgaggaaggttctgtgtaggtgtgaggacgtgggaggtgatggatggaggaggcctgctccttggaggtgggatgagaactcgagagagacagaagttccccacctggagcagatggaggccagtgagagataaagtgttgtgaaaaggtatggagcctacaggatgggggcccaaagacggagagcagacggaggaagccggggagggtgtgggaagggcagatggaaggcgcagcagagataagggctggaaaaagcaaacaaacaattaagggtgatgaaatgagcagccagcagaagtgaggtcaagattcgacagacaagaccggatgagggtagatgcctggtcccctctgcctctgcaacagagtcagagaaggaaaaccttcctccctgtgacctcttgctaggaggcccaggggagtttcctctgtcacgtgcgcccactcgctaaagagaagagcagagggcccagggccccctggtccttgggagctgcagctgagatggcgaggaacgggaagcacgtctgaaaggctccactgccctccagacacagataccacggagcacaggggatgcgaagacagtggaaggcaactgggcttctttggtgtctcagacagaaaagaatctatttgcaatgcaggagaccagggttcgatccctgggttgggcagatcccctagagaagggattagcaacccactccagtgttcttgcctggagaatcccatggacagaggagcctggtgggcccacggggtcgcaatgtcagacacgactgagcaactagcacaacacctgcaggtggtatttactgggatcctgaaaaatgggtagaatttgggcatttaggagacaaggtgaaaccttaacctttttttttgtttgtttctttttatcaaccaggttagatgcccaaagactggcaaacagagaggaggtggagcagatggaagaagcttcacaaacggctggcggagccgaacagcactggtctctgagcccaggttcacaggccagagctgcggcctggactcctgactcaccacagatgggcacccacgcctggctagacagcactctgaacacggactctgcagagatgatgctgggcaatgaccaagtctaatcccgatgtcagatagtgatggtgctaagtgtacacgcgggtcctgcatcctaccaagaccagggaccccaagtcacatgagaggtggttccagtccctctgtttgacatgtgctcctatgaaacatgagttaattttttttttaatttaacatagaaacactttttaagaagtatatccatatcctattattgaatcaccagtgaaccaacattaaatttctgaatttatttctcctccagaaactgctgttcctgtttttttttccactggctcatctttggtctcgtgaagaaccttgccaggccccgaacctgggtttgacatggacctgggtgtggacagctctcccggagcaaggtctgtgtgctttcctgagaggtcagggagcagaagggtctcctgccacccagcactcgggcctcacacctctctccagggggacctggatgcacagtggacacctgaccagcaaaagacagagcttccagctgagcaagccctctagccccgacagagcagaccctgcccgggaaagaggagcaagccgtgtgcccggaggctgggggctccctgagcaggtacagcggatgggcacagagctctccagcagccgttcaggaagcctagcgacctggggcgctctgcacatacgataaagccagcttcccgaaacctacgtgttacttcccactgaaattgaggctcagaagcccttgagtcttatatgagattgatgagcctgggccttcaaagggtggccaccttctgcacttccactcaggttaaagcacacgcacaggcaagaatctcagtggtcagactcatctcttcctggaccagccggcagcgggcagcacagcccaggtacagccgatggtgtaggtgtgtgtggggtgggtagggtcctccgtctgggtgtgtatgggcttggggggtctacagtttgggtgcttgtggggagggggattacatggtcactgcatatgtcccggtggccagcaagccgcccaggtgcacagggggcagagcccaccctccaggtatgcgtgtggcggggatcgcttaccctccggcctgcctcattgttctgcaggttcatgagcacgcggccctgttcctctgagcccttggcgaagttcttctccctttcgcgggcgtccacgaactccttggcgaagcggtagccgtagtccacgttgtcgccgcagccgccccacagccagtcccggggcaggtccttgggccgtgcggcccggctgcagccgcaggtggacagctcgccctcacggcaggcacggctgatggcattcaccaccccagccgcgctcacggcgtaggtgaaggctgtctcccggctaccctgcggacagaggggcagacagacaaggggagaggt

SEQ ID NO: 26148 - DNA, 682 bp, Bovine  19866881636281
aaaatgaatccagcttctacctaatacagagtccaagacagaaaaaaaagaatcagctgtaccaggagcctacaacagagaccctgtctggccaccgatcctgccaagtcccccaggaattaaacgctccccttttctgggttaagtgggtcattagctctgcagagccgtcaggcacctccccataaaccacagcacacttgtgacaagacaccccctgggagtggctgcgatggggagaagtggggcgggccctctgccacgggacaatggatcgggggagggcgatgctgggaaaacaaacccacccagaagtcactgaaccacagcagcgggaggagactgaacgtgggctaccccagacccaaagggaaaagcaggagcggaccagaagctgctcacaaagtgcttttcagcgaaagcatacggacgcattgtgtccagcggccctggcagccgtcccagaagtgcagatggtgggataaagatgcaggtccgccgcccaacattttcttctgccacggctattgtcaccgatgcaggcaggactcatttgtcaagggctcctctcagctttcttttcaagggtccccagattgtgtctttattcggcaggaaccactgcaggtgcaagcaagagcttccgcaccatcagctcatattacgactgccggactcctcc

SEQ ID NO: 26149 - DNA, 1572 bp, Bovine  19866880424694
cactgagttggtgatgccatccaaccatctcatattctgtcatccccttctcctcctgccttcaatcttttctgacatcagggtcttttccaatgagtcagttcttcgcatcaggtggtcaaagtattggagcttcagcttcagcatcagtccttccaatgaatattcaggactgatctcctttaggatggactggttggatctccttgcagtccaggggactctcacgagtcttctccaacaccacagttcaaaagcatcaattcttcggcactcagatttctttatagtccaactctcacatccatacatgaccactggaaaaaccatagccttgactagacggacctttgttggcaaagtaatgtctctgctttttaatatgctgtcaaggttggtcataactttctgtatctaactgtagaaaacaacttttagaaaagcatgaagaaaatacattaaacaatcattgctttgatctactttgcttcagataaaacaggcaacctggatcaatcccagaaaataacaccctgaactcggcatacatattccctacagtcctgtacaccttttttttttcctgaaggaggagaggatggtggaagattctgtgctcacaattaagtgaattacttgctggctcatctctaactttaattactttctcttcctcaactttgcaattagctgatgttgctacaaatttttgtcacatacttaatctttatatagcgtttttggccagagcacagtccaaggctgtgagctatgctgatatctttatccagaggtaaggctcacgggccacgttatctgccgagctgtacccttgcagggcgggtacctgtggcgggcagggaagtctcagcttcagtgttcagcccctgtccacacctgccaggggcacagtgcctgtgaccgcacacgtctttacctctctccccatgcgatttgtgcaagatttgttctgcaccaggagctttgtaaaccctatgcctcttaatcctctgcagacataggtgcccacagggttctacccagttgacagataatataactgaatctcagaaaatttatactactcatctcactggagaggcggccaggagtttgcctcgtcccaaactttgctctccactatgtccgttgcatgctgatggaaatcactgcagtgctgtagagtcagatggtgtggaaggaaggagaaaatgtgcccattttaggggggaggtgtttatcaggcagggctctggggtgggaattagcaagctgtaatgagagaagagccagacaggtactgtgcacttactggtgaaagggcaagaggtgaattggaattttcaagttttaaatttagggaagttggaaggggtgggaaggcctcttaagtagatgtccctgaacttgatttcatgtgaaatctgaaagatatcctcatttgaaggatttagatatgttgtttcaggtgtcaaacctgacttccaagggtcctgtaggcattttgacacatgtaattcgtgaggaatcagagcaaaagatgtagaattaggagttacacacaggtcctca

SEQ ID NO: 26150 - DNA, 1241 bp, Bovine  19866880543256
gcaggaagagaaggggacaacagaggatgagatggttggatggtatcaccaactcgatggacatgagtttgagcaaactctgggagttggtgatggaaagggaagcctggcgtgctgcagtccataggattaccaagagtccaacatgacttagcagctggacaacaacttttatttttaaagttgtagttagtaacctattctagcaaactaaaatagttgttaaaattaccagcaccttataattttagagcaggaatgacatcagagattatttattcctacatcttaattttaactctaaagaaaccaagagccagaaaatgtgatgacctaagatcacacagttaatttactccaggggtgaaaaggacactttggatgtattcaggtgatcacacattcttcaagtgggaagagaggagactttcacttttaaaacatttaaagcaaattattatcaagaatagaataaattcatctacacaaggaaaagtagtaggagactcttcctattaaccatcagaagagaaacattcaggatctgtttagtgcttattttattacctccgccagtagacagaacaactaagaagtgtagccctctgaagtttaaagtctataaggatggctaataaaaactttgaagttgtacagaactttacagttcttaaagcttccatgctgctatgatttagcatagcctccaaggatgcatgtgaagtgggctggcagtaactaggtccccctgatttgcctgtgagtagagcacttgcccagatccacaaagcaatatctcatgggagagatccatagaacccagtgctagcccagggccccaacagcacaccccacccacaaataacaccggggtgggcagaagggaagagaatgaacgtctggcagctaaaatcagggcagaaaacatgctgatcagcagcacaggatatttgggatgaagtatactggtatctgggcttcccaggtggctcagcagtattagtatgccaaggaggagatgcaggagacacgtgttcaatccctaggtcaggaagatcccctggaggagggcatggcaacctactccagtattcttgcctgaagaattccatgaacacaggagctttgtgggttatagtccatggggttgcaaagagttggacatggctgagtgactaacaacaaaaaaatatggtctttatacacatacataaataaaagaaatggcaccataacaacac

SEQ ID NO: 26151 - DNA, 959 bp, Bovine  19866880879563
tgactgagctgacttagcagcagcagcagcagcagcaggcaggcaggttttaagcaggtagggagatactttcagtatagattttggtggagtcttaagggtcttcattaaacatctgccaaattaatgaaaagttggtgtctagtgctatcagggaaaaccgaaggcttccaactgagaggataaatgcctgtaaatgggtaagggttaaggagaaaaggaaccaatgcctccatgggcattcaaattattccaagtttctggagaaagtgactgctgaggggccataaatctcttcactgtgccactaattgctcctggggagagtgtgtctcacacaggctgggaaagcttgaggggataagatgattctctctggaattctccaaaagctgggttgttgatgaattctaaaggggtctgtgtaccagtaaacagacccctttgggccatctggtgctaaacatccataattaaaagtctgaatttgcaagacttccattcatcagatagcaccaatcaaagtgatactatggaactttaaactttcagatgacaggttagtgagaaagggaaattatgtttattacccactccgcatcaaggttcagggcctcttatttaaggcatcgatttccatggaaacagcctgtgaggtggagtatgcttattagaatgatttcttgtaacaaccctcagtcctctcaaggcacttgcaaccagcggaagtgtttaaaatcttaatctctacaattagattaacatttgttaaaagcaccgagcctccaacagatacatggggaaaattcacgaggagacaatgaacacatctcattcattcactggctactgactgagtgtccctcagcttctaggcactgagcccaactctggaggcaaaaagaaaaataagacgcagattctgcccaccagccccttatatataatattctaacaaa

SEQ ID NO: 26152 - DNA, 1326 bp, Bovine  19866880973308
tcaataacaaaggcatcttgggctaagaaatcctgaacatttcccactagaccactcttccctaacaccccttcacatatgtcttgcatgtaactcttagttataggatcacttgaacttcaagggcacagggcacttaggaaccacagaggaagaggaatccccacctggtctctgtgtctgctatgtcagctctcctctctgaccccacagaccaccttactacctttaaggagaacaccaaaatcatttagcaataaatttcctccctacctctgcacattttctcattatgggtactagcttccatcctcttctttctgactgcctcagggcacgacggagcttgtacggattccgaatttgaccacacatcctaagcctcgctacaaaggctgcaaatgttttgatggtggttaagaatttgtcaaagtcccagcctattatactcggggggagcagggaagcccaccagttggcaggaagagagatttttttttcatgctggcaccacaatccaaaaagaatatctccaggccacattctgtgagactccagaacttctagtaaatgatcaaagacacagactattggcttagaatgggtgctgcagctgataaacaagccaacagcagcctctgccagcctcgtgaatcagcaagtgtgctggactgagacaagcagagtgctttccgaaataactttaaccaaataattattttactgtttgccttcttgattcagcccaagggtgtcttgctcgggaaagggttatgatcattgttttgatgaatggcactctgtaaataaatttggaataagatttagcctcgtggagctaaaaggagactcaagatgaaaaagaattgaagattaaaaaaagatcatgagggaatgaagatgctgtgacctgaccaagaaggaaaataagaaatctctgaagcttttccacgatacttgcacagcacaactagtacatttaatcttctaaagctaaataatcaagttatctgttcctcagaatcccctagtgtgatatagcttccagctaccttagttttgagggaataagcccggcatataggtattattcttttccaagttgattttactttgctctttatactgtaattctatgctttgatcttctgcacacccataaagctcagagtcaaaacgcaaaatttaagtacaaatgatgagcgcaaatttccattttattatgggtttttcccttaattcttctaataaattttcttaagcttctgtattttcagtatctttcatttatgatcaagctaaacattacccacattaaataaacat

SEQ ID NO: 26153 - DNA, 609 bp, Bovine  19866881018693
ataagcgattccttccctcaaggatctgacagctccaaaacacagacagcaaaaggtaaaaggaaaaacaggcgaggaaggggaaatgatagccgccccccgccgccaccccagggcccagacaactagggatgaagccagaacaagaagtcagggctcctgattcaccctcaacatttccctctgtgatccacggccccttcatgccaacagagctaattaccaagtgtggtaattacattcttcctccctaaattttcaattatacgagatgccgttccttcaagtcaagttcttgctgatcataaataaagctcttgcagatgatgaataaaactctcgataacctagacctgaagtgagatgcaatcgcatcctcttgtgactccgagagagccctggagggtctggtgagttctcgtgggtctccacagccaggctgcgtctgtgaatttccgggaccagggctttcccactggggaccccttccctagggtgccttctgaataaatctacaacttagttttgtttttatttgattggtttagttttgattgccatcatttaggggattccgagggtaaagaagccacctgccaatacaggaga

SEQ ID NO: 26154 - DNA, 1193 bp, Bovine  19866881118831
ttgcttacatattcattagttgatacaaactcacattttaaaataattgaccaactattcaggaagtacctactataagccaagttatgcgaagtgctggggttcagtgttgaatgttaaacagtgtagatatagtctctgctctgatggagcttaaggtttaatgagggagggaaacagtaacacacacacacacagatacactgataaggttgtgaagaaaaacagcaaggtacagtagatgaagtggtgggggcagaggtctccttaggaaaaggactgtgtctggagtggaggacagagcccctgagcaaagggtttcaccagggttctcaggagggatgaggagcatggaacagtctagaaactgagagagcccaccatagttttagggtagagactgtgtgggaactggtgccagtgaggtcagagatgtaataagaattttaagatgcagaaatttagagaatgttagaaacctgagattcctatatctcctttagagcagctgtaatgagatcagattaggggacacagtggcagatttggttaaactgaagtcgcatgaaggagttggatgtgatgtgactccagaaggtggcaatgaccgtagagaagatggacaggtgttaatggagaggatctgggatgggaggtgggagagggtgactcagagaagaaatgcttgacagtggagcagagttaaaatgaagctaaaaatcaaagctttacgaatgaatgctatttactgcaaagctgcccaataaaagagtaatgaccttcttgttgaagttgggaaatagaaagcaattctttttcttattgagatttcatgtaagtgggaaaaggttgcacagactataaggaaatatcaggacactgcagtcaattctgatactttcaacaacaaaattctattctctgctgccatttctattttgggatctaattaattataaacatagataccagattgaactcacatgtaggcagcttaagaaataaaatatgacaggcagaataggacactgcaattataatctacctttcaaagcactttgaggatgaaagtcaagtgatttctgtctcaggaaggtttgaaaagttatttggaagcaaatcttaaaaactttccatctaaaataaggatacattcagcccatttatttacataatttaaaatatacaaaaca

SEQ ID NO: 26155 - DNA, 1571 bp, Bovine  19866881172417
tgattcctggtttcggaagatcccctggaggagggtacggcaacccactccagtattcttgcctggagaatcccatggacagatgagcctggtgggctacagtccatggttttgcagagtcagacatgactgagcgactgagcataggtgcatactggagcttagagacagggtcaggattggagataaacatttgtgtcactcatataaaagtgataaagttatctggagagagagagtccagtgaataagaagccaaggatatggtagggggaaaaaaaggctgagaaatggcagtcatgattgctaaggtttttggtagctctaaaattcagcagttctctggactagaataaaagcatgtatggtctagctgcatgaagctcttttgcaaagtgagccatctcctgtgtgtcgattttccgagcggtccagcgacagtttctttcatcctagcagtcagctcccggcgtgtctgttgtgtgtcagcagtttgtcccacttgtgctcaatctgatgctgaagcagctcacagaggcaaattgcagcagtgtggccccgtggctgctgggctgattgtcctctgtcaccacattgcgggtgaatttgtctatttgctcttaagtttgggtcgtagagaactctgacaaaacagtctccaaactgaatttgacatagtgtggattttgcatctgcttggttggatactttccctgacctgatttagaatgctgagtcaggacactcttcttcctaacctcccaaaggatgtggcaccctggattgtgtttatttaatcaataatagtagaaacccagttgatagagaaggtccaaggtggtctctgccaatgaagaatttatatgcacaaatatgttttgatttggtaaatcattcttctgctgctaagtcacttcagtcgtgtccgactctatgtgaccccatagacggcagcccaccaggctccgccgtccctgggattctccaggcaagaacactgtgggttgccatttccttctccagtgcgtgaaagtgaaaagtgaaagtgaagtcggtcagttgtgtctgactcttcgagaccccatgaattatagcccaccaggctcctctgtccatgggattctccaggcaagaatactggagtgggttgtcatgccctcttccaagggctcttctggacccagggatcaaacccaagtttcttatgtctcctgcattgcaggcagattctttgcctctagcgccacctggtaagccccttagtctgcattctcatcctaattaggtgagacaaggacagctgtagcaccctagttctcaggctttcccagaagtaaacatatatggactcaagtagcttttcaatcaattgtgatcttaactttacaagcaattatcaagtcttcgcacatacatgtgtatatatagacatatatttccattgcttgaacatgttaaacatcccggaaaatacaaatttttttctgactagaaaaattttctgattagaatttcataaattctaatcctatgaatttttcctaaggaagatgcataagaacatatctata

SEQ ID NO: 26156 - DNA, 1591 bp, Bovine  19866880391359
attttatctgttaaaaaaaaaatgtaacatgaatatatttaacatctacctcagcaaacaaattaatgctaattaaatattaatgtgttgtaattagcattaaaaatgcaattaaattgtgagtaaatggaccaggaatagaaaattgtttgatgtctcaccgtctggcttttcatattctgccttttgtttttgcagcaaatagaggaagcggggcggcaggcagctcccagactggcgatgctttggggaaagcacttgcttcggtgaggaaatgttgaccttggacttcagatgtaccgcggcagacgggtgaactttaatcagaagtggacatttagaactttagaaaatggatggcaaatagctttgatttttggaaagactagcttccttgcataataatcattgaaaaaattgaagagagaacgctgaagattccagcggatggctggtctctcccatcttgcaagcgatactcaattatggatttgtggatattcttagggcctttaagagtatagattttctatcctgatgtcttatttttctctaaagtcatcggggggctcgttgattgaccagctaagactgactttgccaaagggtagttgtaaaacattttgaaaaagaaacttttaacaaatgaccataaccgaggttcaattgttgcttcattagcacttggcttctctgctttaagctaagatccagcatttcttccatattcaccaatgaccagtggtacccctttcttgtctgagggagtgtacctggtattgtcttcaaaagctaaacgtgatcatttgtaaatataagcagagatctgttgctctgacgtttagtctcttcagttggattctccttatcattggggcatttgatttatggtagccttgtgagctaaggaaaagtttttctttagactgagcgtccttctgcctcggaatcaaataccttaaatgtaatgaagaaggagttgagcaaaaatcttaggatgtaatgctgcccgacctcttgttttatggaggaagaaagggaggtttggtgtatctgtgtagcttcatggccatgcagccagaggaggaaacgggaagaaatggacagagccaaggtctgctgacctcagttcagtttcccccccactatcttcgagcagctcaagaactcttcttttgaaaaagtaattaagtttttcattttagaatatcggtactgtagttgattgttaagtgtattttgcaccttggaatttgtggatgaatcacattaatgctttgtagtttaaattgtggcatatttattcccgatgaatgaggatttgttgttgttgtttttctccccactgttttaagatctattctccagatcacactaacaacagcttttcatcaaacccttcaactcctgttggctctcctccatctctctcaggtacggtaccgtaaacccactgcatctgagtgtcagcttatagaacggtttcccctttacgcttcctgtgctgctgggggaaactcactccctccaaaaactcaaaacagagtgtttccgaacagaccaataggaagagggggagagacagacacag

SEQ ID NO: 26157 - DNA, 2516 bp, Bovine  19866880471174
tcgtccctccccctgacactaataatctcctttctgactctagacttgcctattctagagatttcctaaacgtggaatcccacagtatgtggtagtcctttctgatgggcttttatcatttagcatagtgctttcaaggtttatatatgttttgtcctttatcagagcatcattcagtttttattccccccaaattccattgtttggaaaagaccctgatgctgggagggattgggggcaggaggagaaggggacaacagaggacgagatggctggatggcatcaccgactcaatggacatgagtttgagtgaactctgggagttggtgatggacagggaggcctggcgtgctgcagttcatggggtcgcaaagagtcggacacaagtgagctactgaactgaactgaactgagattccattgtatagatatacattaaatgtgcccattcatcaggcgatgggtatttgggttacttcagtcttcggctattaggaacaacgctcctgtgaacattagtgtacaggttttttgtgtggatacatcgtttcatttcacttacgtataaacctaggagatccattgcttaggtccctgccggtatgttcagttcttcgcagtgacttcagctaaaggacccaaagtaggttcatgttacgttgcttgggtttcgcatgtgaattggttgggtttattatttttgtttaagaagtcaaatcagtatcttgtgctcctgagtatggtggtttacaacgcatagggtcacgaagagtcaggtgggactgaaacggcttcgtgcgcgtgggaggtcgagatgcacggtgtgtctgtctcagtagatgatgtgggaccgtgggattacgtgtatcgtagttgtaccactccctattgatgaaaaagtatttgagtaaggtttaagcagatttgtccacattgtacttgaaattgcagtttttcccattacttctggaaggggacttgagagtgtatccctttttcaggtgattataagattcagcaaatctccctaataaagtgttaaatgatgacaatatgaggtgaccacatgggtgaagaacttacatgaggtagcagttagtgactctgtgtaattctgctcttcacagatgcctgtctttccagcaaacaccttagtgtcctgttttgttcctcacaggctctcaaaaagttgtgtgtatgaaggtctgttttccattatcactaagcatctcttatttaaagacgattccaaaaggagaatgcaaaataagcacaggttattctgaggctctttaagttgtcttcttcagaagtattcctctgccctcttttccatttctcttaataaaagattaagagtcccatcctgagctgtatattatgaaaacctgcaaccaatttgaaaccaaaaatactggtttataaatagaagcaatgaactcacttctaaaacgtggaaagatatttttgaatgccaaagctaaatcttttttttttttttttttgcttttcctagactctagcctcagaattcctcattgagtaaaaattgtttgtctattcgtggcagttgctaagagtttaacaaaaggaaaatctagattttaatttagcttggcctcaggtaacatgctaaatacactggggatgcatattatatgaggtttcagtttgtacagctctttctttaaactataatgtttaaacaatactgcttttaattaagaaatctggctttattaaaagccagatctgtgacttataaccatttctgtatatctgctctcaatcaagagaaaaatagtttaatttctgtagctgtgttcgttttgcatatgttaaacggatgcagcatgcacccagggcattccttcagagacagttttttttcttttttccataaatatgtaaagtttgctcttaaataccagatgtaggttaagtggttctttaaaataataaattctacagagatgcttttttggaaccatttgacctttgaattgcctcctctttgatttggaggtgggatatgaggaggagaccagagtcatctttggggatgggaagttagaccaacccagggggaggagaaggggagagaatgctgcacagcaatagaaaaggggaaataaccggccagagttacacaggagcatctttgctttgattttgaaggtggggaaaaaagatggcaaagcaataaaattgctagtttcagtgatgaggggaggtgcacactcactcttgaagacgtttagaattcaatcaagagtgactgcggagccatctacatccatagcgcagttcccaaaccacggccggaaaacctgctgccctgtgagccaaggacacctttacagtctgtctccttttttgtcaaaaatattcagggcgcccccggcgtctgagctcctcagcccagagccccaacgtgcgcgcagaagatctcatcttcgtttcttgccttgtgcaaaccggtatgaattttcaaacaaaagcatcagaacaaagga

SEQ ID NO: 26158 - DNA, 944 bp, Bovine  19866880543654
ctggagtgggtatcctatcccttttccaagggatcttcccgacccaggaatcgacctggggtctctgacattgcaggcggattctttaccagctgagctaccagagaagcccaaagggattgcaaaagaacgtaaaggagatgttcacttcggaagattactttggtatttctggggggcacgtgccacgcttgttttaccgcacagtccaacctctgtgctgtttctgaccttttttggtctgcatcaatattttcatcaaagatcataaaatccatgagaagaggaaactgttttaatcctttgccactctaagttgttaatatcatggcaaataaaaggaagggcaggcaatgaatttttttgaatcatgcatatgaatctctcttaaattctttatcctttgtcaggaaaccagcaagttaaaatagaacattcaaaatttaaataaataagagcccaagactaggaaatagacaatcctagagtgtaatagttaacactgttttgctcttatgaaacaaagataactaattcaaacatgtgaataaaaaaatattattttaaaacaagaagtcattaatttgagttttttttcttttaatgatgactgtagccagtgcatttttttttttttgaaataccaagattcttaattatcatttgaggagaacatacaaatctcaaagattcctgcttcaaatttagacagtgaggacagtaaatatgacaccatgtcgccacctagtggacatttcagaaagtgtctagacatccaggtttctgttgtcatgattatacttaggatcacaaaacccaggactcaggggaacttttcacgctgccctaaacagggctcttgtttcacgggatagtcataggtgcaatttgcattgcattacagtgcaaaccacctacatttgcattgtaaaatcaagtgtcaa

SEQ ID NO: 26159 - DNA, 2208 bp, Bovine  19866880606138
gaaagcctattggactgaaggagtggttttcagtgttgattgtatggggggattacctgggagatttacaacctactgatgcctgggtcctacacccgaagtttctgtttcatttggttgcattcagtgttctggaggtctcagaacttcacaggtgatactaatgtgcagtgaagatgaagacccactgaactaaggaaagccaagacaagatatgaactttgcaccttctcatccctcagcatctacatggaataatgatgaaaaatgaagcaaaattcttcctacatgaatcatttcactgtgatatttcaagagttaagtgcctaaatctcaccaggaaaggtatttcgaatgtgacaaactggtgatgaaggtgttccttgtataatggagataaattgaatatgcattccaaacaagtgcccgcatttatcagggccaagtacaagactcagaaaaactcctttctgtacaatactttataagtcacgaagcacaaccctgaaactcaatatcatgatgacaacaagcactggaataaaaatattgctgtggctggacaagtatgtagaaattattgggagtttttcccaaacaaactcctactttctcaagttgttaggttccaaaaaatacagaagtataagtgttatcatcttagacattttcacatatttcaacttctgtggtgatttatttcatcaaatagaattaggtctttaatttttattcatggactttcatatgctttaattatatcattagtttacaaaattataaattaatggccagagtaagtccaccattattgaatctacccaaggatagttcactgatacagttttccaaaagaactgaatttttgcatacttaaactgctagaaaaacagtcttggaagcaaattaaattttagggatggtggtgattacataaagtaggatactcttcaaagtctagaaaatggagtaatttctgaagatgcatctccatatgagcaggtcattagtgaagacgttagaaatgcttgaaatgtaagataaatttcagagctgtaaattaagatgatgaagatacgccaagtagaaagaaaagtaagtaattttggcagagttaagcagaaatttcctggtgagacttaaaagaggtttaaaatcctcaaagattgaaaagaaaaaagagagcagatttagatgagtgaatttttattccccttgtggagggaaaaaaaaaaaaaaaaaatccctgctaggttagaaaaaaagtatttgttttcatgattcaaaactctagaaaatagaaaaaaaattaatgtaatagctgtgacaatggcccaaatacatataaatgaccctgaaaatttaacattataactattcatttctaaatatatatgctaagtgtatagaaataaatatcatttctaaatttatatacctatgtatatattttgcacatacacacacttatttgatcacgcagataagtagatagtgggggaagaaaagcttgtgcttcaagccaggaagacttgaatgcagctgagtcattttgaacaagtgtcttaatttctccaaatctcagtttactcccttagggaatgtagtaattaataactttcacccaaagtagctttgaggattaaacaaaatgaaatatgcagcatgccttcaaagagacacgtgtgttgattatggatgagaaaaagatgctgtctatgtggtttagaaagttgacatctttaaaagggttgttcagctctggtgatcaatttttcataaacagaatcagctcacactgttatttcaaaataggtcatggtcttaagtttgtaatgcaagtacacccctgcacatgtcactccagtttaagaccttcttaacaaagtactgaccagggctagactagaaacaggctcattccagatcaagcactcactcaattcaggtacctagttcaagagcacaggctcagagatgccctttctgactcccatcactttgtaactgtcacactgttttgctcttcttgggagcagttacccctccctaattaagctgtgcattgatttgttcatgtatttattggacacatcttcaattaaaataaagctagatgaggtcaggacagtctgtcctgtttatgccatatatttacctcttggaacatttcctggtacatcataaacacacaaaactatttgctga

SEQ ID NO: 26160 - DNA, 1501 bp, Bovine  19866880623968
ttgatgaagtggatttttgtcactgcagtttaagttggtttttaaacccccccccccctttttaggtataagctatcagcatttattgaaaagttttataccaatccatgtatatctatttactaactcaaccactaaccattaacttatgaattaaatgtcttgtttatagtgactcctactggagaccaaaaaaagtccagttgtttagcttctgaataacttaaattcagtaatacctcctgtcttcagtgaataggtacagcccagatactgacttggcaaaatttatcattcatttatgtttaattatgagaacatagattctgatactgatttcatcaacagaaaatgttttttaagtacctaactgtgcacacatgcttctcacacctagtaatgtgatttgattgcttagtagtaaagagtttagcatggtcctatattttaaaaatttttttgtccatattagttgacttctgagactgcctgttttgggtggagactgtttggtcactgctctttaaggaactctagcacagaggaaagagtagaggaagaacaagggaatccactctcatttataacaggccccgatacactgagcgagctgtccctcatttatgcctcaaaagaagctctgtgttaagaggaagaaactaaaactcagactcgtgatatgacctggcccctgccacactgctgcaggggagcaaggcagtgattcttatacagacgtgtctggccctcaagtttaagtcctggggattttatagctttatgatctatgaaatgtcatcccagactgtgccttaattctgtctttaaagtaggaatggtgtgatacctgtcacagggaactagtcataaagatgaaactagtgcagagtaggtacttggatgctatttaaattgtttatcagtatacatgtattgggcttccttgatggctcagacggtaaagaatcctcctacaatgcaggagacctggcttcaatccctgggttgggaaaatcccctggaggagggcatggcaacccactccagtataaaaaattttccaaaataaaataagttataatatttttataatgatgacatgttgaagggtcttcccaggtggagctagtggtgaagaaccacccgccaatgcaagagatgtaagagatgcaagttcagtccctgggttgggaagattccctggagaagggcatagcaacccactctggtattcttgcctggagaatcccatagacagaggagcctagcaggctacagtccttggagtcgcagagtcagacatgactgagtgagcgagcactgcacatagatgtgttagttgtcttatcaggtttttgatggggtagatatttacctaaaggtggtcattttctttataggtttgcttgttcccgtggtattatgtaatcctgtatgttgatgaatatctctattatccttgggatattatgtttagctaattcagctatactaggcaaaa

SEQ ID NO: 26161 - DNA, 2252 bp, Bovine  19866880643921
cttaagccacatagtttgtggcgcttgttccagcagcctaggatatcagtgcaggcccccttattaagcatgaaatcagacatgggctgagagtgggctggcgggcagtgaagcagctcttgggagcagggttcgacagtggggctgtgatggagaggtttgagaagctggcatgtgtccgactttccatggacatgaccccaccactgccctggactgttccttccaagtacccccttcatccggcatgctgtctcagccctgcagggtagcagtgatgggagagagaccaagagagcaagatctccaggtcacatacacacagacgagataagatgactgactctctttaaatgtcaccggggaagctgaagattttaattccctacgggatgatatactaggattccaagtataccagttattctaaaaataaatgtagacatgtgaaggaaataaattaacaaaatagccaagtttttgtgtgaagactgctgttttcctgccttagaaatcttgcttcctcagtaaataaaaccttcgattctccaataggctgacccttgtgatgatgaacaagacaatccaaattctgtgtcaaagccccttactttcttcctctcttccctcttttcttttccactctaattcttaatagcttcttcctaaaaatgggataatgcatgtcttaatatgtgatgtttagtgaatagatatgtaagaaatgctcattctttttgttcagtttcctgtcccttcagttcagttcagttcagtcgctcagtcgtgtccgactttttgcaaccccatggactgcaggcatgccaggcctccctgtccatcgtcaattcccagagcttacttcaactcgtgtccattgagtcagtgatgccatccaaccgtctcatcctttgtcgtctctttctcttcccgccttcaacctttcccagcatcagggtcttctcaaatgagtcagttcttcatatcaggtggccaaagtattggagtttcagcttcggcatcagtccttccaatgaatattcaggactgatttccttcaggaagtatcttcagggtatatctccttgcactccaagggactctgaagggtcttctccaacaccaccgttcaaaagcatcaattctttggcactcagctttcgttatagttcaattctcacatccatacatgactactggaagaaccatagctttgattatgttgactatgtcctttaatggtccttttatcatatctttggaaatatatgtgccctaagcctcaagatattcataaaatcagaggttgtagtcttaattttatttgtgtaatggaattcagttccctggtggttcagatagtaaagactctgcctgcaatgtaggaggcctgggttcaatccctgggtgaggaagatcccctggaaaggggaatggcaacccactccagtgttcttgcctggagaatcccatggacagagaagactggcaggctttgtccatggggttgccaagagctggacacgactgagtgactaacacttaaactttaatttttaaaacagtgagattatataatttaaaaagtggatttccaattccaacttttctggagaaaagtggggcatctggccacaccggccacttctggctgaggtttagcagaagtcgccgctttggatagtgcatcctgccacggccccaccttgcgtgtttttctctagacatcgctaaactctcgccagggacagaagcctcaggaatagcagggggtgatttttgtctgcttcctcttccctgccttcacattattttccacatagctttgtaaccatcaaattccttctaacactattcttgatggaaagaaaaactggtaaacgtttgcattaagtgagtattagtaactttagccagaaagggctgcctctgtcaaatttggcagaatcaacagaaatctgcaacattagtattgcttaattagcatcaccagagacccatgcctataaatactttgagcttgtggttgacactttctgaaccctaattaataataaatatttccttttaaactacactttgtgagccaggtctctagtgacagaattggatagtggttgatccaataaaagaaaagaataaatttttattagcactcacagtttgcaaagttccttgacacgaggagtgtgcatcatcaactttgctttggtaatggtggggtgttggaatctcagcaatgaccacaggga

SEQ ID NO: 26162 - DNA, 1587 bp, Bovine  19866880664290
tggacactaaatttgaacttatataattttctgtgtcatgaaatgttatttttcttttgaatttttttggaatcattaaaagatgtaaggaccattcatagactgtcctaacaggtgggaagaaggcagcctgggatcctggtcgtgaatggataaccaccacgccagcctgaccactcctctctcatttccagacacattgtttattgtctctatgggcatttcttttacttccaccattaaaatgttgttttaggctaagaacttaatcccggaagagacttcagaggaccaaataacagacgtagttctgctcagattctggaaataaaaagcagactttgcagagctgctacagccaaatcaagttcccctgaaacaaatagaagccacagtggctgtctaagaggatttaacataaaatggaaaattcttggcatactctgttaatttcattgaagattaaaggataaatgcaggactttgaatcatccacagaagctatttagttctaaattgatgctagcaaatattaaaattctatgtgggttttaacagcatgggtcattgctaaattttaatttttttctcaccagggaatctggccttaatgtgatagaaagactcttgatcttggtgtccaaaagacaaaggtttgaatttcagctgtgttagttttactgtgatcttgggtaagttaatatcacctgtaagaatcttaatttctttattagtaatatgaaattaataatactacttcactggccttttatctcatttttttagctctttactattaattatgaaaatttcaagtaggagcacaatggtagagaactatagaaatcccactgtacaattcattgcatttttaatcaaacttctttcatctttatctcaccccatttttccctccctttaaatactagagtaaaatattctctttaaaattccaagtgtaatattatttcaccttcaagtatttcagtatgtatgaccaacagataagatcttttaaaggaatatcataattccagtatcacacctaaaatgacaagaattgcaaataatgctttgcaaaaattgcattaattctttaacagcatctgttatccagtcagtgttaaaattcccctagtgttttttaaaaaaatgtctatataactggtttattttaatcaggagtcaaagaagacctggggtttcacaggtggctctgtggtaaagagttcacctgccaatgcaggagacgccaaattcgtggcttggatccctggattggaaagattccttggagtagaaatgacaacttactccagtattcctgcctgggaaattccctggacaggggagcctggcaggctgaagtccatggggtcacaaagagttgaacacaactgagtaactgagcacgcacgcactcacacaaagattcatgtattggatctagtcatatgtttcttaaaatgcaaaatttatgaaaatttctcttctcatctttcttcatataattattttgtggaaggaataataatatgtcttatagaattttatgtgatctggatttggctgttggcaaccttcacc

SEQ ID NO: 26163 - DNA, 2380 bp, Bovine  19866880698970
tgctacttgcaatagcttcctacataggctgcttgtgaaattcttatctcagtgtctacttctgcggaaacccaagctaggatagttgatatcagaagtgattctatcaagcggaacctcaggatgggattctgaaaacaaggacaacagcaaggacctagaaggccacgaggacctcattgctgtccaagtgtggcagtgacatcccccagcactctgtagcatcataagtactaggagtctcacctctagtgaattgtaatgggatgtaggtggaatgggatgcgctgacttatataaactcttatgcttgaaatatattaagacaatgataactctaaagcatatgaagatggttagttgttatgaaaagccacagtagccttaaagaaagaaaatgacagagtcgggaaagccacatatcaatttgggatactctgtgaaaaccagaaggcctccatggctctgttttaacagacattcatctcctgaacacaatagattttgctgaatatttggttccaacagtagccttcagttagtgatctgatgtcagtcagatttcaatatgagaggggtagagttataaaggaggctgaaacaatctcctattgaaagtcagggatctgagacacaaggactcttagatttggaagggacccactccagtatttttgcctggagaatcccagggacgggggagcctggtgggctgccgtctatggggttgcacagagtcggacacgacttaagcgacttagcagcagtagcagcagcagcaatctgaggatgtacttagaaacatcaaactccagatttcactgaatttcaagggctggcttgctagaggaagcagccttccatttcccaaagactgtgcaaaggccttgttgaggtaatggccttgtaaagcgatacttttcctccgcaaggtcagttctaaccatctgtcactacttatgggtcaataaccacggtcaagtctcagcatggcccagttgagtaactcgtgtccctgtattggatagaagggattattcactcaacgagctgcagggcctggctaacaggtgtcagcagaactgggagaacatgtttgggaacggaacctgagggtgctggaccagggagagcaggctacgagacaagatgttggatgcgaggacattctcgaatgactcaggatttaacatcttgtcaacaatgcctagagccagtcctaacacccttctggaatatctccttgagaaaattaaagcgtcatcaatgttttgtaaatttgtatgcaggtcaatctaaatattcatcagcatagaaatagtttagtaagtatttttatggacagtattagaaagttgtctgttatattatttaaggtgaaataaataagctcggagaaggcaatggcaccccactccagtacttttgcctggaaaatcccatggacggaggagcctggtgggctgcagtccatggggttgctagagtcagacaagactgagcgacttcactttcacttttcactttcatgcattggagaaggaaatggcaacccattccagtgtccttgcctggagaatcccagggatgtggaagcctggtgggctgccgtctatggggtcgcacagagtcggacacaactgaagtgacttagcagcagcagcagcagcaaataagctatttgcgaagtctccttacctttctctctgtgacctcatgagcatacagagatgtttggaaagatatctctgaaactattatcagtggttattaaaaggaggaaaaaaataagtaaaaaaaagagtgactttcaatttctatattcttcagtaaacaaatgaaaagaaaataaagcagatttagaagaatcattttggttgttgtcttttttctcatttcccaattttatataacaaacatattcttttcataataaaggataaaaagaaacagagctaatatcactactgagatcaatgcttttgtattttaagtgcacttaggatacatataatatgtgataccttcttgagggcagtttggcattgcttttgaaatgaaaatagtatgtcacctttgaacccagaaaatccattttatagacagttaacctaatatctcatgcgtgcttccaaagatacatgcttaactaattttcattatactactgctttcttataacagcaaaaatctagaaagactcaactatatactattccaataatgaaatcctatgaactactaggattcaaggcttgcccatgcttctcttttgctccaacaaatacaagatttatgctgtgagagctccctggcgatctagaggttaggatccactttttttcctgcagtggtccggtttcaatccctacttagggaa

SEQ ID NO: 26164 - DNA, 1380 bp, Bovine  19866880718741
caccagacaggcatctacaacccacattcccttctctccaggctcttgggttttccttgaataatttcttttcctttgaaacatgcctttatcatacactttaaatttattttaaatctgtgagaagagtttggaaagggctgtgatttaacgagtataggctttacttttgtgttgaaccacagaatcagtgaatctggatacagaaaagtagagactcgacctggctctcaaagaccttatagcagagttggactggcatgcatgagtccacagtaaacaggacaagatagactggatttggagctaaatccaacagtgtagactgggagctctcgggagaagtgcagccattaggaagacacacttcctgcccagaaaatttgccactgccccagtggattttggaattacagtgctaacaagtcatgtctaagacccagaggaagccaccacttctccatgaaccttgacttgcttcagcaacctcagagatgactgtgcacccaatccttagaatatccagaatttgtaccacataactggatacctaattggatttttttttcctagcaatctttgctgtgttttcaggatggttagtcttccacttttaccagattgcaaacccactaaggcctgcgaacatatgtgtctgcatagaattgaatgagaccttcgagatctttctgtataatctttccatttctacagctgggaacatcaaagactaaccagttgtgactcacccaaagctcctaccgacccttcaagtttagaagactccttaagattcttttcttttctctccctttcatttatgaatcgaagggaagaagaatgagtgatgctatttctagggactttgttacagagtatattgcttgcttaggatttcctcacctggagatttaggagtagtaaaacacagcctgtagcttggttatagattttttttaagaacatgggttaagacttcctcagtggtccagtggttaaaaatccacctgacgatgcagggtacatggcttcgatccctgatctgggaatttcccacatgctgcggagcaactccacagcaagagagaccaacgcagtgagaagcccagcttctcaagaaagagtaccgccactcgctgcaactaactaaaggctgcgtgcagaaacaaagacgcagcacagccataaataaataaatacaatttttaaaaaagaatgtgggttagctatcaatctgagctggtcagcaagacttgaatgcagcagtgatgagattctacaccctgattaaattctttctcctaacgcagggtaaactagaacctgtaagttttctatgaggaagtcagttgaggacctaagccctgagcatggctagga

SEQ ID NO: 26165 - DNA, 1932 bp, Bovine  19866880779456
tgggggagtgggagaggaaggtggagcgagatggaaggagctagggagagtgggaggggcattcttccctgtccatggtttaggatacctgccaggcccgtcgggcagctcctccgtgaatcctgcatctattcgtgagtgtagagggtctgtcttgttgtttagtcgcccagtcgtgtccgactccttcatgacctcatagactgtggcccgccaggctcctctgtccgtgacatttcccaggcaagaatcctggagtggcttgccatttccttctccaggggaatcttctcgactcaggggctgaacccacatctcctgcactggccagtattcttaaccgctgaaccaccagggaaggccatctttgagcttaggagttcactaattaagaaaatcactcgaagctttgaggagctcacttttcccctctccgggtcccctgagtctctctcttcagcgctgctttccccaggcactccacccctactcccacttctaatatttaagtatttgtaaaagctcagaattccagcctcctctaccaggatctagccccaaattgccccctggtggctggaggggcaaacgacaggatggagcatggggaagaggccacgcggatcctcttgtcccttgcctggttacctgccatggtatctctgtgtcgtgtcggtatgagcctgatctgactaggtaagtctgtctctctgctgtattttggatcattctgctgcggggctccctttgcctgttcttgtttcctacgttcttttggtttgatgtgggtttctacacatgttgtattgaccagagcctttccaaccgtactcagcacacccgaatgggtgagggagagagacacacggtgagactgagaacaggatagttgaaggcggtgcatgctgtcacttcatgggccgatctgagcagctccacaagggccgggctgattagccaagcgcgtgtcacctccgtgccgctcatctgccagccaagagcaagcgtgtcacctccttgacagctgtctgttgtcagaaggccatcttgtctccttttcattttgaccgaacacagcagagacatctgcagagtgctgcagctctgacggggtgccctgcctgccagccctcagacgcaggaagcggcataatggaagagctcagaaaggaacattaacccgttggccatcttggtttgggatatttttgccaaatatgtctcttgttgaggacagtactccatctaagggtgagagaaacatgagatccaatgtcttgatgaactgggctggtactgtatccaatgtcttggtagtgattggcccatgggatttcagttgatctgagtttataggatagggtggaaaactcattatcagagttaaaccctgtgtttcatggtgaggttagacagaagcagaagcatatcttaatcctaggatcacagcagtagtgtcttctttgaaggtcatagtgggacatttggcctgtgtaacaacagcaatgcctggaacatgtgtggtttgggaggaggtggtgttcttgttctttttcagacaaacctggtgctgccatgtttggtggagattctggaatcaccctgagatcatagcctctctatttcatggaatgtggactgcctcttgagggcatttcctataaaacttagcaatatcaagctggacttttgagatagggaaagattttaagttattatacacagttcagcacaggagttagaatggtttactctttgccttgtggaagtgtcttcccgtgaagctctttttttggctgagtcaggcagcatatgggatcttagctccatgaccagggattgaaccagtgtggcctgctttggaagcggcagtactaaccgctgtaccaccggggaggtccccgtaagcttcactgtggaggtctctcagga

SEQ ID NO: 26166 - DNA, 1105 bp, Bovine  19866880829169
tatgctcagtccttgtctgtggctatgtagattgggtaaaatcagggcaaaaaagtatctttgaggtcaacatcgatcactactgctcgacgcagatccagtttaaaagtcatgtaagtgatcgtggtgctcgaggacttcatagactttttgtgtagtctgtggcttgtgaactcatcaggtgaagttttgagctgattattctccgaccaccctttggtacattgaaactcctttgcacagctgtgctcccaactcaacaacagagcacagaaacagtctttgctggaaagcaaagcgcagtcactatcccaactttcctgggaacttgcagccttcaggacgacaaaatggataatcacagtgacgattacagggtttggattaaacatattgcacagtaggatggcatggccccagtttgctcccatggcacaagtgccgtgaatgccaacaacattaagcactgcagccacttacaaagatttttgggttttaaatgtcagtcattggaccaccacttaaaatgaagcacctgcatttgattcaaagaaattaaggtatattaggatatgtggaggtgagtggaggtgttttttggggtttgttttttttttttcagcaaaagccacagataataaagataaaacatcttgagtattaaagtggtctgtttcctgcagtgtatggttgaaaatgacttagcctttaaaaaatttttcagaaataaaagtatataaagagggagataaatgaaatttacatctctgcagacaactctgcatagcaaatttaagattctagtattttccttccaaacatctgaaaattggcaatttaaaaggagaccccgacagattaactgttgcattgctaccagctgtctgtgatgatatcactaagttacgaaactttttttaaaaggtataaacaagtaaggtgataacttatttttgaagatgctttctaaaaactttcatcttagtaagaacatcaaaagtgtactaattaactgtctgaatatacttagtaaagttttaggtagatcagatgtaaataagcttatttcataaaagatagacttatgtgtatccagatctcaagt

SEQ ID NO: 26167 - DNA, 1301 bp, Bovine  19866880868762
ttttttaaattatatcattagaagtcattgaaatgagagtctgaagcaatttgagagaattctgaaaaatcagaagcattttttggtatgtctctgatatttcttcttgtttctttcattttaatattgagtcatcaggcttgctcacatcctgaattaatttcctttcatctctcttccacgtggaagctatctgtataattgttagtacgccatgactccgtcttcattcctcagatgactaaactgagagtgagggaccaagctatcagcctgggtatactttgagctctcagctggaaaagaactaacggatgcaaggtgttgtaattacaatttacagcccctgattctgcagtatgtcgcttagctactatctcacccaccttgcactctgatctctaccttccctttggggctatttctcgtcttacaaaagctatcatctggacacacctcactgtgactcttgtcttctttatctatgaaaatgagtcattttgatcacaaatttctctcctcagaaggtgaaaagaatccttggagaaaagtgtcaaatcaatttcaaatctattttcaaaactccgtgtctaccgcatctttaatgtgtatgcagtgctacagaacattccccataaaacgatgcatgtacaggtttgggttcattctggtgaatacagctttagattaaatgattataaatgcttttagaatatacccagagtgcatgaaccatctgtcttctacatagcacttttcagtaacagactcataaccaaaaattccttcaaattcagcaatatgtataaataacatctgataatatttttagctcaaaaatttttaatggttcccttctagtctgattgattagtataaaaaataagagaattttatgtaagatattttgtgttaaattggaaacagactagccctgtcattgtgaagactaaaaatctaaatatggaaataagacttaaagaaattacattaaaatgtatgctgttgtattattaacgactgatagaatgattcagatcctcagtggtgtgaagaaatcaaaatcagaaatagcctccctggcagctcagatggtatagaatctgcctgcaatgcaggaaacccaggttcgattcccgggtggagaaggtcccctggagaagggaacggtaacccactccagtattcttgcctggagaatcccatgggcagaggggcctgatgggctgcaattcatagggttgcaaagagtcagacatgattgagccataacactttgactttatatgctgctgctgttg

SEQ ID NO: 26168 - DNA, 720 bp, Bovine  19866880930754
acattacctgatgctgacctttatgaagtttaaaggggaaggtgaatcggaggttttattggctccttactagttggtaaaacctatttctgtaaaagaataataaactgtctgtcatttattgtcaatatctttctcagtctgttatttggctttcttgtggtcatttctcggtcacagaaatgtaatattctcttgtgttcaaatctcatggacttggaaagaatgacaaatgcgaatgcataagtaaatacatctttctaatcaggaccttcctaaaagagttcggaaagggggtgggtatgtttgtggacgcaggcagctgctggccgtcgtcaggccagccccggccctctgatgctggcagggtggccaggttacagtcgggttccctgtcaccgctcccggagaaggcacaggctaggtgcccttcctgctgctcggaggtggataacctcacgaagaaccccgccagagagcgagttacttaaaataaaatgagaggaagactttaaagagatggaacatctgcgataaactcattttctgtgtgagcacccatggagacgcctgtctgggtcggttgaacggcgtttctagagaagttgaaaattcatttcatttcattattggaactgttcaggcaccccggtttggatcagggaacggcttcttaaacctgcaggaagctcatttacccctgctgaggctccagttccc

SEQ ID NO: 26169 - DNA, 750 bp, Bovine  19866880936752
cggaagtgaaagccttggacctttgtatttgaagccttgggagggaaacagccatttcagagggagctaattattcactcgagggctggctatgttcaaagatgctcaatttctaatagcgtcgctaatgcgattactttatcagtttgcgtcctaaataaaggaaccaacttcaacactttttcctctaataggaaataccctgcagaagattacagggccgaccgggccccagagtccttctcgcttgtccctgagcacctgcttttactggtgacctcagttctacacctcaagattcagacattttgcaaaacagctttttaaacaaaaaccagctgttccccatctagactacagggggaaaatttttgggcggcttatagaaacattacccagagacgactgttctccaataactttcacacacttgcagctccaaaccagacccgtccctgcgcagaagctggggagcaggcaaatgtgaaattaaaatgtggaaattcaacaccgtggtttttgacaatacatccaattaagtgcttgaaaatgaatgtggctattgtatcaggacaatccaaaagatgtcatttaactaatatggacagagcttttggttacatctcaactttacagttctgagttgatttatggatctagaggaagctatcattatgcacaacagtgaatgtcaaccaattaggtggaatccttgcatttcagaaattcaatgttgcagcttcttcccct

SEQ ID NO: 26170 - DNA, 4591 bp, Bovine  19866881000839
atcagtcctgttccccgtctgtgactaaaggagatatgaccatcttcagcattttcttatgggaaagaaataggtataatacgttgaagtattgacaaaccttgacataacttcaacatgttaactgccaattttataagtgcatccttcacaattattagaaaagttctcttgaaaatctcagtctttaaacagataatatgtggccttccctggtggctcaaatggtaaagaatctgcctgcaatgtgggagccctggattcgatccctgtgtcaggaagatcccctggagaagggaatggcaactcactctagtattcttgcctggagaattccctggacagaggagcctgctgcctggacagctacagttcatggggttgcagagttggacacgactgagtaactaacactttcacactttagaaagtttagagagatggataaaaatcgcttggcgaaatctaaatcatttctttcctagttcctaatggacatcacatttaacgtgaaatggtttccatactggtattcactaaatgttccccatcctccatacatttgaccacagcacagaaataagattgccttgagtacacaaaataatgataaaaatgcatttttatttgaaaagtgtgcggaaacaatcactgaatacagttctcgactgtaatatttaaacccacacaccacaaaatcattggatgctctgacttctgaagctactagaactttggtacaacaaaatgatgccctgacagtctgtcaggcaccacagtctattcaggggcacagagaataaaaactccatgtttaaggttttcatttacattcatagcactagacaaaacagagatctgagtagatgacagacaaaacaatcgaacgtgcttagcctaaaaatgaggataatatcacttaaatgtagactgttgagatacagtgaagcacttcagtgttaggccaaaatgttgtctacttttaacacattaagcaggataacttactttcctcaaataatttcagatacagtcagtatctttcacaaggttgtggacacaaagccgtgtttatacaaggaggattttgaccaaattttaatatactatgtagaatgtaattggattccttgaaagaaatacaaaatgacctacagaatgaaatagaactcatatttgttttttcaataacttgagatatattaaacattttcaatcaaagacaatgaccagagctgactatccatttcaagttcccagtatctctactagaattagtgttttgtgccttctataacacttgtgaacatatggttgtgaaagtatgactgtgatatttttattattcttagcttgggataatagtgtcagtttgtgaaatggaatttaatttataaaccagtttctacatatgttctctttggagcctgatatgaaccctgtgagttacacaggatttataagccccatacgaggagaagccatatttaatgacatacccacagctcccaaattcctctatctggacactttcctttctataatactagtcttcctttcaaagagtgcttgaaaaaataacctagagaagagaagagtaaggataagcatgtgttattgctttgctagggatgaataatattttgatatgtcaataatagccattggttaaataagggatccattaggataagaacaggcatgcagctccaacagaatttgccaatgactaagtctgctgagggataatagccatgacttccaagacctgttggaaagaaaaggaactggggaacaaatttaaataattcaaagatgatttcttcatttttttttccttgaaagatgacaagtttttaaataaccatgttattttggtactcatctttttgtttgtttgcctgttattctcactaaatacggaaaaagagctctgcagaaaggcctttgtgatgctacttcttaaaaaattaaagtgcaatttatgaggaaattagattcagataggataaataaaatgggtctaagcatctcaaattttgatgccaatcatgaaatatttggtatttaaatatttttattagcttagttctaagggcctaaacttctacttggaagataaaaataataggtaaatatttgccatggtgctggtttagtcactaagtcatgtctgactcttggcaaccccatagactgtagccagtcaggctcctctctccatgggattctccaggcaagaatactggagtgggttgccatttccttctccaggggatcttcccaacccaggtctcctgccttgcaggcagattctttaccgactgagctaaaagggaagccccaaatatataaccctttctctatttttttttccctacataaaaatcaaccttttaagtatggtcttctccatattctcccatagttataaactctatttagacaacttgaatctctaatctttctttatggttctcactcaacagtgtcatcctggttgggtctttacccaagaactccaaggcaataagttcataaaattcctattcatctaacagttctactttatgaggcaagtgtctctgtagatttatacaacattgagacaacactcaactcagagcatattatctactttccatgtttaagagctcagcactcttccccagaaataagcttataccattttggtcaaagatcaagaagaaaatatagcttttggcgaattcctagacaatagttttaaatatagatagcatcttggtatctttaaaaatgataaagctttccctaaaatattcacaaacattagatatcttttaatgctttaaagcttgggagtagaaggtgaaggacaacttttctattgctttggctaacatagctcacagatcttccttttaaaaaattattaagtacgttaggaaactagaaacttcgatatgatctctttacaatttgagttttaaactctaaaattctttatggttgaggattctccctcatagttgtagttccaggttatataccacacctagttatatctctctacacatattgtttctcctacccaatgcacccactccattggtgagaactgtatgagcttcatcaaatttgttgattcccagtgcacaaaatttacactttaaagaatatttcagctgttattaaaatgttttttaatgtagtcagtccttctttatggtcaaagcttctctctcttacaaaggagacaagaaagggctggtaaaaacccttgcccaattcttatctgaatgggttggcagagaataacttgtactacaaacataacaaaagcactcactgatacacagaatgtcctatctggttaaaaacaacagggaaaatatttactttagtaaaatgctggttttgaattatttgtagcatgatagctgataatatggaaatgatagaaacttggctagagtggtcactggccagagttttaaaagtcttatgtcaagacccacaagttaaattccagtattcagcattttttctactaatctgtgacttcttatcctcatcacaagacagacatgttctctcaactgccctctgatacattttccaaaggattattttattttattaaaaggtaatcttgtacctaatcacagttagagtctcaagaaatgtccatttcccaaaaagtgaccaagagatggtggtaataatctttagattcgaataatatccttataccctttgctgaagacatcaaaataactttagctgcacttatgtctctgtgagcccttcctacaccatggtattacaggaaacgagctatgtggctatagccaaatttggtcgtggaggtatctgaggcactgattaggacaatgtaaacatcaaaccagtgtaaacacttcagaaatggtttctgtatcagaaagaactgcacgtacattgtaaataattctccaaaataaaatatggcttactaaagcatttgggagacaataagtaacacatgttgttgggtgttaatgcagttcttcaaaagcagtcttatacttcatggctccagatccatttaaaattataaaatgaattatatggaataaataattctgaaataatgaaagagtaatggttacatagactttggggtgttaagtcaaactcaacagagaataaaatattttagatcaagtatttataagtagaatactattttaaaataattttcttgactgtttttaattttgttcctcttggtattattacccaataattgttatttttataggaatagttctataattataggcatcatcaccctctgcttcgtgctatggctatcaaataataatcttaaaatagttcctaaataaaaagcttgttaaataactgacagggacagaatcttggcataagcaaatcaatcatataactggaaaataaatagaaaaaataaatatccaaaatagaatgcttcttggattttagaaagtctaattatttcctattatggaaatgcagggggacatcacaatttgaatccaaaggagaaatcgatttaatgaccacaagaattcaccaaaatttgccacat

SEQ ID NO: 26171 - DNA, 1333 bp, Bovine  19866881003614
taagtgaaagtgcaagtcgctcagtccgtccaactctttgtgaccccatggactatatagtccatggaattctccaggccagaatactggagtgggtagcctttctcttctccaggggatcgtcccaacccagggatcgaacccaggtctccctcatggcaggcagattccttaccagctgccccacaagggaagcccaagaatactgggtagcctatcccttctccagtgcatctttccaacccaggaatgcaccagggtctcctgcactgcaggcggattctttaccaactgagctatcagcgaagcccatggagtttttaggcctgtaacaaatactttttgcaaatggtaagaaaagaaaagatttatcaagcttttaaaaaacccctactcccctttatattttaaatgttggtagggctggggcagagggaggtgtggggagtaaaaaacacgggttgccgtcaaaatagaatacgtgggaatttattttctttctaaaagccctctgactctaacattttcaacaacacattgtatttaacggacaagatgtctgtactatttttatttttttccccctggtttcagcagcagtatctggaaacatgaacgatcctgtgtactggtcagttttcccaaacccaaacccccatgccctaatgcttaacgagctgacgtccctgaaaaacccctggtgactcccgctggaagaatctcaaggagcagggaggctcttctgagttacctcgggtgctaacctggggcaggcgctaggaccgcccagacgcccacaggcagcgcacttcaccgcccgtcagaggggctgagccgcctctgctgttacacaagcgagcaggcagcggcagtcacagctcagcgtccctcccccttctggtggatcggaaggtatttacttgctatttatcattcagattttggacgccgtcaatgtgcctttagtgttcactgaatctgatgctctgaaacgctgtccagcacctgttggctcactctattattttatgtcaatttccacagctgatgcaagcaacagtgccatagagaaatgggctagatatttccagaggctgagatctggaggcatttggaggtgtaagtacatcggtcacagatttctaatgtgctggctgtgttaactgtgtcttctgaccttctttcctcattgaaggagccccactgtaagatgccatctgcatatttcattcatgaaggaagcaccaagacggggacagaaagccctaatgatgggcctgaaactccactttggagtggctgtgggttccctcttctaacctgtgggtttgca

SEQ ID NO: 26172 - DNA, 1056 bp, Bovine  19866881029667
aatgttatatacatatatgtttaaatgtgttcttttaaaattgtaggtttcttttctaaggggatacttacatcaggttcaagtagctctgctaaaaatatgccaattttaagatatgctaatggcctaaacctaatgataaaaatatttcactttagttgtagtttccatgtgtttaattattagcgaggtcatctgtctctgtttatattcaccacttgcatttttttctatgacactcatattcatggcctttgctcatctctcttttcatgtgtctgtaagtatcttattaatttgtaagtgctcagtatatgtaaagaatatttaaaaattttttctgtgtgttaaaaacatttttttgcagcttgttattgactttgttttattgcatcttttcagtgtagaaatttgtggactttcaggcagtgctattcaccagtatttattttgattgcttctgagttttgatatgggatatacagtatctctagggcatcccacgtcatgccagtgataaagaacccgcctaccaatgcaggaaatataagagactcaggtccgatccctgggtcaggaagatcccctggaggagggcacagcaacccactccagtattcttccccgaagaatcccacagacagcggagtctactgggttacagtccacaggatctcacagtcagacacgactggagcaacttagcatgcatgcatacaatatctctacataaatataaatttacttttctaatttttaatgaataaggtaacataacacagtctgcatttttttttacatcatagttataaaagtacctagaaattacccagcaaatttcaccttacttctttccttaagttcatacagaactgaatcctggagatgaatatgaagtactgcctgagatctaaacactatgaaaagagctaaccaaacatcagatatgcagtataacaactatagttaataatactgaattatactcttgaaatgtcctgagagtaggtgtcaagggttctccccccaccctcccacacacacaaattataacga

SEQ ID NO: 26173 - DNA, 1120 bp, Bovine  19866881041592
aatagtttttcttgagttcataaagagatatttaataaccagccaatctttaatttctccttgtgactatttatcatgatttgctaagaaatgtgaaatgtgaagctgaacactacaccagaagctgaatactagaccaatttctaaaactgtgctggaaatggaaacctctgggcactctcttaatgccaaccgataatgtcagcttccaattggcttgactgaaatttggccaagtaactctccgagacatctgtaagagacacatttaatttcagttgtccaaatgccattttcccataccttcatctctctctctctgggcctttttcttgtcctctgtcattcacagtcctattcttgtctatctgccatttattaagaatatacaaatggcatgattacacagtctcctacatattctcagatgtctgacattcatcctctcgtaaccttatcagcaatattgtcattctagcacagcttacaggatatacatagtaatgtcactctaaatgaaccacttagaattctttattgtgtatgcacttttagctaatatgtccccctcaatgcaaacctaaaagtccaaatcagattctatataacaagtaaatccaacctttaaaaaaaagtcatccttctgtgttctcccttcagaaacctattcctgtccccagtgtgacaaggtaattttggttctgatggaaaacccactgatatctcttcttctacactcttttctatgttcatcttctttatgaaaaaacaaattgagtacccatgatggtacgatgacactgggaaatctttgatcttgtttggaggggcttcagggattactggtcaactcttctgaactctgttgactgttcaggtttttaaaaatttctggcaggaaaagaaagacatgccgttatacacggtttactcaacaacaatggtggggtttatcgctctttttggaagtgacgtttgcttgggttctggatggtcagaggctggggtaaagtctaacaggcacatttcttctctgctgacttctccccatccagctttccagagctgctcccattgactgtgtcggggatgtgggtcttctctacacactgttccattc

SEQ ID NO: 26174 - DNA, 1373 bp, Bovine  19866881044943
gttcttttagctccccaattttcaccaaggctccttggtccgtgacagtcctggaacaacagaaagcaaggactttctccaggggcttgttgctgggagacctctgggggtggtgcagttactagaaagccatgtggctgctctttgccgggcagagggcgaagctgctgaatcgacagggtttgggcggggcagccggggagttcttcacctgtctcaactcctctgggcacagacccctgccactagactgctggggtagccagactggaatctttttaaaggttagcaagtttcgtctgatgccatctgttttgtgtgtgcgcactcgctcctgattctgtacaatgtgcaaatttagaacttccctggaacaatgctgagggaacaaacctcagctctggcttttgatcacctcggaatccaggggcggcagggaatgatcggagcagtaacttgagtaactgggacagtattttacaaaattcgaaaggaaaaggcaaagtgaagtcactcaggcgtgtccgactctttgcaaccccaagaactgtggcatacaaggctcctccatccatgggatttttccaggcaagggtgcaggagtagggtgccgttgccttctccagaggatcttcccgacccagagaccgaacctgggtctcccacattgcaggcagacgctttaccttctgagccaccaggcaagcctacaaaatgttaagggacccttaatttttctgttagtgaaattgaggactatagaactgagtgcacaaccctcatgagtgtgtgttcagtcgtgtctgacactttgtgattccatggactatagcccaccaggctcctcggttcatggaatttgctgggcaggaatactggagtgggttgccatttccttctccaggggatcttcctaacctggggaatgaacatgcgtctctttcatctgctgcactggcaggcggattcttcaccagtgcaacctcctgggaagccggagtgcatggctaaggtcacacagctaattagaggcaaggctgaccctgagcctcaggtctctgatttccaagctagggatctcttccatctattaatgaatcagtacattttataagccttttcattttcaaagggcttttaaaaagcatttcattttcttctctccacaacggagaaataagagcattgatctgactccattaagaggagctctgcaccaggtatatgcccttcgtccaaaccaatctggattcaattctgcaaatgttctttctcaaatctcatgggtttgtgtttattcttcttgttacctttgtgttctgtttagggttagcaaagttcaaaaccttttttccacccaaggatggtggggt

SEQ ID NO: 26175 - DNA, 1000 bp, Bovine  19866881070854
ctttagaagagcaactaaacttgaaatcttttaacattcagcaaaaagtagatgagaaagaactctttaagacccagtgaatttcagggcgagcttgatgcttggcagtctatggcaatgcggatttacttaaaaaagaaaaaagacacccatgaaaccagcgtttcagttattccagcagtttggaattgggtctcagcccagattccaaaggataatgctgtgggagcatcaaagaaattgtaagtagctttctctaaaggctatgaaagaagaaaaaagtggaaaccgatcaccttcttaatttctattaattttcttagtgttttgtttattttatgaactggcctgaagtctcctctctctttttcagaagtaccacaacgggtgggttgctatctcttcatgtgtattactgttagtgtaccctcttttcattgagagatcagtctttagaagctcagaatgctgtatttctcttgctgggagtttataaagtctctttggtccagaccaagcctgtcattatctcacactattttccacctcatttcatcctctgtcttcaggccacctgcatttgagttttcagtggccttttgcctatggctccttttgtttctagaatcaggttattcaagtatgtctttgtaaattctagtagtgaacagtttggtgtcttttcttgacgtctcaccattttactgcatcttgtttcaacacacagctttagatttagtatattaataaaagtgcaaattattatagatttcattaaatgccaccagtaaagagcagagcagtttccccaagttaattgtttacagtagcttttaaaatcttaaagaactcaacaaatgtgggctgagcccatttacaatacagatatttagaatgtgttatgacatccttaggccaacgaggaacaaaatgctaaatggaggggaatgataggtttgactttgtatcctcccctgccatcatttccagtgtccctcca

SEQ ID NO: 26176 - DNA, 1772 bp, Bovine  19866881122328
tttgtaggatcctgaaataactggattgtcttttacctgtttctcttctagtataagcacactcctttgccctttactgagaattatataaccactttgtattttccagtgtaagatcaagaaattacccaggtgcccacactttgtagctaatgggcttctgcccctcttttaccaaagctgaaaagaatccagatatttcagaaattctcatattaaatgatttaaatatatataagtataaaaaaatatatatatataagtatataaatgtatatagatacacactctctacttgtaggatgagtaaaattatttgttacattttatttcattttgaatattgtaatgcatttaatgttttatcatcaaatatgggatgtttgtgtttttgtgagacctctttagtagaaactgactagacaatggatgctcttgatttgacatagttaaaaaaaacacatatgccaataagtggtcttttaaattaattcctcaggtatctaattttttaagtttcattttactcatgtaaagagtagaccaactgtcttttttttttttgctattttgatgtctaagctgcttatcacactgtattaccctgcattaatgagtattcctactgtgcaaaattctatcaaaaatgatggtgtgaatgtcatttttaattggaagtttatacagtcaaatttatagtatacaacaaaaaatatgtacgtagttctgctccaagccttttttaggctattgatctttttggtttaagtatacatttttatcaacctgactttaaatttagtgtgagaatctggacatatattactgagtttgtgataataccattcttgggagtgaggtaaactaaggcacaagcagtaataatgccttttaattataaggtgaacagatacaggaattaccaagaatctgttttcagggatcccttttaaacatgaaaacttgctgaccaattttatacattccacagaagtcataatgtttgatttctatctatttaattgttgaatacctcgaatttctatgcctggtaaggagacgagggttaaaatgagtgcaaagcataaagagctcatttcctttatttgatttttgcttaggaggaataaatacctcctggttgcctacctcagatcatttttttctaatcacaaagcacaatgaactatttattgatttagcaaaacactcaaatgcagcacacaagattgcattcaattgtttagtaaagagaaaaatgaaatgaaagctgcaaaacttataaaaggaagcaaacagacctgaaacatcatatttatccacagccattgtgcctaggtaattcagggcatatggtatgtaaatgatgtttggagattcttgccaaatctgcacacgacgggatacattaaggacaggtttcctgggtggaagtcccaccattgtggccgcacactccgctaggctgtgtttgtcctgttcttgtcttgcagcaagagcatcacacagcctttagtggccaaatctgggcctcagtctgctgctaagacattatttttaattcctaagaatctattttataattaaactgaaaatatagtaccagtttgctaaatcttccttttaccccgacgtttgagaagatctgaataattcatcagtatatatttggctattacccatttaaatgaatatttttgacaatggaaactgagtgcctctttgcccctgaagaaaggtgttacgaagtaataatttttctctagggtaag

SEQ ID NO: 26177 - DNA, 1251 bp, Bovine  19866881145034
ctttttaaatagcaaccccttaaaggagacacctttgccaacaaaagtccgtctagtcaaggctatggtttttccagtagtcatgtatgcatgtgagtattggactataaagaaacctgagcactgaagaattgatgcttttgaactgtggagttggagaagactcttgagagtcccttggactgcggggagatccaacagtccatcctaaaggaaatcagtcctgaattggaagaactgatgttgaagctgaaactccaatactttggccacctgatgcaaagagctaacttatttgaaaagaccctgatgctgggaaagattgaaggcaggaggagaaggggatgacagaggatgagatagttggatggtatcactgacttgatagacatgagtttgagtgaactccaggagttggtgatggacagggaggcctgacatgcttcagtccatggggttgcaaagagacagacacgactgagagactgaactgaactgaaaggagacaccatcatctttttatttagctccttctctcctactgtgtctcccccagtgtggagtgacttgtaagtactggttctcctattttatactttaaagatgtttacttgttctcatgtggtatattttcaataatgttttcagatcagtatttttcaaacaatttaaacaatgttgaaaagatggagaaaaacaaaattatggttatttagattcttaattaataggaaaacctaattttttaagctttttcaaaatcagtataatccagatatgattatctgtacatgaataggcatgagtgtactcaacaaagcgataaaaaagatagctgggatgctgtgtcaactcacggaggacagctgcgtggaaggatcgcctaggccacaagcaaataagaaataactgctcagagatggggactatttgttaccacagtattactgatcttatccagacgagtacaaagactgtatagcaccttaagtagtaaatgatgaacaaattttaagtattcatcatggcataatatgtaaccaattttatttgtccttgcttccattataatcaaaactcctctggctttttactagcttttatcaacatttaacatgcagatactgcaaaattcacttctattttgaaagggactggggacaagagaaagacctaaaagaccaagcctagtaccatgtatgtctatgttcagagagagatatcctttgaagtgatgaaataataggcaaa

SEQ ID NO: 26178 - DNA, 1353 bp, Bovine  19866881157126
caaaagtaaatacatccatgggaagaagggactgccggttatggtcgagctggttgtagagagacctgagctgcttatcggggagaccttgaccgtggtggagaatgttcctgacttgaacgtggtcaggtcctgtgtctgccagctctgccatctgctgtcacattgggagggttttctgtcccgtctaagcctcagtctcctccaagataaaatggagatactggtagtgtattgaagtgcttggcacaatgtctggcatatttaagttcacaaaatactaactagtattatttttttgagagataaaaaatagctcaggcagaaggaatagcgggtacaaatacctggaggtaggaagtgtgtgcggtgcccaggtacaccactaggagcaggggatggccacgtgtaggccacgtgcgaggtttacatagagagtgagtctgggtgtagatgcgccgggaatgtggactgaatgctgcagaaaccgtccacctgggcaaggattttaggacgggatgtgagctaggcagtgggtggcggggtagggcatgcatctgtcttgtgtttccagtggaggaggttggtggttctcaaagctcctgtgtacacgaaaattacctgaaaacctcgttaaagacagttttcttggccccaccttcaaagatccaggatcagtaggtctgcagtggaccccaggatgctgattttgaaatgagcacaccaggtgattggacataggcagtcctcaggcacactttgagatggactgagatccttgttgaggaaatgcttgctgacttactggcaggtctgatgaagctcagtgggagggaagatggaaacaaatgtcttaaaaataacatgtttacattcagtgcatgctatagctttgaatcttcttgccctggatcaaggagcacccgttgtacaggtattctttcaaataaaaaatatcagaagtcatacaattgttctgttaagtcttggagggcaagagaggtgtccttaccttctcaatttgcaggaggccactgaaggaaaagcctgttaaaaagagcaataagaggaaggaagactaaaagaagatacagcagcgtgagatcaggaaatgaagaggatggaaatgggaaagaatgggaaaagagcagtcagatttgattgggtgggaatctatttgtgaaggaaaccagccagtatttaacctgttttgaaaaagctagacttccagcatttttaattagtggattgctcgcttttgaaattgcccagttgggaatactcaagttttgatgtgttttatttgcctgctaattagcagcctgcttggttgaccatcattttccctttatt

SEQ ID NO: 26179 - DNA, 1503 bp, Bovine  19866881219664
tgaaagagatttcttgattgttcgtttcagtgctgtcagtttcagtgttcatacatagaaaatatagtgttaataatcccttgtattaaatatggttccttacctggaggagactggcagtattaaagcatccttcaaatttcttaagatattttgataagaaaaataggttatgattcaagctaatggtcggaaatgcttcaattgcataagggaagacataattataggctgtatttccttacacataaactctagtatacttttgctataatttggaacctagtgacaatctgtgtgcccccagctattaatcttgccataagcaccattgtttctctaaaattctcagattgctcctctacattgtagtaattgtccttaaagatctcacaagattgaccatcagtggctgacccactgagtcaagtggcttactgtgatgcccagttaagttgctctgtcaaggatcactgagacagtgaatccgtgtatccattcacaacccagacttggctgatgaatgaaagtcaaagtgagtgaatttctaaatgttagtttgggctcattctagagggagctgacaggactaatattagctgccagtataagttcccaggctgatttaataattaataattaagaaaatgatgctcagagaggtaaagcaagcagaccaaagagtccccccagctaagtgtgagagccaggctttggaccctgaaatgcctggttttaaagctagtgcttttctaagttgggttccctgctgccggagctcatggtgaggtttttggactcagtaataggtctgtatgagagcccattggaaaaccactttcagtagagagtagagaatctggatctaatatactgcctagaatggaggatcttctcagggtgaactggagccatagtggtagggaaggcagagaggaaggcagggatcctcacagcccaacctttaaaaaaaaaaaatgaaaaatgtaccacatgtgactgtataaataatctattctgtaatgccctcaaaattagcatgtgcaatttcattaaaaccagtgaagatttcctgtgacgaggctggggtagaatatgccaattcacattttagcaacagcatgaacactttcttaaaaatgtatggattatctttgggccttcctttctgtgcggtgcaggcagaatatggtttgctgcttcacaaatttggattcttcgtagatcaagttattcttcccccaatacgagaactatatagagtgaaatctgggagcaatacctttttcaggctcctaagtgtgacctagtaattttttttgtgtggcatttaactcgtgaaatatataaaatgacaaatacatgttagaaacatacacaagttgtacagacagttcaggacaaccagtgcataaaaaccattgaaattgattcgaggtggtttataagacaccaaaaacatgaactccttctatcctaaatgaaacttcaccagatgaactt

SEQ ID NO: 26180 - DNA, 1145 bp, Bovine  19866881272202
ttttataagaaattacattcttgttattaacacttgtatacttaacagcactattaactcagttcttctgaatagtataattttaaatttttgatgaatgcaaaatatgtgtggcagagttttaaattaggtgtgaaatttttaatgttttttaataagagagtgattgtaagctatttgggaaatctgaagtatgtttcttagctaagcaaaaaactagttatttaatgcaatagtaaacgatttaaaattttgatggctttattatgtcctaatttataaaatttgaaattaaaattatataccttcagtggtattattaaaaaataaataaaatgcaacaagcctttttgttaaataagatttttagagcgtttcttcacaacaaatcatccactagatggcactaaacaactgccaaattttttctaacaaggccatatcaggtcaagaaaataagccaagaatcctaacgactgaaggaacacttgtgtcagacagacagatcaaatctcaaagaatctgaattgtatgtaaggtgatgctgaagaataactgggagctatttacacaagaaattttacttatcatggtcatttgatatacacagggccagcagctaaatattaacaattcaacacaaattggtaaatttattattaaattgcattaatttgaactccactaaatatctaaccaagacttggattttctctgtttatgaggaaatagtgttcacaaaacaataatgaaaaggaattccaggggaataatttatacacaatttgagctgataattataattactctcaatcaaggggtttggtgggttaaggtgcatataaaaatgttttcacttttttaggacatcctgtcatttagaccgatctttgtccaatgactgagcttataactaagttcataaaattataaatattgtaattatttctagaaagccagaacttcagaagaaagctccgaagtttagaaaatggccaggatatttgtaaatttggagatatgtcattctattgaaataatccactctttcttggaggctgatatgtattaagccataaaatgcatagtcaaacactagatggtttttgaagacatcttactgctttgttgccattttgttaaat

SEQ ID NO: 26181 - DNA, 1485 bp, Bovine  19866881309130
aaatgataattagtattatgcagtgtctggtatagaacaagtgagtgtaagagcaatgatatatgtttaaaatgtgacatccttttatgccctgatgtactggcaacatcccatcacagtatcgttcaagttaatttttttatagccgaggaaaggcggttgaaaacggggtagtttggaaccttaaggtttctgtcgcttctttagtgaagggatgtgcgttttcatttttcatacagtatctgtccttttcatgtgggcagattctgccctttggctaacataccaactgatacctctgagtaaatttgacttagtctttatggacagtgcaaccagctgagcagcatgactctttttttcctttctggtcactttatgtaccttgctgctgctgctgctaagtcacttcagtcgtgtccgactctgtgcgaccccagagacgacagcccaccaagctccgccatccctgggattctccaggcgagaacactggagtgggttgccatttccttctccaatgcatgaaagtgaaaagtgaaagtgaagtcgctcagtcgtgtccgaccctcagcgaccccatggactgcagccttccaggctcctccagtaacctaaaatttgaactctgtcatttagatgattttaactctttcctgtatgttatctaactcctccattaaaagcaagtgactgagcagtttaaaaaccttattttaatttaaaattcccctttaaaccatgagatgatcatagtaattagaaatttccaaagattaccgtctgctttaaaactgttttttgtggcatacttgtccaaatccagaatttatgcttaaattctgatattcatttatagtcctgttgcaatcattttaccgtttttgtgtagctggttgcttatggaatgatccaattcttttacaaccacaataacgtctataacaaaacattgaaatttcaatttcataaaaccaaatgctgctgtttacaaggtcctacctttgccttccaaaggcagtttgttgcaggttatgagtaactttcccatagcacattttgctctctttttttaaaaataatgtgggcttatcaaaataataattacgatttacaatatattttatacgtctcaggtgttttacttgcattatttcatttgcttgtaataaccttggtgcaattggctccattattattattccccccagcttcactatgatttcggggaaaatgtgaactctgcaaactttagagcccttcttatgcactgtacctgtgaagatgcagctttcctataataaggtgctggggtgagaatggtgggctccaatttctttggttcagagagatgtcagtagtcagacttccgtgctgattgattcatggcaaatgtaaacttatctgttattttatttacagaactatggagatgggactccctatgaccacagaccagcagggacctgggtcacatacaatctc

SEQ ID NO: 26182 - DNA, 1385 bp, Bovine  19866881603133
gacatatcttggtgtgttcatagcttaaccaaaattatactcctggactgtccattttataatccacccatctttcaaatttgtaaaattttgagtgtattttgaattttttttttttactatgttgaagtccacttgtttttaattcattttctacaggagcggagtaaaaatgcatgtgttcagttcatcttgttaaaccacaaaatattctagtttactttcaccagaaaataaacctcagtctcttggaggctgagttgagcagatggagagacttatgtacaattggttgattgtatggcggtggggaagtgaactttgggtccggacattctgaatacagacttctaaccaaatccctgtgttcaccccaccagctggcctcctccgatggtatttccgcctccttggcttgagcctctcaggttacacaaggagttactgcttctcatccatcacccctcctacaggcaagcagtatacaactgctcctcttcctgatcagttacccagcttccatctgacttagatttttccaaactgcctattgcagtttatttatctcttgatttctctttatttgtctttaagatttcatagcatataaaaatgtattttggatgcagatcatttttaaagtctttattgaatttgttaaatattgtttctgttttatgttttttggccatgaggcatgtgggatcttaacttcctgaccagcgatcgaatccacacctcctgcattagaagccttaacccctgggcctacagggaagtcctccaaatgtgttcattcttgtgtcagaggagattggggagggaggaggtgtttaaccattttaaacacccaggtgcatttatttatctctttaccttagtgctgtatttattcagtgataagcttattgagagaaactatgtctattgaatttgtgctatgcaaacgccaggtgcagaaaggcttttttttttctgtcacaggatgctgtcaccttgttttcatggttttccagggttttttattctgctctgtctttggtcaaagtggccttcatgaagtggctgggaatcattttgctcatattctcccactgccatctcctccttggaaccctcttcccacagggaaggaaaggtccaccctctggagtagctgaagagcatgcccgtgtaacactagcgccttggagcctcagaactagaaacacaggccttgtgtagcaggtgactcctagagagttgtccctgcaggagttagccctacgaggcagctgacacacttaccttttagacaaggtgaagctggcaaagagagcagatggtaactgtgtgtgttagactttctcactagaggcactttccccttaagtggagggcaggca

SEQ ID NO: 26183 - DNA, 1566 bp, Bovine  19866881616269
cagatatgagtacaagtgaaacagaggaactgaatgagatcggtggattgtatcaatatcttgtcatgacattaaaagtagtttcaaaaaatggtgaaaactgggcaaaatgaatatggcatctctctgtattatattttacaaccacatgtgactctataaccatcccaataagtattgcaattttaaaattatacttactaattatataaatttatatattccctgtggtaaactcacaaagagaaaaatcaagagtctgtattttgcagaaatatatccattgtttaaagtgagttgctcatctttttcttttgctttccttattagagggcaagtcccacttcacagtgattgctcttcaaatattccatttatgaaatggattcagggcaattgctgtagtgttattgaaatctctaaattcttgtccctgaagtgctaaagagcattggaggggactcttgtgatttttcccagcggcaggttcccagccctgcagaaagggacacaaattggagaatgacgatcaggtgaaacaggaagccgggagtccagggtccctggagcaccccccccaagttgtctttgggactgtcaatgggtcctttcatgacctccttttcgcttatagagtgccacattctctgttattcaggggttggaactattgaggaggcaacaaaatattttttctcaggacaaccatctttcacctggattctcgtgcgggctgtgtgcgctaagtcgcttcagtcctgtctgatgctttgtgaccctgtggactgccagggtcccctgtccaagggattctctaggcaagaatcctggagtgggttgtcatttcctcctccaagggacattcccaacccagggatgcaattctcatctcttatgtctcctgcactggcaggtgggttctttatgactagcgccacctgagaatccctacctggatacacattcaccaaattaccactgtgatcattttgcaaaaatatgtgcaatgtttcataactgctcgcctttgtaagtaaaacacgcctttttaaaaagatgagatcagaagtgcagctgctaatggctaggttcgggtatgtttctagggcacttcgggccctccttccacctgtccaaactaagagatgcaaatcgtccctcgtacctctgtgtttttgaacgcacagacatctgtggctaatcacacaagaatatgaacgaactgaagcaccagagagacatctactggttgtttttttttttccttctggactggcttttcagagattattttcagtgtcataaggaattataactaaccagcactcatcagcatggcttataagtactgcatatacggctatgcaattatattgcccaataacctgggacaattaattggaagcctggaaggactgaaatgctcacggtccagtcttcccatcacaggcactttactggttttacagggcttctgacagccaggatggcagagagccaacctgttacattcagtgtagggcgagtggagggtaggcacacacagagcagttcacaaacatgccc

SEQ ID NO: 26184 - DNA, 1147 bp, Bovine  19866881770610
aacacaagtaattgtcacctaggtatcagaattcagagctctagaaggctctttattctgggaaacatgtaggttgagcatccttgaaatggaatcaacaaaacctgtgcactcccaggtgtgaagaggtaattgcaggtgcaaatcggcgatggcatgagcaaccagcaactgaatgtaataagcaagctgcgtgctgacgccttggtgcagctccttggaaagagtctttttacttgaattcatttgcatttctccagccggggaggtgcataatgaaacactctttatatattccaccaggcccatcagtcgataacagtttcaccttcagctcgtccatgtaacttgtaggggtgtgagtgtgtgtgtgtgtgtgtgtgtgtgtgtgtgtgtgtgcatgcatggcagttagtacatatggtatcaatgcttgcatttggatctttcaacataagaactgcttgtttgaaaattctgtcaaaatgcaggagtctgaatggtttccagaactctgtagccatacctggactaagaaagtggaagtcaagggcatgggggcggtagccgatcagagtggcagggaacttgaccttcatttccacgccggagctgatgaacatgggaccacgctcctcagcatttcctttgtcttgcctttctcccactcaccaagcttctttctcctgtttttctccctctccttcccaccccgctccctcaaaactaggagggagtagcccagttaaccaagatggaagagattaaaaaagaagagcaaggaaattctccgatttccattttgagcccaggtcaaagtctgggtagaataaaatacttcctgaaatgttaaaggtaaaaaaagatattaggattctgctatttcagctctgtttcggaagagtatatagcagaaccccatgcacagggcaagccttgccccctccagggtatagctttctagggtttggggaccccacagaggaccttgtggattcttctcaccagagtgggagagggctcactgcaaaccggtataagaaggcaattgcatttaacctccagcaaagatattacaagagagcatagtagttttccatggctgtttttaacaaattactaccaatttaggcttaaacagtacaga

SEQ ID NO: 26185 - DNA, 1872 bp, Bovine  19866881784463
tgaaaaactgacacagcacaaacgtgccctggggaaattttttccgttgatgtgccccgtctgaagtggaataattctgggtataccttgtttcaccctgatgtcttctactgaaagaaaatcatagaaaaatagatcttgactcattggaaaagactctggatggtgggaaagatcaagggcaagtggagaagggagcgacagaggatgagacagttggatggcatcaccgactcaatggacaagagtttgagcaagctctgggagatggtgaaggacagggaagcctcgtgctgcagtccatggggtcgcaaagagttgcatacaactgggcgactgaatgacaacaacaactgatctctgatttactggaatcactccacattccttgatcgttcagcagagtgaaacgcaggaaatttttagctggagtcttccttctccaccagttcatggagaaaccactaagattcccatgcataaatttattacattattatctagccttcagattgcttgggggagtatcaaggatgcttttatacacaagtgctcagaaagtacattttgaaaataacagtgtgctatgaaaatgaatctctcacattgatcctctctcaattaacttttctcagccttaacatccggtgtcttagagagagtgactaggtcaataccaaatgttatatctaagaagaaaaccttgctaagactacccttctctccgtgaataatatttacaattgttgtaggtataagagcttgttttctggagtcaaccccattgaattcacatactgtttctaaatattagtactagtgagtccttgggaaagagacgggtgctttagggcttggtcatctgtgaaatactgctattaacagtcaccatctcgaagaatttgggagaaagttgggctgggcaattacccactaagggcttagtatattacatattcagtatggttaagtctgtacctctgcaccattgttcttatgaacaaaaatgcacttaaaatatctgtaattgatttttattttttgtaatcagatcagatcagatcagtcgctcagtcgtgtctcactctttgcgaaagtctcgcccatattgatcatcctaatctacatcttgtaatctggaaccaagctgctgctgctttgatcagcaatagagtcagaggccacagaaaagctctttctacatttatcatttatctttgcagtctggagcttctgttgggcctcccaggtctgaactccactcaactatgtgcaaagaaacccagaatgaagaaatattccctgctctatggagaggcataggtcttttgctcttggctggcaaatgatcagactctctgaccttcaatgtctggtgaatttcagcctcatttcatgtaattcccctcatccagaaaagccttgaagcacaggtgcagaaaatcctatcaatctcaacgacttccagtgacattgtctgcatctgctttcttccagaggaatctcctagcgaggaggggcagatttcacttgggaacctttggaagatgatctcagactcattctcattttgaataccttgttattaccacagagcatcttgcagtgtaaatgatttccagccacccttcgtagaaaatgacacagtctatcctacttgctgttgagcaggtcctggaatgactgtatcttgttagcaggggtttgagttcactgacacttaaaagcagcaaaggctggaaagttcccagactttgtaagttcagcttctttgatgggcgggtatgagccatttcccactttttcttttgtctcttgacttccccctccttccctactttcttttataaacactcaagaacacaagtaatt

SEQ ID NO: 26186 - DNA, 2054 bp, Bovine  19866880393601
gctcctctgtcctggagttctccggcaagaatacaagagtggccattctcttctctagggtattttcctgacccagggattgaaccctggtctcttgcattgcaggcagattctttaccgtctgagctatgcagaacataatctgaattaatatgtagagaaataaaattttggcaaaacaaaaactaccatttagggaagttaaactgtatactagttttttctgtttatccttagcagtgaaatatattacaggtaacattccaagatatcagttccatggttaaaaaaatttttaaatatgggtccatggttaaataaaattaaaaaaaaaataccgtgcatactgaaataataatagaagtggaaagtcaagcattaatatcattcacataagattttaacttgttgtacatttttgtagttcagtaaatgttctcggcatcactgacttgatggacgtgagtctgagtgaactccgggagtttgtgatggacagggaggcctggcgtgctgtgattcatggggtcgcaaagagtcggacacgactgagcgactgaactgaactgaactgaaatgttctcgaagagccgattcactggagaagaccctgatgctgggaaagattgagggcaagagcaggggatgacagaggatgagaaatggacatgagtttgagtaaactccaggagatagtgaaggacaagaagcatagactgctgcaattcatggggtcgtagagagttggacacgacttggcacctgaaaaacaacaacaaatgttctttataataaaaaacaaaaagtgttatttacttaggacaaaaataagaatgtaagggaaggaagaccaaaatatttttatatgcttattcagagacacagaattttcatgaatttaagaggaatgaagatattcaaatagtaatagaaaatcattagacttatctgaatgttcaaatgcttatataagttttcaatccatttggttttataaaaccaaaactttgaacacaaaacagaaaagttaacattacctttttatatgttcccaagtatcaaactgcatctatttattatggatttaaagaacacagattttaaaagtaaagtacagaagtatctgattctttttaattccacaaatactagcatcccaaactaacatgtaaacaaacctctatgctgcttagtgaattctctccaatttctagaataaacttcgctttttaaaaattttaatgcaagcgtctgacaatctggactgccgagacctccacttcaacaactgagtcaaacacactgccagtcacatgactgcatagagagccagcccacccccacgtgatgctgcagctgctggcccgaagaccccactcggagaactctcgctggtggttaagagcactgctttgcagcgtggagaaagggctcctggctcttgaagcccacagtctagctagagaaggtgcagtgaacaggtgacttcaacggaccatcattagcttctagctgggtggggggggactaggcactgcgtgcaagcttggatgctgctgctgctgctgctaagtcgcttcagttgtgtccgactctgtgcgaccccatagacggcagcccaccaggctcccccatccctgggactctccaggcaagagcactggagtgggttgccatttccttcttcaatgcataaaagtgaaaagtgaaagtgaagtcgctcagtcgtgactgactcttagcgaccccatggatttcagcctaacaggctcctccgtccatgggattttccaagcaagagtactggagtggggtgccattgccttctccgatgttataccttataaaactattttaaacttttcctttcaacctgacttagtctgatgtttcagaaccattcttcaaagaataaaacactaaccatacatttgaaaaaaaataaaaacagccaggaatatttatgaagctttggttccagacacttcctggcactggagactcagcagtgacaggacccagtccctgaccttatggtgattccaggctaggag

SEQ ID NO: 26187 - DNA, 644 bp, Bovine  19866880483668
tatatttttttttgcatgtcttactttacttttctcatatttctttcttttctcacttcatttcccctttcctggtgaactgatgatgaataaggctagattcttctactgccagccaggcctcctctgcctgacccaaggctgagctcacaatgacagcatcaggtgtgacggatgcgggtggaggagactcagatgagaagatgagccctttccaaatctcaccataaatctccaaactgctgaagtgctgcccactcgttacctcggttacagcccacacactctgtctcctcacagtcatagatgctcctcaataaaacgaagttcattactactaaaggaattttttttcttttttgcttctccctggaaggaacaaattattcttgtgttgaacttgctgcctactcacgcccagtctccttttgcgccttccctgtctctaaccccgctccctttcgcgttcactctctgtgctgctgaacctcactgattttaacctgtggagcagcaaacccaggcccggcagcaatacaattgaccttccttgggcaggccagagtaaggcatctggcttccctctgagatgcctgcttcactcattttacagcctttacaaactctcagcttttgtgctacca

SEQ ID NO: 26188 - DNA, 978 bp, Bovine  19866880505131
agtgaaattgatgggtgcttctggggaaaactggtttgggaaaatctaagaaagtcggttgaaaatggctcaatatttttagttcagtagatgaggcagatcaatgacctggaaatgccatttagcctgatttgacttattttattgggctgaatctcctctttccatctccattctcccccacaaaatgagtacacattaatgtgctggactaagcatgcatgctaatattaaaaataggaaagggattattcaaaggtgacaaaaaaaatcctagttcattcaaatcctacagcagtaagaaattaactcagaagaaatgaaaaatatatgacatagataaagacaataaacgtctatttaatgactaccttgtattcaaagcaaagtaacaaaaagaaaaaatgtcaacattacctagaatgagtaagtagaaccaccttttctaaatcaatgaaatatatgtagcacttttgagtcacttaacataagaaaaaaaaatactataaattaaactctaagaaatattactttgaagtaaaaacttttaaaaactataaaaattccaagcaccaagaatatgttaattattaaataacagaaaatttccagtcaacagcaaacctaggcctatgatacatcacccacctttccttgtactgggttagcaactggtaaagtttttctgtttctccactttcatataagtagtctgcttgttcaaggacttcttcaatttcgaagactataaaagaaaaaaggcaaaataaagtaagtcttcccaagccagttggcaataattctaagacacatgaacacttttacatagaagcaaaagaaatcagatacagaaatcacctataaagaaagatcagaaattctgaacaatcaaaatgtgaagtgtagtagaaataagtatgaagctattacacataatacttaatattcacttacttaatgaatatgaatattcatgtt

SEQ ID NO: 26189 - DNA, 1803 bp, Bovine  19866880543816
tatttcttccccagtacgtttgacgatgaatggagacctgcagaaactgaagcgtctcagaaccaagtcacctgatatgagtgtcctagagagaatgtttggagaaggcaatggcaccccactccagcactctcgcctggaaaatcccatggacagaggagcctggtgggctgcagtccatggggttgctagagttggacacgactgagcgactcactttcacttttcactttcatgcattggagaaggaaatggcaacccactccagtgttcttgcctggagaatcccagggacggggagcctggtgggctgccatctatggggtcacacagagtcggacacgactgaagcgacttagcagcagcagcagagagaatgttcatgagcaactaaccccaatgatgtctctggatctgctctgatttctgtcctctgcaaggtctgtgttgcccttcctttgattttgtgagcaaccctttaacacactctcctaattcatttggattagccagagtcagtttctttagcctgaaaattaaagaatcttaatcaaagtgacaattataaaagcactacaggatggcaaacatgattggcaggtcctttgttccgtgggttagtcattagattcttgtaaacccactcggttaagctcttggagcacactgatctaatagccctctaatagatttaagagaaacaaaagtggactaacacacaataatcttttccacagatgtaatttaaatcattttttcctcttcaggtgtcctattctcaagtttttcataaaaatacatttttccccttcaagaagttgacttttcacttcaaattcaaaatgcttcatcaagttagtaaagaattttggcttaagttgttcctagaaattaggtctactttccctcaatgccaattaaaatgacatagtctgacagagtggaatatctgacgtttccatagcagctggcactaagcagctttgcttactaattagtctcatggtacagtctgaaattccctttatccaaagaccagaggttagaagatatggccttttttgtaaacataaccttatgtgacaggaaaccaaaaaagcaaaatttatccagatgaaacagaaaggggaaatgtgctcagccaaactgttagattcaagctgagagttggcagaacacggggaagaaaataccctctcctgatttgttatcatatacatactcagtggaatacttaataatcaggcttgttttgtaatgcagtttggcaactggcatctccagtacccaaggtctttaaatttcattacaagacatgatttaacactgctttagaggacgtcggtctgctgattcagctccaccacttcctgtcaacaagaacactaatattataaaaaaactcttctcacgtactcagtggttatttaacaaagtaatctagctctcaggaaatagagaataatccatcaggccaaagagtttactgggaattcagagctgcctcacaatatccaggtactcaagtttatcctgagtcttctttacgtatcttttggacccaattctaagtggtataaaagtatggttttattgctcccctttggtgggcagcaaatcagatgtaatataaagaagccagagaaaactaataaaaaataacttctattacactgacagttatagaaggggcaagaaaattgcagaaaaagcaatcataaagctataaaacatgtgcttgtctagagtcatttcaaagacaggcaaatgagcttattcagtttagtagcccttgaggcaact

SEQ ID NO: 26190 - DNA, 5244 bp, Bovine  19866880546869
tcgttttagttttctctttagagtgactttgaatgtcattttttggaggtatgacttttttgtatgtatttaataaccagcaatgctactttatcaaatgggaggtaagcagtttggaggtaagcagtcagtaacatccttagtaatttacaaaatgaaacagttttgtaaaaataagatttcttttagtcataaagccttttatggaggggaggatctgtctttgatattatgtagagctgtttaaaattttttccctttgcaatagatttgtaagaagttgccaaaacgtactactcagaaaggtcctgcggatcctccccgcagtgtgcctcgatggtaacaggtaacggcagtacagtatcaaagccaggagactgtacagtccacagacagtattcaggttttaccacttttaagtcatctcacagtgtcatctatgcagttgtgtcacatgtaaatttctgtaactgccatgatgaaaacacagaagtgttccatcacaaaaactcttagtgccgtcccttacggtcacacacattgcctgccaccatccctaatcctgacaactgctaataattctctgtagtcctctataatcttggcatttcaaaaacagtatataaatgaatcatacagaatgtgatcgtttgagattggcttttttcatttggcataactcatttgagatccatctaaatttagtcaacagttcctttttattgttgattatatttcactgaatgggcgtaccagtttatttaaactagccaccttgcggcatttgggtggtttcccaactttggcgtctgtgaacataaggtatgacttttatcagcatgcttttcatctctgggataaacgtccaggagtgtggttgccgggtcttttatagagctgctgtgtttcttcccccgcccctttacaaaggaatagctcccccttctccaagaagtggcaccttcctgagattctgattgtgtgctttttcagcctcttttgacttcccaggagtctgacctcccaggtctcacactgcctcctggcatctctccactctggatgagaactgctgcttccgggagtgagctctggggccccattattccccttcctgtgcagtgcccacttaatcggctcttgtgtccagagctgactgctagtttgagatgcctatttccccacatacatgtcagcagaagtgtgctgtattctgtcttctaagcataccgtagacatgggctacgggtgattacaactgcctctgcttgtgcacctgttaccttttaagaatgagagcagacatctgacttggaaagtggctattatcctactcttgttgccagaaattttcctatctgagtggactagttatagattttgtaaaaatgatttttctcagactcactttttaaaataaacataattacatcaaggaaaaaacaaaacaccctgagaacttgatggaattttgaggattaaaaaacatgtatttaccaagagtatcagtaaatatttaaaaatgctgttaacatctgattgtccttggtcaaagactggggagagaaaatttggaattgaggagaatgccacttctgttccaactagagtgcatgtgctgtggaagtgagggcagaaggtgccagttttgtactattactctttgttattggtttgggatccccctgcccttttttttttttttttttttacctacttcaaccacagaatatttctggtacattctgtaatgcccattggagactcttttgaggttcaaccaaatattcagactcaaaaagcctgtgacaggcttcatctggcaccagttcactcagatggacaaaaaccaagctggcccttggcggtccatgtcaggcttcccgacattcggatgaccttacagcagcatcaggagcagcgcatccgtgcagctccagaacgaccatcgccccgggtcacagctcgggaatcccaaagggacaggcccgtaagagttttcccatcccgggaagtccgcagctgtggtttcctgtcaaacatctggagtcttcccagtctggacacaatgtaccagttaggggtcctttttatgaacagaaaaggtactgcccacagcactgttggcgcaccaacctacctagttttgaaaacgggaaaagctagggtgtctgagctgcggcccaagggcgcaagtgtcggttaacccttttgccccacaagcactgaacacacaaaccccacgggtggcctctctccctggcaggcaggcagctgctctgatgggtggactcgtgcgctgacgcgcggtgctgggagtgaagggtgctgggcccgcctctgcacccactgcggggttgtggtcgggcaccgggggccttgcactcaacttctctctgctcagcccagcccaggacgggcactgccaagggaggggaggacacaggtctcaggttcctctcacggccagagtgcacgtaccagacaagccgggatatcctgcctacaggcctgggtttctaggaatcagacagaagagcctgacgagctctccaggacgctggtttcctctctgaagcccctgtggtatagcagtttcttaccgggagtgaggaggcaggcacgggcaccctgagagctccgtcaggcctgccacatggccctttccgcacgctgggcgacagccactgccgtctcagcgaagctcagcggcgctgccctcgtggtctaagtcaagtggcccttctcaaagactgggcaccctcgcatgtgtaatctgtcctgtacactcattctcttattttttattctttaggcatgagaataactagaaagtcaggaatgaggatttgggaaaagtattcaaccaagtggatcacggacttttatttcatctttactatgaattctgaataaaaacgtagaacataatctaaatatgtagaaaaagttttggcaaagcaaaaagtattgtttagagaagttaaattgtatcctagtattatctgtatgtacttagtgaaatatgttactggtaacattctaagatgtcagttccatggttaaaaaaaatttacgttaatgaaatttatagtgtatactgaaatgatacaagtggaaatttaaatttttatattaataaggaagccccacttgctaaagtagcattaataccattcacatcagattgttacacatttttgtagttcagtaaatgtctttgataatgaaaaacaaagtatttacctaggacaaaaataataatttatataaaaaggggggaagaccaaaatattttttatatgcttattcagatacatagaacttttatgaatttaagaggaatgaagatattcaaactgtaataggaaatcattagacttatttgaatatttagatgcttatgttaagtcttcaatccatctggttttataaaaccaaaatttcgaacacaaaagcagaaaagttcacattacctttttatatgttcctaagtatcaaattatatcaatttattctgtatttaaagaacatcatagatactaaaactaaagtacagaagtgtctgattctttttaattccacaaaaagctagcatctcaaagtaacatgtaaacagacctctatgctgctcagtgaattctccccaatttccagaataaactaaatggtagtagatctagtatatgatttactcatgtaagttacggtttcattaatgactttgactgactgtattagtgatgtagcaaagagggaaaattttcaactactgtatttatttaaaataaactgacaggttcaagcacccatcttaagaaaagccagcagcacttttttaacatattcaaagtaagattttggcctaagcccttaataccttcctgaacagccattgcagctaaacaccctcaagagatgttacatcagggaaaaaaacatggagcaatttgaacttcttcccctggataacagaaaacaaggtaaagcaaatccagactactttcaaatgagtggctgtcacgtttaatacactctgagctctataaaactagagccactatcatatatgcttatatagatatatacttatttttaataaagtctcttgcttgcttcaaaatttaaggatgatttttttttttcctggtcagtcatttcaagggaacaataaataaaagtagaaaaggatgagctgttttgcatatttctgtggaagaacggaaaacatttatacttttgagagattcagaaaattcactgtacagaatgaacagcttatatacactatctgtgcaacttttcttggctggggtatttaaatgcaagagctcctccaagacaagaagccacattcattcttgtccaaatccctctgtttcttctattgcaaaaagaagtttttcctttagttgttcataactcttatatggtggtagatccaagcgattaaaactgaacaaaaacaaaaacaaaatgtgttttcaataaaataaacaaaatatttctaatacaatatattttaaaaatacatttgaaaaactgaacaggaagaatataaaaattttgttggaagtattctaacagacaatttactactatattaatacttagtgaacatattaaatatacaaattttcttatagcaatcgactcaattttaagacctattcataaaaatattttagtgtttcccagagaaagctggaattacaaatgtaactgtagcagtaatggataaaaccactggaatatttttcctcttctctatagtatcaggttacattgtttctggagtccccctaacttctcttgggttaaaagagtccatttctttcactcattcacctatgaattcactcactcatcagttacttactgaatcttttctgtaccaggtatttctcccaggagctagtgatagagatgaaaaactaaggtccatgttctcattgaacttatattctagggtggagactgtctatcaccaaatatatacttttgtcttttcaagtatcttgtcatatgttgggcttccctggtagctcagttggtaaagaatccgcccgcaatgcaggagaccccggttctattcctgggtggggaagatccgctggagaagggataggctacccactccagtattcttgggcttccctggtggctcggctggtaaagaatccgcctgcaacgtgggagacctaggttcgatcccgggtgggaaaatccccggagaaggaaaag

SEQ ID NO: 26191 - DNA, 1585 bp, Bovine  19866880735367
cgaaccagctggcgcatagtgaaaacaagtggagaatcttttaagaatgaagacgttcatcagagaaagctcaaaaaatcagtttacttactataataaaatagccctgtgagcatgacgctgtgcacaaaaaaaagaagttaaagaaatattgtttcgttgttaatatattattacaaacaatcaaacagtttaggcatttttttcctagcctttcttacttcttagatctaatgaagccttaacttgttatttttaatgtgaaaagcaaaaggtctagatttaatataacagtaaaaagtgtcaaccacagattggccctctccgtgggggcttgcgatcacctctacagggactaaatcaagtgacgcagcagctgcagacctttaatggcccctgaaggagtttagggtggagagcagaagggaggcaccctgtgttcagggaaaaactggcaggacaggtcttcagacagttaaatactgtctgattttatgaagccaattcttgcatctccgcatatctagaaaagcactaaaatccttcacggtcacgacggtttctcatgactagcagaagcttcacaagactcgtagaaacctttagggaaaacctgtgcttgattccatgtatttccccctttaccaaaatcacatgaacactgacctttcccctgcctctctggaacagtttctcagagctctccaaggtgctgtctctgcagccctcagattgtcccaaataaaacttaactcaaaactctcacgctgtgcattttttacagttgaccacagtagtgtacaaagctacttttctatttattttgtaccaaaattttcactgctgtttgaaatatcacacaaatcatattgatctttaaagttctctgaaaaatgaggaaaaaatttatggatctaagaaatgaaatggttttcaataataatagcatctctactgtgtttaacagtttatgaaacttttcacgtacattaatttaatcctgatttaattttgccatgtagacattatgttctccattatataagtaaggaagttaagtaaggaagttagataacctgctcaagatcccttagctggttaaaggtctaagtcaagacttggactgtggtttgactccaggtcccttcatgacctttcctgctttcaccatactaattatcaaaagaaaaaaaaattaaacaaataaacaaaaaactcaccccagtttgctgacctctgcaatacatgaaaaggctcctatcgggaatcttatgtaaaaaggtgactaatataaacgtgtctttaaaataatatatctatattggctagaagtgaaaacatttaagaaaattcttagctatctgctgcagctccctgcttctactttgctttcctttaaaaactctaaaactaaagccatccaaatgttgtagtaaattataccttcctctgagcgccgggagttggtaatggacagggaggcccagcgtgccgcagtccatggggtcacaaagagtcagacgcgactgagtgactggactgaactgaacatcagtgacgcaagtgtcaccactatcgtgctctg

SEQ ID NO: 26192 - DNA, 1462 bp, Bovine  19866880798137
atgctggcttcctagttttgttattgtcctatagttctaaaagcatgctacctttgggggaaactgggtaatgggtacatgggagctctctgcactatttgtaattatttcaaaataaaaagttaaaaaaattaatacccagagaatgaaagacccacatttaaaagttgaaaagcaaaagaaccaacatcattaaatgccaaaatgcaggcaccaaaaaaggacttgttaaatgtgagcatactaaagcgttcccgagtaacggtttgttgtgtgtttcgtggcctattctcgagacaagatacaagcctagaaattgggaactaactgctttttccccgtggggggaggagttcttagtcttttatcaaaatcccagttaaaacttggttgctaataaaattgctttgatttcatctgttcacaggctccaaaagaagcacttgctcagagcgtcttggcggaggtcccccagcaggtggtgggctacttcaacacgtacaaactccttcctcccaagaacccggctacgaaatgagaggcgccctggtcgtccgagcagaattctgttgtgctgtgtggagcaacagatttctcaccatctcaaatcgcgaatctgtcattttacacccttctcagaaaccctacgatttacaatgcaaacctagctctctctgggagtatgtctatttaaagcattctttttatactgtttttggaggagagcgctaacttaggctttgcccagtcaacccagtgattgccagtcattgcagtaattgcggtgaggctgtttggattaggagccggtgcgagaaaagcacacgttcttgtggttgtttactttcatgtgatgaaaatgctgtttttgaatgtttgtcaatagaaagaatgggaaattgttggaatgatgcaatttacaggttgctgtgctttgcttaggcgatatatgtattataagccgatgtccacaccagatgaccagagtttcttaaattagatgatactgaatttgtatctagaactatattttatgcttttccgtgggataaaactaccttcacttgtgcttgagttttgctgcaacttagacatgcacagttcaaaacagaatgcatcctcagaagacttcataagaagtcccaaattagaaaggaagacacatacatattcagttcttaaagctgtaaaatcaacaagtagaaggaacttcctgtaagccattttatttgccttcctggatctttcattttcactatttaatattgtaaatgtggtcagatttgaccttttcattgattgtatgtgacactcgggattctgtatgtgcattaatgatagcttgtcctagactcagcattattagatgatttcaactggagtttgttaaaatgggtaggactggggtttgtccaggaaaagctataaggaccaaacatataaggggaaattcggaattgca

SEQ ID NO: 26193 - DNA, 803 bp, Bovine  19866880845385
gaattgaaggatttaagtaagcctgtgcatgtcctcagttgttaagccatgtcagactctggtgatgatgccttgaactgtgacttgcagacttgatcactctgcatatgttgacagatccatgggatttcccaggcaagagtactggagtgggttgccattttcttcttcaggggatcttctggacccagggatcaaaactgcaatacctgcacgtcaggcagactctttgccactgagccacatggagagccctttaagcagagtatgttaaaaaaaaaaaatctttgtatccatacttagaatttatgttccaaatatttaccaagtcagtagccaaatgaaaatgatttttgcataaactgtgaattaaaatttttaagaaactagacatttaaatttatttcatttaaaaatagtcggtttttttttagcatttatatttttcttataattttaaagggagaaatatgaaatataataggtgaatggggccagctgcatggtggtggatggtaactaggcttgcagtgatgatgactctgtatatggtgaactgcaacgctatatacctaaagcttatataataaaggtttgaataaattagaaaaaataaaatgattgattttaaacagtatattttcctaaaattaaacataatatctttgacttgcctctagcttagttgctctaggaagtatccaatccacatccattaatttcattacttgtgggccaaacacacccattgaaagtcaatatgtaaaatatatcacttagatcatatataaaggaaagtaaaa

SEQ ID NO: 26194 - DNA, 827 bp, Bovine  19866880870171
atttgaaagacaagaaaagatacggctgtcttcatttgcatttctttgggcattagtgaagctagacgtttttttaaagcgtctcatgatttatgttgtctgtgaattcttcccatcctttcctaccaccctgtgtaaatctcagttctcaattaccaatttgtatagaaacaaatacatgtacaataagacattaaatctgcaagaggatagaaaatactatttttcaatttgctatttaacttttaattgtgcttaagatgttatacatatagatgttacactttaagtatgtacgatcgagctatcgatacttttccgtaagaggaaaaaaaaagccccttcatcattaaacatcaaataaatttggtcacttgctcaataagaagtaaatttcctgttttgtcaggcttcccacatgggggcattggcaaccttccttccctaaacaaaacaacgaaaagttaacacattcctaagcactgggagttccaagtttaaacaatggataactattttacacaaactataaggttaaatatttgagaaaacactgcatctcacagagggcctggatcctctagaatcaaggcagaaaatgtctccccaaacacccaagcatcaccgtgagcctctgggtacacattcgtcctcacaggggctcaggctctgcatgaagactgaaggcgtggcaaactcacttacctacttgattgtcaacgtcatgtgccagccacagacagctcagtcattgagggcctctgctaccttgagacatggctctcaatcaggggtatttttgccccataggggccatttaagaatgt

SEQ ID NO: 26195 - DNA, 1603 bp, Bovine  19866880906828
cgcttccctctatgtgagaggaagagtcgggctatatatcttttttgtgctgagaccttaaagatcagcttttaacctagagtgggtttttatggctgagttataaacatccaagagctaaaacctgacatttccttaagtattgtcacatctgtacatgatgtgtcagtaatttcagcacatttcaacttctgctgaatactatgccttaagcatgatgagatttgattttatctgtctaaacaacacaaagagaagtacagaggttgcagtttcatgatgaattgagtccatatagccagccacactgcaaaaatctgtgaaggatgcttgcaaaacgagattcaccgaaatggactagccattctgccacgtaattaattgctttaactttctttgcacatttcttgcataagcacaagctatatatttttaaaatatcaactaacacctttgtagtaatatgcaagcttgcaaagaagaacgtgtgcagtcacatgcattatgagactgaatcctcacaaaagcctcacatggtaggtaaaataggttctactgtcctcgttgggtcagaaaggatatgatttgtccaatatctaatcagtgaatggttgaaagtaagacccagtatcagtgtgttaaaagatcaggtgatcagcattagaatggactgtgtcatgtgagaactcaattcacctgggcttacagtaactcttccacttcctctgctgggtgtggagtgatcatatttgtggttttagatgcaagacgtaattggggcggctacagccaatcagaacaacttccgcatctgcatggatcataccattgcctatatgaatacttattccattcctaagactgtgcagaatcgggtccggacttggtatgaatatacgtgggcctctcaaggaatgctaggtaagcattgggaattactgattaagtccctgtaaaccgtgtcccataatgaaaatcctgtaaggcagcagcagagactaattggatttgaacaaaagattgggaaacaactaaataatctttaaagcactcacttaataccatgggatttttcctcaaatcaaacataacttactgattatgcaaatcctggaaggcttgctaaattttctttagtgtccaacagatgctagatattacacacattacctcatctaatcttcacccagaaaaatgggggaaattaggcgttaccaacccccttttaggagacaaggaaatggaggctcctaactgaaaaaaaattggccaagggcacagagccagcaaatggcctatactgagctcagatgtgcacctgttctccaaacccttgctgtctctgcgatatcatcctcttcccagagctcagcgctcagagcagcgatctttcaggccactctcagctgcaggtctctaccaggagacccttaatcattcaccgtgtctactgttagtaccatagcactggaggtaaaagtaacacttactaaaagatataaagtaagttaaagataatgtgctacttaacaataatcagattcaacttctagtttgcacctcaccctataaaaataagaactgctgctgctgctgctgctaa

SEQ ID NO: 26196 - DNA, 1442 bp, Bovine  19866880909182
agtgccccacacagaataagtgttaggtgaaagacacttaaatgtaatataatgcattaagaagaggaaaattagaaaattagaaacattcaaaacattaaaatttctttgctatacattttttatttacaaaaaaagacctctaaatttgaatttggccatgtaaaacgtttggatccaaatcatttgtattagagacataattaggcgctgattctctgactgtcaggccaatccagagctaatctggggcctgattgtcatgcattgccaaggcatattcttaaatgggaaatgacgtgcttagtagcaaagacatagagctgtagaatttaattatatttaaattaatgccagaagagcctgaagagctcttcttctttgacaccaattaggagagaggctgctaaagaataagtcatctgctgaagagagacccatagtttatttgactctaatttcacataaagtctccagataactttcattttattaaaaatagggcaaaaaatcataaatgctgtattcagaaagagctttgatacttatcgggaaattgatgtgttgccttcctaggcactggagaagcacttgccttgaacaagtcgactttgctgatgacgccgaagttgacgtcaacagtgagggcgagctgcatggtggtcggcagcgtctccagcagatcggactcatcttcatagagataaacacatcgacccacaaagaagagtcattaataaacaatactgaagctcattaaacattaaaacaataacagtaacaaaatgccaagtcctgttttgtaaatgaacagctgcaccactgtctatattttccttacttttattgaaccggcataccccatcacaatggaaaagaaacatattttcactattgacgacacgacaattctgagtaattccagaactttgtgcttgctgaaactttagatataaaatttagagaggatggggccaaggctagtgagcaaactggggtgggaaaaggatctggttcccatcttctgattccacagccctaacatcctagggatggcaaagaaaaatgagtataatgagtaccaagtggcttacagagttctgtcatgatcttattggatgcttggggcaaccctaagtatgttcattcctgctttctggaaagaagaaaggaaaggggaaatgaaacttagagcaaaaaagtgttaagtgtcttgtttttgtgtaagtggtgagtggctgagctgggaatggaatctaaagaaaaaatgtattaagtgagcaaattcaaatgattgttatttccttgcttattaactcaatgaactatgtgaatacattaaagatttttctacctgtgaattaaatgatgggcctttaggctgataaaatggtccatgaacaagactacccattcttagtctatagtatagtaatggggtt

SEQ ID NO: 26197 - DNA, 749 bp, Bovine  19866880982155
ctatctgagagactgtctcctggctacagtcctcagtaatgttcccaagtaaaactgaatctcactgcttttaaattgtgattttggttttctatcttttattatcagtcgatatttccttgagagatgttctatggtggaaggaaaagctttgtgaacaaacaaccaacttggacaatcaaaatgcatgctaacatactgaagtctctgggaagtcctttggtgattagagcctttgaactttaagatagcattttccaaacaatagattggacaatggctccctttgtttgggcaactagtgtctttagtgacttgaagaagtagtattattttgaatagtatttgagaaattctgatttataacattaattattttaaaaagttacaaaattcatatatcacacaattgtataaatattcatgtttttacttgaagaaattatctacttttgaattcatgcacattttaaaatgtaattggagaaggaaatggcaacccactccagtgttcttgcctggagaatcccagggatgggggagcctggtgggctgccgtctatggggttgcacagagttggacacaagtgaagcgacttagcagcagtagcagcagcagcaaagatggaaaattcaccagtgggaataataaatggcattgttatgctgagaacattatttctatgaaaaaatatgaactaagaaaaaagaattattaggtagaaaggtcattttttacattattatag

SEQ ID NO: 26198 - DNA, 2412 bp, Bovine  19866881247940
tcaaaatcgaaggatctgaaagctagaggggaataaagtgaggctggaggaggggccaatccgcttagcagaatcagaaaagctgcacagggctgccctggcagtccagtggttaagaatcttcctgccaatgtaggggacacaggtttgatccctggtctgggaagatcccacatgctgtcgagcaactaagcccgtgcaccaccactactgagcccagactctagagcccgtgctctacaacaagagaagccactgcaatgagcagcctgagcaccagagtgaagagtagcccccactcaccgcaacaagagaaagtcctcgtgcagcagtgaagacccagtgcagccaaataagtccatacatttttaaaaataaagaaaagctttgcagaggaggggccaactgagctggacagacagggatgaagaggtgttctccgggcagacgctagtaagggcaggcaacaccactgcacggactaggagtaaggcaggagacgtccagcacccctggtggtatgagcgttcaggttctcttctgttccaggttctgattttctagttaaaccctgtgtccagggccacatggagtccatagtcttgcccagtctgggcctctgaactgaggtggagcctgaccccaggctcagaccctgtcccaccctgcatggctcctctccagaacacagaccagtgtgggctggagtccactttggagcatcctggctggtatcttgagtgaggacaggtaaccctgcctgggtccgaaccccagctccccgtttaccagttgggtgaccctcagcaagtgattttacttctcagagcctccgtttcctcacctgtaatagaagtaaggagagtccctggagggctggtgggagaattaatgagttaatacaggtagatcttagaacagggccagaagaagcattaggtaaagctaaagttgagagtcctcaacacagccttccaggccctccttatctcatctctctccctctcccctcccccctagcccagacttacaggccttttctttgaactgccccagggtctggccatttcccctgcttagagtgaaatccccccaaatcctcgctatccccactctgtgttcaggtccctcaccacctctctgagatatcaggtcccctgcccctcccctcaccccactcctggctttagttttcttcttggccctttcgatagacatcacctgacattattgttgttcaatagctaagtcgtgtttgactttacaaccccatggacggcagcatgccagacttccctgtccttcactatctcctggaatttgctcaaattcatatccactgagtctatgatgccatccaaccatctcatcctctgttgcccccttctcctcctgccctcaatctttctcagcattagggtcttttccaatcagtcagctcttcgcatcaggtggccaaaatatcggagtttcagcttcagtatcagcccttccaatgaacacccaggactgatttcttttagtgcctggagatacattaccaaaacaaaggtgtatgtgtgtaggacaggtgtccagtagttctgaatctgtttttcttacttctcttttaaaaaatattgcaaagtcaagtgtctatctagcaccttgaactgccatcaggtaggcttacttcccgccctatgaggaaattcccagggtatcattatgaaaatgattaagccaaccctaatagaaacggtctatatttaaagtggtatgatagatacagtatgaatgtacaagaactgtacattcgtgtgatataattaccgtatatgtgaaacttgctttgaaaatctggatggatatttttaagtgcctaatcgcaggaagatctggaggttttgtgtactataattacacacagtgctgtgaaacaaaggagtgaatcctatagcattttaatgaagagactgtataatataggcttggattcttttgttttccttccctcctactcagccctttccagcagcatttcaacttctatcttttgagattagctctctgattaaaatattttaatattcaaaatactaatttaactttttcagctttaagttttattaatctttaaaaataaattttctcaatgtaggataaccaaggaaatatactcttcaatacttcacagtaacatcaaccaagaatcataggctaagatccacacagtgaagaaagctttagagattcatttagaaaagctagtcaaaagttcttgagtatctcagtgacactttataaccctctacaggttttgcattgtgttgtacagcttggtttgccctaaaaagtttctctgaatcaggtcttctggtgctaaaatggaggaagtgaaagttgctcagtcgtgtctgactctttgtgacc

SEQ ID NO: 26199 - DNA, 867 bp, Bovine  19866881410589
agtttaataagtcgtgaaaagctgatctagaaatttccaaaaggaaaatatgttcattttcttgttttgtgatctttcttcttttttaagtcctacatcgaggcattctataaattctgtaagaatcatggtgacgtcacagcggaagtcatgtgtcccattctggaggtaagaaagagacctcgacttttttatgccaaataatgggctcacatgctttttatttatataatcctaccatttttttattcttagaagttcttttatctggaaataaaatagcaatatattttatcatgtgtatcatttgatgtcttcagtaagagtggtattttcccagttttctacagagaagagctatttgggaattaaaaaagaataacgcttatagaagtttgatcatgatttacttggatatagtatgaaggaagcagattacaattcgttaaacatttattatggtttggacaactggtgcactataggtacccataacaatcaccaagttccctcccaacatcgggcctgttgggaacccccacaacttgtcagcaaaacccactgcgggtggcacttctcattaagtcctaaaataaaggcccccacgagcaacccttgagcaccactgcagaaagaccacgggtggtgattcacagttggcgtgcccgcttactcctcacagcctggcagaggccaccttcggcacccacctctctaacagatgttatactccctttaattcctcttcatcatcacagctttcatctgtgcccagaggccctcttgcttgcaaatgtcaatctgcacacgcacgggagactcaggccagagatcaagggatcggagggggaattctggggagtagtt

SEQ ID NO: 26200 - DNA, 841 bp, Bovine  19866881614227
cattatttggtattgggctaatacttttttattaaaagataaatatttaaaatttcatcttcataaaataaataagtaaatatttgaaaagcaaagcgtcttgagcactaagtctaataattcagagaccatgggagccaatagggagcaaattccttggcaggaacagaaatgtaaggcacactaaccctgagttcaaaggtgacagctcaaccccattctccagcacatctgaaaacttagttaaaggatagtcaaaggcagacatgattcccatattacgtcagtcttttgacggcgatccttaggtattgcatattaatcaaaagactccaacatcctcgattaagatttcagcaccaatcaactcttttcaataactttcttctagagaaaagacgaaaaccaggaagaagaggataaaggaaaagaatctgaagataaaggaagagcaacagcagagaaaccacttgaaacatccaaatgtgaaacgagttccattacagcggaggaagcgccccaggcaactagaaaggcggttttgcccagaggaactacccgtcactcgctcatcatcagcatggctccttctgccgaggccggggaagaggttctgacgatcgaagtcaaagaaaaggctaagcaataaatatgtgatgatctttagacatactctagctagttccctgagagattacagccaggatcggagtttaatctaatgacaggaaaagaccttgccggcacccttgagaaaccacaggcaaatctctagcttagtttctagggcgtatctgagagtggatcttcagcagggcaataagaagatattaaggaaaaa

SEQ ID NO: 26201 - DNA, 3413 bp, Bovine  19866880283220
attctttggcactgcctttctttggattggaatgaaaactgaccttttccagtcctgtggccactgctgtgttttccagatttgctggcatattgagtgcagcactttcacagcatcatctttcaggacttgaaatagctcaactggaattccatcatctccactagctttgtttgtagtgatgctttctaaggcccacttgacttcacattccaggatgtctggctctaggtgagtgatcacaccatcatgattatcttggttgtgaagctcttttttgtatagttcgtctgtgtattcttgtcacctcttcttaatatcttctgcttctgttaggtccataccattttctgtcctttatcgagcccatctttgcatcaaatgttcccttgatatctctaattttcttgaagagatctcgagtcccattctgttgttttcctctgtttctttgcattgatctctgaggaaggctgtattatctctccttgctattctttggaactctgcattcagttgcttatatctttccttttctcctttgcttttcacttctcttcttttcacagctatttgtaaggcctcctcagacagccattttgcttttttgcatttcttttccatggagatggtcttgatccctgtctgctgtacaatgtcacgaaacttagtccatagttaatcaggcactctgtctatcagatctcagaccagtgtattagtcctctataatttttaaagacttcaaagcaaacctgagcagagttggttgtgatcttataaaagggaattacccaaattccctaatacacatctggaaaatgaatcttcacatggctgtggtgaggactggttgtaattatagggtaaaactactgaacgtataacatgagctctcagtgattgtttttccatctctgctttcaccctttaaatttgctaatgatcctctagatattgttatatatttctgcaaaattttagtggcttagatctagagacttttcaccctcacatgtgtatctatccatgatcattatttctggtcattatggaggatttgcttcacataatcattcaaatctgaataactgacggaggctctgtgatcttcataagacttctaaggtcaccttgggcatcagtttccagctgataaaagagagaaaggagaagaaagaaagtacagttacttaactgcctttgcccagcaatggtacatcatttctattcacattccctgagtgattactagtcatatggctttacctggatgtaaggggtttgggaggaggtgtgctggaaaatgtagttttacatgaagcagctgcttctcagcaacaattctgttcttgtcagggaagcatgactcttggtggacagtgagctgcctctcaccctttgccccagcacactctattcttctttcctctctttcactctgctccctgggttgaagcaagggaagctagggtgctgacgagagagtatccatggtgcaaatagcatgatgcacagtaggtctaaattggttggaaaaggaactgagaccaggaggatcctaaacatggtgattagcaagaaaagaaaaggaatcggagggctcattgaggttgtaaatgcagtaggtatttgttgaataaatgacaattgaatgagcagtgaggtaggggtaaagtggtaataactagaagaagaggagcatttagtcagagttgacatgtgaagagctagtatttcacaagtagaataattccgggtgagaaaaatgtccattgtgtccgttgaaatattgctgacatggagagaagataaatggcattgaatttgttgtagagctgggaggaaaggctataagaggagccatggatttatcaccacaggagttgttctagagggaagactgctgagcctgatgcagaatcactgggagcacattggagataagcctcccacctcaccagtaacattaattaccacatgtagtataatgcaatgagtatcaccacccccagcagcaaaaggaagaatgctccgttaggtcaatggttaatttcttctcaagcaactaaagactgatggaatttcactttcagttgctgttatccatttcttgatttagagagagaatgggactcaagaatcataccgttctccatagtgtttagttcttactttagggagcttgattgctcaaatagcaaaaggaccttggtctccccataatagaatctcacaatgtgaaagcccaaggacagtcctctacagcttgatagacattgtgctagagctgcagttaggtgaaatgtcagagtctcatttaactagaaataaaaacctttgaaaaagttctgagtgccactccctgtgcccaagcagatccagaatgtggtttaagctgctgtgcacaaaagacacagggagagggaaatcaaaggcacagaggccagcagagtgcaaaaactatttctagaagttccatgggagggtctggaataaagttaaggaaacataagagaatcaaagggtgtatcaatataaaaaaaagtcatagaattgaaaaaagaattgaactggtggtaactagttggtcagaatttagagaagtccactcaaaaagtgccagctaagtcagtgttgaaaaggtcacgtttttagctgatatcaactctgtgctgtgctacctacttggagaaagctggaaaaatgtttcttacaacaacaggccattagacaagaatgtcgagcttagtacatctaaagtacctcattcctttggaagaagttggagaaggcaatggcaccccactccagtactcttgcctggaaaaccccatggacagaggagcctggtaggctgcagtccatggggtcgagaagagtcggacacgaatgagcgacttcactttcacttttcactttcatgcattggagaaggaaatgggaacccactccagtgttcttgcctggagaatcctagggacggggaagcctggtgggctgccgtctatggggtcgcacagagctggacacgactgaagcgacttagcagcagcagcagcactatggatgcagtacaggctcaggcataactctgccttcaacactccttagccctgtgaccttgggcaaactaacacctctcagcctgttttttaaaaatcattatttaaatatttttatattcaaaacattatatgatttggtgtacagataacaacaaattgagtaagaagatcctaacaataaacattcagaatatggatcctattattgttatttaaagtaaaggttgataggaagggtcttgaggctttttatttttgaaaaatatgccctagttatttttgagcggcataatcactgagctagttatgagcggggaagtccttccttgatcttttatttttcaa

SEQ ID NO: 26202 - DNA, 1490 bp, Bovine  19866880382439
tatcggatctataggacttatctatgtatcagatctataggacttatccactggttacaagtttgtacccttaaaatctccctaattcccccaaaccctggtaatcatcattcactcttaattcccttatttataaaatgtcagcattttttaaagtatgaacaaataggcatataatatagattatcctagtaccaaaaaggtaagtgctataaagtctgtggatattttctgattgttgaaagcttcattgtcaaatgaaaaataaaacagaagaaaagtctcaaatttttagtgattaataattaaaatacctcttccatatattcaaatatattttcttaaaaaaacttttaaaaccaactcctgtctctgtcactgctttttttctgaattgactctgacctgtatatattgaaaatttttttaactagttcaaaatgaactggttggaatcatatggaagtccctgaatcatatggaattccccagtatataatgaatcatatggaattccctggaatataatctgagaatggtttggaggatgattttttttttcccccttgagagtaatgtttaagactcggtggttttccctcatataaataaacattgctgcattcaaaaacaccctgtctgcttgttgagagcttccaaaagagcatatctggatagttttgattaggtcataatcttcaaaacatggcatgatttcagtgacaagtttaaattttttgtgccctattctaaaatgcagttaaaatcctgtgctttagagctattttttactatcataatttcagaggtgaaaatggtcaggcacataaactgttactgggctgtctactggctcgtgaaagggcactggcccggaagccagaaggtctgggctctgggttctggacctggctggctgatgctgcagtcagcaacgtctggatgggagtagagtctcagacatgtgctggaaacacgtacagcatgttcacatccagaccgctggcaccagcctcacctcaagaagagattcccttccctttgacaaatgatcctcgtgggtctgtctggtcaacatgagatgcatggcccatgtcccacccagtcctcccctaatagttagtccagggagaaaagcatcccaaagctcccagaccctggcctcccacttttttcatgacacggtagggaagaatcagattcctcaaggacaacccttgggcattgacaatcccagcatctaaccttaggagctagaatcagacagtgctaacaaaagggcctgctgggcaagggagtcccagcatctctcctgatgattcccatcacgcccttgcttcccacacactgtgccctgaagcgcctcattttccttttgctcttacttgattaatgcccttcataagtttgcctttcccacaactcaccctgcaggagctgctcaggcataaacttagctgtcgtgatctccaggagttgtcttccatctt

SEQ ID NO: 26203 - DNA, 687 bp, Bovine  19866880447362
tctgtcttctgctattttattctgcctgccgtcagagcacaaaaatatacattcacatcgtctgtttgttgtatcgtattcttggatcatacagatttagttacaatacacacacaggtcagccagtgtaaaaagactgaaaagaatgaaaactacaaatgaggacagatgagctatgcattatgtaatgataaaacaggtgtttggggagataaacaatgttcaaaagcaaaggagatttaaatactgctgcatctgtaattgctttattctggttattagacaaaaagaaaatagctttcaaatgaaatccaaacttgctgtgctataattgaaatatatgaacgttgggtagttctgacttcatttacttttgttagaaaagcaaactttatgcatgggagggaaactttttaaagaaactgttcctagtgacattaaaaaacaatgttaattctgtcatgatgcttttgacagtatcatagggttgtttagcattagttgtgaattattggcttgtgcttctcagaatcatacatacaaaactgagcaatctagggggtgaggatgctaacatactatctatttttgtttataggacggtgaactttgacataataaaatacttgtatgatttcttgtgaaaacaagcttcaaagccatatggacactgtgacaatgactaag

SEQ ID NO: 26204 - DNA, 1438 bp, Bovine  19866880458161
tgctttgatcatgttgtttttgttattttcaatccctcatttgttagtgtctacagaaaaaaactagctttgttgttttaagcagcctgacaggtgtccagggctgacttgctttgactctgtatttgaaatgcttcacattttgtgagcttgacaaatcacttatcctctttgaatgtcacatttctctaaaaatgtaaaaaagggagataatgataatactgctcctgcctgcctcaaaagattgggaagaaggtcaagtgagattctatatattaaaggactttgaaaaccacaaacactgcacaaatgtatggttttgttttaacggtctcaggagagttgtctgcctgaaatgcaccaagcgatccctgaacctaactatttgcaaacccctgtgttcagatcagaggcctttgtatgtctgccaaaggctttgcaaagctccctgtgtgatgtcccctctataaaccatcaccatggctaggtccagcaagactgaagattgagggctcatggcagagggtcacccacagagggccaagcctgaggccagaggcatcacggctagcatttaaaagaacaatatttccttagagtgagtacagagagtaaaagatgctgacgctgttgtgaacgttgtcagtactataggaagcattaggacacctctggcagaaatctaaccttttaagcaaatgtatgcacgtctaggcatggtaattaagtcagtcttgtacagaacagagtttagaaagtgaatcctgcttgatctacctttgtgagcaagttacataacctccctgtgccttagtcttatcatctgtgaaatgaagataatcataatgcacatttaatggggttgttagtcaacaaaagcgtccaaaatgcagtacttgggcgaaacctcaaaactgacagaaagatcttggttcgtttccaaggcaaaccatacaacatcacagtaatcccagtctatgccacaatcattgatgctgaggaagctgaaattgactgtttctatgaagacctacaacacattctagaactaacaccagaaaaagatgtccttttcatcataggactttggaatgcaaaagtaggaagtaaagagacacccagagtacaggcagatttggccttggagtgtggggcaaaggctaacagaaatttgccaagagaacacactggtcatagcaaatacccctttccagcaacgcaagagattactctacacatggacatcaccagatggtcaattctgaaatcagatcaattatgttctttgtacacaaagatggagaagcattacacagttagcaaaaacaagagctggagttgatggtagctcagatcataagctccttattgtgaaattcaggcttaacttgaagaatgtagggaaaatcactaggccagtcaggtagaccttaatcaa

SEQ ID NO: 26205 - DNA, 699 bp, Bovine  19866880485013
tggctttgattgcctttaaagaatgggaagaaatgattttataatgtttaggccctaacacaatttttattcgatcatttaaatttgaaataacttaatgacaaaagtgggggcttcactgatggctcagcaggtaaagaatctgcctgcaatgcaggagatgcaggagacatgtatttgatccctgggtggggaagatcctctggaggagggcatggcaacccactccagtattcttgcctggagaatccccatggacagaggggcttggtgggctaaggtccatgggatcatgaagagttggacacaacagaagagactgagtattcatgcaatgacagaagtataaaacccttttaagaagatatactgaagtgtctattgttgctttttgaaaggagctgtgcactggcaagattgagctttaatactaatagatgtagtttcacaaacaaaaatgcctttcatattaaaattaagatgatgtctttatcttttgaaagggttcatttcctttcagatgaaattatgttgtggagattttggtctggcttcctgaggagacaaatgtgaagtaaacttcagaattcaaagacagaattccatggcgacagtggtgaggaatctgtgctcatttgtttttgtagtgatgcatcatgtgaggattttctaacaaagccatgcattaggatgtacaag

SEQ ID NO: 26206 - DNA, 1572 bp, Bovine  19866880544019
ctagtactcttgcctggaaaatcccatggatgaaggagcctggtaggctgcaatccatggggttgctaagagtcgggcacaactgagtgacttcactttcacttttcactttcatgcattggagaaggaaatggcaacccactccagtgttcttgcctggagaatcccagggacaggggagcctggtgggctgccgtctatgggttcgcagagtcggacacaactgaagtgacttagcagcagcagcaagctccaaatcagtcaattacaaatgccctgtgaagagagcttttccaggtaactgtggaaaaagtcaagtaatgacaatgctctggagagaggatgttttggagagttccaaacccattagcccagtggctactaggttgttaattgtgagactcctagtaatcaaggctaccacagcgaaggggaatgagtacaggataagtaagaatgccacaaaggttactgttactactgagattcagctgtttttctttaacagatgcttctcagatttttgtaagcctttggttaccttctagagctttgaaaaatttgattttgataaacttgctagctatctcactgcttttatggaggtgtaatttttaaagactcattctcaaagttcttcatcccttcaaacttttaaaaataagtattgtaaaactttttcctgtactaaaaataacaaaaaatgagaacatgacatttgaagcaatgatcttcaatttagaaccacttatagttcacagtattctaatcctggtaagaaagtacagttgccttagctcatcctagcattaaagtaaaactcattctactatttcttgaaggacagaataacaattggtgcctgactaaataaatgaatgaatgagtgaacacatgcataattgatgaatgtccttcctccccagaagctcaagtgtgaccaagcgaggcaggctggcagcctaccaagatgccttctagggaggcaattattatcttggtgattttaccctgatgccaagtctggcttttggatttgcagactcagcttaaagctagtctgtcagcttataagtggggccacatccctccgacagcttctcattaacccagctgagaaagatcagaaagtcaacttattaatttactatataaactataaattccatgaggactactattcagcaggtctagtgcatttccttcctccctggaggtagatctagatggaaagacaaatccttttgagatgtttgccaggtgagcacagaaacacaacaagaattattataaaacacaaatgtttaatgacagtgagctactgaggcctgagaatctattaaaacttagcttctgccttgttcctgttgcttaggagactagaaataatgaaaaggtaatctcaccatataagatctaagatctttttatctggaggagggagttagtagagaggtaaatgaaagaaaggcaacaaatgccttcttttttggggggtggggtgggggagggggcaccgccagtctttgttggaaagttgagcctagcaggagttaggcggcaggccccagt

SEQ ID NO: 26207 - DNA, 1348 bp, Bovine  19866880562057
agaagattgtgtaaatcctgaccctggcctggcagtttctacaagttataatttatttaaagtttggttttgtgaaaaaatgctcttcaaataggttccagaattttctttctgctccaacacagaccatgaataacagaactgagtataatgactattgtcaaaggaatcatatccccggtatggtatatgcatcacagttttttacaaggcaagaatggagtaatttgaataatttccttaaaggtcatcacctcctttactaccccctccagttccccaattttttagattatggtttaaagtctatttttcatttttatacaaacataaacttttatacgaacattcactgtaagtcctagactgatgtatttcagtgataggtttgtacgaaacacttctactgacatcattttgaaggcaccactgattctgtgtccttgatgtttaattatggggaacttcaccactcagccttcctctgtaataaaaactgaatggaatcatagttgccagtcaccttatatgcaaaccttacaggacaccagggtcagacacgtcaagcaaggactcaagagcccaattgctttctggaatcttctagttcctacccactccacttgctgcttgtctcctgtatattaagttccattcagaaggcaatgaaagaaaagaatctggatctttaacaaaggcaaattgcttacagaaaaataaacctccaatgtaaatggttttcagtttttaaaaaatggacattttgacagttgactatcacaggagtcggggctctctgtgtataggttcccacccttgctgaagatggaatgggtttttctatgggtttggggagctgtggagccaagtgcaggacagccacgatttcaggtcatgtggcccagagccagctgtaggctctggcatagagagtggcttgtgacgaccaggctggcctggtgctcttggcattctggccctagctgggagttgagtagtctgagttcatgcttggtgcttctgtgggatgaggaaaagcattgccagtgccagctgtaggaaaaaaaaaatgcccaagacctgactccagctctccacatggctgcctgctttttcccaagttcaggccttggtctgattcctcctcagagaggacttcttgaccactctatccagcagccaccctcccaaagtctatctccttatcctgtttaatttcattcagagaacttgtcactgtctggaatatatgcttcatgagtgctggagccatgtggattttgtttactgttgcaatttcagcacctagaacacacctggcacatgtaaatactcaataactttttgt

SEQ ID NO: 26208 - DNA, 1519 bp, Bovine  19866880587224
acaaagaggaccaaatgagggatggaggggaggtaagtattttaaagtgcttaaataagagaccagagagagtacattatgcaagtcagagcaactcagtttattgtagattcctatttgggaaacagaaaaaacagaatggaagcttaaaactgtctgcctctaacactgacacctgtaactgtgaacagctggactctagaggcaggaagtctgatgctcagagccctgtttttggggttgaaatgaatcacatataccaccctttctggaaagcagtcttgtaagaaacaggcactcaggtcaaatatatgaggctctggagttagcatatatattgattaaagtgaaaaaactacatgagtgtggagatgttttccctataatattgctgtcttatttatatgaaaggaatgactacaatacgtttgtgttgtttattcttactgactacatgccaagtgtgaaagtggagcttattaaggcctgtcaggaaaattggctctggcagggccatgggagggaagatgacagctagttggctggggtgttattttggaaacttggaagaagcttcatgatgtgagtactatgtgaatattttaaacattgccatttctgtgtgggcaaacttgattgcatttggttgataaagtcacatccagtacatgaaagaccccagggaagaattcacagattggtaaaaatttcctcttaagatttcaagtttaggtggacctttgtgactcaaagttatttgtaactgggggacggaggacagccaatgcgcaagggaggcggctgtccacaccacaaatgcctggtgatggtagccttcacagaaatcatcaatgataaaacgaaaaatatggtttaacggataagatataaaggcacaaaactaaggcaggtacggtagatactttgaagagtgcgcgcgtgcgcgcgtgtgctcagtcgctcagtcgtgtccaccccatgcactttgccaccccatgcactgtagccccccaggctcctctgtccagagaaaatgccaagtgtggctactttctctgctggtttgccacacttattattgctgttggattttgggtcacgaatgggaggattctggtcccctgtactgtggaactgagatatgtggcattatgcttaaagaacaaaaaggtaaaattttaagtttgttgtttaagttacctgtttcatgtgataggccacaaaatgccaaatggaattatagtcattgtttttaaatacatgtcacacttaggtcagaattgtcaccttttccacacattttgtttggtgaagggagataacatattcgatgtaattcctgtctttgcatgatacttaaaactaggtggaaacttaatgcaaggactatcttagtgaagagcttatctgactatgtacgattttcagggatgttttaataaattagaagcaggaaggggcctctacatacaaatgtcacataaatgattatgggaagatgaaaaatgaatatgggaag

SEQ ID NO: 26209 - DNA, 2383 bp, Bovine  19866880588880
ttgcccctgcaatgtggccaacagccatgaggagccttagcatgacctctgcctagtgctgtctctgttctatgggggtcctggcgaaaggtgggctctcttatgtgaaaatgagcatctctacccatcaaaggcatggtgagggaccctctgcttgctgcccatgagatagactttgcgggcagatctgtggtcaaaggcaaacagcaaacatgttttttctttaacttcaaaacaatacatatgttgttatttttcagtcactctgcgttgtgtcaactctttgccaccccattgactgcagcacgccaggctcctctgtcctccactatctcccagaatttgctcaaatttatgtccattgaatcagtgacgctatctaatcatctcatccttttgcagcatcagagtcttttccaatgagtccaatgtgatccccttcatggattgtagtcttgtggcaaagtggcttgtgtaagtcaatgaagctatgagccatgccgtgcatggagagttctgacaaaatgtggttcactggaggaggaaatggcaaaccactccagtattcttgccgcgagaaccccacaaacagtatgaaatacatatgtgtgtgtgtgtgtgtgtgtatatacacacatatctaattttatttattcaccaattccattatgtgaatttgcctactcattaaaatttatttgtaacccacaagttaatagacgtagtatttttgcagccatttgaggacatgggcagaggggcaaaaagatttgagtcacccacggacacgtccccagctgaggtcaaattaggtgacattttatactgttaacaaggatccttcgtccatttaacatttttgcgttttttttttttttttggttggtgattttgttgtttaaaatggctcccaaacatagtgctgaaaaatctgcctagtgttcctaagtcaaagagggctgtgatgtgcctttctggagaaaaaaaaaatgtgttaggttagtttcattcaggtctgagttacagagctgttggctgtgagttcagtgttaatgaatcaacaaaatatgttaagtagagtgtctttatacagaaacacacataaaacaaggttatggattgattggttgatgaaaatattgtgaccagaaacctgaccccacatttcccctagaagcaatggctcagtgttctgtatttcagtgtttgcattgattttgtagaacatacctaccgcaaataataagaattaataagaattacctggagatcaatttattcatacatatattcagtataaagatgaaaataatataaatgcatatataaatataaagtcataaaatacataatctccctttatccacttttcttctctaatcctgctcctgtctcctaggaaaccattattaaccatttgggatatatccttccatacctttctttattaaattatatgctgaaatatatgtattatatataaattttataagtctattttatgaaaggaattatgcatgtacatatgacttgccttttatcaattaggtgatggtcagcaaattttttttctgtaaaaggccagataataaatatcttctgctttgtgaaccagatgatctctgacacccgtcctcaactttgccactgcatttcaagaagtcaactgtagacaatatgaaagtgaacaggtgcgactgtgttcccataaaactttatttatggacactggaagtttgaatttcatatgatttttatgtatcataaaatattgctcttcttttgattgtatttcaaccatttaaaactgtaaaaaccattcttagtttgcaggcagtacagtcacagacgggctggatttggtttatgggactcactttactgacccctgatgtagattacatgttgaagatctctttctgttaatacatggctatatacctcattgttttaatggctgccttgtatttccattccatgaatgtacttcaatgtatatagctattttccttattgaagaacatgcagattatcctcaatattttgctataacagaacatccttgtgcatacatcttgaggcctttgtgagtgtttctatgcagtagaattctaggattggagctcccagtccatccctctgcattctacctctctcttggcaactgcccatctgtgctctttgtctgagaatctatttctgtttcatagataagtccattggctaccctagttttaagcaggagagcgacatggttgaatctgcttcatttggcataattttttgttacgagaataattttagattcagagaaaagttgcaaagatagtacagaggtttcagtttagccagttcctcctattattaaggacttatacgggtt

SEQ ID NO: 26210 - DNA, 1952 bp, Bovine  19866880594992
acagtagttttttcaagagctggagttaggaggcaatcttaggccatcagtgtttgctgactgaccttttccaaaggaaaaacaaactttctattactttcatggcaagaggtagtttaatgatttggagtaaggtgttcactgaagttaaggttctatcctcccatgtaaactgggacagaggtggcattacctttcttgatgattatatttcaatagcgagtagcaagggggcttctaggtccttgagaaagacagttctggaatgcaaaactgacaagagacttcttaaagacctgcatctcaagaagacagggaaaacatttacaagttttccaaagtaaatgctctaagaaaagggaggttaggatcctagagtcaggaagtttgtcttctatttagtcaacctgagggcaacactcaggcaactctggtcagtggtgtggttaaggaacagaactttctgtttaggcaaatacagtaattgatgtagtatgcagactatttgtggttgactcaaaatcaaaatttcaatgcaaatatcatagagtaaaatttctaatacctaatatatggcataaaatatacagaagattctttggagtgtttcatggccttggagttataaagtgactcaaataacaaaatgttgttaagtagtaaaagtgaaagtgaaagtcattcagtagtgttcaattctttgtgatcccatggactgtagcctgctaggttcttctgtctatgaaattctccaggccagaatactggagtggatagctgttcccttctccaggagatcttgccaacccagcgactgaactcatgtcttctgcaaggcaatggcaacccactccagtactcttgcctggaaaatcccatggacagaggagcctggtaggctgcagtccattggggtcgctaagagtcaggcacgactgagcgacttccccttcacttttcactttcatgcattggagaaggaaatggcaacccactccagtgttcttgcctggagaatcccagggacgggggagcctggtgggctgccatctatggggtctcacagagtcggacacgactgaagcgactcaacagcagcagcagcttctgcattgcaggcggattctttaccatctgagccaccagggaagcccaagaattctagagtgggtagccaatagggtaccttcctgacccaggaattgaaccaggttctcttgcattgcaggtggattctttaccagctgagctaccagggaaaccctgttaagtattagtcgatatcttatcttgataataccaaatcatagaactgtcagttttcaagtgaaaggaattattcaaatgtaacttatactatatatatatatatatatatatgtgtgtgtgtgtgtgtgtgtgtgtgtgtgtacatatatacatactgtatatatatagtatgtatacactatactatactacatatacatagtacatatatacatagtatagtatttatactttatatatatgatataaataagaagaatcacaaatgtttattagaatcattatatgtcaattcatctaggctataattttggaagagataatctagtttaaaaaatactactatataaagaatgtcacatattatgctgtaacaaagtgatacacattaaatctatggatctgatcatttggaagcagaaagtatccaagaagacactctttatttctgtcaacaagaatcagtttctctgagctaaagtcctattctttccataaactgttgaactgaaaagtctttagaaataacttttcttagatttccctctatcttacctaatttggagggacagttctgtttatgaaacttcatattcaagacacattaactactttcaaattcctgatgatattagtggcttattatcagaaatatggcaatttagggttatctcattaagatt

SEQ ID NO: 26211 - DNA, 1009 bp, Bovine  19866880673761
ctttgatggaaaatgcagtgagttatgggagagctgcagagatgttgtagacaaggctttcatatgcccatattcagtgccgtgttctgggggctccagggtagtggccacagagaggagaaatatgtgtagcatctattctcaaatgtgaatgattgatgaagacctctggagagggaggaggatgcatagggacagccgagtaggcagaataggggaggcaaaatagcagataattttacacgcaagaaaataactatttttgaaatgtcagagtagcctgtcagccttgacaaatttttttttttaaagatttggaggaaacttggcaagtaattacagtcagtgactgtcattgtcaagatagttctgtaattagagaaattcaaaatatgtctcatttagagacacctccaatagagccacaggggtagccatcagttggaaaaggttaataaagtcgaaatagtcagacaatggtgcttaagctaaaatgctggcagtgtccatgacaggaaaggaaattctgtcatcctaaaacacggacccttcttgaaagcaaatttaaacagagcaatctggaaagataaatgggtcttggaattcacagtaaaattgaagaagggtacagaggaaaagcctactaaatttctgtgcattagctattcattttaaaatcctatttgttttcttaaattaatggaataataagtagtttgggaagggtgagaggagaaagattctttctttagattcataatacagttggaatccatttttgctcatgtggaaacctaatgaaatggttgaagtagggcaactggctgtctacgcagtcagtgtattaataggcaccaagctgaaaacttccaccataatttggaaaaatgagaaaagttcacccatgaaagcatgtaggaagcagatatgtatgaattcaggtgctagttggagggacaaaatcttcatcacttatttcataaatagagaagcagttggatgcagctgt

SEQ ID NO: 26212 - DNA, 1334 bp, Bovine  19866880707473
cttgttattgaggtccctcagactgctctgggccctgtcctcactgcatacttgctgacttgaattcataagtcaccccaacaacactgtttcttttttcttgcttgcttaaattggttttgggttttttttcttgtgtttgcaaacaaagacccctactcacttagctatgcctctcaccttgtaaaaattttcttttcagaatatcagtccccaaggccaatctccgtttactctgttctcttcacagtctctaatagacacatggtgagtgacctggggactcttaagtggagattcttcaagaaaatatagtaagggcaggaaatgagatgaaaaataatactaaacaaatatttagtattttagatgtcacatccctttttttctaagattggagatacttccttacacatctgaacccctgatacaccaaaattggatcctacttcatcagcaattcaaataaagatgttgatcatcgaccatcagcaattcaaataagcacctggcacccctccagagaactctgcatattgtactgttctcaggaatggctcttgtttgtttctctctagaaaattgtgcacaggcaggcttaggtgggagactttctccagggatttcctggaaaccaccttgatgagagccaattgtggcccctcaaaccttctcttttcccctcttttgtcctgtacttccttgtccttcaaagtcttccagccccaaccctatattattaacattaagacttttggtttagggacttccctggtatccagtggataagactccacattcccgatacagggacccagtttctatccctggcttaagaactagatcgcacacatcaaaactaaaagtttgcatgcctcaaataaagatcacatatgcctcaaggaagactgaagatcctgcatgccacaactaagacctagcacagctaaataaataaataaaataaatattaagaaaaaagacttctggtttaggatacagaggcctcttggaggctctttatccaaagacattgttttccattaatttctaagttcacttcttctttgtcttcctcatcaacttctttgacatttcagtgttttccaaagatgttagaacacagtaaaacttctccatcatattgaaaataaagaatatataatttttcattacaaatcttaaatatttttgaaactattgatcaaaatccatttttaggctgcaaaatcaatttagtagattgtgtctaagattttttaaaaataaaatcatataaagtagaactgaacagcaagctctgggagttgatgaggatagggaagtctggtgtg

SEQ ID NO: 26213 - DNA, 1601 bp, Bovine  19866880738523
attattacatataatgtttggggaaggctagtaacttgaagtacactacactatttcgctataggaataactaggaacttcgtatttgtttttggttaatccatttttggaaaatgaaataaaactttgctagaatttttatagatctcacaaaatccttctgcttagacattttgagcaaatatctctaggaatatccttccctagaatggtagtgatgagctacatccatagatgtatttatcttcattcttttatattggcatattttcaaggatattgcaactaaaaacatgaaatccattatataaatacacaagtccagttttggtgaaattgaaattctttcagaaggtaggaattgcctagtgatcaaattggaatgaacaaatgatttgttgacatgtctaattccacttaaagcagatgaccttctcagatccctcactatccctcagggtttttctctttcccagctagatttggcatccatagatttaaaaaggtgatgatctacttaaatggtttctattgttatgatattagcatttgtactttctcaaaagtggtccaggaattggactctaaagtttctttagtttgaaatgtctttggaacttctggataagtagtttagcatctccaacctagcattaagaccagatactgctgatcttacttaagaatttgcactatcttccagccaaagctgtggcttattgggtaacagcagcagggaccacaaatcgagtggtgaccagaagactgttgaaagtttttagtaaaggaagaccatgaagcaagaagcacatattttatatatttcaagctctacaaatggcaatcttccctcgggtattccggtctctggagaaagaagagctgatcacaaatggatgttttgtgtccatttgtgatcacacaaatcagatgggcttctgtacttaggaagtagcagtagcagaagcagtagtagcagcaataatgtgcatgtgtggatttgaatgctggtttatgtgtagtatgttacttaaatttactaaagagatacatctcaagttgtatgtgaagtttattcatttaagaaagtggcattataggatagtattttatctttcaataatctgtgctctccctgatttaaaagcaacctaatgctctcagtaaaaacctgtatttgcatgggaaaaagcccagtttgcatttggtaagtgttcaaatatggaatatcatggcaaatgatgagcaaaagaatagacaagattgatccataattcccataggcatggaatcaacattttcacctcttgaaaggataaaaagaaaaggagaaaaatatattcaacaatgtcctggcatttgccattaattgtaacttaacccagttgcatatttaagagcagttacagcccttcaagatttatataacacagcagtatgatttatttacaaagagctccttttgatgtgctctttgaaacagtccagtaaagtcatatctcttccatccaaatagcgtttgatttgaattccaaattcagtcctggaaagaaatgcaggcagtcaaatgcatttgctttggacatgagccatgcacagat

SEQ ID NO: 26214 - DNA, 1774 bp, Bovine  19866880743849
atgtatctaacaggaaaggaacaatattcaataattttataaaaatgcctaaatgccagctctacttggtaaacatcccagggaaacctaaaacactaagggtccatgaatctggcaaagactattcttaacagaatctccagagatctgctgaagccatctagtgggaactgcatcagtaagacccacaattttcatgtcaccaaattctagacagaagacaagaggggaagtctgctgggaaatttctgggaaactgagctaaaaagagctagtccctcttcttcctttcaatattgtcataccttgatgtgagaatggaggcagctgcagccatttgctgccagcctgaggatgaagccagtgcacagagaagggcagggggagctgggtccctaagaccctgagcttggagctgccctgccttggagctcctaggtgggttttcttcctgcttaaactgttctgattggggttttctcttccttgcagggaaaagcactctctgatatcaaatgttgataataatagtaatcagcagcaacatatgaaaaagactgatgaggttttctatttctctatgacagactttcaaagagggttctacaagtgaattatttaatcaaagtattcataaaagagataatgaagtccttataacccatttaaagctgccatattctaagtttatatgggccatattggttttcagattttcttgggctttatatttcagccggaaatgctggaggatggggtagataaataccatgttccatacgatgaggcttatatctacttttgccatcttgataaggctgcggtcatatagtcatagaactctataaagtaatgtaaacaaatggttttcgatcaccccattggtctttttttaaattattattgctttataatgtttacttaagcattggtttttaatggtagattatcaaataaccaacaaaacacattttttatcaagtaatctgtctctgtgctgagaacatttcattaacatgatcttgtttgatcttatgcttaaattggcctttttctgattatctgatagccagcattccttagggaagacaacctttttactctttgtagccagtactgagagtttctctgcctaactattatgatcatcccttttctaacatagtgttgctcctcaaagttcagagtggttcaaaaatctccttaaggacttgttaaaacagattgctgacaaactttaggtctggagtagggctcaagtatttggatatctaagatttttcaagtgacactcatgctctttttttacctttttttgtttgtttcctttcctgctttgaggtttctagatctggaaactgaattgcataggctgtgagtgcagtcatttcctccctgagtttaaggggatgctgtagcacagtgagtgggaacatggccattggtgctaatagctcaagttcaagtgctggttttctcttttcagctgtccaacactcagaatatttatgcccgtggatgaagttcttctccttattcttatgttatacagtgcgtgcatacttaaggaatatatttgcctttgtgatgaaatagcctcaagagtcactgtgacctaaacttcccccaaactcttcttaacccctcattttgtattgagcccagagtaaaataatagcagatagaccctctgtacgttgtaagcatcatctgacacttgggttatcatctacttcatgaatggggttgaattttcaattcattgcatgctcgc

SEQ ID NO: 26215 - DNA, 1066 bp, Bovine  19866880769952
tctcccagagtttgctcaagttcaagtcctctgagttggtgctgctgtctaaccatctcaccctctcactcccttctccttttgccttcaatctttcccagctacagagtcttttccagtgaattggctcttcacatcaggtggctgaagtattggagctccagcatcagtccttctgatgaaaactcagggctgatttcctttaggattgactggtttgatctccttgcagtacatattggaatgtacaagtacagtataaagaaacatccttccattttttttaagccaaaataatgtagagctaggacccattccgtttctataaaatccaaagcaaaaacgatactgtaaaaacctagaagaaactctaccatgcttacatttccactgggaaatgaattcttaacaaaaaaagaaatttctgacccaggatagacaaatggagatagaaagcaaagaggcattcccaaggggagctccctggcaaattcggagttgtctatgagacatggagcatagaaagattgtcaaggagagagaaattccccctcagaggaaaatctaaatgtgtttttagccacctgtcaccccagagggaggacaggatggcaatgttaaattggtaaggttgtaaaacaaggaactgtacaaggccagctgaggtgtttaaatgcattttaaccaatgcaacttcattgctgaaatccagacagagactgatgcttcctagatggcagattcgaaacctgcatctgtttcaccttagaaaaccagcatttccattaagattccatgccacaaaaatagaacatgctgaattttcatctaaatcaaatattaggaaaatcagaaaatgaccccggtttcagaaagagagagagagagtggagagaaaacaggaatccaggacacacaggctccattgcaaacatgtgaaccagaaaaaaaatcattctgtacaaacgaagtagctaccgaaggaacaaagacgggagggggtgtgaacagaaagtttattcacgggccagacaggacagcagtgatgagttctaagctaggacag

SEQ ID NO: 26216 - DNA, 732 bp, Bovine  19866880773676
atttcatgtcctggattgtctagcaactcagtcctccagagataaactgaggtataaatacagtaccttttccaggtgtatgaatactgtagttcatacagtagttcagttctgttggccatgtgctaatgaagaaactgtagggatgatttgcctctcctttagcaagtgtgtagaggaacagtcctcgtgtgagagtgccccctccatagcctgccagctctgctggcatcagtttcttcaattactgtatgcctcaataattgatagagttaagtgagtgcagcttctttttttttactgcgttccccttgagtggttcagcaacatgaggcaatttatcatgctttctgtgcaccggtgcataaacttttaaagaatgaattagactttcccttcctgtccaaaaaataagcaattctcaggtttgcagtgttgaaagtcttgattggatagttggtccagcaatatcagcaggccaaagtgacccaaatcatagacccctctattgctttttccctcttgcttcatttccctttggagaaagactcaattaaaaacatttgtggatttttctaaggctgtttctttcacagaggttacattcagctctttggcaaagaaaaatgccagagcaattagtggctccagggaaccgctagttgtttatgtactatttcagaaggacccattgtgggcagcagtagcctctacacagaggttccttttaga

SEQ ID NO: 26217 - DNA, 1193 bp, Bovine  19866880797007
aacccaggtctcccgcattccaggcagaagctttaacctctgagccaccaggggacccccaaagattatggggtgaggttaaaaactcagagtctttacctgacatatcaatatttaatgcccagcatgagataggcatcgtttgtgcatgaagtattgaacaaggttccaccctcaggaaattataacagatggcaaaccagctctacctaagctgcgataaacagcaacacaaagcaacacgtcaatgcagcgcctggagaggcagagcaggagacccccagcttcagagcagacagagacccctgtgggttagggtggccagagtgcagcggggtagggcttgaagagtttaactgggtggaaagcagaggagggagaagggacaacagtcagagggaaagtacagaatgactggaggagctggctgtccgaaagttaaggtggtcatggtcaaaagtgtgggcttgacccagaggaccctgtaaaagtcagaagacagagagctgatgcggcaggcttggcaagggcattctcttgacaaatgcagtggtgcgaaaacagcccaaggctgggaggccccagggaggcagtgactggagcaagatgagctacttctacacccgggcaaaagctgtttaggaccgagcccactgcccagctgaatggtctgaaaatcaaactgttcagctctaacagcccttgtctgcctgggaaagcagggtccaaagttcattttatatgtgagttgccacccaggtcaaggcagaaatttcagaggaggcttaagagattaaacccaacgtctcctttatgtaactgctcatagtaattggaagaaggattctgaaaccatggttaccatagaggactaaaattaagatcaaaggtgatgatttcaaatccaaggaaatagaataggttcaagctagagctcacatttatgctttgtatagactatctgataatcctttgcaaatgcatccttttatgaagcaatctcaggagacagtatagcggttcatgcagccctgaagcttagtgcaaaccctcctagtactgggtaacaggacggaatcctaggctgaagggatgtgaggtttataacaggtatgaggtttttagacatgatttttacagacactgctgatttcttgttgctcctgctgggcctagttgagaattggcatcta

SEQ ID NO: 26218 - DNA, 1571 bp, Bovine  19866880848717
gggaagggatgagtcagtcaccccagtgtctgctgtacacccctctcatcgttgtagtggatgatattgaaataagtgcataagtgggctcacatatctactaattaaagcaaattgactcgtatcagcagtaatgcctgacttctgaggaaggcttctattctaatgattggagagtaaaatatctaccatttctattaattatttagatatgtgttctccacgttcttaactgagtaactgggccatttccatctaacagatctaaacatcagtataattatccctgtagaacctttcctgtgtaggatgccagtggcagagatgcaagtcctgaagtgtgctgttctcattcctgggctgcttctactcctaatagtgataatagcatctccgtgtactgagcacttcctcactgccaagcactgtgctcaggagtgagcttatcagggatggcctagaattctcttgctttttctgtaatccaatggatgttggcatttgatctctggttcctctgccttttctaaagccaacttgaacatctggaatttctcagttcacatattgttgaagcctagcatggtgaattttgagcattacttttctagcgtgtgaaatgagtgcacttgtttagtagtttgaacatcctttggcattgcctttcttcctcagattagcatggtgcttatatagcatgtggtaacagcccatgcacagagtgcttgcttggtgccaggcactaactaagtgctggtttagagaagcccattccatcctcacaacagcttcctgtgactactagtgctggtgagtactagtcctgtcaggagaactggctcggaaagtaaacctgctcactcagattaaacccaggatgtctaatcccatgccccatactcttcaccatgatgcagtagtgggtcgtagagtagcacattctgctgtatgggacatgtcttgtcaactgcccagcccaaaccatagggaacttcatgaacataccctggccttccatcctttgaagagctcctcccatttctctttattctttgagcttcagtaaagtggatcagtggacagcatcacttagatgttgtttacctatgatctaggagttgagaaaggatttgactgttctgaagagcaaataggttagctagcagaattcactctattgcattaatttggagatcagggaaaggcattgggattggtgctaggaacgacaggacactttgcaggcccctctagaactcactggtggctcagacggttaagagtctacctgccatgcaggagacccaggttcaatccatgggttgggaatatatcctggagaaagaaatggcaacccactctagtattcttgcttggagaatcccatggacagaagagcctggcaagcccagtccatggggtcacaaagtgtcagacatgcctgaatgactaacacttcacttcaagaactcacagtctggagggtgcattggggaatagacaccgccaaataacaaaataaagcagatctttcctggaagctgtggagtacagagaagtatgccaggcgg

SEQ ID NO: 26219 - DNA, 2536 bp, Bovine  19866880859931
acagatagtatattttgaactagaaagatttggataaacctgacatcctgtaataagaaaatgccaactcacaggatgggctttattcagtcatcagaagggagaggtcagatataagagaaaaaaaaaacacattatctgtgaaagcctaagtaaatgagtctgtgaaaagtgcctgagcttccatgagacaattcagatatgagacaatttctctaaatttctaaaaagactagaatacccattattacagtggcataaggtgggggaaatgttccaatacagtgaaaaatatgctctaaaatattgatagaggaaaagtatctgttttaagcagaactgaataggtaataaagcataatgctttataaaggggatttgattatattttgtaaatttggtatcactactgatagttcttctgtcctacattttcattctattatttatttaatcatattgtggagtgtgtgggaaaacaaacttcaactgctaaaacagaatgtttacgtaaaaaaggtaaaatcagaataaagtatttagggtattttgttggaaccattattggtattatattaaatgtgttctggaatcaactggttgccatttaaaaatcaccattcaaagccagtgcaatataatgacttcaagtactagaatgatgtgtatgtcagatacaatttttggtaatatactccagattaaatttctttcaagggaatgatttttttttaatttgaattaaataattatttgaattaatattgcagttatttgaattagcaattatttgaattaatagcaacctgctattgctaaggtaactgggttattgattgggtgagtagatatttgttctttatatgtctctcactctggaatcagcatatttaaactcagaatcatttgtcagatgcaatttataagtgaactacatctgtgtcctgcttgtatataactatgaaaactgaatattttaaagcattttcctctacttgtctgatatttcatctcgtactctacaacttatttcaaatatatgttactgatgtggttcagattgtttcttaaatcatataaacattgatttaatatatattccctgtgtgagtttcaaaaaattaggcctttagaatcataattgaaaacatctaatttaggcagatgttcttacttcagtcatagcactacattactagaaattatttaattagaatattttcctctaatttttatgaatctttattttaaactattatttttgttttcatcaaaaatggtaaagaataaaagttgtatcattgtaatcatgtatttttatagaaccatcttattccaataaatttgtcttttcacctttaaaaaatcataggtgttttcacatttttttccataaattagtttcattcaaaagataatatctagaacttatctttgatttatttttcccctgcctggaattggtcaactctatagatgatctggaaatcttacattattagttatataggatatattgcatattaagccatacttgttcttccaatgactttagatgacaccttgacagttatttattgtgtctttaatgttcacaaatagtcactaatgcatgtatatttgaaatatatttcaggtagcctttacactggaaaagcataaatgagttactggtactttttaaacactggcattaaaaaatcttgtatatattctcacacaaaaatataaagctctttcttcttttaaaaaattctttatgtgatataaaaatagaaaaaaatggataaccctatactcagtgcttttagttagaatgggtagattcagtgtgcaaagaagtgctttgaactatgattgggtgatgacataacacacgtatgataaagaaaattcatttatctaaatgttttggcttcaatgataacttgggtgattaatccccccccctctcctaccccactgattttaaagttatttataaaataataaagctgtatcaatcttattaaacttaaagaaatattaacacattttcagaaattggaactgaattttcagatatgaagatttcttaatgactgttcaaacacaagaatggtatatttaaaaaaaaaaatactcttggctctcaggaaattccacgtgaggtgatctcactttggtgtctcttgtttagcttagagagtaatttttgccatggtcacctgccatgcccatctcattgaaggcagagcttctgaagggttgaatgctgtgcctatgggttaaccaattatttctaacatgtgcttctctaaaactactaatatttttcctttttatttgatgtcctgtaggagcgaagggtagcagctggatttggggtgtgtaaatggcaacccactccagtgttcttgcctggagaatcccagggacgggggagcctcgtgggctgccatctatggggtcacacagagtcagacatgactgaagcgacttagcagcagcagcagcagcagcagcagcagcagaaggatcactacaaatgtacaga

SEQ ID NO: 26220 - DNA, 1327 bp, Bovine  19866880936113
agctatggttttctcatcaataaaatggaaccaatcatggcatttgtcttataggcttgctgtaaggatttttaagtgcagaattagcacagtacgcaacacattagaagggattcactatcttttagctagaatgaaaagtgagagtaagtcactcagtcgtgtccaactttttatgaccccaaaggaccaggctcctttatccatggaattctccaggcaagaataccagagtgggttaccatttccttcttcaggggatcttcctgatccagggattgaacccaggtctcccacattgcaggcagactctttacaactgagccaccagggagttttttagctagaatactactaattatttctccttcttggagcatgatttatgctttcctatctatgtcttctctatgctatccccactgcatggaatgcttgcactccatttctgttcattgaaatcacactctaatttaaaggctaagttgacatccttcccttctatgaagtgttctggactcattaagctctgaagtgacttgccccttctccaaaatcctaagaaaatcagcataacttttaagaggcttatcacattgtatcacagttcttcatttttagaaactatcacaatgtaaactttgcaagttttctcatttcttatactcaattacaagccacttgatccatgttcattgttgaatcatctattatgctgctgcagtctcttgcctcatttgtttaaacaatgaattaataaagttttgatttcactttccttaagaaacatagaaaatactcataacataaaaataacatgaaagttaggctttattgatattttattgagcatgtcaatgtacttcccctaggtcaggcactgctaagcattttatggcgtattaggcatgatgtaaaaataggacttcctcatatattttaattaatacaactttgggggaaaaggattattttcttagctatttcacatagaacttggttgattctcagcaaaaacactggcagcaacttaaagcctctcaggactaatacctaaaaagtgtttgtttaaatatagccttcaagaaatagcaaggcatcaataaaatcagatcagaagaaattcaaagtgtaaactatgtatttgggaagatcccctggagaagggaaagccattattctggactagagaattccatggactgtatggtccatggtgtcacaaagagtcagacatgactgagtgactggcactaagatatgtatggaaaaacatttatcttttctaaaggtcaagtaaatgcaaatcaacacagccttaaggaaa

SEQ ID NO: 26221 - DNA, 681 bp, Bovine  19866880971022
attgatgagtatcccctgcgtaggcaaatattcctgtagccatgaggggtgatgaatgctgtcacataggcagtgccatgacatccaaacaggggaaatctgttttcagcatggagaccagtcaggacattactcttactgtcaaaggagtgggatacatctcctcccgtcccctctgcatggggagcagcatggtggggatggcaggctgagtagccatgactccacatgggcaaaaacagcccattttcaggtgaagcaaggagggctcattgtcctgcatgcttatctcaccgcttttattcttccctgtgacgctgaaggaaatattctgctttggacatggcaggtttgagaagccaattaatcatctcagcagagatgttgaggaggcagctggatatacaagtctgaagatcagggagaggtctgggctgggaataaaaaaattgaacctcattgaattgcattaaatcgcccagaaaaagaatacagatagggaaaaacagaggacaaggagttatttcaaataaaaggtcttccatttgccaaagcaaagctgtagaccatccactgtgagacttttctgcccctgtccttcagaggcagggagacctctcaactctctctcagagttgagagaccatctgagatttctgtgagctcttctttcacaatgag

SEQ ID NO: 26222 - DNA, 1011 bp, Bovine  19866880991130
attataactgacctctcatttctacagagcacagtaaaggtgggaataaaaaagtggaatttttagacttaaagagaattttattttttctgaagaccttaaaagtagcaaccaacagattataaaagcttatctgggatcttttaaaaacagggcaaattctcaatgtcagataattttaacaagatgattaaatgacttcttggtttctttaccctgaggctgtgaacctcatcttaggtcagcagggtacccactgcaacctcaacattattgctctgacatcaagcagtaatgcatctgggcagagctctgctgagactcaacatagaggggatgttccttcatatatcaaaagtaggtaaaacttatttatttaataaataccctaggaaaaataaaacattgaacacatggctgccttcaataaagaaattctttctcacattaatggaggaaatctcatagttttctaatctcagagtaggatcagagatttcatgtcttacataaattgatacagtaaatttgcatttttgatgctgtaaagggtctactgaattccagattggcatgtttatcaagttatgggtaaactacagattttcaaatctagaaccctctgtgatcagtgaccatcacatagccttctgcccccacttaagtaaacttccaggtctctgggttaaggacaaagactccatataagtattttaaatattacatcacattattttatgaatacgcagagaatgcaatgatttcaacaattattgctatctttcactgtgtgtgatgcttacttgccaaacaatatgacagttttcacctactccaagattttaagaactgtttataaaaacaggttactgaataaatgcatggcatcagaatgaattccaattccatcaacctaaatgacagaacacaggaatccactcaaatcccacaggagcaagtgtaatagcagcagtacacagagaggaatagatggccatcacaccaaactca

SEQ ID NO: 26223 - DNA, 835 bp, Bovine  19866881007641
accccatggactttcccatggaattctctaggccagataactggagtgggtagcctttcccttctccaggggatcttccccgacccaggaatcaaaccagggtctcctgcattgcaggcggattctttaccaactgagctatcagagaagccagggtctaacacaactgaagcaacttagcagcagcagcctccttgggaattccagacccctatctcctgtttgagagccccagacctctcgctcctccttgggaaccccagacttcttatcaacctgcctaggaattgactctctcactggctaaataaattacacaatagataactgttgtgttatcaatagataactggaatcaagattgcccagagaaatatcaataacctcagatatgcagatgacaccactcttatggcaggaagcgaagaggaactgaagagcatcttgatgaaagaggagagtgaaaaagctatcttaaggagggaggagggttcaggatggggaacacatgtatacctgtggcggattcattttgatatttggcaaaactaatacaattatgtaaagtttaaaaataaaataaaattaatttaaaaaaaaacaaagctatggcatgataaatggatatatgaggtgacacagccaataatactttgcttgatagaagtaacattcttttattaatttgtatacaaagcatgttaaggtatttcttaccatttaaacttgtttttgcataattgttcattttgtatgtcttgtgcacactgcttaattcaactcagtcatcctttttgtgaatattcattaaagctgcctttagaattaaaaaaat

SEQ ID NO: 26224 - DNA, 1607 bp, Bovine  19866881066420
atttgcatttttaaagttaatgactaaagtaataaaaggttcccagttaaattattacagtgactgtttgcttcagggcaagcaaaaaacctttgaggttttaaatcacatttttcagtctggcaggaaagggtattttaaattcctacaaatgatttctttaatctttgtaacttttctctacctggcccctcattctcacacacctggcacgcaaatgaaaaaaaaaaaattgtacaaaagaatgttggtatttggatataaaggtagagctgaggcttccttggagatatcctaggttaataacctataaaaaattggtagctgtatttaattgcctacaggacatcatgttttggttatcctgtttttgagctttggtgtgatccaacctttgacatgagcattgacaatggggcaggacccttgaaattgaacctgccccagaaaagcccagcgacgtgcagtaactgtaacaccagtgctgacatctcagcatttgcatcaaagaggcagggcaagtggaaattttacagtacagttctgcactaatgcataaagatgctaagactcacatattttgcctcctgaatgaggtctttaatccagcatgctccttgtactgcaaacagagatcctcagagcaaaactccattaaagagcatgatcagaaagaactgaatgcacaaaagtttttgaataaaacaaaacatatctcaatgtccagaatataagcaatcaaagcactctttgtcaataaagcccacattctggaaaaacattggggcctagtgatgggcatttgcttagaggctttactgaggtttaagccctggaaaagcaaagggttttatttgacctcagattgcaaagactctttctacactgtctgaataaaggtacagaagtgaacagcaaaatggctggaactgggatctggagactgactgactgggaccaaattctgactccattgcttattagctgagtgacactgaacaagttatctaaaaatcttttgcattcattcctttatttgtacaatagggccaacagcagtatctaactcaaaggtgaggttgggtaatgatgtaaagtgcttagaaccatggcttgcacatagcaaattcagtaatttcagcttctactaccaatattattttaatttttatgaatgagagtcctgtaagaagatgaaagaagcagcattgctttcttcctttctttcctcctttctttctgtcaccgttctttctttcaatttctagttctttgccacattccaaaagggatctgaagctgaggagtgacattgagcatgtttagagtgatgtctggatgcagccttggtctggaggcaaagaggctgagttctcttcctggctctactgttaactactaatagccatgtgactgcggggaagtttgcttgccttctttattagtttgctagggctcccttcacaaaatatcacttccttaaaacaacaggaatgtcttgtctcacagttctggaggctagcggtccaaagaaaggtgtccacagggttggctccttccaaggctgtgagggggaatctgctctaggcctctcacggcttccaggg

SEQ ID NO: 26225 - DNA, 867 bp, Bovine  19866881161086
atataaatagaagaaagtgttccaaggtccaataagatctgaatctactgaaagagtttattatgtttcaggaaaaattaatgaaaatagctgtagtttaaacatatctgtgtgatagtttggaattccaagagtgaagaaaaattctgacaagcattcaataaggaaaaaaataagtttcctacagtggaataaaaagtcaaataagtcttagaatctccataagatgaaaaccatgtgtcaatggaattttaggagacacatttgtgacagaggaattctaagccatatatgcctgaaagaaacagaaagacattctcagatttagggcttagaaaatatgtcatttatatataatgctgaaaatttttcttacaggcattctctagccaagaaataaatgaatgaaaacaaagaaaacaagaaaggggaattcatgtcataaaaagaatcattaagaaaattgatttgtgcagatttaattcttaattgttgaaaatgtgtttactgagaatgtaattgtaataaatcttgaaagaaaacaaatactagtttattatttataagcttggtggaaaatcctaaattagttttaaaatagcaagtgtgaggaatagtaaggagaaaattagtaaataaagggcttccctttatactggcttcccactctagtattcttggacttccctggtggctcagatggtaaagaatctgcctgcaatgcaggagacaggggttcgatccctgggtcaagaagataccctggagaagggaatggccacctactccagtatgctggcctggagaatcccacggacagaggagcctggtgggctacagtccagggggtcccgaaaagttgggcat

SEQ ID NO: 26226 - DNA, 996 bp, Bovine  19866881200932
ttaaaagaaaacaccccaaaaaaaggaaccaaaaattttctcaaaagatttaatctttgaagagaactctatttgggcagtgatgaatatatgaagggaacaacagctgaaaattctggctcttcattacatttgatttattgataccttgtaagttgagagcatcagaggttccaaacatgaattacggatttcaacatgaatgttgccaggagttgttagtgagaattgcttcctcttatagataagattgaagattctttcccctactctatttctgatatatgtgggtactttataaagtatcctttgaagtcagaagaaacttagcttttaggaatttatggttgtggacggcacatgaactggttcattctggactttgtgcgttcaagctttgtggccttgagcaagtgatctcacctccctgtgtctgttttcccttctgaaaaatagcagtgatgataatacccggctcatgggtttgttgtgaaacttcaatgagagagtacatataaagagcagcacaatgcctggcacagaaaataatgttaggcattagtgttatcatgcacttgctgacactttttcctgtgagtaaacagatctatactgacggaaacaggatttataatctcttttctcttagtgttatgtgctcactttattgatatttttcaaaatatatataattctaagacaggcataatactttattgaatggctatacataattaataaatttataaatgtttgacatttttgtcattttcattttgttttcagtgttctaaacactatggtgaatatttttatacatctttctaaatttggcacaattcttctccccctcccccctggttgtggttttattttcatttttgtcatgaatttttatttgtagattatgttagtaaatttatgaaaacagatatatttttgtttcttttggtctcttatattgcttttgtgcttggggagtcttttcctactcag

SEQ ID NO: 26227 - DNA, 1249 bp, Bovine  19866881205591
aagggtttaattttttttttttttttcattgcagacagcattgcagtctactgggtagatattaaccactgtatttacccaacataagataaacattttattcaatttacctgggaattaggtggaattaattgagccacagggaatcccctgccccagccctgagtagagaaaaattcccttcagtgacctcagcttttctgtttagctgcacacatcaccttgctagtggggctgtgtcatttttaatcattcatctcatcacttgtggttattgttaattagttttacttttcctactatgactcttttttcttgttacttacatgtccgaactaaataaaaattaaacttgtaacctagagtggaatagaaccggatcatcaatattctgtccaaaaatgtggtttcaccatctaccaatcatctttttggaaatcaaattgtatcatatcatcccttctaaaagagatgggctatacagcatttaatatcaggtgacaaatttcaatagaaaaataacctgcttgactcttttttattgttttccctgatttttaaccaatagatatatatgttttttccaacattatataaaggtataaagataaaagaaccatcatcccaccacctagaataaccactgacaacactgtggtcatatccatgggagatgttattcttgtaaatacttcacacattaatacaatattttaggaaatatcaaaaaagcagttgcctttgggggtggttggactagggataatttttttctgcttctttacatttctctctgctttgcacattttaaactaatgtccatgtgttggttgcaaaccacaagagaagaaggtgaaaaactaaaaagacccggagaagagccgtgggtgaagagagaggtcatgtgggcagatggaggctggggcaggcatgggaaaggcatgcaggcggaactggggaagggtctgcagaggaaggaagccccagctgatcacacctaattctcagttcctgctgttgttctctcagaattctcatacttgggcaccttcacagtcacttgcacacatgtttatatttcccaggacttcactaggagctgataaaaggaaaattacccaggtcttttgccaatgtcaagaagtgaggaataatttatatgtttttccttaacttctgctgtttggatcattatgaagaaactttgcccatagataggatgtagctgacaggaaagatgtgatgatta

SEQ ID NO: 26228 - DNA, 1967 bp, Bovine  19866881208381
ttgtcctttggagtgattgtcataggtaatctaatgactagtaattaaattcttgaatcgcccttgttgacttgggttatcttgaagagtaagaaagtttatacctaacagttggaactatgtcaggaccccattttcagaaagtgtggttaggaaattaaaagacaaagatcactatggctagtagaaacttgggagaatttttggtctcttttagctagtgaagagggtgagagacaggcaagatgtagtcctaagtctgtccccaaagcaaacaacacagtgttacacaatactcatgtcccccaataatacccatttatcaggatagtacccaccctggatggcacagttgagtgtaaattggcaagaggagtcaggaggagtccatgaccattatttccaacatgcggatgcttgacctccagggtctgtgttctgtgagctctgattattttgtgactgaccattagcactgaaggatacaaacaccattagtcatctttgcatgagtcccttgaccgagctggtccaccactcatagatcagcaaatggttcagaaatgtctagaatttttaaggctttcctagcacctcatctggtaaagaatctgctcacaatgcaggagaccctggtttgattcctggattgggaagatgcgatggagaagggataggctacccattctagtattcttgggcttccctggtggctcagctggtaaaacatcttaaaagaccctccataaatgtcacgagaaaattcagaagcattcaagataaaagttatggaggctggccccacatgcttctgtttaaccaccaaggatgtgtaattgtaaaattccttaatcccaaagccactgtgactcttgactcctggtaaggggtctaggtgaggagtctggaactccaccccatttcactctaaggctactccatgatattctgaagatactagtggtctatacttttgcaggttttttgcaagagcaatttcagagatattcttcagtggtcagaaaaagaggtatgggtatattatctttggaaactggaagagagtagtagaggagcatacagagtggataggagaaattatagggtgcttccctggtgactcaatagtagaatatctacctgccaatgtgggtttgattcctgatccaggaagattccacatgccatggacctgctaagcccatgtgccataactattgaactctagaacccaggagctgcaaccactgagtccatgtgctgcaattactgaagcccacacaccatagaagcccacttctcttgttgctctgcaagagaagccacagcaaggaaaagcccacgcacggtaaggaagagtagcccctgctcactccacttgctgcaactagagaaaagcctgcacagcaacgaagaaccagtacagccaaaaataaataaataaaattatgttttaaaaaaagatacagaggagcatgaaagaaagaataaaattttaaaaagaaaaattataataataggaagatgatgtatcaaaatcaagcatcttgatggacttattgaactgaaatgtagattaatgcagtattcatccccactaaagttgactgatgattaccataaaaaaaagtttgttggcatattaacacaacctttgggcattttagagaggatagagaaaccgtcattccacctgcagttaacaactaactcagaaactggattccttcagtgcacttcctttctcaggcatgattcagaacagaagtagagagagagataccagccaggggccatttgtaaccagcagagtatctgtgacatgcctgcagagtgacttcaccactcattaagggagatccatgtgtgtattctagccaggtgcacgtccctatagaaagcaaacaatagcatttttttttttttttgcattttcaggacaattaatatgtgtgtcaatgaagtga

SEQ ID NO: 26229 - DNA, 922 bp, Bovine  19866881251515
ttttggatatatacccagaatgcagggcggctgggtcatacagttgttctagtcttaatcttttgaagaaccaccatactgttttccatagtctacttggtttttgatatctctctctaattctgactgcaaagaatagaaaagagagctattttatcattaactgtgtgttgaggagaatatatgtattatctcacataatcctcaaaataacattataaaaggtattattaccatattttacaggagatatagaaacaataagtagcccatatagctagttaagacatgggacttgacttcgggttgctctgattttcagatacagccattttgttgttatatttctaacaagaagggctcattttttcaaatttcctattgattcatgaacagttttccataatttggggagtattttgttaatcacatagttacactgaaaaggatcgagagtcagtaaccatacagccactctgataatgtgggccccaaattcttaaatagtcatatccttctatgcagaaaatagaagcagttcattcctaggtatcaccaatagtactccaggctagcactacactgagcctctcatctccagcttggtgtctgccttgtacccagttgctgttattgtgcaaaattaatgaatagtttgtaaactagcatcacttctgtgaaagttgatggacatgttaattataccttatttagatttcacagttgcatgacccagattcttcttttctgccaaatttccaaagattcaggcattttagaaactccagtaaacacagtgcattacaatgcaagcaatggaggaactggccacacagaggcaggatgatgatgagcttggtttatctgactggagggctagagtcaggtagtctgttttcgggattttaagtgattcaacagt

SEQ ID NO: 26230 - DNA, 1599 bp, Bovine  19866881418269
tgaacttcccttgagctcaactagtaaagaattcgcctgcaatgtgggagacctgggttgatctttgctttctgctgtaagggtggtgtcatctgcatatctgaggttatttggcatttctcccggcaatcttgattctagcttgtgtttcatccagtccaacatttcgcatgcactctgcatataagttaactaagcacattaattaatgagcacattaattcaaaggtgcaaaaaattaataaacagaaaccctcaattattacagagttcagaaaccagaagggggagctctcacaccctgcaactatagcagagtccaactggaagacctcttcttccctggcaaggactccaccaatgaaaaaccatgggctctttgtttactgagccctcccaactttcttttcccctctaaaagagaggctccttctcttgcccttgggagacttgcacgtggctcatcataattgcagagcctgactgcacttctctgctgatcccaaataaactctgttttgtgggagaaatgtcggcagtttattattatttcaggtcaacagaggtgatagagttgctatgctttctatgtggactcaagggcaggaaagatggcctacagagaaagaaaaggaagaagaggagccttggtgttcttccaatatgtcattctttcaggcccatctgccttcctgtgttgtggccagtgagacagtgtggatcccctttgggttttaggtttacttgcctatttgtaccatgtttagccagagatagcttttattagtacatgtacatttataaaaagcaaagttatttttgagtgtttgcaaaatctaaagcttgatgaacactatccacattaggaaataaagagcaaatctcattatgacttaatccagtatatgaaattacctggcaccctagaaaaacccaagctgaggaaatttactctcataaagtattgaaatttattctcataaagtatatttgagacagtgccgaaattgagacaaaaaatgcagaagaatgtcagtatctcagtggcgggcaatttatttcttccacctgttgtccaattcctcccacgtctcctaactattgcttctcttgtcaatcaatgggcccttctggtaactaagtagataaaaccctgtggagagtgtctctggggtaggaatggaagaggaagtctgaagagtgggtggcaaagaaactggctgccagtttcagaaaaaaaaaattattgcctgtaatgatatgagtgacattaagtggcagagaggctggagcacacaagaaagtcactgaatgtactcaaagaacgaggggcatgtcagcagatgggaaaaatacagctgtgtcacaacaaaacagctccaaagtcagctttgttaatggactagacacacatatttaggaaaaactagagttaattttcggagaagccaatggcaccccactccagtactcttgcctagaaaatcccatggatggaggagcctgctaggctgcagctccgtggggtcgctaaaagtcggacacaactgagcaacttcactttcacttttcactttcctgcattggagaaggaaatgg

SEQ ID NO: 26231 - DNA, 779 bp, Bovine  19866881441833
ttttttgtgtgtaatctataggaggctctggtgcaaaactgaatgtaagtggttgagggagcagagaatagagaatagggttttttgtttttatttcctcagagccaaatggactagagaaatgtatccttttgatgacagacaaagggcagaagaagatgtttgcataaaaataaactgtcgtgagctgtggattcctagtggtgctttgttaattgtaatggttgtaaatatggaccatctgtttggaaccattattaaaaatgcaagcacattccccaccattcacatgatttactactttcttagcaggatcaagatgaaaaattttcagttgcatttacagggatcaaattaagctgatattaaatccatttagtaatgctgggaatggtttggggctttgcctaatgcatgtaaaataaaaattatgaataccaacaggaggccataatatatttgctcttaaatttctacacagctatgaattgtataggcagtttcttctatgtagcagacatataatgagaagagagcatctcaatgttggtaatggcattaccagagattaaaaaagaggaagaagcctaaacattagcacttaaagatgatatctcaaagatctttagtttgtataggaaattcttctttttttttttaataacatttgagtcagagaagagaataagctaataaattcacaaatccaacccatgtaaataaccacattataggaaaagtaaacatctttatttttcgacttgctccagtttccttct

SEQ ID NO: 26232 - DNA, 2351 bp, Bovine  19866881591143
tgcaaaaagtattctatggaaatggtaatgaaatgaaagctgtgtagcagaaattgtatcagacagaaaagactttttaaaccaacactgtatcaagagataaagagggaattacatgataatcaaaagatcagtccaacaagaatatataactatatatgcacctaatataggaacaactaaatacataaagcaaatactaacaaagacaaagaaagaaacagtaatagagtaacaataatattgggggacattaataccccacttacatctgatgacacattgaaattataatgaaataatcatagttcaggcatataaaaatggagtcatttgttcattgaggatctgaaacatatccctgtgtcactaataacttaaattttctttgaaatgtatcaaaaccaaggacaccacctgatgtatttggaaccaccacaagtagcaactttattgtttcaaggttcccccttgtaactatgcaacaatttcagaccccacaaatccttgcttaacaagcacacttcttgccagctcaccgtggccttgcaatttctgtcttcttcaaagttttagccacattcatgagaaaaagaaggcccacacacacataaaaaatcagaaatgaaagggaagaagttacaactgacacttcagaaatacaaaggatcagattagtataaacattatataggaataaaatggacaaggtacaagaaatgaaccaattcctacaatcatgcaatctatcaaacctgaactgaaagaaatagaaaatatgaacagacttaatcaccagtaattatatcgaatcagtgattaaaaaatttttcaacaaacaaaagtccaggatcagaaggcttcacaggtgaattttaccaaacatttaagaagagttgatacctatctttctcatattatttcgaaaaactgaagaggaaggaacacgtatactcattctgtgaggccagcattacactactatgaaaatcagacaaataaaattagaggtcagtgtcactgatgatccgatgcaaaaaacctgaacaaaatattaacaaactgaatttaacaataactaaaagggagggactgggggcaggaggaaaaggggatgacagaggatgagatggctggatggcatcactgactcgatggacgtgaatttgagtgaactctgggagttggtgatggacagggaggcctggcgtgctgcgattcatggggtctcaaagagtcagacaagactgagcaactgaactgaaggataattttgcctttatccttttatttcacgttgttgatgctttcactacattgacatacttttttctcttggagtactactttatttccttttacttatgtaggcagtttgagtttttctttcttagtttgatttttcagagaatttgcaatcacacaactttaagttgcaatattaagttattttgcagcgtcttcctagactgtggagggaaagaaatcagaaacttaaactaccgttaacattaagaacaattcaagtacaatgcttattaagcatgttttcatctgtgttcttccatactctacctccatattctgtgctcctttctagaaccagtctcctactgcttctgtgtccaaatctttcacagttccttggtcaagaaggtcctttatgtcctctacctcttccttgaatggttttcttttctcaaccaggcttaactgaaagttggctcccactaagggatcgagtctcgtctttagctctttccaatgaggttagactgactttactatagtccaggcagttctgtcatgtgaggctgctgtccttgtgcaaaaggctctgctcctgtgagactcaaaccattccactaacaccctttatccccctgtcaccacctcttagtgaataatgcagcatccaattcagtttcctctctattccaagatctgcctcagctttagtgtcttcattgcacttgtcccttttacctcaaatgaccttttctactctcatgatcacactcagaaatgttctacttctaaaaaacataaattcagacattccaccctgatcccaatctcctttaaatgacctggaacacctggaaacaatcagtgtacaaacctttctttgccttttcctcatctacaaataattactattaagtgccaggcactgaactgttagccctccacatgctttacttcctttcttcccttctaggcttagactccatgggttgtcacctcaagcattcatttgctagcatccactgaattcacctggaaaaaccccaatcctatgtgatttcaattgcactcttttgctgtcccagtaactagcacatggaatg

SEQ ID NO: 26233 - DNA, 924 bp, Bovine  19866881831673
atttggatgtattttgaagaacgatgcaactggattggagaccaaggggaagggagtttcaataagaagaggccagtaacaaatgttaagaatcccccaaatagggagagtcaagactgagaaaagggccttgtattagacaatggtcaattttatttttaaatagaaagaagaataccagtactgactggggagagatacaggtagaacgttggggaagaagctagacagagtggtgggagggcagccgcaggtgacaaggaagatcaagcagcaggcccgaggtgtccccggtgaaggttttggcctcgctgtggccatgaagttataggttggaatacaggggaaaattcacttcttatcttctaaaatctttaaagaatatctattagttctgcctccccacctgatagaggatagcttggaactcaaaaaaaaaaaaaaaaagtgacaagggcagaaactgtacttttaaaaaaaggtgaccatgtttatttaagtgtaaatcaaataacaagatttattcatggttatctttgggaacattgatctctgtccttctctatctcttggaaatgaatgttccaaattaattaaactctcaagagagtagaggatttaggcagaaggctgataattagattaatagctcctgagatattgtgatccatttttcacaaaagaaaatgaaataagttgcttttacatcagaaactctgttagtttgatcatttcatagggattgatgttttccttttggtttcatcaatcatcagcagattcatcaatgcatttcaatgcaattaggtgaattgctttgattggcagaagcatatacaagagcaggaaagttagcagttctgtaaatagagtcgtttagcttcctcttggagaataagctatgctgagaaaaggaaattgaaa

SEQ ID NO: 26234 - DNA, 1201 bp, Bovine  19866882094128
ctgaagggaggaaggcttatgctttcactaggggagaaaaatgtgcttcattggacattaacaaaaggacagtagccttataaagctattatcaaaaagtgtagagaaggtccacatagagatcatttctttcctcaggcaggacagagcagatcatctctctgtttagcattcaccagtgagctgtgccgagttgtagctctaatggcagatccgtgagcctccagggtggtgtaggaagcccagaggctagttactgggtgacctgacctgatacaggtattaaactgtgaatatttgtctcaaagaggcagacacttcaattccaaatgaattgtgaagcattttaaacatacagaaaacgacaataaattaaaattcaagattggtatcactaatgagtacccaagggatacctatctgtatccgttgaagtaaaatgcaaatgctctggagatcaagctcttcacaattgttaaaataatacttaattgatttgacccacattgctgagtgatttttgcacatctagacaagtttgtcctgtctcagctatgccaggggttcccatatatttctacaatataatgaaaaacatggaagcttcgcaaacatgaaagagcaggaaatcttgagcgaggtacaggcttggttgtcatcttatagaaacaactggtaaaaaataaagttcattactttggttaattaaagacagatatttccagtgaataagaagaatgtttcttaaaagtattgtcagtaaaagatttatattgaaatttaggttggctattgaaatattaccaagtaaaacaatttcttaagcttttgttttggttacaatagcctctaaacctttatttttacttatgttgtgacatggacccatgtgaagatttataagttttattattagctaccacaaagttgtacaggttggagaagggcaggtgtgccagagtaccgtggctgccagccacagaaactggttgtggctaatgtgggctaaaggaattcattaataggaagtggtttagaatggaaggaaaatccagatattagacttagaaatgatgatagagtatcatggaacagggaatcaactgctaaaggaatcatggtgtaagaatcatgattttctgactttttaaagactttatccacccctcacccccattttcaggcttttctggccccacag

SEQ ID NO: 26235 - DNA, 1009 bp, Bovine  19866880381446
ggaccagggacagttccatctgagttgtcagcatgtgtttgggctggagagtagtatatgcttctagatagcaattcagtgtaagtcaagtatccgttaagtggggccaaaggaagcaaggccatttgaagaaagcgtcacagactgctctgaggagtcggaatgtttttctgcaagtggtgatggccaagagtgggggcactgaaggactttgacagaaatcagattcatatgtttctgagaatactagaacagctatggatagatggcaccgagggaaaactgaagccagcccatctaggaaacaactccactgatcagagaggatgggccgagtggagcagcgcagggccaaggtcatggacactgagagattctgagtatattgggggaggaggagataacatgtggagaatggttctgggaaaagaaggagaagaaagggatctaacgtctgaatctagcctgggagactggttggaggatgctgtgctacccaagatgggagaagaggaggaatgggagagctaagaagcttaccagttcaattctgtactctctgccctttgttttctgtctccctcctgatacctcattacccccactggcttttctgtcccccccccagattatgccagatgatccctgatgttaatgatttgaccagcatctgcaggagcactcggagcaagttgggttttagacaactgtgggttatttaagcttcagattttccttcctcgcttttatttaaaggacagaatgttatcaccagttatcagatgcgcatatacttgaagtttcaaattttgaagtgctgacaaaagcttctccttgtttcagggtgaggagaggtcttcagaagtcttggcctaagtggtcacaggggcaccgggaacccaggactgcttggctggtttcagagcagctggggctagcgggaaggcacacactcctatttgctcagttacaatcagcaacgacttctttgtgcaaaatggtaatgagg

SEQ ID NO: 26236 - DNA, 1068 bp, Bovine  19866880420691
tccagcctgcccagcgtgcccggccgcgggcagtcctggaacctcaccatgggctgcgtctctgaggacacatgcaatgtgagtgccaagaggaaggggtgggtcctttttccaggatcttccctgcatctctgggagtcagcatgcccttctactggtcagggtagcaccaggaggtggggcgtctgcccatagttccaaggctgaagacagagcagggttcgcttccatttcttttctggcaagctgatcttgccctctggtagtccccatacctgccctctcagttgtggtctgagacagacaccctggcctgggcagagggctgcccaagactttctgcaggagttgtttggtggacagagacacccagggtcatgaagaaagcaccagccctagaattggaatagcctgggtgtgagcttgggctgctctgtttactgccttggtgactcaggcagttgggttctcctgagcctcagtttcctcatctgaaaaatgggaatgctaggtactttcctatctgtttgtgaggaggtgatgtatctgcagtaggtgcccagtgaagagccactgtagggatgtttacggtggggagatgccagccccaggcctgagccagtccctgtcccgattctcctgcagcctgagccctgtctcaatggtgggacttgcctcgtcacctggaatgacttccactgcacctgccctgccaacttcactgggcccacgtgtgcccagcagctgtggtgtcctggccagccctgtctcccgcctgccacctgtgaggaggtccctgatggctttgtctgtgagtgcctgccctgggcagcccacatgctggacacccaagctggcttagatccgtcacctgcctcagggctcagggacagtagacaggatggttgcagcctggaggaggagagcacttgctaggttttcaagggcgaataagaccttgggcagagggagagacatatcagcaaaggggcaaagcacgtgcaaaggcctgtgaggtttataagaacttgggactttctgggggagccatggggagccagcaggaga

SEQ ID NO: 26237 - DNA, 2184 bp, Bovine  19866880421456
tcacacttgtgcaaatttgttgacatgtatacacgttacacccacacacaacagacagtccttggagcctgctgctttgcccagggtacaggaattcaacaaaatctatcatcaaacagaagtgatgcgatgctgagggagatactgagactcccaaagaataaataagtcaggacatcgatttgaatattaccgaggggaagaccaaaaacatttaaaggggaataaagagattagtgatcagccaatggctcaaatgtggtctcccgtagcacacacacaacttgtatcgattgcgacgaggtttctggaaacaaaagcaatttaccagaagaatagtacacgagtcagagatgtttatgtgaagagagcctcatctgaaatctgtccggggctctgctctcaccatccagttactcagcgagggcgggagtagcttacataagcaaactggcctccgatggggcgagcacaggaagatttgatttcaccgtttctgtgagcgagcaggatcagaagctattctgagcggcctcaaaggaaaagcgccagaaatcataaataaagaagaagtcaagcgtgtccagtggccatatcaaatgtgacattccggcagaatgtgtgaacatggtgtctttcaagctgctgattctttaaaaaaaaaaaaagaaaataccttaattcccagtgacaatagcattcgctgcagttaaaacctaacagaaggcaaagcaatgtggggcataaagaaaaaagtaacgcttggaggaatgcaacattcagcctttcatttattttcgataccttctctctgcctgtccttctggtcccactgttctcaaggtcagtcgccctgcttcatttttccccgtactttttttattgctccctgaccatacattattatatgtttatttgcttatggcctgtgatggctaatttcatgtgtcagtgtgactgggtcaggggtgcccaggtatttggtcacatgttttcctggatgtgcctgcaacagtgtttttggaggagatgaacatttgaatcaatggactttaagtaaagcaggttgttctccctaatgtgggtggccctcatccagtcaatgaagagccgagtagaagaacagacggaggaagagggaaatctgcctccctgtttgagtgaggactttggctttttctgccctcaggctggaatctacaccgtatggtctactgaatttcaggcctttgggctcaggctggaattatatcacaggctttcctgggtctccaggttgacaaatgcagacttgaggggtttttaacctctataattgtatgagccagttccgtacagtaaatcacttgctataaatacagatagagatgatagagacagaggtatagatgtatatgtatatatatccccgttggttctgtttctctggtgaaccctaatacatggcccatctccccttggagtgtaagttatctcacttccaggtgatgactccagcctcctaattcatctctctggttctcttttagcctcctcctcaattcattttccaccaactggaaggttattctcctgctttaagtcaccaaggtttcctctggggtccagagggccaaagagtagacagcaggccaggctccctgttctggaggcctgacatctggcagccacagatggacacgctttctgaccggctctctgaattcaagtgacttgacttttctcaggtgccctcatgtctcagggatgcttacccctctgatcactcccttatctacctgtctaccaaactgggcctctctgctccttgcctccctccaagaaggtaggagtcacacgagtccagctcaggctcctcaacgggtcagccttgaccctaaagcctggtaacaaactcaagcatgtactcagctcactcgctggcacaccgaaagtgctcaaaggtgggtagcgcttatttgctgctactgctgctgctaagtcgctctagtcgtgtccgactctgtgcgaccccataggcggcagcccaccaggcccccgccgtccctgggattctccaggcaagaatgcccggagtgggttgccacttcctcctccaatgaatgaaagtgaaaagtgaaagtgaagttgctcagtcgtgtccgactcctagtgaccccatggactgcagcctaccaggctcct

SEQ ID NO: 26238 - DNA, 807 bp, Bovine  19866880433157
aaccgatcatggtggttttgagtgggtgactttgagatgccgattgaggagtgaaggagtgtgtatgtgggaggcctgttcagtgccgtatgggttctgtagctgagaatggggcagggttgttccccagaggaaaatctggtgctattaccagtggaagggagaatggatggatgctaggcagccaaaataaatgttcactgcagtcatcagaaaaatgttttattaaaatatacttttcaaaaaagcagtgagatataatatagtttagaattacaaccaaaatgatgaagtttcagtgctgaaaaaaatgtgtatcttcagctttctcaaaaactgtcatataagtcttatttccccaggaatctacatgactgagttcttacacatttaatttttggttacagttttaatcacttattctttgagctcttactttaggttcagcgctgtgctagactctagaaagtggaatatgagctctgtaagacaggaactggacctcatgttttaactgcttaggaaactttatttaacctttaggaaattatattctagccttggaacttattttggtgttatttcacaacacattttgcatttccttctttatgttacattgataacatgcaatctccctaaaggcttttattagaaaaataaatcttcaggaaagctatcactgtaagcttgctttgcccagcaggaaactttaagaaattgcttgatttaagacttttttttttaacctttagtgtttcttaggcattagaattttatgttatcacaaagcctattgaagacaaa

SEQ ID NO: 26239 - DNA, 2313 bp, Bovine  19866880476903
tctaagcatcattatgtgccacccccctcaacaaacccaccattactccaccttacattactgaacctccactgtgtgctgggggtacaagaaggagtaagacaaaatcttcttttcaagaagctcacagtctggctaggtacatgaagtctgcactgtttcaggctctaaattgtcaaatgttatctctgcttgaaaatggatcagtctctttttcagagtctcactgaaaaagtaaatgaccctaaagtgagatgatctgacttaagacattggtgacagtaaccatgcctctttgccactgcttctgcaaagacacagtatttcaacactgccaccgtggattcagcttacttgctgaattaatatgctgcctggtgcattttcttagctagaactgaatatttacttgggtgtggtgatttccacagagggtgagcccctccagatcctaatggcctggcgttggctagcactcggatgctgcgtagagtctttgtctcacattcacacgttcatggtgtggtgtttgtgtcaggttcttcctctcatgctctaagatgaagctgtggataattttttttttaaaactaagcatctatattgtgcaacactgaaacatttaccaccagtctttctaatgcatactatggggaaaatggtataattcattcatttgttcagtcattcattcaacaaacatttaatgagcacctactaaatattagactatgtttaggacaccaaggattaccaaacgtggtcccatccagcaggaacaaagtaagaaaggagccaggattattaaatgagatcaagcgaaagcctggaattcctcctggatagtctaagatacactagctgtgttttatttttcaagtattttagaacatatggggatttcattttgatcatattcagtgatgctctttgaaatcatacaagtaaagcttgatcattgtgtttaagaggatttcctgccagttctcatcttctctcacttaaggactgacttttcacttgagcagtctacttctagaacaacgactcttagttcagtgagtattcactgtggtgtgactcaaggtgccaggactcccaaagtctcttcctgagcaacaaccatgtctctgggaggtggacagtggatatgtggtgccaatatcaaacaagggtcatctccccccaacaggcaaacattgttttgatgaaataggtaaaaagattcttagttctattttctcttatgcctgttagaaagtaatgcattttggaattttaaatccttggtactaccactcctacttgtctggaagtgcagtaacatgaataaataaatattaaataaatacaaatgaaggaaacaaatgtgatttcttacaaatcctttatgccattatttgagataaaaactgaacttttatggttacttcaaaagacagaaataaatgggccagaatcttgggttttgcctggtttcagatagcctgacacctactggaataagtatggccattagtgttctagaacgggacagtctcatttcctcctcttccttctttaccttcttgttatccagaaaaggtcattctcagttaaaatccactattagcaaaaagctacattatcactatttttctcaatagtcttacagagtaggtattatctccatactgtttatactgttcatggggttctcaaggcaagaatactgaagtggtttgccattcccttctccagtggaccacattccgtcagacctctccaccatgacccgtccgtcttgggtggccccacacggcatggcttagtttcactgagttagataaggctgtggtccgtgtgatcagattggctagttttctgtgattatctccattttaaagatgagacaattgagactcaggtcatcttctggcagatgccacagccaggattaaaacctaggtgactctaacgaccatagctttccatcatactcaggagcctcctgagccacttggagccacagagctacagggctggtcctggagccctggtgttggaagcctctccccttttcctactgcattcccaggacatgatctggactttggataaacacaaaaacgataaaaacataaccacttaccagtccctccctaggccaccacagactcctgtgtcaatgcatctatttagctcaggcctatagactttggctataattccctacctacttacctggaacaaactggaaaataagaaaatcttttaccaacttttcctatagaacattcataggtacccatccatacttcacagacaaatgta

SEQ ID NO: 26240 - DNA, 937 bp, Bovine  19866880497125
tcgaggggttctctcagtctgatgaaaaagctagaggttccaggcacatttctggactttgcaaataactaaggatcggggaagaggccaggaaggaaatagacatccaggagacatggtcagacacatgccagaggacacaggagaaaggagtccagcagaaagagataaggagaaagagagacaggcagatggaaagagaacaggacgagagacaagggcatagaggcatagccaggctaggaatggacagttggataggatgacagagtaaagagcctggagttgtcaagcaaattggaattgaggtgaggctggagaccagagattgagatcttgacgtgtcttggcagaaccagtgaagagcatccgagtggacatttactcttcttcactggtgtttgctttttggggggagtttttgttgtttgttttgttttggcttctcagcattcatttgctatacttgaggtgggacttgtcttttgggattgcatcttcccctttatatcccttcttccctcccagtcagtccatgtggttctaatagaggcaactccaccttgaggccagaggaaggaacatgtgacctagacctaagccaatcagcacattctattcctgtggccacagtgattggttgaaggatggctaagcaggcccaatgagagccaatccagtacttgggcctgaggacttgacagaggtctttgaacctttctgctggtctctaatttaacaggatgcagggtttggggctgctgccaccatctcactgccatgcagagcttgaaaccaaagccaacagagcagaaggcagcatgacagagcaaaatgagtcccagcgacattgtttgagccccaaatccagccaagatgaagctagccctagctcctggccttttttagtttcataagccaataaatttcctttttg

SEQ ID NO: 26241 - DNA, 1843 bp, Bovine  19866880519059
aattctccccctgctgccctcctgtctttgtggttaaaaaagtctgatgccgggcagaaccctgagttacttttttatgccctcagcgccttctttcacttatccagtgtactatgaggcatgtggattccaagccctgtccaagtccccagggtcacaaaggcatgagatgtgtgtcctgccttcttggcactctttgtctgggagacacagtgaacaagccatatgcaaagagaaaagctagtggatataggtgttctgactggagagaagtcctgagaatgtctggggagaccaggggtgccttctcagtgacttttctgctgaatcttgaaagataagttgtacatcaggtggagccagaggaggagggcatcccaggtaaagagaatgacatagcaaagaggaggagagtcccaactcttcagagaagcaggggctagtgtggggcagggagaggccaggaggtagctggggagggccaggagtcatactgcagaggtagttggtgaccaagccttggggcagcttgaatggtatctcttgggtgtcaggagccagtgcgggcttatattcgagggaatggcccctggaggatccactctgagctgctgcaggaaggggaggaagcaggtgagacaactaatggcactgccagcattctggcaagagctcatggatgtgaaggtgaggggatgatgggaaagaggtccaggagaccagacagacagacaccgcagtccactggatgccctccctgggagctgttgtcttcaccgtggaatggcacaaggctggctgctggctgcatttctctcctccagccagcatgctctaaagggaggtttgaggtgcagcctgcagtgaaagctgcgtgtgttaggatgaacgggatcactggaaaggctctgtggagagacagagtggccagctgggcagagacaaggtacctccagcctcactgtcctgctttttctgcgggactgtcttccatccgccttcctttcccccctcactctggggcctgtaaccagggtacccatggcttactctcaccccatgccccatcccatagcgaggaaggttagagctccttctcgctgggttgccagctcttcagcatcccagggcatttctgccaaggatgatgtacaatattatgctaaaccagctttatgggcagcctcttaaaatgcaagcctctgcccgtgatggatggagaacatccagttgtttagccaaccacttacagtttgttgcaaacccgtaagaaccacacaggggtgtcttgttaggcttgttacgccaaggaccccataaataaatagcagagtgtgtcttggtacatcagggctggagtatggaaatagaggcactgcataaataatacatacttacaaaataaatacatcagtacgttagcgtgaacagccataaccaaaccaccctgcgtaacaaccaggagaagctccggggcccgccatgtgattggctgccatccatcagtgtgcatcagcacttgaaatgaccaccaaagggaggaggtcctcctgcgtgctgacctcgaggtcttggagttgaggcaggtggtgagattgcaggtgggcgccctgacgcgcagctctgccgccaaggtgtgcagcctaccacggccgtgtgttcctgcagctggcttagggtctgccgccagcagaaggctgctgagcaccgaggagcgggatgtgaggggctgtacctccaggaagacagtcggcttgcgggggaatcggattttctcattatgcacattcactcaggcttaggagttggtgggtcgacttttcaagggactctcaccagagcc

SEQ ID NO: 26242 - DNA, 1656 bp, Bovine  19866880539438
cctttgcgccctcggctggagtggtcttgatgctcccggtgcagtacctcgaaagccgagaaatcttttagagggtttttgtcttgggccttttacccacttggctgagcagaaagtgcaagtatcgagaaagcatggcagagccgacaccacacaggctgtaggctggcatggctgagggagaggatctggggcgatggttgagcgaggccgagcggcgggggtcccaagagaaaggactggcggtggcccggggccaccgagtttggcctggcttgcggccaggtcatgtaaagttgtgctgtgggcggcaggctcgggaaacttgggcccaggagcctcttgagcaaaagcgggttgtagtgtcctgcccgatcctcctgttccaccaggtctcgggttccccccctggttcttcttccgagttccgggtgacagcggggcgccgagatgagagctgcgaccctccaaagccggcgccccaggatgagactgagaaggcctggctttgcgctggggttggggtggagggcttgtttcgaatttccggcgtctttgaaccctgtgttgttctgggagaggctctgccccctcccgcgtccctcctagctcaggacagctgcagcggttctgaggcccgtcaacatctgcccgaagtctgcacggctgggaaggtttatgactccctgggcttctgaacttgatagagtttatttgcaattactttctttctttcgtttggggcagaatcggattcagagactttgttttcttcctccttttccccttagtctaatgcgcaagtggaaacaaaacaaaaccaaacccctgaactgtgcggagagggctgtggtggggaagaagtcaggattattttcatctttaaaaatctgagctggcatgggcagggggtggagaatgataggtgggtgggggtcccctgttcgctccaacgaagttgtttgttgggtgatcatggggcatatgtcttggtgtgtggagctgggaggaaaatacagcccccagtctggtaaatggtaaggtggctgcagcgaggtctgcaaggcagatttaagatttgttgaaagctctgtaagagatgtggctttccaaaacttgcatccctcggtcacccccaaccctgaacagactaccctgagtccagatccggttccccaaaacaaagcgggtctatttatcaagtgcggtcggcctccagtagaaagcagcgggcgggctgggccacagggctcctgatgggtggggagcgggaactatgttttccctgggcagacaggtttgcaatggaaaggtagacggtacagcgatttatttgtgctttttgctgctcctccaccttccctgaggaggccgcgccactcagagcaagatgtggctggaggctgagtttcagagaagctggcacctctacaagtctgccccacgcatgccttctcctccttttctctttggtccctttctctttttttctccttttgggtctctaggcccccgtttctctctctgcgtgtgtctccaggtttctaagttcctgtctctttctccattccggtgttcctgtctctggccttggcccgggctttctaagctggtggaacccgagcaaggcgcgctgcccgtggctgtgcggattgc

SEQ ID NO: 26243 - DNA, 888 bp, Bovine  19866880546180
tttttttttttttcagaaacaaggggttaattttataaaaagctttcgatttttcacataactagatttctagtataaagttattatttgtggtgaattatattttatactttctatatgttatattttccaatttgctaacttcttgtttaagatagctgtatacaggcttgcaagtaagtctaaaactaaaatttttctttttaacttttattagaagagttaaattggctttataataactctcccagaacagttatttatggggctttttatatttctctgttttggaaccaaatgctcttgcatgaccacaaaatgactgataatggctcataaaactgagagctgttcatctgcataactcaaggctgtttatcatctccttataaactcgaatgcctaataaatgctttctgataataatacatttaagaatgtggctcgtgtatattaagagtaaaacttctagtccacttccagcttagccatggcagctaatttgaccactaacccgttgtagctgcttcctctagagcttgtggacgagtggataggatcaagaattcacattgagatgaagagtgatgaggagactgttggtatacttctgggatttggtgactttgtcaatatggtattggaagatgtcactgaatttgaaatcataccagaaggaagaagaattactaaattagatccaatttttctaaagggaaataatataccaatgctggttcctggaggacaaggacctgaaatatgaatgacttccttgacttatgctagatgctgttctgtcttgtaatgacaacaaaagtttttttttagtcttttaatgtttgtattctgtgaagtcaagtttcccattaaagggaaatgctttga

SEQ ID NO: 26244 - DNA, 1801 bp, Bovine  19866880575223
catcttttttttttttttctttactggtacagtcttaagtacttactagcacagtatagtgtctcccaaacttcaaaacaaaacatccttaaacacatcccttttatcccatttcttttcttccttttagaataaaattcctcaagagagttacttctgtttactgtctaattcctctcctctcattctctcctctgtcttgtgttgtgatttagcccctacctccactgaaatagcttctgtttggtcaccagtgacctcatgtcaaataaaatgagttgcgaaactcctagaacagtttggcataagatgtatgtatatgtttttgataaattattaatatctataatggtaagtcaaagattaatgtttaaaattttaaattaaatactttttaaaaataaggagataaatattgtgttgaatgtgattacttttgattaagggtaagggatatcatgagacgggctgctatttgtcagtagtataagcctttaacactttttgttttcgtttttcaggctataaacacattactttggcttaaaaacttttaaacagacagttgattcttaactgagttctaagttttactaatggatggtggatatctctttagggaagggagaaggtcttcttttacctcataggggatcagcaacatcctgatctgttttgtgttgtttctctggggataagtaactgagtagacatcccttttatccaagctgcttctgctgctgctgctaagtcgcttcagtcatgtccgactctgtgcgaccccatagacggcagcccaccaggctcctccgtccctgggagtttccaggcaagagtactggagtggttcgccaatgccttctccgagcctttggacctcttcaattttagagtttaaaagctttctaattgttgccttttacttactcaatactgactttttattatctttttgatgaaggaaaatgcaaagaatactgtagcctgaaatttttgatgaccctctcttgacagatccagatgtggcctgccataccttgacaaaccacatttttctcaattttgtttcatacagatgtaggcttgatgcttctcagagccatcaagcatctgaaagataaaagctgttgaacatcccagagggccatgtttcataaaactgactgtgtgtcaatagagacaaacccagccatgtttagttcagagtcaggtaatattcatttcaggctttctctgtcaataatgttgtgatattctgtgtaagaaaaatgttaactttttgttctttttgtgcagtgtgtattgattgttttcctttataaatgataaatagggaagatttaactacatcttgttctctaatgtaaatgcttcagtgagatttcttctagcacaaaggccccatttttcttccagattttcatatctgagtttaactcaagattgttttttggtaactcttgtggatagcaagtaagtctaaaataagacctttatagaaataatatcatctaattgcaacagaagtcctagaagagcagtattatccccattttacagaatgatctgtccactcagagagatgggttctcttgcccaaggttatgccctagtcatagaagaaaaggacatgctggtgggtcattatgtgctgtgtctggggaagggaggctttggcttcagaaaagggagaaacaatcaggaattacacagatcaatcttggccccttcagagtgcttgctgtggggaccaggttatatttattgggtgtcacctctcaaacaaacatcagaatccttg

SEQ ID NO: 26245 - DNA, 1401 bp, Bovine  19866880591494
caagagtactggagtggggtgccatcaccttgttttgacaggttcattttcctgtatatcaggttgatcctgataagttttaaaaagaaacggttttatttaaaactttttactgaagtttaacatacatatagacaaaagtacacacatcactcatgtcctgcttaataaattcttggtcatgtacctggcattcagatcaaaacccagcacattaccagcatcactcaagccctctcttatgctcctcaaggcttgatttttaagctacatgagggcagggctaaaattacctttattctagagctaatttagactactccaccagggcatggcctctggggtttctaatgattgcctgagtgatcaacaagctctccttactttgactggctagagcctgaataactcctactctgtggaagctcccctctacacatgggcagatctgtctacagcagatgagccaagaggactcagtttagatttttttgctgagtagctcccttgtatctggtactccgacccacaaatttaaaccacctccccctcaaactcagatgtctaaccccttgattcaacaagactgttgtgcttcactggggagtcccctctagcaacagagtctagaaaatgcttcaaggcagaaagccacgaggaccagagtcttcatctcaattgcttcctttctctcagggattatattcctgcactgcctgttgtccaatatgtgaaaacagttgttttcatatttgcccagagttttatttgtaaatggagggaggagaaattcagttccaattattccatcgtggctagaagcagaacaaaggcctcttttaataaaatttccagcatggatgccatgttttgcaagatttcatctaccaaaataacccaatccatatgtcccttccatccttccatctatctattcagtggctgctacatccctcagaaacaaagatgaataaaacttgattcctgccctcaaagaactcacaattaaaagggaaagccagaaatgtatattgctggctggtaagtgtaattttataagtaatacaggggcttctgagaacaaagagaaaggtacagtcaaatctacttagagaggtcagagaaggtttttacagtcttacatttagcctaagtcttataaaatgaatagagattgacagatggaacagaacattcgggacaaaagaaactgtatgcaaagtataaagtaatgaaacaacatgtaaaattgggagacttattaattccaaacacctataacatagagtttgaagcagggagaggaaagagctaaagttatggggaaaaaaatgggaggatcctatcaaaaaggggggccttgcataccacgcgaccattattcacatccatattcatcat

SEQ ID NO: 26246 - DNA, 899 bp, Bovine  19866880625679
ggcatggtgggcagtgtcgctggcagaggtgggacaaaggggttgagtgatggctgtggaaatggggtgggggtccccaatggggggaaaactaaaattggggagtaaatggggtggctacatttggggctgtagggcctggtggaagggagctgcccgaccaggttgtgttaagtgggtccagcagggccagcagggcatcactgctgctgccggcagcccctggggccaggctgagtggctggagcagttcggtggggtcttggggtgcagcactggagaggagcccagggaatggggttgagctgagggcagcccgcctttcccgctcagccggcagttgttccaagaagtcgccaagggcgatgccgggggcctggagcttggctgggcgggcagtaggaggcgggggcacgatgcccagctctggggtctttctgccctggggccgggggatagtgatgctgcccagggtgggtgtgggcacctcctccttgtcgctggggttcaggaggccattctggttctggggcctgcagggtgaggccagggagttcccgagcagggctgagggcttctcggggcaggcggcgggcggcttgctggggatggccatgtcatcctggcctaggctccagagcctgctgtgcgggtgggcgagcttcaaggcccctggtgtcccacggctcctgtcacttctgcccaggtccagcctctgccggagagagcgagggaggcaatgactgcagctgaccggggacagatgggctctccccaccccctcctgtgcgccagggggacactggggctgtggtcctgggagtgtggccagctaggtctctggggctcagggaagttgggggctcggcccagatcagcagtagaaagcaagcccaggt

SEQ ID NO: 26247 - DNA, 741 bp, Bovine  19866880679284
gtattttccacgtaaattcccttttttcccttagtccttcagaagcagtcctaaataaggaccaaatccagttctcaaattgaattgtacatttgggttattctggatacctgttaatgtatttctaaatatgtgataaaatatttccaaacagatcaggacaagttcatatttcccccaaagggcagccaggccaagagccaagttagtagctaacgcctgattttctttgagggcatgactgaactaaaaagttaaatgtgcacagttaaggtttggattttgtatccaactttgtaaaattcattgtattatctggcatttctagatgtctctgggattcattcttccactcagagtgggcatgcttagattctctgtgagacatactagttctaggctctttatctgtactatatgtggggttctgaataacccccctccatgctacatcatgtattccatctaggatttttagcacagtcttaatatgcctttttacagggtgcatggtccatgttggtgaaagggtagcagtctagacacagctgtgaaacgacaaatggatgactagagctgggtattgggaataaattgatgctaaagtgaaattattgatatccttggtgtcagtgatagaaatcaacaaagtgtgttatagtagaaacagaaaactccagctttggttctggtttccccatttactgttttgaggttgctgaacacctctaagccagtttt

SEQ ID NO: 26248 - DNA, 1470 bp, Bovine  19866880746374
aaaaaaaagcccagatctctcccctgtcaatttcttcctattatcccagaaaatgtgtcttggcaggacttgatggcctggagagtggtgggtgatatttcttttttcccccagcaccctcagttgtggccttagtagacacttcagtgttggtgtgaagggatagggaacttccccacccttgttccagtcctgtcctatccacttccattcacagcatccactgttttagcaccacctggtcttgtgacctaagaagagtcagtttgtggactagggaatttttcagatcttggcttcatctttacttctttcctgatcagatctacctggtcatgactaccctgacttgtagagtgggctatgtccctaaatgatgtgtataaagcttttctagctcttctgggctagaaataactaatcctgtttgcttatctggagcccttgaagcctagatgagagtggcagcctaagaaggtttgaaatactggaccagagccagagcctctttgcctgcacactccactctgcatgttccagccatcggaacaaactgcattattttgtttcaaactgtgctcaagggaagccaagaccttgtaactggaaacttaccaaacagagaattctaagactaaatttagtgttccatttaaaaaaaaaaaataagttgaacattttgtttgttcatcttttatatgttaaaagagagattaacctagttcacactaacaacctaagaagagtattcaaagaagtgagaagaaaactaatcccttttggtgaagagggaaatccttaacaaaatgtaacgaagtagcatgaaatacagactctgcagccaaactttcaaatagcatagcctctctaatctccatcacataaaattttattgtggctcagagaatattaaaaactgttagaaataaatgaaaggaacttccattggcaggaaatagaaaagattggtatgttttatttatgtggtttttctctggtctttaaatgtaaatacacttagctgctttttgaactaggttcttcatttattatgtgcgagttccttttctcttgttcatgttagactataagaatgaagaacattgatgttatagaggatgtataagctatataatatatagagtaacaacagtttaatttgcagtactttaaatattgctgtgacttcaacccgtcatggtctccctactagttcttaccttcctctcctgcccttcttgcttcaacacattcaaacatgagcacatgttttggactagacagagggttcagattgttagtgattcccaaatgctgatccctgagttagttgtgttagaaatcactcagcttattaaaaatttaagttctcagctacaaaaaggaatgcatttggagtcagttctaatgaggtggatgaacctggagcctattatacagagtgaaataagttgaaaagaaagacaaata

SEQ ID NO: 26249 - DNA, 884 bp, Bovine  19866880784080
aataataaacagggatgatgaaaaataagattttatcacccaggtaactttgtgcttatgctgtttgataaggaagtttgcttttaccgaaccacattttatgagtcaagaaaacgacaccctaagcttaaaaaaccacccatctttgtagtcaacacctcaatccttctttgaaggtatttggagtactcatctacacagacaaggctttaatttcaacagtgtattctcaattctgaaagatcagacttctacatcttgaactgaattaaaggtacccctcctctcacagacttggtggcaaacacagacgtttgaagctccacttttatcctgctttaatgagttaggtgagtgttaaatttactgtgtaggtgctgtaaattccaagagtccctcctgcttaaatccagtcaatattagctcagcaactgggcagacttactgcacaaggatgatactaaagtaatagagtaagggggatatttatttgtatacagttgtaccccacctaattttacaaaggaactgaggcccctaaaacaaagaaaaaaaaattggtgctggaaaatacattaacatataaaatgtatttatttgtgaaaagagcatctggatatgcaggtcctgtgtggtttctaaaatcaagttacagggactttcctgtggcccaggggctaagactcagtagtcccagtgcagggtgcccgggttcaatctctggtcagggaactagatcccacgtgtcactgtatgcttcaactaaagatcccacatgccacagttaagacctgacacagccaaataaacaaacattcttaaaatgaaataaaataaagttacaaaattagctctgagcttcccagctgccaaggcaagaaggg

SEQ ID NO: 26250 - DNA, 1208 bp, Bovine  19866880793771
ttttggagggcaagtttttaaaaatataaatgcctttttttgaaactcttagcagtgttttgagatttgatacatgtatttaatgtaattataatgaacatgtttgacccctttggcttcctggcagagaatttgagcagtaggatataagatgaatagagtgacctttgaaatttctttcccatttgactgttgttttctctctgtattttttaagtccattgtgttggttcatttaattgatttggagcaagcagtactttcttgttcaaaatactcaattctggtttagtgttctgtttatatgtattgttccgtgaagttctaaggtttgggataatttgtaggcactttaaaatattatcctaagtttatgaaccaaggcaagcaggttgtttagactttgtaggctaaataattgggtctggttttattttcacttgtgacttgctggacaagatacttaatccctttgtgcttgtttctcctccagaaacctgactctttatctacctcccaggagaattgagatggtttatataaaacaagtttaaacctttcaggaaggttagcactatgtaagtaggggtaatagctattatttctttgactctttatttcgtgttagcctggtcaagtaataatttggcattaggtgggttaatttgtagtgagaaacttggatagagatgaaacttctgtgaatattagagatatctgcaaattgaagtttgttcatcctttgctctactgtctactaatttttcctggctcatttgtgcagctaagtattggtgctgatttgaattcttgagtctgagcagaaacttgtgagagacattctgagttctaagtatgaatttccagggacaggatgtttttttatgtctcagagaattcgatttctaaatcagaaataatacatgtaatacatttccctatggttttttgtagaaaattgattaatttgggggtgatttgaacaggaaaatggagctattgcttctagtggcattaagcctcctttttcagatttattgcatactttttcctttttaaatttttagttagcaaataattaccgaatctatttgacatttatgctctgtttgtgagggaatacatttttaaatgcttcttaaatgttttatttggtttatcagttgtaaaaaacctccagattttggtcctgattgacattgcaaaaa

SEQ ID NO: 26251 - DNA, 2430 bp, Bovine  19866880815107
tgggtgtgggggcagaggggggatggtgggtggtgacataatatctgaggtgggaccccaggctcagtattgtgcttggcacctgtctgctggctgggaggaaagctcatcacagggtctctgaggcaaagctttctttggagtgatctacaaggaattctacaagaaatctacaagaatttcttctcaagaaattctagttaccacggacaacactaagataagtttaataacaatggatgctaacactgagctggggcagaaaactgagggccgattaggcaaggttatctggctactgtgactaacttaagtcacgcagcctcctttcttccccctggttttctgtgttgtttgtaaggactcacggtggggatgccccggtttaggttctgagggtaccaagccactagagggcaggtctctgccttcaaagacccctagtctggggggaaacaagtgccacccaaggtggcaagaaccacactggccgtgcgcacaaggcaggtggcagcagctcattgtgtagcaggatggggaaggcaacagaggatgaaatatttggcccatgaaggaagagtaggcgcttgtgttggggacagcgcggataaggacattccagggacaggaagcagctcataaacaagcgcagaagctgtaaagccatggcatgttctgtgagtaacaacagtcagcgcatcataggaggactggcgagtggaaccgagagccagatggggtcaaccacagagggccagcatgagcagtccataccccagaggatttttaaccaagtgcatcacataatcagatttgtggtggtttggaaagatattgggttggcccaaaagttcattcgggtttttctgcaacaatcccaatagatttgaatggaaagagaaattggattcagggcatatacaaaagagtcagacatactatataattattgggattaacttttagcacaatttttggtaaccgcctgtattagaaaccttgagctttaattaaaaacttcaaaatttgacctagaaagcattctctgttgtaggataataggaaattttcacccactcatttgttccatactgctttccaaaattactctgtatcctatttcaatggtcctttagagtattaaaactccctttatcaatcaatcaacgagtccttattgcttgtctgtgatttgccaagtgccatgtttggccattcgagaagaacaaaagaaacctttcattgaggaattgcttactctcggccaactgcagccacttccaagggacccgccttggcagcagtatgcttggcccatgagcaggagcgcacacttaccacaccgcgctggggctcctgtttatgcgcctgcctccccagcaagagcaggatctcccccagggcagggcctgtgtcctgcttcccactggatcccagtacccagtgcggcgcccggcacacagaaagcctttggtacgtactcactgacgaacccatttaaggaaaggcaacatctgaattctttagtggcttttgaagccctagcacctggcttctaacacaatcaaaaactgcttacaacaagagtgaggggacgaaaaccctcagtgatgcattttccatcctcccaggagccttgtgctgtgaaacgtatttcagagcaggaagtgggaccgatttttgggtttctcatgaaaagttcccaactggtctgaccctagaaagagacccctggaaatcctctgaggaggcaatatcctttcaacacgccttggcctgcttcctgaggcaaggaagcttctcctgcctctcatcaccctcactgagggcggactttggacagtctcttcctgctagtctccacctggcaccagaatggcctggctttacaaacaaaagtatcttcagctgggcacacacagtgccctgggccgaatgacagcactgtgggtggcagggcaggaggagggcggccagcagccaaggaggagcccaggtagctctgcgggggtggcacttacccggactgtggagagccactggtggtatagcttatcactccctggggaaagaggaggcagagaagctggtatttagagaagtcatacatctaccctcaggagttcctcaagttgctttcagcatgcaggacttggaaagctcaaaatctggagaaccacacggaggctcccacgccccctccctgaaggagctgctgccacaggtttctttctcagagtgctatctgatcctatcagtgtcctgagtacaaacccaaatcctccttcttgcctactggatagaggtcagaccccctaacaaccctgcttctcttcctccgtcttgtcttggcactgcccaccatctgcctctccgtgctgtactaccattctgtacaacctcaggctccctgatcatgcatcctccaag

SEQ ID NO: 26252 - DNA, 1933 bp, Bovine  19866880847410
ataaggcattgttcagtcttgggtaggtttgtctctaaatctgtgctttttttctttactgttgctgttgttcagtcactaagttgtgtccaactctttgtgaccccataaactgcaggcacaccagggcttctttgtccatcactatctccctgaatttcctcaaattacattgtttttttttttctttatacaccactaaaaatagtggataaaaatctatatttggacagaacaatgcaggatcaaagtatggccaaagaaaaagtgtttttgttaaaaactgttattctatttactgagtaatccttatgtgccagacaataggtactttacctattttctctctaatcttctcaacaaccctgagaaaggcattatcatctccattttatagatgggaaaactgaggctcaggaaggttaaacagtcttccaaaggtcacccagctagaaagggccaagcttccaaaccaagtttcctgaaccccaaactctggctctaaccaccatagcaatttgcctcttaacaaacttgaaaaacaaaataagcaagaaagccagttggaattggtcaacaagtgtatctcttgcccagtggactgaggagtgctgagctaatgaagccagggtagggtttgttctgaagagtgacacggcagagctattctcgcaaacaaaatacaaggccctcagctgagcatttcagtcaaaagcttaactgctgatgaattacatgcatttttcttttaggagaggatgggaagtaaaaagaaaatagaaatgaggagcttaaagaaggccagaaagcccattagcacttttgacagatccaaagataactctgaagccaccaaaacgtggcctcaagagtctgccaagaagcttcacgctgggtagaaatatgttacacagcttgccgtccaaatagggagacacagcgtcagagacaaatcctgtgccttattttggtgggagaaaaaaaaaatcacaaggatacttttgtggatggggaagggaacatttctgaaataaaaacaccacttggttgaggcataacccccaacccaatcaggttctgaaggattcaggtgcttgttccaaaaactctacacaggtatgttaaaaatatgtaacatttaaccaaattctctctaaactgtcatgtactttttttggtatttctcatcccatctgtgctgattaccaagatatttgtgtctaaacagaagctgtctttcttatctgcttcctccctgcctctttccttctgggacaccacccgcctcagcagtggggagtgggtggggattggccacagccctgggaacctcgctcagccctgggagcacctgtggggcagagcagaccttgggaacacctggagggagccctttgcggttcccaccaagcctcatctcagaagaaaacccctcagagagaggggcctccttccccctgcctttaagcatctggtggcttaagctacagcaaccctcaatttctcaaacctgtcatgcttttcacacccctaggcctttacttccattgcttcctccacctagaatgcttttcccttccttaaggacacccatttacttttcaagacccagctcaaatgtcacctcctcctgaaaggtttcctcaactcctcatttttcaagctgccctttgtgcttccatgacaatctgtctctatcatataatcactcagttacaagtatgtttttgccaccagactgacatccctttgggtgaaatgacatatcccataatctagcagtttgatgaaagagggaatcaatgagtggagaaagccactgactgaagactacggctcattagctcaggtgtgagcagggaggtgtaagagaaacacgagggcttggatggtgtgttaggaagaatgcagcactgacttcagaaaacctcgg

SEQ ID NO: 26253 - DNA, 1662 bp, Bovine  19866880859371
caaagaccagaggaaacactggcataaactattctggcagttcacatttctgtattttcaagagtttccataaagatctcttttgtaccggattagcttttccttttgatgcttttgaactgtggtgttggagaagactcttgagacttccttggattgcaaggagatccaaccagtccttactaaaggaaatcaaccctgaatattcattggaagaactgatgctgaagctgaaaatccaatactttggccacctgaatcaaagaattgactcatttgaaaagactctgatgctgggaaagattgaaggcaggaggagaaggggatgacagagaatgagatggttggatggcatcaccaactcaatggacatgagtttgagtaaactctgggagttggtgatggacagggaggcctggcatgctgcagtctatggggttgtaaagagttggatacaactgagcaattgaagtgaactgaattataaaattaatttatattttctctaacagcatggggcttcccaggtggcacagtggtaaaggatctgcctaccaatgcaggagacatgggagacatgggtttgatccctgggcggggaagatcccctggagaaggaaacaacaacccattccagtattcttgcctggaaaactccatggacagaggagcctggtgggctacagtccatggagtcagacatgactgagcacacacacacactaacagcatatgagtgtgctcatttccccgtacccacttcatcattgaatatcaccagtgttttagtttagtaagtctgttgggcaaaaagtggtttcctcacatgttttaattttcattgttactaatgagctcaagttttcttcatctacttactaaccatttgtaatatttctttctgaaatacttcgcctcatatctagcccactttactattggataactgttattttcttatttgtttgtgggaactctttatatattgtagatgttactcttttccacaatataaattacagatacttattcccagtttgtcttttaaatttctttgattctttttactgcataaaatgttttatttttggggaattctttataactcctgggtttcctgtctttcttgcataagccttttatggagtaaagatattaaccctaaaaaaaaaaaaaaaaaaagatattaaccctttcagtaagaatgggttttgctctctgaacattgtctgatgttgcacctgatttgagatcctaaaactgccattaaaggaagttaccttcccctagcctggaacaggggagggggcatcccagagggtagttagagaggcagtgagggttcccagtgatctttgttgaacaaaacaagctgaactcctgggatcaggtccttttggaagggcatggcttcttaagaggccccaagggggagcctgggcggagccactctgatcctcagctgcctgggagcctgtaggaggagactgcggctgccactatcaggcctccttcccattgtgactctgccagcccacattcatagccactcacaatcatcctactccaaaacaccaaacacagctgacatacacacccatggacatacagaaacacaatttaaaaaaatgcacatgtgcatacccacataggtatctgtgc

SEQ ID NO: 26254 - DNA, 967 bp, Bovine  19866880912068
gataaaatgacttaaaaaataaataggggtgtaataaatacaaaaatcaagctggtaattataaaaaataaagcacgagtctgggacttccctggtggttcagcggttaagactccacccttctactgcagggaacaggggttcgatcccaggttggggaataaagttcccacatgctgcatagactaaaataaagaacttcttaaaataaataaataaaaacaaataaataaaacacaggtctaatggtgtcagccctgcctaaaaccttcagtggctcactatctcttccaggataaagtctaagcccctcgacctgaaatttgcagctccttgtggttttgcctcagtcttcctttccagactcttctccaatggacaacccccacaccctacctccctgaccctacaactaatctcctaaccacatcagactccactttgcagcttcctattcaaattacaaaaggagggcctttatccaccactgctccccttgcccagaatcccttctctctttctcacctggcaaaggcctcctgagcctttgagatcccgctgaacgtccactttccatattccccaaagagagagcagtttgttctctcccctgtgcccccatgatccaacgaccacaccttgtcgtcatccttgacctgagcccccagcccctccactgcactctgcatccttaggggccaagacttagtgcccacacccccctccccaggagtctggcagacagtctgggcttcacatgtgtttgctgttgaagaacagtgtctctctgatcatttaatatttggttatagagcgcatactctgacacaaaagctgtcatcgaagatgtataaattaaaacacgaaacttctcatcaggatgtctcccaggaatggctgggtcagagcggttggctagctgggaaggtgtttaataagaaccccagttaattaacaagagaaacat

SEQ ID NO: 26255 - DNA, 927 bp, Bovine  19866880922848
ccctagtatcaattgaaaaatgactaatattaagaatatttagcacctggattaacactgctaccagaaagctcgccactaggtgtcagccaaggaaaaggggaggaaggaccgcacttcagaaatggtttactttttcatccaattatcactgtcaatatcaactattcaaacaataaaatattaggccattagaattatctattaatgggatgtttttaagaatatatctaaaattttgacatttcccctttgcaattcataaatagttcataaatggtgttagtttaacctgtatttttcaagaaacatttgcatagattggagacgctgactcctaagaggacaccagatcactattcttctgaaatggcctcaaattgtacataacacagatcatatgctaatcatcactggggcgagcggtcagaggaaagagcatggttgtgagaatcagacagatggaaagtccgaatcctggctctgccacttcttaaaaaaagtgacacaacttttcctagcctcaatttctcatcaacaaaatggggccacgtgacttcttccatatgaggactgtaaaaatcaaacaagggaatatatatataaagagtgtggcataaaataaatcctttgtattattttctttttcttaagactttgagtcttaatgacttatttaacaaaactgtgtgtcaactcccaaactgctaaggacactgtaactaggtactgttgtcatttctttccgtccacagagaattattaggcactgtctatgtactaggctctgtgccagggatacatggctgcccacgacatactaccgaagcttccatttcttggtgaaaggacagcataaggttgaatgtgactgtctatttctgagaatatacccattccccacagaaaatcagtgtggatgcatgt

SEQ ID NO: 26256 - DNA, 773 bp, Bovine  19866880956618
caggaccttccctggggctccagacggagctggagcctcttggcctggcactggaggacttgtgttcaattttcctaaatactcttctgggtcccctggcttctctcccctctctggccctggtgcattttaaccctttcctcaggcctggggtgcagctgaccctggggagaccagtggggagaccaggggtcccgggatacttgtctgtgtatgtgggggtctctctctgcctgccttgctaagtagatagatcttcatctaatttatttgtatggagcctgggctccaggaggtagcccctcagatggtgacaaattgatcatagcaggcttgggacacagtcttctgaggtctgtccttgaagttttgattgacaggttttctgtgtgtgctttataaatgttgaaaatctctgcagtcgaaagtcttaactgctttaaggcaaactttaaaaactggagctccctagttcctctggagtgtcaaaattcggcttgcctttctgaggggaacatgtcgtcttaggagctcagtgtgtgcgcaggcgaaccttggaggcacatttaaaagccgtggcgttaatggatgaagaatttcattgaaagggatgcagagcctgccgaaagcgcctgttccccacgctgcagcttaccgagtgaactttggacgtcttcttttagcaaacaaaacctggaaggaaacaaaaacgacccacattctttttcttttttggtctaaaaaatgaaaaacaaaacccacctctgggtgtg

SEQ ID NO: 26257 - DNA, 2433 bp, Bovine  19866881094629
tgtctttcctgggtggctcgccggccctttctccctttctttgggctgacagatgaaggcaggcaccacacgaacgtgcctgttttcaagtgcactgcatgaggaatattcactttatttctggttggtggagcatttccccctcagaggacacagtttactttgtgtaatgttaacatcttgctgtaacactgtctctttaagagagctacattctcaaaaaaaaaagagagagagaactatatcctctgcttctcagattttgagattcctgaccagagagtctctagtttagagccatcaagtggtgagatctctcagggaccaaaagaaggatcttttaaaggattaaaaccgagactgggtgggagatgatcccttgggcacaaagttagtagaggatggagagccttgtggataccttgcccatcaagaagagaatcatttaagtcagaccaaacaattctggtccgctcttctagccgcaaaccagactccttcgttgggatatgtctcagaggatgtggtgtcttttgcatttggaattagcttgatgtaatgaattctgggttttacatatttattaccattgtccgtgctccttctggtcttgtaaccacttctacccagcctgcctccctccagggagaaccagaggcagtcatggaggcagctgggggaggggaagctctccctggcttacagttgagcaggtggggttcaaatcatgactccctcagccacttatttactccaatgaagatttactgtagccagggccaggccctgtgctgatggacaggatgtggagatgaatgaaaaagtctctctcttgagatcttgcctgctatggtggcccacctgtaaccatcagcaagaccctgcttggtaactggggggctctgctggagatgccaggaaggcagctcaggtcacagggaagacagcactcaagctgggccttaaacagggaggaataggcatttgccaagctctgtgatggaaagtagcttacttcaccccctcttgagtctcagtttcttcatctgtgagatggggattataatatgtacatgaagcatcacagctccagacatatcagcacccctttcagagtgcttcgtactgttattgagagcaggtcttgggctcccctgcttccatttttaattccaattattttaaaactattgattttataggacatggagtatattgatattttcatgattttgttgttgttgttcagatcaaggaaatgatagaaaacattctaagggatctcagaagaaaacttagagaaacaaacatggtttttataaggagcatgtggggtcagaaaatgtccacaggacagctacaagcagaaaagcaatttggggaccacaggcatcggtctgagagcagccttgggtcctgcaatgtctttgcttgtctctggtcaagaactgtgaccttggctcataattaaaaagcaaggggggcaggcgataaatatggagactgttctagttaggatggtagcaacgataatattggggaggaaaaaaacctgcaagttgactaaaacggccttagacctggttaaacccctggcttggcctctcttagctgtagatggtagaactttaacttgggtaaaaaaaaggcatgagggagaatttcttggctcacatagctgagaaccctgaggcatctcttgctacagccatggctggattcaggagctcaaatgatgtctcatctctcactgatcactgttaggcttggcttggcttgcctgttagtttttatttcaaacattctcttgctttagaggcaagagattctattctcttgcagtagcagcataaggcctgtgtggtctttagagcttaaagtgagtctccacccatggcgtctgtgcatcagctctcaggggggaccacttggtgcagtttggctacatctgggccaccctgaacccatcactgttaccagacaatggggccttcagttggccagacataggtcacatgcccaccccgtggttggatgggggttggcaagatcagcttcgttgagaagaaggattttcacttcccattcgcaatggggtggaaaagacaaacatgaaaacaagtggtcagtggtgggttggagggtgccaagaagatgaaaggactacagaagattggtaaggggaggggagaagctgggtatcagggaaggcttcacctcagtgctcacggcagagctgaggctataaaggcaaggagggtgtccccagcaaactgcccctcagggtgtgttggctcctatcagacatggctctgggtatagaaggtcagagggggctgtgtggtctcacgggggagatatggagccgagctgcttccttccctgcctcccaggagtctctgaggcatgtccccgagatggagagcatcccaa

SEQ ID NO: 26258 - DNA, 1865 bp, Bovine  19866881113672
cacacatacacacgtgtagagagctccatcttgctagcatgagctagagaaatcctccatgctcgtgggttgaagtaagtcccttgagacaaggagctacaagcagccttcagccaatgtccagcaaacagccagggccctctgtcatgggctgcaaagaaacacattctgccaacaacctgaatgagttcggagaaggacttccccccacttgagcctccagatgagaatgcagcccagtggccaccttctctgctgccttcggaggtttggagcagaggacccagctaaggcacgccggactcctgacccacagaaactgcaagataatgaatatgtgcagttttaggccgtgtgtgtgggcatttgttatacagggagagaacaccagtatggttgtgtgtatctgagtggtgcaagctgtgggccactccgggcgtttgtgagagtgggtgtggattcagatggcatgtgttggaatgtgtgtttgtggtatttgagtgtgcatctaggtgtgtgaatgtttgggtctgtgtgtgggagtggcaaagggatgtgtgtgtgtgctagtgtatgtatgtgtctatgagtgagcaagtgtgtgcatgcacacatatgtgtgctgtgcctcctccccccagactctttttattacttcctccctgggtttgatgttgggggtgaataaaatttaaagagctctaaaattttttagaagagccctaaagggagtggagctttccgtgcatgagtcattaccaggaacacctgtgaactgttgattttaattgggccacagctgtcaggttgcaaggggagggataggtcccttggatggtctgtccccagcccccatctcctgtcagatctttgggtagatacagaagcaggagggcaagagggcccctggaacccttgtctggccagactctcagtcctccaggaggcagtggataagggctcagtgctttggggacgtgggctgagccttggtctcgctggtgcctcacccaggtctcagggctcctatccgtctgtctcctgtttccctgtgccaggaaccaccacctgagacctgggcacccccgccccttcgcatccacacacccgctcacgtagacaaatgctcatctgcgaatgcaagccacacttgcagcgacagtggcgagggctggtagagcccccaccatgtgccaggccctctgctacacctctacatacgttagatccttgaaacaaactgggagggggggtactcaccatcccatttcacccaccaggagactaaggcacagcgggttcacgagtaatgcatggtcaccactgcactgacccgcacacaagcacacacacacacacacacacgtccacacgcctgcccccctccaatttcatcccacatgctcatacttactgatactcacacacatttgatgaagacatccaaatacttgcctgccttctcagctgacagtcacacgcacacacatgtgatcacacatgcaaatgcggaccctcacgcacacaggtgtgttcaccacctacatgtcttctccctcggatgcagatataccacctccccccttaaacagccactcacactgacctcaagcatgcttgaacgtgatctcagcctcagaactcctcccaggctcctccaattgttaacgcaggccagtcacgttccttgcagagctgaacccccaacccactccctgagggcagggctgggatggcttctttgtgggcctgcggtggggctggtgaactcatgggttctcacaactgcccgtctgcagggactggaggaggcggtgcctctcagggcccctgagacgggcaaacctgcccacttcaccaccaac

SEQ ID NO: 26259 - DNA, 712 bp, Bovine  19866881311778
ccaacaggagccttgtaatcagtggatgccagaccggcgtccaagtaaagtaaagatcctttggctggaatgaaatgatccctttaaaacgtgttcaccaggctcccctcattcgttacctctggagaccaagtccttgctgattttttccccttctttatctcaagtatatttaaatgtcaattaaatttgaaatatctacatttgtcagcatttcattgtgggccagcgtgacgtgctgctgatttgtccacgcgatgtgacacatgaaaaaaactctcgagatgcagatcttcctcattaaaaactaagcccgtgcgatcccggcacggcagagagccacagagcacgtccccgcttcctgacgccgtgtctctgacatggtatttaaaaaggaacagccggcgcctgtcaccactgtcacacgcgccgtgctagccagcgacacgttacaccaaacattagagagggttcggggagtcatctgcatgggaactccgcgctgagatgaggtgggcagaggtgggagcagccgtgggagacgctgggctctgaatgtgatggacagcgggcctttctttctcgccaagaccccggcagccctcactgggtagccaagtttgccacgacctgccttttcacagacagctctttgtgtgtaataaaatccaggcaagtggtgggtggcagactgcagggtagtagctgaatt

SEQ ID NO: 26260 - DNA, 739 bp, Bovine  19866881387028
cctcggcaagtgtgacgttgcctgcagtggcccctcgtctgcagaacaggagcagcccgcactgggctgctcggtgcttcttactggcaacaaaattcatagataggctctctccagtcctcctctggcattgtacagagatggtggtgccaaatttaaagccagttagtgttgactggcccaaacgagcgttcttctaaggacacctagaaattcttagcctaactgtcatcaccggctctagtaggaaaaggaagtgtctttttatacaatccctcatcttagccttcagaggccgtaggtagtaaaaaaaaccaccgtgtctctgcagtctggccgtggaccaggagactgtgcacttcaccgtcaatacccccggctccggcccttgagcttgtctgtgtggtgagtgcagtggccacacggactgtgtgagggtccagaccgagccttgcacagggctgcccaggggagcagaaggaggactttaattggtgccctaatgctgttagtatttgcttctccaccctcccacttagagagtaaaacaagcatcctataattcagctgttaaaaagaacaaaataggcatgtgtgccctaaacacaaagtctgagtgaaacctccttgttctaacaaactggtttccaggttccaggagaaggcaagcgggacttactattagggcctctttgttccgggtcatgcccagacagtgtctcgctgagccctcagggca

SEQ ID NO: 26261 - DNA, 903 bp, Bovine  19866881449478
agtattacttaaacggtttttggaaaattgtcatttagtaatatgggctagtggtccttcagtgagactttggagaactaatattggtcagattggccttcagaggtttggcgggtaaccctgcatccagagacctttcccaagacccagtccattctcacccaggtccagcaccaatctcatcagcagtctgtctccctggaggagaaggtgcatactcttctacactacaaccttcttcttctacactacaactctgtgtagtgtaaacttacaaccctattttacagatgagaaaaggaaagcttggagaaatgaattgacttgcctgaagcctcataatcaaaaagtagcttaactggacttgtcatattggtccatgaactctaaggccaggcttctcttgctccctggcccctggctctcccacctgctggcgccagacctaattagagccttgctggcccccaagatgggctgggaggcagatgtgtcattagagcatgagatgctgggagctcacaccatgtgtcattatgtttaattacatgagttgaggcttctgcgtgggctggtggagccagagcgtctctgtgcccaggtgaccagggaatttctgtagccaagtactggggcaggggctgctagaggtccttactacagccctgggagcaaggcccgtgtttcctgcgtctgctggagaaagccttctttctgaagctacggggagggtcttggtgggaaggtgctgtccttcatgcctctctggatgtttttatccagactcccacctgggcaggcaatggagtagaaggagagagctacacaaagggaacagtccccaggtcccctcatcctgtccccagacagatacaggttcacacgcacatacacacacacaca

SEQ ID NO: 26262 - DNA, 1400 bp, Bovine  19866881456127
tggtactggctggaaaacacctgtgacacacaaccactctgtggagcaagagagagctgtggaaaagaatgaagatctctatacactgtgatggactgatctccagaaaagattgtgtgcaaaaaaaagtaggatgcaaaaaaaatgtatgtagaagcttacttttttaagtaacaaagagaggttatgggggagggaagtataagggtagaaggaatggggatgaaagtctgattctttaatgacaagtatatcaagaatcttaaagatgtgcatatcctttaacctggcactgaaattaccgggaacttagtttaaggaaaaactcaaatgccaatgaatttctctttgcaaagctgttcatatcaaaccactactaccaaaaatttaaatttccctccaggggggcacagttaagtaaattgtggcaaatctaggcaaaggaattaatagccatttacaaagacactatacactatctcacgacctgaggaaaatctctatgatgaagaccatacgcaaaagaagaaacaaatgtacatacattcaattatgtaaaaaggcataaaaacatttgcaaagaaatagaccaatggtgaatgctggttgccttagggtggtgggaatgttaagagacactttcccctcatgtttgcttgtcttttctaaattttctacaatgaaaatacattatgttcacaatcagaaaaaacattacacactgttattttttggatgttgtttcaacctggacctttgccctggtgtatgtttttatgactgctcctgtcattacaccaagaagagaaacatggtaagtgactaggtagccccgagtagcattaggcgtttacctacgtaggtcggatttttatctagcacaaaggaccctataagtaggaacattcaaaggcaattagttggtaacaatattataaatagaaaaggagccaaataaatgtttcctggatatcattaatttagttgcaaaatagattcagagttactctgataaccccacataaagaaggcactcattataaagacagccatgtgttaaacaagaaaatgttagatgcagagatggctctgctgtacacaactaagatattcccacggagacagcagttctcaaaatatcaccctcaaaaacaaaagcttcgtctaggaaaacaatcccagcacaaaactaattgatttggtcctgcctacttgtctcagaatctggcacactcttcctcctccctccctgctctggcttggtctgaatactatgacccagtgcaggccacttcttggaatgttcttatttataaagtgagcataataatttactttacaaaacactactgtataggagtacagagaagactggacaagaggcacggggacacacttag

SEQ ID NO: 26263 - DNA, 1170 bp, Bovine  19866881489225
cactgggagatgtggacttctcacaaggctggaaatgatctgctgcttagtttttcgaggggtgatcctgggcaagttaaacagaagttttcttaatggcccccatcctttccagtttaactcaaactcaataatgtgataatagatgtaagacacgtagcagagctacacatgcactcacgaacggttcctgttactataatcctgtcctttgcgcgaagaagattcctttccgggaggtgggttctgggccttccagggcagggcagcaggtccgaggggaggggcgagtgtccgttaatccctccctggccaggtcgtcccaggcagcctgagaggtcaggaaggatttgtaaagataagcacaggcccctcgtcaccctggcaacaggccacgcccctccagccagaccaggaaggccccgcctctgacccgccatcctcacctctcctccgctcagccctgggcgagcctggcctcctgggctggctccctgaaggcagagagcctaaggtcagtgctcgttcccaagcctcagtgtgcaaagaactccccagggagcatgctgcagtgaagattcttgggccccggaacccaacagttctgcatctctgggtctggagtggggccctagcatctgtattcttaatacaggccctggggtgatgctggaaccccccagggtggaggctctggagcagtgagacctgggtttggattccaggccctcttgggaaactgtgaagtcgcttatctctgagcgtcactttcctcaactgtgaaaaaggaatggtagcactgtctaccccctaaggtaaatgtgaaaacagagattacacaagagagatggctgtccctctggtgcagaccgccgctccactgcatgcctcctgggacagagggctccctccctctctgcctgcaggaaaactccttcctcagtggggccgggctctgtctcctggggccacctgctccttcggggacaaagcactttccctgtccccccaggcgctgtctctccagtctgctctgaaatagagggttctgaatcggggggcaaagctccagattgggggtgggatcccttaggatggtcatgctttcctagtggctcagcggtaaagaatcctcctgccaatgtagggtattcgatccctgggtcggga

SEQ ID NO: 26264 - DNA, 1235 bp, Bovine  19866881596879
aaatcctgaggccattttcttcctgaggaaataaatacctaagtggtggtcgcttataaactagattctaacaggtaaacagcaaacaacaaaagaaaaacaggaatagcttttagcaaggaagaaaaattgcatggccaaatataatttttactcactatttaaacccattttcagtaaaatcttgctggatatttttaacagatcttaaatttttaaaagtttgggtcgactgtgacatttctgtatgtgtctgtctccattaacagctcccaactcaaagtactgactcaccctcaaatatttgttttaataaaatgttttaattgctaataacaactaaactttattaaaggcatagatttcaacaggcattcttctgaagcctttatgtgtattaaatttctggaaaaaatcattttaccaagaaaaactctcatttagatgtaaggaagtacatgatataagacaactgttaatatcattattccctttacacaaaggcctaggataattcagtaataacttgtctaagatttactctaagtctgactatgaatccagattctttcactactccatgccacgcctccaaagcatttgaacaaactttagccactgcaagcatggctatttccgaaatgcagtggaccatgaagcccctgaggacagggatacggctttattcatagctgaatccccagtatccagcatgaaaggatgaaaagaatgaacgaagagtaatagaaggaagagccccaggctttataccagttgcccacatgcaggcagacttccctggtggctcagtggtaaagaatccgcctgccaatgcaggagatgtgggtttgatccctgggtcaggaagatgccctgaagaaggaaatggcaacccactccagtattcttgcctggaaaatcccaaggacagaggagcctggcaggctacagtccatggggtctccagcatgacttagtaactacacaacaacaaccaacatgcaagcacccaagataggcagtgttcacagactacaagtgtcacaggagagggtacagtactggatggttctgataactgtgggaaaaattagtgcataaagaagaggtcttgtatatgggtttttaacctgggctctagagaccatagaggggttctgtgaaaacctttaaagtctatcaaactttataaggacatccaaaaacatttttttaagacaatttcggagctttca

SEQ ID NO: 26265 - DNA, 2829 bp, Bovine  19866881636890
tgtctggagaagggtgggcgggagctgggtctgcagaggcctctccctgcctcgggtacggcggacacacagacacacagacatccttccctgcggacactgatgagcctgaggagcgtccctgctcttctggaatgcctgtggcacctccccctgcccgcccgcattcctgctcagaatgcagggcctcctctccctggcacggttcctgggcactggctccccagcccaggggaaggagggggcgataactgccatcccttccaccctcacccacacacagatgctggggttcagcctcccactcccgggtggccaacacccctgggcaccctgcaggcccatctcctccccgccacgccccagagcctggggttccctgagtcctgccccagaggcagtggcctcgtgggtgcctggcacacagtgggcccacggcagcacgccctgctctgcagagcactctctgcactgtgcttctcctcagcagggcccctgagctcgggctctgaccccccggccttacagaggaagcccggaggggctctctcgtggggtgtgtcatcccccaggttcagtagggtcagcggaagcccagctcctccccacgctgagctcagctgacgggtgacagggaggtcagccctctgaggtaagggcccgggagagggaaccccgggctgtggggctgggctccttgccatcctccctttgggttgtgctgggcgtgggggaggccagtgcctggcattccagagtccgtgctgaaggaggaggcggccggccaggcggggagcacggctccccagcctcggtgcctgcccgccattctcagcccgtccgtggggacatgcaatggggctgcgggctctggggaccttcctgcgggtgttgtggctcctggcaggtaggcagggtggggccctcaggcaggcggaggtggagtgctggggctggccgtccccggaaggtggcggtggtttgtgggctgactggggccaggactcaaatcctgctggcttctccaagtttgggtcccccctggctgggttacgcaggcaggtctggcctcagtggttgtgtggaggttgtgactgagcaggggtggggctgtggcttctagatccattctggggccagagtacctgacctgggggctcctggaagggagggtgaccccactgccagagcgagggtcctagggcagagggatgggggtggcattagagccagggcctgctccagtgccacagatgcatacacccacctccgctccctattccatttcattgctctgttcacaagggccatgtcatgtcctttgctgggcaccaaggacgtacccaggcccctggagaagatctcaactgtgtaaacagatattttcaatccagggttctggggaactgtgcctgggagtaggcaaggaattgggagggacacagtagcttgcggttgagggccagggaaggcctcctagaggactggccatttgaatttgggctttgctggatgagtaggagtttgaaaggcagggttaggaaaatgaggcatgccgagcagagggagcagtatgagcgaaagcccagaggcaggacttccaggaaatgcttggaggaacaggcagctcgaggtctgtaggaaggcgggttgacatctgaatgcttgatagtgcccaggccatgagggatcaggagtgccggggggagtgatgggacattacgcagcagaggagctgggccaggtcatgcgttagatctctggctgctcgtagaggcggatgatggagggggttctgaagactggtgaactagaggacgctagactgtggcccagagagttcgtgagtccgggaaggcaaggtgggaggaaagcaggcactggcgagcgtgtaggggatggacctcacagggcccgaagactcaccagacgtgggaacaaagggagcatcctggattccagcctctggggacttctgaggacctcaaagaagtcctttgagaactgggaatgggttcagttgatggatactgagctccttgtcccaagaggcaggtaggctctgggtcaagactgtggttctggccttggtgctgagccttggcctggtctctcccgaaggcccaacgtgtcaggaagacatggacgaatgcctgtcggagccttgcctccatggtgggacctgtgaagacaccgtggcaggctacatctgtgggtgccccgaggcctggggtggattggattgttctgtgccactcaccggctgccagggccacacttgcccaccgactgccacctgcgtccctaccttcgagtcaggggttcacagttacacctgccgctgcccacctggtacccatggacctttctgtggccagaatactacattctccatggtggctgggaaccccttacgggcttcggtgccagctggcagctccctaggtcttgccctgaggtttcgtaccacgatacgtgtgggtgccttggccacgtgctctgacactcaaggcagcgtggagctggcgctggtggaggccaggcttcaggccacactctggagccacggcaagaatgtgctcgtcctgaggctgctggaaccacccctcaatgatggccactggcaccgagtggaggtgacgctccgcttgggggtcctggagttgcggctctggcatgaagactgtcccgcccacctctgtgtggcctccagtcccatggccacggctgccccggcccccacgcctgctgggtcccgcttacccagctgggcggcgtggcctttgcgggctgctcaggatgtgcaggtggatgggcatctcctgctgc

SEQ ID NO: 26266 - DNA, 833 bp, Bovine  19866881674894
taaatttttctgtgaacctaaaactcctctaaaatatgaagtttatttattaaaaaaaaaaaatccctacctaatattaagttcgttccacgtatcaggcaccatgctcagttcagttcagtctctcagtcgtgtctgactctttgtgaccacatgaatcacagcacgccaggcctccctgtccatcatcaactcccagagttcactcaaactcatgtccattgagtcggtgatgccatccagccagcttatcctctgtcgtccccttctcctcctgcccccaatccctcctagcatcagagtcttttccaatgagtcaactcttcgcatgaggaggccaaagtattatcgtttcagcttcagcatcagtccttccaatgaacacccaggactgatctcctttaggatggcaccatgctaaattatctcatctaatcctcacaacaatcctatgaggcagactacatttgttctccttttacagatgaggaaaccaaatcacagagcagttaattaacttgctcaaaattatatcaatagaaaagtagaacctaggtctatttgacttctgtgggcatttccatacttgatccatctcttaatgcccagtctctacttttggaattcaactgatttactgaaaagtaaagatcaggaaacatacattaaggttacagaagctaccacatacagcaccacttcttggaaacagagagaaaagaggcatgagttcctttgagcccacttgtcacagagaccctcctctaggacaaactgatctctccagcactagggcttgaatctaagctggcaagatgctttcctgcatcaag

SEQ ID NO: 26267 - DNA, 931 bp, Bovine  19866881787418
tgttggatgtttattctgcacaggatgcctgtgtcatagaagctcccagattttgagggactgcatactggatactagtccccacagggtagctcatttgatctttaccatgactctttaacgcaagtgcttctagaagccccatttaacagctgaggatactgactcttgggaagtgggaagggacttacccaaagtcactcagctccagtgtggcaggagtgcatgaatggaaggtttgtttcccactctgcctccctgccatccagctagggacaccagtttggaagcacagaggcttccacagggagctgacttctggattcagatgagttttcgcagagcagctcagctccttccttcatgtaggtggaagccttccctttgaatgaaccaattatgttcagaaagcaaaaaataatgtatgcatattagctaatgaggatgctgctcaggatatttttagctgagctgagagagacagagaagagaatgagaattggtagaagttgttttggaagaagaggcagcttggggatcagacagccctttagcacagtgctcagctcttaaactgcttttggctgggtgactgtggcaaatcacctgtcctctcttaaagtgtgtctgagtacccgcctttcaggggtgatgcaaagattgaagataatgggagtaaagcatgtggtcagtggtcaccaattgtacctatgataattcttcatttatcaaatacttaactattgttgagtcctcagtgtctatagatataataacttttttctcattatctccccatgaagcaagtgctaataatatctccattttccagatgagaagacaaagttaaggttaagcaatttgctctaggagggccaggattcaaccctaagcggcctgtgccctaaccaccacacaatattgcttctat

SEQ ID NO: 26268 - DNA, 1096 bp, Bovine  19866881916525
aacatctctttgtgaacttaagcctggattgaaggctatgtgaccctggacaaataacttaccctctctgagcctgtttcgtcctttatgaaagggctttgcttatccttacctcagttgttatgaggacagagatggaaaaatttattaacagtaatcataataatagcccttactctgtcaggcattctgaaagcacttgacacatattattcatttatcttcacaccctgtgaggtgaggctattcagtattatttttcctgttgaacagatgagggaactaaaatgacttgcccagagtccttgctcttaatcaccatactgtgctgtcactcagaacctggcttgcagtaagtgcttgttgataagtctggaacctgtcagctcaggtgtctgaagggcatacactcatgctcactgaggggcagtggcatgattatggctccctgcctgctcttctccaacacagggccttgtctaagggaagccatgcttgctgctggctagaagaactagcacctctgacccaaggccatctgggatcatcatgtcactggggaatctttaagtagtctatttctaaatttcaaagcaagcttgggctatatttacagcgtttaacatatgaaaaatcactgggaaagtgggcttttaagtggaacggttgtgtaatggaatatttcacgttctggttcagccataaagctcagggctgataaacaaagcatctgaagccaaatggctcctcatctgaccccaattaaaataaagatttcattccattctgtcctgacaaagaggaacatattgttgcctttaagggagtttggtttagttaatgaaagaattttatttcatttttccccccaaatacaatatctaattaaataagattcaatttgttaagacttctggtagagacatgttaactcttttaaagctgtgtgcctacatgcctcaagatgtggagggtacttacaaatcctacttcacactccattgtctaaagagataaacccaagtcactgtgaaggcaaacattatcttctccaacaattatctgtttacacatttattacagcaaccgtatgtag

SEQ ID NO: 26269 - DNA, 844 bp, Bovine  19866881925513
accctaagagctgtaatgtgggcctttggtaacacagaagccagtgtagcaaagctgtgggatgcagtaagtacatggaaagtatgatgctgaaacccagcaattatgtggaagactaattgcacattcacaaatacaacaaccaattatctaagttaactttaattagagctataatcacagattttaattatctgaagaaaatccatttaatacaaatagtctgccttaaatatttcccaaattaatttttttcatgttccttcccatttttggagagagtggtagaaaaagtgtctgagctttatattcagagaggcccaagttcaaatctgtttcatctcttaatagctgtataaccattaaaactctatcttacctctctgatttggcattttgttttctgtaaaatgggtttgatttacttactttgaagaatggctttagaaattagagatactgatatcaagtggcacataggggccgtttagtaaatggtggttgctcttattatggttattataaacatgggacatgggttttggtttccagaaggttttactcacatcaaacgtttttcttgtttctgctgccttgtgagctcagggaaaaactttataattcatcttctctttttacccatcagattgtttttattttgattttttttatttaacttgggttattgtatggttgttttcatttgcagctgtggcataagaatgaaaagaaaagaaacaaaagcagatggcagagaaaacgaaaggagtaagacatttccagcccttatgaatatttaaaaacatgtgctgcggttcctttctactttagagctggccattct

SEQ ID NO: 26270 - DNA, 770 bp, Bovine  19866880368668
ttctgatagatttttccaaatattaatctaacagcagcatatgttacttctaagtctaaattataaagctcctattttattgtttgcatttcaaaacttattttaaatgatgtggcagtgaaagtgtataaaatatacttactaaacattattttccacattcaaattagagcctcttgggctgatttttaagtgccatgtacattttaaaatcaaaatgtattgctgacgttcttttaacactccctccccgttcactcttcccaaatgccacagttccttactgctccgaaagtacttatctgtgcattcgtctggtctttcacaacagcacactccaactgtttgtacttcagatctctctctcaattaaagtaacaaatgttaattctttaaggtacttaaccatacggtaaacttgctgcactcttcctttcgttaactttaaatctcattatagcaatttcccctcaacctttcctcccccttctaaattcactacaccagcattgctgcgaagcaacatgcacatacaactcctttcttaagctcaaaataccagtttagcgccactaaaaaagaattaaaatgcctggttacctcgtttcagaacctcatgggagctttttatttgctttcctgttctacctggacagtctatttctcttcgtcagttggcgcggtcccttgctgcccccagcacgagtgcaactcactacaatgtggtttcttttacacaccatcattccagtatctcccctccatttcag

SEQ ID NO: 26271 - DNA, 2395 bp, Bovine  19866880473373
ccctgggatgggaagattccctggagaaggaaatggtaacccactccagtattcttgcctggaaaaatcccatggacaaagcagcctggcgggctacagtccatggggttgtaaagaatcggatgcaactgagcacttgtgagctcagttggcctgatattaggtacataattagtagaagttatgaactgaattttgtctcccccaaaatttctacgttgaagccctcaatgtgatgatatttagagctggtgcctttgggaggtaattagatttacataaggtcatgaggctgggttgctcaggacgggattagtgccctttgagaaagagacaccaaagagctctcattttctctgcctctttgtctctctcttcctccttcccaggagaggacatgtgaggacgcagcagtctgacagccacctgcaagccaggaagagtcctcaccagaacctgggcatgctggcatcctcatctcagacctcccagtctccaggactatgagaaaatagatgtctgttgtttgggccgcccagtatatggcatgttgttacggcagccccagctgactgacacggtagatgaaaaaaaagcaaacagaatcagtttccgaaaggaagtcttgaccctctgtgatcaaggaccatctcagttctgcgctctgaatgaattccgagtgacataaacagaactgccaagtgggccatgtttgtctacatttcctgtcctgtccacatatttgggtgactttttaccctctcagcacttctttagcccaggaacacccactgtgctgctcaccaaacctaccctctcctttttccttttggccatgttttgaggtttgcaagattttggttccctgaccagggattgaacccatgctccttgcagtgaaagcgtggagtctgaaccactgggtggctagggaagtccccaaacctaccccttgctgacaggaggagctcatagtctttctccatccagaatataactgctccccttgttgcctatctcccaaggtagcatcatacttttatttcccccaaaatgatagccaatggaataaagagggctattcattttttttcttttggcattattgaaatatattgccataattaaagttttttttttaatttaaaaattgtaagcagttaagtgtattagctgctgtatgccaatgtcttcaacagtgcaaatagcttatacttttgtttcttccaatagggatacacataaaggagcccaaaagtacaagatatcacaaaataaacatggccatcttcctggaatgcttctttcactcaaatatttgttggcagagagttacgtaatttaatgttcaaataacttaaaacagtgctttaggtaccttggtttttctcctagaaaatgggtaatgacagcattgtcttttccctaggacactggcttaaaggaattcagtttatgagcacagtaactgttccttgtggcaaagactctgtcatgagggccaaactctaaatgcattttaagttacagtgcaaggccttgggacttccctggtggtccagtggttaagactctggcttccaatgcagggggtgtgggttcaatccctggtcggggcgttagcatcctgcatgctgcagccaaaaatgaaagaacactggagtgggtagccattccccactccaggggatcttcccgacccagggatcgaacctgggtctcccgcattgcaggcagattctttacctgaagataatgtcatttaaatccaggttgattagttgcccagtgagctgcacagtttgggaaatttcctggagtctttgatttgtgttctgatgctgaagtctatagaatcccaccctcaactccatctacaggtcttgtatcatagtgatccagagaagaatgttccagactctgagaattgtattatcttatctcctggacactgtgtaagaaggctgtgacaattcctcatgtccattggtgacatgtgcttacagtacttggcatctttttgcctccaaaccttaatctgtgggataattgaagctatactttggaaatacctaagggagtaacattataatcgggagctagcctagttttttctgggtgtataccagctgttgaacaatattattttaaaaatctcttggtgcagcatgatcttactttttcttagcctcatttttgtcatctgtaaatagtaaaagaaaagctgactcttaacatttctcaatgagatcatgtttatgagaagactttgtaaactctagacctttatacaaatgtgggatagtatcattaccttaaaggaacatctcctagaaagaggccccctcccaccctgccccagggataactggtgcacgaaatccaatttcgtttc

SEQ ID NO: 26272 - DNA, 1926 bp, Bovine  19866880511313
acaaatcctgagtaatggtgctgaagcaccccaaaccatcttaataggtaccggttgtcacccagcttctcctcatgtctgcacagaccagctcccaaaggatcatgctcaaaacattgctcttggtctctctggaggggagcctttcaattttcatgtcctattattaacctcttcccaagctctgttttccaagtttaggccggctcatcagagttgaacatggactatttggatttgtgcccaagctgttctccgagcctgatagcacattcattactccctacccatggtttctgctaaatgacctcgttagtgctataattacatgatgttgctcttcagaaagctgggggtggggtgggagatgagttaacgaaggccaagtactgagatggagttcgttgtaaacatactgaatgagcctaccttccccaggcctgattacccatggggagttggaagggaagttttatggtctttttcctctcctttctttttcatttcccattaacggatgatgataacatatacaaatgtgttggtggtagttggtaaatacatgaatttgaaagctgggtggtgatatttttacaacttaatgtatatggaaccatacatttcctggaagtaaagaaatgaaagcaaatgtcttctgagcacctatttaggtttttgttcatcttcgcaacaaatttatgagctagttattatccttgatttactaatgaagaagcaggttcatagaggtgtattttccaagggcaaaaacaagtatatggctgagttaggagatgaacccaggtgtaccttactccaaatctcaatatcccatcctacctctcagttcattcattcactcagtcactcattcagtcatttgttcaacaaatgtactctgacctctatctgatgacaaaatctaatcacataatttcagagtttctatttactctatctaatttaattttacagattcctcagatgaccctaaactcagtggggtcttcttttgtaataattttctcagtcctctcaggcttccaccttgggggtcagatctcaaatctgagattcagaaccctaggtgtctgagtgtgtgctcaatcccgactctttgcgaccccaggctgtaacctgccaggcttttctgtccatggtattctccagacaagaatactagggtgggttgccatttcctactctcggagattttcctgacccagggatcaaaactgcatttcctgtactggcaagtgaattctttactactgagccaccagggaagcccccaggaccctggggtgtatgtttaaagaccatcctgtgcaaacgtctatttttttagttaaggaaactgaggttcagtggttttttgaagtggtaagcttttcattccagtatgttctagggatgtcaagcgtatatttgaatttacttggggtgctgagaagtgatgattgtgtgctgtaacacagcggtccccaacctttctggcaccagaaactggtttctaggaagacaatctttccgtgcatgggggtgggcaatgatttctgttttgcccgctgctaacttcctgccgtgtggcccagttcctaacaggccatggacccatagtggcccatggcccaggggttggggacctctgctgtaacaaatacaaaaaattccccctgctttctgggacagttcacagtgcgtgtgcctgacaagaggtacttgtctctctactgcacacatcagttgattcacaatgaactttttcagaagcttgttaactacaaaactttgtcgtcacacttttgtgacagagaatccgttttcccagactagatctcagaagcattcagagtcttctttgagatttcgttttgggtggtggtaaggtgaaccaggagagtcaaatacctttacttgtcccta
